United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 6

SEQ ID NO: 24569 - protein, 161 aa, A.fumigatus
  UNSURE (159),(160): Identity of amino acid sequences at the above locations are unknown.
LTHLQSDETKICVVMVGLPARGKSLIAGKGRYTLIRLNIHDRGLTILYLAMRYLAWVGIPAKVFNVGTYRRQGTPQPTATFFDPHNTEGERMRRAAAEAAMSDMLNWFKAGKGVVAILDATNSTKSRRQWIYETCRDADIETLFVESSPGAERQSVQKXXP

SEQ ID NO: 24570 - protein, 433 aa, A.fumigatus
  UNSURE (23),(36),(37): Identity of amino acid sequences at the above locations are unknown.
NSNEQLPSNPDASNSGGSLVPPXWVNTPAKPMVRSXXEVHLDDVVRHSLFDQYILFTGGFGFIGSHTTLELLKTNYNVIVIDNISNSFQIVFDRIKLLASQYHERQGTKMPSLHLHAHDYRDTAALKALLEQHQTQTRWGTTKSKISGVIHFAAYKAVEESIRNPLKYYANNVSGLIDFATTLGDYGIKTFIFSSSATVYGTLATSGLPLKEELCTHKEEIYTDHDGSERIVQPGCTGITNPYGRTKWICEAILADLAASDPEWTIVALRYFNPIGCDESGLLGEDPRQTPTNLLPVVVKVMTGEYRELQMFGTDWNTEDGTAVRDFIHVTDLARGHIAALSAANEGKLAENFRTFNMGTGRGHSVKEVVETMEEVSSKHIPRRAADRRAGDVGSCVAVATRSQQELNWKTEKSLKDACVSLCNFLGSRGLST

SEQ ID NO: 24571 - protein, 178 aa, A.fumigatus
  UNSURE (2),(18): Identity of amino acid sequences at the above locations are unknown.
RXVFHGATKPFSPSRIRXMETGGCPHAAFREDISANLLALQTLQKQFQTDLLLIESGGDNLAANYSRELADFIIYVIDVAGGDKVPRKGGPGITGSDLLVVNKIDLAEAVGADLKVMERDAAKMREGGPTVFAVVKQGKGVDHIVNLILSAWKASGGYEVSLERWKNGAPKNSGSVDE

SEQ ID NO: 24572 - protein, 67 aa, A.fumigatus
STPFPCLTTANTVGPPSLIFAASRSITFKSAPTASARSILFTTSRSEPVIPGPPLRGTLSPPATSIT

SEQ ID NO: 24573 - protein, 70 aa, A.fumigatus
RVLPTLHVCSVAYWLHRPHLCPSLAANLDSWALCLQLNLNLPRFELQTMGGIKSFKEPRTPFSYWKQIKV

SEQ ID NO: 24574 - protein, 311 aa, A.fumigatus
GTMVVAASHLALIDEEIHQLMHAARCGDIVQLRSLLYGVSPDIRDSTGRTAFSWAASYDLTQSPETYNNCNLVLQFLLDRGANPDLADYHGETPLHWAVKGGDYRMVDLLLQKNVESDLPDSRSRTPLSRAAERGYDRVVEVLLTKGKADADYKDARGRTPLSWAAENWHLETATILVNHGASVDIHDREGQLPLWWFISNTIKRTAMEQQYQPGKGDYLQKWLTLLGPKHGVEPMTKARRTFLSWACEKGDQELVKHFLQTAWADPNSIDRYRKTPLIYALEWNHYEIADMLISGVKTGTLFQRYSPSGP

SEQ ID NO: 24575 - protein, 386 aa, A.fumigatus
HRRENDDVEARQESNPSESSPAPSEPRRIFSPKSWTNDNAKVPFLGHSRVKKLREETVDLSAVLRGEETPRHIRRYYGQSSPAEKSANGDSPQQQRSNPDFPEENAEDHGLEDDQGSRIYLDSSPNRASDDDTFQIDPTTRHESEMQRADQMAEEIENEHIPATALADKRSVYEENSTPPAQNRQFGGDGQASTWFQKITSLTPGWLKAPVRKSFAPPSPGYGEGSEEEPDVRSANAQTLLDNQLYPEETDETSRQGLQSPEQNNTQPDSPTSSAARPVEDVRVETYEPHFPLAVSGYFTDNHYVLLRRLYRLAKRHPERFPYYPAPGRSDIIGDWIWTSDGEHGVRVTETQFAIIDRFVQELARGDLQAGGTAQIVFTTKARGSG

SEQ ID NO: 24576 - protein, 80 aa, A.fumigatus
LSEVDEGGCVSPRFDVLHKSLAEYKVLERGPKLKSGNASQPSITFFDPSSFSTGTGIVAVIQDTFKKRHQTPRCQRSTHL

SEQ ID NO: 24577 - protein, 103 aa, A.fumigatus
SSTIYYGVFTSWSCSANLIPLWRKPLVFQKLCCGRSVSWVNLYIIFKTNSLSSLDISSSEIWEKSFLLSGEIPCMIYVKTSNFSRGHISRYVKGKGPKNSHYL

SEQ ID NO: 24578 - protein, 121 aa, A.fumigatus
TTPCQVQPSNSSTQPVATFQMHSWIDIPLRDGKDADEWELTESKAIANIDQWYQEGRLLFPRDSLQEVRDQLRKPLKKGDSIYVKGFDGSMYEWPVKTGNIKTHWEADNNTGEEKQVDWML

SEQ ID NO: 24579 - protein, 74 aa, A.fumigatus
NSAQLKTRIITSLRRLPDRRYNNPIYARPTRIASYTVVDSVGLYSVSLPDEVAHSIKQPHKDPTPHNIYVAGFK

SEQ ID NO: 24580 - protein, 331 aa, A.fumigatus
YPTTGGSVRWHSGGDGSAGSATNNEGERISDLLRRRNCQLDKVRPCPSPLVFLLTRCSEEGARFPKSMCSSGVWAGAIPIEKAWDLRDIHDSNVTLKSELERHGFLGQLECSHTAYPLAAHFELHIEQGPILQETGRSIGVVQGAQGYRWLTFTVKGRDTHTGTTPLSARQDPLLAASRMIAASNDIARKHNALASTGIFEIPSNASTNTVASEVSFTLDIRQPQDGVVHTVQEECLQAFSAIAAQDGKGVTFDWTLDTDSPAVKFDQGCLESIQAAANHLVGPDQWMNISSGAGHDSVYTSHHCPTAMIFVPCHDRVSHHPTEYLCPEHW

SEQ ID NO: 24581 - protein, 114 aa, A.fumigatus
RLELIINRDPTDTGMARLTLDDNDASVRRWFAAEVDKLGCSLSIDQMGNMFARQQGKLQTSAPMVAMGSHLDTQPRGGRYDGILGVMAALEVLRTMKENGYQTYYDVGIVNWTK

SEQ ID NO: 24582 - protein, 139 aa, A.fumigatus
DQIWKGYGNQAVVVSVDPKRVYVTSPDDTEHHTIKTKYPYASGQSYCWYQCTIKGGRESRDIDVRQLVKAVEAMGAGEILLNCIDKDGSNSGFDLELINDVKAASKIPVIASSGAGVPKHFEDVFRYTTTDAALGAGMV

SEQ ID NO: 24583 - protein, 92 aa, A.fumigatus
IACPRISYLPSLLPRLRAFFSPSLIEPNSQPHEGWFSFEGVPLKWHLPVGLLYDLYAGADPASKGTRVDETDHPTSSVFTTGLEGSDAGAIA

SEQ ID NO: 24584 - protein, 252 aa, A.fumigatus
  UNSURE (11),(61): Identity of amino acid sequences at the above locations are unknown.
RRMLKPLSTTXGPKKRNSSGSSSGKRQPLQRNKRTGNKRSCGSSWNACSPSPKLTFTPHQXTAPSKAKSPPPPVKAPGYPGPGIASPQMSPHFAPGVAGQQHGIPLSHSPAPYGQYVAPPSGVSYMQGQPFQQGAAAPLSEGYNPMAYPAPTSISPPPSQQYYSSTPAPYSGYSNPAPPNAPSQFMPQGYVPPPPPPRPQQPSYPPSTGPYPSGPGGYAQSRPYGTSQHHKTPSQSQSSSSTDPWAGLNAWK

SEQ ID NO: 24585 - protein, 81 aa, A.fumigatus
QAPGKYVYPPHPFLRLDPNYPRQGLTKGLMEGIADRPSKSVQGYYGVLITSEGLDYSVVVNHTIKSATPRQIYTALQRIDH

SEQ ID NO: 24586 - protein, 111 aa, A.fumigatus
QGGQLNYLTKYLELLDTVFLFLKKKPLTFLHTYHHGATALLCYTQLIGLTAVQWVVIDINLLVHVVMYWYYFQSARGIRIWWKEWITRLQIIQFVIDLGTYSENTPLSRAC

SEQ ID NO: 24587 - protein, 115 aa, A.fumigatus
TSGFVYFASYTYFSSTYFPWAPNMGKCAGEEFAAFSGIAIISSYLFLFISFYIATYKKTAKTGRPRRNTGKQSLVDMKNFEVPSVTPAANSKATSNGAAVASGRANGPVTRSRKA

SEQ ID NO: 24588 - protein, 181 aa, A.fumigatus
RQLSKLLFSFDMAAPGGPSPQQIAAMQQQFAAEAARRGLTPEEFARQQREQLNAEAAKHGMTTEQYVHQLRMRAMAAHQQQMAQQQAQAAQQQGQAGPQQQQQQQQQQGQSGQPSPPQQQMQQVPVNPSNPPDPRAIAVAQFLRSQNLKSRTCILDGQRKDMFKGTFSPILLTSLRLSTDE

SEQ ID NO: 24589 - protein, 77 aa, A.fumigatus
  UNSURE (55),(60): Identity of amino acid sequences at the above locations are unknown.
RVSDSVLMSSIVKRAIRALESPAYAKAAAKKNSLLPPVTDRASAENVFKLSLFPXLPCAXPKSTRMLATTMPNQRPA

SEQ ID NO: 24590 - protein, 102 aa, A.fumigatus
ITHTPSHCHYIYCYFYSPLSLSLLQPPLSSCASYFSSSLHTFPLTVQNNSLLSRQFTSPTTNMASPEKAKPEGILGLSAAEAKILILGFLCITDQYKVHTRP

SEQ ID NO: 24591 - protein, 131 aa, A.fumigatus
IDYEKLASKGGYTAGSANVMFNKAKRKLTELNPDNSTENGSSAAGEASSSKSATATPKKGQAKRKKAAGATDAEDGGADGEEAATPTKPKRQRKAPVKKGTDAKAGADSVENGYVTWVFRSILFDYHIGDC

SEQ ID NO: 24592 - protein, 74 aa, A.fumigatus
KNISDLGDLAAAIKQRQANRMESLMEKWQTEADTLEGGNGKRTKRKTLFEEPPEEAFAATAARQASKKTKKSKA

SEQ ID NO: 24593 - protein, 116 aa, A.fumigatus
HSAKFVHESDTPIQILEPFLLLGLLANYNKFEFQNPYQLRLDDFVNESSIQKIVKGVGLSCAALRNGYIAVQDDAPEGWTLSSTLVFFGLGRLAPGTRNKTQAPTAEEAKEVFATL

SEQ ID NO: 24594 - protein, 148 aa, A.fumigatus
FTYSRWLTGIRPSQEAAILLSTYDFANANKLFGYHLINSMPEKDSEESPFASFLSITSYMLQHAYRSPRVAHYAELNLFTLRILSEDSALCKQLCSEGEKRKVRLCRQRQPYLPLVSGDRVLATVIFDIMIDTISHNLRRRLDANIYR

SEQ ID NO: 24595 - protein, 76 aa, A.fumigatus
HDSSSPVVKTSIESQGKTDYLVIYKVATRLSSQTVGAMILCAHTSLPLLNNVYHTSKYFIVFFMTNGTTVALSDFV

SEQ ID NO: 24596 - protein, 69 aa, A.fumigatus
PAYRLIIPPFYIKVSSSLTGMASSRFYYPLASFIKYLASYYLSRSYYHSSFTSSIVHSYVVPETFPLSL

SEQ ID NO: 24597 - protein, 104 aa, A.fumigatus
PFPKVPPGKGTLTHQHFDDMLNFHSTEEDKVTGRLVTKFLDFKKPTRDIRTRLMGKHAKGMTDGEAKELALFVDLLERCLSLNPEKRCTPAEALRHPFIARPKA

SEQ ID NO: 24598 - protein, 73 aa, A.fumigatus
TSPTSLRHLDADAVRICKEHTEGVNVIETTLDKRDCRFGNSLGCSVGGYCYKSCAQPGSGHWCWTAHNNGFRD

SEQ ID NO: 24599 - protein, 100 aa, A.fumigatus
CACLLQPALFQSSALKARQMAFNEFEVTAAPKVAEGEGKMLTDELVQVNDNGSSPTSNDLDCEKHGASRQSNPLPDLKRKLKSRHLQMIAIGESYFDSNI

SEQ ID NO: 24600 - protein, 361 aa, A.fumigatus
LFGGFPKSTAPSRGISVAAAPYRVFYSRKNFLFPDRQRGPHRSWRDEVRTMDKLFLNGSAYMIGKMNGEHWYLYLTEPHTMLTPPTSPGAKTEFTETETKVLSVPQGAALQTDSEDETLEVLMTDLDEENAKQFYLENATAVAENRYRNSNSEKSDHVDVFSNTSSDISDFDSDGSQVLPPELTTEGHALGTVVSEACGLSSVYPKEKYPDSRIDAYLFTPCGFSANGVIPPPEGKAGTHYFTVHVTPEPHCSYASFETNVPHSQNGQTTAGIIKQVVDIFKPGRFSVTLFEAKPALSQVEDEWKEAKYLAARRTAKMEHVEGYRRVDRIVHDLDGYELVFRYYERLDWKGGAPRLGEERS

SEQ ID NO: 24601 - protein, 171 aa, A.fumigatus
PRAPCSIVAQLCTFVINRIQFLNHISNHHTKPNMGSIAQTVRELDASTVKVTRSTNLRLVPEPGSPEELSHSHCTDHMVTVRWTVNNGWETPEIKPYENLSIPPTAGCLHYATECFEGIKVYRGYDGKLRLFRPDCNGERLVMSAQRTSLPTFRFEELKVLIAKLMQIDGP

SEQ ID NO: 24602 - protein, 100 aa, A.fumigatus
ECLDCSLSNGATGIDASGISGSLTVIDSSGNSLGNMIVSSNAGGSAQNSIILENVQCTNSGSTVSLNNNAVLSGSVTSTWVHGNMVSRIPGLLHLPAHRM

SEQ ID NO: 24603 - protein, 214 aa, A.fumigatus
YSGGATTPTHAQGSQVTTPRANVLLGANSKYFTMAPPTYAQYSSSQFINVKTVSGLPVMGDGATDDTANINAILAQYAGCKIIYFPAGTYIVTGTIFVPAGSIIVGDAYASAISATGSNFWNPNAPTTMVKVGNAGDVGVAQFTDMMFTVADVLQGCKLVGQPPFRLDATTNCKAGRSQHCRCSSWRRGILEHAFPHRRCRRLQTLHHNEQEPA

SEQ ID NO: 24604 - protein, 60 aa, A.fumigatus
RAKLPVQPDYGDGKSDEDVSWMYMSVIDYIRYYNDLDERLVVRFVFAAARQTSENVAATA

SEQ ID NO: 24605 - protein, 69 aa, A.fumigatus
LAGSFWVSVARNWLGSTLPLQPYSTLANTILVASLVLPFFHRLYPNSHYLHRLMVLFLTFSPTFIILTI

SEQ ID NO: 24606 - protein, 154 aa, A.fumigatus
RHEPIKRSGALFATALEGLRYLQTYDWLFLRTIITFGYLGWIAYALTTVIDLHVLHRTSDSKRTVGSTIFFTSILAALFSVLLYQKSSWQYYVYGAFPIFFWEEVFARRKALIAGREILLGHVRSFGGYIASGFQLVAFVAVLEALVCYDTLTY

SEQ ID NO: 24607 - protein, 89 aa, A.fumigatus
RPQLSRLIYRWCSNDRLCRTYGALLMFFTGLFYLLFEDTILKHSKSSGHAPGAISSLGSRVIMGMQVQFFVLFIFSCGLQDYVAAVSLP

SEQ ID NO: 24608 - protein, 73 aa, A.fumigatus
LLNRKLLLYSPLFAMSQLELEALCKYLNKILKKGWIRELSSLVAALVLFIKKLDRGLYLCINYQGLNTIIVKN

SEQ ID NO: 24609 - protein, 135 aa, A.fumigatus
RGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENVSGRPAFRLLLIANSC

SEQ ID NO: 24610 - protein, 73 aa, A.fumigatus
YVSRDASSARDQLTGQPVAVKKIMKPFSTPVLSKRTYRELKLLKHLRHENVCGHPTANILPPLCSDSLGRSLA

SEQ ID NO: 24611 - protein, 64 aa, A.fumigatus
QLDSYFVTELLGTDLHRLLTSRPLGETIHSILPISDFGMPRLLPPFRQYLNQYLNANHVFCSEV

SEQ ID NO: 24612 - protein, 83 aa, A.fumigatus
  UNSURE (53),(59): Identity of amino acid sequences at the above locations are unknown.
HDAPSNGVTIKPRSYSRQDGHTLVACVGKLPCGFGTFPRIPGLKQDLTDEALXGPMCIXHNVQYMRCIPRMAGGNIPRPKRKH

SEQ ID NO: 24613 - protein, 69 aa, A.fumigatus
VEVDTRANILLLDISGQIIAFSTSTEDAKILQPGFLCDNSWRMKTEMDYGSDGPMIGRTISQWTGKVNQ

SEQ ID NO: 24614 - protein, 82 aa, A.fumigatus
DSSIFQHSLHMLSLATPFHSFLFGNKITPFLLSLFTIHEALSLRPSIFFSTLFCNVDGCYFLNKSSYLNGSCLRPYEKQFVP

SEQ ID NO: 24615 - protein, 64 aa, A.fumigatus
  UNSURE (12): Identity of amino acid sequences at the above locations are unknown.
TIQVIQGRDWGXIIARVMATLYPQHIKAVHLHFAPVAPPYPWGHPWIFVQINSESSLLLAEQCL

SEQ ID NO: 24616 - protein, 113 aa, A.fumigatus
SIPDSQLDLLHQKLQAATFPDELDAAGWDLGVPLDEIKRLTAYWRDGFDWRAKEKELNGKLHQFMVSVSVSGFVQLDIHCVHQRSPMPGAIPLLFLHGCNVPYVRLALQMKVC

SEQ ID NO: 24617 - protein, 67 aa, A.fumigatus
  UNSURE (31),(43): Identity of amino acid sequences at the above locations are unknown.
MVCGISSRRLTWPTKPGTSCLPRLDKFIPFXKNSSWREDTDTXDGGTQVIFLMGPNAVDENGTVFLH

SEQ ID NO: 24618 - protein, 152 aa, A.fumigatus
RTAKDGARSSYGVFWGHNNVLNTAVPVEGEGNHTNQVAELRACMRALLDVVHVRSLFEDQGIILSAVVIKSDSEYLVRGVTEWLPKWKRNGWKNSRGLDVANWEHFKAIERLTEDLERHKLTIKFWHVPRRNNRDADTMAKAVLRGAWNRGL

SEQ ID NO: 24619 - protein, 114 aa, A.fumigatus
VPCATARSGPANSLFPDPIATQITSTALGPRPKWTFCSGNTAMPPTADCPPTSQPVHSDADFDHPTHPFAYVINIPLIEMTPENGSTEIWLGTHIDSGLHIQEGMHGDRASGRI

SEQ ID NO: 24620 - protein, 328 aa, A.fumigatus
ISPARILPAPGEDNWPTDLVDVKPYLQRPDVVQALNINPEKKSGWEECSGAVSSTFNAANSLPSVQLLPELLESGIPILLFSGDKDLICNHVGTEQLINNMKWNGGTGFETSPGVWAPRHDWTFEGEPAGIYQYARNLTYVLFYNASHMVPYDLPRQSRDMLDRFMKVDIANIGGKPADSRIDGEKLPQTSVGGHPNSTAAEQQAKEKIKETEWKAYAKSGEAALIVVIIGVTVWGLFIWRSRRRNRGYQGVYQRDIGSGYIMERFHNKRSGPADVEAGDFDESELDNIHSPGLEQEHYAVGDDSDEESPNHQPAAPPSSTKPGGAQP

SEQ ID NO: 24621 - protein, 123 aa, A.fumigatus
NQSHTKSPHPITRHTQIYHTDPAAAIAVPMASILQAIRYSHGKLAIIDQLQLPYVEKFITIRTSEDAWHAIKEMRVRGAPAIAIVAALALASELNTLIIHDKLSSRAEEVKLFIREKLDYLVS

SEQ ID NO: 24622 - protein, 81 aa, A.fumigatus
QEIKVLRAKNKQKMKKKARKYTSLGNNLFISMQEGRDYIQQVNEQVDEQVSKSTPISCQRAPPRCSGCWTIRHTRRSCPNK

SEQ ID NO: 24623 - protein, 221 aa, A.fumigatus
PQTLNNATSLFNGGDKGWGRQTWDIAVHISNSITFVLFDNRWNGFPGIFASCVTHTVTPYEWRIAFGVTPLLKAGPINFSQQVFFNLDGFRGNASTSDASDSTVLNHRPRLPSSGMRFDVDEWEIPTGDMKSNREGKEFDFWSADKFIGDEVQKGNAGSDVTYVLSHKPLGDKEDEPVAILSSKPSGVTMELYTDQDALHVHTWNSDLGNMTFFCSGWSRN

SEQ ID NO: 24624 - protein, 360 aa, A.fumigatus
  UNSURE (354): Identity of amino acid sequences at the above locations are unknown.
AIMPPKSVRRGAAAAAAAGRGGGGEGTAPRQTTSEAASNTPTGSAASTPQPSTAVGTPSTRAPVQRLQTLKKRTPSGSIGPPARTPAATTPGNGEPTKPILKYKPRAVGRRSKEERDAIEKLEAERNRERLAEVAAMSRGRGNLQRGRGGPGRGRGVPLGGGRRGRGGRFEPDSRASSMSRSRSVIDIASGSASRHVSSDESDTETILPIDQIEVDSDEELDDVADSKKGKLPLRYANREKGLRPVRVERREHEERVVSVNMESSTSKPAEAETKAEDEVEEVGAKKTRPEDDSLFVRDDDVIEPQVKEEPIDDDHPMTDVVPHVGEATHDDGFLPAQKVKVRRRLSPKIPDHXAAAMED

SEQ ID NO: 24625 - protein, 374 aa, A.fumigatus
SGILGLSRLRTLTFCAGRKPSSCVASPTWGTTSVIGWSSSIGSSFTCGSITSSSRTKRESSSGLVFFAPTSSTSSSAFVSASAGLLVLDSMLTLTTRSSCSRRSTRTGRRPFSRFAYRKGSFPFLLSATSSNSSSLSTSIWSMGSIVSVSLSSDDTWRLAEPLAISITDRLRDIDDARESGSNRPPRPRRPPPSGTPRPRPGPPLPRCRFPRPRLMAATSANRSRFRSASSFSIASRSSLLRRPTARGLYFSIGFVGSPFPGVVAAGVLAGGPMLPEGVRFFRVCRRCTGARVDGVPTAVDGWGVDAADPVGVFDAASLVVCRGAVPSPPPPRPAAAAAAAPRRTDLGGMIAQRIWARTRCVLQRRERTEESVH

SEQ ID NO: 24626 - protein, 73 aa, A.fumigatus
PDFLTGMSLRSLFVAGLATLALAVPAPQIQARQGMSSNELESGPCRDVTFIFARGSTEQGNMVCFSTRSSLST

SEQ ID NO: 24627 - protein, 78 aa, A.fumigatus
GLIVGPGVCSSLKKDLGSDKVACQGVGGAYTAQLAPNFLSQNTNQASINAATDMFDLANTKCPNTKIVAGGYRYIICI

SEQ ID NO: 24628 - protein, 74 aa, A.fumigatus
RSPLYDFTSSAVKTEALQGFRICILRRCIQVTDILKGYKARAAHDVECSTNSIFFFQVVKTASIHSGIPDQTLA

SEQ ID NO: 24629 - protein, 91 aa, A.fumigatus
NNSQGSAVIDNTIQALGSDLKAKVKGVVLFGFTRNVADKGQIPGYPKDQTKIYCAVGDMVCVNTLIITPAHLTYGADAGDAAKFLASKVHE

SEQ ID NO: 24630 - protein, 85 aa, A.fumigatus
PLLMVPSHTMVHRYTASLSSLPRDELLAFPFFPIGALPPFPYMYQTKGIKKCIAFKTKEEYLHGSLAFLSGNVENAGSQRLTCMS

SEQ ID NO: 24631 - protein, 61 aa, A.fumigatus
SGITPDDPDTSIDGKGTHYIAGINSSTSPFSRVPILQARFSLDPLHQANNGMTDLRNFSIS

SEQ ID NO: 24632 - protein, 152 aa, A.fumigatus
RQAENTQPAFIQKLRNQYGDMSGRLERPVARPRLAKKDDEDDDEPTYVDEGSNEVISKEEYEALLRGEEKQQESSEQQSGHESRQDTEKPDTEVASSKQNLAGIGGPKKRKQAKVVADDSAEAENTTQQERTGPQKAKEKQKKKKIKLSFDE

SEQ ID NO: 24633 - protein, 115 aa, A.fumigatus
RFYEVQGRGEWPGRAGVSEKRPEGHPLCGECVRFSLPSCLRSDSMRVVQESVPRLIEAYRGNRIKDINTHCLKQFNAHWECLENNNQNLWECRKPEMELNSCVFEKLVRPRRVFG

SEQ ID NO: 24634 - protein, 110 aa, A.fumigatus
FLPRGADQSPRFNQHVLVDTTPMPSDIPKVEEIGATSAPLLSASYFIGDRCKAFNDDFMKCKAEANGRGELECLKKGRKVTRCAASVYVFLFRHACVQILCGLCRSRFRG

SEQ ID NO: 24635 - protein, 82 aa, A.fumigatus
  UNSURE (15): Identity of amino acid sequences at the above locations are unknown.
MENIRNSTQYVLEKXKSMPTVPVNSQPYLIPGNRPTELNLGQSGLPLPNTPTLKLPFQILRSPLESPSRLRTMPQEWHDSKK

SEQ ID NO: 24636 - protein, 63 aa, A.fumigatus
IVLGYDRSWTARTGGSGQHDCHAAAAMGWDYGMLLHHVLEGAKPLVQFLDHYCPFSIGPLAIK

SEQ ID NO: 24637 - protein, 162 aa, A.fumigatus
NHSGSSRLCRRLIEEGKVIWQEWQGLAISQDRVFETVSIALVGKYTTLHDSYMSVSKALEHSAMHCKKKLDLIWVESSHLEDEHKETNPAEYYKAWHSVSTANGILVPVRFSPHTLCELTLILCSGWFWRAWYRGHDQECPMGSYEQCSLPGCVPGYAGGRY

SEQ ID NO: 24638 - protein, 210 aa, A.fumigatus
YYVQGGFGERGTEGMIKSAQWARTNNVPYLGVCLGMQVAVIEYARNVCGLTGAGSEEFHENCEHSAIVYMPEIDKTKMGGTMRLGKRATHFQPGTEWSRLRKLYGDKQEIWERHRHRYEVNPELVDQLEQAGLSFVGKDDSGKRMEIIELKDHKWFVGVQFHPEYLSRVLAPSKTFLGFFAASAGCLEEITEVFKDRHDLSHRELKIPLH

SEQ ID NO: 24639 - protein, 291 aa, A.fumigatus
DSTQKPQTPNVQNFEILPQSKQEPGTIATSRPPPGGVSSPSIAVVLPPPGAASTPHQPNSSPAVRPMNQPPPNHTPAPRSSGQYPPFQSQSPSIQSRPQQHGSPAYYRPAPPPPPRVGYKSVVFEFTSPLTPYGSSTSGHAGSGDRYLFPEYSILEWLPGGNTVLASFLLIRKVDPNTPFPIEDASVTSTSRAKGKSTSKSKKADKNKDKAAEGGEGKEKDKKENGKSDEGAKEKDNAQLSNNQDSATAATDSAKGSDNKGNQKAQAETPSKPDSNKSKVFTRGSKDPRYA

SEQ ID NO: 24640 - protein, 84 aa, A.fumigatus
ILLARIRRPPVVKTSNGLRLNSPPCKKFLGRLVYKVHSFFTDCRDGATEAYFASLHSQWLTSCNTQTFGLFYLGSSSLSGVGSN

SEQ ID NO: 24641 - protein, 69 aa, A.fumigatus
LSSIAADSRQARASQVKQSEGLCVAAGQPLAVQGSKVSLCGSVSTIRKETVYFVHQSAKEFLTGRAIQP

SEQ ID NO: 24642 - protein, 92 aa, A.fumigatus
WYPEIEHHAPNVPIILVGTKLDLRDDPATAESLRQRKMEPVSYEQALAVAKEIRAHKYLECSALTQRNLKSVFDEAIRYVWHCPRSDVVPRC

SEQ ID NO: 24643 - protein, 117 aa, A.fumigatus
NMIDMPPHLVYDQCIPRRIHPYRVRGFLPCADSHSEPVVDSTSRFDNYTASVMVDGRPISLGLWDTAGQEDYDRLRPLSYPQTDVFLICFSIVSPPSFDNVKAKVLNSPVSCCALTA

SEQ ID NO: 24644 - protein, 81 aa, A.fumigatus
PDEVEDFITNKYCRAGGGGKSEHRRAKIEAKNKKLNEERQRQAKNIQKEKTKSKNTHSKENEEQGADQWAGIHPSRRARMA

SEQ ID NO: 24645 - protein, 251 aa, A.fumigatus
PMHNLVLQEREGIFSIIPTWYESRTKELHKVRQERDRLVEATLSSEQRLEKQKEDNIKLKDERIQLRHELEKAREALKAGGGSMAELERAQEEIRRLTKANASLERKAEYEAKQAEYTREQYQTASNVAAQSGNEILQLKEENESLKRKVAGDASRLRELNIQSDEQRHLARVKELEAMLASREDLLRRKEDELREFRKNRPSTRSTSTQPRSPKWTAANSRPTSPGINNHNGSGYSGRGSGLRFSSEVPL

SEQ ID NO: 24646 - protein, 73 aa, A.fumigatus
FIPAFHLPINLISHTIYLAIFSNSTRLAYYAIFIPTSNIGKIGKLIYITRTTTTGFFLKFKYNYNFNLTQRKY

SEQ ID NO: 24647 - protein, 237 aa, A.fumigatus
  UNSURE (213),(224): Identity of amino acid sequences at the above locations are unknown.
RTKHGRREQRKCRAHTRAQDCLRCEPAGRVAEIAICEIAGQDGAKLGCCVADRHEGDGRDHPVDGCDCRGNGPGEEPQAQGEDRGADHEAEKFVFGTQGEALAVVGDDEFVVVDAGEHAKHAAEAKAEEGETGVGGGHAEGLVDWWEGLGEHVDEGERDGADDGYQEDNGFGEEEVDGAKEGHGEEGAEVRDTVWVEALHHRLGLLAEALHRXQDFLSKKKGSXESRIPNRKHAISP

SEQ ID NO: 24648 - protein, 280 aa, A.fumigatus
  UNSURE (2),(13): Identity of amino acid sequences at the above locations are unknown.
FXTSLLLGQEVLXPVQGLGKETQTVVQSLNPDRIPDLRTFFTMALFRPIYLFFTEPIIFLVSIISAIPFTLIYMFTEALPPIYQSFGMTPTHSCLPFLGLGLGCMLGMLTRIHDYKLIVSHHRQRLPLRPEDKLLGFMIGSPVFALGLWLFAWTIPPAITSVHWMVSTVALVAIGYAATEFGSVLTGYLADSYLSYAASGFAAQTILRTSMSAAFPLFAPAMFGSLGANVAVSVLAAIATVFCLVPPLFARFGERIRAKSRFARYSLDVYNRITVEEEGF

SEQ ID NO: 24649 - protein, 155 aa, A.fumigatus
PPHLLHHGPLSPHLPLLHRTHYLPGIHHQRHPFHPHLHVHRGPPTNLPILRHDPHPLLSPLPRPWPRLHAWHAHPHPRLQTHRLPPPPAPPPASRRQTSRLHDRLPGLRPGPVALRLDHSPGNHIRPLDGLDRRPRGDRLRSNRVWLRPDRLSRR

SEQ ID NO: 24650 - protein, 76 aa, A.fumigatus
  UNSURE (33): Identity of amino acid sequences at the above locations are unknown.
YRCYSPMAFITVVVELYSSQAMLHMFAFIISCXYLANLERLYDQTQFVVNTRDGSTGKFHIAAAGGHNTREVLSPP

SEQ ID NO: 24651 - protein, 61 aa, A.fumigatus
SEGFSKSLFILAIATGEDDNSSPSPTDLDTKLQRKMLCSSSIRTLMGKINYPKKTGWRDSD

SEQ ID NO: 24652 - protein, 152 aa, A.fumigatus
TWVFYFGTPFFQKLGKPSRTPFLISMFPTIVNVCSTPISFYTMEKLGRRTLLLWGALGMVVCQFIVAIVGTVDGSNKSAVSAEISFICIYIFFFASTWGPGAWVVIGEIYPLPIRSRGVALSTASNWLWNCVSFSSTRMPKKKKKKKKKKKK

SEQ ID NO: 24653 - protein, 95 aa, A.fumigatus
IIAVITPYMVDTDKGNLKAKVFFIWGSLCACAFVYTYFLIPETKGLTLEQVDKMMEETTPRTSAKWKPHGTFAAEMGLTDKDMAEKTAEVVHQEV

SEQ ID NO: 24654 - protein, 250 aa, A.fumigatus
RCTTSPVYGVIFLFKWIREPPSTNTTQPLDGTYITSLPENLFFAAQTIQNACGTQAILSVILNQDSPASTPYPINIGPELRSFKEFTAGFPPDLRGEALSNSETIRTAHNAFARASPFVDETVRTTQDEEADVYHFIAYTPVNGVLYELDGLQPYPISHGECNAETFPEKVIEVLQRRIARYPEGETRFNLMAVVRDLRFRARETGDVELLEREARKRRAWAWENTLRRWNFVGFIGEMSSPRGWKVPRC

SEQ ID NO: 24655 - protein, 68 aa, A.fumigatus
QMSQDEAKSLLLANTDRAFKSGAFGLPWFECTNPKGETEGFWGIDHVGQVAEFLGLDRSLDQGFRAVL

SEQ ID NO: 24656 - protein, 74 aa, A.fumigatus
  UNSURE (64),(74): Identity of amino acid sequences at the above locations are unknown.
NSPTHPGFPSRAEKPCSIPLFLLPRSFPKRSGGSVWLHKTSSEISGADNSLLITSQHYLGLVSXRSERLYVPQX

SEQ ID NO: 24657 - protein, 178 aa, A.fumigatus
ILLIPGSICFVFSIMMTSLCRKYYQAILAQGILGGLSTGVIFTPSLAAIGHYFQKRRGLAMGICAAGSSLGGLLFPIALRHALYSRRLGFGWGVRVVGFVVLGLLAIACTVVRERLPPRKGRFFLLRAFVQPSYSFLVAAVFLSFWGMWVPCLFIVSFAIQKKHMGGNLAFYTLSIVC

SEQ ID NO: 24658 - protein, 133 aa, A.fumigatus
LSAIQFQTLCRLPLPKSDDWPLPPPRRMCWTGLNKEMRDSDVAYYGRLFNQWCHGTGMPTIDHPADEYFVQVARFDPSKGTIDVLDSYPMFRTHLTQTKPDRRPQNESSADMGLTMIQTQVKCPTWLWILFMK

SEQ ID NO: 24659 - protein, 112 aa, A.fumigatus
SGRRRCHRSHQRTSSMPNLARNQCVLIFSHLPQSSEGESFDAFNLGTIESTGTPELQECDTFTSSALSTDTYKSKMQSLRNPSAIWHFSLLPKSYSNAAQATIAFSTPYPHE

SEQ ID NO: 24660 - protein, 157 aa, A.fumigatus
ILQKCSQSIGVSFINPLILIFTVQRHQAAIATSITMTGFDLKNPMKESVNVSVMSTDVEKPPPQLCQDASHLPFAAVPKRKPVPVGATKASSDAQAAIATKEPSAYLPTKGAWWNLNRNWQQFSRKKRVVIAAIAVAVVCLLALVIGLAVGLTRGKG

SEQ ID NO: 24661 - protein, 94 aa, A.fumigatus
SHGRVHYSVLTDPLHGHGLRGASFSLLLSSFYSPVAIPHLAYLFGTLVSNFESMLITVAHVSDYDIAYYSSIISTGKADRRMTLFATVCLRTRI

SEQ ID NO: 24662 - protein, 71 aa, A.fumigatus
RLNNLERQTSVPKVYVILGLVGIYTFLVFFNIAGEFLVNFAGFLIPGYYSLNALFTSGKADDTQVSLFPLN

SEQ ID NO: 24663 - protein, 67 aa, A.fumigatus
IKALLNGFFFPTIGRHFPEVCAWEFQKVSKEQLANTPSFTDISRSSFGSIPWDEDSDPRFDDNLEII

SEQ ID NO: 24664 - protein, 211 aa, A.fumigatus
TIADRKAASKDVKRMFRREQEISNSDLDPAAKKEKLAALAGKIHAAQVNHNYTIYYPLTQKYVALYAEQKKKKKESSAQSEKPSEPEAEVASKLIYDTTGERPPMWRVVEKCMEDGTLDLLREGKLDGSEGEKSSQAPEQKKSKKSTDDDQYARNKSSTEKVSDKPSGKSRKSGGKQDRKPKRSAAMEGAYWSANEHDDDDNESDGGFFEA

SEQ ID NO: 24665 - protein, 255 aa, A.fumigatus
  UNSURE (214),(233),(235),(242),(244),(250): Identity of amino acid sequences at the above locations are unknown.
TQRFTFYTSFFAIYTVTVSQIWVGFGQIRRQSQRLWHQTLWRPPMRPLQLVQDPVGISHRNSFIDVVQPGCPMHASNAPPALSSLSARSDTSSSCPVRSPDSPFYVRPKTTMTDSPQPPAPETKSALSKLNPLNYMFSSISQERAPNQTVDLPVEREPSSIPRGDADGNWEYPSPQQMYNAMLRKGYTDTPQDAVEAMVAVHNFLNERCWAEIXGWERLFAKGLGQAWEKCRXGXQGIARKXMXQEMNRXCGSSL

SEQ ID NO: 24666 - protein, 141 aa, A.fumigatus
KLGSFQPRGEDMLLAGMGSTSSRDPSLNRQRNRRESGSTAPTTTNITDRTHNTVPTSIDGDHETSMIEGNGVGQQLSLKNERALSNMSSAAATPLSEVTSAGAYGSCIAKSEGDARRSKPSVSALELQIPGHYPPANHIPA

SEQ ID NO: 24667 - protein, 108 aa, A.fumigatus
RRKFSSGSSVNLLVPQDHFHLVKGTTKEHNVTHESGMHMTLHFCEACGCLLYKTADRKDFEGGVIVLAGTLDDPHALDDAKPEAEFFVKDRASWWPALGDVKQLQGFD

SEQ ID NO: 24668 - protein, 71 aa, A.fumigatus
  UNSURE (11),(31),(34),(47): Identity of amino acid sequences at the above locations are unknown.
RSWRCRYKVNXKQKNASPGFIIEANTSKIVXWYXLLLKVGARLIGNXSGSHLRSGRQPRRMAGLSMNEGPS

SEQ ID NO: 24669 - protein, 228 aa, A.fumigatus
FQQLTLIYTSASSDQAINQLCDQIHSLNNGSTAIKVQADLRQSDAPAQILAATFDAFPNANNKIDILVNNAGVSLCKNLADTTDHDISSVFDINVYGLISMTRAVIPHLRAPGRIINLSSVAARRGSPGFSVYSASKAAVEGFTRSLACELGPVGCTVNAVQPGAVESDMLRREVPEQLIAYIQENTPLGHRIALPEDTARVVTFLAGEGAGWVTGQSICVSGGLHMN

SEQ ID NO: 24670 - protein, 580 aa, A.fumigatus
PIPHIIWPEGLLPNMVGRFQPPNAVKTRQEFLPFQAQALQRINAHRRGQSLDQRPLHDGTVSITNATANQQHQILAGGEQHPQFSQSAHFPQHSSPMPVMPECPSLTSEDLQALSNSTSNANHPGMAYMNSSFIAMGNPSLGLRPMDNNLNLMQQQQQQNAHVSCVNSLEGQILDNGAWNFYQQGQLPTTLRSQVNNLSADGRRQSVQSDITPSQRPHTPKQANTRKLSIQSSWSFFSRPLTTDPDYFPITPATTPFKKPAELAQYSTDMQSTPTKETGRSAPASAQSVYMQRAKSLQGVAGSTFSNSKIEMPSPPNTASFEIDNFDAFSSQQGSSFEISESENLSQSHYASSSATSSFQSSPELAAMPSPEDNHEKAHKLPIFPAASNRPAHRKALSTSSSSTLTKPRLSPRVASIDSPNLDARVHASIKETGITIDEIASYISGPDPEDGKWVCLHPGCERRFGRKANIKSHVQTHLGDRQYKCDHRNKCFVRGHDLKRHAKIHTGDKPYECLCGNVFARHDALTRHRQRGMCIGGYKGIVRKTTKRGRPKKHRPELEERQDKAAKTRSSPRGWKDTR

SEQ ID NO: 24671 - protein, 124 aa, A.fumigatus
QGPVGVGSPLGRGFRSALSVAVEIAKEVVFDYKWKKAVAFSVRHSFVAAGTLFIVFVSRGGSNALLVGFLADKKGHGLHVRGHVGLGTVAANARELESVLYIYRISSVSSENGGFLKFKTYGIT

SEQ ID NO: 24672 - protein, 158 aa, A.fumigatus
RYGDLIRTYIKEGKIVPMEITVALLSNAMAEALAAGAGATAEGGKKKARFLIDGFPRKLDQAVFFEDTVCPSEMTLFLDCPEEVMEKRLLKRGETSGRDDDNAESIRKRFRVFVETSMPVVRAFEEQQKVLSVSATGTVDEVYARIREGLEKKGVQPI

SEQ ID NO: 24673 - protein, 162 aa, A.fumigatus
HAKIVSVDTTAALNIPGVYDYVDHRDLPNPKANWWGAPKCDEVFFAVDEVTTAGQPIGMILASSAKIAEEASRAVKIEYEELPAILTIEEAIEAESYFDHFRFIKCGDTDKAFEEADHVFHGVSRMGGQEHFYLETQACVAIPKPEDGEMEVWSSTQNPTET

SEQ ID NO: 24674 - protein, 106 aa, A.fumigatus
LRNSQTYVAQVTGVAANKVVSRVKRLGGGFGGKETRSVQLAGICATAAAKTKRPVRCMLNRDEDIVTSGQRHPFLCHWKVGVTKEGKLLALDADVYANGGHTRDLS

SEQ ID NO: 24675 - protein, 79 aa, A.fumigatus
SFYHLIFGLHCTERLTIIVRRFNDLAWTDYEDNSRGVIAGALEIGSLDLWDADKLINGSRFVRRQNPPAMMNWLTDYKQ

SEQ ID NO: 24676 - protein, 92 aa, A.fumigatus
GSLLQLYISDLNNITNPYRLGSAAARADDIECLDWNKKVAHILVTGSSAGFVTVWDVKTRKESLTLNNMGRKAVSAVAWDPEKVRLNKINSS

SEQ ID NO: 24677 - protein, 63 aa, A.fumigatus
TKSTVADFISDFGQPTKLITSTPLESDPLIYVWDLRNSHAPERVSSEFPYSSIGNSTNMINTI

SEQ ID NO: 24678 - protein, 63 aa, A.fumigatus
LTPWRQAYLYDNEDRFFVGWRLGESWIYCTVSWCVSLFCAVAMILAGNSLPSEGGYELIPDHF

SEQ ID NO: 24679 - protein, 241 aa, A.fumigatus
ERVSFQLRRCKTVQSLAMITKAGVPASKILVGMALYGRSFQMTEAGCYTADCTYTGPMSGATPGECTDTAGYLSNYEIEQIIAGGGVQQYSSDDGDILVYNQTQWVSWINPSTYWDRLAWVQGLNFGGTSDWAMDLNQTFADADASNIVYISPDIWSEPDPTVACYPPCTFVFPPWSLSTPTTISRPPVTMTLEETWPLIESLNGNITTTGYTTGTTVTTITLPPVTTDLSSPTGLEGSEL

SEQ ID NO: 24680 - protein, 393 aa, A.fumigatus
LEGLISQSTFPGWVFSTFGGNGQESEAQELGSGDYLAEGSEFPEKRDFCQAPMVKIHKGGPPDSGAVPTLQGNRSRRHKDDNVSNAIEGWAYSSVKPVVKEQLAKDSAFLKELIKVLKASIADASVLYGGLMIILNLTQFLPSMTEEQKKMSQLKAYADASGATAQAGPHPLDDDEHVIARCNAVVQAGVMPLFIECNKSSLPSAQGLVSKILLSLSRDRKSRGILAQQGAVKLLLSLGSARQGTSGSISDEAMQSASHALARILISVNPSLVFPSSGVPQITSAVRPLTNLLATPEVGNLTAEQPRDLLPVFESLLALTNLASYPDPSAAEAIVRHAWTVVEDLLLSSSPMIQRASCELVCNLMTCESGVAKFADGSKRAGVHTRRLEGTAL

SEQ ID NO: 24681 - protein, 395 aa, A.fumigatus
  UNSURE (358),(385): Identity of amino acid sequences at the above locations are unknown.
EYRWNTSLTSNDVHRRLPADGGLWHNEEPVTTPFFGIWDRSAGKIGTLIAFLPTDKPSPTAQVDMSSVGAFAYRVEATESLSRVTTFFLQQRINHRDRQEMGSWLMRFKELDLRLVSWKMSLPQKWKDTNISRQPTVVTMDPNLTLAHITHNTSMILLHQRIAYPPPEWLEVVKLPTLSSAETCEAAAAETANITEKYLGNCPRDGVVDSQFAFCVFVSARVLLGEFSSSGPSRGFSQRTLEVVHWRYYGTPLSPDYWTLMKCLDAMATRWSGRVQASRQNSAARYFGQLNAIHRACQSDENFKLDVLGYSNEIEWTGEKQTTAPAAVPAPDTTTGLSQVAFPADLPPMLQSSPARMXYNTGSPDELTTVTSILLDQQYSELDGXHHGSEGPRMR

SEQ ID NO: 24682 - protein, 196 aa, A.fumigatus
  UNSURE (15): Identity of amino acid sequences at the above locations are unknown.
AYRNCSGVSPFFGVXRQPKEVPIQEKYDYCEKIIDLLEMRPMAGATVGSGGAGLNPEQRKRLTIAVELASKPELLLFLDEPTSGLDSLAAFNIVRFLRRLADAGQAILCTIHQPSAVLFEEFDDLLLLQSGGRVVYNGELGHDSNALIEYFESNGAKKCPPHANPAEVRLVPHLFKPKLTKFPVYARGHRRRKPGL

SEQ ID NO: 24683 - protein, 90 aa, A.fumigatus
QQGKFLLHIFTGLFNTFTFWHLGNSYIDMQSRLFSIFMTLTISPPFDPTAPAQVPALSGNLLLITSRPPPKIFSWHRRWSPTAILPPTGL

SEQ ID NO: 24684 - protein, 139 aa, A.fumigatus
QSSQYMLEVIGAGNPDYKGKDWGDVWAQSPQCKQLAEEIDKIISSRRNREIRKNKDEHREYAMPIWTQIVTVTKRAFVAYWRSPQYTLVSVQFRHRGVEANSNRANSSFISSLDSLTRLHSGIWEIATSICNRGSSRSS

SEQ ID NO: 24685 - protein, 370 aa, A.fumigatus
WRVCLQPRGEDEHVINFFYYVANEMRAIMAKLGIRTVNEMVGRAELLRVREDIRSAKQERIDLSLILTPAHSLRPGVATYNVRKQDHRLHVRLDNKLIAESELALEKGLPCRIECDIVNTDRALGATLSYQVSRRYGGAGLPQDTIHANIKGSAGQSFGAFLAPGITLELEGDANDYVGKGLSGGRLIVYPPRGAAYKAEENIIIGNTCLYGATRGTCYFRGVAAERFAVRNSGATAVVEGVGDHGCEYMTGGRVLILGSTGRNFAAGMSGGIAYVLDMNQDFLSKVNMEMVEVSGLEDPAEIAFVRGLIEDHHHYTGSELAARILLDFTRALPHFVKVLPTDYKRILEEEAAKAAAASLHHGRLEGQKS

SEQ ID NO: 24686 - protein, 276 aa, A.fumigatus
DIGDTTGHTSSEITTGRAKNEHTTTGHVLTTVVTNTFNNGSSTRVTNSKTFSSHTAEVAGTPGSTVETSVADDDVLLCLVGSTARRIDNETAARKTLAHIIVGVTLKFESNTRSKESTKGLASRALDVGVDGVLRKACSTVAATDLVRQSSAQGTVSIDNVTLNSARQTLLQRQFGLRDELVVKADVQTVVLLADIVSSHARTEGMSGSQDEGEVNSLLLGAANVLSDPEQLSTSNHLVDRADAELGHDSTHLISHIVEEVDHVFVFTTRLQADAP

SEQ ID NO: 24687 - protein, 91 aa, A.fumigatus
CVHPDGAHERNYYRPSPWDAGDALLQDCTSYGHVGNKNDLSAATIEEYIIVSRGLNTTEHTQASFVVVGDSRSHVIDIDQRTSQARAPSTR

SEQ ID NO: 24688 - protein, 70 aa, A.fumigatus
GNIINKKKNPPKEEEKKKDKEEKKEKEKEKEKEKEKEKEEKKEIDHHKTTWIKVSDLDSEDRSHCMRCLT

SEQ ID NO: 24689 - protein, 69 aa, A.fumigatus
LDGNYIIIKQWISEDLQEELFAHTRRLREGKLVTETSSTLTELKVNDRKKDRMYLVRKKSPNRRAWIFT

SEQ ID NO: 24690 - protein, 218 aa, A.fumigatus
  UNSURE (95),(127),(195): Identity of amino acid sequences at the above locations are unknown.
LPAGGGNSRTLSCGHPNFPKGGFYPPGPLQGKWGFWGEASSPAQGTLGIGLFRRIPVLTGQGAIFFVTGRCTGPVIRILGEWQREMPVMLDFMFXFNEQLKRGLALVASSEQSEQPLKSTSSSSINXVSGGLAAGLATAITNLLSAVKTRLQLMPGKYGNMIRAVRLMIREDGVRSLFGGLGLRITRKALSSALXWTVYEELILRAEARWAEKDKIDL

SEQ ID NO: 24691 - protein, 138 aa, A.fumigatus
KYQVRGLAYPRGIARPEIFEFNSVNDHCDRPAPDMYVMQYQVKATTSEDRANDRIDYHSLLYRLLSVSYLLVWSQSYISADMHQWEQPRATAVSFVSVIAFIFAARYLPLLRWFFKFTYLALGCELLLVGAFLRSLAD

SEQ ID NO: 24692 - protein, 189 aa, A.fumigatus
VSLSRGCSHRIVIVLHPKSEPTSPGPKPPLHSDHPPSTPIYAPSPSTTPIQTHPPPHAQLSGMTMYANDPTAPFVHQNSSRPRNPQSPQPDPQPPRRPASQGTDPPRHSAPPHRRPHHQDHQSRYAAKASKQDIPAAQPRAHYSYTRRLHPSLGPPPHQPLAASSRRRARFPARSWTRGNAIPWRLARR

SEQ ID NO: 24693 - protein, 89 aa, A.fumigatus
RCMRMTQPHHLCIKTHPDLETPNLPSQIHNRRAAPRRKVQTLLDTQHLLTVVPITRIISPAMPQKPRNKTSLPHSLEHTTVIPAAYIRP

SEQ ID NO: 24694 - protein, 150 aa, A.fumigatus
PNRTICASKLIPTSKPPISPARSTTAAPPRVARYRPSSTLSTSSPSSPSPGSSVPLCRKSLETRHPCRTASSTLQLYPPLTSVPRPTSTPASSSFLTAQSPLPSAELDAGQCDTLAPRAAMSSRSDGDRCTACARIVRGVRSPKSSYTDV

SEQ ID NO: 24695 - protein, 355 aa, A.fumigatus
SAGGGMDNPSLCPDYYLDSSPESSVSKSKETIAHIHSMDPAGTLIHPILTPRFAPTCSPPAFHGLAQLAQSYNPPLHIQTHLSENTGEISLVRELFPQSKDYTSVYDDFGLLTPRTILAHAVHLSPSERELIAARGAKVSHCPASNSALGSGLCAVRKLLEAGVEVGLGTDVSGGYNCSVLEAVRQGCLVSRLLRHSGTDDPGDGDDGEEVLSVEEGLYLATRGGAAVVDLAGEIGGFEVGMSFDAQMVRLGHSHTSSSPTAEHGVVDVFGWESWTEKVHKWVWTGDDRNVKAVWVRGRLVHSLDEGQSQSDVSIPEKGKPTWIWARTGAAWESKWWLCGLGFVSAWFIFDRVMR

SEQ ID NO: 24696 - protein, 193 aa, A.fumigatus
TNGGDKWKKGLDGLLNTTFQRFFPFQNGMVMSEIACEPNMKCDRNQDCFKGFLSSWLTFMTTIVPYTSSEVVPRIQQSALAAAKQCSGGQNRTLCGRRWHQDTFDGTSSLEEQMSALSVFSSSMIAHRMQAQAPLTVDTGGTSKSNASAGTGSEQAAPQPQPVTTGDRAGAGIVTVVFLSGWIAAVTWMVYGR

SEQ ID NO: 24697 - protein, 74 aa, A.fumigatus
VRHGSMMSIQTNGVSLPDIGFTQMIEGSSITDMHLFSPSQPDLNWDNPEVRNAVFDVIDFWGQKGTDGFRVYQP

SEQ ID NO: 24698 - protein, 78 aa, A.fumigatus
  UNSURE (39),(40): Identity of amino acid sequences at the above locations are unknown.
KTLGADMLWLTPIYESPFEDQGYDIANYKGINPIYGTMXXWEDLAAEIHRRGMKIMMDMVFNHTSSQVSGSNAETSLC

SEQ ID NO: 24699 - protein, 255 aa, A.fumigatus
KLGRQSTWEQSADIPDEDTSLTVFNRGNVMPSTKILTFYRKQPFDLEARYAKPDMLPGKINPWIGRFSVKGVKADANDDFMICKLKARLNLHGILNVESGYYVEDVEVEEPVDEDKMDTDAPEGEQPKKTRKVKKQVRKGDLPISTGTNSVDQTVKETWIERENAMYMEDKLIAETDEKKNELESTIYELRDKIDGVYAEFASEEEKDKLRAKLTDMEVSTMSCPHTGRRNSKLTRYVGLALRRRRRHYPVRLRC

SEQ ID NO: 24700 - protein, 280 aa, A.fumigatus
PLFAGLLDMVADQKYCPNISNFLFNDPDGNITGFVPHLTPLAPPVLALSRLAISPAKPIPPAESNQALVLNPVPPSARWIHHSKTQGRRLYNLLAQWNVLYVGLFNRPAITLLAPWGNGEAISQPSINQFDLFPRLNTNFYGPSIANITAMRQPRAQGVQANRVSTITVFNTKDNTDAFTGLFTGDAHDTILHPDIRGNLTAPQHFSVMKVPHHGSKHSESQEFYYQYTADVYLISSRFSIHGYFHSPCTLPSLRMPTDTDCEGNRLPTLKITKERFHHR

SEQ ID NO: 24701 - protein, 140 aa, A.fumigatus
SHPTNSSQSVGGRARCRPGDRHADAAAPRARTSHQNDLRCGAVPRSACGAARARGRGGVGGEVPSSVLWCCGAGAGAGVAAGRAASCRGCGGSSGKHGRGLRYDCVCAGFVLCAGVGEDGAGVVCAVAARGAVACCGACG

SEQ ID NO: 24702 - protein, 203 aa, A.fumigatus
TRPAARPTSTQQQNQDQDQDQDQKQTPLQPPQIQNSTDLIPPILARASGVVLDVGPGTGTQMPLLRGRAQAIKTIYGAEPCRGLHAELRARAEEEGLGEKYQVLSCGAAARELVPELQREGLLPAGDVEGVLASTDGVFDTIVCVRVLCSVPELERTAQELYALLRPGGQLLVVEHVVNPWRTAKGALGLHFGIAKSALIPKI

SEQ ID NO: 24703 - protein, 123 aa, A.fumigatus
PFLFCFPKDQRHMALLSPGSQEFEHLLKWLVSRQTSELGEEESDEEVDGSPDQSDSLHRDTSNLALNDKIAVLPNLAPPTEESLLWAGFNGRCNKYADTCYSLWNSGTLVVSIYRFCDVEHYS

SEQ ID NO: 24704 - protein, 215 aa, A.fumigatus
  UNSURE (120): Identity of amino acid sequences at the above locations are unknown.
GHYVWIFLSEFGTILLYGIMFFYLRRQMKQAAALRQNHQESLNRLNRVVVYMVIYPLVYVLLSLPLAEGRMSTARHVVPSKEYFAAAGALMALSGLVDVVVYTLTRRHLLLDTEVSTSDXYYAHTGSNLYNTHVSTTVAGPESKKSRVKSRLRRGMQSINDTVLDDRGDSTEDIVPKGPKGAAMELGHMAHGVYQETTIEITHEPVFTTGLEATR

SEQ ID NO: 24705 - protein, 264 aa, A.fumigatus
GKRPQSNYCPPDLGDVKGRSDGFISPEHRHPSGTEDEHGKNPLYLIKEEIAIMKKLNHNNLVSLIEVLDDPTEDSLYMVMEMCKKGVIMKVGLEERADPYSDEQCRCWFRDLILGIEYLHGQGIVHRDIKPDNCLLTNDDVLKIVDFGVSEMFEKDSDMFTAKSAGSPAFLPPELCVVKHGDVSGRAADIWSMGVTLYCLRYGRLPFEKQSIFELYEAIRNDPVVCEEETDDNFKDLILRILEKDPSKRITMSVLTPERDKRRE

SEQ ID NO: 24706 - protein, 71 aa, A.fumigatus
  UNSURE (3): Identity of amino acid sequences at the above locations are unknown.
GNXVLPKASYARMEINSDIQGKLILVSYVRKGQVTRLQRHGEVELFAGDLEGIYYNSQARSYPAGIFLEVI

SEQ ID NO: 24707 - protein, 282 aa, A.fumigatus
DLHPTATRDLTSPAISIGWNTFEKLDQSCVEYGISSNALTSRACSSISTTYATSRTYSNVVVLTGLTPATTYYYKIVSGNSTVNHFLSPRTPGDTTPFSMDVVIDLGVYGKDGYTVASKKIKKSDVPYIQPELNHTTIGRLARTIDDYELVIHPGDTAYADDWYLRVDNLLTGKDSYQSILEQFYNQLAPIAGRKPYMASPGNHEADCTEIPFTSGLCPEGQRNFTDFMHRFANTMPRAFASSSSSSTAQSLAAKAISLSNPPFWYSFEYGMAHIVLIDTET

SEQ ID NO: 24708 - protein, 198 aa, A.fumigatus
CKRQYCWISFREYWSLAAPTGILCTYFRSGFLRLLDCCPDSSSKEQSTNDIWRCICLSVQRAISQHNIDPTTIRGIGFDATCSLAVFSTVTDEPVSVTGPNFDSDRNVILWLDHRPVKETEKINATKHNLLRYVGGKMSIEMEIPKVLWLKNNMPKELFDQCKFYDLADALTHIATGNEKRSFCSLYTQPGDGSKALR

SEQ ID NO: 24709 - protein, 173 aa, A.fumigatus
PGYGLLMPSGDIPPSMASLPYRSFRQPSRQSSRQASMDTRDDIQIHQDHYIGIDVGTGSARACIIDAKGNIVGLASENIGLWQPQQGYYVRISDRASSVFLTVALTVRQRNNQQTISGDAYACLFSALSASITSTRLLSAELGSTRRAHWLFSPRLQTSPYLSPGRTLILTAT

SEQ ID NO: 24710 - protein, 89 aa, A.fumigatus
CGAPLPRADQRVHVFFPSEWSASNFFTAYIGIPAFLVLYFGHRLIFWSDPWAWRSEEVDMQTGLAEIIAAEKPPRVRDTWWKKLMAVVE

SEQ ID NO: 24711 - protein, 98 aa, A.fumigatus
  UNSURE (81): Identity of amino acid sequences at the above locations are unknown.
FPFAASAPIGSGIEVIRPNEPKRKSAQNRFVSSIYLVSSSGIAQSRLWDSAISRYGVTARVKLALGGSRKVNEEITRGTPXRCNGVLGSRSTPFGCLM

SEQ ID NO: 24712 - protein, 202 aa, A.fumigatus
  UNSURE (6),(7): Identity of amino acid sequences at the above locations are unknown.
PRFASXXSSPRRIRQRQRPFLNMSSWPRSAWATRLSCTPSRSPHHRPPAAPHGTCWSCPASRRSGPTSPAALQPCSPLSPSASSSRPSRRSEASCPRTWGPPRGFPRISARPLRARTTPSRLTLSQPHPRSRPIPIPQSRPSEISFMPVMPPGPTMPMRPRTLTQRLQLTRSLSDVCLNPTTSTSRALTLIPPAHLRHLLKR

SEQ ID NO: 24713 - protein, 278 aa, A.fumigatus
  UNSURE (32),(57): Identity of amino acid sequences at the above locations are unknown.
RIPEGQQQTIMAVFGSDQSIEVLAVEFSARKXYGKLRRYTTLRDVHPFSMTKICFSXFIPPAHPSTPETLPQYVKLASISMGNTVVVHTFPLAPSPPSSRTPRYVLVMPGESEIWTNFASGFAALLSIITVCILLQAFTEIRGLMPPYLGASAWLPPDIRAAIARPYHPLPPHPLPTASALSAHTDSPKQTLRDLLHARHAAGANDADAAPDADATTPANSVFVRCLPESNNIYIESSDAHSSRSSSSSPEEVEEQPSRSWDDLDEEERSAWNQRLID

SEQ ID NO: 24714 - protein, 291 aa, A.fumigatus
EHTIADPAAPLVKTSPVKMASFLAVAAYLTVIAAAHPLSTRLYPTVLRRDTTATSVEPVSAISLYYQAAANSSSIGALIQADLQLPSIVLEDVNDVSSVTCSVDSLTVTFNSTTTFNQAYSSWPRSHLLLVTNHLGNCDAEADRGLYRAASLLFHPSTLTITASTRKTNLQQQAKTITIVFGHPDPSQHKRELATSIDLAWSGDLIRTNGLTIHANHATLDAAISIDGIIAYHVETRTATTLSLDIAVALDSSLGLSVSAAGVVPAQRLHIPMEPPSKAGGFSIPGDLDSG

SEQ ID NO: 24715 - protein, 125 aa, A.fumigatus
VFGITYILASFNQRLWHFALTQDVLLGIGASMVYVSTISVALTWFDQRRGLAMGIFISGSGVGGIHCQASTPYLSSYHSLWIFRQRIHLAFPCVSDRTVRRAVLDQRERGPCTSFGGWERRSGRR

SEQ ID NO: 24716 - protein, 135 aa, A.fumigatus
RGSISVVGWPWGSSSPGVASGAFIVKRRRLIYRLIILYGSFASAYISRFPASLIELFGVQYLTSVNGVLVPHSGDGSVDRDAVDWNADSSVTALVSSIVYDRVGIDCGVLLFAATLACVPVRIDATLGEVGRWKA

SEQ ID NO: 24717 - protein, 69 aa, A.fumigatus
  UNSURE (36): Identity of amino acid sequences at the above locations are unknown.
LGNRVFVAGHSSLFTTGGMHSATIRLMAAVPQEVSXASFGSDIREPFYQFSCPRPWANPSSNAFAQNPR

SEQ ID NO: 24718 - protein, 212 aa, A.fumigatus
  UNSURE (40),(47): Identity of amino acid sequences at the above locations are unknown.
SSNDDLSRRGPGNPLQRVPLSSVRPVQASGRANALPQESXYPTSSHXAGAPRTPFASHTGLPPLPKRLLQRGLPLHPSVPGTVRDAAKDTTLLGYPIPKGTRILVSPEVINHSKELWGPDADQFNVERWLGPGRANTGGASSNYSFLTFLHGPRSCIGQGFAKAELACLVAAIVGRFQMELKDADAKLEVRRSATVAPKDGVLARFTPLEGW

SEQ ID NO: 24719 - protein, 252 aa, A.fumigatus
RIARIFVRRGEDPRRIDLSRALDRMIAVLPDEMRMQSLLRPLEATGGERLRDLGLRTRDFWALFEAWETVHLVPTDDGLYIRDDIIQYLKRHPEVAESMVRNTADIIRSYESYRSLITQLSTLLFPWTAPHFPDHIHLHTQIHSGGRGLVFSAGDNQAPFLLASIPAIRQLGCDLPIEVMYLGDRDLSQDMREQLEALPGVTTRDLSVMVNDNGWTLAGWAGKPFAILFSSFREAIFIDARFAVPAEPGRLV

SEQ ID NO: 24720 - protein, 60 aa, A.fumigatus
QNSERLINPALRRFDIPFKPISRMTTGFVAIAFAIAIAAIIQQRTSLFGHFGGRSNARMQ

SEQ ID NO: 24721 - protein, 122 aa, A.fumigatus
CQNAVIYRRPPSHVSIFLQIPVYALIGLSEFFSSLSAMEYAYTKAPRSMRSIVSALFLLTCTIGSTVGITLSPVSVDPKLLVEYVSLSIVMFATGVVFYFCFRKYNQMEESMNMIGETAGKQ

SEQ ID NO: 24722 - protein, 157 aa, A.fumigatus
HTDLHPGNLFVSNGRISCMIDWQGIWAAPLLLRARHPHLINYQGDIILKPLVNFNNLDTEEKKIIRDKMSKSIVIYLYEKQIAKEVPLLNRVIHLNHSQTRCDPIQFIGDTWDDDIIPLRESLIQLERQVQVPCRRVFIKQRSNYTFSTTEAGRPRE

SEQ ID NO: 24723 - protein, 330 aa, A.fumigatus
  UNSURE (239): Identity of amino acid sequences at the above locations are unknown.
NIKGWNNFILFALGTTLPVSRTHKLFSWQSRMKELYLHRAVEVQPCFNRDVLRDLSDRATTARLELEAWAEGENIQFDTVRPADRVGPPFGTDEEDLDAQILQSATTGSLQTLREWTAKLHTAPDARDRATRAFLAAINEYSDEVLAVLLESGLVDINAEDDINERNCLHEAAISGRDFVFKTGISAGVDVSRSDVYGRIPLHYACMHGRVDMVRELLAVGPDTVDTADHNNFTPLIHXIVKDQLACAEQLLQHNARIGPASESDHIPLNLACQHGSIPIVRMLLERNAQLLPDAEGILPQHMVARASQPPRTVASSSNSTELDLKPRDL

SEQ ID NO: 24724 - protein, 60 aa, A.fumigatus
RILELDRIHEFIILRKIENDYSLRRGAIGSISESTSREDNNGNEDHNTGKDAWKPTRFLH

SEQ ID NO: 24725 - protein, 376 aa, A.fumigatus
KRLRFCSDQKLLPKGSVNQNRAVEWGTNTMTGAALLLLKSFVGTGVLFLPRAFLNGGMLFSSLVLLAVSILSFYCFILLVNTRLKIEGSFGDIGGALFGKHMRRVILGSIVLSQLGFVSAYIVFTAENLQAFVLAVSKCKSFIDIKFMVLMQLVIFLPLSLIRDIGKLGFTALVADVFILLGLIYLYYYDVTTIVSQGGVSDIKAFNPSTWTLFIGTAIFTYEGIGLIIPIQESMKEPRRFPGVLAGVMVLITIVVLSAGALRYAAYGSATQTVVILNLPQDDKFVNAVQFQYSLAILLSTPLQLFPAIRIMENELFTRSGKYNPGIKWKKNCFRFFLVMICAFVAWGGADDLDKFVSLVGSFACVPLIYVYPVCL

SEQ ID NO: 24726 - protein, 84 aa, A.fumigatus
GIRLRTTQTTTHTHTHTHTHTHTHTHTHTHTHTHTHTHTRVRIDTLTDAFRRTEIKKRRLFRMFTYRGIDLEQYVQLSFIHAFL

SEQ ID NO: 24727 - protein, 104 aa, A.fumigatus
LGMCYRLLDLSCEQLRDVVHARARRRFNRGLKRKPMGLIKKLRKAKQEAKPNEKPELVKTHLRDMIIVPEMIGSVIGIYSGKEFNQIEVKPEMVGHYLGEFSIT

SEQ ID NO: 24728 - protein, 325 aa, A.fumigatus
  UNSURE (22): Identity of amino acid sequences at the above locations are unknown.
PDPDAQQIHRIGPTKPQTDLEXTIHNILVESGLADPSGKSTEEQVQEFEELQARKLPIEEIRARRAELRKQRDLLFREEVRAKRIKKIKSKSYRRVHRKERERLQQQERQALLEAGVDLEEEDREMNERRRAEARMGAKLKDSKWAKSLKQTGRTAWDEDARRGAAEQALKEEELRRRIEGKSVSRADEDYLGSSSSESEDEDPWAEDAGSDAEKQKLRKKLEGLERDDVDASEITGPHAKLFSMKFMQNAEAARKAENDAEIRRLNRELRGEEESQSEAESEVGRRKFGQSQDDKSGKDKKQKSLPKTEFEEAPGSDDEADAVP

SEQ ID NO: 24729 - protein, 62 aa, A.fumigatus
RIIRPLLPLPVPLKLTLFTFVTYALLDPVVIPLSIEIVLLSVASRCAFTYHVIRAQKGPVCS

SEQ ID NO: 24730 - protein, 246 aa, A.fumigatus
  UNSURE (220),(235): Identity of amino acid sequences at the above locations are unknown.
RSPAATGRTKCGSQAGNLLHSLGEHSGPVNRVVVAPDHAFFVTASDDGTVKIWDTTRLEKNLTPRSRQTYRHSSQAKVKTLTFVENTHAFISGATDGSIHVVKVDYHNVNDTVRYGKLQLVRDYQLPATEDGSVEYPLWIEHFRSDAQSTLLIATNTCRILALDMKTMLPIYSLQNPVHHGIPTTFCCDRKHNWLLVGTTHGVLDLWDLRFQVRLKAWCXPGSGAILRLQVHPTXGRGRWVASRAV

SEQ ID NO: 24731 - protein, 261 aa, A.fumigatus
  UNSURE (7),(49),(60): Identity of amino acid sequences at the above locations are unknown.
APGPSDXGTWAVGCVSSSVKSRNEITSWDIEKIRCREVYHADFARKQYXCPTEDLAAFQXINAKAKSAFVNTRDYEAWHIESDRPEGMLSRFGTEGQLSGAIESSGPSAASTPAGICAFAVGYDSPEDGKDNSTRCGFIVSGGCDRKIRFWDLARPELSTIVSGQDIVSEGGVSGKPRYELSQPLPNLLVTTEHIPGPPAASSAGSKGSSKKGGGARLPRSTVISLQQQQLLKSHLDFIQDVAVLRVPSSPRGEKDPTMAL

SEQ ID NO: 24732 - protein, 152 aa, A.fumigatus
QPCRGSSWRPSGHPCHRTCVQSDAWQRLAQTLQLSKPPLKDSLNVKDGPGRVRGVLVLGGVTNQTLFISEGDIGRSDTVSLVVGDDFNLSVLHHTDTRVCCSKIDTDDCGQHDLARELHDFGKTISKTYQCHSFPVLSLPQRVRFRKKPMAQ

SEQ ID NO: 24733 - protein, 71 aa, A.fumigatus
IVLSTVIGIDLGTTYSCVGVMQNGKVEIIANDQGNRITPSYVAFTDEERLVGDAAKNQYASNPTRTIFDIK

SEQ ID NO: 24734 - protein, 113 aa, A.fumigatus
TVHFFITFIVKELLSTPHILTMSRLSSRNGAAKPFTAWTTVFYLLLVFIAPLAFFGTAHAEEDSVQENYGTGMSWILFFRNHEVLVLNRAVHSHRYRSWNNILLCRCDAERKG

SEQ ID NO: 24735 - protein, 122 aa, A.fumigatus
VSLSMEVWIAEEFVLTSARRLIGRKFDDKDVQKDAKNFPYKVVNKDGKPVVKVEVNKSPKIFTPEEVSAMVLGKMKDIAEGYLGKKVTHAVVTVPAYFNDAQRQATKDAGTIDGLNVFSTTV

SEQ ID NO: 24736 - protein, 343 aa, A.fumigatus
  UNSURE (5): Identity of amino acid sequences at the above locations are unknown.
FGSCXCIPSEETRLNDIAGVITKMKVNHASLTPSFVGFLDPAAVPGLESLVLAGEAMSPQHLATWSHIKLVNGYGPTESSVAAALNPNMSSSSDCRDIGLPVGVRFWVVNPANHDQLVPVGCPGELVLEGPTLARCYINNPQKTSDSFIFNPCWTKRDPNGGSDRRFYKTGDLVRYNSESGSLTYIGRKDAQVKFHGQRVELGEIESQLSADTDIKHCTVLLPKSGFAQGKLVTVVSLSAGPGQALEADAVPLKLIEHREKLRYVKSIQERLSIRLPTYMVPGVWLCVEALPMLVSGKLDRKSIATWVASMSEEPEVHATEAANARAANSTEDQLVSIWSRVL

SEQ ID NO: 24737 - protein, 286 aa, A.fumigatus
  UNSURE (256): Identity of amino acid sequences at the above locations are unknown.
HTSLYVCWQLYRMPIVDSVQVNCLHEVFFEAAIEDARRLDAYFAEHKKPVGPLHGLPVSLKDQFHVRGVETTMGYVGWIGTFQGKKGDPRRGVFESELVRELRNLGAVPYCKTSVPATLMTGETVNHIIKYTTNPQNRLLSCGGSSGGEGALIALRGSPGGFGTDIGGSVRIPAVFNGLYGLRPSSGRMPYEGAANSIDGQNTILSVIGPLATTVRSLRLLFKAVLSQKPWFHDPLVLEMPWREDIEREVGALVKXSATDPSKLAFAVMHNDGILMPHPPIARAMK

SEQ ID NO: 24738 - protein, 97 aa, A.fumigatus
LKRGSVGPCGRRHAIPAKWRIQNPIPSPSELRDVTGYIEQFLTARELEITGNDAVDIVKQTTSGNWTAVEVTEAFCHRAALAHQLVRLLATIPYADC

SEQ ID NO: 24739 - protein, 114 aa, A.fumigatus
RPLNTAGIRTLPPISVPKPPGEPLRAISAPSPPELPPHERSRFCGLVVYLMIWLTVSPVIRVAGTLVLQYGTAPRLRSSLTSSLSNTPLLGSPFLPWNVPIQPTYPIVVSTPRT

SEQ ID NO: 24740 - protein, 119 aa, A.fumigatus
KTVNQNNPISRLVIIRMRLLSTLTLLVSAVAANPMFHTARQDTSATKPFHLKTADASNEKHNDLYVYAYHTGAGFNDAVLTPDKDTASTAFLNGTYTQFDLKTPFPWGFKPIAVTNYAR

SEQ ID NO: 24741 - protein, 77 aa, A.fumigatus
  UNSURE (57): Identity of amino acid sequences at the above locations are unknown.
VCQRPVQFPIRGQYYVIAAAFGKIGVLVGNYVFPIIQNNAPNDVRQGQDLNFVSSSXCIFSAFLAYFLLPLIGQVCS

SEQ ID NO: 24742 - protein, 211 aa, A.fumigatus
  UNSURE (168),(171): Identity of amino acid sequences at the above locations are unknown.
LDQVLDCRAEVTPDAQLLQSDNHVFPRRGTVLTVGKDVTELAVGEAVDTTGGTDGEVTPDVGRTAEVQFMHGTAGGLETFAGIFGSDTAGGRVSLGLKAALRFEALFAGEVEVNLGRGVGVNPVKQTDVTDAVQKDTHGDLQLGGWQVDTGDHFGGGVLDLKTKVQLXEVXLVIGVRVQVLDRTRGDVTNQLSEAEHRTLHGLETWRAWRW

SEQ ID NO: 24743 - protein, 94 aa, A.fumigatus
  UNSURE (91),(94): Identity of amino acid sequences at the above locations are unknown.
IQESWWPMPRLWESPGGGVNRYGNHIFLVGRRLFRNRVVNQKIIGGGPRSPSPSPPSFQAMERAVFSLGKLVGYVSAGTVEYLYSHADDKXYFX

SEQ ID NO: 24744 - protein, 495 aa, A.fumigatus
ELNLRFQVEHPTTEMVSGVNLPAAQLQIAMGILLHRIGDIRLLYGVDPNTSSEIDFDFSSEESFKTQRRLQPKGHTTACRITSEDPGEGFKPSSGTMHELNFRSSSNVWGYFSVGTAGGIHSFSDSQFGHIFAYGENRSASRKHMVVALKELSIRGDFRTTVEYLIKLLETPAFEDNTITTGWLDQLISNKLTAERPDPIVAVLCGAVTKAHLASEGGVEEYRKGLEKGQVPSNDVLKTVFPVDFIYEGQRYKFTATRAGLDSYHLFINGSKCSVGVRALADGGLLVLLNGRSHNVYWKEEAAATRLSVDGKTCLLEQENDPTQLRSPSPGKLVKFTVENGEHVKAGQAFAEVEVMKMYMPLIAQEDGIVQLIKQPGSTLEAGDILGILALDDPSRVTHAQPFTGQLPDLGPPQVVGNKPPQRFSLLHSILENILMGYDNQVIMNTTLKEPVEVLRDPELPYREWKRSVFLPFNLVIPQNLGRPTSKTPSKQGQP

SEQ ID NO: 24745 - protein, 154 aa, A.fumigatus
IGLYTLLNSSLPARSIWYALSTFEYSDNAFVMASMDKVFSGYYARQKLLERSDNPFSKGIAYVEGKLVLPSDARIPLLDEGFMHSDLTYDVISVWDGRFFRLDDHLQRILESCDKMRLKFPLALSSVKNILAEMVAKRGIRACPYTTGIGRNIP

SEQ ID NO: 24746 - protein, 385 aa, A.fumigatus
KHYLGFAQSEGPCADHAEDTLRKYGISAPSTRAEVGTQDLHAEVESLVASFVGKEASMVFSMGFGTNANIFPALVNKGCLIISDELNHASIRFGARLSGASIGMFKHNDMKDLEAKLREAISQGQPRTHRPWKKILVVVEGLYSMEGSMCNLPGLIALKRRYKFHLFVDEAHSIGAIGPKGRGVCDYFSIDTKEVDILMGTLTKSFGANGGYIAADKAMIDKLRATNSGIFYGEAPAPAILAQISSALRIINGEIVPGQGEERLQRLAFNSRYLRLGLKRLGFIVYGHDDSPIIPVLLFNPAKMPAFSHEMLRRKISVVVVGYPATPLVSSRARFCVSAAHTKEDLDRVLTACDEIGNVLQLKFSTGIAGGALPVFTTGLEGAAP

SEQ ID NO: 24747 - protein, 309 aa, A.fumigatus
RLVVDRTVLPESYSTTSTAIPFTGDGRRDRRTKNGPSFELTVSGGSRESSIKSPQNKALAPWVRSINPCNTSRDVLRDTSWFGRWQHAYPRPPHVAVVKWKSLKSPAILPLTTEEFPTAQELGSDYLQTPYRVFPNDDPEGVEVPKTRGILLREMISLRLSHGFQIVIGKHVAEVSGQPALETLNVFDTRSLERDGATVFLSKGNTIHRLICVDGGEIEVTRFTHRTSSTLAAGKRDGFSLYTPAMRTILSTEYELKNIKLDPTAEDYNWNYADNYVAGHRDYLFNPAQQLQFWRVRSSRTGINSRSMG

SEQ ID NO: 24748 - protein, 182 aa, A.fumigatus
  UNSURE (43): Identity of amino acid sequences at the above locations are unknown.
CKRPNGLSEQTPKIIEPEPKRVAAEAAEELRRAGEAARSFPIXTPTWTGQFGVAGRPEERPLPSAFGGRSSTARRTAAGPSSASILANLSARTPSSRSATNSPAPSRSPTGVDFMTMIRDYILSQGGAVYTQMLIDHFNRYCTTPQRSAEFKEMLKTIAVLEKGGRNGRGRWSLKPEFAKVK

SEQ ID NO: 24749 - protein, 164 aa, A.fumigatus
  UNSURE (20),(22): Identity of amino acid sequences at the above locations are unknown.
STSFRPPTSGIVRDFRSSVXAXEFVLFVKSSIFAPYFDNFALSIDPLLEKNCDLLLDSIETHHTETNNFQYYQRSLAREQQRISAWQQKRKQENATRAALKQHFLPEDEWQRLFKLPQEPSRFESMLYSRQVDQYARQIDSFVSSTTGKMFAVKGNLLPGETAK

SEQ ID NO: 24750 - protein, 86 aa, A.fumigatus
SDTGYVASHAKLVLQAGAFAAVTVDFVVYPFDTLKTRVQSPDYNRLYKDAATGAVRRSALYRGLYQGVWSVVLSTIPGCTLSRSVS

SEQ ID NO: 24751 - protein, 67 aa, A.fumigatus
  UNSURE (20),(50),(51): Identity of amino acid sequences at the above locations are unknown.
VAKVRLEIPGNSVVNFPVRXHNFHLITSLIHQLQTPNIRDRTGLPFIGGXXGVCPFRQVVYFRPLFR

SEQ ID NO: 24752 - protein, 210 aa, A.fumigatus
  UNSURE (25): Identity of amino acid sequences at the above locations are unknown.
LQSVAFQVLGRQDLPSIMAIGINQXYSDQYAIQPPIAADIPMDGYHLTRAQLAQMPDPEYAAARRGAAFTFDGEKFLRLVQALREPITSETRILYAPSFDHAVKDPVDDDIPIAPTSRIIFFEGNYLSLNKEPWSSAAKLMDELWFVEVDFETARKRLVRRHVQAGIAKDEAEADKRAMENDLVNGQEIVDNRMDVQEIITSYYDTRWDR

SEQ ID NO: 24753 - protein, 87 aa, A.fumigatus
DTRRYSLTKCLIASTTPNSHKVSSHSEPPSRVDNPVGQPTGLPMDTWKKAYKCPVDSLWTSGDAAARGQYSGTRSQEERADSERDNI

SEQ ID NO: 24754 - protein, 189 aa, A.fumigatus
KVVINGAHLNATSKVWDNRAAVLFKILRELQLYYRILCLAMSDTLPNPSGLSAKVNKKRKRQAEEAPKEDKAASAKSANNNTLEAAEGPLKKKKKRNFKNKQKQQKKKDLEDDPKQQERKGGIDESIGKMDGRLLADYFVQKAKRHNKELTAVELGDLSVPGMVISAWLRLEWVFNRGGSVRLTRLLGE

SEQ ID NO: 24755 - protein, 296 aa, A.fumigatus
LLCLNRATLLLHHSASQALNQQRLETYLSSYGQPSLDIAEHLRNSPPHHSHSRPNGGTDTPKDLAARVKIIELFTLHVLPRNEEWDYAREFINMSEVLDEERKDVFLQTLEGIKEEKEQGELRAAALQREKEAELERQTREEDRRRAEEAAAAERLEQKNQRRNDSKVDSGIEKSRPNGASKAKVGKPADKMSSSKSTPSGRTAFSPPASSKNVKKTDKPARSNRALANVLRNIMQYMSKTVAGNPLSIARTLLFMLGIIVALSRQNIREKIRRITGSGWQKIKGTVGMGVKVSYI

SEQ ID NO: 24756 - protein, 102 aa, A.fumigatus
RIKVWNLYITLLSSILELGPEEGKKQFGQKKWKSISSQVRDGQIWETVVQTGYRGLEGSVDAEVVYNLSVKPLPPPINSCTDTDFYALTEPLSCCTTLLPKR

SEQ ID NO: 24757 - protein, 135 aa, A.fumigatus
FTETSSPAVEAHVAEPPVPQTESRRVTRKPIEGDCNICLCLLREQDSDENGEGSEDRDDENEDDAAGTGSGTASDEHDAPEEHDDDDLVYCKNQCGTNYHKACIDVWHATQRTFETPRGDPIGLSCPYCRAAWSS

SEQ ID NO: 24758 - protein, 267 aa, A.fumigatus
SQISCKAMRSCQASEEQGINNNTRGSAIPVPNNATGLNVKKVRFSEPLPQRQQTFTHHQLSDNQSPFICKITNRTLRSTSDMQPKKLRMSRGFANLKALQTEEEVISQPASDDNQDQSVSKTSQQEQSANVPTTRNKAGTQRMVLPRDDNHTSRIPGNKQRTLTTTIPAGFQVSEAQPRQYWLGRFMTLTNAFHYEDSFNEPDIATGFGMLSSYSRPLGHPDANLANYRVKRAFMVLENVCVTEEASASLREFRDEYIAIHGDRWML

SEQ ID NO: 24759 - protein, 325 aa, A.fumigatus
  UNSURE (69),(217): Identity of amino acid sequences at the above locations are unknown.
LISVHSFLLRDESSIRNSLRVKVRNSQIHEAWDSHRQVSMRIPTKSSSCGSQDSNETTASSENFLERSXYRSPFDSKSVPFSSPSSSQTSSRSTSFTSSTSTSSSEHKYSKIPVPTAHPVNGIHSRETYQKEGKRSLLSSLNKRYINLRRNASNDENKSISNIGTQETEDGDLDIPTHPRLVKIAQNVRYVRPTEPVRVYRISRPVQAVQVNQPTLXTQPIQPVVPIELAKSAENVQPTAESASVCEKCLEHQSKQTEMIEQRTEVVLDSSSKKFRSSITRTTSSSSSKAALIHLTSPRSSIPVPAKVRSPAKPCAPARRRRSKE

SEQ ID NO: 24760 - protein, 61 aa, A.fumigatus
  UNSURE (27): Identity of amino acid sequences at the above locations are unknown.
RCRDTLNQMSICWERRLIGGVIGVKGXLQTAVLWTTPEFDIYMGFLTIIGSSLSDALKFNI

SEQ ID NO: 24761 - protein, 114 aa, A.fumigatus
PDPVGADIVQHGVGPVDSSVSLFINNVLRALLTPRCSNSDGHLAFHGYLAGVIYTAFPDPAATAYRSVGAPMQIFIPIRGYFPKSLNVMLTSIVYSISPRRSVYVIAIFPVSAR

SEQ ID NO: 24762 - protein, 191 aa, A.fumigatus
SLTLNWGVRVASQEEDLFNEITHVEEEISKFRSTTGNLQDYIPFLRLNPFSTNSRKAKEMRDRRDRYLNALNRDLDDRMEKGIHKPCIQANVILDKEAKLNKEELISISLTMLSGGLDTITTLVAWSFCLLSRRPDIQEKAAQAIQDMFSQDEPLCDAQDDQKCAYVAALVRECLRSEIPCLTNLRFSRPA

SEQ ID NO: 24763 - protein, 106 aa, A.fumigatus
FLFFVFSALAVDADEYALDPEVWNDPEEFRPERWFEQPDAPMLTYGIGYRMCAGSLLANRELYLVFIRTLNSFHIEPHDDVDWHPINGNSDPTSLVAIRLHHGAGR

SEQ ID NO: 24764 - protein, 302 aa, A.fumigatus
LGWPTIGPSSPGKPLKFFLLASDSNRTALRNRLAGVYGASMAIPDLTRVQALLMLALHEWGMCRGKSAWLYVGMAIRLSQAMGLPFELENEVSSRDDPRSPAFKTETELFGVRRGPEPKEQTSDDVIAQETKRRTFWACFILDRCLSSGKYRPRMIRVKELGIQLPSDNAFAFGERVRTARLNEPSARRPPSFGSQGMQIPSIRQSIGGFSDDKLPNNVPPDNKPWSPISRRKDSSEDEIDRWEIGAEESVLSRVIRIIRIWGSIAKWSCAGGRRYACIHHPPVSNPRKLNIDRTEQVPPCL

SEQ ID NO: 24765 - protein, 508 aa, A.fumigatus
ELQSSLKDWDSEPIKMETTPHAKNPSVIDCYDGITPTSVPEQWNYQILYYDPTQPSSPPGSYLSTKDSPDCSVVLVDNSTATDEWRGKFSFRMSRQPPYAFLRGHAVQASQEGIVTEQSGSSGRALACYSEDYLLSLPLNASFVVGVYPREDGASLPDGKVEIVFQSLAQGRYFMTKSVALAPFVALTRRVWQLRRRDWLGDASKTCIVDDLHSPVSGYAMAKMNGTIGYYFLTPTGIMPFANGRLGPDHSTWQDEVAMAGNANGLFSLTKAGDVYPYSKSLSEREPCNISPDHKFSDVTCTITDSFVYAIKTDRTVWRYDPTQQPGTWEPVCQTSDFKAAVLVASDAAVFAIAHPTCPPRYGPSGAVFSLLEGPSPVLIGSDQLHINQLKIASNFLVGLASGDNKMYVWNGDPGSWTDLSTAPLRPWGGVRDVVDGGSLGIVALSGDQREIVQLDRHERTWNSLGVLTDEWRLHEGTLTLCALVDDGPIFGIWNGRANFIYPPGIVP

SEQ ID NO: 24766 - protein, 74 aa, A.fumigatus
TNGSGLQTNGFYNVLGPDYIGEAFRIARTVCPGAKLFINENLVQSRPGKRQELYDFVFRFVAKDSSSPRVEDSV

SEQ ID NO: 24767 - protein, 229 aa, A.fumigatus
RNADMSHSRTMGAFCAATLITAFLAAAEGTNAFTNTGTSPLRKEAASKGILIGSGAINQTYLDNPQFATILAEQFQSLSPENEMKWPFIHPTPGHYNWDTIDRLVGFAENNDMVVKGHGLISSCCNPDYLLNITNPKLFRAAMVDHFGRSCTDTLARLIDGTLSPKHSRQMAAAYRPMAFTTCLALIISERLSVLPEQCARVPNCLSTRISSNHVRANVKSSMISSLGL

SEQ ID NO: 24768 - protein, 68 aa, A.fumigatus
PFQPRGEDYSMSGDDLSHQAWTERQHISERLSTYGDQFEALEFTTMTETLEWLPNFSGPNTVRNINDT

SEQ ID NO: 24769 - protein, 164 aa, A.fumigatus
NIMPNFQAHSLTRSTYSWLPLLFIPTNASPLFIISFVTLTYILHRPCIYCSALLLILFISSCHWADRCFFDFRGDWFSPRYATSSPYDAVSANTSLASYVAETVNTTTKALAGAAVEEAQRRLALNGSSELGQQEWTGVGLEWLRSLLGRRDWTLPCVDVKVRL

SEQ ID NO: 24770 - protein, 163 aa, A.fumigatus
AAAPSEISCQTSKPTHSHDQHIAGYRSSSSQPTPPPSSSFPLSHSHTSSTDHASTAPRCSSSSSSPPATGLTAASSTSAATGFRRATQPRAPTMLSRPIPPWPVMWQKPSIRPPRRWRARRLRRRSGDLRSTDQVNWDSRSGPVLDSNGCGVCWDDGTGLFPV

SEQ ID NO: 24771 - protein, 70 aa, A.fumigatus
  UNSURE (38): Identity of amino acid sequences at the above locations are unknown.
ILYSDHKNEITSRNDDNLHAIAADNLVQVKIMQAQSMXYEPSGACKRMSAISASYSYIDLWIWWEKKDRE

SEQ ID NO: 24772 - protein, 77 aa, A.fumigatus
VPVYEFKVDGESVMRRRGDDWINATHILKVAGFDKPARTRILEREVQKGTHEKVQGGYGKYQGRIFYTVKCRRLPFG

SEQ ID NO: 24773 - protein, 66 aa, A.fumigatus
DILHGQVSSFAIRLTLSIGTWIPLHEGRLLAERNNIIDKLRPIFDYVAGDHTPPPAPKHTSAASSR

SEQ ID NO: 24774 - protein, 154 aa, A.fumigatus
KPTHDADLIWIRCRPTIATQSWSSRLQSSRPIVCGYACKKIENYLLAADTVHEDNKLKGVEKALEEDVPEKRDFYTNIVVLPKPDGMHALKVAEEDLEIASVEFPWQPAREIDPYIGENSVLRTLMSSSGEKDWLKFRQAGSTRAWRVLRREMS

SEQ ID NO: 24775 - protein, 323 aa, A.fumigatus
GGTHFPSPRVRHGQICFEERTPAWNISLYGMPTGDEFIHYLEKWIEAPTDASCPLGGKAPYTNALVIDSRRLMTNASHFRTSHTPLRSQDDYIKAYISARRIADGISKEHGIDVFPYSKPYIYFDQYVSIVQLTGTLLGCAVAIIFVITSIILGSVATGAVVTATVVMIVVDIIGSMAIAGVSLNAVSLVNLVICVGIGVEFCAHIARAFMFPSRTIMGKTPTKFRGKDARAWTALVNVGGSVFSGITITKLLGICVLAFTRSKIFEIYYFRVWLALVIFAATHALIFLPVLLSYFGGEGRFILVVSFESFSFSPTSGLSNTI

SEQ ID NO: 24776 - protein, 69 aa, A.fumigatus
VMPILDPTVVWKKPLPPEVIAPCLLMKTTTLKNSSDALHDPMANVFACFTYERCWLIYGFVLCTFCSFI

SEQ ID NO: 24777 - protein, 138 aa, A.fumigatus
  UNSURE (66),(83): Identity of amino acid sequences at the above locations are unknown.
SPKIVFEGTTTFGYKEWSGPLIRFGGKDITIKQNSGAVIDGESSRWWDGEGTNGGKTKPKFMYAHXLEDSTITGLSIKNTPVXAINVQATNLYLIDITSITSTGMTTAGTTLTGLTITKVPGWIFGGLTSRTRRLHWH

SEQ ID NO: 24778 - protein, 117 aa, A.fumigatus
QAVISNLSFLSFLPVERFILTDQNCSVDRNSRSFIPSFIMRSVKLFGLAALGSLGAAAPAPSRVSDLTKRSSTCTFTAASQATESASGCSEIVLDNIEVPAGETLDLSDVDDGTTVR

SEQ ID NO: 24779 - protein, 68 aa, A.fumigatus
LRYFQAGVEQSEMRPTYLSPQAHVKLSSPGAFDGLRIHTDEINEVIKRITPRSLTIAVVRSPLYDLPK

SEQ ID NO: 24780 - protein, 72 aa, A.fumigatus
PICQIMDSMDWFDPEGTEASIQAQKLNHALKMDGRILLRSASIEPWYIKQFEENGFTARRVGARFPGSCIDR

SEQ ID NO: 24781 - protein, 163 aa, A.fumigatus
LSSAAAPGAGKSTFYWNHLQPLGYECVNQDNLKTVRLVYTLGEHENGTLKLDTNRDKNASKSPRSFSPPVPPSSSVGCIRFQGSASTQTHAADAMTDNTNADPNTRAEWVRVAKESNVPIRCVYFTSSPELCKHNNAVRAANRSLVPLFSSQMLETKLTVYAL

SEQ ID NO: 24782 - protein, 93 aa, A.fumigatus
HERIARQKVFGVRIGLSTMRSKTVCNIVQPFRSLYHAKWMSNMSLDVVASEKTCIRLYQKEKEKREEKKKRSMNDTVCRVYVDMYPIYPAFQE

SEQ ID NO: 24783 - protein, 162 aa, A.fumigatus
  UNSURE (153): Identity of amino acid sequences at the above locations are unknown.
TGRLCTILNVQLSGPAKSRYHWLNIFIGPEDELLLKKDELSILIRRVLREYPMLSYFQGYHDIAQVLLLVLGEKEAAPAVTNISLFRIRDYMLPSLSPALKHLQLIPAIIEKADPALREHLGGIKPFFALAATLTLYAHDIQEYSDIARLFDXIRHGPKYRV

SEQ ID NO: 24784 - protein, 72 aa, A.fumigatus
IWMDQLNLTHFEGAAHSAYLAQSRVPNIIACNVILLSIVSIAVAMRLYVRYRYFMIRSDDSKSYHSQSLGQD

SEQ ID NO: 24785 - protein, 92 aa, A.fumigatus
SWSCGPARLKTGQLVEATKHLAGWLIRSAIGTGSMADVPQNLLQQIKDFEEMFTVDKAKLKQVVDHFVKELDKGKPLSLTYFWIAPVASREI

SEQ ID NO: 24786 - protein, 175 aa, A.fumigatus
PHPSGEACPLTTRTTQQPMNVTWVMGFPDGDEQGTFLALDMGGTNLRVCEITLTEEKGGFDICQSKYRMPEELKTGTAEELWEYIADCIQQFIEFHHGEEGLTSLPLGFTFSYPATQEYIDHGILQRWTKGFDIDGVEGQDVVPPLEETLKRKVYPLLVVVVANLRTSNNVLTAG

SEQ ID NO: 24787 - protein, 70 aa, A.fumigatus
PMGLSVRSSINIPYAHYAMIYLDNMGRLKVTESPSIQEQNGTVFTPEVRERFLEILGAKIGYQRPMVRSM

SEQ ID NO: 24788 - protein, 95 aa, A.fumigatus
LTDSFFHGGRVEARADILRIHSRSMNLTRGINLTKIAEKMNGCSGAELKGVCTEAGMYALRERRVHVTQEDFDLATAKILNKHDDKEVAVSKLFK

SEQ ID NO: 24789 - protein, 79 aa, A.fumigatus
  UNSURE (4),(6),(10),(11),(13),(16),(17),(18): Identity of amino acid sequences at the above locations are unknown.
LRRXPXPAPXXFXGIXXXYTHCADPSSPVVKIALLSDSYKLEKMLPSSVDPLVSLMMVEKVPDSTYDMIGGLDQQIKEI

SEQ ID NO: 24790 - protein, 159 aa, A.fumigatus
EVIELGLKHPELFESLGIAQPKGVLLYGPPGTGKTLLARAVAHHTDCRFIRVSGSELVQKYIGEGSRMVRELFVMAREHAPSIIFMDEIDSIGSSRIDSAGSGDSEVQRTMLELLNQLDEFEPTKNIKIIMGTNRLDILDPGLLRPGRIDRKIEFPPPS

SEQ ID NO: 24791 - protein, 111 aa, A.fumigatus
YYQAALRCFPGKFGPMNRYLARVVFADTLLKETAQLEAQAYELEQRTALAAEAKSVLDSWVRYESQVKQRQQRELAESVIAKIQKELENPKVLQQILQQSVADVERKFQSP

SEQ ID NO: 24792 - protein, 157 aa, A.fumigatus
PQVGVTRLRPTLPVRSVGANLTASRSASNVPAEDPKKKAQSIIDSLPGSSLVSKTAILSAAAGLSVAAISNELYVMNEETVAAFCLLSVFTAVAKYGGPVYSEWAQGQVQKHKDILNAARADHTNAVKARMDNVKELSNVVDITKQLFAVSRVNSVL

SEQ ID NO: 24793 - protein, 61 aa, A.fumigatus
AIYPNRKNAQLLQLIPKLQNAQPLTTSSKSNNFDNPKCIYTSACATFHAEQESVASTSTTP

SEQ ID NO: 24794 - protein, 161 aa, A.fumigatus
  UNSURE (1),(109): Identity of amino acid sequences at the above locations are unknown.
XSAFPSSPAVKNKLEQHYSLTYTIVSLVFLSPLGGYALAALTNNHIHLRFGRRGVAIIAPSCHVISYIINCLHPPYPVLVVSFIFAGFGNGLADSGWNAWIGNMADANXVLGLLHGFYGAGAVLAPLVATALVTKAEVGWWYFYYIMVCPFHFPSVGVSCC

SEQ ID NO: 24795 - protein, 252 aa, A.fumigatus
IGCAVIELTTSVYCFWDDTGAVFRRDTQHSTGGTGSGGGSLRKALFTKHAGRITWLCAVFLLLYVGVEVALGGWIVTFMMRVRHGEPFASGMAATGFWLGITVGRVVLGFVTPRLGEKLAISVASSLFIFLGISCMLTVADLSHLLHRLGPHPLARSELVRFDRGRLAAGVLPRAAVPCRRGRGDQVAAAWVARHRDWLCGGLWSGRWLGAAVCCWSHCAGKGCQGVAAVCHWLAWGDYGVVDVLATDSCSA

SEQ ID NO: 24796 - protein, 117 aa, A.fumigatus
RLQIYLISSIALGLILWLVPNLYVSTVAVSLQGFFLGPLFPAVVVVATKLLPRGLHVTAIGFAAAFGAGGGSVLPFAVGAIAQAKGVKVLQPFAIGLLGAIMGLWMCLPRIPAQHET

SEQ ID NO: 24797 - protein, 75 aa, A.fumigatus
ITEGKEWKIAFRIKFRYFKYLVILFRLTNTPVLFKRFIKKVLYKVLHCFVVVYLDNILIFLENKNKYIEHIKEVL

SEQ ID NO: 24798 - protein, 78 aa, A.fumigatus
  UNSURE (50): Identity of amino acid sequences at the above locations are unknown.
LMKTKDERHPHADLPRCRAQNHPEPKGFLRSQIRATDSGYLTRQIDKDKXRFVGQVQPVEASYTYGNPIREKVVNMPR

SEQ ID NO: 24799 - protein, 161 aa, A.fumigatus
AGMYPPMGAPPMGLYGAPQPMNQFTDPNNTTVFVGGLSGYVTEDELRSLLQGFGEITYVKIPPGKGCGFVQFVQRHAAEMAINQMQGYPIGNSRVRLSWGRSQNNSGPAGSPYRPAPPPPPMYPSMGMPPAHQYGGFAPMKVGSLNNTSEAPRSSDEAQFD

SEQ ID NO: 24800 - protein, 60 aa, A.fumigatus
IQLMAGALEVQPTYNKPTPIPHHDAGTALTNDCSLPNIMGFETDLESTPCPKKNLPKTES

SEQ ID NO: 24801 - protein, 63 aa, A.fumigatus
CNDCEDSSSLRKSEKDWFNVTLANLAGMQSRASGTDSSVAFYSNFNGLPCSKTARGASTLGFR

SEQ ID NO: 24802 - protein, 86 aa, A.fumigatus
LCSSISISAASITSPKTRLRDCLNTFEEPVWTQAGTTRATTSHRSIISEYVVMRIELVLSYRWTRTNVIGSTRSTVLAPQRRSVEE

SEQ ID NO: 24803 - protein, 164 aa, A.fumigatus
KRYCAAAFQSHLHTHLYPHSTISIHVSVLSADGSLLAAAVNACTLALVDAGIPMPGLLSACTSGMSGSASTPRDPRNDFLDPLLDLSLPEEQELPFLTVGTTTAIPVGEDAMDDDDEDMKVSMMVMDSKVHCTYLETMLAVGIDGCKQIREILEGVIKGTNRGV

SEQ ID NO: 24804 - protein, 66 aa, A.fumigatus
FSSRLVDKMYGEPIEPPNEVYYIGSVNQFDKSCNRDGSFCIVDSAAFIMSCSTCKAASSCPIGTKM

SEQ ID NO: 24805 - protein, 158 aa, A.fumigatus
LAMSLPTKGEQNLPTLLASMRPTVHLETFVFLTTTQPIENLPLQSLKPEMLFQEDEGLSIITTKDLPESHGLLEYTFPCKKISLTVHSSLEAVGLIAAISSKLASHGISTNVVSGYFHDHIFVPIGQEDAALQVLQDMMKAAESTIQKEPSLLHDLSN

SEQ ID NO: 24806 - protein, 65 aa, A.fumigatus
KAVENEMSTLPSFLTRLGKTKRYGVVSSLDAKEVVRQLTGVLNIQEADKNVSRFELRGRTVFRQA

SEQ ID NO: 24807 - protein, 69 aa, A.fumigatus
  UNSURE (8),(9),(10),(13),(14),(34): Identity of amino acid sequences at the above locations are unknown.
HRCQPFRXXXIGXXNLSSKFFEFLTGRPKGWKTXGETSDDISAGDVEQVVPATNQSTKSTFLGLRNSLI

SEQ ID NO: 24808 - protein, 83 aa, A.fumigatus
SPRSADDYPQVTAFTQAKMYTQHGAQMAPPQKPETFMLSNEAQQSLPHDAQVALQQVDNCKSMICYSHLRSLCFLLVRLLSAR

SEQ ID NO: 24809 - protein, 276 aa, A.fumigatus
RHAWISRCHQLLASLGQKLQSLAPQPTLSDFPMLSLTYEELDKMVSAKLPIAGITSLDLVEDVYPCSRMQQGILLSQSRNTSVYAVHDTFEVKGVGIKPSVDRLIIAWQKVVSRHAMLRTVFLENLTSQDLFCQVVLKEYNPAPALLSCSEERDVLPTFDNQQPVNYRDPRPAHRFSICETANGKLFCRLEISHAAMDGTSISLIVRDLQSAYSGQLQEDRKPMFKDYMRYLQSCSHSAGLNYWLPYLSDVKPCHFPVLNDGRPSNKRLHGLFTSV

SEQ ID NO: 24810 - protein, 488 aa, A.fumigatus
TSSFIRRLIRNSADRLPVSALLATGLVHHHMVRNKWRSLAALVVETAEAREVHHMCVLVGYGADAVNPYLAMECILKMNREKLIRKPLSDEKVIENYKASCDGGILKVMSKMGISTLQSYKGAQIFEALGIDDSVIDRCFAGTASRIRGLTFELIAQDAYAFHERGYPSRSIIEIPGLPESGEYHWRDGGEAHINDPVSIANVQDAVRTKNDKSYEAYAKAAHEQIKNCTLRGMLEFDFEQRSPIPIDQVEPWTEIVRRFVTGAMSYGSISMESHSTLAIAMNRLGGKSNTGEGGEDPERSKRLENGDTMRSAIKQIASGRFGVTSHYLADADELQIKMAQGAKPGEGGELPGHKVVGPIAHTRYSTPGVGLISPPPHHDIYSIEDLKQLIYDLKCSNPRSRVSVKLVSEVGVGIVASGVAKAKADHILISGHDGGTGASRWTGIKYAGLPWELGLAETHQTLVLNDLRGRVVVQTDGQLRTGRDVAI

SEQ ID NO: 24811 - protein, 263 aa, A.fumigatus
VNVVVRWRRDKADTGSGVTSVGNGADNLVAGQLTTFSRLSALGHLDLQLVGIGKVVGSHTETAGGNLLDGRAHGVTILQSLATLRVFTTFAGVGFTTKTVHCDGQCGMRFHRDGSVRHGTCHETTNNFSPRLNLVDRNGAPLLEVELEHTTQSAVLDLLMSSLRVSLVRLVVLGTDSILDIGDTDGVVDVRLASITPVVLARFRKSGDFNDGTRWVSAFVEGICILSDQLKSQSTDTACSSGKASVNDAVIDTESLENLGTLV

SEQ ID NO: 24812 - protein, 292 aa, A.fumigatus
WPLEPFSHTISTCRRKLYLTEVDFHTLSWLSPNMCQNEVEVNGWTSMPANAGAIFDGGPFINVPEALSIEEIKFPVDDPIVEKTMRYAKAALPTETFNHSMRVYYYGMHDCASHGVLINRSQALGMAITKQQFPKQASALSPSTWALTCLLHDIGTSDHNLAATRMSFDIYGGIKALEVLKGFGATSDQAEAVAEAIIRHQDLGVHGTITYIGQLIQLATIYDNVGAHPYVKDFGELIHDTTRSQVHEAHPPGEWRTFFSGVIQKEQAIKPWCHTKKMVNVLRKGSQHPDEQ

SEQ ID NO: 24813 - protein, 75 aa, A.fumigatus
STSSSPGAYIVFIYIWAIIYQLSIGAVGFVLASEIATVRLRSTTQGLVTITNAAWGLIIHFTIPYMVCSGLPYRI

SEQ ID NO: 24814 - protein, 167 aa, A.fumigatus
AVPSSWLPHNSTAPSHHSPRSVDLSPTSTIQYLHCSLSPRHLIYYILPTSLSLSLRVDGSPPLRATLNMVQSPMLSCPLKQTNEIDWIRPLKDYIRQSYGEDPERYNQECATLNRLRQDMRGAGKDSATGRDLLYRYYGQLELLDLRFPVDENHIKISFTWYGFSAC

SEQ ID NO: 24815 - protein, 69 aa, A.fumigatus
RILTVVCARNSLPSDGGNAPNQSHKHEGFLKSAWHKLMNSTKNGDGENSASNSGKKESGDAEKSDKESK

SEQ ID NO: 24816 - protein, 93 aa, A.fumigatus
DFLSMRITSKSPLHGMASQLVDARLWLDGSHLLIDAQRSHDRYDAFTHKPTSQYSLAYEKASIIFNISAVLSCHAANDNAADVRFDQAEKYRP

SEQ ID NO: 24817 - protein, 242 aa, A.fumigatus
PRISSQADYDKECNEKLIHIRDTRARQAAVMQNGMMPQGPAAGMPGVGQNGFQQLNRPVQASPMPGQQQMPIGINDPTQQAAIQQRQQQQQQQQQSQQQQQQQQSQQNQAMLQQQRVQQRPGGNASLPDDLNTLSAQEYEHVCRIANQILAKTPQEDMEKIRMNLQNMTPEQRQYLTRKNMDPITYFFRCQALNQLRRHKRNRMEMARAQSAGVDPNGAMMTDPMMNPQQRQIFQNMVTLQL

SEQ ID NO: 24818 - protein, 130 aa, A.fumigatus
FEVYWAKEDHYGAHYDAGDYDRGRHSLVGESSVRGAYRVNAWWSSLIHYIFLDEPRTMCVVGEPKATNTTVLSYENAHGLTVQKYVDLGHKRSVHVYCSREKWFQLCPLFWDGRERPLESSDRMAWDAKL

SEQ ID NO: 24819 - protein, 66 aa, A.fumigatus
HRTAIHGTIRSTARRSLDDQLISFSIIPLFTFLDATTVLLTTVYYFGGFRSVCHMSFAYLSGSESF

SEQ ID NO: 24820 - protein, 257 aa, A.fumigatus
  UNSURE (80): Identity of amino acid sequences at the above locations are unknown.
YRGQMPEIPLSKLDLQVPGWGSIEARTQILIKTKVQNDGCLDRSNTPGPRKPTPNPQSLSPRRSNISCISIPTAEVTILXHSLFPPSTPPEKARLYHHLVNSRRVQPTFHVTFIHRASKTERVDIWDRYANQYIAKMKEQSQAQAHTASPVLTPTLAPARVRLERLIWDDRIMAFVARIMPPGDREQPDWPCANPIPHVTVGTASAEVKPKESNDLLRRWLEVGSGGDTGIWEAEIPGVKVVQGSVGMVMSRGKLLK

SEQ ID NO: 24821 - protein, 153 aa, A.fumigatus
  UNSURE (8),(44): Identity of amino acid sequences at the above locations are unknown.
AQDPGTDXQDPPKTEPPPPKGPVKNRGSPPEPPRHPSYPHPGVXGCQRRHLNRQPQWRRRQHRQLRRLRTPPSPRRQKVNAQKADRPDPTPQTCLFLGPRPRRPDLPARHLQGLPGARLQHALLAAGNADHQSEFLVSHAVGAFRDPGLVVQG

SEQ ID NO: 24822 - protein, 243 aa, A.fumigatus
  UNSURE (8),(44): Identity of amino acid sequences at the above locations are unknown.
PKTRERTXKTPPKPSPRPRKAPSKTEVPPRSLHGTPHTPTLAFXGANAAISIDNPNGDADNIANYGDFVRPRPQGARKLMLRKLTDQTPLHKHVFFWDRDHDGQIYPLDTYKGFRELGFNMLFSLLAMLIINLNFSYPTRLVHSVIPDLWFRVDVGGIYKAKVGSFDLGRVEMGADERYAMQHGSDSGTYDPEGRFIPQHFEDVFAKYDRDHDGALTLGELFEMVQGNRCAMDPFGVGLFLLA

SEQ ID NO: 24823 - protein, 99 aa, A.fumigatus
AELRANGYKMTQNEEDSLIRWILSMDQRGAAPRPSHVREIANILLAQRGSTPTQTVGEKWVYNFINRHNEIKTRFSRRYNHQCAKCEDLKIILEWFNYV

SEQ ID NO: 24824 - protein, 102 aa, A.fumigatus
SDSSVERRSDLLIMYLSPTAFLLCPEDGSSCPLSTVLMFDNFSSPALVCEFPSTYLPFIGDLECQAVFYVLFFKIQNDATMHGVLLKRNGVYLACSQQSHAL

SEQ ID NO: 24825 - protein, 109 aa, A.fumigatus
RLWSKIFRWEHDPAWAITSKLLISKHQQVQLLEAASVLVNMNQHAPSESAEAESDQSSASPDTSSELRDGISSAETTPPPMDEDDENEEDMEMSGMPVFPNKRYSVGVF

SEQ ID NO: 24826 - protein, 200 aa, A.fumigatus
PRCYWSEECHHHWLLQMPLPRSPPSMKDTNGEPIGVPMLLHRRSSTRRGLESTSVGAPSGFGHYLSRSMNSPSQEPAVARKPSPNHSNIGASSVAAAGGEESSSDNKPVNTKSRNRRASEGSHLVKGEGKRALAELRCDRCGKGYKHGSCLSKHMCVYSPPKCHPAAWIESEQCAMSALLQGRPRGHAAPLVSPDPFPPL

SEQ ID NO: 24827 - protein, 69 aa, A.fumigatus
HTTVGSVQDYISTNQLAEYSVRDVGWITAILVFLTLFLGVQVGPLFDRYGPRILLVCGSLAQHHLLYSG

SEQ ID NO: 24828 - protein, 60 aa, A.fumigatus
  UNSURE (45): Identity of amino acid sequences at the above locations are unknown.
LRILLYIPNLNLSTSISRYISIHVWLSSETISKRINININAHLHXFTDERQAQNLKNPNT

SEQ ID NO: 24829 - protein, 165 aa, A.fumigatus
VLFLSAMKLSALLQPLVLGMSASAAARPSKPSTYTEPYRPQYHFSPEKNWMNDPNGLVYDAKEGVYHLYFQYNPGGTTWGAMSWGHATSKDLMHWTEHPVALRAKGFPDNITEMFFSGTVVIDERNTSGFGRNGNTPWVAMYTSYVSVLYSLVLIRTNLRFLRAA

SEQ ID NO: 24830 - protein, 124 aa, A.fumigatus
GFGIGYIIKDDYISICASSKHRQTARLMQTLESYLYEIRKLLRATNSKAVSPRTSRAREMEMVAERFQNDHRRGRLVRGDSGLVRRGTDTPTTDSGDIEDDGMGGCRSLSRSYLFSRHLLTMTV

SEQ ID NO: 24831 - protein, 300 aa, A.fumigatus
ATMVALQNALAYHEPGIKTILIQTSFLLALNWVNTLLDKLIYCGLIGQLLIGIAWGVPGANWLELDVQKTIQQLGYLGLLLLVYEGKLIAEAPADTVIFDEIVSTGGLSTSFSQLKSNIGLSSMVAITGIAVPMALSFILMSLLSATPLQAFAAGASLCSTSIGTTFTILSTTGLAKTRLGIVLGSAAMMDDVAGLVMVQIISSLGSANQESSFDPVVVIRPIFVAVGFALGLLLIWRFVVVAVVRKYQAHAIRIPGWMRSLNVALVIYMLYLIGLVTSAQYAGTSGLFAAYLAGASISW

SEQ ID NO: 24832 - protein, 317 aa, A.fumigatus
EDIRDVFAAKGFLVDVHLPLDAETRKHAGFGYLYFPSIHAARAALDALQGTHIDGHSINLELSDHSPITSLHRDHPSELDHARRPSELHSSASPSSGIQPERLEVGQDLKAREARPIPLSVTDLCSSNESTDHEPKGNNILSTTPDNFPRLTRDLEQSRFPPLSQIDARVLTHHRRDPDTSMLGASAPACDASHGNDASGRSCQLQGTPGSFPDDDSDGTRSGPLQELAQTSGAGHDDHCKPRRSKSMRYLNRNGDKSPSRALRRRATERHSLRHGTRNSVGGFHDEGCAYDNYSNTSGYSRPRSPAASQEKISVPG

SEQ ID NO: 24833 - protein, 242 aa, A.fumigatus
RRSSSRGEESVRHSAPTFDLPYRPHPWRRCHSHHHHPHPHSRPHPPPPPPHSHHDIPHPHPPHLPHHYHQHQPRPFPPPPPPHQHHHMPPPPPPPHPFHPSHTPRPSWGAHGPFRPSFPPHPRAHDHGSWRSAWPFFWPHQEYQSEAPTVAMDQLPDATASAPRPADAVLFIGNVRFNVSEKTSEMYSLRKGSLLMSTCLWTPKPGNMQALVTYTSLQFTRQGRHWMPCKVHTLMVTLSIWN

SEQ ID NO: 24834 - protein, 134 aa, A.fumigatus
QLSALQTDTPGAARKMATRSAMIHDREHADEVEMMDGRGRGLPMMGAEYARDGTGEGGEGGEAYDDVDAVGEAEERDEADVDDSGGEGEEDEDGEYRDGCAEEGAADGDENEDADDGGGNDNGATDEVYKEDQT

SEQ ID NO: 24835 - protein, 247 aa, A.fumigatus
GFGGGPGRKQMGPRGFGGFQAPAMLSQGETKTLKSLVGTVCGVTPLVTDFNREYKHHIYQPCMPHVLNALTRQIDMANRTDDFTSWPWHSKWMQSVTEGYDKQNELTPRLGFKDILAKEQLESPSAKHWPVQSKEINYYGYPDTELREYFRDAIDDAERERKRLFITHLTGTTHHPWGMPNNSYQHFMGDKNFKAKDDLNKYLNTIGFIDNWLAEIMDILTEKGVADETLLVMAGDHGLSLPNDGGV

SEQ ID NO: 24836 - protein, 476 aa, A.fumigatus
LPDAIPFSLGRVRQPWRQLMQDVSPSFTSSPTSTMTTISTTTAATAAAAPKPDKPRKLRSACDACHRSKTRCSGGNPCTRCHEYMSPCTYSYSSRCGKPKGARSRKTLEREQRVAAAAESARIARNPSALASLPATSTCTSTATTAAAAAAATTTTIATTTAPSQGPAVDSAAAAAAATTSTVASPRADDCLGLFDDDEESNPFFSSGSENTGGTSFSPDWIPPLPSISDSDLSFPLLESCLGPDHDCNDSLFWSTTAEPDCQPTSKEPLDPRSKLLRSCKCLQTLSSLTARDIRRFDATFVFVRNYARAFSAFYHCSHCPKDAGSISMAVTALQLATTALEKTATAGTDAAGFKSGCSGMTAADLDEDLLTPGAEFFLPANGRGASNPAFQLGSYQIAPLPGEPDVEEHSEILNVLNPVRGAAAYWAAAGNFGIAPGGRFPPRARGIFLEPFNRSSSSSSSSSSFSSGSEIPPPL

SEQ ID NO: 24837 - protein, 214 aa, A.fumigatus
FRTKTKVASNRRISRAVRLLRVWRHLQERSSLDRGSSGSLLVGWQSGSAVVLQKRESLQSWSGPKQDSNNGKERSESEMDGRGGIQSGENEVPPVFSLPLEKNGFDSSSSSNRPRQSSARGDATVDVVAAAAAAALSTAGPWEGAVVVAIVVVVAAAAAAAVVAVDVHVDVAGSEARAEGFLAIRADSAAAATRCSRSRVLRLRAPLGLPQREE

SEQ ID NO: 24838 - protein, 62 aa, A.fumigatus
PSFPPPFSRPVPALIDFPSFFSPPQDARGLAFSACSWHLDHFSIILFPRRLSSTLPRQPERQ

SEQ ID NO: 24839 - protein, 547 aa, A.fumigatus
  UNSURE (504),(518),(534): Identity of amino acid sequences at the above locations are unknown.
TIWMEGGFSKFFMFLKQNPRDPSADKFRMPCAMMLLYAFELMLRDGLTAATFKDIQEEIEAVFEDGSDKHQHRATAEILGALISSVADTSVEKRTLVWEYAFPIVQRIFTDGLTPENSGYWTTFLHMVLQCRDPRRAWPLVDWLASFRLDMTTNAAFKESSKINLLHQCIIDAGWHFQLEKPIVQDFLAHLDHPYKGVREAMGQTLATIYRTRYHESYADLQRLLKAQESASPVGSYAYLPTEEFSKMVRDVFARIEKWRHERSPGQQTPSSYTSGSKTVLLWLDSTLSSYECTQLVPFFPDVFTGQLLHMMDVKEDPELQSLAYHVFRHLPNIPYPAEQDSGFIKSLILIGQTSPSWHQRLRVMINIQIIYFRRLFLLSPIDRDKLFDCVANMLEDTQHEVRAGASATLSGMIRCSPVSLRQRMVSRLQERFTRTLVENPLPKKPKNHARSALASPVSSRSGTPTPEHTRLIIVRHGAVLGLGALIQAFPYDSPPPRWMPEAXTTLSNRAASDPGIXGSSVKSIISDFKRTRXDTWHIDAKVSDER

SEQ ID NO: 24840 - protein, 95 aa, A.fumigatus
VLCTWLRWSTNPLTHWLGSTAYSLSAGGSLIHPSIPGILLTPICPHTLSFRPMVLSDSLLLRIAVPTGSRSSAYCSFDGKGRVELRQGDYVTVET

SEQ ID NO: 24841 - protein, 288 aa, A.fumigatus
LVLQSPCFFHRRFDDAVNIQKVLEEISDDEWLSHSRLVQTATGVREVSKQLQRRPIKRAVKNVMIVTKARDNRLVYLTRELAEWLLSTPRYGSDLGVNVWVDSKLRNSKRFDAAGLLQSEPRFEQMLHYWTPDLCWAAPEKFDLVLTLGGDGTVLFTSWLFQRIVPPVLCFSLGSLGFLTNFEFENYKSHLNDVMGDVGMRVNLRMRFTCTVFRKDRSKGAQAGAVEEGEQFEVLNELVIDRGPSPYVSNLELYADNDLLTVVQADGCIFSTPTGKFSALGSDGLQIR

SEQ ID NO: 24842 - protein, 68 aa, A.fumigatus
RCILGLSCLFIGIRPLPQFLKFLFPAERSCELSHTGITIAQKKDIVGTRPHTSHPFHVNQYSRDSLTT

SEQ ID NO: 24843 - protein, 141 aa, A.fumigatus
NSNALQRLHPKMADGKLRGAILVVSDTASQDPSTDKVGDTLTVSFTAGGSNSWDPPVIRIVPDNVLDIQRTICNWTDGPNWFNLVLISGGTGFAVKDNTPEVCYAAFGGPKRQTDNLYRLCHLSSIAMRLALCKPTAKVTY

SEQ ID NO: 24844 - protein, 241 aa, A.fumigatus
  UNSURE (225): Identity of amino acid sequences at the above locations are unknown.
HRVRLEQSFYSVQQLTIPSVAMMSRPVAGVRNKSLLITLPGSPKGAKENLEAIIKLLPHACAQAAGANSRALHAGGVKKLEADAGIASQSQSSGSKVQSHDQHHHHHHHNHGHSHGHGHVVPRAHTSPSQRPQSNDPNAGPNRRYRSSPYPMLSVDDALKLISQYTPEPAVIEVPVTPSLVGSVIAEDVYAGEAVPAYRASIVDGYAVIAPDSPTAEYSTRGIFXSGLHHPRESRRDAVAP

SEQ ID NO: 24845 - protein, 72 aa, A.fumigatus
  UNSURE (65): Identity of amino acid sequences at the above locations are unknown.
AGFKSKQPASKSAGDKKNQGDLAGGMNNLSVHEKVAVKSKNLDVLSEYHKSQRKRAMNFAVIGQXSSSTPQW

SEQ ID NO: 24846 - protein, 286 aa, A.fumigatus
HTAKELETLPQSDQQGIAHAWSIFSAAPAKHRKLILQGIMAQCCFPQLSFISATVRDLIRIDFLTALPPEISFKILCYLDTTSLCKAAQVSRRWRALADDDVVWHRMCEQHIHRKCKKCGWGLPLLDRKRLRESKREIERRAATWDVSKQPAGIEGSSATIETAAAGSKRKPESGKEDTAMVKRQCTSIVSQSEQNEDYFKTRYRPWKEVYKDRFKVGTNWKYGRCSTRVFKGHSNGIMCLQFEDNILATGSYDATIKIWDTETGEELRTIKGHQSGIHCLQFDDT

SEQ ID NO: 24847 - protein, 118 aa, A.fumigatus
LISGSMDHTLKVWNWRTGECISTYSDHRGGVVGLHFDATIVAYGSVDKTVKIWNFEDKFTCLLSGHTDWVNAVRVDSASRTVFSASDDCTVKLWDLDTKSCIRTFHSSPRGWKEPRTG

SEQ ID NO: 24848 - protein, 65 aa, A.fumigatus
  UNSURE (4),(13),(18),(20),(21),(27),(42),(63): Identity of amino acid sequences at the above locations are unknown.
TAIXGTGGKGLKXGEKPXNXXLESEYXIYCFSSLKLMASWFXLMLTNIHFSTGSEKLLYPFGXLI

SEQ ID NO: 24849 - protein, 74 aa, A.fumigatus
LWCQCTGSRRLKLMGSYLASHVKICLVVARNNTCRHWNMVSRQLIGSSKIIDVQKSAHINVGGGGIFADASKRY

SEQ ID NO: 24850 - protein, 288 aa, A.fumigatus
HPSQVAHLCAVQRVKGGGELIPEAAGAVSTDMPGVIMDNATTGRPGHAPDTQTPSNGDNLRNGSFHINGAAKGDKDHDPDKESYAGKPRIDGHRALPEIPHITQGFFPFSTLVNRSVQQCWNELSDLITELAAIHVSPHSSVPLLPVNGKSPGNQSPENVQKKLRILDFAHAKRAEFIKLLVLSQWSRRARDVSKLIDLQNFIRARHQAFVDALQRVGEMKRDLVQAQVANPDLQTALEILSKGRLESLADVSLVCTHEAQHLLTQSCLARLQVVQTSNTERSFETVA

SEQ ID NO: 24851 - protein, 199 aa, A.fumigatus
NWYPALWPAVSKASKAAPVTEVARESISVAQNVASSMTTSSESLLHTPKQHRNPSLQLTKKKGASTRSLPADATTTKVNITSDGSASTSALDSQFDTAGPAPNLAQKEGSSEEAAGATDDKNGEQLKQTTDTSPSGACTGVVEPGQAQSSSKPASGWFSWFYTANSAEESSSGAQSERARETESTPTEPSAEEPDAEEL

SEQ ID NO: 24852 - protein, 62 aa, A.fumigatus
FWLPLGLPVKSKADKCVFLIRTRPGERVAKRRRCKSRIGSSHKITQAETIKWFKNRFDGIVR

SEQ ID NO: 24853 - protein, 74 aa, A.fumigatus
CANPSSPVVKTPCQDAKGSRFPHQPTHTLLHTFRTFDSSTQRVDQSNAKSSRHGMLPAFFYKSPLQSRKKSFFF

SEQ ID NO: 24854 - protein, 124 aa, A.fumigatus
SSLFRCRWDDEEGGGDGRSKKNSERLGNSMADGTTFLQTIGKARYTVRTFGIRRNEKIAVHVTVRGPKAEEILERGLKVKEYELRKKNFSETGNFGFGISEHIDLGIKYDPGIGIYGMDFYCCM

SEQ ID NO: 24855 - protein, 66 aa, A.fumigatus
YSATHDIDLPFFQISRAIMLNETVTGKAVNLHSDDRLRDIDMPPMHRINIYKTFLPQGPKERERGE

SEQ ID NO: 24856 - protein, 80 aa, A.fumigatus
TLVMPRSVPVTHQHHLTLRESYIDWIYDNLIPETPNAYTCYLMHAQSDMGYDIGHTAIGNNIQQPTILTYRFFKSAAQLC

SEQ ID NO: 24857 - protein, 116 aa, A.fumigatus
VGDLRREEPDITFAHIVDERFPILIDGLTVSDINEKEGKTYLDTTGSIEDKRPLRRDMPMQFPIRMGLKSHVNPGHGCCVRHDVRVFLSSPSSPVLAESTYKQRPSSREYKPTYYD

SEQ ID NO: 24858 - protein, 136 aa, A.fumigatus
  UNSURE (114): Identity of amino acid sequences at the above locations are unknown.
PSRGVPHSIQAFNTGVEFLLVFDDGSFSEDNTFLASEVFAHNPREVLAKDLGVPIASFENLPEDELYIFPGTPAPKDIEAQNVSTAAGIVPRTQSYSYHFSEQPAHEVAGGSVXIVDPVTFPIASNFSAAVVTVKP

SEQ ID NO: 24859 - protein, 204 aa, A.fumigatus
  UNSURE (27): Identity of amino acid sequences at the above locations are unknown.
QKPHWRMEQIFCGWRERLFVQFSRPAXSVDHMCFLLEEENALFNGDNVLEHGISVAPDLGRYMESLELMAKLGCVIGYPAHGAVIDDLPSKLEEYIRHKEMRVQGILSVLVKERERVEGERGKEGRRKGGMTLHEIARAMFGTVPDEVIDQAMAPFLMQALWKLTEDGKVGFEPGDPVKRKWFAVARRKTRPSIRRQHGSVTSR

SEQ ID NO: 24860 - protein, 178 aa, A.fumigatus
PAQVQIVLKLGSVRRSRLAGVAYSIGPEWLPPRTIQRWPGKLISELANKVPTAIEYESPSHSVKSWGFLCNTEDPASDIKEYFKLHLAPGAHQGGKITRAEAQRWLQDYIRCVSQHVTAHFRDTLPSFAACKVEWVFSVPTTWKDVRMVEETRHLLQRAINMSSPGSPVFTTGPEGPA

SEQ ID NO: 24861 - protein, 510 aa, A.fumigatus
MHDQIKIKLSLVIDSLSKTFPDSSRASADLWKFAKVHDRRNYQLIRFAMNVTSDYRTVVKAIRELARRIQSSNNSSLLETFTPLLYRSSSLIFNRSHTPAIMELSRTDEHGLANPAHEILREISSKNPEVLEAQVQEMCKDLESQAPKATTTAAGGTEEILKACSGFARKLADKLPKERKFLQALRSYALHSPSPRAAKHAVSILMAVADKKEMYAKDLIQACVSKWKYGSDRFLTKLATLSQLNLLAPSEADEESDAIISIAVNQILLTNRSPEPDAGYSWSDTVDEETAAKEWALKIIVNRLRAKKGSDGDDDFRAHAVPVFETLNKLVANEGELSKKKDTPAAQKSRLRLLAAKSLVKLCATISLCDQLLRPLDFNAIALVAQDPMLPVRSGFISQLKKRLVQRSHLSYRWYIVPCLLAFEPNVSLKDSTLTWLRSRAAFFSQQVQSSGQKETIMESIFSRLLSLLAYHPDYPSADLDEATQVRDLTDFARYILVFTTGLEGSAEEQ

SEQ ID NO: 24862 - protein, 277 aa, A.fumigatus
RGLPSRGEDTAIPIPQTVTNGIELSRVLQNSYTTALILEDDADWDVALKMQLREFARGVRLLNGEENAPKTAPYGTDWDILWIGGCASGPGANETTFFAIPDDPTVPSPDKRDGWGGPLETWKQQYPNLPIGTTRFLYRAEMGCCTYGYAVTREGAKKILAALSVDRLDCAVDNAMSDLCAGTNGRRQLKCFATFPNLIGTYRHAGPASRDSDINGGDDASWHEAQAWNMVYSTRLNIHQLVAGERQVYSQHENEKSGAITELDLAEIHYPRGVLVG

SEQ ID NO: 24863 - protein, 72 aa, A.fumigatus
ATPPKQLRGFQKLMLQPGQTGRATFKLTRRDLSYWDVQQQKWVVPSGTFKVYVGSSSRDIREEGSFRVRRGW

SEQ ID NO: 24864 - protein, 192 aa, A.fumigatus
YKQFWLNPRGASLQWLGLLYAIFALAVSILNTIEEPVPHSLGDHQAATTRFRKRTVQCLVQANYITPGRYKVEALFLYTMGEFLTSCDAQAGVSFMLGLTIRLAMRMGYHRDPRNFPKMSAFEGEMRRRLWAVVSQLDTLISFQVGLPRTIQAWQHDVELPRNFRLMKITMRIRKNSHSLGQKLSSLRCAIP

SEQ ID NO: 24865 - protein, 70 aa, A.fumigatus
LVSKFDLDERLVLLLDLPGFACFGYSGFSWDRSGDSEAEAALFSKSSKRRFSILPVASGDCQNTFSAPMS

SEQ ID NO: 24866 - protein, 94 aa, A.fumigatus
ASVNLSKPSWLYTCYCAFEIAEHTFLFLHKMHRSSNNSYHQSSSSRSSSAHSSSSAFSPNANPNEDWTKISDLAERRRIQNRIAQRNYRKQLPY

SEQ ID NO: 24867 - protein, 90 aa, A.fumigatus
FLLQQHDDLLNILARDHFQGDTERFAPNINVRARKNPKNFHGKIIQNALIATSKLINSVEYNELDIVVGFLDAEFDQFACRSFYGHWVTG

SEQ ID NO: 24868 - protein, 129 aa, A.fumigatus
VPLNRSSSNLSYRPHGHASNIATHMLEKRQFGAVASIFQHSESLIPDAPELIQTFLESETDSTCKRNAFAALMSISHQKALEYLGTTFDSIPNTDELLQLAELEFIRKDAVQNTQNKVGLLSYMHYTRR

SEQ ID NO: 24869 - protein, 149 aa, A.fumigatus
KGKYLRLIFDLLEASTSTVVYEAATSLTALTSNPVAVKAAAGKLIELCIKEADNNVKLIVLDRVDQLRSRNEGVLDDLTMEILRVLSSPDIDVRRKALGIALEMVSSKNVEEVVMLLKKELGKTVDEQYEKVGIVLVCSKNRMLTTYTE

SEQ ID NO: 24870 - protein, 114 aa, A.fumigatus
STLRETGIRNPLGAFPNPDNSFPFCAPAMVNSPRTSQHPQWKTFRANIFRVCKVSPVEPEFIEPILSSARSCLEHRHAYVRKKAVWGRGFHFPTLRVSNPRRARVDSNIPRIRD

SEQ ID NO: 24871 - protein, 89 aa, A.fumigatus
QRTQNSEYRQLLIQSIHHCAIKFSEIAASVVDLLMDFIADFNNNSAVDVISFVKEVVEKFPKLRASIVDRLVSTLVFTAGLKGTAVQID

SEQ ID NO: 24872 - protein, 102 aa, A.fumigatus
ITKTESLNSGFMHPFSILTLGIFVAGYITARWDLVTRLYELAIFAWDHGVVVSASQFAQPVLRAFVTAEHKTADAKTIELITLVRRHEQPKAFRCCQSFFSS

SEQ ID NO: 24873 - protein, 317 aa, A.fumigatus
RPRKQDRRGCEMVKPSSQIHRAWWKECSVYQIYPASFKDSNDDGIGDIPGIISKLDYIKNLGVDIVWLCPSYKSPQVDMGYDISDYYSIADEYGTVADVEKLIEECHKRGMKLLMDLVVNHTSDQHEWFKKSRSSKDNPYRNWYIWKPPRYDEQGKRHPPNNWISHFQGMLDWPKKLSQILTEAGSAWQYDELTDEYYLHLYAKEQPDLNWEHPPVREAVHDIMLFWLDKGADGFRMDVINFISKEQSFSDADVKDPQSIWQWADKYYANGPRLHEFLQGLGQILTDYHPFSVGEMPFVQDTEDVLKAVRFDRHEIN

SEQ ID NO: 24874 - protein, 138 aa, A.fumigatus
AGSVGVVFVGPLPDTLGIFDIGVREALLLADKVNHVHPKSVRSFVQPKQHNVVDCLAHRWVLPVEIRLFLGIQVEVVFIRELVVLPSASCFCQYLAEFLRPVEHTLKMRDPVIWWMTLSLLIVPWRLPYVPVAIRVIL

SEQ ID NO: 24875 - protein, 202 aa, A.fumigatus
SPRFRTIQFLLTTIMSSISFFSESYRLWIQSNFWLMMVSVFGALGFMLVMYWKRKSYPANLLFLSAFTLLEAYSISVVTSFYDARIVIQALILALGIFVALTLFACQTKYDFTNWMPYLFGALWFLILFGFMSAFFPYNSTAELIYGGLAALIFSAYILVDTQLVMRHYHVEEEIAAAISLYLDILNLFLAILRILNNQNNQ

SEQ ID NO: 24876 - protein, 293 aa, A.fumigatus
LNAPSTRGEDPRSLYETHGLCSAHFRHALQDAATRFNALTPGSDIRIAVTPYDIRGGHYPDFRHLRKTQTPLSEHSIDAILITGGAPGVYEIDKRPWMQTLAKFLQTVFREYPAVRIMGTCFGHQLIGHALVDSGAGDVYVEKCPLGREVGIHTVQLNRDFVDAFPLALGHLPNGQLKIQMFHGDRVMVKGGTEGVLPETAAVSLPAPWVNIGSTPLCPIQGMYYPGRVLSVQGHYELDACGMQSMCLEFAPLLGWTDSKLGLFLEQVGDDYNGRQDDSEAFALAVVCFLAGE

SEQ ID NO: 24877 - protein, 83 aa, A.fumigatus
RFILIAVILVPFTLFGTSYVYSKPFFTGWVVVSLIWIWASVIICVVYPVVESAGALGDISRGLWMDMKALTGVKKQSLQTNAV

SEQ ID NO: 24878 - protein, 62 aa, A.fumigatus
  UNSURE (28): Identity of amino acid sequences at the above locations are unknown.
HPVVEAVRLSRGIWRHPLNFEDQSGYRXSRYPKPTCSTPTRPPMCPNVIRNFSKGYMLHFNF

SEQ ID NO: 24879 - protein, 153 aa, A.fumigatus
PNCAQNPNDKSATKRSLEYWIELAKLLERGGINALFLADTFGGHDTYQGKLDECIRRAAQWPVTDPSIVCLCPALKHSTLLTLTAQPISAMAAVTKHLTFAITSSTSSEAPFLLAKRFSTLDHMTQGRFGWNIVTSYKKGGVQGYRAGQVHRA

SEQ ID NO: 24880 - protein, 118 aa, A.fumigatus
QECRCGRHMVRHWRRNWSVADLVRFENTYPGVRCDIPAHVYQSGFEPNTQWTEEFAQGHEIREYWQRVARKYDVYKYLRPRQKVQKVVWRPEEAKWEVTLQDLESGKVFSCYSVNKHD

SEQ ID NO: 24881 - protein, 312 aa, A.fumigatus
  UNSURE (96): Identity of amino acid sequences at the above locations are unknown.
VYEEKLDVVINAIGHFNAWKLPDYEGINDYQGDLFHSSNWNHNVELKGKRVALIGNGASGLQVLPSIQPIAAHVDHYARNRTWIADSFGTTGVRRXEPNLFSPEQLESFKDPEKYLKYRKSVEQGYFSRFGAIFKDSPENKELREKWTTLMLQRVGNKPELADKIIPDFPPNCRRPTPGPGYLEALTKDNVSYIQTRIKKFTSKGIVTEDGTEREVDVVICATGANVDHAPPFSIIANGIDLKSAWKPDGLYGHPYNYLGVATPGFPNLFWIGGPHSTGHSGSVPNSIENLVTYVAKFVRKSLHRRGRRNSA

SEQ ID NO: 24882 - protein, 113 aa, A.fumigatus
PAAWASGKSSTDKRVIMSTNGPIATEMPFQNGNLADKNGIISQVKSVEGDEPHPPVRPSFELEEHPIDEVRQIKVGVIGAGLSGITAGVLLPAKLPGLDLRIYDKNADVGGTW

SEQ ID NO: 24883 - protein, 94 aa, A.fumigatus
VVSSFYALRVRSLENECTLSLLLVHFRFYTNFVCPSVDRDVAERSILIKNMLEDLGESDEAIPIPNVSLICTLFLLVSVFYSNSILLHRSTRWC

SEQ ID NO: 24884 - protein, 65 aa, A.fumigatus
SFHSKLLLTPAAESDHDLDTKKIVKMTTVTLTSSDGVDITVGKLSRPSMPFVSGPWKMNALYLYF

SEQ ID NO: 24885 - protein, 78 aa, A.fumigatus
  UNSURE (26),(49),(77): Identity of amino acid sequences at the above locations are unknown.
AANYLDIKALLDVGCKNCANMIKGKXPEEIRKTFNIQNDFTPEEEDQIXRENEWAEEVSFTSLTASNGPIANRADPXR

SEQ ID NO: 24886 - protein, 74 aa, A.fumigatus
LYPSSQVNEVVLKKVIEWCTHHKNDPPSTGDDDDSRRKTTDIDEWDQKFMQVDQEMLFEIILVCTRLSTLPAEK

SEQ ID NO: 24887 - protein, 104 aa, A.fumigatus
YVATTPPFSVALNQSSCVRPRGAFACNTVTMVQIASIGAKGAQEKVQIAQAEAPQFEKVDWKREPHLRKLYMLSAALMVASATTGYDGYVLCCGERSAGLIAVV

SEQ ID NO: 24888 - protein, 223 aa, A.fumigatus
YACQYFADDGQLDPFLLPQGEGEQLAGSPGQHVQYWCHSQLLHYVCSPVAPWPLRQGDSKFLTATSSPYVADHLGRKIAIITGCCFMVVGGVIGCASNGYNMYIASRFILGFGNGLAQMCSPLLLVEIVHPQHRGPVTTIYNCLWNAGALLVSVIGWGTSYVASEWSWPSITLLQIVPSVIQLMFIYCKSSSGTRVVPIVMANRNGPQRIPESSRFLHQQRTA

SEQ ID NO: 24889 - protein, 176 aa, A.fumigatus
VVNRATERVKRYSNWGILSFMYPTPNEVNFCFRQHILSHAPHTSATPPKHTQGNGRLERQTTVAGRRHHPRPAASLRCQRCTHPSSPTPTTALPPRPQPPAHQTRNPRLGLTPASPDPLPPGPPLRSHPKRCRRGLPKDNGTLRVRPRNGNQKSPGRVLRRNQQRGEGRTGADPGG

SEQ ID NO: 24890 - protein, 339 aa, A.fumigatus
YLPMYTVPDGPEDKWSIGLPNESSATPIGVYYLSCTPHQTRSTFASDNIYYPTLLTPLQPHQNTRKAMADSKDKLLSQVDDITPDPPPAYDASAAPTPRLPRPPPLSLPVLNHLRTKRVILASASPRRRQILSLLGLPFEVIPSDAVEDFPKTMEPFEYVLATATKKAQAVYSAEINNEEKGEPALILAADTVVVDNLSGSILEKPRSEAQHIAMLKMLRDNRMHKVYTAMVAMAPLESARQPGYALETHIEETDVVFDRDVTDDLIVAYVRTREGADKAGGYGLQGLGSILVESIQGSWDNVVGLPLKAALKLIEKVMAKADDDNGDEMLEGDEEEEE

SEQ ID NO: 24891 - protein, 134 aa, A.fumigatus
AQDRAPNRFTPPLPHHPPTFRPHYHHPPWPSPSQSTSEPPSTANPQHYPSSPEYSPQELTPAPVTHTPRPYPPPPSSAHTPQSDHPSHPDQTPHPSPRCASQAHTPAAARSPAAPSPPSQCKPYACDYRAASSA

SEQ ID NO: 24892 - protein, 249 aa, A.fumigatus
QLRRNHRKMSLNTVTSGLNQDLPTDSVTKTASGTVNSTADHITDQTIPGEYPSDDTDTEYDKPAPDISFSSIWSASKTWLFSLFPNVLDRFENWIKALVAWVLPPPRQAKMYEAILNRPIASSFIICQLVCCGVPLLVFLAGVFLFAAVAVLLWAVLSLLLAAPILLVASMMGVSLWGWGWVLYGLVKFIDQHFLGGMITRFWLANRQDQDGGDGPEGEGQKGEEDEMTGKDDKSEKKRPKKLQVKKDT

SEQ ID NO: 24893 - protein, 184 aa, A.fumigatus
RRSASSILLHLQFLRSLLLTLVVLPCHLILLPLLSLTLRPIPSILILPIRQPKPSNHPPQEMLINKLHQPVQNPAPSPKRHPHHTGDQQNRRRQKQRQHRPEQHRNRRKEEHTRQEDQQRDPTADELADDERGRDGPVQNRFVHFGLSRGREDPGDQRLDPVFEAVENVGEKGEQPGLGGGPDG

SEQ ID NO: 24894 - protein, 286 aa, A.fumigatus
NSENALQLITILKKLCNSLSLLSPKTGDERPSETITALLSSLPPNLLRHFTPSCSAKIRVLDQLLHNLRTSTSEKIVLVSNYTSTLNLLANLLNSLSLPFLRLDGSTPAQKRQALVEDFNRLPPNRCFAFLLSAKAGGTGLNLIGASRLVLFDVDWNPATDVQAMARIHRDGQKRHCRIYRILLKGSLEEKIWQRQVTKIGLADSVMEHKNSVAQFSRDELKDLFRLDEASRCQTHELLGCDCGGLGQMAGPSSNDTSIPATDAEDSPSSDLSDTDHEFPDIPTLI

SEQ ID NO: 24895 - protein, 72 aa, A.fumigatus
ILSTGGNVENMSDPEPSAAACSSSPPTVQTPESATLNYAFLVHSQKTLTQNLPPRVDNKLLARQKRRRTRYI

SEQ ID NO: 24896 - protein, 63 aa, A.fumigatus
  UNSURE (36): Identity of amino acid sequences at the above locations are unknown.
TSRQVMRVQCSTVRDAPPFSIEQGKTRKSVGINKVXNPMWTISAISFILSRRTRRNDNILNAL

SEQ ID NO: 24897 - protein, 446 aa, A.fumigatus
  UNSURE (14): Identity of amino acid sequences at the above locations are unknown.
QDERNCANGPHRIXYLVDANTFASLALLNRKWRRISDCAALYAHHLSRCSSFSATGEPISSAANPENLAYLKRRFLSEIRRNAFEVFLRPRQTLIKLISTSMSSSTAFPQGEAFRFAFSPNAQMILCISSSRIVVLDVTSDSAAVKHELKIWRRPLNATILDDGSLLAVVSSDHQINIYSLTNEEASLIQDLKLTEVPRALALSPSGGVLAVAYSDKIEMYAIREGALTTERRAVRCDGVDAISFSSERVMLIGSSSPSASSSLVTITVPFYTAPDTESSPREVQVRMWTTQILFPDLISGYSHACLLPLRAEGEGSWILGYDRRIRAFRAFGVTNANSGTTYFVGPISANTLQEALPTMLPSADGQGELVALGFQDSGLWVYGVPSQLDIARSAGETQASPSPPQRHSMRNLGTLPHNNALRLEWTINKPKTIVSGHKMSDLPGM

SEQ ID NO: 24898 - protein, 203 aa, A.fumigatus
CRGFLRLGRSDPGNRLIVSHLWTLVRRTHTLRTMILLQVRWRNILGLDKRGVDPVLARQLFVRALLHDLALGHDHDVICLSDCREFVGDHDGRSILHGMVESFLHGSLSVWVERAGRLVKEEDFRPRNDAAGDGNTLPLATRKETTSLPDARVVPLRQVLDEVVRKGEFRSLLNELHLVIMRRGLPWGTTESIGDIVKHPGVD

SEQ ID NO: 24899 - protein, 69 aa, A.fumigatus
VIDKSYLRLNTLVNSVIKGPSGSGKSTIIGLLERWYSPCSGSISLDGKDISHLNLKWLRTNVRLVQQAR

SEQ ID NO: 24900 - protein, 263 aa, A.fumigatus
AIYLTCPEQEPVLINARVFDNIANGLGGTPWETASHDDQMKLVQEAAKLAFAHDFIENLPQGYHTRIGERGGLLSGGQRQRIAIARSVISGPKILLLDEATSALDPHAEATVQKALDHAMQNRTTIVVAHKLATIRKADNIVVMSQGKIMEQGTHEELARKNGIYASLVKAQDIAPANLEQDHGSEGMSTSDEGPEMGDNQSVTRVRTAETQKPAALRDREDHSLYKKIGIIHNIWNLLRGMPELWIWFAVTMATCIGGGEYL

SEQ ID NO: 24901 - protein, 96 aa, A.fumigatus
SRRITPGEYMTNLLTTMSCAAAVNPGQALLLGNILSVFTSPNMVARGNFIALMFFVMSLGILVIYFIMGWSTNTIAQVRTFPPVSPANLYHDTDQV

SEQ ID NO: 24902 - protein, 230 aa, A.fumigatus
LCLLIIFLARQMTPFTNNARSDGLVLRHWQRQSESAKAPALEGASEMEVDQAKAGGGAATPEKEYPFAKYNVKPRVPRRYTDEEYNRHLKSDDWSRQETDYLMDLVEEYDLRWVVIADRYDFQPQPIDAEANATALVPAKQYRTMEQMKARYYFIAASMLALEHPPSEMSEAEFDLHEKMMKFDPDRERARKELAALQLNRTADEVREEGILLEELKRSLHHGDGRPRLM

SEQ ID NO: 24903 - protein, 187 aa, A.fumigatus
FCFLLTAIRGSYGIHVLPCPELRIDHWCCSANGSNCCDNAFKLQMGTLMFSSTSAAPSSTTTSTIATDTGTTATTATPTTTTPTPTTTTAIITEPTTSRAASGGSERSDSKPLIVGVSTGVGLGVCLVTLIGALCLQRRRYQRRLNENQHFGVTYMSSGGIHTRPAAAPAELPSNQAPRVFEMGTGG

SEQ ID NO: 24904 - protein, 162 aa, A.fumigatus
LHRLQTWLHPQGLGVTIPDQPVQPPFRANPAGLVSSKRRLGRDVKVRVDPDAPRLELIGDATRSRHILAPYGCPQPRVGAIRPRNDIGLVRPLEHRQDRGKRLFLHDPGRLGKVIQQCPGGRTTPPSPGWCRRWHSSCLLRKGSAKNPWLCSYCMLFWHGPK

SEQ ID NO: 24905 - protein, 192 aa, A.fumigatus
KLHGEVLRRGFPGGSSGGLGDSLKVGGGTDPKVLFGPVPEQHAVRTKPGIFGRAFPQKAGRMPSAAPSGTRGGSSSPRTLLDNLPESARVVQEEPFAPILPMLKWSDEADVIARPNGTDTGLGASVWSKDMTRARRIADQLEAGSVWINSHFDVSPKAPFGGHKTSGIGTEWGLNGLIGYCNSQTLWVKPSL

SEQ ID NO: 24906 - protein, 76 aa, A.fumigatus
TVRQTTHTIEVKLPLPLTDTISISKRTRPRRAPLTILNFCPGILTDSPTSLQPFIVSLPFGTACLLRPTCTTFARV

SEQ ID NO: 24907 - protein, 170 aa, A.fumigatus
NAQQLAALQAQQQAAMAGRRSRPTSPGIAMQGGALAAMGFTSPQNNGFLAAYDPNNPLLGNGLGALGLSQFGLGGHEGYLSDHSEVTRGRSPRGRRGSSKPPEDPTDPNLLKDIPSWLRSLRLHKYTDNLKDLKWTELIELDDKALEERGVNALGARNKMLKVFLAQLVN

SEQ ID NO: 24908 - protein, 147 aa, A.fumigatus
TFECWLTNPAILLAGCTSSNGLSIVYLVSLQYTNTSTSVPDDPVLVNPGIAGKVYNVSHRNSTIYEVRAGYMGLCLTLSNRAQLCSGSAAALARMVQAEGIQGNDAGAADPLNLIWIAQNFKEKIVFDGLMYVLYSFPWLCLGGGMI

SEQ ID NO: 24909 - protein, 92 aa, A.fumigatus
  UNSURE (87),(91): Identity of amino acid sequences at the above locations are unknown.
KKRSPNLVKGGAVFAFSLVFQTETYEPVLLQRRVDQLRKEAGDMTLRSKLAPNISARDNFIRSIVRPTKMLFLSPIVAIFVFTGGSXGISXH

SEQ ID NO: 24910 - protein, 295 aa, A.fumigatus
RTNLYDYQFSLSWTFCAVSRRLTPPHLVTYPKRPRLCIQINTVRKSLMDCRASRSTGAAAMSCEKSICPLDLEKNLVVQVENPTSGCFVTDYVTSHVVDWDGPDDFARPVNWHKKRKWLNVTSVAFLTFLTPLASSMVAPAGGLVIETFNITSESLASFVVSIYLVGFAVGPLVLGPLSEIYGRLRIYQACNAVFIVWNVACAVAPNVGSLLAFRLFAGIAGSCPLTLGAGSIADLFVPEERGAAMSIYSMGPLMGPVVGPIAGGYLAEAAGWRWIFWVISMAVSILSDIEETVP

SEQ ID NO: 24911 - protein, 89 aa, A.fumigatus
NRRNADWVENGFHAGAFQRSSLKYMLNYARVYVLCATIARIQKRPSSEVLADPESDAVLGLWKSLVEIIMGQMAWLVNESAYRCQLTWA

SEQ ID NO: 24912 - protein, 103 aa, A.fumigatus
VSNRAFFPLYLHLYVVQFLLLPLLTRSPSNFLATFLGNTLYLSALIYYTYITFLGYNALPFLHNTELLLLPILVLSILWLVSLIAGWGVVMHGHSVEWLFWGV

SEQ ID NO: 24913 - protein, 60 aa, A.fumigatus
SPQNGLAISKYMIYLQRKTHTEQNIISMCHFMHIMHPNHGKMDENQKEPNDTHVHQRPVF

SEQ ID NO: 24914 - protein, 74 aa, A.fumigatus
NVELARNYPNFSGGPAMGFELFTQPLQRRAEPAAGYRGGKRKLGSTHCINVKFPQAFDFSSIGFMVQVRQNCPP

SEQ ID NO: 24915 - protein, 173 aa, A.fumigatus
ALQSLHLLCYDVRLTLVYVQHESGKELKLLHFIYEQPDIDEIRGNPQRVLDLIHKFEEKYRFMNVGAAKGKIVTDLIAELKPHTMIELGGYVGYSAILFGDAVRRAGGKRYFSLELNPEYAAIANMLIELAGLRDFVRIIVGRSDKSLHKLFTSGEVKQIELMFLDHYKPAYT

SEQ ID NO: 24916 - protein, 232 aa, A.fumigatus
PRSRALSFQPGLVKTIAHGIFGFSHHEEWGAGLITHIGSIVRLAMRLGLHRDPSHFSNLSPFEGEMRRRIWSTIDQIDCLSSFHLGIPTAVRSEDSDTNAPRNLLDTDIEEGMSELPPPRPFSASVPIGYLLTKLKLSRAMRRVVEFLNSVQRQPYERVLQLDRDLIEAYRSIPPHLQLNNWHNAPNEPAYVMVQKVQLDTLYHQAVTALHRKISPRGPDEPHICSLSAKKH

SEQ ID NO: 24917 - protein, 237 aa, A.fumigatus
  UNSURE (5): Identity of amino acid sequences at the above locations are unknown.
LGGTXAVSGRPGGEDRCRPKAQMDVKNLAALPSKMDQAFAKYPDIDAVIINAGIQRLLDFNTTDVSAAQYPTTDAITDEVTTNLTGPTVLARCIIEHFKASRPNQPCLLALVTSGLALVPATMFPVYCATKSALHSFTALLRNQLKHTSISVVEIVPPYVETELDKDHVDEVARRMGGTRPQAMPVKQYVDQVMRGLEVTDANGKIQKYVADGLPRAAVDAWVTALSPMAKLLHTEL

SEQ ID NO: 24918 - protein, 160 aa, A.fumigatus
RGIRASWRRRQVSTKGTDGCEESCSTAQQDGPSICKIPRHRCSDHQRRHPASPGLQHHRCLCSSVPNHRRHHRRGHNQPDRADRPGTLHHRTLQSVAAEPTLPSGPCDFRSGAGPSNHVPRVLRHKISAAFLHGALEKPAQAYVYQCGRDCAPVRGDRIR

SEQ ID NO: 24919 - protein, 63 aa, A.fumigatus
FNIFISTTIFLLGLNYIRIRAIVNIFFSDLKTLVYSSLYIKGAPLYISTVNGYTISKKFYINY

SEQ ID NO: 24920 - protein, 233 aa, A.fumigatus
  UNSURE (10): Identity of amino acid sequences at the above locations are unknown.
RGSFDPSWWXTYTHPAIMSRSRLPPTPSMSGEFIIREQPSVDGADAFALPPAALSPARSASASRRPSKSDSSSYFPASPTSPELTGVGRNANPPRQAGTKRLLEDFDLPPPPTRTRKIIQMKPKTQTQAKPATTNTKPSTKDNGKNQPASNANTAASANSKKKQPSATSAAGRKIARKTAHSLIERRRRSKMNEEFATLKDMIPACRGQDMHKLSILQVRSFLLSKLMAASDL

SEQ ID NO: 24921 - protein, 405 aa, A.fumigatus
LRLPCFHGNSQMCLAFLFCLFHSRISIFSGPSDITLKDEPTTKGNHPKVHSLGGVYDVSDAKVVQAIIIGAGPAGILAALRLHEHNHISPTIYEIRSEPSTLGGAIGIPSNGLRLLHRLGLWDAVQGRGAETSTLSLHGIKGQVIGQMDMTSWSRQKTGFGYLRIRRTDLMDVLYEAARRADIPIHFGKRLTHIVEDDQTVTVAFSDGSSDHADLLLGSDGIHSTVRSIYVDPSMAPEYSGISNAYSLVPTSDLAIAAGSISGLNATLTTDGLLAVLPCTPGGELIYWFFSRELAMPASGDTRDGWEERGKEQVESIKSTVLDLIKETEGSWGSTMKEMIKHTETLQFFPVYRLPTDGKWWRGRCLLIGDAAHAMQPHASQGVYHGAGRYIRVLVFYHEGARHPR

SEQ ID NO: 24922 - protein, 211 aa, A.fumigatus
  UNSURE (196): Identity of amino acid sequences at the above locations are unknown.
RYTSISCYQSPVWLQPLPQQAVESHCPMIRVPKESIQRTSPHQMTLFGPISSTFRRTMTRIEQSRLLSLFMGGQKPRKVRSSFRNSAMKRGIRMLLRFIPRGLMYVSRTRPKRSLSMYTQNQWQGDPDSSGVDDVAFTMEMLDNFEKRYCIDSSRVYAAGKSNGGGFTNLLTCDPTAFKSIDYCGICPRFGCLLPXRTRGRLQSRQGADQL

SEQ ID NO: 24923 - protein, 165 aa, A.fumigatus
SSSSISVALVQLRSSTSGNGVSDIDIIMASLSRTLRPFAPRRVRWGSPLSPVIPRRFLGIPPQFLLDEYIPRYQLLSSVDAAKKRSLAYAHLQNCNLCPRHCGVNRYEETGVCLIGAETAKVNVIAPHRGEEPCIQGYHGSGSVFFSGCNLRCVFCQNHVRSREG

SEQ ID NO: 24924 - protein, 86 aa, A.fumigatus
DIAHQRNGFDLTPEELAEWYVKLQQVGNVHNINLVTPEHVVPQVALSILAARDMGLKIPIIYNTSSFDSLASLQLLDRVPHAGDSR

SEQ ID NO: 24925 - protein, 204 aa, A.fumigatus
RLKHSIQLVSFIKNSPLEKLRSINANSPVVVRGIVQPKKTKGSDTEQSDCWEVHIADIDPLNEFPKDIIMTPGTAFAPEHRYLQLRSDSELRDALRFRAQVRNICREELEQCRPPFVEIETPLLFKSTPEGAREFLVPTRRRGLAYALPQSPQQYKQILMASGIPRYYQFARCFRDEDLRADRQPEFTQVSIETRCPLLNCDLT

SEQ ID NO: 24926 - protein, 100 aa, A.fumigatus
  UNSURE (92): Identity of amino acid sequences at the above locations are unknown.
HKLFAQLDLEMSFATGEDVMRTVEGIIRRLWSSLMKDEAPSGPFRRMAYQDAMSRYGSDKPDTRYGMEIFKIDYLLPVDLVNKIGPLTVFSXKGEESEHG

SEQ ID NO: 24927 - protein, 228 aa, A.fumigatus
QPFNCFIAIWIVSPKRIVTSSEHLFYCLAQTTVHIAEPKHSAILQHNPDAFAIANALDLERARGRVRGPLHGIPFTVKDNIATKDRMETTAGSWALLGSVAPRDAFVVRRLREAGALLLGKAALSEWADMRSNNYSEGYSARGGQCRSAFNLTVNPGGSSSGSSVAVGANLVPFALGTETDGSGTFLVWSSLFQTSLTVTDSDQSSAEKCCCWYKAYSGPHITRRRNP

SEQ ID NO: 24928 - protein, 218 aa, A.fumigatus
RSRIVINPAQRNAVVGIKPTVGLTSRDGVIPESLHQDTVGVFAKTVRDATYILDAIHGVDPRDNYTLAQNGRTPVGGYAQYLSDRSSLKGAVFGLPWESVWRLGDPDQISQLMKLLDLIRAAGATIINGTEFPHYRQIVSPDGWDWDYGSRRGYPNESEYTYVKVDFYNNIKAYLSELNNTNMRSLEDLVEYNKANFGMEGGFPGLHHGGGRNRAMRT

SEQ ID NO: 24929 - protein, 76 aa, A.fumigatus
FGTKKGKLSCDTIQEVNRLLFKDFSPNKTAGVVSGQRIDKVNFPRVVLNSCNSIHHALDLSTGRFYRLIAWNFTVI

SEQ ID NO: 24930 - protein, 231 aa, A.fumigatus
SQKNAGDQLPSVVDVRNMSVAKSIAAVLVALLPGALAQANTSYVDYNVEANPDLTPQSVATIDLSFPDCENGPLSKTLVCDTSARPHDRAAALVSMFTFEELVSNTGNTSPGVPRLGLPPYQVWSEALHGLDRANFTDEGEYSWATSFPMPILTMSALNRTLINQIATIIATQGRAFNNVGRYGLDVYAPNINAFRSAMWGRGQETPARRRLLPGHRRMRTSISLASRVVC

SEQ ID NO: 24931 - protein, 70 aa, A.fumigatus
QAFSQEETLVRSRLKLWASFYCFVQIYGLIVWLLGQHNDSLMSCDYALTLILGFQQDILANVICLMNTFS

SEQ ID NO: 24932 - protein, 62 aa, A.fumigatus
LRGLQNNGELRLGKSWLFSRSFDNWNMGEFARFFPELGKILIMDTMMMEPWNLHETSCFGSP

SEQ ID NO: 24933 - protein, 143 aa, A.fumigatus
WGVSQPQEFLLGGRAVPTVTFYKFKGLVAQSREGTPHVEFNLRWIESLMRIHGRYFKDNSGTLATELRAIQRAVDDIRENLRKLTEKNLYDLNYLLSKPVLADKINGVPKAIQDYDAILVDGEDARMSDVDGDDREGEWVGLE

SEQ ID NO: 24934 - protein, 150 aa, A.fumigatus
RAENCLLRTYERGVSFDTFDNPDAADFSLTLNYKHKGYQCTRRSRTFLCGTDQNDYSDFALEWLIDELVDDGDEIVCLRAVEKDSGLASDAEIEAGKYREEAERLFEQVIQKNSQDEKAISLVLELAVGRVQDIIQRMVHLRTRIWIEVC

SEQ ID NO: 24935 - protein, 327 aa, A.fumigatus
SMSWSTMAMRLSVCEPLKRTRASRAMRKSRLESTGRKPRGCSSRSYRRTARTKRPSAWFWNWRLVGFRTLSSEWYISGREFGLKYANTSKIRIYEPALLIVGTRGRKLGGVQGLLPGSVSKYCLQQSPIPVIVVRPTTKREKKKKKRQADPTRRSYNQILEQSSRRGSRIFDASSSTESNISRLPDEEAAVAAALGLPASYTNSRSSLSMSERSSVSQEEPVPPNWGSLSVTAKSRLAESAETTEDEGASDDDNSASQSGQHIEDVSPKHKAADDSQAVSKEGDVAPDSGTPTTTGTPPPLESRKVNIPLIVTEDISTHQKDKGNGG

SEQ ID NO: 24936 - protein, 446 aa, A.fumigatus
IPDLQDIKALCDPVGGSIACLQVQVQTISIMHLTSLVLTVGLAAAAPSFNPRGKGHDSRPAVTNIQVGPRPYYLLDAMADSPLKKKLQSCSEKRIKHAPAFSISHRGGPLEFPEHTREGILAGARMGAGIMECDVAFTSDRQLVCRHSQCDLHTTTNILTIPSLAAKCTVPFQPAANGKPATAKCCTSDITLAEFKTLCAKMDGYNASATTPEDYQRGTAAWRTDLYATCGTLIDHNEYIELVDRLGLQFTPELKTPEVAMPFGGNYTQAMYAQQLIDDYKAHGIDPSRVWPQSFLPDDIFYWLQHEPKFGKQAVYLDERVDTDAGYQKAVDGMADLAKKGVKIIAPPIFALLNTTADGEIVPSAYAVAAKKAGLDIITWSLERSGPLKAAAAKGEYYIQSVKSTITGDGDMYRIVDALARKVGVKGIFSDWPATVTYYAACMGLD

SEQ ID NO: 24937 - protein, 149 aa, A.fumigatus
KRNSSRARRSASSTLPPSLSPTVVVRSSFPNTLARAFSPVRAWAQASWNATSHSPQTVSSSAATRSATCTRQPTSSPSRAWQRNAPFPSSPRQTASPRRPSAAPPTSPSPSLRPSAPRWTGTTPRLPRPRTTSAARRRGARIYTRHAAR

SEQ ID NO: 24938 - protein, 388 aa, A.fumigatus
  UNSURE (79),(137): Identity of amino acid sequences at the above locations are unknown.
FFFPPKKFVNKVDSPGNKGCSNSGPFNSPIRAPIGTNGDFCQGSQSRALTMFVMYAASSNKGHLFSRFGSARFLPSSNXGAQIELLDGTGISNGYMPANVRCDNCLQWTGGSLDPSSSSSSWIWAEKQGPAIDSNDXRYAITRHDSRGVHTINMSQARAANVDASNPFAGQNAASTPETVTTGGTTASESDSILIAHAVLMSVAFVVFFPSFAISIRIIPNSTVVSRIHAPLQLLTLAMALAGLGLGVYLGVDTNQMDKYHPIIGLVVVGMLLLFQPLMGFLQHMHFRRTGGKSFFAYVHRWLGRTLIALGIINGGLGFLLTKNAGNAAPKGAVIAYSVVAGVVGLAYITFVIVLPFRSKKSAAPQKVTSLNGSGEGIAMQERNGASD

SEQ ID NO: 24939 - protein, 74 aa, A.fumigatus
QDPLMGRPAQFNNGLAYTPQQLGPKYGGQPQQYQPPVGYNYEAFQTPGTAAKPPFGRRKLQIGIYGVVTSRNAT

SEQ ID NO: 24940 - protein, 100 aa, A.fumigatus
FGVSTNRAIRTGKTYLLNSVSSRLLSCVSLESESFLCLLPVDGSDQVLNLLLFTVGNAAKQPFYNFSFSPDCLVTITPPIYIDDLMKLTNLSCIITYTDP

SEQ ID NO: 24941 - protein, 178 aa, A.fumigatus
  UNSURE (16): Identity of amino acid sequences at the above locations are unknown.
FGTSGLFGMGQAYIIXSDTFRKSMNIALPVRQPKNGQSPGRDDSQQSKSIRILREHLEAERAKMIQEQHKSPNSLEISFIDRALNNLKEAKENIKRETAEKLDAVRGQAPVKNADGTIAEPPRLGEKDLKLAADYERRRKEEEDWKREERNHARREAHLKAMELEREKARSAFKVKQR

SEQ ID NO: 24942 - protein, 61 aa, A.fumigatus
SASCVCDPTLFGTSKNVTDYLVHKWEDPNIRELTPQFLPIFQSVLCGDSDQLEDYRRAELI

SEQ ID NO: 24943 - protein, 85 aa, A.fumigatus
SFRPSRVKTKTIGMYILYLFLSAYCTMAALHKHADSNDEHTRLPSSLRRAKCVRDVKHDSFQRNLRPSFHCSYCFHVIFGLVLTT

SEQ ID NO: 24944 - protein, 249 aa, A.fumigatus
HRATVADINRNMAENLRYCGPSLIANETTLHNVIQMVTDIITKKHPCQLEFGPEEESLEAGEETSEFDWVVVDTALDVVSGLAAALGESFAELWKVFEKTILRYAGSTEALERATAVGVLAECINGMGAGVTQFTRPFLKLLIHRLGDEDPQTKTNAAYAVGRLVEHSTADAEIVKEYPTILGRLESCLQMKVSRLQDNATGCLSRMILKHREAIPLKDVLPVLVSILPLKNDYYENEPLYRMICQLCM

SEQ ID NO: 24945 - protein, 335 aa, A.fumigatus
  UNSURE (258): Identity of amino acid sequences at the above locations are unknown.
WPNRLLTKHDSSCLIPDAPSMMLRSPIPPERTSSRSPAPPRPSFDDELERPGSAGSDASSVASNVTTVSAIQSSLNNFGAAPDASSPRIPRTSSTNGSGTTDDNPRRPSASSLMPQNEMTSRKISGRVVPPDLSRHRPRHHSQGFFEPSLPTASLSDVTLSASRIAAQAAMQQQSSAAQHPPKRLPSNVQGPDGRGGSISPPLPPPQQVLAAPGSGSTSGQSYQNGIGGGNALAATTAANVVFPRGPALQPGMASDPXQPEREQMQNGHKPKMMSFSKPKPLGISRDQDLTVWIGYTVPTKMGFPGLVGLSPPPGVERIPFPEPLSDVLFNPRLC

SEQ ID NO: 24946 - protein, 403 aa, A.fumigatus
RYQAVKDFLMQCFQKDPNLRVSARKLLKHPWIVNARRSDSVVPKKSTEYEEAVRSVQEWNEALRSPGAGTLRKPFRHDRQSPSPLRRNQLPSRNTPTKDALPAPVVSNAKDQSLLSNATAEDNWDDDFATAISPSALQLPHLRPHDNFGGMLSSEKLKAFASLDGTVIKSENSFGDFNDSFRTTLHCGESDPLQTIRPFPFKQTGTDDGFAQKSPLQMEPKRSTPFVHNVPILTQNPVPPSRQARPASFYKENSVEDYSDIIITDEDVLGRKLNGVKVRMEANIYPNVDDCLSDLFQETDEERYISNSADLPPSKEIVRYHTPSRDDEQEPHLRRQLSTKRHRSAVEIHRFAENERDEDFSDILGPEEVALDKPDSDGSSDRSTLMLNSRHCLHHGAGRSRAT

SEQ ID NO: 24947 - protein, 91 aa, A.fumigatus
PNCICDTWAPSRGAIQVCINPKSRAISIHPASVFEKLVVRKLDGYCMEDTNLLYVVLRSLGYQVYRTGGRVSRAAAAGSNAVVGYQALYVP

SEQ ID NO: 24948 - protein, 73 aa, A.fumigatus
VGTGWRSVDCSGAQRAGSDQDLEHANLQSVIRQYHTRTWDQFLGEVLAESCVPVPWDEHTENLDRLLRSLWLG

SEQ ID NO: 24949 - protein, 436 aa, A.fumigatus
  UNSURE (1),(2),(418): Identity of amino acid sequences at the above locations are unknown.
XXLRGDDNAIILKRYNRYPLIIDPSGRVTEFLQKESTDRKLTVTSFLDDSFVKQLESALRFGNPILIQDAEHLDPILNHVLNKEYQKTGGRVLIQLGKQEIDFSPSFKLFLSTRDPSATFPPDVCSRTTFVNFTVTQSSLRTQSLNEVLKFERPDVDARRTDLVKLQGEFKIHLRQLEKRLLQALNESRGNILDDDNVIETLETLKKEAAEISKKMVETEGVMTEVENITLNYNIIARSCSAVFAVLEQLHHINHFYQFSLQYFVDIFHSVLYQNKRLAAEKDHSARVQIILKDLFVTTFQRTSLGLAQKDRITLAMLLAQAAPYPMDKTIIDIILDESVQGGDLSTAPELKEQVLTKISNMPIFKASFANITQEHGISFWAKYWLKAVSRSLGMNIRKISTDCFAHCGWVNLAGLDXFVPTAERFIQTVLGPKNP

SEQ ID NO: 24950 - protein, 62 aa, A.fumigatus
ETERESISTFYCNSSQKHQPSNTNLLPTKFINPSIDHFIIRFIRPISQSIFLPPQPSTTIRQ

SEQ ID NO: 24951 - protein, 77 aa, A.fumigatus
FHKLTVASADGPVEDQCAAKLVNMLGPAVSLKAWIWGLQYARPGQQVRAGSQFPKDEYFCHDMFLLGSRSMQCLRQY

SEQ ID NO: 24952 - protein, 64 aa, A.fumigatus
CSHWHGQYILEAPRDNYWKTLMLIIIIFISYSSALSAHYGGTHMELPTVPYPLLSAPLHKSSDC

SEQ ID NO: 24953 - protein, 139 aa, A.fumigatus
SPMEALHPPVKTSVTGHATGATAVVLIGLFIQLISFGIFGLTAVMFYRRIMEAPTPQCHNADLPWKRTLEMLFGVSALIIVRSVYRVVEYSVGSNGYLLQHEWPMYVFDTIPMLTVMIIFYIWYPSRIQQPSSCEDQRK

SEQ ID NO: 24954 - protein, 63 aa, A.fumigatus
RRPCVNKLFSLPWLWASQFRSNKQASSSETYSKSPILLLTISRFPSTKHSQLYQQMELTASFV

SEQ ID NO: 24955 - protein, 72 aa, A.fumigatus
EVYSTIFRQPGSSICTLMDALQTDLCPSGGVFTRRGVMCFILLFNALLAKAELTASFESRPNMLKHKNLYVF

SEQ ID NO: 24956 - protein, 302 aa, A.fumigatus
LRPSGIPFCSLLKPAHQAKTHAFRGKAERTISTHFSLQLPSCSGLNMRWAPKVGNELIRGISGGEKKRVSIAEAMITKASTQCWDNSTKGLDASTALEYVQSLRTLTDMANVSTLVALYQASENLYNLFDKVMLIEEGKCAYYGSAKEAKAYFERLGFECPPRWTTPDFLTSVSDPHARRIQRGWDDRVPRSGEDFRRVYRNSDTYRAALQEISQFEKELETQEHERAQARQEMPKKNYTIPFYDQVIVLTRRQFLIMYGDKQTLVGKWCILVFQALIIGSLFYNLPPTRFVDMYTDGCSSN

SEQ ID NO: 24957 - protein, 102 aa, A.fumigatus
ALSSYSRPYSMATKRKASALNAAVDDEPVDPSDELAFYCLGGGNEVGRSCHIIQYKGKTVMVCCAISLLVWRQLTDGQYSSMRACILRKKDSRLSHSSTSST

SEQ ID NO: 24958 - protein, 225 aa, A.fumigatus
GNRSKPDLVSYPKGWKKTSCCVPLQLQRYLYCSYPSPLSYFRVTRLWYEIALSLSNLPRAPSFPLSVMSTSSLSIAVDPVALVTTECITVTSSMRKHARWAHSSVAAILGGNASSRVYEKDTSAPPSPRNGAASPRPRSRLSVMDDDHALANRWGLRGKKGKSMQDNPLISAFTRLRSDLKDCKDIRTFDTPALLHPFLQVTRSSSTSALDHLPRPDCYHQVLRV

SEQ ID NO: 24959 - protein, 285 aa, A.fumigatus
RIAKTFGPSIHRHSCTPSCKLPGHPQPRPSITSRALIAITKFFAYNIINRDSPRLSMAMQLLSAAITHCRFEASDSAADEIVLLRILKLMEGMLSRPEGELLGDESVCEMMETGLSMCCQVRLSEVLRRSAEMAMVNMCQVIFSRLSQLEVTESVDSGSLTTAGNSAEQTGLKMDPSVDGNTVTSQHPSAMGSDTAGPERERTGGDEPSDQAAGGSAVAAPPNPEDDFGNEVEPYSLPSIRELFRVLIDLLDPHNRQHTDPMRVMALRDYRCGSGSRRGLHCQPS

SEQ ID NO: 24960 - protein, 220 aa, A.fumigatus
DRATNVSDAGSNAVRSDPGETAESTVDGAGARRESWVPIHSPGLRLPGPDAERRPSLPLPPRALQSQSPYSLPSLQHHPDGPLYGTSSPSLPSLAPSAGAPPSQYGQVPPPNRLQPLNSWLTRQQGPYSQSLPPINQATSHGLPLLPPPGSVNHAAASPPVTVDGFEGGVSNAMWSTSLGGDDVVAFLEGCDYDQLSSMMPSEVGIPTGWLSTVWSEFSR

SEQ ID NO: 24961 - protein, 252 aa, A.fumigatus
KILQLPLTCNRLFNDLVCCISPSSKHSRHKSAAFIYIHQPQHLSQKPVEPSGPATELRVSLERHSLCSLCGSLCDRCFLFCLSCYSSFVLHTMLSAGERHQPPINTNAVVDASRTPVTKVSLNHNSTTSMRSETSKAENIQHIWVVTGPAGCGKSTVGRMLQQELGLPFLEGDDVSTCIHAIFLHTASRQNAQVDLTRTHTVPLTDQPGENGQWHSSNRRRPLGLAHLLAQSRHRGPLPFARFSPRGSNVPR

SEQ ID NO: 24962 - protein, 182 aa, A.fumigatus
  UNSURE (1): Identity of amino acid sequences at the above locations are unknown.
XRLLDPRFPEKIPDVFQVSHHFTGATYGVLCKVKRQCALHVWDHCVSFREMTTFLSSAVSFDSTFVNTTLIGLGHLSCVLIQHHADVVLPCAEYFNPGWEIELGTCEGALQHRRTFRRKIDPVVNGITNMDKYKPIETIKTATPTVVMLSHIRYVLRDLNRRIKLADVQQICQRHQDGDHGN

SEQ ID NO: 24963 - protein, 194 aa, A.fumigatus
SAFPLCDYVADPVQWLFMNSSISEGLPLAMGEAALTGVPVVCTDVGASFCVVTDRATGKKFSEVVAPNDAISLASAQIRVLALLGQWSAFAEDEEGYVPPTLSLHPSREEVEQIKRRMYDKAEQRRKLGMLGRSNVYNNFSSDRYLREHEQMLWLGKYQSRSYVARGPGSSSNSRRFFKEKWKSSILIELDEMP

SEQ ID NO: 24964 - protein, 102 aa, A.fumigatus
IAELSWLTSSRYVKDIKTAIMATDLIVNIWGFRDYRLHIYGDMERAPAYASECQEIIASKGLREHVVLKGLGNPSVVLQDAVSCNPPFLSVTMWLIQYSGCS

SEQ ID NO: 24965 - protein, 204 aa, A.fumigatus
CQDRDKVCILTNYSKDICQPCPLYPVWMSDENTDVMRQFFEGLRQVWSDEKVDEWYNAIYGDVSGPEKPENLVLLSPDAYLLFTKGYIAFEPVDKDPEGMWLSLKLWWLQRDEKDNVDFSIIPHLPSDLNPSEYGIALHDVCNDSPLLSGKTITLNTHDPQNYPLPDTRIIEMQWVLNRVLALSGSVKPNALDEWHEVADEELS

SEQ ID NO: 24966 - protein, 567 aa, A.fumigatus
QISEDLSDKLSDILTTLVEIFALSTKAIKRGRLLKFTRNILLGTDDAIKEAVDKLDKLTKVEASLVGAETLVEAKRTGRVVDTLQTTVTSTNVTVQETGKAVNQMTVQVTEVHEMLGNLLIATNGKDEKHGDTAKSQRDLVRKILQPSATDSAQDWYDRISKTRVPGTGDWVRHEDVFQGWLARDLPVMFVSGNPGAGKSYLSSSIITFLKDQYPQGVQHPSHVSIAYFFFKDDNPATRSFHQALRDLAHQISNNDPAYEKYLAALGDYGSVRTLESAWRTLFVNYFLKKESITSSVYVLFDAVDEAFEEERLAFLQLARDILDSPNRGRLQLAMVGRPHISDQVAEALETNVPTIHVTTLKNSADIDRYIKTSIQKSVILRRVSPALRKEITEKLSAGAEGMFLWVNLMLQELVKKRNESSIRKCLEQAPKGLKEMLRHVLLSFSASLNDEELEFLNELLLWVTCAVRPLSLGEVEAILELKSAEGDGMIYPEGALRKQFAAFFNLDREDGLTTTELQTMAKKTYESDDEDMTKLDSDDEDAFEDVDHLIEVESNKKSTTGTFNHA

SEQ ID NO: 24967 - protein, 149 aa, A.fumigatus
LPFIKGPPLTRNNFSFIGSFGIFLGITAPTKEEPEFYSLRLCEYRWTLSVSRKHAEFLEFALDSLDNACNLDHHVPGKPGIDELMTSAAKPTIHNPPLPSASQLDESMLEMDRAPDSTRGGTSSVVSGLASPATSVSDESVQEASVPQL

SEQ ID NO: 24968 - protein, 163 aa, A.fumigatus
WDSRGLYIMIVARLFHLILVIWCAFSDGYDLSERKQPQGRLGITLDYGLARNWPPSIDDRGADTQRNWFYSSHLTFKEPVSTITDGQLWQMVRDALDEIPAVLTQYGISKNKGGSNVMTVLAFGNEIILASSKKSVDSFTYEFGDGNTPSCQGSSALPGCLEG

SEQ ID NO: 24969 - protein, 62 aa, A.fumigatus
  UNSURE (53): Identity of amino acid sequences at the above locations are unknown.
FEHSRRGKSEDRPDPSMFYAHCKLDIERLICGCVEPFDYGQVAQTGEDKYQKXSKPSNSISS

SEQ ID NO: 24970 - protein, 383 aa, A.fumigatus
ERHPDDVPIIAMCGSGGGLRALVAGTGSYLAAQEVGLWDCVTYTAGVSGSCWLQTLYHSSITGRDYNRLVDHLKNRLGVHIAFPPKALNLLTTAPTNKYLLSGLVEKLKGDPGADFGLVDIYGMLLAARLLVPKGELGVSHQDLKLSNQRYNLYNGAHPMPIYTAVRHEIPVLEAVEDEEPKKEITPEKLIKASQREAWFQWFEFTPFEFFCEELGAGIPTWALGRHFNGGHNVVPHGEYPLPEMRVPGLMGVWGSAFCATLSHYYKEVRPLLRGIVGFGGIDSLIHGKSKDLIRVHPIDPATIPNYVLGMKGQLPPSCPGIESAERVSPDHGCGNEQQLAYLPVFTDSPRWGYNWRLRCLPWTERQKNGISEETGHARSTSH

SEQ ID NO: 24971 - protein, 150 aa, A.fumigatus
SYLTVLIVTIGVGIQKRPSSVSQVGPWSSDFRLINSPSFTDGVSAVSSLIFACSATPAYFSIAAEMRDPRFFTRALIISQIGSTLIYLVIGVVVYYYCGSHVASPALGSAGPIIKKISYGIALPGLLATTTIVIHVSPLVLIYTTPVYKY

SEQ ID NO: 24972 - protein, 89 aa, A.fumigatus
VGWLGTVALMMKTQIGLGVLSIPSVFDTVGMIPGVILLCIVVSIAAWTSYVVGVFKINHRQVYGIDDAGGLMFGAIGKEIFATSFCLCM

SEQ ID NO: 24973 - protein, 112 aa, A.fumigatus
  UNSURE (69),(87),(112): Identity of amino acid sequences at the above locations are unknown.
DPVKETRAAPSHQSRVRRVEIDQWRTYTFPHLKLTSVALLTQTITLPQSAYLTFFSDPFTISLWVYHTXTYYEENDIDNTDDSLHTXLLDGRNMLAEHSGRRGTVRSGPGFX

SEQ ID NO: 24974 - protein, 380 aa, A.fumigatus
RVIEQCAILGIPKEDMHKVYCDRELLLPDLTCGLSVSDFSIAWTIGYDERFGSDVRLQQALMYYRPHVDDSQYTYPLDFCPIYNAETKEIIHIDIPPVRRPISRAPPNNYHPAAIEQDGGYRTDIKPIHITQPDGVSFKVDGRIIQWQNWSIHVGFNHREGIVLNNITFNDKGNVRPIFYRLSLAEMVVPYGNPEHPHHRKHAFDLGEYGGGYMTNSLSLGCDCKGAIHYMDAAFVNRAGASTIVKNAICIHEEDAGILFKHTDFRDESIIVTRGRKLIISHIFTAANYEYCVYWVFHQDGTVQLDIKLTGILNTYAMNPGEDTKGWGTEVYPGVNAHNHQHLFCLRIDPNIDGPNNTVFQVDAERGPGEVGSAENKYGN

SEQ ID NO: 24975 - protein, 232 aa, A.fumigatus
RSMPRRTLRRNSAACRRLSASSRSSTTPLLPLSSSPSSPRAVTTTPPLPSSRACATSPSATMCSSSSTRCRPVSVPTGKFWAHDHWNLQTPPDIVTFSKKAQTAGYYYGNPALRPNKPYRQFNTWMGDPARALIFRGIIEEIERLNLVENTAATGDYLFAGLERLAKQYPEHLQNLRGKGQGTFIAWDTPKRDEFLAKAKGVGVNIGGSGVSAVRLRPMLIFQKHHGKHSAV

SEQ ID NO: 24976 - protein, 221 aa, A.fumigatus
PMGLSAARHMRGENLSTGLLKVAPKGLNQVFTAMAGSDANETAYKAAFMYYRQQQRGGPQAEFTAEELETTMNNQAPGSPQLSILSFKSAFHGRLFGSLSTTRSKAIHKMDIPAFDWPQAPFPSLKYPLEEHAQENAQEEQRCLQEVERLIKEFHNPVAAVVVEPIQSEGGDNHASPAFFQGLRDITKRNNVLFIVDEVQTGVGANRQVLGPRSLEPPDSS

SEQ ID NO: 24977 - protein, 68 aa, A.fumigatus
CNSSAIPTFGSIHPSNVFEGYSSFPTPLLELDLPISERRALGSSVLQAEHSAESLPSHFTSGERKASG

SEQ ID NO: 24978 - protein, 80 aa, A.fumigatus
SRFSLLPLLLRPPFTPPYSGAILFTSFLPPSPDYLSLVVFYTLLRTTVSLDDIAASILNQLIDRLNPSPHKVHPASFRLH

SEQ ID NO: 24979 - protein, 87 aa, A.fumigatus
LQPYRLLRLRPARPSALLSPAVSFSTFVSAHEDISYLKVPQELTGHCISSFRRRFCQEVPLNVSYSMSLDSSFNSFTTMAMVEISLA

SEQ ID NO: 24980 - protein, 272 aa, A.fumigatus
LVFTRRCCYRRFVSMARLCRLKRQANSTTVHRTVPMQIEIVKNKWDTGSRASPFRTYLYNHVGDQAPFYQPTAEDDETKWEEALRERPGSGYVPVLVRGFWELGKRAQRQKDFLTMAQTRLHEINNCLTDLLSRHDLKISVKIADCRRKHLVLSKRCLALAAKTQVLRNRGYAMDEAEEELKKKLAQLERSVFNPSLNGRAEEIWARMLAIREHSKRLQAEMEKAGASTAAQGEEELDENTMKTAKKVCLPLQIALHSSVPVAILLIPPDLG

SEQ ID NO: 24981 - protein, 225 aa, A.fumigatus
KSRRGGSPGSDVSEDEEGIAAWGTSKKDLYNADQIETEADALEEEAEAKRLQQKHLQAMNEEDFGFDETEWVESDKKEDAEDEAGVVTEVLPQVEITDDMSSEEKLKILKTRYPEFEPLAKDFADLRTKHAELEKAAKAVKAPEDEEAILGPAPAPVIKFRALSAYLGAISMYFMLLSSSQDASGKPCPLPPAQLRAHPVMGSLVKFKKLWETVKDLSVPEPPKG

SEQ ID NO: 24982 - protein, 111 aa, A.fumigatus
SSVIRFGERQSLMNDCSWCRVLMFSVMSDSKARIIQAYFNGDKLVIRKSRLYDFSTPETLSSSTTLFMQWMASKTGGNTSGFPVEDFEPFEEDDDTELFGKKEIEKISDAP

SEQ ID NO: 24983 - protein, 204 aa, A.fumigatus
GGSFAFVPRRLNSFLSCRSCFNNTVLHSWRNHDPMAIIRSTKNDLNVAEDFSIACFIAVSWYNAIELIVLCFTTFKKRGGFYFWALLISSIGILPFGLGYILLIFDIYPGYFSVALADVGWCAMVTGQSLVLWSRLHLVVYSRLVLRATLAMIIIDGVILHTIGWVFEMGEQSPRSHWFTPAFYIFERIQLICFSIHEIILSII

SEQ ID NO: 24984 - protein, 208 aa, A.fumigatus
RRSGERYCCFGTEVEEWKGGFGLDDGEDDFVDGEADELDAFEDIKGWGEPMGPGRLLAHLEDPADGVQDDSVDDDHGERGAQDQAGVYDQMESGPEDQGLARDHGAPSYVGERDGEVARVDVKDEEDVAQTEGENADRGDEEGPEVEAAALLEGGEAQDNEFDGIVPGDGDEAGNGEVFGYVQVVLGAADDGHWVMVPPAVEDGVVET

SEQ ID NO: 24985 - protein, 415 aa, A.fumigatus
  UNSURE (381),(399): Identity of amino acid sequences at the above locations are unknown.
NPKESPVERALAGANLISTQDMRVLQAAVLFLLCLRRCCDSRLVWAEAAIVVRVAQRQGMHRDGQRQGLTPFEIEMRRRLWWHICILDMLCSEDQGTDTQIWPGMFDTKLPSNIDGDEVTPGLTTLPPLRRGYTDITLCIIHCEMMSNLYWAGKSLDEDARQPSTSEKEKLLSTLANRLEVLYLHNFDLDIPIQWVTVVIARLTLSKGWLVHRLNASTAGRDPAATNDEIFHMAVEIVKFATLIQNNESTSQWAWLCKSYKQRHVVAYILSELCVRPVTPETEHAWEVVTEIYHQWLREDRQTNTMLQKPLSRLMERAALARRTKLAGAEASGGRSVAAPSDNAAIDRVQGTLQPAVSQSIIPPPNVLVGTDMGVRLEDPXAAVSEGHILNTDANPSEXTEFSFSALDWLTGPLP

SEQ ID NO: 24986 - protein, 88 aa, A.fumigatus
SSRRMDSSCSVPNNNRVMALPDSMPIYGVLCIPSAKTSTPLRLSEDKTQSTLALPVITHLQNALRDTPLTASWAYAPWTLKKRGCFCR

SEQ ID NO: 24987 - protein, 62 aa, A.fumigatus
KLNNWSLLDPNFPRIPVSSPWSGGLTLGSLDGLVHAGRATNKRTGCSSSLGFGEERLQGPPW

SEQ ID NO: 24988 - protein, 79 aa, A.fumigatus
RVCLTGRLTEYQVIGRHLPTEANPTPKLYRMRIFAPNPVVAKSRFWYFLTQLRKVKKANGEIVSLNVVCLLWERIVRSR

SEQ ID NO: 24989 - protein, 122 aa, A.fumigatus
DSGYSTQSAMASVFTDFKEGQQNGSGPCLAAALTSIATFQSPDRLLSFYNFSDFDHISADLRYSLFQANGVKLPKQEQNGWVDIFAAYWKAVREIVKFEEYTPVKHLWAQGLRGWRKVWHTL

SEQ ID NO: 24990 - protein, 139 aa, A.fumigatus
CNLAFQLNSYEAEIRVLRHELESRGVQPVSSHLAGPAQHAGPSQAPPPALGHGPSNLFGGIMTNQGGSGPGLAPPPPQDQQPPQHTLQQPAPAAQQSAPQPPQSSFGGYQPGAAVNGMFLLYLLMVLWRLTVRCLSLSM

SEQ ID NO: 24991 - protein, 76 aa, A.fumigatus
ATCSGPDTTNISRNYFRSPLNFGPINLFLLHYPVTTTTKMGLITHNWLPFALCIGFAYSRAAITPGVTEVDLIFPA

SEQ ID NO: 24992 - protein, 80 aa, A.fumigatus
SPIALSCHPRGEDGRETNWRVWVLRCCKLQDMLHLYRNSQDWQDFSNLLFLVLRGIVAREQEAYGPYSYYKPRRGHYTIL

SEQ ID NO: 24993 - protein, 120 aa, A.fumigatus
ALLTNSGAVTWAQRSSSSDPERNYLYVNIKTPDVAKSAADLKITPTNVSFTGETNKGVKYHVSLDLYAEIDPENSKVNHTDREVELVLRKKELKEEYWPRLVKDTQKLHFLKTDFDKVWR

SEQ ID NO: 24994 - protein, 65 aa, A.fumigatus
ALLIFDLKEGCTSLEYTVGDLLGRPEMHNLWNDNLSGHTASLNDIMKYASFNSLIPPDKLRLVLP

SEQ ID NO: 24995 - protein, 395 aa, A.fumigatus
SWHLCFSWYVHPIMHPGPFILIFFFLCTDQAYFIAFSILILHTDVFNKNNKRKMQKSDYVRNTRGEGVSDDVLECIYENIAYTPFIHIEDTPSHSRQLAKPRRPLFKTPSSEHLSRVSREPVDPYTLIMDGKLDSLRPSLKDVMNLEDTYRCHGTTGPPDINSLHQAFSKTAILQIVSARSRPDAFMPASIQNPAESNPGLVDIKVAKVGLLWRKDPRKKRARSPWQEWGALLTFSQLYFFRDVNWIKSLMSQYESHQKEGRRRAVVFKPPLTEFKPDGIMSTDDAVALVDSGYKKHKHAFLFVRHHALEEVFLANSEDDMNDWLAKINYAAAFRSTGVRTKGMIATNYDAQRNRMSRKPSVTSCNSHRSADREPPSPNPDTHVSSPRGTGPQYV

SEQ ID NO: 24996 - protein, 280 aa, A.fumigatus
RLVCPMLALVGQYIKVKRGAAMGIVIAGSSLGGVIWPIVINELLKKPTIRFEWTMRIVGFIMIPLLAISCLCCRPPKIPTATKRLQDKPDANKAVTPEREPVSTPKTRFSILREPKMQVTCLAFFITYFGMFSPFFFTTSYAVAQGFSTDLSFYTISIINGASLFGRIIPGILADRYGRFNICILATLLSGIIALCWTTATSVAGLVIWSAAYGFTSGVRLGLALVPFIRNADTLQGHSLPSTSLCSPNCDTKHLGLINRCCHGIYIPFVCTYILSHTQS

SEQ ID NO: 24997 - protein, 94 aa, A.fumigatus
DRELMETELIRRLISSYFNIVRETIADQVPKAIMHLLVNHSKDVVQNRLVSELYKEELFSELLYEDDGIKAEREKCERLLETYKEAARIVGEVL

SEQ ID NO: 24998 - protein, 133 aa, A.fumigatus
SACPSSPVVKIPSGPATNSNAVCGPRLDLGILGYCFLPSFIAHIPLQVAYLFLNALTQYLCIRGVHLLSAQTSSLTVTVVLNVRKLVSLLLSIYLFGNQLSPGVVIGAICVFAGGGLYGLEGARLRKPINKKD

SEQ ID NO: 24999 - protein, 139 aa, A.fumigatus
EMFEPNMRSLAQACAAASNWLWNFLISRFTPQMFAKMEYGVWFFFASLMLLSIVFVFFLVPETKGIPLESMDVLFESKPIWRAHATVLAKLREDEEQFRHDIEESGYSKTGEQQVEHLFQESPKVYPVFGILGQVSTIS

SEQ ID NO: 25000 - protein, 302 aa, A.fumigatus
YGVSETLAPSHKQWIIPFAVQLIPSGLLLIGAVFLKESPRWLFSRGRREDAIKNLCWIRQLPADHIYMIEEIGAVDQALEEQRTTIGLGFWKPFKAAGTNKKVMYRLFLGSMLFFWQNGSGINAINYYSPTVFKSIGLHGANTSMFSTGIFGVVKTVVTFVWLLYLIDRVGRRLLLLIGAAGAAVCLLIVGAYIKIADPASNPTQEMTGGGIAAMFFFYLYTVFYTPSWNGTPWVMNSVCPSCHLASIVFTNQGRKCSSPTCAPLRRPARPRPTGSGTFSSRVSHRRCSPRWSTACGSSLHL

SEQ ID NO: 25001 - protein, 277 aa, A.fumigatus
FGGPSQLEPFDDRGGIQRARKKGMESDEILNPNQNENNDNWGAHVRWTGPQILKQLPEINVLCAGMGTSGTMTGLGMFFKENKPSVLRLGVCTAAGDRVPGPRSLALLKPVEFPWREAVDAIEEVNSYDSFSLSLDLCREGIVCGPSSGFNLQGLFQLLGKRKQAGTLAELAGPDGLIHCVFICCDLPYQYIGEYFSKLGEEKFHPIKNQVSSAGAHLLINAIILTPAESQRSRHLPLRRELGTKPHRPLHAFLRDPPLALGQSSAKHRAQATLLRA

SEQ ID NO: 25002 - protein, 194 aa, A.fumigatus
LPQNLSAVDIYRYDESWERSPIVLFTHFYETPRSLSDSLLRNIELRPLCCVLDLRTAADYSTWHLPGSVNIPLRSLDSHTPKPFADPGVLEAQWLELETLFKTEEALSKLRGQHVLVICYHGDTARVATSVLRAKGIEADSLRGGYQALRDHGLWGENEVSTCTANGTRTGSEHMTSTISLERSHGPNAGKKSA

SEQ ID NO: 25003 - protein, 355 aa, A.fumigatus
LNPSPRHPSSPVVKTHSGYVTDVFPFVAKSSNLLVASNSLVDNSLWTIIDTQDTSKVRVISSIGRGGAAFGLSPTQVDEIWFKGAEDHPVHAWVVKPSNFQPGNKYPLAYLIHGGPQGAWNDQWSTRWNPAVFAEQGYVVITPNPRGSTGYGQPFTDAIRGSWGGLPYIDIEKGLDYIEENLDYVDTTRAVALGASYGGYMMNWIQGHPLGRRFKALVTHDGVFSMTSQLASEEQYFPLHDLGGPIWKVPENWEKWDPSRFTEHWQTPHLIIHNELDYRLTIAEGLAAFNVLQMKGIESAFLTFPDENHWVLNPENSLVWHQTVFNWINKYVGLPPVNDEKSDAFSSKKNPWRSL

SEQ ID NO: 25004 - protein, 75 aa, A.fumigatus
GNILIKYPSGYINIIKDIYYIPKLGINLISIDRISKALGIITIFIKNKVSLYNNNQSIMARYKNNSLYYILFTIL

SEQ ID NO: 25005 - protein, 357 aa, A.fumigatus
RLDGPESKQISALSKIRVGQKLNDLLVLDIQRARRLIKVSARASLKKAAKQGSLPAKFEDIQEGAEVTGFVRNITSDGLFIEFLGGIIGLVPKRLLADENVNKPDYDMVKSQLVTATVHSIDRDFQRFILSMKPSEATSAGPKKPAPKPTPSNDEVTNAVDESIKSMSDFTFGRTVNCKVVSVKATQVNVQLADNIQGRIDVSEVFDKWEDIKDRKQPLRFFRPKQLISARILGIHDARSHKFLPISHRSGKFPVFELSVKPSFLQAANPSPLNLEQVQVGSTWVGFRQQRLLKHGLRIQPPHPMFRGKTTFSWDAFRMTCSPFGRIWKNSFPQSGPTAKKCHFSGRWKPQKRVPFK

SEQ ID NO: 25006 - protein, 184 aa, A.fumigatus
SKPTPTPKSFCQPVMWTHGMRMCCCTSLFRREFKSNKFCSSVMKTVYWRVTDPEHRFVSHFSWAASMYYPMLNKFFETFFRGDFPNKGKQVYLDHVEEVRSLVPPERLLEYQIKDGWGPLCEFLGEEVPDTPFPRGNDMADFFNRCRTRNRRQMMNAALQAFTMGGALLATGVAAAMVFKRFSR

SEQ ID NO: 25007 - protein, 116 aa, A.fumigatus
IQALCQPSDGLLALRKALERLGYVKCYHMMSASVENPPDCLMWHDALCAKYDGVGEFGRKEWDQLLGDCQVCLDDRRDRRNATADPSPGCLRLACLCLRRRVDRSLPQRQSHSVNP

SEQ ID NO: 25008 - protein, 94 aa, A.fumigatus
CGTMLSAPNTTVWASLAERNGISCWETARYAWTIEEIEEMQPLIPLQAVCDWPACAFAEELIEAYPNAKVILSTRDVDSWHAYVLLYKSIQKRV

SEQ ID NO: 25009 - protein, 106 aa, A.fumigatus
LISIMVIFISSLMVVATNQSFIFMKTTLSAMIDLDRLVHGVGSTCDFRLLGPWLDGHEAEERRPLSVMRSFVHMLIMVGYLKMIFDWFQSSLADSTYQFINSSAKR

SEQ ID NO: 25010 - protein, 66 aa, A.fumigatus
CPLGICHLVSVAGFSPISTTNGYSDNAGILGITVKSNKSLIGSGSSGVIKGKGLRIVSGASNIIIQ

SEQ ID NO: 25011 - protein, 78 aa, A.fumigatus
SRVRVCGLSAGRATLSSSKFTCSMWSKIIIDPCRNIAITDINPKYVWGGDAITIDNADMVWIDHVTVSSPGPILFGSL

SEQ ID NO: 25012 - protein, 160 aa, A.fumigatus
RFEPGDHLQQLLQRSQQLLRHLRRLPLLGHLPGWIQRSGHHERQLYLPFQWPQSQSPGQHPSPRGKLLTFFSKHNLTNQVNNYWYDSSGHAFEIGSGGYVLAEGNVFQNIDTIVQSPVDGQLFTSPDSNTNKVCSTYLGHVCQVNGFGSSGTFSQGLHDG

SEQ ID NO: 25013 - protein, 113 aa, A.fumigatus
FCGVTNLHPNNGLATRLQHINRLRATAWEDRLNLLKTKMKYQDLLAIAGCIANAGAVSVSGAAEGFAKGVTGGGSATAVYPSTTAELVSYLGDSEARVIVLTKTYAFIEIALL

SEQ ID NO: 25014 - protein, 89 aa, A.fumigatus
TARIGRQHLVLGTSASNRVTISNNYFNGVSSYSATCDGYHYWGIYLDGSNDLVTMKGNYIYHFSGRSPKVQGNTLLHAVSSSPSFPSTI

SEQ ID NO: 25015 - protein, 188 aa, A.fumigatus
LPHAFPLFTAPFPRTLHAKMSVLRHGGSYLQRRLTKMYTDTKTACESVTTASKAVDDPELVALHRSFRTQRDRLLAWGLDWSDASAAQPNDIDESLTQAGFSDVVESVMSSIQELLSEAERIQHGGSSDLPPKGAQKDSTSKDSLPALPVKTHWTHEDITRSKSLLADLTACIDTLYDLSRSRRTMTS

SEQ ID NO: 25016 - protein, 180 aa, A.fumigatus
DKFNCSKTTEYPRRDFENFKWNADSVSLCSDLHPDPYYKPGSSSDDGAPCHRGKGSAGYFGAEGSDCDSPFSLINETFSWIEKNLKGNIDFVLWTGDSARHDNDQKIPRTEDEVVRLNEMLANKFVDVFRDRQFPNGLSIPIVPTIGNNDIMPHNIFRGSPNRWTKRLQKIWRQFIPEHE

SEQ ID NO: 25017 - protein, 210 aa, A.fumigatus
NRSPLGVGSCIAAILNGKLLDFNYRRIAHKMGMPVDRKKGDDLRGFPIEKARLQAFFPLMALGVAAFIPYGWVLQQGAPLAVPLVLQFIIGFSFIASLNTLSTLMVDLFPDRASTASAASNLVRCWLGAVGAAVIDHMLNAMGWGWCFVFWGLLMLVGLGLLLVEYHRGMQWRLARLAKLDQRQVEKETQKAASENKEAHGDENEANSDT

SEQ ID NO: 25018 - protein, 229 aa, A.fumigatus
RPAYILASTVYLAANIGFALQNSYVALMVLRCIQSAGSSGTIAFGYGVVADIATAAERGSFIGPVSAGVMVAPALGPVIGGILAKFLGWRSVFWFLVIISGGYLVVFMTTMPETNRNIVGNGSVPPDQWWRMSVIQYLAARRRLQKMTTEERIAHQQQRANLNQARGHQKLSFPNPLKAFVILLEKDAFIVVSYVGLAMLANTALLTSTPNLFGKLYGFNDLQIGLCYM

SEQ ID NO: 25019 - protein, 649 aa, A.fumigatus
  UNSURE (397): Identity of amino acid sequences at the above locations are unknown.
EGFGNMELKETTSGLPEEVLLSKVESFSTRFSGTFQTPVRSFKPSRRVKIITLCHSECEITQNGNSVALALYLLDQDAESMTVVNLRADRVALPKKDAVTAKKQRKKASSEERSLLVQATGIHHFANIQDACRVVDGHTSRILTLGAAHNGDNELYLQSPWSNPIKIDIPHSLMLYERYGVSSSTSANRPRDSGMNRIMADSPISISGLDHPSVRGKFDVIDATKRRHKLQIQMEPSNELVKDIIQICKFVLRGFEKAGDGILAGWWETVKWLRARGTGETDLEWTAMIIVLFAMALQFIDSDQTPVKQARRKKGLLRSSSGSYVDLESWEAMLDKESSSCGVVAPWMASSSWGWILEQDAEHDAVKSQGMNARKTDQQASKGSTFRTNTYLFRCIXLAREFLRTPQGNSTIGPNGHLPTALSCNDTLRRTALCTIVVGLHLFREEQKLSICDAEHERKPLGLLAPVLAQIGGWLGWTSWTWADNAYYGSEMASMERWQFEASRISMMDIPPEPFAPPSIFAHLETAWGQRSSPFFTLLDLVSTSESAPRNGRLWQECFRLTPRTLALNGLLSEIHDISSSFDRVKLLHRWGLTRNVVETFPQSVSTPLYEAIMRTPTQASCSWNCNLLKLVQRYDLSMSLDMDTFFSP

SEQ ID NO: 25020 - protein, 62 aa, A.fumigatus
PTIWTLDFDNSDDKTGAESLRPLSTYSRMMLMYLKGEMKSGEDDSCSPYGAGCERQLHYQML

SEQ ID NO: 25021 - protein, 208 aa, A.fumigatus
KAASSDQSSLLHLCRMHPSALLGLLAFTVAASAIPAPPASAHSKHSINNFKSKIKNVVILVMENRSFDNLLGGQKLKGLENPVNTGPYCNPYNLTDPSQGVACSAAKDFDSITNDPDHAIYGNNIEFYGTFNPDNTQIAEGKLVPHNQGFVHEQVRKYGAKVNKTVLATQVMNYYTEEQVPVLTSLVQNYLTFNHWHSDIPGVSILCL

SEQ ID NO: 25022 - protein, 74 aa, A.fumigatus
LTLQNTNPNRAALVSGTSLGHGLNDAAFTKHEFPQRSIFQQLTETGHSWINYVDPAGGTGPDAGYFNWTYVFTY

SEQ ID NO: 25023 - protein, 335 aa, A.fumigatus
LPTRPLQIQRSRNRYVSPFLDNPAMQNCEHTNADFFLAYESLSLYEDAYKCYHLAHLWRESLYCALMVPLSEADLTAHALALTTTLTEESRDYVSAAQIHAEHLHDIPAAARLLCRGSRFADATRILTLHGKKDLIPEIVDTGLADAMGVTTDLLADFRSQLNAQVPRIRELRERRAADPLAYFGGDPTTDDLGVDIPDNVSLAPTDASTLAGRTMFTRYTGKTASSRHTSKTRRREERKRARGKKGTVYEEEYLVNSVRRLIERVNSTVPEVETLVDALLRRGMRERAVAIEKAMQEVLKMCAQSREEVFGALEQNESEKDAAVLKPGLEGNAL

SEQ ID NO: 25024 - protein, 119 aa, A.fumigatus
  UNSURE (22): Identity of amino acid sequences at the above locations are unknown.
SADPSTPVVKMANESLISRRTXREYLPFLRKLQQLPEDRRRFEIDNYLGRWAKALKHLHALNAYDEIRVYVIKHGLYKEAIDLFKYQPEQLRDITHIYADFLHDHSKYKEAGIGTSLHF

SEQ ID NO: 25025 - protein, 383 aa, A.fumigatus
TLVLPAGVVKTMINRSIIGRPMPNGPVYLLQPDTLLPVEEEGEEGEIAIAGVGLAHGYYRNAALTAEKFIEWHGKRVYRTGDQGRWTRRNDGQRVVEFRGRSDRTVKNRGFLVNLPADVEEPLRQMGFGVTDVYASLINGLLVALVTPATADLDGLQSEADRRLSSFHRPGRYLAVDQFPLSANGKIDTKAIENMLKEYQARLCEGTDDEETTGGERPTEREQVIAECMYTALGLDLPSASASKDFNFFAMGGNSLAALRFTSLCRERGILLTTRDLYLHPTVRGILPYARDLAHSGLPLPDKEEQIDHRLSLKAEVAAALPLLGDIDVAPLTPLQLQLSAPIFQSDGTNTNQLRQSYPLASSEQMSNAYCSRAAGRSGDPPK

SEQ ID NO: 25026 - protein, 180 aa, A.fumigatus
RHENPIELNNQDMTGTFILRGRLDVPYEYTVRHMRDGSMYCTRAVDARQNGKICFSCLCSFKRSEGQQTFHHQPGPAQERFRALLAGKKPEDHPRSPSVDADWWIEQVQRGNIAEPEFPGLDVRNVDMTSYNATEEVKQSPEKYRQLTLYALKGSPHDSNVALSKQDLKAREQTGEFDNL

SEQ ID NO: 25027 - protein, 99 aa, A.fumigatus
EDGIQVLRSGGVVRGYTNWGTFRLPKPTTKHQARYTDGHHFIMRFDASGPVQSAVRRTLSLDPRMIRFSVVKLGDKLEEIKDVEGKVEWTNARKLADSI

SEQ ID NO: 25028 - protein, 117 aa, A.fumigatus
KHSFCRHSPYPSIEISTSPLIIVTLIRNNYLIIDLILYLYLPLLYLVFYESLTMPDLRRQIFESGKTMSRKAASREGSRRPSRAASAQSSKQSSRNVSRHPSDEEDEGNLSDDTAYR

SEQ ID NO: 25029 - protein, 119 aa, A.fumigatus
  UNSURE (7),(11): Identity of amino acid sequences at the above locations are unknown.
KGTRRCXIRSXNVMRFGETAKSSIGLFSGQDAAPFAIQDIFNDILKLFRPVGVCISIWNNVTHVIQGTEAVKNANMISYDWITTNNYVIPPSRTLEKEKREKLGEESEGKKLTYMQCRR

SEQ ID NO: 25030 - protein, 91 aa, A.fumigatus
PEKHPVVRTHPVTKWKTLYVNENFTKEIIGIEKRVSDALLDTLYRTIAEAYEYQVRWKWTPNAVAIWDNRVTFHTGIFDYCMSTPLFYGPC

SEQ ID NO: 25031 - protein, 162 aa, A.fumigatus
HPFANTMLALSLLYIPLGLAAAQLIGPVGPTTALSKKTVDCNILSYGAVADNTTDISTSLESAFNWCVRPNPGSRLVVPEGQYLISRGVVLSNATNWAFQLDGLITVAYGGNWTIDRALILEGLAGTDVLNTTINGEGDQKFLLDVLVIVNGERQSLVVNVD

SEQ ID NO: 25032 - protein, 88 aa, A.fumigatus
SLFERTRKVDLDATATTKSVFDDPVLAKYYLPHPQYENMHRFDADFRWTYREEIAVRRKTDLKIFLWILVMFFGLNLDRGNLGNAPAG

SEQ ID NO: 25033 - protein, 228 aa, A.fumigatus
  UNSURE (170): Identity of amino acid sequences at the above locations are unknown.
SFQPRGEDSPSLRGLNELVENPYFGGTSVRVPYKTEVIPLLHSMSPHARAIGAVNTLIPIRKFPDGVDTAIESSLYLEKSRAGPTKALHGDNTDWIGIGNCFRRGLSPANAIRPSSTGLVIGAGGMARAAVYSMIHLGVQNIFIYNRTKANAEKLAHHYTRQNLLAHGWXGRTLARKSTPTVPCRMTGLRSTSRQPSFAAAYLLIVSEECQLPTFSYLRNGLGALPEA

SEQ ID NO: 25034 - protein, 96 aa, A.fumigatus
ASLQETKANIMQLAYKPLNTPLMKQMRALSHRGWVALDGLDVLPEQGFAQFELFTGRRAPRRVMRRIVLQEYKEVEGQDEQSAIQSRLENLDGQPT

SEQ ID NO: 25035 - protein, 161 aa, A.fumigatus
  UNSURE (78): Identity of amino acid sequences at the above locations are unknown.
HRLDRDRKLLQKRSVSCKCHPSVVHRSGHWSGRYGSGGSVLNDPPRGAKHLHLQSYQGQRREVGSPLYPTESFGAWMXRANSRSKVHTYSPLQDDWPAKYKPPTVICSCIPAHSIGGVPAPNFQLPSQWLGSPTGGVVVEVSSRHRFKRRRLISCSWPTNL

SEQ ID NO: 25036 - protein, 177 aa, A.fumigatus
QHDNADYSENHPPPPHPPPPCSPHTSSRPVQWRPTCGIPHPPPPPHPPPPPHPPTPPAAPTPPPTTLASITTPPPTPPPSPPPPPRSPPLLRPPLSRLTRLPHPPPPPHPPATTPPLSPPPPPPPPPAPPPPPPPPPSPPPSPAPPPPPPPPLPPTPPHPTPPRPPPPPPPHPPTPP

SEQ ID NO: 25037 - protein, 195 aa, A.fumigatus
LSSSVRSIRPSIMVGIMVDSMIMLTIPRTILPHRTPPPPAHPTPPPGLYNGVRPAGFPTPPLPPTPPLPRTPPPLPRPLHPPQRPSPLSQPPPPRPRHHPPPPPAPPPYSVPRSHASPDSPTPPPRLTPRPQPHLSPPPRPPPPPQPPLPPHPPPPPPPPPPPPPPPLPPHCPPPPPTPPPPALPPPPPPTPPPP

SEQ ID NO: 25038 - protein, 171 aa, A.fumigatus
LFREPSSPTAPPPPLLTPHLLQACTMASDLRDSPPPPSPPPPPSPAPPHPSRGPYTPPNDPRLYHNPPPHAPAITPPPPPLPPPTPSPALTPHPTPPPPPPASPPGHNPTSLPPPAPPPPPSPPSPPTPPPLPPPLPRPPPPPSPPTAPHPPPPHPPPPSPPPPPPPPHPP

SEQ ID NO: 25039 - protein, 171 aa, A.fumigatus
ESSLSHVALTWSRLFTLQPISNLSTYRVFYTTAQHVPSPSPPSPHLPPPHPSPHKPHNPKSNPDNLQRQPSLLHPPLLQHHVPRRPRQPLRRPPPATKPEPRGDGTTRPRHPLPPGPDTQEPRRERHGAPAMPYLLSARGRGDLEVVPGDREGVAGCAPGRGRDPALDQRG

SEQ ID NO: 25040 - protein, 238 aa, A.fumigatus
PGAVSSHYSLFLTSLHIGFFILQLSMSPLHLLPLLISLLPIPVLTNPITPRATPTTCNGNPAYCTRLYSNITFLGAHDSPFVGPLPQQNQNLEVTEQLDLGIRFLQGQTHKNLDESDTALRLCHTSCLLEDAGTLKSFLETVKGWLDAHPDEVVTLLLTNGDNVPVARFDEAFAGAGLRDYAFVPEGSPKTLAMDAWPTLAALIEKGKRLVVFLGEYQPSVTGMFERYVRLTMVRLRR

SEQ ID NO: 25041 - protein, 149 aa, A.fumigatus
QMADTHPETPPASSPSRSTPPGSATHPLPTSWGSPRAQTHSPSTRPPQRPRRSAPRAHYPRWSRAGSRPRPGAHPATPSRSPGTTSRSPRPRADRRYGIAGAPCRSRRGSCVSGPGGSGCRGLVVPSPRGSGFVAGGGRRRGCRGRRGT

SEQ ID NO: 25042 - protein, 71 aa, A.fumigatus
LISDRRVRGEDTMRLGAFALRSTSITAKPAVQSAAFNGLRCYSTGKAKVRDACSGSIDMFRAFFTDSFFFF

SEQ ID NO: 25043 - protein, 188 aa, A.fumigatus
  UNSURE (134): Identity of amino acid sequences at the above locations are unknown.
EYSGLFWLLLTGEIPTEQQVRDLSAEWAARSDLPKFIEELIDRCPSTLHPMAQFSLAVTALEHESAFAKAYAKGINKKDYWNYTYEDSMDLIAKLPTIAAKIYRNVFKDGKVAPIQKDKDYSFNLANQLGYGDXNDFVELMPLVPHHPLRSRRWETSLAQTTSPPWDCSEPRPSSSLAGGSPPLWLGP

SEQ ID NO: 25044 - protein, 149 aa, A.fumigatus
DSEPSLSVPPLSRLSLPCSPLLSTACVAILLARPRFVTLVRGQLTCFELSLLIASSSFSPSRRRSPISFPVRSRRLRSSESKRAAYWELPPTIQRVLIKRAVVHREHGSKVIGEVTLDQAYGGARGVKCLVWEVGPESLFPSPSVSVII

SEQ ID NO: 25045 - protein, 334 aa, A.fumigatus
CFSPWLQFSHYSGLGFSICCRLVDEFLKSHRHPRESLTVIFTTRSTRKGNDTLLRLQDHLRRASASASAPAAASARVTFVAENVDLSNLVSVRALSRRLNKTFPKLDAIVLNAGLGGWTGINWPKAIWGVMTDLVHEVSWPSFKIAPAGMVTDAQTALGDDKEPRLGAVFCANVFGHYMLAHNAMPLLRHSDMLHGPGRIIWVSSLEATVKHLDIDDIQGLRTLAPYESSKALTDILALTADLPSTAPWVKSFYSVDEQPEPRKETELEPPHPNMFLTHPGICGTGILPLSWPLFYSMLAAFWLARLLGSPWHTISTYAGAVFTTRGRKAPAQA

SEQ ID NO: 25046 - protein, 68 aa, A.fumigatus
MSPRELQAVVVCQGMDCCAWRVYPPRLHGNGESKAACPSGIKFVIPSVAISLAEADIQILHHENDHRL

SEQ ID NO: 25047 - protein, 61 aa, A.fumigatus
GTMAKLAPLLAAMKKAIKTTSPNISPSLFGSSSPTASAAAPIHTPRQTSHTFFPHTDRVYR

SEQ ID NO: 25048 - protein, 348 aa, A.fumigatus
LPCGSSSESSEQPLCPVRSGARASSIRTSWGLPTRWRGASAMAAAASPSMFLRLDFLCATLTSLSFVMPAIYDSLVHSQGLTPHRAWRVAYVVPFIIIVTLALAMLFLCEDTPTGKWSQRNDNNPVMQSNIVDLHRPSASGTPSSINVSTVPEKKGVATPQIVDTEAQPVIDISLANNETIKNPTLREALRVAFSLPTLALALPYACSFGAELAINSMLGAYYLKNFPSLGQTKSGRWAAMFGLVNVVFRPAGGFMADVIYRYTRSVWGKKVWLVCLGVCMGAAALAVGLLDPKREGLMFGLVVLMAFFIAASNGANFAIVPHVHPTANGKLSVFFRQAYANRPRNRL

SEQ ID NO: 25049 - protein, 300 aa, A.fumigatus
  UNSURE (297): Identity of amino acid sequences at the above locations are unknown.
FSSSRCADIASYFTPKYIEGLGTFQDGGVRVNCPLRTALRESEVLWPSRKRPDLVVSIGTGYASEGSSFDENSTHAFLKGGFIDRAIRTFLSSPAVDGRRGWKDALDSVPQDVQKNVFRLDRILPGELPELDDINAIDELDQHDYRISEELTKAWFAKALFFELDQEPTFLQNHYECRGSILCCKHDAAGIVKQIAARFPEARFALSRGSSLGDVDGEYGCSKCGYYRKRVSFKVSNLHETVDLGVTGTTGFISIGGFPTTVQCLLENQQADSPFGRSDHSRDRWPPSRGCYCSTRXFTS

SEQ ID NO: 25050 - protein, 62 aa, A.fumigatus
NRSQNAFGDPLGCVIRSLTDYVIDNMMTQQVACPTPIAQTKASFPAPPNYIQPPQFQGFYVA

SEQ ID NO: 25051 - protein, 147 aa, A.fumigatus
ASGSRNRADHQTRFDFYFKSCSAQPATMPPKARINSKNSVEQEGRVLLAVSALKNKEILNIREAARVYNVPYTTLQRRLKGHTFRAELRVNGYKMTQNEEDSLIRWILSMDQRGAAPRPSYVREMANILLAQRGSTPTQTVGESSPG

SEQ ID NO: 25052 - protein, 63 aa, A.fumigatus
MIAITSGKKRLDLAGPLLANLFRVLFTKVTRDLQRYVQRCVGTNREIYLNLRIKAITLMGCLK

SEQ ID NO: 25053 - protein, 464 aa, A.fumigatus
STRKRNLFLFERVAPSLRSTHSYIDRPPQNRIRFPSKWPNTMMRTRMSSTMRWRRGSRRRTAGRLSPPSFDTKGLVSQQLDSFDEFISSTMQELVEEQGQVTLDQTLPPSEDEDDPVVLRRYELKFGTVMLSRPSVTEGDGATTIMLPQEARLRNLTYASPLYLGITKRIMEGRERLIADRDEDDAAPDADEDRKARGTYLQWEQKELPPDQAKEETVFIGKMPIMLKSKYCILKDLSEQALYNWNECPYDSGGYFIINGSEKVLIAQERSAGNTVQVFKKAPPSPTPYVAEIRSAVEKGSRLLSQLSLKLFAKGDSAKGGFGPTIRSTLPYVKTDIPIVVVFRALGVVSDEDILNHICYDRNDTPMLEMLKPCIEEGFVIQDREVALDFIAKRGSSQSSMNHERRVRYAREIMQKELLPHISQSEGSETRKAFFLGYMVHRLLQCALGRRDVDDRDHFGKETA

SEQ ID NO: 25054 - protein, 333 aa, A.fumigatus
  UNSURE (81),(126),(138): Identity of amino acid sequences at the above locations are unknown.
QRQGLCGRGGTSTQEIWGEIIPFQVHTFGVRFWGGLMGYIWVNIFPLPAIQLALSTRIQFFFGIFSGFMVPFLGESPRWFXVRSRSSAAKEVIARFLDKRLEDDEVLTSLQSIETTVAHEMESQKXGWRTIFSNGPQXTFRRIALGVGVNFMQQFGGVNIVAYYLPIIMKRSFGFSDRMSLILSAVDSMQWMFWTGLGTLLIDRLGRRKLLIVGAAGQSLCFAMTALGLGIGTKPLEGLAVAFIFVYYAFFVRNPSDSEAPYHLTSHMQGLSFLAIPFMYPSELNSSIHRNFACSAAMVMEWLGVYVIVAITPVGDLVPPPLWMYHYFNTNSH

SEQ ID NO: 25055 - protein, 87 aa, A.fumigatus
LTLGIESIAWKFYLVFAIANFVFTIVCWFFVVETSGLSLEEIDKMFEIKYYGGKYMTYLEAAKKAKGNPLCHELCEDGESKDKQRSL

SEQ ID NO: 25056 - protein, 76 aa, A.fumigatus
SMQVYTNLFPVRHTWYLLGTIIILNGIDWAGFEVLAIGNKEIETLPTGYRILDGLFQALGEGLDGHARLLGLTGVV

SEQ ID NO: 25057 - protein, 81 aa, A.fumigatus
ARTGRGHSGPPCRKAPAWPTARRQTPRMHDETWRVAQRPAPRPGPDPLRPRRQRRPRISGCRPCCRSSSATPTSSKHTKTF

SEQ ID NO: 25058 - protein, 98 aa, A.fumigatus
EVQINKPTDTPYTMQVLLLGGHGKVAQKLTPLLLARSWNVTSVIRNPEHENAILALGKGARGKLSVLLSSLEDVKSDDDAKKIIDAVSPDYVVWSAGM

SEQ ID NO: 25059 - protein, 118 aa, A.fumigatus
VILCHCINCKRYTGSGFSANIAVPKTSLHWTKGQPKLYVDKSERGTGVPRMFCGDCGTPFTSEPSGQDEVIIIKTGTLDDPYRDECGELAMEIWCVRKDKWVDQMKDESITRLDKSMG

SEQ ID NO: 25060 - protein, 258 aa, A.fumigatus
SRGGSSEPRRTRILPKAEKKTTRSIEFFPRGLGDRINKGITRITPVSGNCGGSNSPSRPSYPRSSCSMWQDVCSLPQTTFEAFRGNMDRLKFIKYRQSPRGSQGVVPHKDSSGVFTFLSQDDTGGLQVLNKKGEWIDAPPIEGSLVVNIQQGFEAITGGVCTATTHRVIVSLCFTLYLGHRSDVEKAPTSKTRYSIPYFSAVRMDLTLAQLKESAAHIVQRIPASDDRKKRAVDVPSEFLSPLYSCVSLLLPCAPFAV

SEQ ID NO: 25061 - protein, 118 aa, A.fumigatus
INLTPPTRISPDNPIAMAKVAALGLLLWAIPSVAVIATVKSPCLSVCGGTQKTIGDELICNDGDYNATTKGLTMKNCLLCESTSTTYSSQFDSDVYWFICMHALSLDSPTTYHTGAHG

SEQ ID NO: 25062 - protein, 97 aa, A.fumigatus
SGVVNQKYTIQVCVYENSASTSLSPCESQCLPLKPVFETLWWNRNVSLFNYCTQNNNAFPTYANGCSQCLMGNAGSNVLGNLMENMGSACKTQPIAT

SEQ ID NO: 25063 - protein, 180 aa, A.fumigatus
IELRNAYLAHHLVAIYYHHRQKRQPLGNMTAEKLRIIIVGSGLAGLAAARILREHHDVTVYERGGPDTATGGQGICLFSNGVKILQTMGFDRYRAGGVPCYGYRLFDKDGNQLQDFPVDFKKRYGADTLSMKRSDFRDELLRLATAPSDELGIQGSPAQMVFNIRSSARGRRTRTNASEG

SEQ ID NO: 25064 - protein, 60 aa, A.fumigatus
LLLMLPQITAESTLSHNQELMLCQCSNLILLFHTYGAISNCNIDEVWAQPASSKEFMERK

SEQ ID NO: 25065 - protein, 135 aa, A.fumigatus
  UNSURE (56),(129),(132): Identity of amino acid sequences at the above locations are unknown.
MTGLNPETDTILQICCYITDANLNLLDPEGFETIIHHDRSVLDSMSPWCVNTHGRXGLTAAVLASTTNSTTAAESLLAYIQRYVPHPRTALLAGNSVHADKMFLAKEPYKAVLEWLHYRILDVSAFKEXAKXWGG

SEQ ID NO: 25066 - protein, 104 aa, A.fumigatus
  UNSURE (37): Identity of amino acid sequences at the above locations are unknown.
PTPTSTSSTQKASKPSSTTTAPSSTPCRRGASTPTVXRGSLPQSSHPRPIPLPPPNPCSPTSNDTCLILARRCWRGTACTLTRCSSPRNRIRLCWSGCIIGFSM

SEQ ID NO: 25067 - protein, 83 aa, A.fumigatus
LVLASPGENLTTGIALLYSTGGNTHCLEHETQLASFVDPGDIFALSTANPSLVGEDCASCSWAVLLNLEVLELVALGKVTEYQ

SEQ ID NO: 25068 - protein, 174 aa, A.fumigatus
RVCRPTPLTRCSPPCMAWTVNGYTLACSPALSSPRLSSTTAETGSSTQTTGTNTSSTTIATGTTLPGRLPTQRQPLRRIPSRSPPSTGISPVSKRQAARFCTITAWRMRSLPRIAPRRTTSMLLIPWVSVPRSWTISIAYSRLVEWAIARRGPVRLPSGRVLPPMPAMTRRITC

SEQ ID NO: 25069 - protein, 369 aa, A.fumigatus
  UNSURE (18),(54): Identity of amino acid sequences at the above locations are unknown.
RPAHREQWLGKALEEVIXSFKDTRISYYLGCWTVAGQGWKSSQRFPENLDGVVXGAPAINLVNLCSWGSRFLKITGPPGSETFVTSAQWSAVHNEILRQCDALDGAVDGIIEDTDLCQPVFETLLCNSTAVDKTSCLTGVQANTVNEVFSAMYGLDGKWLYPRMQPGSELAASFIYYSGNGFKYSDDWYKYVVYNDSNWDHSTWTLADAAAAAAQDPFQISSFDGNISGFQKAGGKVLHYHGLEDAIITSDSSKAYYKHVADTMGLSPSELDHFYRLFPISGMGHCSPGTGAASIGQGSSTYAGDDPQDNVLMAIVQWVEKGIAPEYVRGSKMSRDGTIDYRRKHCKYPKRNRYVGPGKYTDENAWKCV

SEQ ID NO: 25070 - protein, 92 aa, A.fumigatus
HYLETRHLHIKVSAFSIDFTKPEERCFSLCSQQRKDILASHRNRYEFLLSNILTATYHSKNSVDQEIGSAIPGTDSWQRLIPSSSSLFVPCI

SEQ ID NO: 25071 - protein, 306 aa, A.fumigatus
RGGVDFVVPVMEAISGLSSSNELGRNHPRSTEETPKLLYCTAIKSRTMVNHDTVDLPVIDYAALGEKDAAGYRTAVSIDERRRLFTALRDIGFAYLKHPGVNQVTVDELFAHSRRFFAKPLEEKMQILGKLDKGRGPSQGYSNPQQLAHDPQTSDLKEFFGMYRDDDTEKPNQWLSDADSKAMRTDLVRFFDSCHGVILELLSALAEEVGLAAETLHPFIREKNHFIACLHYPATEPESFRTRVRAAAHTDYGCLTLLFNDSGEGLQVLRNNGQYEYVPRKDGCAVLNGEPSISLIGKQRKPEITD

SEQ ID NO: 25072 - protein, 95 aa, A.fumigatus
SKIRLILYTIVTTYLDITKITSNLLRYLLNPGLAHFDAANRIILYLSLIKDYILEYRSNLTGNIFIITSNTAYIDYIDYSSSKGYLIKLFSAAVN

SEQ ID NO: 25073 - protein, 221 aa, A.fumigatus
SNFQNVDSQKKASTRFAAANQEDSLKDLSRSAESFWERGHLVQAEETARRALDGQKQLLGDGHRETLTTATTLAGILKQRDRDDEAAIFYENILQTADEVLGGEDLVTLRVLNDLGLLLQKQRKYDAARRMHEQAVRAYAAHYGEEHSSSIISMTNLARVMKAQRDYEEAEDLFRHGLALREELLGVTHPETMDSVRFLGRAGGITGQRDRRSTAGTDGRK

SEQ ID NO: 25074 - protein, 176 aa, A.fumigatus
  UNSURE (173): Identity of amino acid sequences at the above locations are unknown.
RLNVTTRRQKTYFDMDWRSARSCWESRIRKPWIVYVSWVEQAESLVRETAGRQLALMGGNSPDLLQCMSSFAILMLDHGRTDATVEIAKRAVETRKHWKDKHALDTVDPNTLTSLNNLAGVLQSCGHHYSAEEIHREVLEGSRLVLGPDHPNTLSTCSNLAQLLDKSSPRAGXHIH

SEQ ID NO: 25075 - protein, 310 aa, A.fumigatus
TDSCCARPTRDSMQLWADLVQNQSYTFDNTLPYYQETVQFRPPDALRRAANATAQYNPDAFAHEGQRPLHVSYPVYAMPFSTWMRLGVEEVGINETLDFNSGSLFGAQYGSFTIRPSDETRSSSQAAFLSPLPSSAYLKIYQSTMAKRILFNPQKQASGVRVTGLLRTFTLNAKREVIISAGVFHTPQLLMVSGVGPADTLAEHGIDIVQDAPGVGQNMWDHVFFGPTYQVALETFTKVPTDPWYLASQLAQYIFSHGGVLTSPVIDYLAFEKIPNSFRLNFSVQTIRDLSWFPNDWPEIEVGRLDVLLC

SEQ ID NO: 25076 - protein, 137 aa, A.fumigatus
QYISTAAYVGNFSNPVVSQPSGGKQYATILGALVAPTSRGNVTIASNDTSDLPIINPNWLSTEADQQIAIAAYKRIRGMFHSTAMAPIVVGDEYFPGSQYQTDAEILEVIRNTLMTIYHAACTCKMGTRDEFSPRRW

SEQ ID NO: 25077 - protein, 177 aa, A.fumigatus
PGMLLYRSWMQVHRAHPVYEQVAGELRKMTAFIRQEALEKAREIQLKADEEFAIEKSKLVRQETAAIDSLYEKKFKQAAMSQQITRSTLANRTRLRVLSARQELLNDLFQQAREKISTVASHGCPDITRPFLKGLNLQGPGSLLNGGPRYPFGGQEIPDFQRGVKQCHSKETVEKEF

SEQ ID NO: 25078 - protein, 125 aa, A.fumigatus
YLPLVLINSVGLSNSMARILTACNAISYFIFSCVIATMVERLGRRGLMLLSGFGQSLSILVITILLCFAENNKVYGTASVAFFFLYHIAFGVGMLGVPWLYPTEINSLPMRTKGAAVATATNWLV

SEQ ID NO: 25079 - protein, 62 aa, A.fumigatus
CLWTLHRITNFAIVEITPIGIQNLGWKFWIVWTVLNAVFLPVIYFLYPETGKSVWINFPFSG

SEQ ID NO: 25080 - protein, 72 aa, A.fumigatus
PQSILTANRTLEDVDAYYRTNPPLIVVLDPDAISTKRPLRFTQHEDEELQRKVKEVQIEIPKGDSADVEHAE

SEQ ID NO: 25081 - protein, 290 aa, A.fumigatus
AKPGDVKDYFWSSTQSLFTDGWTLVFSRISSVFGDIPNGESATAAGDTSSRVRDTRSIADSPRLVRAAYKSLQLVASDFIALLPRQCRLDLVNSLSRFALQQEDFNISLTTTSSFWNISDFLQGQIEEFCIESHVELSVSEETLSALARGDEPSVSRNALWLLLLLRIVSLARDSRLEIRNCAIQTLLRIFDAYGQQLSPKAWRLCLNRVLFLMVETIELELANSRAAEKARGSEVVHSWIETAVVMIKGIANLITTFFGAYGWRQCLWTLPGNISWDICTSLSAQTSWS

SEQ ID NO: 25082 - protein, 107 aa, A.fumigatus
RSSVLVIMEYTEHDLLQMSRLTLSLTRTIAAPVMWLWPPETALTVVPNISHRHCDLTGIKLCTHHEVFYDMKASYISSLPLLFYRESALVIGARDKINLVPFMCTWI

SEQ ID NO: 25083 - protein, 118 aa, A.fumigatus
NQFCPFVEDRSIGGRLSWGFHDEAQKAIAQGQSWSKVRDATADLQTSLRSMKFETPDNEAAVTEKVSPVFPIKIGSLSPLTILHSMRRSFRPCRRGSLQCRTSKETNVRRGDIFFHVY

SEQ ID NO: 25084 - protein, 140 aa, A.fumigatus
LTSGITISVPVKMQRSPALARSTISPRKITSMVRGMLPVGISCDDSCSFTFCQSTNVLFPISRRHPERFMHMSFGHCVGSVYRKVCSTFETTDLHCSQTKVPRESSGRISDVRVTVPEIESSFPIWAVRSWRSLETKGRL

SEQ ID NO: 25085 - protein, 426 aa, A.fumigatus
  UNSURE (18),(19): Identity of amino acid sequences at the above locations are unknown.
FRTNPRQEEFGVYTLEGXXYQLTSLNNQILADAIANQYFGFQPFLTRALHNLIAKYEPEYFVSHRQASSASSQASSSMMAANASVTENPDLERNMREKTRHQQTDKLFSLAFYNLPLVSRLRQLRTAQIGKLLSISGTVTRTSEIRPELSLGTFVCEQCKSVVSNVEQTFRYTEPTQCPNDICMNRSGWRLDIGKSTFVDWQKVKLQESSHEIPTGSMPRTMDVILRGEMVDRAKAGERCIFTGTLIVIPDVSQLGLPGVRPEAVRDNGAFRSGDVGGGGVTGLKSLGVRDLTYRLAFLACMVTPDTTTPGQQSNQQLNGQSHNILASLNQNNEPEVDEDKAQEALLQSFTPYEVQDLKNLVHSEYIYSRLVDSIAPMIYGHRQIKKGLLLQLIGGVSKHTEQENMQLRGDINICIVGDPSTSKSC

SEQ ID NO: 25086 - protein, 368 aa, A.fumigatus
NQGSKQDVEALVDYIYDTKKGLGWDLDFVVPFAAIPENGREIDSIDSKSELAHRIMLTNLLRLLGCIKTQKQTHGFETRPAQVILPLSPNHGTFGNDGLYSESKLALETLFNRWYSENWSNYLTICGAVIGWTRGTGLMSGNNMVAEGVEKLGVRTFSQQEMAFNLLGLMAPAIVNLCQLDPVWADLNGGLQFIPDLKSLMTKLRTDIMETSDVRQAVIKETAIENKVVNGEESELLYKKVIAEPRANIKFQFPTLPDWEQDVKPLNESLKGMVNLDKVVVVTGFAEVGPWGNSRTRWEMEAYGKFSLEGCVEMAWIMGLIKHHNGPLKGKAYSGWVDAKTGEPVDDKDVKAKYEKYILHDGVEVRVM

SEQ ID NO: 25087 - protein, 147 aa, A.fumigatus
PLSRFVLKTKEQRAAEKAMMDKSPLNTLTLEDWLESERHKLTGNLTPVTPETFAKWKKERLDKKAAEEQARKAKEATGRALFESGNWRAEEESDDEDGDDGTWNLEALRRETEKLREKKEEERLARLAGISLTPSSNDETVAQEGEG

SEQ ID NO: 25088 - protein, 91 aa, A.fumigatus
TNYSSRCSIGQMGRTDLRKVVLSKHGNPRTTTEKVCKYFIEAVENQKYGWFWVCPNGGDKCMYKHSLPPGYVPVPVSKALYPGVNLYLDSC

SEQ ID NO: 25089 - protein, 295 aa, A.fumigatus
  UNSURE (155): Identity of amino acid sequences at the above locations are unknown.
IPRHRSTCTKPTSRTRTRIWTAFRRLTADEILPEVQWGVRYHTYVVNSPVYCAYLLRKFVLNGGQTREYTLVDPMEAFELSGTGTGPVRTVVNCSGLGFGDPKSFIIRGMSRALSLQVLIQLLIRLPGQTCLVRNPCSVTITRQNSDGTWSFCIXRPLSGGTIIGGTKQPHDWNPTPSLETRKQLLSSAEKWFPFTEGSGGQFDVIRDIVGRRPAREGGMRIEAERVGGDRFIVHAYGAGGRGFELSWGVAQDVVQLMFENGLARQKVSLYIILEVSTHGSFTNNKALPVADSLY

SEQ ID NO: 25090 - protein, 74 aa, A.fumigatus
PRVLTAKPQGENNQSTPQNIHNFKHLARGGSILQGSKCLDGEEHLDSPPPEYLHEANIQNAYAHLDGFPPPNSR

SEQ ID NO: 25091 - protein, 163 aa, A.fumigatus
  UNSURE (61): Identity of amino acid sequences at the above locations are unknown.
TYCTTDDRHDMTHLQVNLSAVAPSATPPISLPINVAIHNPAATPVTFVNWGTPFDPKANLXGVFQINDTATDHPITLDTIKFQRRLPPSREDLVEIPAESSMERTITIPHVPLEEGHEYAVQAKGIWHGIWECARNQVTDAQLQELDQRGEFESERALFKVTQ

SEQ ID NO: 25092 - protein, 135 aa, A.fumigatus
  UNSURE (44): Identity of amino acid sequences at the above locations are unknown.
PLGRRSLRHSPHQPPHQRRHPQPSSHPSHLRQLGHPVRPKSQPXGRLPDQRHRHRSSNHPRHHQVPAPAASVAGGSRRDPRRELHGADHYHPTCAAGRRPRVRRAGQGHLAWNLGVCAQPGDGCAAAGARPEGGV

SEQ ID NO: 25093 - protein, 176 aa, A.fumigatus
  UNSURE (170): Identity of amino acid sequences at the above locations are unknown.
PLHGAVACSNLCLLSQVNQSISPSSCGKATMQTTIDIPTDAARVFSILAQGGIGIVPSSVGYGIIATEPPALQRIYTVKRRQPHKRHAIIGSYALHREIHVLPPDKMALVRWLTVDLNLPLGVIARYRRDHPLLARLDEETRAASSMDGTMAMLVNGGPFQEELVRVAAXAGRAVL

SEQ ID NO: 25094 - protein, 80 aa, A.fumigatus
PVFSFLLPPLFTYPSPLSVLACPSFSPSVPLSLFPSLISHFQLLCSLLSIFHFLIPVPFIFLPSCTLFSPSSFPYILFLL

SEQ ID NO: 25095 - protein, 572 aa, A.fumigatus
CCGPFQPRGEDVQSERLKKVLGEVLDGYPGVTMTLERVEFRSPFKPFVHRWERFASARDQELDSVTKSHVDLLYTTLEEELRDTIARKNDLVLNGVVTHDLLWTIFEPEDEIFSMVDGRPRAFRFKSGETNCRTGAFDLEAQYIDFDGEDFGFRDKDFEVVPFGGTMPITALPVFPLRHHSDQISIRDALIARGAVWETYKGYHFKYYEGLAVGRYMRREFKFNIKSRIIIDAEAFNTFNPDESVSVYPTCGNELTDDERLLAAPTLRGYSLKEKRWLEFNLDSVKEIVWDSQAFDSLVLPQDQQDLKTLILAFANAQSKQADSFDDVVQGKGRGIIMQLSGPPGVGKTLTAESVAEVMKVPLYVMSAGDLGTSASRVEDAFKDILRMVLNWGGSLLFHYTYVSFPSPPLSDFFSTHHCSTFPPPLPFLTCVFFPSSPSFHLPFPSLGPCLPLVLSLRSSFPLPLSHLPLPITMFTSIYLPFSYPRSLHLSSLLYPFFPFFLPLHLIPSVVSAPSSFFPLAFSFGTPLLIHLASNGLSSSPPGYHLSFLYRFLNFPFLYLSLPFSLSICSSI

SEQ ID NO: 25096 - protein, 80 aa, A.fumigatus
SIHTFATDAINEFTVVRSISDMPHSELCSYCYVTRYKMMQATPYSIYDKTYQSDLEFIHSKCGLSGPTSILPPLQESPDP

SEQ ID NO: 25097 - protein, 65 aa, A.fumigatus
PPTVGVGIKSAISADYVNSRFGSLEGHHPSPFVQEVIAFTFLVYLLNYDIYWNPFVSIECTIRDW

SEQ ID NO: 25098 - protein, 288 aa, A.fumigatus
  UNSURE (40): Identity of amino acid sequences at the above locations are unknown.
SGAVAGLTVDCSLYPLDTIKTRLQKARHHAPSTPGSTLSXRQTIRGIYAGLPSVLFGSAPSAASFFIVYDGVKRSLFPPAGSDTAATRSRIVITHSLASSMGEIAACAVRVPTEVVKQRAQAGLFGGSSLLALKDILALRHPDPTGIAKRGYGQVIREMYRGAGITIAREIPFTVLQFTMWESMKEAYAKRMLVPSTRESGAVSQIPASTSAMFGSVAGAIAAGLTTPLDVIKTRVMLARRGEGGDARVRIRDVVQEISGEGFGAFWRGMGPRVAWIFFTTPAGRSCN

SEQ ID NO: 25099 - protein, 355 aa, A.fumigatus
RGSFAPRGEDEIAKMQAEAGGNGNEMDDYARVTSAFEVTTLDDGEEQGEPEDKEDPEHLVGFARLYSGTLSVGDEVYVLAPKFSPEHPHAHPEPQKVTVTDLYLLMGRSLEPLKTVPAGVIFGIGGLAGHILKNGTLCSQLEGSINLAGVSLNAPPIVRVSLEPANPADLNKMVTGLRLLEQSDPCAQYEVLPSGEHVILTAGELHLERCIKDLRERFAKCEIQTGQTIVPYRETIVSAPEMAPPKKPDLGRGCVLAVSPSKQLTVKLRVVPLPEAVTDFISKNVGTIKRLQSEKRSAGETKSDAKASNGSLETTQQAESGDASGEAREGSLLSQEDIIRELTRIFNEEDKEGKE

SEQ ID NO: 25100 - protein, 101 aa, A.fumigatus
ANRRPNIGTWHPLGRVTGGTLYPGLMVTSGVIYHILRFLTIPVDIRNICVLLAPGFSGLTALAMYLLTSEMSPSPSAGLLAAAFMGIAPGYISRSVAVKLR

SEQ ID NO: 25101 - protein, 94 aa, A.fumigatus
LITFFLPGFESIIHECKYRSIVYLRPSAFNGPRLDELILMLRDIVDPWFNFRATKYLVQNGFYSFWDWFDDRMWFPTAQECMKQQVTCPGVLLG

SEQ ID NO: 25102 - protein, 60 aa, A.fumigatus
TRTFHPVVKIWAEQTDLTLLILVSLHTLETLESIMEHASRRVEAKVLVRNDARSVPTIGR

SEQ ID NO: 25103 - protein, 105 aa, A.fumigatus
GAGGTKRSCVRKDLHWYGSLFSGIRANLGTNANISVDHMLSIEWSAANGWNAPRIVPYQNLSLDPSACVFHYAFECFEGMKAYKDKKGQIRLFRPDLHHGVEGPR

SEQ ID NO: 25104 - protein, 295 aa, A.fumigatus
KRNYCPVPSVKTNWPTWKHVHKHLTGYLRMQTGNLPSGLDPSPDLQAIAEKNSVKETNKLLKLLLIAVIRSPNPERFVNQIQDLSLQAQEGLKIAIEESNGELIPSDVEDETTEDTKKQDLSVDLELQFEERVGKVIAENDRLTHEKKELEKALEDLHNRLARLQENNDTLQSRLASTEDRLVTLKSGKGDIGVSAKALESKTRQQEDLIASQEERIAAAQDEIDTLRMTVESLHVKNQRFQKLQDDYDELKTDRDQLARKANAAEKYRQKLQASQAFEKEHQLPLRKSPIRASL

SEQ ID NO: 25105 - protein, 98 aa, A.fumigatus
RYGPRTYHRLTAVGQWSLHPFFGRSSSEIYSKYQKVYESRYYHIQISAAQAQLGHHYSPLFHFNTIVTFSFCKLSAVNLSGLRNPQSSPRGWKDQRCR

SEQ ID NO: 25106 - protein, 66 aa, A.fumigatus
  UNSURE (58),(61): Identity of amino acid sequences at the above locations are unknown.
FHCIVFAGKDPSRALACSSLKPEDCRPDWYDLDDKEKTVLSEWFTFFSKKIHILRKVXDAXNYYCP

SEQ ID NO: 25107 - protein, 77 aa, A.fumigatus
PHHYGGIVQMRRYVIFSVGFVNDGKQLTDALFAGTDPSRPTLVAIKGIVFDVSKNPAYGPNGQYRGRLILPLPCAAK

SEQ ID NO: 25108 - protein, 81 aa, A.fumigatus
ITSVCGLPSQSGDSVRVMVISLLRYYLTDYIGVYRTRVASLKSTASRLKVYNDPYIPPSILEDASKVPFNKRQVTVVNGSL

SEQ ID NO: 25109 - protein, 186 aa, A.fumigatus
IEPPLDLLFPAVKTSGKWNKMPILTGFNTNEGTYYVPSAMSHRRMGSFFRTLLPAYSDKDIRTIDELYPDPAVDPSSPYRETRSIPVGPQYKRVEAAYGHYAYACPVRQTATLASAGQEEPVFLYRWALNKTVQGGANHGDQMEYETYNPEVRGISSSQDEIAGTFHAYITSFIVAGDPNAVGGKV

SEQ ID NO: 25110 - protein, 362 aa, A.fumigatus
LDGAGLIARQVGLQHSHVLIHCSDGWDRTGQLSALSQICLDPYFRTMEGFMVLVEKDWLSFGHMFRHRTGPLSSEKWFQIENERIGGDSGRPFGEGGGASKAIENAFLSAKGFFNRDNTSRDSLPDSEGEMQNYDSDSPRKPGSAPRSVVSEKEVTKVKETSPVFHQFLDATYQLLYQYPTRFEFNERFLRRLLYHLYSCQYGTFLFNSEKERVEMKAKERTRSVWDYFLARREQFLNPKYDPLVDDHKRGKERLIFPRINEVRWWSEAFGRTDAEMNGVRSASVTPSVRRGSPASESTPVLTGIETAHHAVGSGASGNVTNNATSTGMAAVASGISNLSFSKGKESSQEPKNLSQMELEMQ

SEQ ID NO: 25111 - protein, 339 aa, A.fumigatus
  UNSURE (337): Identity of amino acid sequences at the above locations are unknown.
HFDADDATMSAFDPSNVDLNTASKEDVICFLSLSENEYNGHLGARISSIFVIFITSTVFTLFPVVAQRLPQWRIPHHVYLFGRYFGTGVIVATAFIHLLDPAYQSIGPGTCIGMSGAWGEYSWCAAIVLSSVILVFLLDVGAEVYVEWKYSVPREANATATFITQPACSSPHESSDRLTATEPSSPTGGKDLYPHADELSVASEQAFRQDIAAFLILEFGIIFHSVIIGLNLGVAGDEFATLYPVLVFHQSFEGLGIGARMSALHFGRRRWLPWILCLAYGLTTPVAIAIGLGVRTSYSPGSRTALTVQGVLDALSAGILIYSGLGLHHGAGRVHAXKS

SEQ ID NO: 25112 - protein, 63 aa, A.fumigatus
IFPQPAGRKAPSGANTISAKQEGLDSSDTDNPYVAEPGKSVKGEGETDSVKLKGTVDPARPQR

SEQ ID NO: 25113 - protein, 75 aa, A.fumigatus
TTFVKRHLTGEFEKKYIATLGVEVHPLTFTTVCPANNPALSFHFASPGRLTFRDRTWERFSSMYGTQLVRRSSAV

SEQ ID NO: 25114 - protein, 87 aa, A.fumigatus
PEGKGRHCHALESYTTSSLDAYHNFSPFFLSFLANDNSIYDEQKANLLTGFGHLRMAEKNFHTVSLLQGGYSLLPHTALQRKPLYGK

SEQ ID NO: 25115 - protein, 62 aa, A.fumigatus
HLVDSLEFQGTASSINSFIMGDVIGFLLGIGPMNSIYVSTTCIQHLGTTSLGQLLKQLRVFI

SEQ ID NO: 25116 - protein, 95 aa, A.fumigatus
VIVGLLGSDGHTEHHETGDLVRVCENIPIVLCGNKVDVKERKVKAKTITFHRKKNLQYYDISAKSNYNFEKPFLWLARKLVGNAALVSFRAYIVL

SEQ ID NO: 25117 - protein, 95 aa, A.fumigatus
NLGTIQFDVWDTAGQEKFGGLRDGYYINGQCGIIMFDVTSRITYKNVPNWHRKLLSAYWGVMAILNITKQVTSSVSARTSPSFSAATKSMLRSAR

SEQ ID NO: 25118 - protein, 68 aa, A.fumigatus
  UNSURE (41),(50): Identity of amino acid sequences at the above locations are unknown.
LTPLSSFSRRNYLHSTTFRADITAKQPKTVHRTKLGIVHIXPVPIKPTTXSEVIKDDCPEPFPIPGKY

SEQ ID NO: 25119 - protein, 219 aa, A.fumigatus
RENLAVPPGDPGSYKSPFFKDFIHLNVAMMTSNNALVPDPDKQDDLASKFWQWPILNVGLRMCSWDDNTIKYYLLGNPFVYWGSTFSLGVFGLLIFWYLARWQRGYKDLNQADIDHIHYSGFYPLLGWILHYFPFIIMARVTYVHHYYPALYYAILTFGFCVDWLTQKMSPVARGSLYAFLYVIIIGMFVHFRVIVFGIEGPSQQWANLNWLSGWRIAN

SEQ ID NO: 25120 - protein, 83 aa, A.fumigatus
YSIRSHLVTRLSFQQGNGYALLRLYGDVTIEKDAGVDTLFFPFGLVKVAGEGLQLGNYMRFKETKYFNASVDCLIVTVPQTTA

SEQ ID NO: 25121 - protein, 60 aa, A.fumigatus
CSPTTKGNLYGALQVDMTQASEQKAPRHLCTELPCAKLSDRKKGAYSDAGYMLRPYRVHY

SEQ ID NO: 25122 - protein, 93 aa, A.fumigatus
NKSAGEFPAGSVGGALAPAAPKFSMSLNNNKPKNVFAAMAKKNPLAGKKGPVLEQPKKMTEQERIMKEEMEAMERKRMRAGSGFPNAKRPKIS

SEQ ID NO: 25123 - protein, 65 aa, A.fumigatus
LSILFGISTEDSFISLSYNNQSSIAVANTTMISSNFAHHGYIAYCPSFAVILTTSRLWFRTCRRP

SEQ ID NO: 25124 - protein, 63 aa, A.fumigatus
AGPPDLIYFYPHATTTSTTTTGCAVGYGQHRPRWFILAKIYLSSQSNQQFDDEVNYLAYTKPF

SEQ ID NO: 25125 - protein, 124 aa, A.fumigatus
RGSFRPRGEDRWHRAEMQVTKGENLIKHEAEIMSRPKRTWFETERDKRAARKLGATELNGPSKKDKVKLSNKDKKRLDDARQRHEGNIGWKKGKADREAPKQGKNKGGKTKSDKKNKIKMKGKK

SEQ ID NO: 25126 - protein, 183 aa, A.fumigatus
  UNSURE (18): Identity of amino acid sequences at the above locations are unknown.
DPWPPGTFFFHLFHSGFXFPWQDTFPFSPARPAIGSLADTRSQEMEVYTGVRAASSRNAAPPADVKIHTIFPMGILSPGFDNEQGLKPQLTKELEAADKPQRPIEVAKASIQGLEKGDYLITTMFVGHMMKASALGASPRNSIITDTLTSWLSSLVFLQVIPDLRKKAFNWGLKNGVPSSQSK

SEQ ID NO: 25127 - protein, 448 aa, A.fumigatus
STRSCQPVLKTTPMLGTDAAVGDAERRGRPRPSLSERTIETLSRIPPSPGPPSRQSSFFNGNSPVRSPSRTPSVMTSRSPSRASTTRQPSENDFLSQQASAIQLPSRSRISPAPTLSSNDASTGQRTSSAGTDISSTLKKPSVRASLYNGVNDTTRKSPDPRPALGKTSANATFSDMGPPPPPLHVKKTRKSLANNSSPINNSRKPSTPLNAPDLSIEQQSEIEMRKASKSSSALRESIAKAKAARKASARQNNTQNGSVDIFDNLNVEDPFNQQPKDSKSGLLRKRVEAGRTSGHLNIAAMSLTEIPKEVMAMYDFDPNSTTDWYESVDLVKFIAADNEFVELSEAAFPDIDPFDIDSDKDERGNQFAGLEIMDLHGNQLRTLPMGFRRLQRLHTLTLSNNKLDAESIQIVMQMEALKDLKLANNLLEGSFSSVFTTGLEGSGGCYW

SEQ ID NO: 25128 - protein, 80 aa, A.fumigatus
RPLKVRGLIPIRLCLSCHLHWWRRLTSMNGTVGIQCAFRFYLSYTNTILVQAWVSILLAVHGAGIAVGSRESLWKYLCSS

SEQ ID NO: 25129 - protein, 143 aa, A.fumigatus
VSLEVPLLKLICDPIAICACWADRSATRRWPYLAGLLGLVGATLILSFSESVSLFVVGRLLQGLSGAVAWTVPLAIITDRVGVTQVGPYLGYMTLGRSAGMSAGPIFGGLVFLYWGYFRTYVTAFIILGIDIALRLLLVQGPQ

SEQ ID NO: 25130 - protein, 129 aa, A.fumigatus
  UNSURE (26): Identity of amino acid sequences at the above locations are unknown.
ESSHPPNLYTPLDSPSSPPFPTHARXDTMKTSWALATLVALASAKGSKGAQCRCLPGDSCWPSPASWAALNSTVGGRLVATVPIGSPCHDPTYDAAACAALRDAWNLPQTQYVELRYAGMLHRNKGRES

SEQ ID NO: 25131 - protein, 252 aa, A.fumigatus
  UNSURE (185),(209),(234): Identity of amino acid sequences at the above locations are unknown.
VSWLGNKDGRETANGRCSYFARSSGAGALSVWMHHFNDIQYKDWSDSHYKGPAFKVGAGVMGFQVLEAAHARGLVVVGGECPTVGLAGGYIQGGGHSALSTSYGLGADNALEFQVVTAAGKLVTANRSTNPDLFWAISGGGAGNYGVVISATIKAHPDATVAGAGLQFLSSKTTADKFYEAILEXHGLVPEMIDAVPPSSTRSLSSSLXSTLFTAYHQDDGRCQELCWRPSLTXWISLNFPFTVSIPRSLIL

SEQ ID NO: 25132 - protein, 180 aa, A.fumigatus
  UNSURE (3): Identity of amino acid sequences at the above locations are unknown.
YAXPCRRLVKTVPSSSFNGDAPLHSPAFSHFRHSSIDTRPSTAEAKLHEDDEADLAAAIGLCNFGTPRTGPVPMSPGIPPVPPLPSRYLDLSNGTGSISQSLDPAATVNATSSLTESTPNIFLSVSYNPSLSYKISDEREVKMGDADRVQRQNRNADVDFSNRPAHADDDDDGVFGRMEE

SEQ ID NO: 25133 - protein, 80 aa, A.fumigatus
  UNSURE (30): Identity of amino acid sequences at the above locations are unknown.
GLRGSQSRAPKEYLLSNFFSSSHTPKISPXKNISFFLSPFPLNKSPHSRSLLKISFLSFSPQIFTSYPFCVPFYRLRLSI

SEQ ID NO: 25134 - protein, 186 aa, A.fumigatus
LSPASLMRAWISTSRTAISAFSFLRSSIRLIICVLDFSKTANIVRNRSRLVERRGSEVILGGVLGLLIWSLPPLPIAALVCAASYAAFSSRSESSSSEMASASSMSSRICSRCFIFCSRSAFFPNEIRPSSTYSSNPSAKSSSSRISLVSRMSSFSVFFRPHSSSLMFSSREMKSCSSVSGSHFLW

SEQ ID NO: 25135 - protein, 333 aa, A.fumigatus
GVKTPTRKTKEKGPRETRRRGLILTRGCGKFQTPVKGPKGQLTGWTEEGTKDHLESSMRKNMGESKGKDYGAFRPIPEGKAEIRGKRKEGRSPVYQRKWLPETEEQDFISLEENMSDEEWGLKKTEKEDMRDTRLIREDEDFAEGFDEYVEDGRISLGKKAEREQKMKQREQMRELIEEAEAISDEDDSDLEEKAAYEAAQTRAAIGSGGRDHINRPRTPPKITSLPRLSTSLERLRTMLAVLEKSRTQMINRMEDLRKEKADIAVREVEIQALIKEAGDNYERLRQEAGLTPGSEEDLSIATDIKNARGLESFGASIAGSAGDSGSQSPSST

SEQ ID NO: 25136 - protein, 81 aa, A.fumigatus
NPGLGAYIGFLGVIWFTWLQITLFDIRFARDSVFERICKAAQLAAMVGFASAGTRFTTQIRGENVWAFQSLSLLLGVFTKG

SEQ ID NO: 25137 - protein, 94 aa, A.fumigatus
YLTSLHICLYTIRRYSPCIMKHSPPAQQTQRPPHPIPPLSESTPLAPPMHLFSIPPSIHLPSLNTFPPANPLLLSPHNPSPPFPNFCEKPSPPT

SEQ ID NO: 25138 - protein, 188 aa, A.fumigatus
VRTGVQLAIIAAVALLLVVILDNKFRVLPASIHGHLPTHYAGYVVTDVTVVTCSSISIFSSCKVDPKAWSRIEKDLYLRSGWTSSAYVQFQRKKEEELLASDKVVIDLKISRLIPQSSNDPHGEKIEWEQRPGGIWLKRTAKRHASDSQKAITSIDVLFGADAVDPRVGWEVKDTPLPLVFTYGNGRI

SEQ ID NO: 25139 - protein, 84 aa, A.fumigatus
SDAERELAASSRLWLLSLVSLSPFLTYSCYVSFYQLVCLGSFPPRLLIPLELKDHLFIHGFLRSCQSNLSSLFLYIFSVLPIVA

SEQ ID NO: 25140 - protein, 107 aa, A.fumigatus
IVESTRAWRDAWSSILLHQERMLCEFDGIYAPIIGSSDPTTAKAAPTPEVTLARTRRLREEYEELRKELAEELNAVDQRMIRPASQAKEYLAPLKKTIKKREDRKVA

SEQ ID NO: 25141 - protein, 107 aa, A.fumigatus
QVVFVPRGRGKGVARGGGSRASANRKTTAPKVVAAPVESVVEIPTQPIDPDSFSRSLGPTAKQQPTVDLSTQAGAARGLAGASRGRRGASRGPARGNNRGRGKLWVP

SEQ ID NO: 25142 - protein, 251 aa, A.fumigatus
HILCQHPFLPIASGTSTSPLFRSRAKTLASLTTSKLGSQSDSTPKEIHLPEDPFVNGQPIEAYLYKDATECPICFLYYPPYLNRTRCCDQPICSECFVQIKRPDPHPPEHGEAEPNAAAAEGDRRDNQDCQLVSEPAACPFCVQPEFGVTYTPPPFRRGLVYATDPTLRPNFTSPMSSTSSLASANASPGTGRRRATSLSANDPAVITTDRVRPDWAQKLANARAHAARRSAAATALHTAAYLKNSTESGK

SEQ ID NO: 25143 - protein, 161 aa, A.fumigatus
KSQYFFQLIGHCKDTQQMTTTASETARLHITPFTPDLLPSVLPSSIRASATDISFHSIATFPENNYGYVTLPAMEADKIKKKLNGSILKGRKFKVETARPPKRQEVDVETDTVMSIRKTTSDKVSQKRKANDNVLDGYELPSGRQVKRGWTESADAKKGET

SEQ ID NO: 25144 - protein, 244 aa, A.fumigatus
KEGGQSRQMPRKGRRKDEKLKKGKDGKKAKTQVKSKYTEKSECLFRTKIPKNRSASPDEKQEKQIKKKKKSPQESVVHEFATTITHPSFLRSEVDGAAPTSAFEEGKGWIDSAGNLKETVSDRLRKDQYRPGQVAGAKEKRKSAKAHPTAQETHLEKTEDDRIDSADESEDWTSSSGTTSSDDSSTDSEIDDGMSSASSESSASFNRGEQQQSHSLTTKENVSSPRKTDESELCLPHAGRRNQV

SEQ ID NO: 25145 - protein, 129 aa, A.fumigatus
SIQSCEHHTKPESHTSFKVSEQGTIKPPSTLQESDTDQTITDTMNKTSTELIALKSPMAKHSSLIFFLHTAAKIIILLAIVDVLRVLIRQVQVYLDQQAREHNEIHGPQRVRLVRRRRRLDDDIFGFPF

SEQ ID NO: 25146 - protein, 72 aa, A.fumigatus
HDEIKTQFSRHYNHQRAKCKDPKIILEWFNHVQIIIMQYGIIPKDIYNFNETGFVMGLVATAKVVIRAKMLS

SEQ ID NO: 25147 - protein, 227 aa, A.fumigatus
RTVSARQAYRRIRRVLQLQWRGVTLVLIIIANVIFFSVTFIELDSSLKPTAENMEKALPWVACLAATNGDREKCDPEAAKFRPSEGLLLAVLVLLSLVGFWNFILFARPSIFHGWVDFFQNKFGTGDGRLEFVSADARTRLGDTRSYEMLNSTGLPSYKSPSPMVRSPSPARMGGTKSPENGHFGRDARYVRPSMSFSSPRPPSASQGRGWDPKTTFAPAVYREYDD

SEQ ID NO: 25148 - protein, 128 aa, A.fumigatus
WSMCRYFLFQAGLIPIILLMTDPTSTDAPAWLQDVETTKKLLTHPSLSNNRLATRCLEVVNRLCSPTYTSSVSDGSTPIQPPMLMQFSDQLLNDPMFGSMFPDVDQELNLGGMDFSEWVNYTPQTDLH

SEQ ID NO: 25149 - protein, 74 aa, A.fumigatus
DAPGNLADGAEYVLDLLNILFLQRIWLFIKIWIASLSFSELRLDLNDALFLLMRRCVTEDQIHIFESLLTGLSS

SEQ ID NO: 25150 - protein, 62 aa, A.fumigatus
LILGIYLDITCTISKLTYFTRNPSPNYFIIVKYIFHYLAEILLLLLYYPSIFSNVNSFINAN

SEQ ID NO: 25151 - protein, 239 aa, A.fumigatus
RTSSFVILISNSYKLKDWHLYIYWPLATSIGMPSSPTSDRNDLLLNVTILTFILFRAWKLSGSAMRGAFALGLHLRNVGICTSDTSKEIRYRVWWSLYTLDHLLSAMTGRPSCIVDNSCTTPLPVPFDEPDFQKEEVVRMIGDASRGNSNQLDRISPVCPSASDLSTTLDAKTADGTANAKTSGSSMVEYLKSLPPCMSLYFIQLSTLTSINKRMTSKLYGPEAMHSPWPSKEFTIQSL

SEQ ID NO: 25152 - protein, 158 aa, A.fumigatus
RRLGWSSPRIVSGPWCELAVLEEFSFTNNCVFFTNRANQEVLNWLTKMKKSIGNDLSDQAIKDYLWSTLNAGQVVPGYGHAVLRKTDPRYVSQREFALRKLPDDPMFKLVSQVYKIAPGVLTEHGKTKNPYPNVDAVSSSLLMIDSGMASDHGRLTHL

SEQ ID NO: 25153 - protein, 62 aa, A.fumigatus
HSGVLLQYYGLTEANYYTVLFGVSRALGVLPQLIIDRALGAPIERPKSFSTEAYAKLVGAKL

SEQ ID NO: 25154 - protein, 404 aa, A.fumigatus
LFGLLLFTTFWGDQVRSFVAAILRSWIAREGKMARLGRFGFLALAVVFHLIYAYSIFDIYFVSPIVSGMRSYGVEREPGAKAPASRLVLFVADGLRADKAFQPAPDPSPEDGEDAENNDPIYLAPFIRSRVLSHGTFGVSHTRVPTESRPGHVALIAGLYEDVSAVTTGWTLNPVNFDSVFNQSLHTWSWGSPDILAMFKEGAVPGRVDADMYGEEIEDFTMDATQLDTWVFNKVKELFASAKSDPELDAKLRQDKVVFFLHLLGLDTTGHGYRPYSREYLHNIKIVDKGVQEIATLIEEFYGDDRTAFVFTADHGMSDWGSHGDGHPDNTRTPLVVWGSGVAGPKYTDGKAVTGHEDGFSADWGLDGIQRHDVAQADVAALMAYLAGLDFPVNSVGQLPLPIY

SEQ ID NO: 25155 - protein, 85 aa, A.fumigatus
VRCWASPCDKYELFSPAGHCSSSSSYSSLVDSDLTMASLARSTLRLRATSRFPVAARTLTTSPHLRAAAKPYFPDEPSAPKVVTA

SEQ ID NO: 25156 - protein, 104 aa, A.fumigatus
HFAGQQNLRSAEEMEEEEREAQSAKLQELIRRGTPADLQEANRLMKVMAGFDTRHKTDYRAKAAEEVAKVQQKAKILEEMLQSHKPGDRIAEGDVFEVKIAPGD

SEQ ID NO: 25157 - protein, 73 aa, A.fumigatus
SSADPSSPVVKTEEWRQTICQTSRYKEDLGHIRDMHRLLLYKGYMFPEIRHEDAAVLNPSDVRPCLRGSRPMA

SEQ ID NO: 25158 - protein, 129 aa, A.fumigatus
PIRIGNLRVHFKVLIRRFRRCAKKESDDPEAVHKLLEINDSIHRTIERYKLVKKGDYDTASKIPKGTLGTTTGVSKNANNELSLIDFDPEPSSNGNAPPPAGGSSLENDLLGLSIEEPVPAGSISLGPG

SEQ ID NO: 25159 - protein, 156 aa, A.fumigatus
RLTMDIGNLTTSANAPLQQAPAGFKPTYDIMASFNSSRPVSQSSTPAPRPPQQPTATPTPPPPPASDPFAALVSASPRTSSPFPPGASSTQSPAAASSALLDLVGAGPPTTAAASGSSAQTQDDDEWNFASSLPESNALPTTNKVSSPRGWKEPRH

SEQ ID NO: 25160 - protein, 319 aa, A.fumigatus
YLSADPSSLVVKTQLDDDQDAFNEDTFGDVGTGSVGKDFDFFGQTAKVADAIGEEQVRFNLQHSGAPSGSSAKEIAAQPPATSVSSDKPKRTGYEKYQDPGYIPDLQAKSSVWGLQKKPEPAHEPVHEPASQTKKMLSLEEVEAQLRSRGIASVQPPVSMPMPMPDLSHLQRTQQLPNGPEAFSQLPPEFLQAQFPKDVPPAHLLHHPSMVPEPYSLPPSAPNVPLHLLHNANVLPQHMAPPQRQAIPPRVQQPPPQHPPPQAIKGANTGLPLITNPQQLMQLTEEQRMAYLMEDAKRAKRNHKIFLLSSPRGWKEPCH

SEQ ID NO: 25161 - protein, 100 aa, A.fumigatus
TTADPSSPVVKTYGHASPVIIAGGYKADSALEAVDSRYKGYDVVIGIGRPWTSNPDLPFKIKAGIPLRPYEREFFYLPKDPKGYIDYEPSEEFKATQVAA

SEQ ID NO: 25162 - protein, 230 aa, A.fumigatus
KMYQFVEVFKDPRTYFIAVIVAAMNISNAAISSFSVLIIRSFGYTTKETELLTIPGGVVSVISIVTGTYLAGRFDQRCLSLIGILACGLLGGCLMAFSHEGMKAAELAGNYLTTCVGAALPLMYSISGANVVGHTKKVTLNTIVLMSFCLGNILGPLTFRTEDEPDYMPAKIAIVATVSVAVVFSVLLKRYYMYENRRRDIQAEGHGPENSDFFGSDGQGESGRLRYSMF

SEQ ID NO: 25163 - protein, 369 aa, A.fumigatus
  UNSURE (342),(355),(358),(363),(364),(365),(366): Identity of amino acid sequences at the above locations are unknown.
DLTDHNRSHQEASMRHWDPQYVADFDRHNYSHIRTARVQPPGSLFQNSHQVAVHQRSNVQPRGPHDVTASAYQMIPPDTANTPAPLENQHYGGVRYRPAYSPPSYARPNPYMPFPQWTISPVTNQPRRHHRTQNSSSTASAVQGQQQATSVGHTARRRTRPAGETNPQLPRRLSTSQVPRVPAVATATSSSPGMAIGAPHYLTYLTPEDHVRIQRLAELQAYTSSMRTGSVVHGSHRQHSLDDDGIGDRGSSTPKGLDDTTDGRPEPKEDKDLTVNLECKICMSQLVDTVTIPCGHAILCRWCAEQHIPSSQLDQARVKGRPLCPMCRGVVKSKVRPRIRRXDSANVIVVRLHHXAEXGAFNXXXXPSP

SEQ ID NO: 25164 - protein, 65 aa, A.fumigatus
GSVTKFVPYLVAGVQHSLQDIGVKSLDELHDGVNKGIVRFEMRSASAMAEGNVHGLHSYDKKLYS

SEQ ID NO: 25165 - protein, 77 aa, A.fumigatus
SSGSVQIQSEWFLLEPSFEAQLFVYVFSAISGLHSKFMERDISAPFTCAIVIPHMSVFAVLFYKNTYLAGGYQVSGQ

SEQ ID NO: 25166 - protein, 292 aa, A.fumigatus
PQVRFNFTTVGDLQSVEKDTTIDIIGVLKDVGETTQIVSKTTSKPYDKRELTLVDSSGFSVRLTIWGSTALNFNATPESVIAFKGVKVSDFGGRSLSLLSSGSMTVDPDIEEAHRLKGWYDAQGRHETFASHATMSNASSSAKRLDHLKTIAQVREEQLGMSEDAVYFSLKGTVIYIKQDNMCYPACLSEGCNKKVTELDPGQWRCESCDKTHPRPEYRYIMLINVSDHTGQLWLSCFDEVGKQVMGTSADQLMDLRQNGEKAAGDIFQEANCRTWNFRCRAKLDHFGDQQR

SEQ ID NO: 25167 - protein, 241 aa, A.fumigatus
KIVYKVVQDKEGRPRVVEVELDENGNVIKKEKMDDVQDPSGREFTEEELLIASPVVLGFAFSEKLWLEFSVSGISDIDWNEDAFDSLVLPDNQKSIVKALVESHTFRAAQNIDDVIQGKGKGLVAVLHGPPGTGKTLTAEGIAELLKRPLYMVSAGELGTDSRTLEAELNKILDIAHSWGAVLLLDEADIFLEKRTIQDIHRNALVSIFLRLLEYFQGILFLTTNRVETSSHTAPGRIRDC

SEQ ID NO: 25168 - protein, 84 aa, A.fumigatus
KQLLTCFLSSQAMDVGTLKSLPADTIRILVWILSFLSFGYATAEFEVTSERLGVYRPEEHIEYVNPLFCSARLRFGTDASVRLL

SEQ ID NO: 25169 - protein, 421 aa, A.fumigatus
  UNSURE (419),(420): Identity of amino acid sequences at the above locations are unknown.
ASVMRRLSLRSPPRDSEYTARRSISSMSIPYSVRRVYVLVLMLLSDFCSNPKDYADNQDARQYDSRLRGPIRQVELEIDPQTGMKNYIANERGDWATSTAYIKYSLARSIHYGRLYTSGGHHKGKEEDLCEALRCLGQGLHTLEDFAAHTNYCELALREMGFRNVFPHTGAATEMNIRGHRVFPLVTGTFGMVDFFHSVLGEATDHFTQSEVNEMDIALGDAQANSSGGSLSAFTGLLGKIPGTKDLIAEAEELKRRSDAQQYANQHGGQRTGYAHETSRGLDSYGSAVGRDLGESLSRASGPSQPSTSGGPAGPGLPGMPDFDPKKTVAQIYPILQFRDNVVRKLSSIIEKIPGLEALVEKVTETLTIFVMSLLAPFIRPIINAASNSLQAGSSSVIDASGKHQFEPCLHHGAGRIDXXV

SEQ ID NO: 25170 - protein, 61 aa, A.fumigatus
RYTLLPVRQKPQSTEYGVRENVLSGKHGLVQPCNPKSQYLDELSKVSARSEDVKQPNQIMK

SEQ ID NO: 25171 - protein, 70 aa, A.fumigatus
IPPTLASLLPQAATNTIRSTTEFYQRWSMPVEEFRDTINNCYQKYDTMSYSIQRIILPQEAKMEVHPKAY

SEQ ID NO: 25172 - protein, 338 aa, A.fumigatus
LTLPLQLARSTMLATRRGVRSISTDDLIFLIRHDKAKVSRLKTFLSWKDVRKNVKDSDDKGGADAADFAGADDPIAGGVVAGPQDVASKPKNKRARVGLVWDVNSFYSVQVPEREDEEDEEEEEQNYATLQRLAAADERTKNMTREEYVFWSECRQASFTYRKSKRFREWAGFGIVTESKPNDDIVDILGFLTFEIVQTLTEEALKVKEREDREKIRRGGAESGAGENTKKRKRETGLFDPPEEGRTPVEPRHIREAYRKLQATPNKNIAMLLHNGRIPARMPLRLVGSILSCISDLHADLLPDLTEFHILSPSYTRTFPFPAFTFFPSAELYYDRYP

SEQ ID NO: 25173 - protein, 186 aa, A.fumigatus
  UNSURE (92),(148),(168): Identity of amino acid sequences at the above locations are unknown.
PTTMKQTGTLVALAGLVSMVHGHGFVTSPKPRMPGPAMKAACGNQVEINQQSDNYGNIQGELQVSKGQSDYNADECNIWLCKGYKFDDNKDXVYSYTAGQTVDFVVDIRAPHTGVANVSVVDTATNTVIGNTLKSWNDYASNATGVSXDENNFSITIPDNLGNKCSEXPCLCSPMGMVPPNLFNRT

SEQ ID NO: 25174 - protein, 180 aa, A.fumigatus
ASRRVGAQCSDVSLAGIIDRERILTGDRDIHNRIDQFDLRDQLHGLDCAVQDGPRDPAMDDLRCVPGFQHFDRGNSHVRESFYSTYQQVFLWAEIFTFICNPGILTVAQVCYLQLAWFVIMVTVAAAAPKHNDSEFVFRTWMNNTGWENNVICFITGLVNPLYSLGGLDGITVCPFPEDV

SEQ ID NO: 25175 - protein, 80 aa, A.fumigatus
RGTGIFTTASTNLIYATNFMALIALYKTDLVIQPWMTFVAYQGFNILTGGTVMFGNRFIPLINKFSCGLRFSLSYVTLAY

SEQ ID NO: 25176 - protein, 93 aa, A.fumigatus
SPRSTPVDLALVGRSLVIMRNFMVDGFSIYGFIFVFIMQCFLGTSLAEFVSAYPVEGGMYHWIAAIAPKRYNSILSFATGWSTVFGCELGWDH

SEQ ID NO: 25177 - protein, 274 aa, A.fumigatus
  UNSURE (23),(27): Identity of amino acid sequences at the above locations are unknown.
YETPDEDESKLEWVVITNGTPAXCTQXGLFNVFADRGPIDLVISGPNHGRNASTMYNLSSGTVGGALEAAICGKRGIAISFGSKDEQPIEVIRAAARLAVRVVNHLYQNWDERVELYNLNVPMRADVETRPVLYTRTLPYYWPKGCLYAEVTQANGHSAPGLTNGNSNHSDETDAKLCNGTTTKAVNGFGGSHLKKRNFAWSAELSEMKKALQASEKGTDAHTVLNGSTRLASSIIFRPRDGTSRLQEADCPIQRYSPYRKLLACFWSGWTLGA

SEQ ID NO: 25178 - protein, 143 aa, A.fumigatus
ALTQIKAQDIRSDANPDNVGLTETSTVVCSTHPTDVFLGSSGTLLPGVEVRIMTPEGKEVTSYDTPGELVVRSPSVVLGYLNNEKATKETFEDGWMRTGDEAVVRVSPKGTEHIFIVDRIKELIKVKVRYPRSCISSLALSFN

SEQ ID NO: 25179 - protein, 97 aa, A.fumigatus
KGVMISHRNVIANTLQITACEKTWRDSLTPTGGPRYTDIALGLLPYSHIYALVVICHSGPFRGDQVIVLPKFELKSYLSAIQQFKITSLFLVSGVNS

SEQ ID NO: 25180 - protein, 74 aa, A.fumigatus
SEDTIEQMLTEDPSFSKVPPIIITMLRSQEICSKFDLSSVTSLFTGAAPLGMETAADFNKIYPKVIIRQGYGKH

SEQ ID NO: 25181 - protein, 109 aa, A.fumigatus
GLQVAPAELEAHLLTHPAVADCAVIAIPDEAAGEVPKAIVVKSASAGNDDEAIIQSIKKHVEDHKARHKWLKGGVRFIDVIPKSPSGKILRRLLRDQEKELRRQAGAKL

SEQ ID NO: 25182 - protein, 82 aa, A.fumigatus
  UNSURE (48),(53),(61),(74): Identity of amino acid sequences at the above locations are unknown.
WYTNPSLVKHGDTPAPSAASTALSVSSPASVLPASPSPVTAYTSTSSXRMSTXTVKGYTEXFFPGNNWECMGSXGKNPDTPG

SEQ ID NO: 25183 - protein, 190 aa, A.fumigatus
LQPRAAHDNMPPPVGRYGPSGLSGPYSHLQQAHLQQQQQQQQQQQQAQHHPAHAQSANTALPPPSLGGHPGFAAGNPNTNINPFTLSGTGIANGMSVAGFTGAGDGGGSGLASHAAQIGFARGAQMQQQQLLQTHDGRLALETKAGGVKTRIRDVWKHNLAQEMAVLRQLVEKYPYISMVCPYWDDDPGG

SEQ ID NO: 25184 - protein, 227 aa, A.fumigatus
QHRTMLYQRLTALGVAALVAASSVSASPMARGVKGRCRAKYNKAVSHVPTTHEATPTINLPVELPETRSQSPWPTVDEIVPVKKPQADEDPNASSSSSSSSSSLSTTSALPSSPATQEQDTVSAAPAEPTTAAPETVNKAATTASSSSSTTHSGKATFYGGNVSGGTCSFTGYTLPSGLFGTAYSGAAWNNAAECGACVSVTGPNGKTIKAMVRLLFSCGSYHIYPS

SEQ ID NO: 25185 - protein, 143 aa, A.fumigatus
NHQSNGTSPLFVRIISYIPQLTPPIQIVDQCPECEQDHLDLFQNAFTQLADVSKGIIPITWSFVPCGITTPLVLKNKGGTSPYWFSMQVMNASEPVAKLEVSTDGGKTWQGTTRTSHNFFEKSNGFGKDTVGLEGYRAIRQLP

SEQ ID NO: 25186 - protein, 75 aa, A.fumigatus
IGVVLLLIQSIPQEMCLKIRCILESSPMLRDEKVNDPLSSLQSVLIILKQLTFVLNYSGADVVVSSERRRRSREI

SEQ ID NO: 25187 - protein, 82 aa, A.fumigatus
RRITRYSIACLFRNNVHVPLGIAVLGLYSFQLSLLTLGYFPTISFCFFRFWFCLDQSSRVLHFATPLILSGNVILGDWICGS

SEQ ID NO: 25188 - protein, 390 aa, A.fumigatus
AQFAVPSRPVVKTFLMKTVNSVNKDGSRKYHLDIQLNTLVTNVRFDTTGERPRAIGVDYLRGQSLYRADPRASKASAGTPGSVNAAKEVILSAGTFNTPQLLKLSGIGPKEELSKWNIRTLVNLPGVGKNLQDRYETGLVGKAPTDFVLTSKCTFMYSMPDPCLDQWKNNAINKGTYTTNGIAIAIVRKTSTAEGKPDVLISGAPVNFPGYYPNYSYEGLKDAQYWTWITLKAQSRNNAGTVELRSADPRDTPIINFHSFDSGVTDNGADEKDLQAVYESMLFSRKIFNDLVPLDGKFEEVWPGPNVTSEADLKDFIKREAWGHHACCTAAIGADEDPNAVLDSDFRVRGVDGLRVVDASVFPKIPGWYIALPIYMISEKAADVIIADAA

SEQ ID NO: 25189 - protein, 113 aa, A.fumigatus
NLDDTSKVQNYTFTDFSPGFLAKAAERFSKDAVILEFLTLNIEEDPLAQGFQAESFDLIVCANVLHATRSMQETVAHCRCFLKLGGKLVLSEVTIGGLGGICREISRWLRRRA

SEQ ID NO: 25190 - protein, 383 aa, A.fumigatus
  UNSURE (249): Identity of amino acid sequences at the above locations are unknown.
PPCLLVSLQRSPCLLLFMVHGRILEVMHSNQPRLCSSHNDEPAFYSIVDSDDPYVQSLMEQALQRRLRKGQYQMVSKLSDLPSPSAPLFQYREYERLDFEHAMMYSNTSLINAYIIRKALIRKHYLSNTVANWVTKHPNSVLRNHFKFACDFELDYAEFLDEALLEAYELRESLDRNEGKPDSEKEWWILKAGMSDRGQGIRLFNSEDQLREIFEEWEEDNSDDGSEPENPDTEDQNGDRDGQGVVTSXLRHFIAQPYIDPPLILPSSSNRKFHIRTYVLAVGSLKVYVYKEMLALFAAKPYCPPWEDEDEVIDLARHLTNTCFQEGGSTNEGSVRRFWDLDHHVPGLSHGWKEKIFDQICAVTGEVFEAAVFTTGLEGSAQQ

SEQ ID NO: 25191 - protein, 338 aa, A.fumigatus
GRGSSIPVVEDTLPRTHRRRREKKLMTMDEVNSRFPLTKYKAWRSTRANASIPTAEVISTADSSLHSPNIKNGTLVVDTSVSPSLVKSASTDSQRQMGPTIAQTSTVAPDAGAQFAQLDEKSNGRPIFADCIHARDVSKYTNDEMKDIHNQDSCECHGLEDIGDADHPIRTAPLAELLPTPADSCAICLDVIEDDDDIRGLTCGHAFHASCVDPWLTSRRACCPLCKADYFTPKPRSDPVVERASTDRRSMVGMYAPSRPRPVFIGWRSNPFRRTTILPQRLMRRDGIPPSQLSGALNVDSYMAHNASDTRSEISRPQPRGSMRLFRLHDGAGRKRDA

SEQ ID NO: 25192 - protein, 65 aa, A.fumigatus
LTLFSGTSGQAKNYITRTQAVRKLQISLPDFRRLCIFKGMFRKYDPLFLFSICGGVDPDRIASAI

SEQ ID NO: 25193 - protein, 94 aa, A.fumigatus
  UNSURE (20): Identity of amino acid sequences at the above locations are unknown.
QQGGLEGNSGESRQRDQISXTWMKPRRSRPPRRPENLMEQIDKFEPAAPEADTLPQPDLMGTEAGSLFAPFTFYISREAPRAPLEYFLRPFGWE

SEQ ID NO: 25194 - protein, 279 aa, A.fumigatus
  UNSURE (277): Identity of amino acid sequences at the above locations are unknown.
SDCFCDLGIYPREPRNKKKASKTSTPNTTFYYTKDIQYLLHEPLLRKFREQKAVAKKIARSLGRGEVGDAARLEKNHAPKLTLDHVIKERYPTFIDALRDLDDALSLLFLFANLPSTAHVPPKTIALCQRLCHEFQHYLITTNSLRKSFLSIKGIYYQATIQGQDILWLVPYRFVQRVNGDVDYRIMATFVDFYTTLLGFVNFRLYSSIGLRYPPKFDTRSDENGAELAAFTLEGRGVGDAPKAIEAGNTQATTSTNNKEVSKEIQAKVDNVIKSAXPG

SEQ ID NO: 25195 - protein, 78 aa, A.fumigatus
LMRLYVKDCITMGKFPIAAVFSTNPISDVSNSEQVMRSSTSKGTCVTISLGPKNNFLCLDPVVHMLCHSSLGIPYSSP

SEQ ID NO: 25196 - protein, 186 aa, A.fumigatus
QVSNNSFVKTLTGKTITLDVESSDTIDNVKAKIQDKEGIPPDQQRLIFAGKQLEDGRTLSDYNIQKVRESLTDDDWFRFVYAHGVFSGDASCSLDCWTWFPDPRAGPSAPGDVWIVMEDLQLLRRMCSADRMLLHMFRSPPSTWSSVCVVVLLNPPSRLSLPSTTARSPSAASATYVFVPIARPNM

SEQ ID NO: 25197 - protein, 141 aa, A.fumigatus
ESTLHLVLRLRGGIIEPSLKALASKYNCEKSICRKCYVRLCPDRSTQHVTRYWGRSLWNSLLTRSLYRPVFLPVPPTAVRRSAVTATSCAPRRSSSKRFLSCYGFSALLGERDARSYDVIATWEVLKGVGMMKHYSRSHIF

SEQ ID NO: 25198 - protein, 133 aa, A.fumigatus
ILHNNPHISWRRRSCPRIRKPSPAIQRTTCISRKYPMRINETKPIVVRQRFAYLLNVVVAQGAAILKLLTSEDQALLVRGDTLLVLDLGLDVVDGVARLNVEGNGLTRQGLDETIVRNLSVMAFPEVPRISCR

SEQ ID NO: 25199 - protein, 86 aa, A.fumigatus
QSTHLLAQTVLPEDPETKSSNPANNLHLPKIPHAHKRNETNRRPSEIRVPSECCSRSGCGHPQAAYQRRSGAAGQGGYPPCPGSWP

SEQ ID NO: 25200 - protein, 73 aa, A.fumigatus
  UNSURE (17),(38),(73): Identity of amino acid sequences at the above locations are unknown.
DSTKRWYWNLSPRASWXHGYDGIVMGKTNWTLARRLPXCHRSIKTRITIIENMRLTHNVLVSFTDTTGGISCX

SEQ ID NO: 25201 - protein, 78 aa, A.fumigatus
GPNLCTGLLYWLTRHQSEQLTSFNSIDCQQLTGKNIEQRSDHVQRRAMHRNAVLFCDYELITLYLATFDRYSVRALLC

SEQ ID NO: 25202 - protein, 64 aa, A.fumigatus
VRGVLLDTCTKYSKLSQAVDAGPAQRLQVLQSHKPINVPFQKHAMSSLFTKTLTGRQQFQAPYA

SEQ ID NO: 25203 - protein, 76 aa, A.fumigatus
RIRPNTRRSPAKMSLTNCRFYEEKYPEVDSYVMVNVKQVCDCFYDNGRSFAGIFDYLSVVHSADRRNGRIPEGSSI

SEQ ID NO: 25204 - protein, 66 aa, A.fumigatus
QIAVSTRRSTRRSTAMSWSMSSRYATVSMIMVVLLQESSTISLWFILQIAEMGAYLKALQFDNLNA

SEQ ID NO: 25205 - protein, 138 aa, A.fumigatus
  UNSURE (11): Identity of amino acid sequences at the above locations are unknown.
SPRTAVPSSAXRVDEEAIQAYEQALTINPNFVRARYNLGVSCINIGCYPEAAQHLLGALSMHRVVEQEGRERAREIVGGGEGGIDDEQLERMLHISQNQSTNLYDTLRRVFSQMGRRDLADMVVAGMDVNVFRKEFDF

SEQ ID NO: 25206 - protein, 75 aa, A.fumigatus
  UNSURE (64): Identity of amino acid sequences at the above locations are unknown.
FTFPSTRMAVVTGAQLIARTLRDLGVTVIFGIVGIPVIEIAESAIDLGIRFIAFRNEQACSYAXSVYGYLTGQPG

SEQ ID NO: 25207 - protein, 95 aa, A.fumigatus
ASYVVRSITTGTRSRLNFGAQWNEQSNPDNVTADIISTVEFDHTGNYLATGDKGGRVVLFERNETVATTFSFHSSNAQGSNESTRKKPASISFTP

SEQ ID NO: 25208 - protein, 120 aa, A.fumigatus
LPSHRTIHSMVYNAMKMFMEINPQLFDECSHEYNERQNSAEQREKSRQERWEKVLERAKQRKNGLLPPPAPPAEVPAQVDEVDALAQDNQKRLNALKLEDSASNKERKEGATATVSSILP

SEQ ID NO: 25209 - protein, 381 aa, A.fumigatus
  UNSURE (282),(306): Identity of amino acid sequences at the above locations are unknown.
IRSARVRHSKSLREEAAPAQTVTEEVPLVDSKPVELSSAESTKAEKAPTKMTTDEAPLAEKSSEKTVPAEPIAEEKVQATIGDEPLSRNNVEEQPKQKSVEANKAADEAVLEEPIKESAPEEIPEDSRNAVVADAPVTESSTTEKVEVTAPDAEKEPALKESAKEPIQEEIPEASEKEVAAETPVTESSTTEKVEVTALDAEKEPALEESTKEPIHEEQTIETVVTAEVTAAKEPEAQATEEPVANESINQRGRGNNGGSLLLAKNSAKEPISNETAIRVTXADESTKELSTGFAAAEDITGKGAXHLTEVSTAAGRTGQGFCQRRICCKIGSNRGEPGTHLRTIPLQWLFPKEPEPPNAEKTAVEESFWRQFPKPPWDEF

SEQ ID NO: 25210 - protein, 228 aa, A.fumigatus
  UNSURE (24): Identity of amino acid sequences at the above locations are unknown.
SAPLPVMSSAAANPVDSSFVDSSXWVTRIAVSLLIGSLAEFLASSRLPPLLPRPLWLMDSLATGSSVACASGSLAAVTSAVTTVSIVCSSWIGSLVDSSRAGSFSASSAVTSTFSVVDDSVTGVSAATSFSEASGISSWIGSLADSLRAGSFSASGAVTSTFSVVDDSVTGASATTAFLESSGISSGADSLIGSSRTASSAALFASTDFCFGCSSTLFRESGSSPMVA

SEQ ID NO: 25211 - protein, 154 aa, A.fumigatus
SFQPRGEDAKHPNIVGVKLTCGNTGKLARIAAQAKPDFLTFGGSADFTLQTLIAGGAGIIGGVANLIPRSCVRLMELYRSGKIAEAQTLQAVVARADWLAIKGGFVAVKSALQSYRGYGALPRRPCVPPSAEEASALKNAFQEGMEMERSFEVA

SEQ ID NO: 25212 - protein, 71 aa, A.fumigatus
RQRLASQLGSNSTLAREFSGDRAASSVEEISTLGLNADQEALVRKTYYEALRMVWVMVSHRNIATVPVQSC

SEQ ID NO: 25213 - protein, 133 aa, A.fumigatus
LVSITIHGVVRRGACVRSQPSLPHCPLQSEVLRLTRCLRRTRSTEEFSYFTLRKKETEKAPATSLFGIACSRQLDSNLLINRPADVTRSTVQKAVVVITDTPQSVGQLREKLSVVTSAWFAQRYVENIHVCVK

SEQ ID NO: 25214 - protein, 133 aa, A.fumigatus
FLAGSPRSNLGVPLKVVSSPNVQSPAGNSPTSRLGPIPKFLGFSPSSKLFTYFSWHGHHKSSFYDVAWVLTGQPIVGSNLACIFTDVAGIWTGIPDVSVLLSHIARVLTNIAQLQPYVPQLQPGFSCVQPYVA

SEQ ID NO: 25215 - protein, 179 aa, A.fumigatus
APFPSFLGSPPVPSYSPTSLGMGITSPRFMTSPGFLRASPSLAPTSRAYSPTSPAYGQASPTSPSYSPTSPGFSPTSPNYSPTSPSFSPASPAFSPTSPSYSPTSPAIGGAGRHLSPTSPTSPKYTPTSPGWSPTSPQTYSPTSPNFAGSPTSPGGPTSPGYSPTSPAFSPSYVPSSSA

SEQ ID NO: 25216 - protein, 69 aa, A.fumigatus
TQRELPQVPVVEEHSTFFNTTEYKALFSLSCRISREHDESFSTAYLSIYTHLYRHRGYNYTINPGAECL

SEQ ID NO: 25217 - protein, 108 aa, A.fumigatus
FGISQVKSQPKPATAAKAANTTRGRGARRGRRGGGRSSNRPKPKTVEELDAEMVDYFASNENAGPADANAPAAANGAVQQPAAGGEDLGMAEISVSFADFNAHWTHRH

SEQ ID NO: 25218 - protein, 70 aa, A.fumigatus
SAGPVKRVMLTYNKNGTSRGIASIVFSRPDTAAKAAKELNGLLVDGRPMKVRGASSSFSFQPSLTLRRLK

SEQ ID NO: 25219 - protein, 82 aa, A.fumigatus
QPSPPPQETSPQPPPASPAPGTYSSRPHYHLNRLNLPAGTELKKRPPVNAPPERLMPMPEGNLLRRIAGPVPGCLVGSAPRS

SEQ ID NO: 25220 - protein, 217 aa, A.fumigatus
LITNSTSKVVFAYGPVIMVSCPICGNSVPSLKINDHIDSNCENFIEEPTSSTGEPGSSHKTPVPSFFQPTSVRKAASQSIPQNDSPSAPSPLRPASGKRTITHEKESALNGDNPDQGEAQREPHPKKPKVNALQKAAPLAERMRPRTLDEVCGQELVGPNGVLRGLIEQDRVPSMILWGHAGTGKTTIARVIASMVGSRFVEINSTTTGVAECKKIF

SEQ ID NO: 25221 - protein, 153 aa, A.fumigatus
RRKGPTGRFEYLGNGRVIISGKERRVRSFKRICGGTGITPIFQVLRAVMQDPQDPTSCVVLFGNRQEEDILCRAELDAFEASDKNKCKIVHTLSKAPDTWAGRRGRIGEALLKEFAVPDDESMVLICGPEAMENSAKTILLAQGWKESNLHFF

SEQ ID NO: 25222 - protein, 210 aa, A.fumigatus
DALLHPACRSLPGPLAFSNASAASGWAQKISPYASGYHLKAAFHANDQTNAERLLRSVWGPMSDPSLANYTGCTWETLNADGTPGLGAATSLCHAWGSGPTADLSRYVLGVQAVTPGFKEWTVHPQTLGLGYARGKHPVPQGNIRVDWSFGKDGLLNMTVTAPAGTKGIIFPPSPLKVPLSKYRVSGHARKVGEGFEIQGGQAFTLQQSR

SEQ ID NO: 25223 - protein, 141 aa, A.fumigatus
  UNSURE (5),(14),(22),(78),(81): Identity of amino acid sequences at the above locations are unknown.
EYFPXRSSLVIFVXYRDFKVPXEYAPLAIRTRAAALATASNWIFTYLVVEITPVSIKSIGWRTYIYFSVFNFCFIPLXYIXYPETRNLSLEHIDRLFTGEKILLHLPQSMLADAEDAVAPGTDNSDGKDVDLREVENVKLG

SEQ ID NO: 25224 - protein, 265 aa, A.fumigatus
RKPEVGNPGQGRPSSTAGPFLEPVKRGKFLDHKGERWTLAGEVALEALGGPKVVWKPGRTDLVDDSKVPPRGRLPDATQGAEHLRAVFYRMGFNDQEIVALAGGHTLGRCHIDRSGFQGPWVNNPTRFSNQFFKLLLTLDWKPKTLPNGISQFVYVDPDAEEGDEPLMMLPTDIALKTDPAFRVWVDKYAADKDLFFDHFAKAFAKLMELGIKRDENDRVINADNVKGGYISAPKKSNHPTGPAKGAQGGCPVAASQGGCPRAKL

SEQ ID NO: 25225 - protein, 115 aa, A.fumigatus
VSIRNASRACSGLMSEYFVEEMSRLLDEEKQMTHKALSARVDAKIDDAKFFNKLGKLPAEFDAQQIDWAYGPVIQSGGKYDLRLTAVSDNSNLEPGIIIAGFGIRYKTYSSMIAR

SEQ ID NO: 25226 - protein, 97 aa, A.fumigatus
FFRQAKHTLHDNLNSNAHQIMAEEIVIDKTLFFNRLSSFYAAWRADKRSSHPTFGGVGSIVILMGKTDEASTFQKNNAMHVCSILTTSFGTSFATLT

SEQ ID NO: 25227 - protein, 64 aa, A.fumigatus
QPIEKQSLVYHNLFSHDLMGVGVEIVVQGVLSLPEELEVYKSSQASLVALSSGFGNATMVNTRF

SEQ ID NO: 25228 - protein, 248 aa, A.fumigatus
CPSPRVKTQLHADNCANTGVSSSTVSSSVVPVTPTSSAVQESTPATSPTPESSAPGSTTTVKTTMTSTFCPESTIPAGSGSQPSHSASATQSSSPNCPTDLSGQYEFPHLIIPVDSSSPNKAPGTSFNGTVSSTVSSIFNFDIPSSDAGKTCSLVFLFPKKEDLETSSYSFSGDGKIDFAMLESAATSQTSFSNAPKVKQDYGVTTVSPGNSYLISTFQCPAGQAVGFEMKNAGSTNLNFFEDYNPAP

SEQ ID NO: 25229 - protein, 221 aa, A.fumigatus
QCPSTSEKPLRDDISQIHTIYSFYVRESVATFLRQPPPLESLISSFREIQSRGLPYRVAIDTTGKVLGYGYLAPFNGTRMAYAPTVEVSLYVHPEYTSKGVGSRLLSSILESVESEAGVWHRAYEHKEYESHVQVIPEDEGRVCSIIACMAVDTTGKENGEGLRKWYEQRGFVERGRLKNVGYKQGRWCDSLSILWFSLPTDMRRIDTVYLQYSVRRDANL

SEQ ID NO: 25230 - protein, 172 aa, A.fumigatus
VIYIPSQKSKDFQSFSAPLLNIHDSHVTAPFFGPNQWIALVQPVSGGGIPPSLPAVQLKVTFKEGGAFDFHNNFERLKERMQQALELSQEDGRRSGNVDLSTIHLEELPAYTGPQGDMAGVHSHGQDLSPDPYSRQDGAGTETEPLDPPPGYEEVQQQSVANELEERLRRGS

SEQ ID NO: 25231 - protein, 93 aa, A.fumigatus
YFHTVRMGLADFFSDMISSLSFPEAQAEAPAETVEQTSQEAETENKPDVSEEKTEESTEESGEETPAEESSEESQEEPEEEEPEEEEEAEEEL

SEQ ID NO: 25232 - protein, 60 aa, A.fumigatus
ASMNRPARMNNVRNTTESKYVVLWLLVDEFAAASMMRTANEDTYATVVPAEMRRFMLPKR

SEQ ID NO: 25233 - protein, 502 aa, A.fumigatus
PVVPARRPLPEGLEEMPFVTEVSVNLLAHSGRVQFVGRENVDAILEKIDDLGYEASLDNIQPVVVNNEEGKNQKRTVSVRVDGMFCHHCPERVLDSLKAFPDVECERTLSLNNNVLKVTYTPDPPSLTIRAIIQTIESAHDAFQASVFHPPSLEDRSRAMQLHERRRLLMRLTFVLLVAIPTFLIGIVFMSLVSSNNGVRKYLEQPMWAGSVSRMEWALFIMTTPVMFYGTDIFHIRAMKEIYSLWRPRSRTPFVRRFYRFGSMNLLISAGTTVAYVSSLAVLIMDAAANSSTSSHSTTYFDSVVFLTLFILAGRFMEAYSKARTGDAVASLGKLRPSEALLVEKSTPIDQTEFGKSFSYENQQRIAVDLLEIGDVVSIPHGASPPADGVIIGPNTYQFDESSLTGESRWVRKSAGDQVFTGSVNVGQPVKIKITALGGSSMLDQIINVVREGQSRRAPLERVADVLTSHFVPVITLIAILTFLIWLSLGSSPRGWKVHSSH

SEQ ID NO: 25234 - protein, 70 aa, A.fumigatus
VDFSSFLLPITLLWNIPIVTENASGVNHGSQYEHHDVLFSGLFYFKSYYPIDCMITGILQNCPPFHLPCS

SEQ ID NO: 25235 - protein, 81 aa, A.fumigatus
  UNSURE (15),(28): Identity of amino acid sequences at the above locations are unknown.
ELALGGDLGFQFVNXGFKYCSFYDRGYXSLGAISDTHPNPKLRVEHSADPGQGVADGTQSQHYRPAYELTEDQEERLGRSK

SEQ ID NO: 25236 - protein, 107 aa, A.fumigatus
ALFFMRNANILKTDITDPQRHFEMVAPARALHEPVLRAAILAFSSRHINRQKQDGDTESLKYHNECLELLIPTLSCDENEISEELLAAIAILRQNEEMDRKFSKVVS

SEQ ID NO: 25237 - protein, 90 aa, A.fumigatus
RRAIISNINVNNGRSGIDLNSVLTSIHTFDPAAGCDDSTFQPCSSKALANHKVYVDSFRSIYGINAGLGPGKAANVGRYAEDVYQGGNPW

SEQ ID NO: 25238 - protein, 264 aa, A.fumigatus
RYLATLAAAEQLYDALYQWKKQGYLTVTQTSLAFFRDFSSTVEPGTYKSNTPTYKSLTDYVRTYADDFFFLVEKYTPSNGSLAEQYDRNTGVPLSANDLTWSYAAFLSTLQRRLNIMPDSWGPSSANPVPTTCSKTTITGTYSAVAPPFPTSTAQCVAAVTVPVTFWLIENTYYGENVYMTGNVSALGDWNASAGYSLNAGLYTSDENLWFATVKGLEPGVTMEYMFYKIEPGNSVTFEGGENRVYAVPTACPVAPQVHAVWQT

SEQ ID NO: 25239 - protein, 312 aa, A.fumigatus
QTNSGWSVRASPAISRADSSTIPPSPARTIFEERLSESGTQPIDIAKANSQSQDDSEAPQATTPLLPPFMGDEPLSVTASRVQSPLQSPSVADVSEESLDKGMMSSDPRLAGMPSPPLSTKPSVASFNRPRASTMRTLSGEGPSFALTDPNDEWATQLGHANFTIQPEPYVPEVYDLSSFRQLREHWDQAQCNFTKHLVRTGEHYGVTSTIYKLTEAKWDAINSEWKRTYDEMLSQLDATDGSLMGIIQSQGNPCEPVKIPRLHDEKFPELGDGEIVGPMKIAPAANMPARCRSRSLKRSFFKFFQDLISRS

SEQ ID NO: 25240 - protein, 159 aa, A.fumigatus
PHSTPQTDGSYCVPTVNMWTTTSGLSGRSLRLSITFAAVVGFSLFGYNQGMMAGLLNGDEFVNSFPILKMPDNPTAGEKHYIDVIRGAVTSCYELGCFFGALFSMFCGNRLGRTRLIFMGASILIVGALLTTVCYTGKWEVGQFVIGRVVSGIGNGMNT

SEQ ID NO: 25241 - protein, 141 aa, A.fumigatus
TAKDVNGKTTFQIHTNVVFPPVLYPPTQQHNPPVPTPEWSSLIQSWCRHHRIYRLSLIEAIESPLFHNGTLRTRLSMSEARAVLDWMAKPEEEGGGGRRAEWIDGGSKSVAWIWWRRPEEWAGIVADWVCTSFSSACWLAC

SEQ ID NO: 25242 - protein, 112 aa, A.fumigatus
  UNSURE (13): Identity of amino acid sequences at the above locations are unknown.
SFDACSMYVDVIXHLARMFDVVLMFSSLIARMLQLSSVVCMLFSMHLFHRVISTICLIIILIFMELTKPSSDVVKVFYTIAYEALYRGSYPIYVSTIYCSSLRVALMTMDIY

SEQ ID NO: 25243 - protein, 157 aa, A.fumigatus
LASTFEAHGGETVIYEPPADFPPLTEGFTHLISNTVDFPAFDAANDALIPVVKPQWVQASLAKKKLANPRQYNPDPRLFLNDVVVMCGDIPEGDKDAIIGGVLAKGGLYSPRVSGMVTHLVDLTMDSDKARIVTSRKLNIKIVLPHWYDCDYPTIFD

SEQ ID NO: 25244 - protein, 203 aa, A.fumigatus
ASGPGVTTMRGHWGLQSPYVFPTNSTTVRNHLQDTLTVQTRPMLILGSIIDDPRNSHLIRWSDKGDSFIIPDRNKFARTLLPTIYGHGNFRAFCRLLWYYKLDLKKQSSPWRSWQRTPFREFSNPNFRRDDDAGFLRIEGRRKKTKESSNPVSRSSVSDPFSRSGGESSMDEDHVASDMWRGGKACESVRGSYTRYPKRRRVS

SEQ ID NO: 25245 - protein, 89 aa, A.fumigatus
GSECILPLNGVGLLTVCEVGITRHTQRGHIARATMEAACFQTKAILDAMAKDSGHKLSELAVDGGMSNSDICMQVRLRKKASSPLHGYQ

SEQ ID NO: 25246 - protein, 89 aa, A.fumigatus
TQADIIQIPVERPAMHETTALGAAIAAGFAIDVWKEFSELKNMNRANRTTFTPRISPAQSARMYKQWSKAVEMSRGWLDTSEIESEDQQ

SEQ ID NO: 25247 - protein, 70 aa, A.fumigatus
QPDFKMAFLQAQVQNPNFTTSLITDEHVISMYMQYSTLIAHSYTDMPKPYMQQLLFWDFIFEGGEATKNS

SEQ ID NO: 25248 - protein, 257 aa, A.fumigatus
PNTDFCVREEHEDTLLHETLLCLKALCTTSVALKHLTKIEAELFPALLKMLFDEEKKGPSEYTTRGIIMNLLFTQLATASSDEMATACASRILSYLQDPSPPEESQPLSFIANIYQSRPYRVWCKEVSNVTKEVFWIFLHHLNVIPIVKSDKSPSELEQQTFRERHFPAPRPPVPAAPYVGGVEWDATNYLAAHLDLMNGLIACLPSVEERNNLRSELRASGFEKVMGGSLRTCKEKFYSSVHDCLRTWTAAAVEDG

SEQ ID NO: 25249 - protein, 91 aa, A.fumigatus
TVSLSATASRDTAADPSDFVHYLREIQKPEMIEIGKIHKLRILLRNETVSWVDTFIADGGMDEIVQLLYRIMKVEWRYVHAVRTDVLMTKY

SEQ ID NO: 25250 - protein, 90 aa, A.fumigatus
DVGSWRRRCWHIASLETVYYDYYYYYYYYYYYYYYYYYYYYYYYYYYYYYYYYYYSCCCCCPTATHTTLSLCRGNIYEITDAMCMPFSSL

SEQ ID NO: 25251 - protein, 358 aa, A.fumigatus
  UNSURE (165),(185),(186): Identity of amino acid sequences at the above locations are unknown.
LEISLPLLLTSPLEMRPRHREEFEIAIFCSLPCEAEAIEALLDEVYDRFGKIYDKEPEDRNVYINGRIGKHNVVLCQVPESGKCSSASVASSLTFSYTGIQLALVVGICSGVPSPSCSEREIFLGDIVIADSVIEFDVGEQCPWGFQRETSVEAAHERPVLERPXRAIRNLLNALSIHGNRALMXXESAGFLKSYSPEEVQSGSIPEHRKISFSRLHIDTSIAEILFAFHDEYEDTLCKGALEEECYISACAEEQVCRRSSSDESVKPALHVGMIASGDTVMESAEHRDMIAETEGVIAFETIGAGMWDTLPCVIINGVSDYADGRKNEGWQNYAAAVAASGAKAFLQYWAPCAKASE

SEQ ID NO: 25252 - protein, 146 aa, A.fumigatus
HILRISTQTIQLCLFTKTWSFANYPSSGLKDITFPISMADTPHETGYYFAQQFTFTGVFDVGHIGLQPRSDASGSSIVHAVFSSFVSGTTSTDPNCHDGADGGADVSCAVEIPAPYAPLYDLVVQNSAGTTCLHPSGMDRARLSQP

SEQ ID NO: 25253 - protein, 130 aa, A.fumigatus
PAGGTIGTGLFISSGTAIAHAGPVGALIAYIFVGTIVYSVMTSLGEVATYIPTAGAFTSYTTRLVDPSLGFAMGWIYWFNWGFRLRGGIDGLRDDHPLLGTRNWSIAIFLRGVRVFTTPINFRPVGFYWE

SEQ ID NO: 25254 - protein, 178 aa, A.fumigatus
SEAPVEPVDPSHGKSQTGIDQSCCIRGEGARGGDVRRNFSQRGHHRVDDRPDKDVCDQSPDWTSVRDGRSTADKQTGSNCSSCRLLDFFFLLFPLLRKRSDTDRWQSSASVYPSTAASDRASPTPVPPHCSPHRCDGRLAASLPCSSETEPCLLISDAFQRWIPPDPWHLRSDCLEQP

SEQ ID NO: 25255 - protein, 69 aa, A.fumigatus
KPSVLYLIYRSSLSLVALPSGFKGCLTRDGWRMIKAFGTSPCYFDGRDEGISDTKYITWWCLLLHGLSI

SEQ ID NO: 25256 - protein, 60 aa, A.fumigatus
DDGFYSVHQTLPTLLNVEWQHNNTVENSVHAYSKPYPVCNNGDFEFKHEQAYLDEGQNFW

SEQ ID NO: 25257 - protein, 292 aa, A.fumigatus
LSCYLEHGADVNARSAFKGWTAFFEAASNGHKAVVQLLFDCGADVTMKDEDGWTPLCQAASRGHEAVAGLLVSHGADINARDGNGRTALYRAASDGYEAVVCLLLDHGADINARGKYKGRTALFEAASNGHEAVVHLLLDRGADVNMKDEDGRTPLYQAASRGHEAVAGLLVGHGADINARDNDGQTALFRASSNGDEAVVQLLVNRKANVNVADYFRGMTPLSQAASRGHEGVVSLLLDHGADINAKDSGEWTALDVAAFKGHEEVVRLLRFPQKFGVSFKFHQKFCPSSR

SEQ ID NO: 25258 - protein, 338 aa, A.fumigatus
  UNSURE (26),(75),(93): Identity of amino acid sequences at the above locations are unknown.
LRACFVRNLLTWYREPNSHSVHPALXPDFQVASCVPEETLSQRITLKQESGIDAQEALRQIKSGASGQTAPPAPXPPPVPTLNVPGGVPPPPXPPPGALPAPVAAAPDMSAVFAQLNQGDAITSGLRKVDKSEMTHKNPSLRAGATVPERPSSQGSISRSKSPAPSKKPKPESMRARKPPRKELEGNKWLLENFDNPGGIIEISAQQNQSILISRCNKTIVKVNNKANAISIDNCNGLSIIVDSLVSSLDVIKSAKFALQIDGVVPTLLLDQVDGATIYLGQQSLATEVFSSKCTAVNVMLPPKEGTDDDTKECPVPEQIKSYVKDGVLVSEIVEHAG

SEQ ID NO: 25259 - protein, 253 aa, A.fumigatus
  UNSURE (16),(43): Identity of amino acid sequences at the above locations are unknown.
SFEPVTPPQHSVPFGXEPAYIANENTGLYTAIPDITSAATFNXMMQLPPSNLASASYPMPARTYHSNVYSVIEGSPTYKQRRRRSSIPPSAAANGHAQTTSPPSQQIAYAAHRPSDLRRSVSNSVVPAAEGEDTHEASNHGANGYTSAVLPRRNLLHDMSRNGTPLSNVEENPESNPQTTGHQDDLVTLPNGEAYEGGVQNNVSNKVERFTPGPIRRARSATMMELGPYPQKSHSCPIPSCGRLFKRLEHLKR

SEQ ID NO: 25260 - protein, 214 aa, A.fumigatus
ILQAYFWTNTRKNITKYNPMRGIVDDDVARVLLHDVIVAKDLAKAERELLAMSGLKKFMARLPNNREKDWFRRHLRKYIQMYLPDSPFEITTTNRYTITEYEAAVCARKFIKQGQEIKYLSGTLVPMTREEERDLDLKRKDFSIVMSSRKKTPSFFLGPARFANHDCNANGKLVTRGSEGMQVVATRDIYIGEEITVSYGDDYFVFTPRRKKES

SEQ ID NO: 25261 - protein, 345 aa, A.fumigatus
TTAGVFLVPHYPRRARKISHFGSVTRKLHFAEERRKVCQAHQEESERDDEPQRKQPMVRKKSGELVRPALRPPSARRRPSSMPGTPTYAKAVHFDSQLEHIRHFLQLDKPQAVSANTSPAEDYNNESEFPFEAPSFEREIRLSNFPKDVSSRALQKVRLERLFLSSDKDTLVGVVAVANLAFQKHIAARFTFDYWRTVSEVTAEYSDDVRRKQANDGYDRFTFSIKLTDHANLEQKTMFVCVRYSVAGQEFWDNNNFMNYQVNFVRIPRPRPEPRRPSAATSRPTLPRSKSFAGVNSRPSMPSSLDDFDEDMNDYLSFGRPKKPLKEESSSENLLKEVHRMSASP

SEQ ID NO: 25262 - protein, 148 aa, A.fumigatus
PLTIPSIKHAPVSSLHPPQSFHKEATSVPFNKMKTKATSLFLCVSALVSSISALTISRINGNKYLSPYAGETVSNIQGLVTAKGPSGFYLRSTTPDDDDATSESMYVYGSTAVSKVSVGDIISLSGKVSEYRSSASYVVLTAGRDRRK

SEQ ID NO: 25263 - protein, 87 aa, A.fumigatus
TFPFLLRGLLVFIGCRWLTGENGPRLLHVAGTYFFTKGFLLTRMVLEDKSACDVLPFDDSSSSASKGKQGCWHEKSFDKAIVITIDA

SEQ ID NO: 25264 - protein, 444 aa, A.fumigatus
  UNSURE (93): Identity of amino acid sequences at the above locations are unknown.
GLLGSPSFPTPVPKIFVRIPSTLFASRQSFSDFHTSPNLGMIQLTPPSNAQSSLPYPPVMHLTQHTLQPVQAPMMSPPMRWGFEASPPTGTFXSPRRSNQWTPRQFSTHQNQSSSNGNSMKHGGKRDHASAFGGKPPTVAPSVPAPPPVPSFGNPLPVKPPPAVDAANPRKKNRKHNQLGLTPKTEDHESSEEDDVDEESRLAPAAASAIVPLRFTYKGRTSTLQSPTDIAAWIEERKKRFPTQAKAEEKRKAMQEAKKAREEALNKKRIERQEQRRAQKVANDRPESVIDPADAAAKAKRKADKLQRKLLKEQERVAKAEADAERARLEVERLQKVAMEARRGSESATQKTEIQPSVAAEKPDPESGQKVEMVGSKDNNSEAVAVPTESSIASMAHGTVVTKIEPGDSVESRNEESAASSFDDSDSSDWTSSSGSDISSDSDE

SEQ ID NO: 25265 - protein, 266 aa, A.fumigatus
YVPVRFPLAINSDHRLLTTYRSEAKGMLMDFKSREKGGTTYSHVLEVLLRMRQVCNHWALCKHRVDALAGLLEKHKVVPLTPENIKALQDTLQLRIESQEMCPICLDILEQPVITACGHSYDRGCIEQVIERQHKCPLCRANIDDNSTLVAPAVDLGESADEDVDADPNNPSSKIEALIKILTAQGQAPDTKTVVFSQWTSFLTLVEPHLQRHGIGYARIDGSMKSTARDASTYKFSKDPQCKVLLASLSVCSVGLNLVAANQAIL

SEQ ID NO: 25266 - protein, 76 aa, A.fumigatus
RWRCSFQPRGEDGRLLLQALMSAICLRRRKDMEFVNLRLPALTSRVLRIKFHPHEQEKYDMFQYVSLSLSIRTTAC

SEQ ID NO: 25267 - protein, 220 aa, A.fumigatus
SNNTASGGYVWGHYVSQYADVNLYNYAVSGAVCSNEITPRTFSSINAPFPSVLEYEVSAFLADSKHKVSGKRFLHIPPRETVYSIWIGTNDLGNYAFITDSQVKDKTIPDYINCVYSVLDRVYASGGRYFVLMNLAPLQLAPLYATPENGGVGANHYWPDKPDNLTLTSYRMWEQVATVNHVFQYQTPYELLVARRYPGARFAVMDMYGLVCCVLVIGSG

SEQ ID NO: 25268 - protein, 88 aa, A.fumigatus
SLGLDDTDFWQLSEVYYNPTKYFNGSAQANVTGFNNHCTLDGGQCTRLPSPDSFMWFDELHPSQRTDQIIAEEFVKVVGGDSKWATYW

SEQ ID NO: 25269 - protein, 68 aa, A.fumigatus
NTLWDCNKPRKAAKNQCHPDPMTNTQHTNPYMSITANRAPGYLRATNSSYGVWYWNTWFTVATCSHIR

SEQ ID NO: 25270 - protein, 158 aa, A.fumigatus
PTELKSQNMAQKPKKQRVTTAVFVTSIPLDAEFDEIRDVFSKCGVIAEEIDSGRPRIKMYMDENGKFKGEALIVYFRPESVNLAIQMLDESDFRLGVSGPQGPMKVQAADFSFKSQQEAPAKSSMRDKKKIIKRTQKLNRSVQGNPRDLTRCGLTWSY

SEQ ID NO: 25271 - protein, 205 aa, A.fumigatus
DFSSASFANSLVLATNNATDTPLDLSTPLSRVLFDLQEIDTHIHNLTSKSAIPLLTHTRDQTVAAERILKETEEQLSSVTKGYERLEQEVLRKWEAADEARVAAEKSLATVRLARAVARCLALGRQLEGQLSEVTGRGGPAATAGAQDRSSANPGREDYRALERAASTIVSLRRMFSATAVGEEGYGLERVNVIRTLRGELVIPG

SEQ ID NO: 25272 - protein, 143 aa, A.fumigatus
LTTFRGIRWAPLNIGIERRMQTFVVLCHTLTIAIFLTVFFFACALPVFWPLLLPYLVYISLFSSSATSGTLSGRSNFMRSLSIWSLYASYFPACLHRSEALLPTRKYIFGYHPHGILSHGAFAAFATEALGFSRLFPGMSSPR

SEQ ID NO: 25273 - protein, 72 aa, A.fumigatus
VGVAISCVRSQYGHFMPPIFLLACIALKRYFQHANIYSATTPMAYFLTVHLLHLLLKHSDFRGCFRECLHHG

SEQ ID NO: 25274 - protein, 370 aa, A.fumigatus
  UNSURE (58): Identity of amino acid sequences at the above locations are unknown.
ILASGQFSHLPGYGTLCSLVDRLVHWIGQDHSSAVGRFCMAAIDSGSCIDFHPDYIPXSGKTFLLTTLIMIIHSFISSMPTKWVARFNSYGSTFNMMALVVVLIAIPAGTKNEPKFNPSKEVWGTITNGTEFPDGVAVLMTFVGVIWTMSGYDSPFHLSEECSNANVASPRAIVMTSGVGGLMGWFLQLVVAYTVLDIEAVIDSDLGQPWASYLLQVMPRKTAMAILGLTIVCGFSMGQGCMVAASRVTYAYARDDCFPLSRIWKKVNERTKTPVNAVILNTVLGILMCLLILAGDVAIGALFSIGAIAQFVAFTIPISIRVFFVGNRFQKGPWHLGPFGPAIGGLGVLFVLLMVPILCLPQRERGGFDP

SEQ ID NO: 25275 - protein, 65 aa, A.fumigatus
  UNSURE (55): Identity of amino acid sequences at the above locations are unknown.
QAGSFRTFQGTEPFAAWLTGWSTGLAKITAAPSVDFAWRRLILAVASISTRTISXPVARRSSSLR

SEQ ID NO: 25276 - protein, 87 aa, A.fumigatus
WCPFCVFPSVRGADLIPDQMNWTCLVWGAPMLTVTIWWVIDARRWFKGPKINVEHVIHGVEAIVDVGVEAEDQRSQSQDAASKSSNV

SEQ ID NO: 25277 - protein, 83 aa, A.fumigatus
QLCRRKTAARVLYCTSWYPSLAVFNQQDLFATSKTHIELTVQCHSGLTHFHYQISSDCAVSAPPRDPPQTQLSPLSSIIGLYR

SEQ ID NO: 25278 - protein, 403 aa, A.fumigatus
AEQTDPMHRLALVTAYEAMEMAGMFPAAIRSTRPNRIGTFYGQASDDWRELNASQNISTYAVPGGERAFANGRINYFFKFSGPSYNIDTACSSGLAAVQAACSALWAGEADTVIAGGLNVITDPDNYAGLGNGHFLSKTGQCKVWDKDADGYCRADGIGSVVIKRLEDAEADNDNILAVILGARTNHSAEAVSITHPHAGAQKANYRQVLHQAGVNPLDVSYVELHGTGTQAGDAVESESVSDVFAPSTPRRRPDQRLYLGAVKSNIGHGEAAAGITSLLKALLVFQKNMIPKHIGIKTEINPIIPKDLERRHVGLAMENTPWPRPAGKKRLAVVNSFGAHGGNTTVLLEDAPERVKVSTQDDRTTHPVVISAKSKKSLQANIEKLLSWLDQNPDAETSGNFP

SEQ ID NO: 25279 - protein, 147 aa, A.fumigatus
LSALVRCILSIFEASTDTMFSVIVKHQGKRHEVELDPSANGETLKYQMYSLTGVEPERQKILVKGGQLKDETPLSALNAKPGQTFMMMGTPSGGQDAVDLGRPKEPVKFLEDMTEAEAARAEGAIPAGSKNLGNNWYLNSYPTNPEG

SEQ ID NO: 25280 - protein, 153 aa, A.fumigatus
SQSLRPYLQCVRSSLTAALAISNFASQTSERHNVPEIEAQSSPELLLNPLTISRNENEKVLIEPSVNSVRVSIRIKQADEIEHILVHKFTRFLTQRAESFFILRRKPVKVRKSRPRRGQVAHLFKGYDISFLITPFHTEAMVFTTGLEGAAAI

SEQ ID NO: 25281 - protein, 172 aa, A.fumigatus
VCMNDRPPPCTTISVGFISYLSTHLLISNRVTLIPFTIPNQQITFAIVLVYYFFFLFFFFFNPFDHLLQTNLLIIHNSTIASHFSFQRIILPCQPVSYHHSSSSSSLLSAIRFIITARSDKNPPVVACSRLRVNPGRADISGSLKLCRNPFGSFLLPLGKTDFPSPYLPDIS

SEQ ID NO: 25282 - protein, 135 aa, A.fumigatus
WTVRHSIELFNATDGSRHRKTRRQSGLYPRDGGHHRSWHLRSVPSIDAFRRIARAAVDIRPGICTAIDLIKRSKCHNFIILEKSSGVGGTWNDNRYPGSCCDVWSSLYSYSFEQKADWTREYPGQEEILVLPTVV

SEQ ID NO: 25283 - protein, 174 aa, A.fumigatus
VMVIGATAAQIIPEIAKTAAHVSVYQRTPNWVMPRLDRPVGAVQRALLTYIPPIRWRKRALMMDFREWFFEAVVDRNSALSDVIRKTCLESMRAQLPDRPDLWDVLTPNYSPGCKRVIISDDFYPTLGREHVALETRPTQRITETGIDTADGETKEFDLIVAATGFRTVEFMYP

SEQ ID NO: 25284 - protein, 194 aa, A.fumigatus
QDYLIGVAQKYGLYRYIRFNSAVEDARWDEADLKWKVGVRVSGGKDSQYLESYEITTDFLISAVGQLNVPRMPDIPGLDDYKGKLMHSARWDWSFDWTGKRVAVIGNGESRASHCLRQDVSNGDRRNRRPNHPRNCQNRRARFRLPAHPQLGHAASRQARGCGAKSPADIHPAHPVAEARAHDGLPGVVLRGRG

SEQ ID NO: 25285 - protein, 103 aa, A.fumigatus
LTSRQILFLIGLTLIIGVQRTLAFFSRRQKLKGTAAFAAGILLILFRWPLTGFLIELYGLFILFGDFLVTIGQFAGNIPVVGPYIKTALETLAGGRRNAELPV

SEQ ID NO: 25286 - protein, 213 aa, A.fumigatus
RPLRDHGFTGFAFYSSWAYHAPNNSTVDFSTGARDITPIFELAKELGMYMIVRPGPYVNAEASAGGFPLWLMTGEYGSLRNDDPRYTAAWTPYFANMSQITSKYQVTDGHNTLVYQIENEYGQQWIGDPKNRNPNKTAVAYMELLEASARENGITVPLTSNDPNMNSKSWGSDWSNAGGNVDVAGLDSYPSVSYRPIIFYLICSDFGSAGHAT

SEQ ID NO: 25287 - protein, 232 aa, A.fumigatus
  UNSURE (214),(230): Identity of amino acid sequences at the above locations are unknown.
LIIMTTSKKFSPLFPHSCLSSRAVPTTPGPVLKVDVLRTPALSLLTCSTDGNIGQRVTAMSLYMLYGGTNWGAIAARVTATRYEYSAPISEDRSIGAKYSETKLLALFTRTAKDLTMTEAIGNGTQYTTNTAVRAFELRNPQTNAGLYVTFHTDTTVGGNQAFKLHVNTSVGALTVPKNEGLIQLNGHQSKIIVTEFTLGKRNILYSTAELLSXHSEQETGSAHMRPQPXEA

SEQ ID NO: 25288 - protein, 194 aa, A.fumigatus
PRFLLLSPIVALPSDITDALKIARLASHWMFGLFIAATVLNFILIFLAPFAVSSRPPQTISPDPSVNELHPPHRRRTFLFLRAFPFLILTFLAALFTIVASVVATVMFSIFKNVFTSSGYDLNIGAELGSRMMAFMWIASAVNLLAFILELGSCCAACCGGRKARKELKSLKKTERGAINEKGSPHSPATTVTG

SEQ ID NO: 25289 - protein, 112 aa, A.fumigatus
  UNSURE (44),(90): Identity of amino acid sequences at the above locations are unknown.
QTIMVLWSLRSLARSWSFTTRNHHQTYVNSYNQAIEQLQEAQAXNDIASQIALKPLINFHGGGHLNHTLFWENLAPKSSGGGEPPSGALXRAIHENYGSLENFQGKMNPALA

SEQ ID NO: 25290 - protein, 140 aa, A.fumigatus
  UNSURE (130): Identity of amino acid sequences at the above locations are unknown.
TYFVAFASVRLVMESPTSSSFAGQKRKIVEMSSDEEDARPPTGFRRFARASSRSESPPSFGLGSARRNPWNVNMQSATAAPRGGNANSSKPITGRGNSFAARMMAKMGYKEGQGLGASGQGIVAPIEAQXPPTGPGVGLP

SEQ ID NO: 25291 - protein, 347 aa, A.fumigatus
RLANCAVWINLIVMFITMGGAANAPPNYAAASASAGAVINEALITPVNGVYPPVQTSGGLPEAGNFVGSLNGAMQAVFAYGGAMVFPEFMSEMKRPKDFLTAMWAAQAFIYFWYMFYGLFMYGYQGQYNVNPSYLGIGSYNISTAGNVFAMVSAAIAAGLYGNIGLKGMSAAKSFRRCVNAVLTVLVLYNQVFVELLRCPPLTTRGGKWFWVILVPIYWGIAFALAAGIPNFSGLTSVVAAVCILQFTYSFPPLLALAYWVKRAALRDGEGFDPATGQTILHDRSMSRVIRGFLAQRPKELAMSVFNIFYVLGALVLAGMGAYSAIESLINAFAQSRTTSYTCKISI

SEQ ID NO: 25292 - protein, 218 aa, A.fumigatus
  UNSURE (50): Identity of amino acid sequences at the above locations are unknown.
VRNEYQQARTFQYQVDIHDAVQGKNLKTITGGRYTLQANETRTIRTTTHXSDLNFWSWGYGYLYDVRTSLLLNHHAIDSVKTRTGFRKTEFTHGAFKLNDRTLHLKGYAQRTTNEWPALGCAVPPWLTDFSNSLVLASNAALIRWMHVTPWKQDVESLDRLGLLQALPAGDSEGDATGRRWAQRTELMRDAIIYHRNSPSVIFYEAGNHGISEAHRAR

SEQ ID NO: 25293 - protein, 187 aa, A.fumigatus
TSGAGGTATFTTSGPRYSSTTTPSTPSRPAPASARPSSPTARLSSTTAPSTSKAMPNAQQTNGPPSAAPSHPGSPISRTASSSPVTPPSSAGCTSPHGNKTSSRSIAWACSRPCRRATPKATQQAGAGRSARSSCATQSSTTGTAPASSSTKPATTGSRRRTERDEGSAGYVRPTRGSRGGIARDAE

SEQ ID NO: 25294 - protein, 307 aa, A.fumigatus
  UNSURE (291): Identity of amino acid sequences at the above locations are unknown.
ITGQSAILLEDNYRSSGSILRSAQDVIEQDSSRPSRKLQPTHCPGTMPVLRKLPTAEAEAQWIVLEIKRSMAMTGKLLNYSDFAILLRSAALSRHIESEMGKQGVPYRMVGGLRFFDRVEIKVLLDYLRVISNPGNSDALLRIINIPSRKIGEESVKTLMNGADTAKIPLWNFIKDVAQGRRSTDKSLSKLTDQGLCTLVGIIESSRQKLLECTDGSAPRKLLEFVIKKLNFREYLTTTYCQNEENRWANVEELLAQAGDVAATAAEKGQDDSLPEIQGLAQQQAHQGLKXLSQFLANVALSNEIPL

SEQ ID NO: 25295 - protein, 412 aa, A.fumigatus
QSSGSVHPAVKTTDPSKPMPSPLNTSDHCRENRQDNSSVLQSPVSPRSSVKTAPPPNHSSTSRIVHAPSPSKPSGSGQESTTSSAGDRVCGDPKQHDRGVIAIANDIGARKLSDTGDSVQSPTSSPVSLLDSLQSMSGDRTPGHRIMPRTSSIDSAISSLSSASQPHKSSFDASAVSQADIDRLIATAGSTEAVIIHLLKEKHHAASQNAQLWRLVDKQRTLILGLNKDLERALKEKERYKKRAKELQNSIPPVPPTNDHIVQSRSADTSAIPASRDLSKQEQAQGESSEAKSTNAGMQDLCDSSVLSPNAKVDRPSPAGADSSRLEYNFGKRIFATRTIEELDQESKFAIARLTAGRNVIGEPNSLGHPSSTLNKTSHRMKVQKGSPTLPGSPPWPPENRKKHKVWLWKTT

SEQ ID NO: 25296 - protein, 72 aa, A.fumigatus
SSRPPHRCPASHGFSPIAATEYFTPSIQRLSRIDYYLQLMYASWSSEQRVLYATRSSPDILVFTAGGRAVSQ

SEQ ID NO: 25297 - protein, 60 aa, A.fumigatus
YQLYECTILLTLFCVSAIDTKKGHCPSSAVTVSLTSPQQVPAAEQRVPVAESHRSLVVVK

SEQ ID NO: 25298 - protein, 174 aa, A.fumigatus
LPRTFAPVVKTTNAHSPEVAHAFLKLDYLGIVMTITTTCISVTYFALYSYPILQVTYIFLTVLCAATIFWVALDPRMDGARAGPWRSVFAMPLLALQRPDSANLLCKAAVFFLLATSGLAPIFHVIWAEASYGLIRIPLDSLTVTCSSYAVGTAVYVTRFPERFWPARFDLIVS

SEQ ID NO: 25299 - protein, 67 aa, A.fumigatus
SATADPSSPVVKTSIRSEFVYYFKFFSLFTKILVSAVGQTHRPLPSSTKWLRPNSLLRLPPDATYEE

SEQ ID NO: 25300 - protein, 66 aa, A.fumigatus
VSFSSSRMNISQSSFPFHFPTCQITPPRRPKQPRPAQGCMVILACFEKDIGQLKWSNHIIWAPTRR

SEQ ID NO: 25301 - protein, 201 aa, A.fumigatus
DGRPVYIEKLGKIDLNAMYKITTAERMLQNLVCEYEKLADPRLPACSRKAGKLLETCCSIMDLKGVGITSVPSVYGYVRQASAISQNYYPERLGKLYLINAPWGFSSVFNVVKGFLDPVTVQKIHVLGSNYKKELLEQIPAENLPVEFGGTCECAGGCELSDMGPWQEPEWAKPPKWALPKEEQDVVVFTRGWKEPRHGAP

SEQ ID NO: 25302 - protein, 101 aa, A.fumigatus
LSSPCIFLKFDSTILPTMAAVAENKPATTSKYDDYDFPTTAPEPQPGHPGHTTPEQDAKVDQLRSELEQLGYTDRLDTLTMLRFLRARKFDVAAAKAMYVC

SEQ ID NO: 25303 - protein, 104 aa, A.fumigatus
EPGSLMWLPLRPCMFVDRPALLFSRVTCLRRLESVLWILSIVPLLMHEFVTLTRFIDCEKWRKEFGTDDLVRTFDYKEKPQVFQYYPQYYHKTDKVSLFFFLAA

SEQ ID NO: 25304 - protein, 125 aa, A.fumigatus
SSNLNTAAAYLVKSLPDVKFDIGEMYSGSVPIDKGNKSRELFFIFQPTIGEPVDEVTIWLNGGPGCSSLEGFFQENGRFTWQPGTLAPVENPYSWVNLTNMLWYVLPFQAVIQEITCPISDAHRL

SEQ ID NO: 25305 - protein, 95 aa, A.fumigatus
RTCCGMCYLSRPLFKRLHVRYLMRIDCDRVNQPVGHGFATGKPNATSQEEIAEDFIKFFKNFQEILVSKTIKSMFTARVTQAAMFLKSSAQCWDR

SEQ ID NO: 25306 - protein, 104 aa, A.fumigatus
SSPVPASLSFPSLISPLPCPVEMLFGSVASTALLALSLCLDSASAAKHGRFGQKARDSLAKRSSSSLVTHEPETRSRHKDFRFLNKDTKRMYIFVLPALELMIV

SEQ ID NO: 25307 - protein, 189 aa, A.fumigatus
  UNSURE (132): Identity of amino acid sequences at the above locations are unknown.
STRAFFICKLESTDINTMRANWRTTRLLHGVRAIIGGQGPPLVLIPDWPQTAEAFSGIFEPLSKRYRFLALDPPGLGDSPPPLNGYDTGNVSKVMVEAIHDTLKYRPYHLVGHDVGGWIAYPWAAQFRSRVXSLSILDASVPGFQPQLQFPLPHPTKLRLWQFSFNALPELPEILTPRRNRELLTCFFI

SEQ ID NO: 25308 - protein, 133 aa, A.fumigatus
IFLSAPWVPSAHPSIFTQCFAMAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFATPRPLAAA

SEQ ID NO: 25309 - protein, 389 aa, A.fumigatus
QYLSKSLFPISNYPALSSLVFSKQKGITVVFRNDPLESLKVSSTFDSIPFVRDFLQKEIEAQLRILFMDELPAIIHRLSLRLWVPEYRAGEELQTQTASANGEGPGQDPLASPPQDPVDALGNALNESEIESLSLDSSVETHTLFSQKNLLRLAALTDSQRTLSLFTPSIREVVYRAWTSPSDQTDASGSVTSPFFPVLSRTLSQVGSMSSFPDSASMVSSQSRSSTPSHTFSGYGLSLGADRHSKAHARKRKKRVVDMRRPKTTDDAPSVSDESSFTESTSAPSICSAPLPVLDEQTDDPVTPPLSPDNDLHLPAIPERHRMSISRPALRRENASEMIRDTAECKPSSNAVGQAIQEEDLSATPRAAVRAHGASVLEKGKQDPDSSAG

SEQ ID NO: 25310 - protein, 246 aa, A.fumigatus
  UNSURE (208),(227),(233): Identity of amino acid sequences at the above locations are unknown.
ASLIHGGAWRDPTQTAASYVAPAESILTTSPTYTSTTLPHIAAFASIEYRLSAHPSYPQNPDHLDSTEYRNAKHPDHIRDVQAALALLQRKYGFGSKYILVGHSAGATLAFQSVMGTFRDSAAAVASPPVAILGMAGIYDLRLLRDTHRDISAYQEFIEGAFGSDEAVWDAASPAFVKGSQGVEGGWTSGRLAVLAHSAEDGLVDAAXQKAMQAALSRWEDNTPQGXGQRRVXMLSLKDDHDDAWM

SEQ ID NO: 25311 - protein, 388 aa, A.fumigatus
RHAKIDVTSSLGLIRVTGTEHTCESIREIIYDATNRIRQEDVDLPTPNHATSKSGRTLTPDFLAWVSKTYGVAFEQNPSQGVIKMFYLAENREDADNARRTLNLAIYNTISPAIPFGTYLSAAQSASVYNVDPEQNVLWFDRQKVWFRWAMSSTQSSETKILDTPYFDKHQSLLSDELLKLLRKSSPSSECHGISETVIAAIGQCLFLRKPSFEIQTLSAPQLGKLNLPRTFTTDVPRVTSFLRTLKPRLLDDDQQCYIFQLIPTPAHANIFPRLEVEVTLPGLHPSSVSDAQIEIRSVKAELAESSVDYLLPENGLDLRFTRKLHRDLLHGHSENESAANVTVESLREYLQGVFSRYMNNEGEAPLPAFTHVPLPNNLLKGTFSRKP

SEQ ID NO: 25312 - protein, 152 aa, A.fumigatus
VVGASDEFTKGMLLCPVFYLIIELADYVRLLQFRVDKRTGNSVAIKVIDVENAEDEVEDIIQEIAILSELDSPYVTKYHGSFLKGSHLWIVMEFCSGGSCSDLLRPGPIPEDYIMIIMRELLRGLDYLHTDKKLHRDVKGTLRSSFETQLGS

SEQ ID NO: 25313 - protein, 239 aa, A.fumigatus
  UNSURE (206),(228): Identity of amino acid sequences at the above locations are unknown.
QIRTAANILLTSNGQVKLADFGVSSQLSATMTKKNTFVGTPFWMAPEVIKQSGYDYKADIWSLGITAIELAQGEPPYSDIHPMKVLFLIPKNPPPTLQGPFSKTFKNFVELCLRRDPRERPSAKELLEHPFVKRARRTTYLTELIERYEGWQIRNGVQNGGVDEDCVQDLPSNDKDREHEEDLWDFGTVRPVGRTTAMGPMKEADXNTRNHNTTAWNFQDKSHEEVMXSSRPQPDYPKK

SEQ ID NO: 25314 - protein, 65 aa, A.fumigatus
SSVCYAGCDSKMPISRCKVQINIGHVTDKIQKIKLKSMNHIPTNTNRPQSRDTDVSHPIIRRQTA

SEQ ID NO: 25315 - protein, 238 aa, A.fumigatus
  UNSURE (211),(227): Identity of amino acid sequences at the above locations are unknown.
HTPVASVLSPMDSMTDSSNSLRSSDLPEMFRPPVNRAMRVLDRSFFRKTVPLSAAAVFQNSDISKVRAELHKSRDLLAVPRLNCIRDVADQEGQIKKALLLRETVKHDDKETWSPKISELVEKGRIAMRPYDLTLDYDFWTYADIISSILPEDELQEIPQGFTQVGHVLHLNLREQYLPYKYLIAEILRNKYRVIRTWINKTGDVGSHSEXRTFPFEFLGGDNDLNXVPARAGLRVPL

SEQ ID NO: 25316 - protein, 246 aa, A.fumigatus
  UNSURE (2),(245): Identity of amino acid sequences at the above locations are unknown.
MXSQHEQDCEFRFDYSRVYWNSRLETEHRRLVEKFNKGEMVCDVMAGVGPFAVPAGKKKIFVWANDLNPHGYEVMQDAIKRNKVEGFVTPFNMDGREFIRWSAKELLETEPVTVTIHPKVRRDRKSGNKVEQAPPPHPEEYHRPVFFDHYVMNLPATAIEFLDAFPGIYAGKESLFAPHTSQRLPMVHVYCFSGHSENELDDHIDICQRISERIGYTITPEDRIGGSGNQSVERISRPGWDVRVXQ

SEQ ID NO: 25317 - protein, 221 aa, A.fumigatus
ILIEISRMATGTSANRCEVRACQRCRKLKVGCDKAKPACRRCIKAGMRCVVPHAGSNKADRASTNCDKSILTDGLDDSLRNRDEVRLARCHCCPPLTAVQLTGSSISDKNGPFHSPSSYHKLTPHKRNRNPVSCIRCRRLKVRCDRQQPCHSCTKAKAVCAYGRSSGIHRDSDGESFADDSSAAVRFAAWSDRFRTDTHWITLVREVCPVVHPSMGSSEHC

SEQ ID NO: 25318 - protein, 86 aa, A.fumigatus
GHSRRPAGGEKKSRGFGRSKAVADVGDGRQTGGKPQVKKATFESTKKKEIGVSDLTLLSKISNEAINDNLKLRFEHDEIYVSIHSP

SEQ ID NO: 25319 - protein, 140 aa, A.fumigatus
  UNSURE (25),(45),(66): Identity of amino acid sequences at the above locations are unknown.
LADLEIFALLRACADIDSSDDRHIXATCWCPSTLSETVSLYRAMXCRQRRVADIVASQWVSTPTMXSSLIEAKIDSKCPPHVFAVAESAYYNMKTYKDNPCLNNLREVGGRKKPKLPNRIIAIPWPRDFGGTDLSYPAYP

SEQ ID NO: 25320 - protein, 121 aa, A.fumigatus
EGDAAVSGSGDLAFDVALGADLVSPHMIIQNHFLGFVAADLCLAIYNAQNIHYARNRATNLANGKKIYDVDLVPLLLSTFRDLFENYHLREFIIAATLRNQDTFQTFLKACRECLASIQSN

SEQ ID NO: 25321 - protein, 98 aa, A.fumigatus
RPKWLAAWLNADDIEQAPPFSFRNMGTLAYIGDARALMQLPHEDGRRYKYLPHGLTGRMAWLVWNSAYLTMSISWRNRLRVAFRWLLNNLFGRDVSRY

SEQ ID NO: 25322 - protein, 125 aa, A.fumigatus
LRQEKMAYTTVSQRKLAELDAKIPAEWRLSASQIPPGMLSPAESITNVKQYGRVNVMDIPRTCGLLSARELQITEDYDVRGLLRAMADNHLTAEEVTTAFCKVRCPSPSFLFFFFFFFFLQAKKR

SEQ ID NO: 25323 - protein, 186 aa, A.fumigatus
  UNSURE (136): Identity of amino acid sequences at the above locations are unknown.
RSLESSHRAPTDPLPNRTAVRPRRPARARARRLPAPHRPPHRALARAPRLRQGLLPHQRCRLQHRDRRPRRPPGERRSPPESTPHRPGAHRPDQKQRPPDQWAPRQRQIRLPADAETGQTRPHGGGSPRRQGILGXLPRFLVGFRPEFRRELPGFPASFWVFFGSHPNLGGRFPFGGQEGRPNSLV

SEQ ID NO: 25324 - protein, 186 aa, A.fumigatus
  UNSURE (133): Identity of amino acid sequences at the above locations are unknown.
RAAIAHQLTRCLTEPLFDRAVQRARELDAYLHRTGRPIGPLHGLPVSVKDCFHIKDVDSSIGIAALVARPANEEAPLNQLLTALGRIVLTKNNVPQTNGRLDSAKFVFRRTLKPVKRALTVGAPPAAKGFLAXCPGSWWGSGPNFAGNSPGSRQVFGCFLVPTQTLGGVSPLAARKAGPIPWFKGG

SEQ ID NO: 25325 - protein, 237 aa, A.fumigatus
  UNSURE (52): Identity of amino acid sequences at the above locations are unknown.
ELTNDFRFKTTLGIPILIFILHILNRLAAYTPLANPPESIESGNYGAPPRAXWWFKQAMIYFFGLLGMKICVFFLIQLLPFIVKIGDWALRWTEGNTALQIIFVMLLFPVIMNAIQYYIIDTFIKRPLSRTHELLQEDDEVEDALLDDGRTPHNALLSSAEDADTFGPDEGIIGKDLGKTLEPPAGPNGFRHVEYDPAVDGEYFSPASSTSASSSSSHGEYDAMSSSTKLTPQNKRP

SEQ ID NO: 25326 - protein, 81 aa, A.fumigatus
  UNSURE (24): Identity of amino acid sequences at the above locations are unknown.
EFSHSTEREDAKNPPPCSWKKTAXKTGPPPPPVQEWSSLPTLLNKTNPPKLNWRLNAFETKKIPTKDHVEYQTRRKSPSRE

SEQ ID NO: 25327 - protein, 194 aa, A.fumigatus
FDMSCSFQPRGEDTFIIIHGPRGSGKRELVLDRALVDYKYKIVIDCKQIQDARGDSAKIARAASQVGYRPVFSWMNSISSFIDLAAQGMIGTKAGFSETLDAQLSNIWQNTATALKKVTLEHRKKNDNDSHLTDEEYLEAHPELRPVVVIDNYLHNASESSVVYDKITEWAAGLTAGNIAHVIFLTTMSRTPNL

SEQ ID NO: 25328 - protein, 221 aa, A.fumigatus
  UNSURE (25): Identity of amino acid sequences at the above locations are unknown.
QISNSWRTVLRRRDTAKYVESKTLXHVYARILTYAQGAGQRIIEQSASEILKMFLLTPETIEQSWTHEQAWYLIKRLAESKDGSLSYNEIVLSELFKENGEITLRALEHAELISIAAVNGCPQRIRPGKPVLRAVFKKVTENKALSSRMDLAIIAKKINKENKSIEKYEEELSLLGSLPRQPRELTDRIQWLLNKVYSSQNKIAKYEKESAYLQKILRSEH

SEQ ID NO: 25329 - protein, 304 aa, A.fumigatus
TRQVSWIGTPVIETRLAVCYALNDPMEISHSLVAHATTLAVRSGASSSTSERPPAYKAVGIALAVSSGVFIGTSFVLKKTGLLKANVKYNEEAGEGYGYLKNVWWWSGMILMIVGEICNFVAYAFVDAILVTPLGALSVVITTILSAIFLKERLSFVGKVGCFSCIIGSVVIALNAPEQSSVGDIQDMKHYVIAPGFLAYAGVIIVGCAIVALWLGPRYGKKSMFVYISICSLIGGLSVVATQGLGAAILAQINGKSQFKEWFLYVLLVFVIATLLTEIIYLNVMSSVPGLQERVLTADHHRKR

SEQ ID NO: 25330 - protein, 237 aa, A.fumigatus
IHPRPTMAGRQSSRENAREQDLWPASSCPPCRPSQCTDRKGHGAGERPSTSQLDRHSGPVRPSSRDPRRRHHGASRRSPRSRRNQIQHSGPVARQGRHQGHSHRRRSIQDHAPPMRNGERSGAEAAHRRAASHALDRTLPPYHRLPGPQPPAIQHRPAPPGPHRRRRVMDNQGLEADDGRRLSRLGPTSHEAHRPGQGQRSPGVEALPAPASKDVDQGPRGFARRCLPSNAVSDRDH

SEQ ID NO: 25331 - protein, 231 aa, A.fumigatus
YIHVRRWQDGSLLGKMPVNKTYGQQVVVHRADLHNALIEKAMALENVQVRVNSTVTRVQFDPPAVTLADGTMVQADVVLAADGIKSSIRDQLLGKDATKAIPTGDAAYRIMLPRCAMENDPELKQLIDEPQATRWIGPYRHIIAYPVRNHQLYNIVLLHPDRTDVEESWTTRGSKQMMVDDYRGWDRRVTKLIDLVKDNEVLEWKLCQHPPLKTWIRGRVALLGDACHPML

SEQ ID NO: 25332 - protein, 62 aa, A.fumigatus
AIATISMISDHLSNDCSPYVGQGAAQAVEDAAALGVLLSSISSRSEIPLALASYEKSRKHRA

SEQ ID NO: 25333 - protein, 69 aa, A.fumigatus
TVQQSGTVNRATLHLPDGPEQQARDDQFRASMNGASNPDKWADLETQKFLWGWDAEKAALETWEGELPF

SEQ ID NO: 25334 - protein, 76 aa, A.fumigatus
SSLYQCAELATEWCGSGQLSKMQSSPNMLTKVRCSPSVTPYPRANQATQLNNCFMNSSSRSRLVRRELPFTLNGQS

SEQ ID NO: 25335 - protein, 120 aa, A.fumigatus
PWNRPWILVSLHSSTIQLWDYRMGTLIDRFEEHDGPVRGIDFHPTQPLFVSGGDDYKIKVWSLQTRRCLFTLNGHLDYVRTVFFHRELPWILSASDDQTIRIWNWQNRSLSKWTPVSPRG

SEQ ID NO: 25336 - protein, 77 aa, A.fumigatus
VLLIVPRQKGRSWSIQELREKSWEDLHCLWWVCVKERNRIATSNLERQRLKAGYGEWEARERDRTVSFSFLSELRPS

SEQ ID NO: 25337 - protein, 277 aa, A.fumigatus
  UNSURE (16),(108): Identity of amino acid sequences at the above locations are unknown.
TKGNTSSLTNQVEVMXQTCSDVTALTSFSENHDVARFASFKDDIAVRQRTPVTLKVSTDDRLTPAQLAKNVLTFTMLFDGIPMIYQGQEQHFSGASDPENREALWLSXYNTNAPLYQLATRLNRIRKHAAQIDPAFVDSQTFPIYTGSSEMGFRKGVEGRQLVMVLSTQGMDSGKYELDMPIGYQPGFVVTDVLNCANYSVNDMGLLKVSMDKGEPRVLFPADMMEGSGLCGYGRSNGTTYLNLKKNSTQFSGGGLSNRPTVPLLLICCLTCLILWC

SEQ ID NO: 25338 - protein, 68 aa, A.fumigatus
TSHQHLSCEGFFPLFFCTVNHTDRKIELKSFLLLLLPSKWHINVLEDSTFKVTRVLRKAPVDDVIPDK

SEQ ID NO: 25339 - protein, 194 aa, A.fumigatus
QGATAVLEFSAIDSPFAQPRNVIVGQLAASIIGVAIGKLFALNPHAHSLPQVGGALACAITIAFMAITNTTHPPAGATALLAVTEVFELGWYLVPVVLLGCALILCVALLINNIQRRFPVYWWTPHSLARPKLEDVESIGHEKVSSVKPTESEDSVTDEPEEIIIRRGEVLMPDNLWISAEEREVLERVSQRIQ

SEQ ID NO: 25340 - protein, 72 aa, A.fumigatus
PMKIRPTERIFEGRPQGILKDFFIPSNIFLGLGHHSLLPSGHLFIETSFSVLYNLLLAVESNPVRSSSPTTE

SEQ ID NO: 25341 - protein, 272 aa, A.fumigatus
KAFGRPSLPIFSFLPAIDPLSSTFFFICVHDPRQTFELLPGLSFYLPPYHLPSPIHTAKMVSASKAARLAKRAAEGDKKKTAKSKKDVKGDESPLVDADGEPRPTEDQPATTEEKMKEVEKLTAQMDKHGLSDRVTTGVLSSMASSRDVKITSASLVFHGKVLITDSTLELNFGRRYGLLGENGCGKSTLLKAIATREYPIPEHIDIYLLNEGAPPSDLGALEWVVTEAQNQLERMEKQAEEILEKDGPESPILEDLYDGLHHGDSASALDN

SEQ ID NO: 25342 - protein, 396 aa, A.fumigatus
RSKRGEKGGQWWGKVEKLGTQQLGWWRLRPWGPWTFPQGAAKCAVVGTRDTSQISQQPGYSSRADKIGVIKKLPSRVFYRTLQEVAGYITVHIAMATPAPAQTEPSGLENISTLLENLTSCLSSTGSSLPKAKRESPSDVSIEPPHDGISLLDTKSDLLLSYLHNLVFLIIFQLREAASAEPKAEENSHVDNGNSPLREDIVKKLTELRVYLDRGVRPLEGRLKYQVDKVIKAAEDADRAERGAQATTKSKAKNAKSSSNSESGSEESSGDSESDNEGEDEEEDDIDEMAYRPNISAFAKGIKSEAQTEEKADKKISGDGIYRPPRIMPTALPTTERKEQRDRRPRRSNVIDEFVSAEMSAAPMAEPSIGSTIVQGGRHSKTRKEREREAERTAYE

SEQ ID NO: 25343 - protein, 284 aa, A.fumigatus
PTRNSRCPLHQVVISFTATSGTMVPRVTEQRTTPRPSIEPFLMAIAANTVLPTTVVTSNGKTQTFSEDRIPSLTDLTTTTKVTTTLSENEIQTATSTTTLIPVIFPVTKGGFYWSPVPEPTAPEFPIPSLPDFPPVPSSPCFKLGDLFSRNCPPNDNKAPQTTHFTRGPNSPSCRSNCGHLRSETDSSSSSSCTTQNVTSCPKCILSQVFEFLNLSWLYQLNISFLPRNNRDAYLDIHHSEPHRNSPPSGTDTSCSSEKEKCMQHAQLWLRNSAPTLPVINPVM

SEQ ID NO: 25344 - protein, 83 aa, A.fumigatus
LQMPFAPSGYKFYRNVRDYGATGDGTADDTAAINRAVSDGNRCQYRLADNGCHVKWQDTDLFRGSNSESYRFDNHHQGHYDPE

SEQ ID NO: 25345 - protein, 284 aa, A.fumigatus
VFHRDSCSPAPFLFESDRIGSCFTFRTHAAFIWATEVEEKKASFIQQEQSAYAPRHLLSPAGTANATSSNGKGSIRDSQLYKRILGQSLKQVGLSENANEDASHQPESSSARDKGAMPYIVPPRTEGEDGYSSFKGFRGYTGEENEDLVRQVTEVAATAAAVAARDVARTRKPSVQQGTARHSNKITGDLSKSVLEDQEDVGIEHTHASGGHDAPNWSKAKSSIILLVATILYAIIAEILVNTVDVVLESVDIDEKFLGITLFALVPNTTEFLVRPIQSIPAAP

SEQ ID NO: 25346 - protein, 103 aa, A.fumigatus
HRREIPWNYPLCACPQYYGISGKTNSINTCSSMNLTPVQNAISFAMNGNIALSMEIGSAYALQVCLLQIPALVLFSALYSRILDPSDLLTHSSSPRECRIRGS

SEQ ID NO: 25347 - protein, 193 aa, A.fumigatus
PSSPVVKTFRWRLLAFQPIVLLSNAIQYLPSIFTKGRRNGIWIPLKRAPGHSVRAIVYHPRTQTHSGSRAIHLNIHGGGFLGGLPEGQTSFCQKVAHETGAIVVSTSHRYAPRYTFPTAHEDVQDVAEWLIENAERLWGTNPRSMTVSGFSAGGNLALGVAQGLAHTEFSIKASVTFYAPVSIYIIHRLHRLF

SEQ ID NO: 25348 - protein, 65 aa, A.fumigatus
  UNSURE (4),(5),(7),(17),(64): Identity of amino acid sequences at the above locations are unknown.
RRGXXKXLGIQWAVFSXKLPRILSLLAIAHAQNTKTHLGQPGRRTRTPSTRLRWCSNTGERQPXS

SEQ ID NO: 25349 - protein, 297 aa, A.fumigatus
TQGPGVARISGGRSAKPDDLDTPTSNKDEARYCRGTPRAAASGFLHLLYPTPELWTASLPHRTQVVYTPDYSYILHRLCVRPGSTIIEAGAGSGSFTHASVRAVFNGYPSEAPAAKKRRLGKVCSFEFHAQRAQRIREEIHDHGLDALVEVTHRDVYEDGFLLGDPKTGKSPKANAIFLDLPAPWLALKHLVRRPPSGAESPLDPSSPVYICTFSPCIEQVQRTITTLREYSWLSISMVEVNHHRIDVKRERTGLDCEGVRGATVFPKSVDEAVAKMRAVEEHSRRLSSPRAARSAA

SEQ ID NO: 25350 - protein, 63 aa, A.fumigatus
NHIDEKKIEYVHLPRNALNRVDYSTLMGSVLAAQISSDPSGVGTLSFTELEEYEESEMRPAGF

SEQ ID NO: 25351 - protein, 68 aa, A.fumigatus
RVCGSADLPFPCSDILPKGWASEGQPSTLCFKDKDVYPFGPGFPFHTRLKADERSNVLRCACYTAVSR

SEQ ID NO: 25352 - protein, 66 aa, A.fumigatus
LFKDDKDNLKSGNFLGGMLADLQGGVAGGEGRDNPDDWEAKFKPEVEDQYIDGLTRGWKDPRRRYQ

SEQ ID NO: 25353 - protein, 62 aa, A.fumigatus
VMEPDYGALSSRLIRGAFLLQSSINMEDLRLEEDEYLSFWVTNNAGIERLALSTRRGSKETS

SEQ ID NO: 25354 - protein, 127 aa, A.fumigatus
LTLSETAVSLYDVVAQDYSGLFLQSTRRRRLDSLKSHSDSLKQLQPSTIQSAYTQQQTLNIHTFNYIYGTVFFLPQSRDQYPKYSSITLFLAKDGGSIDHSGLYSLVCFRACPITWLHYSPHPRGST

SEQ ID NO: 25355 - protein, 123 aa, A.fumigatus
LRYRAAWLTFQSVGAKDKIRCAVFSLPSARELKATHLEPKKPWPSRVETAAHEGQPNLLWKNSHVDFTKYAHIDGILPEVWRTSGPGISGTVNSGLGISQHICYLGCEHTRDASIYLRRHILT

SEQ ID NO: 25356 - protein, 155 aa, A.fumigatus
DGLRYESVRTKGQTILTRQMFSWWANVATSPYLIGTQIQALVIQNHPEYVPQPWHATLIVWAVLLIPVAVNIYARRLLSPVEVIGGIIHILFFPAVLITLVVLGSRNSSEFVWTHFENSMSGWKNDGVIWSVGLLTAVYTLGGTDLSSHSTLCLR

SEQ ID NO: 25357 - protein, 67 aa, A.fumigatus
SDRKQRYLSFLPMLAFAATLQASWEAIGASMFAGLENGGPVVLIYGLILAIVGSLGIALSLAELASM

SEQ ID NO: 25358 - protein, 204 aa, A.fumigatus
  UNSURE (2): Identity of amino acid sequences at the above locations are unknown.
SXVSFSHNHQPLGLRFSSRGRHPSFIPATLQSSMHLRNFSLAVISTVVASGAWYAYQGSNSPQSPVTSPSQTRSIATDASSGPHAEESAESTRRAILVDNDQFYTATLSGDQPLYKQTDDSDRRILEMLTPEQATQKLRRNEQSFMVNRGKGVVRYDVVQVPSNSPIEDDHAEKIVEVPSSVAAANDGGSTSDWMFWAVFDGHS

SEQ ID NO: 25359 - protein, 271 aa, A.fumigatus
ARGWTTSAKLRNVLISYVARELNTTYKAAATNPSLISPSSEAVDAAIKQAFVRLDNDIVHSSVDKVLKSNSRRAAAELLAPALSGSCALLAFYDSQSKDLKVACAGDSRAVLGRRGPTGKWTATPLSEDQTGGTPSEMKRLREEHPGEPNVVRNGRILGQLEPSRSFGDAFYKWSKETQEKIKKQFFGRTPHPLLKTPPYVTAEPVITTTKIEPSKGDFVVMATDGLWEMLTNEEVVGLVGQWIDQQRAGNNGTSKAWLQSWFGLDNKRDH

SEQ ID NO: 25360 - protein, 159 aa, A.fumigatus
DKMFRSVPRRIPRRLPTLSSTAGSPSHLALRSFTCGYPRMSSSPLPTVEPPVSTTLPSDSFQLLSTAEKSGSAEDALYEQQIKDVEAWWKSPRFEGIKRPYSAADVVSKRGTLQQTYPSSLMARQAYSIWLIEKNRQRENPFLTNYGRTLYTGTLGQKS

SEQ ID NO: 25361 - protein, 83 aa, A.fumigatus
LLNIIIRSIIKSYLLLFTILKNNTLKLEGILLLIKIITNYYSLEYLYLLSYLIDNKPISLNSYPTLILKLYINLGSKELSLIL

SEQ ID NO: 25362 - protein, 77 aa, A.fumigatus
TDCGMLTFSDEDIRAKIREELGEDASDIKFLPFRDLEASVREDVRFLRGSRLVQGNVTGYVYEVERGRLVRLDVSDI

SEQ ID NO: 25363 - protein, 140 aa, A.fumigatus
QTGRRHLHGRAHRYPPLPPFSSPYRSTNSADVFSVLGLTEGDAHVIRNAGGRASEALRSLIISQRLLGTEEVVVIHHVSPVCSHPSLTSGTDDDDDRRTAGCSPSATRISEPRSGKSLARMRRISSSCRSGIWRRVCGRM

SEQ ID NO: 25364 - protein, 139 aa, A.fumigatus
ARGCNREYSAECDFVFRARATTFVCLTWFALFLAWEMVDMRRSFFRMQPGSTRYLTQWMSDVWRNQFLFWSIVAGFVTTFPILYIPVLNHVVFKHTGISWEWGIVFVEAVLFFLGVELWKFAKRVYFRRQQGKNVQSLA

SEQ ID NO: 25365 - protein, 184 aa, A.fumigatus
YTIFLFLSSPFRNPDRYPCYQENGRTYHGYRKGIYMLPCDEQEQDRLDIFHKLFTVARVSDGLIYAPHPTNGRFLDLGCGTGIWAIDVANKYPEAFVVGVDLAPIQPPNHPRNCDFYAPFDFESLWALGEDSWDLIHMQMGSGSVASWPNLYRRIYSHLRPGAWFEQVDMDFEPLYGRAEISDA

SEQ ID NO: 25366 - protein, 106 aa, A.fumigatus
  UNSURE (10),(14),(16),(39): Identity of amino acid sequences at the above locations are unknown.
PVHVVFPFGXLVNXLXGFFFFFFFSPNTRLDFLDLMFLXGQGGQRPPDGAFPPLNVRGFISSGFNALGRSRNNSDAMDIYTITDRGPRCRERPGRWSLARQWFPKY

SEQ ID NO: 25367 - protein, 61 aa, A.fumigatus
  UNSURE (9),(23),(29),(38): Identity of amino acid sequences at the above locations are unknown.
LSHNSQGIXHSLNLRRKVYVCPXCPITHXTKIKESTKXLISGKWRSTVTPTINLTQCKYPP

SEQ ID NO: 25368 - protein, 92 aa, A.fumigatus
  UNSURE (51),(52),(53),(55),(57),(58),(59),(60),(63),(64),(65),(66),(67),(68),(69),(74),(78): Identity of amino acid sequences at the above locations are unknown.
GGGIIFLALLLLGGRTVPVVSKLQQPPWGDIMGGCARSTSKFYLGKHFVRXXXPXRXXXXGRXXXXXXXRSASXAFEXTGIVAILLMLSHSV

SEQ ID NO: 25369 - protein, 94 aa, A.fumigatus
IGSGMNSDLFPPQDRWKAMAVFTLAPLIGTAIGPITGAFLVQYESWPWCFYVVSIAAAVMQLAAFLLLRETYGPVLLRRKCARMRKTTGTLTSL

SEQ ID NO: 25370 - protein, 112 aa, A.fumigatus
VTWDGPNDPENPKNWPASRKWMVFIPMSLFNLLSSMSSATVAPALEAIADDLKIRSQTLLIMSLSVYLLGSAIIPLVSSPLSEMYGRVIILSASNIVYIIFNTLCGIAKTQN

SEQ ID NO: 25371 - protein, 329 aa, A.fumigatus
  UNSURE (16): Identity of amino acid sequences at the above locations are unknown.
SATTSVCIFPPPPGPXYHDSPLIWRSWHWIRYNAGSVAHAVLRPRGMSWTPRPLDLGVGTSFDQHVIRGYRFLARRWVPGAKIYLFGFSRGAYTARFLNEMLDYVGLLSADNEELIPFVWEAFTQWKFSEGEKPEERLGAMRSLSVSRETMCRPVGQVHFLGLFDTVNSVAEFNKESSTRPSPKIMRHAVSIDERRIKFQPVLFESKLGTGSPDMKQSVDDWKKGPENIYDTDNDGEFSILEADFKEVYFAGNHGDVGGGWPSKSWPASQIPLTWMVQEAIKAGLTFESNKLEVLGCQDPATCGSGQDIVRQAERLHHGAGRIDSVLTT

SEQ ID NO: 25372 - protein, 158 aa, A.fumigatus
KRMNQKPSVGSPEWHQIRKNNHKEGKLRQLFCGAIQANSISVERRRREAINEGINQLARLVPNCDKNKGAILQRTIEYICQLHDEKKTMSERWEQNNMTTSHAINEISAQNSKLKLEVNRRGDIAQKWLQRCRDAGLEFDDYNDAEELEPLEVDQGQV

SEQ ID NO: 25373 - protein, 116 aa, A.fumigatus
LYTLAEHKFHALGSDVSVAYQPEDLIRNPPRPSDVTLELLLASQTHLGHYTSRWNPQNSRYIFGIREGVHIISLDVTAAYLRRAAKVVEEVAARGGLILFVGTRWAMDPPGSKVTR

SEQ ID NO: 25374 - protein, 64 aa, A.fumigatus
NSQLLPSLFLTSSAFFQFTMQILDSGEKITPEALIPKFEVNRLLKQGKNHLLSRFRCTSSPGAQ

SEQ ID NO: 25375 - protein, 143 aa, A.fumigatus
RGSIVSYVVLFVFAWDEAAALMMLWQVYFGFTHCPDICPDELDKMAEIIDRVKEATKGENIFLPVFITCDPARDTPQVLREYLKEFHPDIIGLTGTYEQVKHVCKQYRVYFSTPKDVKPGEDYLVDHSIYFYLMGESRFPRVK

SEQ ID NO: 25376 - protein, 84 aa, A.fumigatus
TEPDLYLYMYIRPDLSNPRLYFPPSVEDNILPSASLSLFSLHSIPPSTNSSLFQISTFSFTSSSTSSAAFHAIPRCPALTANHN

SEQ ID NO: 25377 - protein, 85 aa, A.fumigatus
YWEDPPFSWKAALLFVLTGAGMIVYFRVEKERLERKRIAEMSKGVGRPKVGGPFTLTDLDGKEFTAEDLKGKYSFVCGPLCLCLG

SEQ ID NO: 25378 - protein, 183 aa, A.fumigatus
RTDILGLPIGQHISLAATIEGQPKEVVRSYTPISSDNEAGYFDLLVKAYPQGNISKYLTTLKIGDTMKVRGPKGAMVYTPNMCRHIGMIAGGTGITPMLQIIKAVIRNRPRNGGNDTTKLDLIFANVNPDDILLKEELDMLAAEDPDFNIYYVLNNPPQGWTGGVGFVTPEMIKVRIISPHAD

SEQ ID NO: 25379 - protein, 60 aa, A.fumigatus
IGSLADLISSQEHLPAPASDVKILLCGPPPMISAMKKATESLGYTKARPVSKLEDQVFCF

SEQ ID NO: 25380 - protein, 406 aa, A.fumigatus
  UNSURE (41): Identity of amino acid sequences at the above locations are unknown.
FSQSRPGAFFMVHFRSKELTKLSPFGKWCNAFGIHGGFMIXQDDVDTYTCHEPCSANAAAIRDLQEHPEDVPYRVLGSLGKPYKFQIDEIMLANAWRPNFALADSYVSRDGQGRVFLGGDAAHQNPPHGGYGMNSGIEDAISLAWRLSALYKGIGGGNLITSYTNERRPNMMLRLERCAAHIGKFTPMIMRTMMAPSTEIFLEESEEGEKARAEIATHLDSVGPENIDRGVELDLRYLNSEIIVSDGTREPRFDNMRYTPSTRPGHRAPHVFLRDDQTSIVDLYGTEWSLMDFSKVKSDSQTTNGFVSLDGEMTSPVATFKAVAKAMQMPLTHVQLDAGEKHVKEVWENYDYVLVRPDGYVAWRGGKEGARDECCELNEGRIRNILRIALGWKTFFTHRGWKDTRY

SEQ ID NO: 25381 - protein, 209 aa, A.fumigatus
PLDQDDLEDEQQEFVWDRCLNDQMFVFQEHELERILDIIITNMTPQRSPSQKPVPANLLFLSARYAHYHASPELLADLLNSATEKINDVVERHQWDMTILAFWMSNATLLLHYLKKDAGLVGSTVEFQLHLAELINEIFILIIRDAERRMNKVLDAAMLDHETIPGLEDVAFQNEWKLFRPKNKTKAPEPAEKRFRLTRPGMGPSASPN

SEQ ID NO: 25382 - protein, 196 aa, A.fumigatus
WHTRICCAAVVAGSVYKDVLSTTTGWLGHDYAKSPWQLMLSPMPAGQSQFLTTPIAAKPLSFSLALDDHSHDDEHTLQAHYGRGLVASLDDDNASTITARLEDSDARLMEMLAAQAAHRELESLDADEDAIASDEKLTDEEKRKILQRSLNMAASNGDVDRVHKLVGGKAKDYVDVNMADEEGTVPLIYASCFVRN

SEQ ID NO: 25383 - protein, 183 aa, A.fumigatus
SMRAVLCVIKIIFLLVGCGTDGEQGHQDVVSALLDAGANVDQQDRNQWSALMWAMTNRHKTIAKILLDHGASPDIKSSSGGTAFDFAQPGSEISEYLHENGYNFGPSAIEDDFYDSGFAHGRFEEEMAENEMKRRMMMEESAINLEVDLSSLGLDEKFEVGTPFRRDVNDADRVAARPGRSGR

SEQ ID NO: 25384 - protein, 123 aa, A.fumigatus
GIQLKHFGKLPVIGGRNCQSVTQTPAHGETFKIGERISVKALHTPCHTQDSICYYMQDGDEKVVFTGDTLFIAGETSILWCIRMNLTLAGCGRFFEGNAQEMHKALNETLASLPDDTRVYVSR

SEQ ID NO: 25385 - protein, 126 aa, A.fumigatus
FLSPELLNGFVILLGSTTPTSLSKRNPYTSLSNSCNNPFRTFGRFNCIFSPSFAPILRKLSASRPTRVVHADNIPDSNSVRTKPRFTVSSSSVIVDLVRPRFARRYTCIRSELADNAPAQSGSALR

SEQ ID NO: 25386 - protein, 315 aa, A.fumigatus
IAYVSSMNQTMEKMAKMTDSEYSHFMRVAFGHTAPMQPDYGAIGPLEFVDPTLNDSQKEAIRFALAARDVALIHGPPGTGKTHTLIELILQMVKRKLRVLVCGPSNISVDNIVERLAPNGVPVVRIGHPARLLPSVLEHSLEVLTHTSEAAAIIKDVRKEIDEKQASIRKTRTGRERRAIYDDLKELRREFRERESRCVDNLVRESNVVLATLHGAGGHQLKNQKFDVVVIDEASQALEAQCWIPLFATSKVVLCRRPTEDSPYRKAFLCQLENPGKKEGFNPKVGLTQFLRETMANFLGKTSFGDNSSLEGDPV

SEQ ID NO: 25387 - protein, 64 aa, A.fumigatus
  UNSURE (18),(19),(21),(22),(23),(24),(25),(26),(27),(28),(32),(49): Identity of amino acid sequences at the above locations are unknown.
FLLCIREKSRREFSYFLXXSXXXXXXXXLFFXLYPVELLSGRGPLGLPXPPYRELGLKGNPLGT

SEQ ID NO: 25388 - protein, 96 aa, A.fumigatus
TRHQPNTNLTANGNNMETQTWLIVGASRGIGLEFVRQLLTSGHRVIATARGPGSALDTIARDAPDRATILTCDVSKNESIMVCICIPICYQLRQRY

SEQ ID NO: 25389 - protein, 209 aa, A.fumigatus
YKQHNLTHPAAILQNCQQLHRHELTRADKDQSNAEMSRTVCITAVDGHTGFLIAELLLTNETFKSHIKSVAGLTLHPHAAKCKELAKLGVKIVPHEPGRLKHTVQTLQQIGAEAMCLIPPAHKEKFDITMEMIEAAKKANVANVCFVSSAGCDLAERDKQPHLRSFIDLEAAFMASKGDSSTQTGHSPVVVRYSPPSLYPCLFARQWAI

SEQ ID NO: 25390 - protein, 175 aa, A.fumigatus
RRKRGADEGRDALRRAQKLRIGARSIPGVPIVYVKRSVMILEPMSTPSEEVRDGVENRKFRVGLNDEAVLGKRKRTEDGEEKKKKRGPKKPKGPNPLSVKKPKKKPAETASGPKQEKRKEQKLDEAPDRTNDDGESGAPKPKRRRRHHKSSKGDGNDDHAGEPSNGADAATASNE

SEQ ID NO: 25391 - protein, 120 aa, A.fumigatus
MGVVASRSYVCGWSLPVPMSPQLTGGLESRFENFDEYTRRQYNAKAPHLPNPFGYDEVPNKFSEFDVFQKLRVLHQLSVWTFWNPDRIREKMPEQKEIDQTQWVGKIPPSAVDLGLPQRC

SEQ ID NO: 25392 - protein, 110 aa, A.fumigatus
  UNSURE (4),(99): Identity of amino acid sequences at the above locations are unknown.
DIPXTGCSSTIRNIEFIKALPSITITKLIDGITVLGIRSRHRSNHSAMLTLWFPRLMNNSGSANIFAKITIYYYLVNGLKPKLLIRTNIICSEGFILNXKHSIAIISSYS

SEQ ID NO: 25393 - protein, 83 aa, A.fumigatus
RSLLLVYLVSKLVVYLKTNLLANYNFIFNLLDKSTLNRATIYVYIINYKFSFIKVCNKTPTLIIVTYYTYIGTISNTNFITAY

SEQ ID NO: 25394 - protein, 78 aa, A.fumigatus
YKNMYLYSNTLSRCEYFNTTLYQTMQLAENLIAPSRPTMLITKKKKGGGGGGNEIEASISMQLFNAAYAKGIKMSERL

SEQ ID NO: 25395 - protein, 174 aa, A.fumigatus
LISRQSLSLLSPTAPRLTSLSLHHPLNQHHAHTMASPAQAQAPASTSNQPLTPPAEPSSTNNTANTTASQPPHPTGTSTTAPNTAMPSTTPQPTQIPSTSLTDSGKSRRPRDVRLIHMLLASLGVTAYQERVPLQLLDFAYRYTSCVLHEAVHPRTEGYAGGPRNRAEQQSWAS

SEQ ID NO: 25396 - protein, 81 aa, A.fumigatus
  UNSURE (25),(78): Identity of amino acid sequences at the above locations are unknown.
QSMCELIFHSIANLVGSCWFRFIVXILDAQKRIGTADISYSGVIPSEEENPARPSVYPGLDNVRHSLHNQKWGGPLMXSII

SEQ ID NO: 25397 - protein, 145 aa, A.fumigatus
  UNSURE (103),(110),(111): Identity of amino acid sequences at the above locations are unknown.
TQHAPSHPVASACPLSKAPNPKKGEKGEKTPRFFLGVFWGFKTPAPGPLLKNPPKRGGGPNFPPPKGPGPKIFLGKKFSPPPRGLCPPPPKNRGGGGVFFFFXPPPPAAXXKKKAPHKIFWGPPPGPPRGGGEKNTLFFFFVWGA

SEQ ID NO: 25398 - protein, 106 aa, A.fumigatus
APGEDLSGRIINIHHSFLPSFKGAKPYHQAYDRGVKIIGATAHFVTSDLDEGPIIEQNVVRVNHALSPKELTHAGSNVESNVLATAVKYVTERRVLLNGHKTVVFA

SEQ ID NO: 25399 - protein, 62 aa, A.fumigatus
SCRDQLYTDIKINDTLCERYQTHMARYGRKITKSHDKVMTGSSDIGRFFFFFFFVSSSTDYS

SEQ ID NO: 25400 - protein, 67 aa, A.fumigatus
GTLPDGKEAMGDGDRGVIFFLSTEYFQRVYYMQTAPRRLPFDINASCPLKPMNSAIGISSKDDDSLE

SEQ ID NO: 25401 - protein, 66 aa, A.fumigatus
STAILWQSARHRVVSRLSGVTPAGRTVPFESPYFSTGIWTIMSMTQTLVCYEKLQRISNKLSLGIL

SEQ ID NO: 25402 - protein, 89 aa, A.fumigatus
SMTCKSGKKKVPWVLLLFLKLVPFCKAPYSGFWKYLPGFLHNLKNQQPRLIVGTISDCLIRALIGFGLNRQDICLLVIYSLGQSNVRES

SEQ ID NO: 25403 - protein, 143 aa, A.fumigatus
RVLSRIISILTPLTGQSLTMSVHANGKTPTHAFSRSPFRTRSNFQDACRALLDPLVPRFTPGCSRVKIGSSATRFDEGGAQIEGFARPLWALGSLLGGGYDYAEAARWREGFISGTDPDHPEYWGDIEDMDQRMVEMCPIGFA

SEQ ID NO: 25404 - protein, 119 aa, A.fumigatus
PVGNRFWEALSGICSRTIQHPDSQVNRLCITPDKRYLAAAGHNNVKLYDIKSTNPNPVMTFDGHTNNITGVAFHCEGKWMVTSSEDGTVKVWDTRTGSLQRNYAHKSPVSSPRGWRASV

SEQ ID NO: 25405 - protein, 244 aa, A.fumigatus
PSSGALFFPQSIHPPNTDPVGDADAFGHIRKKELQQSAKHLGLRADSDVFIVDDPARFPDSMTATWSESDISSLLASAFAPDLASQSQSSAVRHRVPGTGPPTATIDVLITFDKHGISNHPNHCSLYHGAVHFLRALMKDKAGYTCPVTLYTLTTTSILRKYIGVLDAPWTMASGALGSIFAGAAKGGKEDMPGKLLFISAVNEYLRAQAAMVKAHKSQMLWFRYGWITLGRYMVVNDLRRVRV

SEQ ID NO: 25406 - protein, 177 aa, A.fumigatus
AERTSRLPDGFSYAEGALLEPLSVVMRGIQVARLNLGRGVVVCGAGPIGLIALAAARASGAHPIVITDVELRRLAFAKEIVPSCITYQVDLAKDAQDNALAIRALFGDSEYVAPEAVLECTGVESSVCTAAYTARRGGVVVVIGVGKATMNNLPFMHMSLAEVRFTLNLGRIRANDG

SEQ ID NO: 25407 - protein, 67 aa, A.fumigatus
IDLRFINRYRDTWPSAIACLSGGILDLRKLVTHVFPLERAKDALHLCADPRNGSIKVMVVDEVDASV

SEQ ID NO: 25408 - protein, 81 aa, A.fumigatus
DAVKASPNSSQVRHSISTYDLHSDNSQGDRVAVEPGVPCEQCFLCNDGRYNLCEDVQFAGVYPYAGTLQRYKVHPAKWLHK

SEQ ID NO: 25409 - protein, 83 aa, A.fumigatus
YFHSAVLCVLGLVLHANVEKGYSNERCHLLSSLEEKQCILFSHYRSYTRIDFIHNHYLYTPIAWICTQMQSILCPLQGKDMRY

SEQ ID NO: 25410 - protein, 60 aa, A.fumigatus
PMVWPAWSRYTVFLTPVWYYICWSGFRSISSNMWVVSLTGYQLLLKRTLDEPLSFTDNQA

SEQ ID NO: 25411 - protein, 67 aa, A.fumigatus
EDEAKVSQIEWRHQLATMDIEAITQRMTSQPTMWFQGVQDPAMRAIQQGESPVIAVMPTGGDKSMCL

SEQ ID NO: 25412 - protein, 241 aa, A.fumigatus
DWLDPTAPPNAPWKGTTDAKLVANAFLIRSLDLMCKISRILGQDTDTSRFVRWSESSRKEFQDEYVTANGRIVFDSQTAYALAICFDLLKPSQKNHAGGRLAYLVRKKEFKIGTGFAGTPYVCEALALTGNIQLAYAMLLEERCPSWLYPVTMGATTVWERWDSMLADGSVNPGEMTSFNHYAFGAIAKFLYERVAGLQRVEPGWKRSCVAPGIGAELSSAAAEHLTPFGLLSCSWRTGKN

SEQ ID NO: 25413 - protein, 72 aa, A.fumigatus
QRSQMVDAISISIGSLFGSPPVTAFVESGAGISEGGKTGLTSCVTGICFFIAVFFAPIFASNPSLGLLAARW

SEQ ID NO: 25414 - protein, 150 aa, A.fumigatus
SLLGATGCTLVIVGALMCKAAAEINWRYYGDAIPAFLTIAIMPFTYSIAYGLIAGILSYVLINTTAWLIEKGSVGRVVPPNKDESDPWSYKVPGGFLPPWLRRAARGKKDFWREDEEESVDMGVVPGGSVSSHDRPEGEKSQVGVGNKSL

SEQ ID NO: 25415 - protein, 107 aa, A.fumigatus
ALPELPQSMRRFFACYTHYQPGVPNSIATSCSGNLLDIPDWCTYSIYCSIYLFHDGNSPAPEWAANRQVPDRYSANKGSGQRRNRAVVFYQRNSHRVFSIQPGKNPC

SEQ ID NO: 25416 - protein, 140 aa, A.fumigatus
IESGLVRDRMDEFKAVRKQTVDKATLEISRLEKRLTRLTQLLASLPPDQIQGGKRWPISWQNDQRKALEQTIVSWQDDAGVPRCPFCQQEFTSYTFRRHHCRTCGRVVCGDPATGCSNEVPLSITPCMLNPLAFCVVILR

SEQ ID NO: 25417 - protein, 180 aa, A.fumigatus
ISEAARNVAVCYKSRSLLLYLTSFFLARDPRRPPSAAQIAEASKVRKRLTDSFAQYDVAARRIRDMPTDSPTQQRLQKAIYQQATNFLHLHMLPLKALPKILKHATPNGRPASAASSIATPTNSAVGDHRPRESALASIKYNGIAASGSNTSLTSDTSSAVSASEAGLHHTGRRSDAKRL

SEQ ID NO: 25418 - protein, 138 aa, A.fumigatus
WRGSFQPRGEDKGTELYSPTDPGILVNIYNALSTYIVPGPTLIPGAVSVVQSSSTITASGTPVTGSGSAPTTSATTTLSTTTRATTTTTTTTAGSSTSVQSVYGQCGGSGWSGPTACVTGATCTSYNSYYSQCIPTAS

SEQ ID NO: 25419 - protein, 186 aa, A.fumigatus
VDQLAPPDCILATNSSSYKSSEMIQQVTRRYRVCNGHYYMPPDQNHLEIMTCGYTDPSIIAFLMEQSAAAGFVPIHAKVESTGLIFNRIWAAIKRESLLVMAEGVGTAGDIDQLFKGWFHGEVGPCEMMDRVGLDTVYNIEKHYVEERGLDAKPIEWLKENYVDRGLLGRKSGKGLLSEESNGHAQ

SEQ ID NO: 25420 - protein, 336 aa, A.fumigatus
ECVSYGSRRSFDILTSTMDPSRSPSPSFSSPPSEIRILTLNCWGLKYLAKYRHERLSEIGRQLALADPPPQIVGLQECWTQQDYESIRQQTNHILPYGKFYFGGIFGAGLAILSKWPIEESTMYAYPLNGRPTAFFRGDWFVGKGVACARIRFGPEVGDVAEVFCTHLHAPYEREPNDSYICHRTAQAWEIAKLMRGAAERGHLVIGLGDFNMIPSSFAHQLIHAHAPVRDVWQVLHPDSSVGATIDLPEQKRNRPVPTAEFNLLENGATCDGRFNTWRWSKEDRKRLEKREDVVVDRTRPAPRGKENGLHLWRGTAGYPSAYPGPGGSVQSGGLA

SEQ ID NO: 25421 - protein, 220 aa, A.fumigatus
ALPPSRRHPHGTPQPPRRISATKLPEECLLRRRRPRRAPRCLPARHPPLAPAHPRRSGSGHRTGRPDRRADLRRRSHRPPPRRCTSHLPALHLHRHRGHRPRPSRDRKIPQPRPEDPSPPQRRQCRQPTPCAGRLCRRACRVRHAECAADRSGAERGEWGCVRVCARVRVYRRAGVRASGDLRCQPWRRARADRDGESDSDASGECGGAPGGGYHRHVPV

SEQ ID NO: 25422 - protein, 425 aa, A.fumigatus
  UNSURE (350),(364),(372): Identity of amino acid sequences at the above locations are unknown.
QHQESRPISPPTGSEVQVAIRATGLCGSDLHYYNHGRNGDFVVREPMCLGHESSGTVTAVGPDVTTLQVGDRVALDVGLPCRTCTLCRTGRYNICPDMKFRNSAKLFPHLDGTLMELPNHPAGSLPQSSLKSVSYAGGALVEPLAVCLHAIRRSHPPTPAEVDLATEQGDQTAALIFGAGAIGLLLAAALATSQPFTSIVIADIDPARLEIAKSLNLGLKTHLLPKGGNAANPPPAPDASAAEHAAYAMQNAQRTAAALKEANGVASGFVRVYECTGVPACVQAGIYAASPGAVLVQIGMGNPIQTLPVSAAALREVDIIGTFRYDGHAYPAAIELMASGKLDHVQKQVXTHRVRLEDGNSAFXLAGKGLDXTGQPVVKVSIESKIWIGCVRPPCLYPVGLLRGPSCWTGDLRSPTRYLFCSKFL

SEQ ID NO: 25423 - protein, 135 aa, A.fumigatus
YLLSFFSSHHLNCFVSPYALFLNIGFFLHRDKSSHPALQLRHHAFGSTHWCHHPRAQGVERSLVHSDSKGELAIVVWWSVDSNVVLKEFPEGTRDEFIRNCKDGQYDDVVVIYRSNASTKVSVAVERGDKCLVTD

SEQ ID NO: 25424 - protein, 74 aa, A.fumigatus
VQFTGPFDAELLSVLPKSLKYICHNGAGYDNIDIPACSEKGAIIYVLLIQKPEKLIKHRNCRLQYPSRREPRNC

SEQ ID NO: 25425 - protein, 61 aa, A.fumigatus
TSDSSYTAIRALTPLSNSDIMPSALLIGAITHARKEWKDLSSILTLKVSSRLWSGGVSTLM

SEQ ID NO: 25426 - protein, 107 aa, A.fumigatus
  UNSURE (80): Identity of amino acid sequences at the above locations are unknown.
RRWPTLGSLIRLGVPPNWHSWSRPNSFSNRWIKMPPFCFPHPWKERTIPYLSLLNTLRTGEITPYPPLVGPPWGFNFLPXPKLNHSRATFPPKCPPHFTVSISGYVS

SEQ ID NO: 25427 - protein, 206 aa, A.fumigatus
  UNSURE (13): Identity of amino acid sequences at the above locations are unknown.
RYNSFAWKGETEXEYQWCLEQQLNAFKDGQKLNLILDDGGDLTALVHSKYPEMLKGCYGVSEETTTGVHHLYRMLKEGKLLVPAINVNDSVTKSKFDNLYGCRESLIDGIKRATDVMIAGKVAVVAGYGDVGKGCADALRSMGARVLVTEIDPINALQAAVQGYQVVTMEEAAPQGQIFVTTTGCRDILVGKHFEVMRNDAIVCSK

SEQ ID NO: 25428 - protein, 160 aa, A.fumigatus
  UNSURE (26): Identity of amino acid sequences at the above locations are unknown.
LVSASFGGFILINTDIGHFDIEIDVXWLKANAKSVQNIKPQVDRYLMPNGRHIILLAEGRLVNLGCATGHSSFVMSCSFSNQVLAQIALFKAEDEAFGKKYVEFGTTGKKPVGVYVLPKILDEQVALLHLEHVNAKLSKLTPVQAEYLGLDIAGPFKSDM

SEQ ID NO: 25429 - protein, 69 aa, A.fumigatus
TPTGFLPVVPNSTYFLPKASSSALNRAIWARTWLEKEQDMTKEEWPVAQPRLTRRPSARRMMWRPLGIR

SEQ ID NO: 25430 - protein, 389 aa, A.fumigatus
  UNSURE (147),(367): Identity of amino acid sequences at the above locations are unknown.
LGSGTEKDKAHLHIALERTGNIQTKVLGLNGSELGQLGIDVLQVEQSNLLVQDLGKNVDANGLLAGGAELDVLLAKGLVLGLEQSNLGKNLVGEGAGHDEGRVAGGTAKVDQTTLGKEDDVAAVGHQVAVNLGLNVLDGLGVGLEPXNVNLNVEVTNVCVDQYKATETRGNQSLTANNGVVTHNLKVLANKNVTATGGGDEDLTLGSSLLHGDDLVSLNSGLKGVDGVNLGDEDTGTHAAESIGTALADITVTSNNGDLAGNHDVGGTLDTIDERLTATVQVVELGLGDGVVDVDRGNKELALLEHSVEVVNTSGGLLGDTVAALEHLRVLAVDEGGQITTIVEDEVELLAILESVELLLQAPLVLXLGLTLPGKAIVTLELASFQNSK

SEQ ID NO: 25431 - protein, 504 aa, A.fumigatus
IGAALPPRVKTEQRTVETEYYDFLVVASGYFSRPYTPDIPGLAALAERTIHSSALRSLEDLDAIVEKGSDGGRLIVIGGSMSGVEAASSLALHVSSLRYAPGSSVQTDSFPEVYHISSRPFWTVPTYIPHAQKDNGTGTETVSLLPLDLPMYDLARRPPGPVEYAFGPASAAQVAKVNDYFQSILGEDYTNIGPGDIGFKGGEEETLQPRWVAIGNDYAEFVRSKAIKTVIGRVSAVHASSPGPAKVDIELPGKESMSLDNVAGIVLATGFRPFPSLAFLPEDVLSALEYSPDDSFFPLILDPKGASNANIPDLGFVGFYRGPYWGVMEMQARSLAQTWAGDDTEHGIQFSATELESKAQERQKVREYRSADPNLHRGQFPMGDYTGLMESFARDLGICRAPLTELDERPGPVVPARYVMSGPGTADIRTSLQALQETLQPRRESASPAVAMAVFRALHGSWDFTRSGQDGISSGISTFFPRYPSSPAYEKSSPRGWKVDTCLW

SEQ ID NO: 25432 - protein, 62 aa, A.fumigatus
SDLGIIFSWFKELEVNYGRKRYANPKRIDHISALIITKCGWFPGSPTQLSDENVGKWSHFTG

SEQ ID NO: 25433 - protein, 335 aa, A.fumigatus
GYSAHNWPKGGRDSLTRTSGQEEQPRAGRMIQDKTPSILEVELVENIPIDVSTEPGAGDGENSTVFNVWVDMDIPPDEWGTSPYKNGPPKKSVGKNEDDLPLKGTMDYIEHEIKDGYLEPIIKDVIRSRCLETKGSQGPAVDRDSRPEGKAEDPNVMVISLHSCGNLLHHGVRSLVLNPSVKAIAMIGCCYNLVTERLGPATYKVPILRTQHPRLTQDACAYDPHGFPMSKRLESYEHISGTGVKLNITARSMSLQAPYNWGREDSEAFFTRHFYRALLQRIFVDRGVVEKPVNPTDLYGLETGAPDAVGNPLIVGSVRKAGFTSVFCIRSCRSG

SEQ ID NO: 25434 - protein, 79 aa, A.fumigatus
QVPFYMRYMRWPLAYNGHLLSDYVNVKCCLRTTRYLNIKRQDKFGYLKSYKAVPRRSRLNLFQLSMFPSFSFNLLVMLA

SEQ ID NO: 25435 - protein, 110 aa, A.fumigatus
GHFPSTTPSSYHVCDEMYLFNKNQRRLLVYFAVFYVLLFIFCHFNSARDPGSYFFRPEEGYRPQYSVRRILESRHFISRFNQSTPQPKQSLQNLTSGVSPRGPKDPRSVT

SEQ ID NO: 25436 - protein, 206 aa, A.fumigatus
VQWVRRKPIAWECNSTNVFPVPIYVLGFRFSAHSQTGVCSPDDFVGRVFASCMAMGRYPLLPNQRKEFVPVDYIVHALLHISKSKDNLGHAYNLVHPDKTHAIDLCTSFNLLKTICPYPMHGVTYTEWVQSLSLSPEDPLYPLVPMLKERVLGERTRWEVYENMVEYGRENLHKAIKDAPDILACGPMDQLFSRYLRSWLPTSCAN

SEQ ID NO: 25437 - protein, 140 aa, A.fumigatus
TFATEEFVIRLFGTWRKCGEAGPFLKVSFRDVSVDCRVSWLKRFSTGFFRRVSSPLPFAGDKEYFHLPYFGGDAWLAQHAQYQNQMVLSTDMERVFDIGPAFRAEVKSRTSGRHLTEVSNSSSPIWLCFASLHACYETRC

SEQ ID NO: 25438 - protein, 254 aa, A.fumigatus
FTLLGTAMVLEENYYEVMDLMDSMIVFVLKGLQERKKYRDLIEIVQNHYPTAQDFRIGLDEQGKIPRISFKEAKRMLRDELGFKTEDTDDLRCAVTLTLLLCFFFHLPGLTGHQPRSEEEEAALGRHFRESPYLGQTDIFTIDQYPAFCRPFNTHPSPDAPGFTNSWDTIVRGREICSGSQRIHKYEAVCKAMASRNMDPDGKEWEHYVGAFKSGMPPHGGLGLGVNRLLQGFLGLDDVRETTLFPRDVHRTAP

SEQ ID NO: 25439 - protein, 113 aa, A.fumigatus
SSNRRRPHQSVAAIDRLHRNRSLRWQSAVERCRSNCQVVCIGISAVSRVKVANHRHFSYEDCLNFHRYWTVDDLNMCGEYSAMRSIVVASPNEVIKMPMNEPAQGKKKSQIEE

SEQ ID NO: 25440 - protein, 184 aa, A.fumigatus
YVTRMGFKQIAYRGPETGSRSVVSHVISNGQAIFVLTSPIRSMAGTGAYDDDPDVTKADRRLLEEIHNHLIKHGDGVKDVAFRIEGDIEAVWKRAVDHGAAPVAAPTTLKDDRHGSITLATIGTYEDTVHSLINRHDYSGPFLPGYEVVTDDDPINRLLPSIDFIEIDHCVGNQPWNGVDPIVK

SEQ ID NO: 25441 - protein, 87 aa, A.fumigatus
NICTLDSSIVRSSRVQRSRSIWYTIAHLQGAKSIVTRIISRLEPILADFVAPPSGMLIKVLSLDPQPKQKEQAMQLVEKVETRNGSA

SEQ ID NO: 25442 - protein, 84 aa, A.fumigatus
WRKSKLETVLPDSWGPKTLSRATGNSFLAPLADKQTSVWNRLNYASSAMNSKTDQKSANGWQQFSLDHDDQVADRFSEDWSLAL

SEQ ID NO: 25443 - protein, 65 aa, A.fumigatus
VYRLFIVKFFISAKEPTVVVNMSVLLRKLVHNEAIREDPKEIYGWRVYMLACSVSCPTISLVLRD

SEQ ID NO: 25444 - protein, 80 aa, A.fumigatus
NEAVRMDPRKDLHPTVQHPKKPQDEPELGDSVNPTRLQEVTPAQGLTPTGPQLPQKLSVPHSMVPKEAGTKGTSTPQVFA

SEQ ID NO: 25445 - protein, 181 aa, A.fumigatus
LSSGKCGVFGDICLSLVDATFPGHLLHTNADYKCMLIPLLTFTKISIISKPQESRISLIICRTMPTVATFLGLAISGAAMASCAALGAYNVDPNSISVSGLSSGGFMSAQLGVAYSDTFKVGFGVFAGGPYDCARGQSVRHGPNPRNSHFQFQYPRYADAKSSTLLACTTKTHPSRPPSPT

SEQ ID NO: 25446 - protein, 97 aa, A.fumigatus
NDIDGVSGFKTGPTSTSASPHLKSASIQYYAYLSETCKTSALHFTKSAASANECDNTGRSDSWKNLEECPMGVVEEERSIRWKPEIPGKQRGESGQT

SEQ ID NO: 25447 - protein, 107 aa, A.fumigatus
TQKDLPVQFLSVAEPLDARLVIGSFGSSHAYNEPAFPLIVARNPDEPVPTVEVSRYGKLPEIHHIFKSDPQSPPVIVTLVFIGMVLAAFPVLGGLVSRFLQTTLSMF

SEQ ID NO: 25448 - protein, 61 aa, A.fumigatus
WLFIGVNLNHLPTAFKSAPIPHAVFLGSLVSIEWIFLPLLLPLDTLPDSSSCRCGRCCRIH

SEQ ID NO: 25449 - protein, 498 aa, A.fumigatus
KILLTPVPLVIPRFVPSWEDYTRVLELAKHFEQLSCEFEEERQRERQQRAAKGTHSRAYPLASSKPIVEVYKNVRDAVEERELSGEGEDFMPSTTPRLPLNESSIESGESLERTSEEEPRGEPVLQRSSTHPSTTEDKAQGDRPTGSEGEEEMHSDEDRALAEDLHTTDSNDELAKLSPEDEQLDLKELPKHERSNLLKMLTNFWSERSASGWASLDYPLSMSDHVFADCDIIVREDEPSSLVAFALASSDYKEKLANIQKRYEQLDEKKSISKEGSDAMNEAQVEHALLRSTGTHLKYQFQEGQAKMLCKIFYAEQFDALRKKCGVAERIVESLSRCAKWDSKGGKTNSLFLKTLDDRFILKSLSPIETQAFLKFAPAYFQIMSEALFHELPSAIAKMFGFYQVIIKNPATGTEFNWFLLLMENLFYDRVPTRIFDLKGSMRNRKVQSTGERNEVLLDENMVDFIYETPLFAMEHSKKLLSQSVWNDTLFLGRQNVM

SEQ ID NO: 25450 - protein, 62 aa, A.fumigatus
  UNSURE (50),(53): Identity of amino acid sequences at the above locations are unknown.
SAACTGTYGQRTPPMCHCCQDLFWSDSYTAVISIYRPTFTIVAESRSLHXEAXIHTVIKTPA

SEQ ID NO: 25451 - protein, 67 aa, A.fumigatus
VRYTLSAVPSTPVVKILPAGDIKPSIFVNLKKHMMHFAIGDNAESHQALILTREKARGWGKGVGRQY

SEQ ID NO: 25452 - protein, 68 aa, A.fumigatus
RPDRSYGVTRLPMLSRPEDHYYCASFLPAGGPLKQYSYVIIPSSVYKPSLSFRGKVYLCYKSCKSFFW

SEQ ID NO: 25453 - protein, 80 aa, A.fumigatus
LKTPTPPGSQSTNSVPKTPYTTRQLEKQASAVKKLLKEHTQSPFPLLEAQLDKIIKGYKMTLNELILMRDEIRKHRANNE

SEQ ID NO: 25454 - protein, 74 aa, A.fumigatus
  UNSURE (29),(43): Identity of amino acid sequences at the above locations are unknown.
GSSFGWKRFVAAGASGVIQSGNKGAIVWXYFPHFWQGRVYFGXWIALPEINADVSIKPFQPYGRSNILCSPRGR

SEQ ID NO: 25455 - protein, 182 aa, A.fumigatus
FSVCLYSTVHSSLSYPLTIHVRHFFCAYDQDYVRVVSRRLTNFVLSTLPNPTGPSQLIIIGCGDSQRIVPYVSETAAAFPIYTDRMGKIYKKLLMKRTTSHITQPPSYAQVSFFGALGKTFGQMFRSGWQAFRGGSWSQNGGEWVFRGGKSFYVHRMEHVSDHLTADRLLEVLSLDEPAQTK

SEQ ID NO: 25456 - protein, 176 aa, A.fumigatus
DTDGGQWMGRVPGCPDGAVELQHRHAEYRELYVRWLQWATLLPFMRTLGSRKCNVQNAHTCNNEWWSYGEENTPMIVSYIQLRYQLKVYLQALFEQIHHTYDAAVYGFRTDRSADREDDAGECQCYHAAVHVWLAAACHPVTIPNAPSGRCICRRRARVRQSRGRTGGQTRHMLVD

SEQ ID NO: 25457 - protein, 85 aa, A.fumigatus
LVAFSLVVPSGNDDRSFNWYASGDTHQARGTIQDTIQPDNTWQQSAPNEWHDHSVSLGSMETASYGTSERGLYWLWDMSWNGTES

SEQ ID NO: 25458 - protein, 159 aa, A.fumigatus
SRLGSALKYGATHTYQMTPDSSEQNAEEILNKVELETGADVVLDATGAEPCLNCGIHILASGGTFVQVGLGKPNPSLPVCQICDKEIVFKGSFRYGPGDYQTAIELLHSRRIRLDGLVTHEFPFTQAEDAFQNVVSRAGIKSVIYGPGVDEHVAKPTLT

SEQ ID NO: 25459 - protein, 225 aa, A.fumigatus
TAMIVAYFFLDKRLHVKIYDADEEVYQVPESVLPRVDGKGGSSKKSALKFDYQANPFSFKVKRGGEVLFDTSGSNLIFQSQYLSLRTWLPEDPNLYGLGEHTDSLRLETTNYTRTLWNRDAYAIPEKTNLYGTHPVYYDHRGQHGTHGVFLLNSNGMDIKIDKTKDGKQYLEYNTLGGVFDFYFFTGATPKDASIEYAKVVGLPAMQSYWTFGVRFPDSICGPSG

SEQ ID NO: 25460 - protein, 161 aa, A.fumigatus
PYTGAVWPGVTAYPDWFHPDIQKYWNDQFAKFFDPKTGVDIDGLWIDMNEAANFCPYPCSDPEGYARDNDLPPAAPPVRPSNPRPLPGFPGDFQPSSSSKRSTKGSKVGLPNRDLINPPYMIRNEAGSLSNKTINTDIIHAGEGYAEYLHHGGRRNRAKRA

SEQ ID NO: 25461 - protein, 71 aa, A.fumigatus
  UNSURE (4): Identity of amino acid sequences at the above locations are unknown.
IGHXEVGFFRPRGEDPICREGRDSLTADLTLAGKPCNTYGTDLKNLKLLVEYQTGTFSALNGYDCSLLLSR

SEQ ID NO: 25462 - protein, 95 aa, A.fumigatus
FHQCRYGYRDVFEVAEVVYNYSQAKIPLETMWTDIDYMDRRRVFTLDPERFPLEKMRELVSYLHNHNQHYIVMVDPAVSVSGKFTFPSMEGVGAY

SEQ ID NO: 25463 - protein, 271 aa, A.fumigatus
TAPTPATRHLPNMIRVLITGSADGLGLEAARQLANRGHTVYLHARNEKRAADAKAACPGAAGVLIADLSNLAETRRLADEANAIGQFDAVILNAGMLYGPFRKTPDTGIPAMVFVNVVAPYILTCLLRRPKRLVFISSQLHRQGDASVEDIFWFKRGEGRFQDFPAYCDSKLHVLLLANAVARRYKDTSVVSVHPGWIATKLGGEGAPDKLEDGVDTYVMLAEGDYDRNLTGKYFEPKRVLGRPLPASEDINLQEKVVKACEEVTGLKLSA

SEQ ID NO: 25464 - protein, 318 aa, A.fumigatus
YAFPSVPGGVRHEGILVALITPFTDDQKHIDAACLKAHIDRLIAAGIHGLVPGGSTGEFTTMTTAERKELTELCIKFAAGRVPVVVGTGSTSTAEALELATHAASVGAAALMVVPPFYDPVSLEQLTELMAEIHTASGLPIMYYNIPSASGLKLTPGEIAGLSKVGVKYLKDTSGDAPAFTELVFGLSDKITAFNGYDTLTFYGLAAGCPGGVWGAANFIPELAVELYETVSVKKDLKRGRELWTKIWPICKFLESHNYAAAVKAGVELTGQETGGLRNPFKSLGPELQAELKQLLIDAGVSTVRMASLHPGWKFDGV

SEQ ID NO: 25465 - protein, 185 aa, A.fumigatus
QSTAFSVNQHLVSYLALYSDVRNPYRDLTFLVGDSPVLAHALAATGALHHAILRNLEFSLPWSPYTAGDGGTALSPEEVERAVISSMARRPSSKDYEHFLGFKQRALRQLSLDICDPIMRNDNRTLAAIMVLALMDAIESGDGAWKYHLEGAKKLLKSRQQSESPTQAQGMMNWLDTFAIDGCLL

SEQ ID NO: 25466 - protein, 116 aa, A.fumigatus
SIISRIQLMGSTLARPGSLTQPFYSSTMGPAVLKRLEETSWVGCPAYLLEVIFFVEAGHFMAPGKDPFSQHTTSFSSVFLPDDSKPLQSPEALLGHIQAFDPVAWAESMQSCLYLE

SEQ ID NO: 25467 - protein, 83 aa, A.fumigatus
  UNSURE (36): Identity of amino acid sequences at the above locations are unknown.
KGICDLEISLLLESNLTMAAVFSDNDNNLDGTIGEXGPSKSEVVAETIRRNEMAFFGSTGSPQKAQFFPIAKGNWSNVWRANP

SEQ ID NO: 25468 - protein, 88 aa, A.fumigatus
KIKYFDTVHIASSLLILKSGFLYVASEAGNHHFYQFEKLGDDDEETEFNSENFPADLSVTCEPVFFRPRGAENLNLRRDAQLSQPFDR

SEQ ID NO: 25469 - protein, 419 aa, A.fumigatus
RVVSFTLPVKQETITSTNSRSWETTTKRLNSTVKTFLRISLLPVSRCSSDREELKTSTFVETLNSLNPLIDSKIVNLNEDDAPQIYTVSGSGARSSFRTLKHGLEVSEIVESELPSVPSAVWTTKLTRADEFDAYIILSFANGTLVLSIGETVEEVTDTGFLSTAPTLAVQQLGEDSLIQVHPRGIRHILADRRVNEWPAPQHRSIVAAATNERQVAVALSSGEIVYFEMDADGTLAEYDERRQMSGTVTCLSLGEVPEGRVRSSFLAVGCDDSTVRILSLDPDSTLENKSVQALTSAPSALNIMSMADSSSGGTTLYLHIGLYSGVYLRTVLDEVTGELSDTRTRFLGAKPVKLFRVSVKGQTAVLALSSRPWLGYSDIQTKGFMLTPLDYVGLEWGWNFSSEQCVEGMVGIQAQNLR

SEQ ID NO: 25470 - protein, 79 aa, A.fumigatus
TTLKRLAIYVGVKEPAMCTHCVIMDYIITSCGTSTANTSTPPSICDLDGMLPRRINSAHLDIMGSMPIVATATTVSPLQ

SEQ ID NO: 25471 - protein, 426 aa, A.fumigatus
RVGLYSGSGTLGLIQALRELKYKGGVTIISKEPNLIIDRTKLSKALIPDAEKIQWRPKEWYEAASIETIFDEVTSVDFSSKSVSTKSGKSIPYTKLVLATGGVPRTLPMKGFNDLGNIFLLRFVTDVQNILKAVGDKNKKIVIVGSSFIGMEVGNALSKENEVTIVGQEEAPMERIMGVEVGRIFQRNLEKNGVKFKMATGVEKATPSTADPTKVGAVHLKDGTVLPADLVILGVGVRPATDFLRDNPAVQLEKDGSLKTDEYFAVPGLNNDVFAIGDIATYPYRGPGADPVNGTATRIEHWNVAQNAGRGVGRAIVHALNTGSLQSLRPKAFIPIFWSALGAQLRYCGNAPTGWDALVLKGEPDNAKFAAYYCKGETVVAVATMGMDPIMSKCAELMRRGNMPSKSQIEGGVDVLAVDVPQEVMM

SEQ ID NO: 25472 - protein, 137 aa, A.fumigatus
YCGSEVSTGDPCQQSHASWMLINALCSVATGYGQPPGTIYDWALEPPSLRDADYNPSDDLRIRLRIEKFCDRVTKALYSGKPDPAEFISSEKLLIVQLLESELREMEVDFGRDISSMNIWTAVVVEPLLNCHLQISI

SEQ ID NO: 25473 - protein, 188 aa, A.fumigatus
AATKLSSSDINMIHLRAAELHLRYFVFLGSNPRGEDLTKLFIATTSFLGRVLDLETSPGELIGHATNYILQMIVSAAFALMKLLKSDFSRHIDFDHGKLLFNGAISAIRRISVMDHDRPVRLADILAQMWNANEAAHSPGDNVLELKVRCRMSMSHVYDTVWRWRQRFRPMRSIEDSHIRPAGWKINA

SEQ ID NO: 25474 - protein, 269 aa, A.fumigatus
VVVHESQSENMNFQAKNFSYMTKAFGDFLDEVHAGGRQYLRSISAELPSKLPANLAADFPGLKDDFKLPQALSLVTENAHSSPLRISGPVTMWLHYDVSSNTKQEGWKLRVADRYAQVMANVLCQIRGKRRLVLFPPADVQYLQVPPGASSSTIDIFQNIKDGSIVSIPHTSPQEAVLHSGDILFIPPMWLHTASPTGGVSVAVNVFFRSLPKGYAAGRDVYGNRDLQAYEKARIDIQKMVRSFDGLPSDISRFYLLRLAQELKDNAGV

SEQ ID NO: 25475 - protein, 98 aa, A.fumigatus
  UNSURE (3),(24),(91): Identity of amino acid sequences at the above locations are unknown.
EAXCATSQYQNLVWVYRTGHMADXARSSTFAYATESYRRQKSVAPGRLGFDVIEELSYIQAQYFTFVWDHLSRNDSNNYDQAPRKSCDWGXKIVEVPT

SEQ ID NO: 25476 - protein, 180 aa, A.fumigatus
TLARCFRPRGEDNQVKSYANSQVSLTKKLVSQISSIPTTVQWSYDNTNTRADVAYDLFTAADPNHVTYSGDYELMIWYEIALFMSDWMAFADWHRLARYGNVQPIGSQIASVNIGGHNWELWYGGSTQKTYSFVSATPITSFSGNVMDFWNYLTRNHGYPASSQYLISTSATSPCSSATD

SEQ ID NO: 25477 - protein, 440 aa, A.fumigatus
  UNSURE (198): Identity of amino acid sequences at the above locations are unknown.
KTLLVEAPNGHGSLYKEVRFSPTATPIRRAQSGSTSNPASTFDHRRVLGKAESDRFSYSALSTDYLEQARTLLHRQRASFENERALFAEERQLWEKERELLKLRISELEALLKSKDTLNNNHSTPDTLVKFSLHPFGGPLSPNLSNERHRNHDYISAQVWEGPSPTARPTRVFHSVEKTDGQDHLASITEQGAHMPLXASSLDAAYPPKLRAAELSSCMSIPFPIEKLDSKLDGITLKSSALPPDVVARVMTPPSLSPMDVSPESPDRSKLSSERKNSLKLKLSELGPPDVNLVRDAGHTPMVLIDADADTEQASVNGDAIPQVQGKEDEPFAPRAAMVGQPAENSDSYFPDLPDDPALKGPLSLLNEEEHDSEFLQELDLKLLDQARRAIGRSSDADPDDEKIADADPTESVPELKFKNTTNFGTAFGGLNHAAGRKDV

SEQ ID NO: 25478 - protein, 124 aa, A.fumigatus
IASNLYGQLKVNAAPILLLYSLFMRLIRLLLSVELEESRFHTLMMPTTKSILGLSLAVASKAYAATTLFNGLQSAIFPTTTSAECLASFNTSLQCDPLVSRLYMQTDWVGWNATNLTAFVSPDN

SEQ ID NO: 25479 - protein, 235 aa, A.fumigatus
KEQKKEYSLTKLCCRELGLLATQPILALLTLYQSFVYGVMFLFYQMYPVAFGDDRNWTTSLKYLPLLAIITGTFVGALGIVLHNHLYFRHHCHNPDGTYIPESRLPPMIVGCVMVPAGMFWFAWTASPDNVSWASPICASFMTGCGMYLLFIQGWNYIIDCYTSMANSAMGINGSMRSVFGAVFPLFANQMVGALGVAKTTTVLAAVSVMLVPVPVCFWHWGSLHHGAGRIRGGA

SEQ ID NO: 25480 - protein, 199 aa, A.fumigatus
GPLSERFGRKWPMLIGITASSLFDVMPALGTNVATVLIGRIFGGLFGVAPVAIFGGVLSDCWPLAQRGIAMALAVSLVFSGPTWGPVCGGFIMGSPSLGWRWTMWVVVIIGLGFTLLCVFLYPETYPPVILRAKLQALRRKNGNLNIRTALDKGGLSIQNIMSVYLVRPFCEVSYFPIFKDFTEHRCDSLEKNKRKSIH

SEQ ID NO: 25481 - protein, 151 aa, A.fumigatus
IEPAAGSSQPRCEDDRQHRKYFSTGASAEPDNLRRDKGDGRLLYQVLVSGVTIHMWYPVKILSIIYRAKELPPKYGCTVNAVSPGPTMTEGFAAAGKEQMKILQPIIDQTPVGPRMAQPDEIAYAVAFLCEERARWINGAHLIASGGLFID

SEQ ID NO: 25482 - protein, 170 aa, A.fumigatus
  UNSURE (111),(133): Identity of amino acid sequences at the above locations are unknown.
LHDCLKDGVNFIDITEEHNTGFYPTLHSASYVKYPPKMQYAEEVAALNKNLSKENMKANLERFTSFHTRYYKSQTGIRSATWLFDQVQRVVSESGAAEYGATVERFSHPWXQFSIIARIPGRTNKTVVLGAHXDSINLFLPSFLAAPGADDHGRWTVTILEALRGLCNQT

SEQ ID NO: 25483 - protein, 65 aa, A.fumigatus
SRQTRSLHDFEQPMLSNALQGGPSTFCGGFHSKFSSAGQTEDVTGGCSCRKCTIIQEAPIQLKEV

SEQ ID NO: 25484 - protein, 368 aa, A.fumigatus
IISAFSTHPPSKIGILSIMESKEVDITLEKQQDYQEKLWKTAQSEWKSDILPRANHLAHARASLPKSLSYAGMGYEAAKQHILDDIIPGLNGSSISPNYYGFVTGGVTPAALFADNVVSAYDQNVQVHLPEHSVATDVEYSALGLLLDLLQLDRSFLYNGTFTTGATASNILGLACGREFAVEAAAKSRGAALQSVGQHGLFEVMQASGLSGLQVLSTLPHSSLVKAAGILGIGRANVKNISRDDNPLLFDLARLEGELARTEKATIVAVSCGEVNTGHFATAGLEEMLEIRRLCDEYGAWLHVDGAFGIFGRVLDDSPEFSSIKKACQGIELADSITGDGHKLLNVPYDCGSFSVVSLHHKGSKDPR

SEQ ID NO: 25485 - protein, 108 aa, A.fumigatus
PETIRNSFAGAGLVPFNPDRVLSQLDIQLKTRTPPGSRSTNSAPKTPYTTRQLEKQASTAKRLLKEHTYSPLPLLEARLDKIIKGHKIALNELVLTRNELHNHHANNK

SEQ ID NO: 25486 - protein, 101 aa, A.fumigatus
LSNDDGLATWFARLSPTSTEYVIYEMEMLAMIQPVLSFQAVCSISSIMKQGYTFGHSQNEMTRFIRTQTVVNSNRSILLCSTVNDDLGDMSYQVFTRSSGA

SEQ ID NO: 25487 - protein, 77 aa, A.fumigatus
FTTKLVLTVLYCIDVLRMVLGNTKWALDFSFYVLNELFDLADDFESLSGDQEAFTQKCSWGLASTYLVNHANPHFRQ

SEQ ID NO: 25488 - protein, 113 aa, A.fumigatus
HPVSSPPSIVAMSLSANKCTEAQATFINEAYRALPINCNFTVEQDKLMNHPYIPRCLSIQAALGFKNKYTPRSFASSIPWAVLQLRHASVLYAFFFQYNKGGTTEPHDPGEIT

SEQ ID NO: 25489 - protein, 85 aa, A.fumigatus
LRRAFTTHQSPQVSDIFGRIASTTLTYGFAAGLHISFSPNACAAVMLDGEGQTHLRLTEHSYGAEGGLHDESTCLDCKVMSRRIF

SEQ ID NO: 25490 - protein, 116 aa, A.fumigatus
  UNSURE (80),(95),(97),(98),(99),(105),(106): Identity of amino acid sequences at the above locations are unknown.
PPFPAVKSTSSLPLIILLSSMSRAFLRFICRGLRRIYAGYATAAPLSGDARVYYAENYQTLESAPIRIDAYEKFLAGVDXAVRHAFTRCRVRRNXNXXXREKRTXXSTPRVAPRAW

SEQ ID NO: 25491 - protein, 226 aa, A.fumigatus
  UNSURE (129): Identity of amino acid sequences at the above locations are unknown.
KTTQGPIAMSEEAPKHESPSVISPIENEEKGLAPKPLERVPPNGGAKAWACVAGSFLLQFCSFGYVNAYVSILFSSLFVSFEKQPTDLPENRCGIFQLYYQETMLKDQTSSALAWITTLQIFLLFMFGXAVGKMIDVYGCRRTLPPFSIGAVFSVCMLSLCTKYWQVMLAQGVAFGLAAAGLSLPAMATATQWFSTKKGLAVGIVSAGSSLGKNGEPLQPNSHLDG

SEQ ID NO: 25492 - protein, 99 aa, A.fumigatus
STPPCTSSSLVSSLASPSHSGLKTSSVSSVPNSSSATKSTGHLASTATYQISTYDSTLPSFSASIAHVAPTVAAANDLLEAPLGMGVFCALLGGLIAIF

SEQ ID NO: 25493 - protein, 165 aa, A.fumigatus
  UNSURE (57),(64),(109),(118): Identity of amino acid sequences at the above locations are unknown.
QHRISENGQSGSNKPQEATGYADEFSFHFHAVTKANLKQSFSSNIRTSRIHSHRWRXKLVISSXKQRSISTFCFHSKLLAALTYTRLVIETLEPLPEDRKCFRMGKRVXVERTVKDVXSALKTNSDGLKQVLDETVKQYQSKQSELDDWKVSLSMPGVHVNSIDD

SEQ ID NO: 25494 - protein, 174 aa, A.fumigatus
WTETGSFQPRGEDYGRGGPYGGPRGPPPNGRGGPMGPMRGAPSGMMGRGQRGPNPAGYGYGPVSTGLNPGYDAYNYGPGPRPSQRFGENGIDYHGPSPVETARRPSPGPIGMAVSPPETAPIGQAIEMTSQPRHTDSAVELGPNAVPEEEQPHAVSNDGHPEPVSPSSLYSRSA

SEQ ID NO: 25495 - protein, 63 aa, A.fumigatus
RRGRNRSPQDLDPAARVPSYLKGLLAWGPWARPYHWAEVLWGLRRDLPDHSLHHGAGRIQSQS

SEQ ID NO: 25496 - protein, 299 aa, A.fumigatus
KVEPNDNATGNDSEQMNYLNSLWSKWMPEASPRIAVDSHPRLSGIQDTINATDAHGPATRLPAEFYDKKAREYTNTIAVDEWFAGYAESREYRKLGIGALMGDVVDRMVNAAANGGWRSERSASGSSTENGKAIKFAMSGCHDTTLAAILGSVGAFDAKWPPFTSSIAIELFSRMENQPPSSPSPSAKQRSLVSYLTGHDAVPSSNTDRTPLSSLPNSTRQALQNHYVRIRYNDVPVRIPGCAAKAENHLPGDETFCTLDAFKQIVDKFTPKNWREECVQNLGEGLYGKDDAEKAVAGF

SEQ ID NO: 25497 - protein, 66 aa, A.fumigatus
RHPDPCGMKGRLSSGIFGVRWNDLYAPGSRMLSSVTVKEFLGFCRELASEHVEAIIFLVQVHLIMI

SEQ ID NO: 25498 - protein, 123 aa, A.fumigatus
  UNSURE (61): Identity of amino acid sequences at the above locations are unknown.
LLTQSKQSLQLILFVKSSLNEVDPHTLLLLSIAIVLQSLLKHNTPLNRSFAMFFSKLLFIXAFALAVSTLPQFYPGGSMTRHDATPTSSTSISPTSTFASNSARPSATTNRHGSVHIVYQLDP

SEQ ID NO: 25499 - protein, 312 aa, A.fumigatus
PGVYPSKPILNCVFCVIQCSYGVNFPRSLGNNTPGSLWDNVADRTGQNLFTSNRYGHLKRQIYQSVRRADFCGFWLCRGLSAEATHPRDADLVLFHCHGGGYVSFHPSAGAPEHLFMAELLQRHGLTVAIFSLDYTLAPAATFPKQRDEAIAAYDWINKELGVDASKIVVIGDSAGGHLIMSLLTGLHQRYPRANDGRSADHHRDRPAGAILVSPWLNLYTSHPRTLALHWEERLFKRSLDKCCEQVMRDTPADIAEVYGNFAVDVAARGSWKEILPDRTWVSAGAESWYSCTTLKILWPMHGVTGQQSRWM

SEQ ID NO: 25500 - protein, 196 aa, A.fumigatus
  UNSURE (185): Identity of amino acid sequences at the above locations are unknown.
ETVEENIMAALVQTIPQQSSTVSVLQTRPSSSSGSFAPSPQPSQQQNSRSSTMSWNSYNTVSGSQGYRAGHQVVAPYAFTGTPSIPNASFNTTQNSQSWSPHLRPENRTSSAPSVPQGTPVHPHAIGSNPRFSHHPAAGSVSTSSSNSSVQSYRSKDDSAIPSRQSRSDPPLRPLSTANLPSPWXYTAGMAGNAVE

SEQ ID NO: 25501 - protein, 406 aa, A.fumigatus
  UNSURE (28): Identity of amino acid sequences at the above locations are unknown.
TCSPFITVFHFETLPTRREPGTNSSIVXGRSKGNRLATLWNLLDTGASAPWPTLFSMAAEHDSVLAMKVLLLQDGADTNAVEHTEGIPLMVTAVVNRSPKVVRFLLTRDGVDPNVKNHDGQTPLAYAACECFNDIVKILLKCPQVDVNCTDNAGCTPLRLAAGRSHVFVVRTLLSNPWVDVSVRDNILHMTALSAAVAALANRIAWSPEKVKLKHRRTIQALLEHPATSVNYDMDPDLLPLYRFSAQYGYEEIFKLLWSKGAGQLPAELDRSGILFFVAEHGQAGIMKMLFANGFEPEAQTDTGRTTLSIAAEHKQLEVICLLLSTGKVDVNSKDQAGRTPLWWAMTHGWRKTGTDETLKLLIAHDATIPTIERRKWLQKSLCNALEYGNCFLCLPTGLEGSARAL

SEQ ID NO: 25502 - protein, 70 aa, A.fumigatus
SCWKLGGRFMVDIVLYLLDDANAVNHQIYHQLGESGKLLILECLVGLDVSLYMGLRERASGMLYISHVVA

SEQ ID NO: 25503 - protein, 312 aa, A.fumigatus
QLIPSIPALRPTEENEVKSPDVPSKPAIPSRPQKLSQQTPAVDASSATSPTEKRQPPSIPDRPKPQIPPRPAKPITRGAGEEVPAKEKPAVPIRPNGSKIAALRAGFLSDLNSRLQLGPQAPKPQEKKEEEAPAEKAPLSDARKGRARGPSRRKPASQNVSTRLPTIPEIRIIETWNVWQVGEDGNLTVETGVKAKQPEPAAPEVSTSKDSMAPALSKNVAGESTDPSPMTATKESAPETAETIPSTVGDAAAVSATELTKPNESEVQQKSADAQSGITSSTSAPVDDVIEALAATADGKRSSEGSVPPEEQ

SEQ ID NO: 25504 - protein, 344 aa, A.fumigatus
HPVVKTLDPVDRAFYAGYEDGSVQSVDFYKSQSIQHTLHDPSLHSTPSQPSAEDRWLAPSSDFGGVHSLSLSYDGMTLLSGHQNGKVLSWNVARRKYASTLADYTHPVTNIIALPLEGLPSSGNELRRVAHTIVKPRYDHALSESSGTPDAVPADYTFSTHLLASDTAQLTLSDHQRDQFSTALTHAFFPESMMEEGLAELAALKHSGNNGNHVSTISQSVVSQQAAIVDDSQIASLEEEITTLKKKLAVNEAARQVTTDEVTKLRSDLVNLHDYVNELHQKQEHAHREKLLRQARKEERETRRREAWFAAERKGKKGDAVLRRMELEEEAQTSETDDQSSDEQ

SEQ ID NO: 25505 - protein, 79 aa, A.fumigatus
KRQSLLVTALIIGFAGLSFLFQFHTPKYGITLLPFPLGSEPGFPPASFALFLSSLTQELLAMGMLLLLMQLIDVVMQVD

SEQ ID NO: 25506 - protein, 141 aa, A.fumigatus
  UNSURE (1): Identity of amino acid sequences at the above locations are unknown.
XGNPRLGSGYDCSSSVVRGEQASLFMTGTWQSKPGEVERAVSHAISVGYRHIDTAYCYQNETEVGNGIKEALQSGKVKREDLFVTTKLWCTYHTRVEEALDKSLKNLGLDYVDLYLMHWPLAMNPEGKHLSTLANHRNLTG

SEQ ID NO: 25507 - protein, 179 aa, A.fumigatus
ASFNPCKPQKPNWLKGNHELFPKHPDGSRDIVHSHSHITTWKSMEKLLATGKTKAIGVSNYSKRYLEQLLPEATVVPAVNQIENHPSLPQQEIVDFCKEKGIHITAYSPLGSTGSPLFTAEPIVAVAKKRGVSPASVLLSWHSTFPFASPISLFACNPLTIIYCNSFHLRELDASALSD

SEQ ID NO: 25508 - protein, 453 aa, A.fumigatus
KRNETKLLGKMTHSQEILALLEYLRMQRMNSVVASHHITKDFPDLFYAPGFKHISGMLYVPLSAGGTDFMVFFRRGHLTEIKWAGNPYDKKPQNGHLEPRKSFQTWRETVLDQSREWTESDVETAAVLCLVYGKFIKVWRQKEAAMENSQLTRLLLANSAHEFRTPLNAVINYLEIALEGSLDPETRDNLTKSYSASKSLIYVINDLLDLTNAEKGQKLIKDEIFDLPATFREATDMFEGEAKRKSIHYKVVAHPGLPPAVIGDQRRVRQVFTNLISNAVRHTTAGSVTTEIWRSLEQAQPGCVVVQMTVLDTGSGMSQSTLEALFQELEQVSTDDDNYWFDPEDQTHPLDSCSQDKRVLGLGLALVARIVRNMHGQLSVRSEKGKGSYFEISLNFPVPDDVASGESEEPSVPDIVEPAVPIQQEVEFMLVDSKSTRGGEQRRRSTGSDHSKG

SEQ ID NO: 25509 - protein, 101 aa, A.fumigatus
LRLNLLQVPDNQIFLLDTFARPRFVLTHAANKQIQDLHVLVIRDLRLLTRSCFRMVTHGTVTFPIPISHLVILFTSACIRMSAFVVVNFNIILLDGDDALA

SEQ ID NO: 25510 - protein, 62 aa, A.fumigatus
ITSVLLSRLASLLRPVITYQLPYLPLISLSGRFYEFVFLKSFSIDTSTSSCHLDLTICLDPT

SEQ ID NO: 25511 - protein, 327 aa, A.fumigatus
  UNSURE (60): Identity of amino acid sequences at the above locations are unknown.
HAAPILNFSALIMSRFDCFFVIRDEPNEAVDRNLADHIVNVHMNRDEAVQPELSTEQLQXYIRFARTFRPVFTEEAKALLVEKYKELRANDAQGGIGRSSYRITVRQLESLIRLSEAVAKANCVEEIVPSFVREAYDLLRQSIVTVEKDDVEVDDDEGTHANAGAGEEDHEMADRDREGDSPMRDHAEARPRQKTKITYDKYMKILNLFVRRVSEDESRSGEGVEQEDLIVWYLEQIESELNSEEDLQRERDLAGKVLKRMVKVRSSPTASVFVTACFTDYLRHNRKISSCQSEERVWWMLMGIRKNRFNGPSMCCILTVPTRRLKR

SEQ ID NO: 25512 - protein, 271 aa, A.fumigatus
FLCVKGPKVGHLAHFWHMVFHESKDVAVIVMLTQTVESGREKCAQYFSLDHDRPSMILRHDEDDPFEHNEEYEEANDNVMGEVTLLESSFDQNSRSEVRKLRLTLANESKIVWHFLFAGWADYSKPEGEDREALLHLIELSASKCSSDNPRIVHCSAGVGRTGTFIALDHLLRELESGQLLKVTDSQTDPVFETVNRMREQRMMMVYNEMQLQFIYEVLREQVDLKLGKRTSNAGRRLDERSAKMAKLSNSSEYLPSHKPELEPVNDGPSP

SEQ ID NO: 25513 - protein, 179 aa, A.fumigatus
RRRPGFVCDHPPECFRGIVATCQAAAQNWEGMMALRFLLGLSESAFGPGTPYLLSFFYRRHELGLRIGLVFSAAPLANTFAGALAYGITSGHSKLAHWRLLFLVEGAPSIVAAFLAWFYLPDHPASARFLTDEEKEVARARGLRKSGEGERVAGIDWTDIGRTLLDVKAWIAAVCCASP

SEQ ID NO: 25514 - protein, 131 aa, A.fumigatus
YTSLGTQCVITNSLSSDQMLINHLDNQGSDTRRGMGIVILNLVGQCGPFLGTNIFPENDAPRYVRGQSVCAAFMIFVTTLALTLRCLLVWENKRLDQKYGTKNEESTKGGPNGNDDGVAEENYGSTFRYVL

SEQ ID NO: 25515 - protein, 161 aa, A.fumigatus
QALTGRILAVPCWMLKPGSQRYVVLPLEPRSSCPDTELQLMYFSCNVSFSSLPVFLPKIIKDMGFTSINAQGLTAPPYFASFLVTIATTWLADRLQQRGLMIILLSLTGAIGYVLLATCTSVGVRYLGVFLAAVGVFPSIANILPWVLSASSPIPYRLTRC

SEQ ID NO: 25516 - protein, 64 aa, A.fumigatus
TQSSKYADRAKRNLDEKYSYLAGNAFGRDKKGRVKRDDPHEMQAGAEGGGAEYTAYVYYEFEFN

SEQ ID NO: 25517 - protein, 144 aa, A.fumigatus
HIWFSRLVSFNSYVSLVLPASRPDIMSKSNKYLLVSLPTSITPSHHRDDALDAVSATVSPDNGSVAPFPIPEFKIGTLDALVQQADELAKLEASCQGVVAKVGDALKGVLEGDETQIDKMKTVNDSMSTVSAASVGEGGSLLAD

SEQ ID NO: 25518 - protein, 204 aa, A.fumigatus
VLAIQPGEEYAGDSSTQTNVRASPLSLQHSSNSFLICRGNLSTKSLASVVDPRTLVRDSEYIETHLVAVPAQQVKEFLKTYETVAPMVVPRSATLVASDDEFTLYAVTTFKKHSPEFVHRCREHKWIPRDFKYVEGGKEEEQKEVERVGGDERKLWGETLRLGRTAWSEAVMVWIHVLVLRVFVETVLRYGLPLDFVCTIIRVC

SEQ ID NO: 25519 - protein, 253 aa, A.fumigatus
  UNSURE (245): Identity of amino acid sequences at the above locations are unknown.
DDSGDPHRRRRLLMILVRTTDHPSSRGLPEHHLVALPPRGEDSVHNLLGFRNLDLYRTIDTSSILIQFLVFALTVLTPSTPWFQFLFVANAAVWRIWYSVGIGFVLNRQSNCKAWTRHFVKYGESPQEAWNQWKGTYHISMVMCYASFIAAVWKMYSFPADWGYGLVLLRHVLGAGLIALQIWTSVSIYESLGEFGWFYGDFFFDESPKLTYDGIYRFLNNPERVLGLAGVWGAVLITSSGAVTXPCPGWAIF

SEQ ID NO: 25520 - protein, 232 aa, A.fumigatus
  UNSURE (67): Identity of amino acid sequences at the above locations are unknown.
PPPPPPRPPPPPPAPPPPPPPPPPPPPPPPPHPPPPSPRPPPRAQRGIISPGADDLGSKYGPPRARXSDSPTAGDKDGAPNTCQPQNTLRVVQETINAVIRQFGRFVEEEISVEPTKLSKGFVDADGCPDLQGNEPCTQDVSEQHKAIAPIRRKTVHLPDGSNEARVAHNHADMISAFPLIPGLLRAFAIFYKVSSPGLTIRLTVEHETDTNRIPDSPDCRVGDKKELEPRS

SEQ ID NO: 25521 - protein, 66 aa, A.fumigatus
NCCTCALKPSGSLLAYQWIATKSIVQVLQCSKNWSIHPVPMLGGGPFVTAGVEMRTWAANGCRLTR

SEQ ID NO: 25522 - protein, 100 aa, A.fumigatus
DLPSPSPRESAVSRITTAPSQISSADIATSPGVTTGATSATGSAPPWTSIPCSGACPPRWTPSGPPPFTQPASKPSWASTSLTSAPNRTLARPTRPPATW

SEQ ID NO: 25523 - protein, 265 aa, A.fumigatus
TCADARSPEVKILISITMIFKAIFPILYALGPALALAQGKRGLAYNDGALANLFSGYSHVTWGYNWGYERNGLGASLDFNPMLWGLPSSLDPQWTAAVHATGVEAILGFNEPDLGSQSNISPADAAAGYLVSLQPFAAQVRISTPAVTNGPPPNMGTGWMDQFFEHCRTCTIDLVAIHWYANNDPEGFKAHVQQFYDKYHLPIWITEFASSGSEAEQIQFLQAVLPWLDAQPYVERYAYFGVFPGFLVNEGGDGLSQLGQVYATY

SEQ ID NO: 25524 - protein, 159 aa, A.fumigatus
LTHCADPSGPVVKTPYIQSYFATTHWAYQKLAALEKRLRDLKLFKSSSGDASERPWFADGAKNEHQLTTAGSIQDDHIPFLARGVEILHVIDASPMTGFPSVWHSMDDDGEHLDLDTVEDWSLLFTAFAAEWMELEDFMPGNEARLKEKRSHSERKTEL

SEQ ID NO: 25525 - protein, 240 aa, A.fumigatus
IRMVAGCTSAHMLCVLSRLSPRSLIATAIFFTTALLTANFVNGGQNIPSCPSGIPCYTPVYPSTEELAFMVTTTALTLVTNFVIVPRVLDRSKKSRTIFSYLAGLQFGLGLFISGMADPAKVLRFFAVLTDPARWDPSLALIILFGIGPSLATYLSVKPGQKKGEKQKGEESAKPTLADNWKLPTLTMADIDWRFVTGAVAFGLAWGLRGVCPGPAILRTVVQPTWGLVAMTGYMLGNLF

SEQ ID NO: 25526 - protein, 123 aa, A.fumigatus
CPSSYTQVRLFVERTFPPLRAEELCRGRFDIDMYESSFRLRGKTYDYKIQYASIKKFFLLPKNDEMHTLIVLGLDPPLRQGQTRYPFLVMQLKLDEEISLELNMTESVLPKFRFDVDLGTNSL

SEQ ID NO: 25527 - protein, 74 aa, A.fumigatus
YACAGFRPPWSSTGKCKLAESGLGWRPSGGGETFTLDSNNIGAAQWSRAAKGYELKILSRSSGVIQLDGFDQEV

SEQ ID NO: 25528 - protein, 236 aa, A.fumigatus
DFERLSKAFKIWYGINVENREHALRGWNWGKAEFTKAKLAFNVQNRPAFEIPYSEISNTNLAGKNEVAVEFALTSDGDANAQPSGSTKNRGRKAAAGPDELVEMRFYIPGTAVKTEKGIKTENDENGEEEEEGEEQNAANLFYDTLMEKAEIGDVAGDTFATFLDVLHLTPRYVSLLNALFRHCVLRNSAEVALISTCTNRRSDFAAKHTTIRFNTPLSRNSSCFLRTTRCTHSLY

SEQ ID NO: 25529 - protein, 326 aa, A.fumigatus
RAGSLFIFFPNLVLCRTSQRMSKGSIAMDTPPEKDWIQLDHGQVRSGLGLVSSRTSERLNQVDRIRANGVGDHIALPQLVVCGDQSAGKSSVLEGISGIPFPRQDGVCTRFATEIILRHEPNHRRNTATILPHISRTEEEKAKLSAFRREVSDLAQLPGIIEEAARLMGVQGMNDLADAPTFAADVLRLEIVGDTGLHLTLVDLPGLISVSENDDDVQLVGDLVNSYLENSRSIILAVVPASSDVDTQSIIQRARRFDKDGFRTVGIITKPDLINDGTEGRIAKLANNADRTKLRLGFFLVKNPRPIDLEKVFTTGVEATAEVYPH

SEQ ID NO: 25530 - protein, 174 aa, A.fumigatus
IPSNPRGQRRGDRRRRRRTHTRRNRRHRRRRTMRRRSPGYRGRLRRTLIRELPRLDQHGNHRARLEREGPMPKHPQQTRNLARMRRHTHKQILAISALKHLIQRTLTPRILRRPRLPSHPIPQLVLLTKPLFNRPPGKRPRNVRSTPPMITRMQTNPLAQPLHHQRLKRRSVLG

SEQ ID NO: 25531 - protein, 240 aa, A.fumigatus
  UNSURE (12): Identity of amino acid sequences at the above locations are unknown.
YWSFLDGNGTAXWSDADLTPAGVAQAQTAHDFWASLITREGIHTPDAYFVSPLTRALRTANITFGGLALPKDAAAFEPLVMEGLREGISLHTCDHRRSRSYIAGSFPGWAIEEGFSEEDELWNGVTGETRAAQDARSKSALDEMFERTDGKDLFVSVTAHSGEIASLLRVLGHRAFSLKTGAVIPVLVKARKFSNKCAPEPTTVPWTTSAHCTAPPVTSVTACVCASSAAPVTTPLATGV

SEQ ID NO: 25532 - protein, 307 aa, A.fumigatus
KYFDWYWAYTGRDETKDSCLGMPHIWDTSAGWTIRFDLVDNQGFFDALAAETGIDASWVTFGDETSDYVCADPGDVRPGLGHVPCRKLYCQKLNYPQKASDDAIHVGNPKKLIEASLGNVTALRTSLLSSYLSVGLSFYDDGPNDGAASDAVVAYSMPVLQLAEAVSSMKDIKDIGEKAKEEAKKQLIFKILSIVFMVLPFVGEALGPLIGSAASIARIALLIGEAGNGALTVADIIEDPSSAPFAILGLIAGVGSGTGKLSKGEALADASKARGLLKASDLAKFPQRFRDQDALVQKIVKSLCARK

SEQ ID NO: 25533 - protein, 75 aa, A.fumigatus
TQVLSFHRGVKNQLNSCSHNYLGYIDSFSGNSGYQHKVTCTMICTLDVEQNNEYPVVRRWGSCGRFLGTGRHLRP

SEQ ID NO: 25534 - protein, 169 aa, A.fumigatus
RTTRSSARDRSLERSHGLGPPCGGGSNRCRECRHPEGMCPPPSGCGTRDCLWTDYFAGIRIEPPNPLPRRLAVSGSWFSPWRPELPLVSTTGRARYFRCAHQPPRHQEMQLHRVDPVGRIIASQAALALKPVLLELGGKNFAVVLDDADLDLAAREITKGAFLNVSPHI

SEQ ID NO: 25535 - protein, 203 aa, A.fumigatus
LGSVRTTELTLMQNGQICMSTDLVLVTTAVASALEDKILAILQDINTPSVLISPAAKSKVEMLVSDAHDRGAQIHAHPMGHDASPRSFPPTVVTGLTPEMKLYEIESFGPVVGIMAVEREEQFMAIIEAAKYGLSSSIFSRNHYRSLDLAGTIKAGAVHINSMTVHDEPTLPHGGYGDSGWGRFGARWGLEEFIQTKIVTLHP

SEQ ID NO: 25536 - protein, 210 aa, A.fumigatus
TPGYFGETLTHQGDQVLRNRAKEIKRVCDEEIHCGPRWAEIITNDAIGLIEEYGALTTSIATGSLPFIQHGHGLVLKEPLGVVLGIAPWNAPMVLGLRAVVAPIAAGNVAILKACALRQADAEREIVSGLTISQGSELSPQTHYLVASLFQEAGFPPGVLNFLLYRPQDAPDIFDVLINHPAIKKCNFTGSTQSGVSSPRKPPWPSSPCC

SEQ ID NO: 25537 - protein, 205 aa, A.fumigatus
  UNSURE (4),(7): Identity of amino acid sequences at the above locations are unknown.
RRFXYAXPSIPVLKTPIPPPPRQDLKTGLTPRGSLEPSESPPGPGPWEYPLWMQGDDFRLDELLQPPASAKPTPTTIPIASMRQSRLVMHGHGINVDRTRLDSASEIKGAVVIPGKYRARQSVLGRLDNGHKLFFPLNRHDAYHRPEGLDFVQLHLRRQPRYHCGREAPRRGVVPHGVCMDLSAPIVRVGYEHLDLGFGCRGDEH

SEQ ID NO: 25538 - protein, 69 aa, A.fumigatus
FRENIELDNPYLAASIMAINCSSLSTAMMPTTGPKDSISYSFISGVNPVTTVGGKLRGEASCPMGCAWI

SEQ ID NO: 25539 - protein, 574 aa, A.fumigatus
  UNSURE (458): Identity of amino acid sequences at the above locations are unknown.
SLNCGSAHPRVKTIYTAFSQGSHQAYSPLNSHESQEIILLYPDKALQTSKLVFAPCGTPPGIKFVAEGLARKAALSTTSNSLLSLAKIYQDGMSNISGSGIPKKSPGVRDILALYYLSLSLQPSPSTANNVGILLAGIQNNAAGKSLPRSSGEAQHPEVPGVVPGSGISLALAYYNYGLHLDSRHAHLYTNLGSLLKDIGQLQAAIRMYEQAVQCDGNFDIALANLANAVKDAGRVNDAITYYKRAVKVNPEFAEAVCGLANALNSVCNWVGRGGIANGYGFRDRWHVTEQGMLRDASTSETGSGWIQRVVDIVNRQLKEGESWGLGLLSPNTIEQLCVQIAPALESRRSACGSLATILQSWAGQRWEGSRIVKLIERANRSITWQWYQDRYIYGKEYPLTKYQRPQLPSGLTVPNAPTVLPFHTFTCPLSAKQIRQISQRNGLRISCSTLRSPWLPXTVYPPPPPPNPYLKVGYVSSDFNNHPLAHLMQSVFGLHNPSRVKAYCYATTASDKSVHRQQIEKEAPVFHDASCWPIERLVKQIVDDGIHILVNLNGYTRGARNDLHQQGEAHAWE

SEQ ID NO: 25540 - protein, 269 aa, A.fumigatus
VREVDRHRSNEGPGFRRSSPAWGEGRSQDGSRPPRREFQERTPTAAELDNSWRARMRPDQPPAKEPSNPRSPADTPASPAAPACRRKLNLQKRTVTDTPSSPAPSTDSKASPFGGARPIDTAARERQVEERRQLALRQKKEAEEKAKAEKAEKQRQSKEQAKSEKSVPAADPNGKDSMDIPQGGKNFEILRQAGEDEGGAAEQEQPEEAPAAAAGDEASKQAPASKTNGNWRSGGPTQPAEAAADEEGWSTVSSRQRNNRRGQSGRTFA

SEQ ID NO: 25541 - protein, 86 aa, A.fumigatus
NPAILPPGPLRRMQEHYLAGSLTIYRHVTLLISVFRYLLSYVTFNYYSSAAQVTYRLAFIAAAGTYGIVVYKAHIARGRLQGSVPS

SEQ ID NO: 25542 - protein, 463 aa, A.fumigatus
  UNSURE (452): Identity of amino acid sequences at the above locations are unknown.
YAMRVSFQPRVVKTITDFVRYRNATRDMNERYPDATPEEVAREDVCIICREEMAHWQEPAGVGEGGAAPAQPRPRIPERLRPKKLPCGHILHFSCLRSWLERQQNCPTCRRPVMAPTRGRDPLPANINLGQGNGGAGPQPNVPAGNQPFGQNGPADNLPRARIFQFGPFRIGFGAGRGDLFRNFHQQIHQGNAPAQQANNGIPPGARQIGFGLGFGRPTPAPVPQALPTNTPSNFVQMQNQLHQMELQIMQEINNLRVTAEQLHYVRLLQAELQRLRNPPAASSDPNTTITPASTFQPSSSLSATLRRQFTSDPQASAIPSGDSRLPEGLSLPEGWSLIPLQSAGQGPSGISSPVPTTAPEPIPTVQVREGPSVTENSASAAGMNGESSSTVDAARSPTSSLPDWGSETPTAAAHSYIESSPQNLDKELFGKPSETKESSAWDDEAPNTDLXYTPGQKHIVTP

SEQ ID NO: 25543 - protein, 75 aa, A.fumigatus
WLTGKAGDCTNSAGTLSFSEIEAILKDASRNATQTYDEASSVQIVTFDGNQWVSYDNWASFQAKLDYANSHCIGG

SEQ ID NO: 25544 - protein, 254 aa, A.fumigatus
YVPRPGTSHNPGWGKFASIDQHFCVLDCETNTFIADHELSRANQLHPPRPRMGGCVWSLGDSPDAWVVEADTGRPVQPLRGHRDFGFACAWSPDMRHIATSNQDKTVIIWDARTWRILQTIESDVAGYRSVRFSPVGGGPRTLLLAEPADRIAIVNAQTYQTRQVHDFFGEIGGADFSPEGSTIWVANTDEHFGGFMEFDRRQWGQPYGPRGLPNEWIREADLDEDERCVLSERERQMRFWWNLSDEEHEALLL

SEQ ID NO: 25545 - protein, 222 aa, A.fumigatus
QFCIGAPVYLAAVLEYLAAEILELAGNAARDNKKTRIIPRHLQLAIRNDEELNKLLGHVTIAQGGVLPNIHQSRFRTLFSSSLYFLTNFQTFYQRRLLRVERVLARSFNCPIFLSFLFGFLNRRALVSHDVITGFWTGHNYGSVFHAFTYGCTLCLRALNDTDSFLNEICLSETMGILVNLTLSRHKGLYLQSFLQYTTKAFLHFNINVQSNVQDRSFEVRY

SEQ ID NO: 25546 - protein, 66 aa, A.fumigatus
MLLNIQMPTKLGRRTRSMYLRQLDETTMSSLLEDRHGVLITYFETSVLDVALNIYVKVQKCFSGVL

SEQ ID NO: 25547 - protein, 174 aa, A.fumigatus
  UNSURE (6): Identity of amino acid sequences at the above locations are unknown.
LGNSEXWGTQDEYTSSESADEDEEGNDPDDNADEEHKAESDLADKGKAEVSPPGSPSQRSEQTTQSSGSQAASQYLPFSILSPDPHSLEAGDEPVGRKFPWGFANPYDPEHCDFVKLKDSVFTDWRTELREASRVVWYERWRTSRLNRNGISASPMQKIYSGRMGPSHDGRRTR

SEQ ID NO: 25548 - protein, 181 aa, A.fumigatus
ALRPSWPSTVSLDWVFCSSFPSNSVANRMAANCGSISAITIIRIRVLTTVDFFDLPYSMIWAAFWSVTEPALANLNACVPMLRPVFKAAFPTLFASRKMYSTQPGSGASGIKNKAFKRMNEVESDLQLTNLTQLEPVRTSREGRISEHGDDGSHDDRSQDGRSQDESTHVPRSVIVNRPWT

SEQ ID NO: 25549 - protein, 131 aa, A.fumigatus
ARFLPAPSREDNAMVLAKLSYLFFYLRIFVTKGFRIAAWVCMGCACAYWTGSMLQIFFICQPFQKNWNPTLPGHCASQNVAFSTIGAFNLITDVMIMVLPLHFIWKLQMSTATKLALYGIFGLGLLFVVPF

SEQ ID NO: 25550 - protein, 270 aa, A.fumigatus
RTPFIVLCIYVSIHLFGVLADICTQFSSLETSFASHWLHETTLPLANLCIRLPQTFQRRPFSQSLYFFFLLDCCARVAPLPMEVAASRDSAPVGPPTGPDATITNGDQDLLLDDSLMDDGRSSSLSDIDDVLDNEPSDYEESPKPEKLAAENDSEAETERIEDSPNHFRRTNIVVSSYGPSPSKLAQSTTYDDAVDGDDQIEDSPSKPRSKPNGILESAEDILGLEDSTLSESYGKRSAKRPESGADVEGETGGRSDPPQKTRRVREKVN

SEQ ID NO: 25551 - protein, 105 aa, A.fumigatus
SFLYTITEMRLPCAPSLALRAARTPLAFARNGQKHSLHTGTYNAAVIGGGITGLATAFRLSQDPKCTHITLYEKQQRVGGWMMSETIPLGDDDGNLHHGVEGPRL

SEQ ID NO: 25552 - protein, 71 aa, A.fumigatus
LNISERADGYSCSLIDENLRVTHFETVHDYLTRVYLIYKTTNMMMFCHYTAPMDELVRNQQTPFQPAIVHK

SEQ ID NO: 25553 - protein, 93 aa, A.fumigatus
QCLFVLSLCKLTVPQFPKSQPLIKEKWYLTIRALLMQNHEVKEVMSHAAYLCLFSMMCIIMIALQVTDVLCTYQGRSFCDVEVTNVCSGCVEI

SEQ ID NO: 25554 - protein, 212 aa, A.fumigatus
QLSSSYSESIIRDSRVLRFHDSYLRSGAMNYPPSHNGQYPPQYLQQPQQLLYNNADSNVSPYEYGKPVAYPQTIISPYSSYGQAYNIEQHQHQPQSHHQQQPPQQQPQQQYVNPSDVFHQPLLPPASSSQLAHGSTQYGAQPMVSVAGNSNRSPAVASASTSAQSTPAPSTQSAYQTAPTLNPRNNVFNQYSQVALPAPSVPSSNSVATAPS

SEQ ID NO: 25555 - protein, 83 aa, A.fumigatus
RSLLLVYSVSKLAVYLKTNLLANYNFIFNLLDRLTLNKATIYIYIVNYKFSFIKVCNKTPTLIIVTYYTYIGIISNTNFITAY

SEQ ID NO: 25556 - protein, 131 aa, A.fumigatus
HSTLIIMSVSITADTPVASATKPADVSLGSKGRMPEFSLAGKVVLVSGAARGLGLTQAEALLEAGAKVYGLDRLEEPVSNPVFYNLAHGASCLTMLDGDSPPSSSRFKSEPRRNWGRSCTIVVLMCVTRNC

SEQ ID NO: 25557 - protein, 138 aa, A.fumigatus
SAEFFEIQKRAKEELGTELHYRRIDVRDTELLTSTVEQIADVEGRMDGLIAAAGIQQETPALEYTAKDANTMFEVNVTGVFMTAQAVAKQMIRFGNGGSIALIASMSGTVANRVRFYQFLSRVENGDPRVSSLSPLLT

SEQ ID NO: 25558 - protein, 103 aa, A.fumigatus
GLICPAYNASKAAVIQLGRNLAMEWGQYGIRVNTISPGYIVTKMVEDLFVQFPERREEWPKHNMLGRLSTPNEYRGAAVFLLSDASSFMTGSDLRIDGGHCAW

SEQ ID NO: 25559 - protein, 187 aa, A.fumigatus
VCLSLSIKQPWTDNCSGRIIATGIIELPPIPAGQNGTIKLPSAPATAIPGKVWLTMSFLQKGETAWAGNNYEVAWYQQCLKSSSPRFSLAVLDEALTHSSTKTSHRISGASFSLEFSRETGSLYAWTAGGLSLLDQSSSTGAISPGFPRPPTDNDMSHDLLEWRRFGLDTLTSQLRKMQSSPLAGRG

SEQ ID NO: 25560 - protein, 446 aa, A.fumigatus
ALPTPAMGKGTRSNRSTGSTVQTEKYSLGEKQDKLEGELSFSTPNKWTAETPNLYNLCIALYVDGAKDPVQTINHRVGFRQVEIKNGNITVNGVPVMFRGVNRHDHHPRFGRAVPLSFLREDLLIMKRHNVNALRCSHYPSHPRLYELCDELGLWVMDEADLECHGFYDAIARPLDIPESMDYEERKKLTFDQAAQFTTNNPEWKEAYVDRMVQMVQRDKNHSCIVIWSLGNEAFYGSNHQAMYDYVKQVDPSRPVHYEGDMEAKTVDMYSYMYPSLERLVGFATAEGDEFKKPIVLCEYAHAMGNAPGGLEEYMEAFRAHRRLQGGWVWEWANHGLWDEKKGWYGYGGDFGDTPHDGNFVLDGLLFSDHTPTPGITELKKAYAPVRVWPGEDGTLVVANDYNFVGLEGLQASYKIKVLGDRYVCLYPLNSLGLTTVAGALLPQAL

SEQ ID NO: 25561 - protein, 105 aa, A.fumigatus
DVCGTWQWWGSKLRLVYLASILFTFASAETLATEYLVMGVWYINEENVYVLRSVKGVCAWAPGSGYCARSLLRILDQKVPNICRSIIAREPPPFLGEAAPIFFSL

SEQ ID NO: 25562 - protein, 87 aa, A.fumigatus
SGIGGYDRDGAGEAGQGVAVETAVLTSSWMCYVSIYKSLRTSLSEIILSLVCITGSVKSYGTRVRWICIHHYPLTWLYTTCQHSQGR

SEQ ID NO: 25563 - protein, 61 aa, A.fumigatus
LKIHRYVLPPTHQDVGNVFQGNLSGCLHTIDWGKGSYGHWIGDAKADNVLIWYHGQHHYHL

SEQ ID NO: 25564 - protein, 215 aa, A.fumigatus
CNQFDKDIGGGFALPANMGYFKFFANLVDHAATHNKSLAIFSLTYTLAPQATYPTQLRQAVDCLRYILANTSHQPSRIFLGGDSAGGNLVGGVLSHLAHPHPQIDPLNVSENLAGAVMIAPWTLMDTDFPNRKIDSSGDLITPAVAGPWARAYLGTATRDVYTDLSKAESDWYSTFPVANVLICAGGNEILLPIIQDFAEKFKVCTCLILGVSGC

SEQ ID NO: 25565 - protein, 378 aa, A.fumigatus
AILITQKVGNDFVRGVFGGERKRVSIGMLQPVSLPFPKAIRECAYVSTKSEMALACTPLAAWDNSTRGLDSATALKFIESLRLLADLAGTAHAVAIYQASQSIYDLFDNVTLLYEGRQIFFGPTSTAKGFFERQGWECPPRQTTGDFLTSITNPQERRPRAGMEKIVPHTPEDFEKYWLQSPEYRRLQEQIERFETLHPPGDDEKAAAHFRKRKQGVQSKSSRKGSPYLISVPMQIKLNTRRAYQRLWNDISSTLSTVIGNVVMALIIGSVFYGTANTTAGLSSRGATLFFAVLLNALTAMSEINSLYSQRPIVEKQVSYAFYHPSTEAIAGVISDIPVKFVLAVVFNIILYFLANLRRVCITILHPTSLSLSSSCLS

SEQ ID NO: 25566 - protein, 62 aa, A.fumigatus
SEKCSPLQRYQYLLNHPLFQFLLTNGDFEGVSQTRMMKEFKGEIVYNQEVSLQESCSHLRLR

SEQ ID NO: 25567 - protein, 124 aa, A.fumigatus
MSAPSSPVVKTADAQGRGLSPPQAGIVFKQLNVSGSGAALQLQDTLGSTLALPFRLPELLRQRHSPSRLILKSFNGLMKSGELLLVLGRPGAGCSTFLKTLCGETHGLDVDPKSVLHYNGTNIF

SEQ ID NO: 25568 - protein, 79 aa, A.fumigatus
ACRNRARICACANVNCSSLQVDKHFLHLSVGQTLEFAAAARTPSHRFHDMSRDEYAKYAAQVIMAVFGLSHTYNTKGWK

SEQ ID NO: 25569 - protein, 96 aa, A.fumigatus
KSLCPSATSHRPRSVQMANDIETSFQAAIDAGQINGAVICTTDTNGTFVYNTALGQRTLLSGEKLPQQLKQLLYLAPGNQTGPRYCGPALRSRMDY

SEQ ID NO: 25570 - protein, 77 aa, A.fumigatus
GAAPSSPVVKTRRNCCRRNCGPMRFVYSMRRSVADGSYSLRFRMWRLTMNGCRLRRRRGPRLKVCTCFWLCGFYGPF

SEQ ID NO: 25571 - protein, 60 aa, A.fumigatus
SFVIDVTPAPAYKPSSIAGETVFLYTYTFQAEPASLSPNIGSLVSLVEAMRKYRTHFLMS

SEQ ID NO: 25572 - protein, 186 aa, A.fumigatus
NMLRQACSVAQRNEAAEGSIVGSIMFWILGCFIAILDWLVTLFNRYAFCHIALYGKAYIPAAKDTWTMMRDRGIDALVNDCLIGPVLTMGSVFVSYVCALLAYLYLQFTKPSYNADGNFTAVIMAFAFVIGLQICQIFMTPVSSGIETIFVAMGWDPQVMIRDHPDLYYRMIQVYPRVQQAIQPSA

SEQ ID NO: 25573 - protein, 64 aa, A.fumigatus
PKLSHSGIIPLPWLCLRFDLRHPISPITHGLAQAFTCSFSRIDEWEGVELSTGVLGDASPFVNP

SEQ ID NO: 25574 - protein, 98 aa, A.fumigatus
IVYSTILTLWRPQNYDWAEFKKVKLALEELGGDLTTVHNQSSKILAPNAQELKRWGRIAAFWSIATFLGHWVLWPLPMYGAKYIFGKTVSIQPLSCEK

SEQ ID NO: 25575 - protein, 62 aa, A.fumigatus
AENHRSGFLSQQLECVYCQAINGSCVTILSLSVIIRIRTKILSIDKISGLEECHVLRYQFGR

SEQ ID NO: 25576 - protein, 170 aa, A.fumigatus
DKHKTSSSENPQNSTPPKRLSHTPTSTRNAKRRISFRSSRLSTGSDRISLNISRYRIIFRVDMSYEERVNAHPNLGDESDVEEEALVNDYREQVNFDDGMSELDRTTSLGTGSQTQDLQAQLAAAATPLEYQATLETKFASYDNYCSLFHYILNSEGPVELEVPSVRPHL

SEQ ID NO: 25577 - protein, 124 aa, A.fumigatus
YYWAWDVIDEFIYQFESFCRYRNRVARSGSNEEEAQLLRENPNTWGCYSVLNVLYSLIQKSQINEQLAAIKRGEDPLAFAGEYGSRPLYKMLGYFSIIGLLRVHCLLGDFSLALKTLVFTTGLE

SEQ ID NO: 25578 - protein, 600 aa, A.fumigatus
PRGAQLAVVAHIRHIYTDYDRRLKTTSFHKAQSAVKEPTLAKLVEWRGADENGKTVLEDVFREVIVISDDDDSDAEEGEVSRSINRDHSIEIVSSHQRADDLQMRPVSFSHPTVQDSHLDISDDEPPPGFRFIPESPKKRRLDRRGFSRYHAWDRALNRYRKGTYHQHRFYADSTGHPGPLLTARQPVQENITFDPGATCHPHITALRHVSVDPHIASKTEVLHHGQRRTLTRTLKENHVSLQRTDAERSGQKTHIRPPLISHEPSNPGTLLHLPIPRSDASRLADRTEGERVSADQRRARFDQRLNSPNTPVFVGGPTEIQWRGRVPSGAMSRIPGPPYLEMQPNPQDHILPSIETPPLPQQIRRPPSAHLDQLTRRITGGFTIRSVTPRHPAQEDSLPQGESDVRIPASKRRRVANHDPATYIEPRSDVAPIVPVGTHAKQQYVDLGNASPRSLTSQSGAPICRRYMVPVKSPYLAERYPEGSQGPFNYAQPVPEVVVDQRHYSNFKSKSTAWGHQPKHQLEQYRVLHPLQGSPGQVHVSSDACYATASSNESCNAVSKLPDTASEAGRVYESRRIHEEAGEATYMPDLHNWWSTPRA

SEQ ID NO: 25579 - protein, 94 aa, A.fumigatus
HRILVLADPVQELYLRQLQAYKPTPIKPGDAEAHVQKFSAPAAPQSPEEANLANDLKAYESQDVEVEGQAAAGEAAPVEESWFEEEPEEETAHH

SEQ ID NO: 25580 - protein, 63 aa, A.fumigatus
VKTMFNLNFISSTEFQIMVRNVHAVIQAQWLLHNGTAQYMHPPNHFSSITKAMSLLALRIKMS

SEQ ID NO: 25581 - protein, 110 aa, A.fumigatus
TQVLRCIPIPSSICLTPAARISPPVGAPAQTTQINSHSATEAQEKMTPDSQKSTMDKMKETVTDATDRLTGSAQGDSQKSYSQQAYDSIRGGADNQTHGSSTETMYVPPV

SEQ ID NO: 25582 - protein, 66 aa, A.fumigatus
CAGSVYVGSGGCCPYWSLSKSGRYPLQTLVHLCIRLDVYCSGHEVCIDQNGAPTEYGRIHRFTDVG

SEQ ID NO: 25583 - protein, 176 aa, A.fumigatus
VHYWQHGRIGRYVVESPIILGHESSGIVVECGSKSGFAVGDRVALEPGVACNTCSHCRAGRYNLCREMRFAATPPYDGTLATYYLVPAECCYKLPPHISLRDGTLDEPLSVAVHSCRLAGEMQGKSSGRFRSKAGPLALCGPGACVWSGNCTSCERCAQKNRVLAEKRATPSLPDD

SEQ ID NO: 25584 - protein, 64 aa, A.fumigatus
SWSSLCPSCSPRITQAVNQAFVLHPGGSFHYEQRAVPTLGSDRDVLVRVVATGLCGSDVGASLP

SEQ ID NO: 25585 - protein, 75 aa, A.fumigatus
EMVPLMSRSVWLYTVVGSQGKCRGKAVVVFGARPVRLLCVALARAFGAATVLLVNVVPKRIGFWLKNGPPLPYQM

SEQ ID NO: 25586 - protein, 343 aa, A.fumigatus
GFECTPVDPSSPVVKTQLERRRKRRGRYGTFQRPLRHRLLTREQEVDPPAVEAPSNGFQDVSLNDSGAPQLDLPLDPPAGSNGGVGFNFGGWGKDWNTGSKWGLDSLNMNGNANADDGNGTNPWGPIGSKKDTSKTPGGFDFGDFGDSGDAVQEPPAEKKKPEEDIWADFAPVSAKDKKKKKKDLVEEIPKEPEPEPEPKPLPAPEPAPAVDDSWMAGLSKKEKRKAKKNAKVAEEPPAPEPVIEEPKTDNVWSTAEEKKEPEKAPEMADDNDWGWGVPTKKKDKKKKGVLETVAPVESPTPEPPAPEPAPAEDDWGIAWGSIGKKDKKSKKGAVVEEPAPGL

SEQ ID NO: 25587 - protein, 273 aa, A.fumigatus
RPGAGSSTTAPFLDFLSFLPIDPQAIPQSSSAGAGSGAGGSGVGDSTGATVSSTPFFFLSFFLVGTPQPQSLSSAISGAFSGSFFSSAVLHTLSVFGSSMTGSGAGGSSATLAFFFAFRFSFLERPAIQLSSTAGAGSGAGSGLGSGSGSGSLGISSTRSFFFFFLSLALTGAKSAQISSSGFFFSAGGSCTASPESPKSPKSKPPGVFEVSFLLPIGPQGLVPFPSSALALPFMLRESRPHLLPVFQSLPHPPKLKPTPPLLPAGGSRGRSS

SEQ ID NO: 25588 - protein, 72 aa, A.fumigatus
LGQRSNKRPFCNNSITLLMQSLEALSRPIMVFHLVTALWMNFKTNMLHEELFWGLLQPPTSATPLAAAQSCM

SEQ ID NO: 25589 - protein, 217 aa, A.fumigatus
KRPQGRRQSRAQPAASQPHPHQHRPHRVRVHPDLREYRLRLPHRRLLLAPAAVLLAHLAPPCAPRLRHPSLHPVLRHKRHTGLQPTHLPLARPPHLHHPHDHRRLGSPRPVLEHRVPAVHRPRRPPQAPHPFSPRHGRRPLRRSHPRPLLRQLRPGRGLLGICLTRSPPRRHRHVLRLLSLFHRSRPHLLAVSRRDLPHGHPRPRLVHRDRHKLEPQ

SEQ ID NO: 25590 - protein, 83 aa, A.fumigatus
GTHCVIFQPRGEEFIMTFLLVTLCCILATLGSFLFGYDSGVIGSTLEQAAFLQQFDHPSDAVTGGIVSSYNGVSSRHCSLDEF

SEQ ID NO: 25591 - protein, 84 aa, A.fumigatus
GTILGSIAAPYICDPFGRRPVMYVGTLLAALGAALQAGATHVAMLIVGRVIAGFSIGLMATTIPIYCVSAFQQPLSYTRDMLFC

SEQ ID NO: 25592 - protein, 265 aa, A.fumigatus
  UNSURE (3): Identity of amino acid sequences at the above locations are unknown.
LVXQWVGYGCSLHTGAFSWRFPLAMQAVPAVILGTGVWFLPESPRWLIEKGRKDAGKAVLNRLHLNRTRTNTDLIESEFTQICESIASDSRTVVSSWRQLLFSSPTWRHRVLLACGIQAFTQCSGTNVIQVYSPRIYRSLGLPTSTTLMITGVWGALAQFWNTVFLLFIDRVGRRKLLIPSLLGMGAALCVEATLARYYGNFGPDADSSVSASPAALRAAIAMFFVFSLFFTALGLISWLYPAEIFPTAIRARGSSIATATNWSL

SEQ ID NO: 25593 - protein, 444 aa, A.fumigatus
  UNSURE (412): Identity of amino acid sequences at the above locations are unknown.
SRALPPLVKTDERHIRYCPVSTETMAVSHVWSHGQGGRPETGFNICLHRRYTRLARALGCTSYWMDTPCIPTDQELRYEAMGQNNSNFLNSKVTLLVDRDLMEINIHPLTLEAKEAIVATLAVCDWNVRAWTLLEGMRGRWNLHVLCKDNHVISLVDVLNDVLAYSNLTLVSPCLALQHYNPTGRRPVEGEIPPVKIEQATCLLNHRHATKDRDVTMIWSLVCGSQLVKASVDFWKSKMGSPLATGFLVSSSPRLQDQHGFSWAPSRPNLLPPTAGTSSAAGQYPAYDGELSVAGMITEQGFKAEWLMCLIGRSRALPTWLHLRFYTQDESQIRSYYHVYNKGGNSRMDMKSLYKLRSVIAPVFKKYRWVALLLPAVRDRGTNGATSPPRPFQYQGEAKGTLPVIAGSHDEXGWEWQFVAEWDNNFRPAEFGPREVRKVYIPEM

SEQ ID NO: 25594 - protein, 82 aa, A.fumigatus
KSFNKMAIEFTQDTLDEIYAFAVALGRRAGDLLLERIDKQIASDGETAYTYTEKDNAVDIVTQTDEGNPSTHPPRPPKKERK

SEQ ID NO: 25595 - protein, 123 aa, A.fumigatus
SRTEGTVNFTHLFPTFCVSIGFLVNHRPVIGVIYAPAMNQMFSSCVGRGAWLNDTRGARRLPLRRNPIPPMPATSPRGCIFACEWGKDRRDIPGGNMARKVESFVRMASESGGMVHGVRSLGS

SEQ ID NO: 25596 - protein, 133 aa, A.fumigatus
SWTRWLTVALYAYLGVSLTILGTLLAAHNLYPTLRPYTAPFFELSYYQPSEGVYVQGFDDVYFVVSSAITFTAVRAIAIEWIFRPAARYAGLKRKASNRFAEQAWMWMYYAFFWTFGMVCLAASIHCLSERWN

SEQ ID NO: 25597 - protein, 104 aa, A.fumigatus
DLISSHQELAELTLARQTAKILKYFKFELCCNITFGLFMVNWLITRHIFYPLLCWSIYKDVPDAMAYGCYSGSNAEMISTDGYPNRFRLLFQPPSWDFNGPLLA

SEQ ID NO: 25598 - protein, 111 aa, A.fumigatus
YIWTNSYYWMDFKAIWAQWPARGISANLKWYLLAQLSFWFQQILVINMEERRKDHYQMLTHHIITSTLLTSAYIYGFYNVSNVVLCLMDIVDLLLPVCHEISSPLIKNWPS

SEQ ID NO: 25599 - protein, 308 aa, A.fumigatus
PCIAVKPEANLIKRSTCVAGGVKSSEYNTSLHIGALFIILSVSTLACAFPVLATWFPRLRIPPSVLFTFSHFGTGVLIATAFVHLLPTAFTSLNNPCLSGFWTTDYPAMPGAIALAGIFLVTLVEMIFSPARHVCRGGLKVSEQETSLSESGVCNSHVPVARDSKTRDEVKRPGCTRVESQSHLRDLGPLVGRQTSVSRTINRMGEECDRIMRIASAPEGMRPVQESKAPPIEDVERSDDLALTPEQKHKKAVMQVFLLEMGILFHSVFIGMSLSVSVGSEFVILLIAIVFHRMFSAFGRVLYPANVG

SEQ ID NO: 25600 - protein, 78 aa, A.fumigatus
  UNSURE (78): Identity of amino acid sequences at the above locations are unknown.
CPWHTDARKFLASRSFKLLEMLILFSTPIGQAIGLATHTLYSPDSEVGLLLVGTMNAISSGLLIFASLVELMSEDFLX

SEQ ID NO: 25601 - protein, 75 aa, A.fumigatus
VRSSASSKHPDEHACIPFSRIVNPPLSFSPLTSQSPRTHVSPYEFGLAIALTFDTLINSPLRLSQKSIPYVPGRI

SEQ ID NO: 25602 - protein, 138 aa, A.fumigatus
TYLDSNPEAVIVGSPLDGSKNPTDTKLGDLVGDITGVITTAYGYYVLLPLTALTVTGSNTTAAARTDLESAGTCGDVTVGSYNVNNLAPNSTTLPKIAQHIAQYLKSPTLVFLQEIQDDDGPTDDGGMLPLRLTVAIG

SEQ ID NO: 25603 - protein, 112 aa, A.fumigatus
RQKEFTSSILAEDSTAKIIVSGDFNEFTFAQPLETFLAESGLEDLDEVAGIAATERYTYLYDMNCQQLDHMFVSPALATGAQMHHLHVNTWVSFDDQASDHDPTVALLNACS

SEQ ID NO: 25604 - protein, 189 aa, A.fumigatus
RRYASSQADCGHRLMHAPGVSANKTLSTLVQSIADQGGIRYSFVDIAPVNKEDGGQPGGNIRVAYLYDPSVIRLRDANTGSNTDANEVLPGPELKYNPGLIDPSNNAWLNSRKPLAAAWETLDGKNKFFTVNVHFTSKGGGSSIEGDARPPVNGGVATREAQAKLVAVRCPRFQSLSGTNVRRNLHRPS

SEQ ID NO: 25605 - protein, 231 aa, A.fumigatus
TPFQFAYKSMGQEELAKEHTYSIMATEGRMDSFNHFMVGKFMKTNAAPDRLRALGYDLESVLNDAQASTPPTMVDIGGGRGEMILDFKAAFPQLQTSDLIVQEFNHDITDIPGITLAVWNYKDESPQPIKGALIYHLAHILHNLPDLEALRLLKKISEAMAPHSRLLIHGFAKNTTYAKMHAAMIALFGGRERSSTEWHQMAGLAGLRVTFEAYPDFGEGLIEMRKVESSA

SEQ ID NO: 25606 - protein, 67 aa, A.fumigatus
LLFCPFIGGCGQAFQAIIVSPQFEKKNMLARHRLVNSVLKSEIAAIHAWTPKCYTPEQWQALQQGSA

SEQ ID NO: 25607 - protein, 73 aa, A.fumigatus
  UNSURE (32): Identity of amino acid sequences at the above locations are unknown.
SYQAEGFSGCGLPYALWPAIVYRLPAYSLTQXSDVDPIIFRGLKSLTLNDTQQQTLLRLASEGISVYSPHTAV

SEQ ID NO: 25608 - protein, 68 aa, A.fumigatus
CPNCSYSSHPVLLEAPFHPARRQKNSVLLTIDLTKAVADEAIKRKDSVVVAYRMHCGRQSSTGYQHIR

SEQ ID NO: 25609 - protein, 153 aa, A.fumigatus
YDYMQVVYGLETGAVYCVGAWWKGLANNHMTDDQRAALSPDSEEFRLRVGGSKTQVLGWSLYTTLLWLLKACMAIFYSRLTYVSPRLEVVTDTDTDADTDADADGQGRSDQHAYPRACGLRGHRGDLSDCDSVDPVWLPSDAQELADLSKSWP

SEQ ID NO: 25610 - protein, 169 aa, A.fumigatus
RMSRLVWRSSLTPTLTPIPTLTLTGRAGLINMHIRVRVAYGAIGVTYLIVILSILFGCHPMHKNWQIYPNPGRRCHSLEKVASTDVLVRCQPAIAPLDVYMTVTLNVATDIYLITIPTPVRSFSYISSRPSHIHRCSSKRDFPGARNSNSSSSSLVESSSWRPGSSAAF

SEQ ID NO: 25611 - protein, 486 aa, A.fumigatus
  UNSURE (395),(479): Identity of amino acid sequences at the above locations are unknown.
FTTSLRLPPTMSDLPPERSHSRRNTNDLGLVPTETKETLHEAGLSPNTPEIGINYPEVGRPADPVFPEEYNLETQTGLVPARTLESVRTTTWTGRQISPADLEKGGEPVDFVTFTINDPDNPHNWSHVYRWYVTIVVSMLVVCVAYGSAFVTGGLGLIEDKYHVSLEVATLTVSIMVCGFAVGPLLWSPLSEIIGRRPVYVISLGLYTIFQIPCALSPNIGGLLACRFLSGVFSSSGLSLAGGTIADVWNIEERGHGHCVLRRSTLLRSRRGPHRMRLDQRRFAPPGPLLPGQHGLCRRGHDRRPAGTRKLRPCHSEAPRQKAPPGNRQPQHHHRAGKSQTELQGDRAHELRPPDHHDPHRARPRPDVHVHRPHLRHALRLLLRLPRYLRRIVRXQRRTDRPDVHPDSDRRRFRASRHPPHGEAVPAHLPVSRPDARRPTHRGASRSPLYPDRNVHSRRYVVQTYYLGWARVVGYRVRXTRRGKVR

SEQ ID NO: 25612 - protein, 313 aa, A.fumigatus
  UNSURE (223),(307): Identity of amino acid sequences at the above locations are unknown.
PSPSWSVGLRLGRCSGVLCRRSSAVVPCMSSRSDCTPSSRYPARFLPISVDCWPAVSLAASSPVPVCRWLAGPLRMSGISKSAGMAIAFFAAAPYCGPVVGPIVCGWINVGSHRLDLFFLDNMAFAGVVMIVVRLVPENYAPVILKRRAKKLRQETGNPNIITEQEKVKLSFREIVRTNFVRPITMILTEPVLDLMCMYIVLIYAMLYGFFFAFPVIFGELYXYNDGQIGLMFIPILIGAGFALLVTPLMEKQFRRICQSRAPTPEDRLIAALLGAPFIPIAMFILGATSFKHIIWVGPASSGIAFXAHAGAK

SEQ ID NO: 25613 - protein, 98 aa, A.fumigatus
RGMFQPRGEDPPVGGIANGAMVLDDKLFIDMPFESFQAAMKPKVQGSIYLEEVFSADNLDFFLFFSSISVMTGQRTQANYVAANNASLTPFSPLSRRF

SEQ ID NO: 25614 - protein, 164 aa, A.fumigatus
FMVAMAERRRARGLPASVIDIGMVVGIGVIQRSQNDKGVSAMENSIRQMDYMPVSETDLHHLLAEAILVGQRDESPELITGLETYKPVEGEAPFWHHNVRFSHLITDPDAAQAGADSAGSAQKSLKEMLLSSGGPEEARKVMENALLQYLASSLKVSTALFKPS

SEQ ID NO: 25615 - protein, 237 aa, A.fumigatus
LSRETIYTDVPIIDLGIDSLVAVQIRNWTWAEAGYDLPVLKILGGSSVTQICDEVVASLSFDKSSIAAAKVDSQAAPAHKLRPWDKPSADTKRTDSIAPVPRSQIAANGPNGLPNGALKKASKLAVKVRPLWTTQAGGKDTKKGPRPAPIRIQPLSLGQYRLYFLSQYMDDDRVLNCTISYALSGKLDVSKLEQSLIQVVQRHEALRTSFYTDEKDAKPSLLPQGPKDPRIRLRTGE

SEQ ID NO: 25616 - protein, 67 aa, A.fumigatus
QLYSAIGPARLYNIGQRYSGLLHMFWIGASLPIITYFIRKRFPKSRFVDAIHWPIFFAGTGNLPPAV

SEQ ID NO: 25617 - protein, 83 aa, A.fumigatus
PFLPDGVLIWMLGNVKDVCSSDQPDNFTCPQGRVNYNSAIFWGGTSLPILYPKSHTDSFIQPLGPHDYITSARDILVFCTCFG

SEQ ID NO: 25618 - protein, 94 aa, A.fumigatus
LSALQTRCNHEILTGWQVIKGRRPHWWAKYNYVLSAALDSGVAVAAILIFFSLIFPGVSLSWWGNTVNSGTVDAKGTPWKELGLNETFGERTWS

SEQ ID NO: 25619 - protein, 180 aa, A.fumigatus
RAGRKIDSRVSFHCVYWPAFLMALDLPLPRRVLIHGHWTINREKMSKSTGNVVNPFFAIDRFGVDTMRFFLAFQGGLAGDADYDNSYIIRDYKKLLQWGIGNLTHRTIGCAKGNLRSYIADAAADKLPAPTPEDLEHQSLLEQTPDKVAEQMEKLNPRAALQDIMAIIEKVSVESPYHND

SEQ ID NO: 25620 - protein, 92 aa, A.fumigatus
PQTNKYFHAAEPWKTPAGSQRALYNVAESLRISGILLQPFMPSKSTELLDILRVDKTEPSKRSFSAARYGCDPDYGEGVKKSILFPPLIIEE

SEQ ID NO: 25621 - protein, 443 aa, A.fumigatus
  UNSURE (9): Identity of amino acid sequences at the above locations are unknown.
SSPGCYNKXCMILAAHVVKHLISFSTEAYAAHIRGIPGPHIGPGLGYAFGLYAMQVLQSLTMNHALYRGMVVGGMAKAGLTSQIFAKAMRLSNRARAGGKQANDTGPKSAEGSPSGAAANDAAKETAGWSNGRITTLLGVDVDRIDTASGMLHMLWVAPIGLIVALIILIVNIGYSALAGYALLVVGVFALAWAMRLLVQFRRAINKITDQRVTLTREILYSVRFVKFFGWESSFLKRLEAVRNREIGSIKRLLFVRHAVVVCMVSLPTFASLLSFVTYALSDHSLSPDRIFASLALFNVLRMPLIMLNLTITQMTDAWTAMNRIQEFLQAEEKSDPVEWDTGMDKAIEVEHASFTWEQVQSNKGEEKKGEKPKRSQVLPKDATPSSPSDDKSDTTELVPFKLTDINFEVGRGELLAVIGTVGSGKSSLLGALAGVFTTGLEG

SEQ ID NO: 25622 - protein, 402 aa, A.fumigatus
HQPRSFQPRGEDIQIAATICEWMYVPRRWAGAQHLTKRLMFLILVFVINLAPGVFVFAYSKSMGISKTIPLIVGIVHFFVALATFVFFSVMPLGGLFGSYLKKHGRQYVASQTFTASFPRLHGNDMWMSYGLWVCVFGAKLAESYFFLTLSFKDPIRILSPMQIHQCAGVKYIGNVLCHKQPQILLGLMFFMDLTLFFLDSYLWYIICNTVFSVARSFYLGVSIWSPWRNIFSRLPKRIYSKVLATTDMEIKYKPKVLISQVWNAIIISMYREHLLAIDHVQKLLYHQVPSEQEGKRTLRAPTFFVSQEDQSFKTEFFPPGSEAERRISFFAQSLSTPMPEPLPVDNMPTFTVLIPHYSEKILLSLREIIREDEPYSRVTLLEYLKQLHPHEWDCFVKDTKM

SEQ ID NO: 25623 - protein, 256 aa, A.fumigatus
RHTRLGGGSIVGKGYSDDGYTVTDGYTDTATTITEKEEGDHKRKRRFRETAKQKLLRKRKDENWECESDEDVRAYRKEKPARIGGINCEGDGTYHGSDYDTSNPPTSHNASEMSEVRDYAYEPPRQSRNFSFTPGSEEVLSHTTEERQHLREPSARRHNRRRERRRAPPTTPSRQGSPRKRDRLSVPGHYTEPLDFSSAGSRSEYQYSNVETDDGSGTKHYHHPIPGLSKGYRREGGRNRRRDSLSDSDGDETRYS

SEQ ID NO: 25624 - protein, 248 aa, A.fumigatus
SGGKYQVSTLQSTLRAAPYSLPVVTISLDDFYLTHEQQQILAKTFPSNPLLQHRGQPATHDLPLAEKVFESLCAGRPTAIPQYDKSAYSGQGDRVPESQWETVNGDGQDKIKVVIFEGWCVGFRALDEDVLREKWEAAVRQKDQGGYNGRLGYVKFEDVKAVNDALRKYDVLTEFVSLPSWIALDVDANCSSEPARRIGSYVSATLLHSLSYQYPLAKHLQAMRKTSTLSTTGDRNRRERCVQSKERE

SEQ ID NO: 25625 - protein, 74 aa, A.fumigatus
  UNSURE (50),(51),(52),(53),(54),(55),(56),(57),(58),(73): Identity of amino acid sequences at the above locations are unknown.
YMTDYPSYELFTEALREGAFKPASNSTDTNWQGRQLRLIVNKERRVDGLXXXXXXXXXGLNIYAHSTTPLDTXN

SEQ ID NO: 25626 - protein, 62 aa, A.fumigatus
TSPSDAQDLHFVYDWRQEQERTLRAIKGTGMTEEQVSHFVDGCTYVELVDDRRLIYDRLPVL

SEQ ID NO: 25627 - protein, 71 aa, A.fumigatus
PTSWYSSQNNRSRSANNNDDKNSQKLGTHLGILTVLARYLKEESNLIMTMINYVTVVSAQETKEQPATELG

SEQ ID NO: 25628 - protein, 84 aa, A.fumigatus
DMTIEALEKLRLCKQIEAMQIPVALLSSARDSPYWTICNALIENAYLDFEIRKQDVSLDCPWENSISYSSRSRVVNQSTSWTPT

SEQ ID NO: 25629 - protein, 62 aa, A.fumigatus
TDMLTKRKDISMPVMHGFEATRAIRALEKERDGCGPATIIALTGLSSSRDESEALTSGVDLF

SEQ ID NO: 25630 - protein, 404 aa, A.fumigatus
  UNSURE (48): Identity of amino acid sequences at the above locations are unknown.
DWAGVSVHLESTEAFESRSRRHGVEELVTLTVSDTGKGISEAFLRGRXFTPFAQEDTLAVGTGLGLSIVRSFVKALNGIINVHSRPGEGTTVKVSLPLTRPDPEDSLEDSLPSRQDDTMNEAFSLRNSHGGRRVAIFGVEPADACEHRLWSIIARYLTDWYGLELVSLSSQEPIDVLLADEDSLASISKEAVTGIILSLLILCNKSVDYSAIRAEWSPIAALVDIIRRPCGPHKLARCIRKCLDNGPRGGATLPPRIELPERPRMSNGIPPPCADLTEADPLAASGDRTRATSFRVGTLSSSEDSGESQSSSDIADALHGSDTSMSPLPTPSETASKRIERKARVLVVDDNSINLNLMLTFMKKQELEVLDSAENGKVAVDAVERMQQGYDLIFMGRRLNPRLD

SEQ ID NO: 25631 - protein, 86 aa, A.fumigatus
YLLIARLLLLSSLSLNPLSFQAPPSRWVFLNMAVDEKTDAQFHETVPTRDADVGDAIELAQQAASAKYSPWTPNMFPLYRCLTIAY

SEQ ID NO: 25632 - protein, 161 aa, A.fumigatus
ARLRRVSFCYYPIPSSLSLSATMTLSAVPDYENQHILQRNRLKPRAYFLPATSISLNGRWDFHYAASPVSAPEPTWSKGTKNATAEPRRDSNQFSSDGADSKTAWAPITVPGHWQLQGYGRPHYTNVIYPFPVCPPFVPTETPTMGGSVVIIILLIVISIV

SEQ ID NO: 25633 - protein, 232 aa, A.fumigatus
  UNSURE (1),(14): Identity of amino acid sequences at the above locations are unknown.
XWDRHYLFVRGERXMIFSGEFHPFRLPVPGLWFDVFQKIKSLEFNAVSFYTDWGLMEGNPGHVVTDGIWSLDEFFTAAREAGLYLIARPGPYINAETSAGGIPGWVLRRKGIIRSNSEDYLRATDTYMATLGKIIAKAQITNGGPVILVQPENEYTTWPNVSESEFPTTMNQEVMAYAEKQLRDAGVVVPTVVNDNKNLGYFAPGTGLGETDLYGIDAYPMRYDCETITFKR

SEQ ID NO: 25634 - protein, 99 aa, A.fumigatus
INVPNMSSLSISRRCMHIVSLSLLVASSLAANTAQWKSRAIYQTMTDRFGRTDGSTTARCVASENIRCGGTWRGTIDHLDYIQGMGFDAVMISPVVKNV

SEQ ID NO: 25635 - protein, 66 aa, A.fumigatus
FFVLYSVPYSVLRKNLQIPLLDIQHPWEKQTMDLTSIFTPYSQSLDFSLSTLGVSFFSAHSSFSSD

SEQ ID NO: 25636 - protein, 266 aa, A.fumigatus
NILLIGGGVSSTDIAREIGPIAKTVYQSTRNGEFDLSESVLPENGIRISEIARFELQNDKTLPEDAHLPLIVHLKSGQKLCSIDGIIICTGYHITLPFLPDYHDDVTSPADANETVLVTDGTQVHNLHKDIFYIPDPTLVFVGVPYYTATFTLFEFQAIAVAAFFSGVAQLPPTEDMRAEYLARVKAKGSGRGFHSLRNVEEHYVADLLEWVNKARASRGLAAVEGHTKSWLEAKEAQRERLKELLGGGTRRDSGVGEFPVLETCR

SEQ ID NO: 25637 - protein, 63 aa, A.fumigatus
TFDAVVVAFGHYLAPRMPDIPGLPEAKALWPSRILHSKGYRRPDGFENKVSQSGCGYMEIPRY

SEQ ID NO: 25638 - protein, 112 aa, A.fumigatus
PQSLTRFISTGGKGGKGLGKGGAKRHRKILRDNIQGITKPAIRRLARRGGVKRISAMIYEETRGVLKTFLEGVIRDAVTYTEHAKRKTVTSLDVVYALKRQGRKYISGYCEF

SEQ ID NO: 25639 - protein, 278 aa, A.fumigatus
  UNSURE (97): Identity of amino acid sequences at the above locations are unknown.
AFLSAACGENANGGMPFPWPPNYNTYSPSPHMPPVHPAPMPGSCPCSYGQAALCGIHQPISGYPVHGMTGSIGNLHYQGCVNCPRGPQGPVGAQGPXGPHGTSGAQGPPGPQGSPGVGADGPQGPAGKQGVPGPVGPVGATGPAGPQGTAGPPRPRGEDGCNHGCNKPGDKPGDKPDEKKPPEPSGQGVGRESSDGPKYTDEPAVPANQGAGVDNVSKGPVYNDEVSAAGQGIGAESAGGPSYTGDPQTSSHGIGRETSGGPAYIEAKNPSGQGIGVA

SEQ ID NO: 25640 - protein, 195 aa, A.fumigatus
KAVGPGCSSPCLAPPSKNCLPSTPLRPLCFSNSLKSTMAQPASVVLDGEDPRLREKERGTFDAVDYGTGTAAIRPQHRKLHDPSVTFEEYYYYAQLTRAEEESRPNGDQERGWLSIIFPSKSGGGVQPLPQHPSEDAKTPSAGDAARQMTITDEEWTNASRALRTATRGAIFYLITTDILGPFGLGYAFATMGWG

SEQ ID NO: 25641 - protein, 95 aa, A.fumigatus
GGENKARYLRLLCRVRQKLEGVEYVLHLASPLPHGTNKETYFGPAVKGTTAILKEAAKVRTVKRVVITSSMAALIPLTGVPEGEFVRGRFPIISG

SEQ ID NO: 25642 - protein, 197 aa, A.fumigatus
TRTEDTGWDLSVDPNADFTGPDDAATSFRLYRASKLLANNASWEFRNTAKPHFALVTLHPAYVFGHNHVQTSPEEVQGGTNGMLWGTIMTGKPMGNSTGVHVQDVAEAHIKALDETVPDGSKFLLAGKRASWSDVARIVKRDYPDIGAKITEDISGEPFPLDTTEAEKVLGMKWRSLDQMVKDVVDQQLELMRQTSL

SEQ ID NO: 25643 - protein, 77 aa, A.fumigatus
QTEPSAAIVYSDRHNRTNIEPFYRDVCLINSNCWSTTSLTIWSNDLHFMPKTFSASVVSSGKGSPEISSVILAPMSG

SEQ ID NO: 25644 - protein, 74 aa, A.fumigatus
  UNSURE (7),(11): Identity of amino acid sequences at the above locations are unknown.
CVYLNDXAHGXYLGLVVYLKFKFPSSTLVTHTQTYQLQSSIKYTRFGSSIKQPLQDAFFRRPPCPLGPCRRSVF

SEQ ID NO: 25645 - protein, 204 aa, A.fumigatus
NSSSHHPRSLPIHKRTSYNLRSSTLASGHLSNNHSKMRSSVVLLALSALAAAQSSSPVVRDDRFHLNCASDHTNILQEAQTTGVTVIGPEVSATEVSGTAATTTSISSTTSQPVIPTAPTVIGSSGVPSSFSTVPSSSGVKSSTKTASTATATETTSESTSTTRSSASSTRSSTSSTTSNAAMPMATGSLGLSVMAGAALAAFL

SEQ ID NO: 25646 - protein, 288 aa, A.fumigatus
SRLSGNGSSSDDDFGPALPSADAPKKRRRKLPFEKVYVNALPASPRYSKSLMHKEQLSFVTMTPYTDFLITSSMDGIVKFWKKMAVGVEFVKEFRAHPADIKSVSVSADGRSFATAGADKTIKIFDVITFGRLGPLLLIWLCQLIGCPDLLAMLSLDFTPRCVCWVHPRGASLPLLAVTDEDSPMIQVFDGRGENTTPLNTVKSIHRSPVAAIAFNNAYDCVISADRSGMVEYWRASDGSYEKPDNVFELKSSTNLFEFKKSKSAPASITISPCLHHGAGRIASEVFH

SEQ ID NO: 25647 - protein, 248 aa, A.fumigatus
KIPLQPPRLPTKPTSPNPDLYFSRKMKYLSIVAASLAAILPSVSAYPITGDGVNCRSGPGTNYPVVKSYPKGHEVSIVCQAPGTDIKGDKLWDKTSDGCYVADYYVKTGTTNYVAKHCDSGSGSGGGGGSSASGSGKAIVAAAQKEKGLPYVWGGGGCKGPSGGGFDCSGLTQYAVCQALKKTIPRTGPTQYKLEHGQTGFRAQQPKEGDLLFWATCGDLQKQGWPTLVFFIPPPPHHPLLAKNGTPW

SEQ ID NO: 25648 - protein, 144 aa, A.fumigatus
STSPLSLHPLQPSFPPSAPTPSPATASTAAPVPAPITPWSSRTPRATRSPSSAKPPAPTSKVTSSGTRPPTAATSPITTSRPAPPTTSPSTAIAVAAPAAAAAPRPAAPARPSSPQPKRRRDSPTSGAAVAARDPLAVVSTAPG

SEQ ID NO: 25649 - protein, 273 aa, A.fumigatus
GRGGHKKFPDRLVPLPRGTVFRKQWVVRRGRNEEYQRGPPLFLQVPASSPEKQIALLGLLGAESGLPMFEFVLRWPRAGYGFLQRLADGVLGQPGAVETTARGSLAATAAPDVGESLLLLGCGDDGLAGAAGRGAAAAAGAATAIAVLGDVVGGAGLDVVIGDVAAVGGLVPELVTFDVGAGGLADDGDLVALGVRLDHGVIGAGTGAAVDAVAGDGVGADGGKDGCKGCSDNGEVLHLAREIEIRVRRCGFGWKPGWLKRNFLWADHTIYRH

SEQ ID NO: 25650 - protein, 422 aa, A.fumigatus
  UNSURE (77),(87),(113),(126),(140): Identity of amino acid sequences at the above locations are unknown.
SPPGDHAGWAVQLNRASVPGPSNRGHLQLGSGHHPSVSQDSDKIGDNRADPTGGSRFAFASFRKKYARYDDRAKSKXKLAPYAIGQXFSVIQYTPVLNDQNSASDSGRAILDXQYIVGVSSPIPVXEFSTGGRGLLIPDXSQPDPNDNSNEPYLEFLQNVLKMDQDKLPQVISTSYGEDEQTIPEKYARSVCNLYAQLGSRGVSVIFSSGDSGVGAACLTNDGTNRTHFPPQFPAACPWVTSVGGTTKTQPEEAVYFSSGGFSDLWERPSWQDSAVKRYLKKLGPRYKGLYNPKGRAFPDVAAQAENYAVFDKGVLHQFDGTSCSAPAFSAIVALLNDARLRAHKPVMGFLNPWLYSKASKGFNDIVKGGSKGCDGRNRFGGTPNGSPVVPYASWNATDGWDPATGLGTPDFGKLLSLAMRR

SEQ ID NO: 25651 - protein, 161 aa, A.fumigatus
TPPAQKLPALYVVDSIVKNVGTPYTLFLGRNMYQTFMNAYTLVDSQTRRKLDEMLKTWKEPVPGSLDTRPVFPPEITRSIESALIKARTAALQQQQARSQQDILNRGRVGTPPHGWTNNTTLNQSATRLAPSTSQNGHAHQVRNGHTLNYHAAVRPMLVTN

SEQ ID NO: 25652 - protein, 83 aa, A.fumigatus
  UNSURE (11): Identity of amino acid sequences at the above locations are unknown.
YLTHTQLDPRXTPTPQPLQRSEVDLAALNRDIVVLIAAARSDFANNPLDPSVQQRLKALLDLQGILQRQELVFTPGGWKDHVE

SEQ ID NO: 25653 - protein, 139 aa, A.fumigatus
RQTARRRERKHPNIPECCYFRLKIPFVPFLPRLHSHLAHEHRCFTAYLPVMSSGLASDEVAEDYKNSLEDLTTNDRFQISNLTVIAKENTEHAMAISRVLENHIRTVGGLCFSLSCISPWLLYLARRSAVCKFDRLNHF

SEQ ID NO: 25654 - protein, 66 aa, A.fumigatus
PRPGWHSSSWLDEQHYAQPECDSARAFHKSEWACSSGPKWTHAKLSRCGKAYARHKLAVVNALCDI

SEQ ID NO: 25655 - protein, 386 aa, A.fumigatus
YKSRAQLRAPGILPRRSVNQPVQTGLKCVDSMVPIGRGQRELIIGDRQTGKTAVALDAMLNQKRWNNSSDESKKLYCIYVAVGQKRSTVAQLVKTLEENDAMKYSIVVAATASEAAPLQYLAPFTGCAMGEWFRDNGRHAVIVYDNLSKQGVAYRQMSLLLRRPPGREAYPGDVFYLHSRLLERAAKMNDKHGGGSLTALPVIETQGGDVSAYIPTNVISITDGQIFLESELFYKGIRPAINVGLSVSRVGSAAQVKAMKQVAGSLKLFLAQYREVAAFAQFGSDLDASTKQTLARGERLTELLKQKQYSPMAVSEMVPLIFAGVNGYLDGIPVNKILTWESDFLASVKSNQPEILETIDKEGQVSKELEAQLREVIVNFNKSFNA

SEQ ID NO: 25656 - protein, 415 aa, A.fumigatus
RQEKTVHGGSITQLPFAHLCVERLVEVHNDFTELSLEFLADLALLVDGLKDLGLVALDTGKEVRLPSEDLVDGDTVEVTVDTGKDERNHLRHSHGRVLLLLEELGQTLTTSEGLLGGGIEIGTELSESSNFTVLSQEQLQGTSDLLHGLDLGSGTDTGHRKTDVNGGTDTLVEEFGFQENLAVGDGNNIGWNVGGDIATLGLDNGQSSKGTTTVLVVHLGSTLEETGVQVENVTGVGLTTRGTTEQQRHLTVSDALLGKIVVDDDSMAPVVTEPLTHGTASEGSEVLQRSGLRSSGSNDNGVLHGVILLKGLDELSDSGTFLANGNVDTVELLALVGRVVPSLLVKHSIESNSGLTSLTVTNDQLTLTTADGDHGVDTLQTSLDRLVDGTTGQDTRGPELSTALVLSRRAGRTTL

SEQ ID NO: 25657 - protein, 95 aa, A.fumigatus
SLNNNKACLPPNAMDVLNRGNGVVYLGNTASYSRCSHLRSFFIPGFIQMPAGLIFITGATGFIGSAVALEALNAGYSLRISIRKESQIPKLKKIL

SEQ ID NO: 25658 - protein, 161 aa, A.fumigatus
TTLRKTTLLSQIKALYLPRPDGATAPNPGKTVPTVGQNVATIPLSDMYLKIWDVGGQISMRNLWQSYYSSCHAIIFVVDSTDVGQDPDITRLPSNQKPGSLSGPSASGSGPVTEEMAGINAPGREFGRLDECRQVLESVLQHSDVAGVPILVLANKQDRED

SEQ ID NO: 25659 - protein, 62 aa, A.fumigatus
VEVVRIKEGLVRKVFEGESGGGVRDSRVLPVSALMGTGVREAVEWIQSRVKWNKEGRPPIMK

SEQ ID NO: 25660 - protein, 120 aa, A.fumigatus
PLVDIWLTPPDFLHTTVLEIASSRTPLEVDSFVSHLEQSGVIPGLVNYTFNHRARLVKPVVSFDASAMALSFVPAAGEPSRWSRSVDDDNYTYHHLRRDLYAGVAATGSSPRRRKVTVLD

SEQ ID NO: 25661 - protein, 68 aa, A.fumigatus
DIDQIIRSCHPIPLIDYGDILSVGLQELDYFPAYGIDFCGAEDIDINASIPVWSTLVSEMAYLSHQKN

SEQ ID NO: 25662 - protein, 67 aa, A.fumigatus
SISSLCNCHADNIRGQLCKIPKIATPAENRITWGTSEPEAPFSTPTYQDTNKIKSSPGAEGAALLAI

SEQ ID NO: 25663 - protein, 81 aa, A.fumigatus
RSRTRFFQSVVKNGVKARQSTLKSVKDDKEHRRTRISTKSGYDRRMENKKKALIAASRNRKSKTQSTDPGSDDESWDGLDG

SEQ ID NO: 25664 - protein, 170 aa, A.fumigatus
SLELRRLMMELLQQVYLDDPLPANRKHPSHTAESFYIDYPELEETKHLKRGLGLVTTISDNPPMLNWIYADTETHELKYGNRTQSVQHVVGPWDWADEETTITLEGKRAFMAVQEEDGSWAVYFDRDGDELEWVLEEEGKLDNPFAPIKLKRTMVPQVPQAEQSNKNDNS

SEQ ID NO: 25665 - protein, 67 aa, A.fumigatus
GSPLIANNQSASSLLREVLPMTTLVPREPYSKEELEKLYPKELQLQLVQVVCDEIQTYFPRRVNQAY

SEQ ID NO: 25666 - protein, 458 aa, A.fumigatus
PANHPQSYSGPSYRGGHSGYRGNSQNHGRDQRFSGSGHSSYNTGPSGRGRFNSFQWNARGGGGSVSPHTTHPEPSQSPAPLPAAGEQSFSGEGDRDQAFGSPSRDLQTLDQGSKPCSEDVDFPKISRPTQPSDTNATPNKGGKFSFAFKAKTTPAPAPKPVPDLAQRMQAREPPPRVAEPARSRVLLGPPPRFKPEPRFDRRDRDRDRDRHRNRERDRGRRDRRDFRRDPRDYREPRDIRDNRKEDRRFDQRHVGRKEDRRQDPRPPRGPRERSPGVKQPQVLTRPKPRPTLPEEYAKSDSVYYRKPGNESVIGAGTYGKVFKAIHVYTQRKVALKKIRMEGEKDGFPVTAVREIKLLQHLRNHNVVSLLEVMVERNECFMVFEYLSHDLTGLINHPTFTLTAAHKKDLAKQMFDGLNYLHHRGVLHRDIKAANILISNRGSLKFVFTTRGRKDPRMV

SEQ ID NO: 25667 - protein, 416 aa, A.fumigatus
RRLSGNSGSQPGQSRGPQSQPSQNPPGTSPSLHDRPAQGSQAVENEDSSRALVVILKSQAHIFFLHGNSHVIPLPFEVDSVFATPRGLLFQRKMQEEDTSIYPMAPPNSFISSFLTTDFRASESLELPSGKVKRPSLTISPAQNTALNCRATKTANLPRVFSLIDPHSEMGLVVTKQSSRWLQRSINSKPSGLDALDPADEIVYVSPVNELLGSSRALSKSPLTLVVTVNLNTGLYTLWTTRYREDETGPSSKKQRRRDTGGTRSKRRSSHFSMATGATTPAARPSAARESFGPRGDNWNASGFSHSQYSVDGRPDEDDLASRLGQDFGDLGVPSKTSRRVSSMLARTDLASSQDRIAFSDLATGSQTGTVPHGGLRQSIGGNSTRGSLGFNPRRSLPPGNWLRIQHSKQFRRCTG

SEQ ID NO: 25668 - protein, 166 aa, A.fumigatus
HWQCDVLVASFDATVLRTTGVKLVQHLWASDISAELAVDASSLEELLSEYKEHNHSWIVIAKQDSKERGFKVRCLAPREELDIRSSELIPWLRNEIRARNQREGAPDLRQSRLPSQSDAIAGANERSSDVRILVSQHRSKKTNRRNIVESGMSCSKNSHHCTNNQN

SEQ ID NO: 25669 - protein, 107 aa, A.fumigatus
SFEAALLRSREVVEKAINGPIAAIDTRDDLLEAIRDTRLSDPESWRSVIQSAPLTERKYLSQVHELLLDLSNECRANDGPDSVSNAFIYNYRTGSCLYYDLGRGSEK

SEQ ID NO: 25670 - protein, 76 aa, A.fumigatus
QAIYNHIITLSGRHIFYYYRFKSTDSSRLLSTSSSSSSSLLDQSFVETPANWSPVLSIICSGSALSAPPIKIAFYS

SEQ ID NO: 25671 - protein, 192 aa, A.fumigatus
GSIEQEDPQASIQANKREKQWLQILDRKHIRRHQRIPHHPTLHIHKRREKHHPQRKTHIDIRRRPLPRRMRTPRNGKHQQHQPRHQQPTPQPVHPDFPRFPALRKITRDREKRGHGRHRGQNPPDEEIPAPGEKPPAQPREENPHEETQRRASAVHAEKQVLPRPGGGTHYLKSSCLKADTQRALRLALRGR

SEQ ID NO: 25672 - protein, 168 aa, A.fumigatus
SKKIPKLPYKQTSEKSNGFRYLTANTSAVTSGSPTTQPSTYTNAARSTTPSARHTSIYAVAHCLGACALPAMANTSNTSPGTSSPPPSQSIPTFLVFLRSAKSLGIEKNEVTAVTAARIPPMKKYQRQVRNLPLNPEKKIPTKKPSAAQAPYTLKNKFFRGPGAVHTT

SEQ ID NO: 25673 - protein, 186 aa, A.fumigatus
CKGSMQGIMNASPLQIVAWTVPMAFGGLLISTVGGFIMHRIPGTILMLISCVGYLGSGLFFALIPENGGYWAFVFPSMICGTIGIDISFNVTNIFITSNMPLEKQGLAGALINCTLHLGIALHLGFADIVQVNTDDQGLRKSYQAVFWFQVALSGLGLVVNAIFVRISRAKSDLTVDERRALESNL

SEQ ID NO: 25674 - protein, 172 aa, A.fumigatus
VVCTAPGPRKNLFFSVYGACAALGFFVGIFFSGLSGRFLTWRWYFFIGGILAAVTAVTSFFSIPSDFAERRKTRKVGMDWLGGGLLVPGLVLLVFAIAGSAHAPRQWATAYIDVCLALGVVLLAAFVYVEGWVVGDPLVTADVFAVKYLKPLLFSLVCLYGSLGIFLLYGAL

SEQ ID NO: 25675 - protein, 462 aa, A.fumigatus
DVMMEAIEPLWGVPAADILGRVENALNAGQMSMIRFAISDHHVSHSMDNHAPWMADQITGWFSQEMLDTLPDLVFAVNVKDEPKVVVAHDALEQVLSQARTALHNSIGRDPELSQQVKFIEVGRQNAWEALTMSCSIDFPSRAFSKTTASSTVSEVGLLSNLTMSKDICLYPELRNLHAILQAPASLALTHSLVPIFSQAKPSSFQDLLYPSPWYAAKMDMMEYREQDDMDWEQKENLVYWTGSTTGGYSTTDNWRSFQRQRLVLWTGDKNRPVTLLRKSDSKGPSDNIVTWEAYNSTIASISSSLKIRMSAVIQCEEDAFRDQKAAFGFEDEVKDELRASYAAKYTLDLDVNGFSGRFYRLLRSNSTVLKHTIYKEWHDDWLIPWVHYIPVSMDLKDFPEIVRYMSKEPEGLALGQKIADQSRDWSNKVLRKIDMRLVFWRLLLEYARVLDENREQMHCCS

SEQ ID NO: 25676 - protein, 171 aa, A.fumigatus
DLPLRYGRSWSGEGKVLACCLAVNQTSGGRTKGRCSYLYGAATAVGMIRGGGGEPQKLRCLVGAGACGTTKSEKATYHVHVPLLSEDLDLLLGQSSETEHADLTGDVFPVARCALCLEALPQTLAHLRDTTAHRAQVLLPLSEELGVIENAASDARPIRRRVRNFRALQDG

SEQ ID NO: 25677 - protein, 137 aa, A.fumigatus
  UNSURE (14): Identity of amino acid sequences at the above locations are unknown.
AHRRLPISFRAPGXDASTANANIASQLAILQRSEISNPPAYGARIASRILNDPQLFAEWEEDLRTMSGRIAEMRKGLRERLEAKGTPGNWEHITSQIGMFSFTGLTEEQVKILREKWHVYMVSGFLAFCSSAGTSPD

SEQ ID NO: 25678 - protein, 83 aa, A.fumigatus
SSHLLQNFRGQHGKAYLFNTVVNVTHSEAVERNMTTGRHIVRDIFCRQCAELVGWKYDKAYESSEKYKEGKFILEEELLCVVC

SEQ ID NO: 25679 - protein, 150 aa, A.fumigatus
RVICHICRVWGIIIIIIIIIAPSILMGHPGEAYMPMTSYALLIIGMIYDWLANASTVMCKQLDLWILFPDQLMTTFDTIQAGNFLIRRIVHSSIHHIQLQIIEARESVDALMIKPLRIIIALVTTVDMKHTVLLLHLTGMPELMNDKCNI

SEQ ID NO: 25680 - protein, 195 aa, A.fumigatus
RWLTHARSFRSWVKSYMPYLQSLGHHHHHHHHHRTFDSYGASRRSIYADDFVRPIDYRDDLRLVSQRQHGHVQTTGPMDSLPRPTNDHLRHHSSREFLDPPYRALINPPHTAPNHRGAGISRRADDQTLADYYSPSYYSRHETYGSSLALDRDARTDERQMQHLGYDLDQNLPWWNCLSSFHQHSLLIFSSFRTL

SEQ ID NO: 25681 - protein, 63 aa, A.fumigatus
MMATALAPRIRPSSLNILESKNAKIPNALRRKNIYDAMQRSIAAGSTTFERVFTTGLEGRTGI

SEQ ID NO: 25682 - protein, 465 aa, A.fumigatus
DDSVFEITYSYIGPSSPDFALFFFVSPPRQIFYSVHLPSLFHPPGFNQSTTTTTTTACLVPPSPRYSMPHGIRAPGDGITGGYTGDSLALKITIATLAGITWYNAIELVILVFVTFSKYHGTYFWSLLVSSSIGLLPYSVGFLLKFFQLTDQTWLSVTFITVGWWCMVTGQSIVLYSRLHLVVRNPRILRRVLTMILVDAVIFHIPTTVLTYGSNLAGPVDAPAYIRGYNVMEKIQMTGFCIQEFVISALYIWETIRMLRLDPDRGKRKIMYQLVAINLIIILMDLGLLVVEYMNKYIMETMLKGVIYSIKLKLEFAVLGKLVYLVHNHVWKSDPIGVAGEDCHHQHYINHTAGYSHPDYHYPDFVDATRITSDLTRAVPPASSSANARRRCHPWMDSDDISIAMFEHSENATPSLPDQATGHSEISQSWSGETQRDVSPLDFTGSVHKQHNSISVSAPAPDKPG

SEQ ID NO: 25683 - protein, 146 aa, A.fumigatus
TNTSWKPCSRASSTASSSSSSSPSSANSSTSFTTMSGNLTPSASPARTATISTISITPPATPTPTTTTPTSSTRPASHPTSRALCPRHPRPQTLAAAATPGWTRTTSPSPCSSTRRMQPPRSPTRLPATPRSRSPGAARPSATSVR

SEQ ID NO: 25684 - protein, 246 aa, A.fumigatus
PSIENHHCDSGGNHLVQCHRTRHSRLRHLQQVSWHLLLELARLLVYWAPPLLGRLPPQVLPADRPDLAVRHLHHCWLVVHGHRPVHRPLLTPAPGRAQPTHPAPRSHHDPRRRRHLPHPHHCADLRLQLGRPRRRPGLHPRLQRDGKDPDDRLLYTGIRHLRPLHLGNHPHAAPRPGPRQAQDHVPARRHQPHHHPHGPRPARCRVHEQIHHGNHAQGRHLQHQAQARVRRPRQTRLPRSQPCLEI

SEQ ID NO: 25685 - protein, 76 aa, A.fumigatus
ITASMSAGSFAGAIAAGFISDRIGRRLSLLVASLVWITGAVIQCSAQNVAHLVAGRVISGLSGILPGHHSTELDRS

SEQ ID NO: 25686 - protein, 85 aa, A.fumigatus
NEDVRVMFSDFGRAKVTRKRKSSGQKPQLSKSKEAEDGYAVRGRCLGRLSHVIAWSNYYSSESKDLQRCGSYIPPEAYFNDQNSN

SEQ ID NO: 25687 - protein, 321 aa, A.fumigatus
RPLYLGSAKSNIGHGESASGVTSLVKVLLMLKQNMIPPHCGIKTKINHNFPTDLAQRNVHIAFKPTPWNRPVSGKRKMFINNFSAAGGNTALLMEDAPLREITGQDPRNVHVVSVTARSQTALKRNINALIKYINTHAPSSPANERRFLASLAYTTTARRMHHPFRVTAVGSSVKDIREVLRQRADQDVTTPVPATAPKTGFVFTGQGAQYTGMGKQLYEDCATFRSTIHRLDCIAQSQGFPSILPLIDASMPVEELSPVVTQLGTTCLQMALVDYWKGLGVPPALVLGHNLGKLPTLNSCGVLSTQRTNLPSWGRRAPFF

SEQ ID NO: 25688 - protein, 117 aa, A.fumigatus
RVLDKLTIKSITPPTTAHGPPTDAEWIVKTPYTTTEVQRQMELIKQLIKCNSQSPPTKATRQLAKAAESTMHKVLLLDQEIKGLHTANEKQKRKRATPRSYIATGGVLTGAEGQQLA

SEQ ID NO: 25689 - protein, 267 aa, A.fumigatus
RLRSWMLGPDWPSHGEIDIIEGVNTQPVNQMTLHSTDGCSIANGGFTGTLLTSNCYDYAPSQDTNAGCGIAATSSRTYGTGFNNAGGGIYATEWTSAGISIWFFPRGSTPTDIRAGTPNPTNWGPPLAKFAPGSCSFDAHFSEMQIVCPFRPRSICPPWVLPRADRWKTNKVFDTTFCGGWAGSVWGSGSCASVAPSCQDFVANNPSAFREAYWLIESLKVYQDAPGESNNMRMNATSHLNVQLPRKGGRRSPGLHGRGFLEGTGKW

SEQ ID NO: 25690 - protein, 200 aa, A.fumigatus
PSTPRTGAPSPMAASPAPCSPATATTMPPAKTPTQDAASLPPQAGHTGRGSTTPAAAYTQQSGPLQVSASGSSLADPPPRISEPAHPTRRIGARRSPSLPREAAALMPTLARCRLYVLSVPAPFVPLGFCRGLTDGKQIRSSIRRSAAAGQAVSGALVAVRPWRPRARISSRITPLRSGRRTGSLNRSRCIRMRLGRVIT

SEQ ID NO: 25691 - protein, 136 aa, A.fumigatus
  UNSURE (8): Identity of amino acid sequences at the above locations are unknown.
KYRYLFDXDGAGFSGRFLPFLQSHSLPFKTGLFRQWLDGRVTPWLHYVPIDVRLHGVWSTLAYFSKFDVPVTEGPDGQPKDTIQRHDARGKYIAEEGRKWAEKPLRKEDMEIYFFRLLLEWGRLTDDNRDMLGFKI

SEQ ID NO: 25692 - protein, 60 aa, A.fumigatus
KDWVTVALAVKSGPDNRVVEMVSTSGTQFIYGRLTNNEADLEPTKYPQSFWFWHRPISSQ

SEQ ID NO: 25693 - protein, 80 aa, A.fumigatus
  UNSURE (80): Identity of amino acid sequences at the above locations are unknown.
ILHGTIIQMFSMLSLPDLIPTVAAASMLSHLWSATVYPLVTDQLHVPGLSSSLFVNFVCDIPFAVPVVLVGGVFDWYSMX

SEQ ID NO: 25694 - protein, 251 aa, A.fumigatus
KAGDDRNGVDQCRFSLQRSHFDLFRLPSCEMVTMKLLYLTSFASLAVANGPGWDWKPRVHPVSVPLAGFVCCMLTASCLLQKVLPQMIHLWDLLQGAQQLEDFAYAYPERNRVFGGRAHEDTVNYLYRELKKTGYYDVYKQPQVHQWTRADQALTVDGQSYDATTMTYSPSVNATAPLAVVNNLGCVEADYPADLTGKIALISRGECTFATKSVLSAKAGAAAALVYNNIEGSMAGTLGLHHEARRIRDKV

SEQ ID NO: 25695 - protein, 85 aa, A.fumigatus
PSPYSVSIERDHKPIQVCKKGQPSVAVKIEGANQPMYGRQLEEKDTLYSHISRASIDTLKEFYRSDVSMEEWALIKKLKPVFDIP

SEQ ID NO: 25696 - protein, 237 aa, A.fumigatus
RNSCPKFAIMFPNKGGSRPALGCQDSLANALEQSHCRFPVYWLLDLNAAKEIIEEGSHVESGDLLTKVSRDHGGVSVQASTLGSFEALLEFLRVSKIPVANISIGLFYKRDVMMCGTMLEKAKEYAVMLCFDVKVDKEAAAYAEEVGVKIFTADIIYHLFDDFTKHMAELTEKRKEESKLLAVFPCVLRPVAVFNKKDPIVIGLDVIEGSLRMHTPISAVKTNPTTGAKEIIDLGRV

SEQ ID NO: 25697 - protein, 206 aa, A.fumigatus
  UNSURE (159): Identity of amino acid sequences at the above locations are unknown.
KMHSSAYADILPMTIGNRVSFEDCELYPAPDSCADPAYFPNESQFQLRSSHLQSIPKTHYFPAYMSWTHGSLPSHTAGPLSVMEMGLHPVLLSPDRVASPWSGYSSISGAESPGSTADGSFAHSNMMEPYPSPPYAYDDPRDSSVKAEQYSSPVTSITXSVALPQIQTYPEPRPMVKSPYSVTAPAQPNVFEEHNCSERIGSLGSS

SEQ ID NO: 25698 - protein, 64 aa, A.fumigatus
LGPLVCISLLGIGHGYMLTSQLGSQVTSWVISQEGGLTVGFITPLLVNFKNPIWFQEGNYRGTN

SEQ ID NO: 25699 - protein, 126 aa, A.fumigatus
YDGNAIGRNSKNLTVALSTLSTHTKPQPPSQDDEQKGSANDPLLRDIQLPPEIIDYVDAARNPDIYTREFVELVQRGNQDLKGKKEAFASFRDVLAREMRSAMPECRGEVERVLAATGGARADTEQ

SEQ ID NO: 25700 - protein, 149 aa, A.fumigatus
  UNSURE (126): Identity of amino acid sequences at the above locations are unknown.
CRRQNPTSRHYDYRLILGRVEALMTAREEEDILTLANLLRSGLVRNLGNITSPKLFLHAYAGTKLLIDDYITQVALSIQHIAALQTAPVHESGFTSQAKLELLHDTRQAFGKTTLLLQGGSIFGVXHLGVVKALHLQGLLAKIITGSGS

SEQ ID NO: 25701 - protein, 82 aa, A.fumigatus
IVRGSFQPRGEDQAPSVQSEVWEEERLPFYRPEQFYPVHIGELLNSKYRVVGKLGYGAYSTVWLCHEKGCALAFSFRDDDQY

SEQ ID NO: 25702 - protein, 89 aa, A.fumigatus
IRNTGLWESLAMALILLYGYVMRRGVLWLFLFEMMTSTNLDLASEQKYVAVKVLASNHQEQALSGELGIYKHLSRLKSSHIGSAYIRGL

SEQ ID NO: 25703 - protein, 121 aa, A.fumigatus
GTFDLVGPDGIHRCVVHPPMHMSLHELRMRSRDRRFSESLFKETLLCILQALDFLHREGNVVHTGMSPATADKREYLLEMTDGVTDIKATNILLRIDDESILQDFEKAEHQSPSPEKFLGN

SEQ ID NO: 25704 - protein, 178 aa, A.fumigatus
RPACDTFRSGAVEQLRVHARNLKELSTRENAGEVELYEKGYGKDAANVAKDAVEYGAANHFDVVLIDTAGRRHNDQRLMSSLEKFAKFAKPDKIFMVGEALVGTDSVMQARNFNQAFGTGRNLDGFIISKCDTVGDMVGTLVSMVHATGIPIVFLGVGQHYGDLRGLSVPWAVNLLMK

SEQ ID NO: 25705 - protein, 93 aa, A.fumigatus
KARIPGSYPLQAIVLLVARTRNMAFLLTLAALGCSAQGAVLPRASIDSDAVVGFPQTVPSGTTGEVYLAYQPYLKVVNGCVPFPAVDAEGNTK

SEQ ID NO: 25706 - protein, 81 aa, A.fumigatus
  UNSURE (70),(71),(72),(73),(74),(77),(80): Identity of amino acid sequences at the above locations are unknown.
VPPRHDTGFCWSVGANINSAGLAPTGASNGDCASSTGQIYVRGTTYGNYYALMYSWYCLHHGAGRIARQXXXXXQRXVNXK

SEQ ID NO: 25707 - protein, 134 aa, A.fumigatus
ERRNSSSSRSLSLSLNLNQQSQNNKKKTKRILPTTPRKILGLNEIPTTSAPTAKPQKKTRSQNNHNHNKNNPAPAEESLNRRDTAPTQTQKASPARKWTTTPQWRSPAAVASVPRCNNNNNSNKTAAHWAGSVV

SEQ ID NO: 25708 - protein, 275 aa, A.fumigatus
SLFLSSTMSDQENNSRPSSPTPNPTQTEEGAPPTPKTDTQTPTKKPPKLGKKKQQQQQESKPQPEPEPAEPEQQEENEENPPDNTKEDPRPQRDTHDVSANGEATEEDQEPEQPQPQQEQPRPRRRKPQPQRYRPDSDTESIPRPEMDNNTAMEKPRRRRQRPQMQQQQQQQQDGGPLGGLGGVNQVGDLVQNTAGNAVNGVTGSAGKAVGGLLGGNKGEKEDGGRDEQLRLTLDLNLDIEVQLKAKIHGDLTLGLLYVFFRRFPYPDGMIKCGC

SEQ ID NO: 25709 - protein, 341 aa, A.fumigatus
HLRQNTVDRLSPFLVALRSWENLKRMLQGRDCFEYHSIIGQTILTMSPRLSRKLTQLPTLFLGLPSLTITGNVSVRSFGIKSLNPPKPSRFNIGPELPVLKSTSTAALERKANTLPLRTGAIAIKKGMTAVYDAETGKRIACTVLQLDRVQVVSHKTRQTHGYNAVQVGAGWKHPSNVTKSLLGHFSTNGVSPKRHVYEFRVKDESGLLPVGQTINADWFQECQYVDARSYSKGKGFAGVMKRHGFHRQDRSHGVSLTHRSLGSAGPIQGGGSRVYPGKKMAGNMGNEQNTVQNLKVLKVDADNSIVVVNGMFSATQRSIQHCKWLIFILLHVPSAGLKDA

SEQ ID NO: 25710 - protein, 69 aa, A.fumigatus
LFADSVSYSVNSNYGTADDLKALASALHDRGMYLMVDVVANHMVRWISPLMCCLLIEPGICRCRRFGRL

SEQ ID NO: 25711 - protein, 106 aa, A.fumigatus
LNQGYAGAGDSVDYSVFNPFNSQTSFHPLCFISNYDNQTDVENCWLGDNSVPLPDLDTTNPDVQKIWYNWVNSLVSNYSSKDGLLVSAQKQELTDMLQSTAYELTL

SEQ ID NO: 25712 - protein, 159 aa, A.fumigatus
IPARRYTKDMALAKNAAAFIILSDGIPIIYAGQEQHYSGGADPANREALWLSGYSTTSDLYKLIATANAIRSHALSNDPGSVTYNVRRSHSRKEHTIKQGYSTPINTPSNKYTSTISIAKKPQRTPNIHRPPETRWLLETSYTPSLGLNTAIKGRTQLK

SEQ ID NO: 25713 - protein, 237 aa, A.fumigatus
  UNSURE (225): Identity of amino acid sequences at the above locations are unknown.
VSQTLDTPPRLTPTDQGPVPGRFIHRVTQWPTHPPVWLLGSTPISVRMRPTTTGAASYGPGLQNYRNPGPGVPPSVGPMSPTGVHSPSGTPKLDIGYSAPLDQPPNTDARRRPQRLDGAPPDRKPVRTAASPHSQASSMGSPRPQASPSAASFPQSSGTSTPNPSGTPASAASQKPTTQPSKPSAGGLPGKGPKTFEEMGVPTAQKDSDCVSFSFLPDRCNEPNXCLIITAGMEGMR

SEQ ID NO: 25714 - protein, 168 aa, A.fumigatus
  UNSURE (2): Identity of amino acid sequences at the above locations are unknown.
PXVPPTDEQREASLERARIAVLSSNDPEMQLAWAQDALAYVEVAVQNEARLSLIQPPRPQTPPVERQLKLDAMNIVNFLADQYHPKADFIRGMWLEFGKFGHRVDKKAAFRAYTRAADRGYARAEYRIGMQFESSGEPEKAIKHYEKGVALADSASYYVCSGQLFRHK

SEQ ID NO: 25715 - protein, 61 aa, A.fumigatus
YHGRQRLGMMILLGQHGQRQDYHMGLDYISLAAQSCDENAPQGAYVRDFLLIHSLNALSLT

SEQ ID NO: 25716 - protein, 278 aa, A.fumigatus
  UNSURE (205),(206): Identity of amino acid sequences at the above locations are unknown.
HDVRQVYGMLLARELPQVNVPESYLPLDLNAARVNIEKAAYHGFAKAQVKMGAAYELGQLGCDFNPALSLHYNALAARQGEPEAEMAISKWFLCGHEGVFEKNDELAFKFAHRAALSGFPTAEFALGYFYEVGIYVDVDLKEARSWYAKAAANGNKDATSRIDSISRSKTLSRKDHENVAIARIKSRYGSHQREISLESTQENLXXADPSRMSLSDTGHSAAPYPDRPGSGSRPVYPQGYSMADPPPSLAFGINPNIRANAPNYNRGRVLRPRPSELS

SEQ ID NO: 25717 - protein, 62 aa, A.fumigatus
FAQTLVLIQSGSTIRYRSSSLSHLRFTKDCVKWPNMVIGSIRLALYPNVNCTFLPIKSRQYN

SEQ ID NO: 25718 - protein, 67 aa, A.fumigatus
  UNSURE (5): Identity of amino acid sequences at the above locations are unknown.
EDRCXRGVPSKACIKIRHVDIWNLFLCLDSKIINYLTTINRLDTMIFKGLIDNLLVKGFLLYRSNYL

SEQ ID NO: 25719 - protein, 388 aa, A.fumigatus
  UNSURE (362),(379): Identity of amino acid sequences at the above locations are unknown.
VPKDTYAGWFLMCTMQEVKTDAGQNLSEYKENQDVTAPPDPIAEGTTSDVPIHGEKTNILFHPTPTISYKPMFDQLEKRATGVCLGSLCWCTLPRPCFWWLAMGVSYPWPVCTTTGIWLWMKEVIRSGREMEWSSEQLRGQTVSFTTLYVSKEHLLSQANQATANLLPESVEWMNTFLGVVWGLLNPDMLAPIADTIEDIMQASAPSVVENVRIAEIDQGNNPIRILSMRALPDEHVQQLKDNICEENKKNKDPQEAAAAEEGGSYYNLEASFAYHAKPSGQSASSKARNMHMQVVFFLGIQGLFGVPFPVFVELIEMVGTIRLRLQMMPEAPFMKEITYSLVGIPHIKAGCMPMVRHGINXLNLPVISNFVNYAHRTXCRLSQHPNQ

SEQ ID NO: 25720 - protein, 559 aa, A.fumigatus
  UNSURE (456),(504),(529): Identity of amino acid sequences at the above locations are unknown.
KRLSGDSLPMAGIQKQLRNMRRNKKAEEDKIKAMAAEMESEEERKLKAKGSMTPKASAGSQAPSATQGAKVDDQLWTTKYAPTAINMICGNKGAVEKLQTWLHNWHKNAKFNFSRPGKDGSGVYRAVMIHGPPGIGKTTAAHLVAKLEGYDVVETNASDTRSKKLVESNLLDILDTTSLQGYFSGEGKKIESTKKNLVLIMDEVDGMSAGDRGGVGALVSLAKKTHIPLILICNERRLPKMKPFDHVTYELPFRRPTAEQIRARLSTICFREGLKIPPPVLDSLIEGTNADIRQVINMLSTVKLDQQQLDFDTGKEMSKAWQKHVILKPWDIVSKILNAQTFSPNSQTTLGDKIELYFNDHEFSYLMLQENYLRTRPALAGNYQGKEQKLKLLELADNAASSISDGDLVDRMIHGTQQQWSLMPTHAVFSFVRPASFIYGNMVERPGFTSWLGQNXKQGMSPWCSICVSNINMACAGKLWRYVKEIQGHMRLRASGDRDEIRQXYIPLLWNKLVRKLMDEGKESVEDVXGLHGTVISSRADDWDALVELGLGPMEEFNV

SEQ ID NO: 25721 - protein, 223 aa, A.fumigatus
RRMRWGRWDVVLFLSGMLMAEADLINGTWERPSVYEKPVHRGRSTLSRLSSRKFWIALFIFGLYLGSAPNTGYKWTPFYMWTWKITPKTYPEPHRFPQTLGAVLIVFSINHSKDIQKLFVNRLSQYLGKISFAFYIVHGPILHSLGYSLMPNIWKITGKQTDFQYCLGFLIGWLICLPVSLWAGDVFWRAVDIPSVKFARWVEDKVLVKMTGQQNSTPNAHIR

SEQ ID NO: 25722 - protein, 82 aa, A.fumigatus
RQREIGAQPISKPLRQEQQGLTYASQISRKQLHRFEPWPSDYTIKHVLRNNRSGILIASEFKPRPRTFVPGADCFQRWPPWW

SEQ ID NO: 25723 - protein, 63 aa, A.fumigatus
QTVQASEITDANPWLWMTGWANYLQGISEQNLLDCVETPNKEPMDATEQCVQVIWVTMEQLAC

SEQ ID NO: 25724 - protein, 79 aa, A.fumigatus
LSFNHINKLNFLKAYPKAYTAIFLLDNIKSSFSVTRLILLNLEQVLSQLNIQLKTPIPPGSQSTDSILKTPYNLKQLKK

SEQ ID NO: 25725 - protein, 75 aa, A.fumigatus
  UNSURE (14),(34),(69): Identity of amino acid sequences at the above locations are unknown.
QGRPPSTAPNPMEXSDDDPTDEAWAMTDIKKHAXSFMLSCLTNAIATLNTRVHLCAPWLCLARGNTAGXTPRVIL

SEQ ID NO: 25726 - protein, 86 aa, A.fumigatus
NMIILLNLVILALRTLQLLMAYNMTVTAARGCLLRVLFCIYCLDSFVSLIPLLNKLLAFLDRESLCSFYLPPRLLPILKLLLMCSM

SEQ ID NO: 25727 - protein, 125 aa, A.fumigatus
TLESDHFVCVRQKLNEDDKPQVIIVNLKNNNETIKRPINADSAIMHWSRNIIALRAQGRTIQIFDLSAKQKLKSAVMNEDVVYWKWFSETSLGLVTDASVYHWDVFDPTQNQPLKIFDRLPNLSV

SEQ ID NO: 25728 - protein, 190 aa, A.fumigatus
GAVGCQVFERLPWDFWGRTGPGDVRGVLTTVASGLLYTLDLDSGANAWIGYQAMAGIGIGLAIQVPMMASQAVVRVEDLSTVSAIVLFFQCMGGAIFVQAGQAAFTNKLVQEVQRHLPNISAARVTSTGATELQSEFHGHELQVILEAYVAGLKDAFIVAIVLAGIATLLSFGSGWRSVKSKKEEPKAQP

SEQ ID NO: 25729 - protein, 117 aa, A.fumigatus
SCRAELPDVFEATPSVLQSRRAAVLSATPSVSFLVRYDYRISMCSSRLIKSEMRISQSRKMYGHCKTFSRCKQSIMAQDSTLHGIYDLATKVSPLLAFSELIFTVFALLRKLLGHDR

SEQ ID NO: 25730 - protein, 360 aa, A.fumigatus
  UNSURE (143): Identity of amino acid sequences at the above locations are unknown.
TRYFHPVVKIGSLGMLIMDYLQVSRQASEGRRAARLSRGLSYFVKGSSSFVDSQPSCSGSSAPTLSTPASSAMRANHLSAGSSHSFELPSKRSHSIDARSSSSVSDSKADNGDQNNSSGPDTPLPDWWAGSRRKGLKLDESHXSSWAYRRAANLLRESLELDADGGVIFLEVTNSHMLDFETGSDCSGENGPAAPVLAVSTRDEPFAPWPGSTVLYPAANLDSGFLHQLLRRYTKGKLWSFHRDGILSSSDDEKPNGNRSMKPAEPPRGSGKKWKQTENAMLNLFFPNATQVMFVPLWNAANSQWFAGCFCWNTVETRVFSPSVELSSVLGFGSSIMAECNRVQSLISDRQKGDFIGSIS

SEQ ID NO: 25731 - protein, 98 aa, A.fumigatus
VLETEKASLVHRPVIDIIGYRHELRSPLHGILAATEFLHSTDLDEFQLSLLETINACGRTLLDTMNQVLDFSKIISLERTWRQLKRHTLHLGTGRGRA

SEQ ID NO: 25732 - protein, 320 aa, A.fumigatus
RWDKCWREPNGYGLANLPEGRRVPGLEELIIQLEAKPGGFSFTEQPATKFTSGLTKRNWEEAGDPLATTGMSFKRKLAGDCARVEGCVHRSRADRRKQEEIFSSSYSASIYISRILKLPENKRKVFVIGETGIEQELQTENVPFIGGTDPAYRREVRPDDYKLIAAGDPSLLDPEVGVVLVGLDFHLNYLKLALAYHYIKRGAVFLATNIDSTLPNSGALFPGAGSMSAPLIMMLGEEPVSLGKPNQAMMDAIEGKFKFDRSRTCMVGDRANTDIRFGLEGKLGGTLGVLTGVSSKDDFLTGPIRPSVYLDKLSDLLEAK

SEQ ID NO: 25733 - protein, 199 aa, A.fumigatus
SEKRRVRPLICKVPVSQNHSRPGKNCGFLPAGGTSTSSTEHFAREETAAMASVAWSAMRQPLPLLLQTFQGLTTKNEDFWFRACPYFGRVCYAAGTVLFQEGDLPDGFYLLESGMLRAEYELPQGRYFELIVGGRPCGELPFFSETRRTATVKAEQDCVTWCLNADKWKQLREEEPEIAQELLTVSLKLTSERMDSITS

SEQ ID NO: 25734 - protein, 71 aa, A.fumigatus
ATMFATSRSQVSGPNLGKLMKATKMAHLCEALSGCCMNTNIIKTVLLPDMYLCIYYSSIASSEPVYAAKPG

SEQ ID NO: 25735 - protein, 291 aa, A.fumigatus
LRDVANIVAYVSLSLLVNVECPVTMESIPLSPFDLQGSFSNIPYAFFYENTQCENDFMPFDFLKGSLWASLQRFPILTGRLRARSTGHIVVEVDAGNPNQPDIRETLCDSVHWSQLKESSFAWDAWPAGVATVGPVATAAADGEIKLLNIHVMRLAQNSGVILFINIPHYVVDGVGYFAFINHWAETMRMQQQQQEQENEARSRFSFDRGIIQRYLPTERAPLDPLTASIYGQRNLLVDWLAWLSPTTLGGLLSKTAAMARGEAHLFRIPRASLDQGLHHGAERIHGGLLK

SEQ ID NO: 25736 - protein, 88 aa, A.fumigatus
TVRIDQTLMPPLWLRDFSGLDSYYFIQCHYHAELNSRQPPKATVPVSASQHFYIMAQRALIRQSKKSWLPGLLRTHRAIGQMLNYGYN

SEQ ID NO: 25737 - protein, 281 aa, A.fumigatus
LIVACPNYPRKAQRSPIFDSRWKGLAVRSTFLQTAPDPSAYDVFRCPFPRCNARYRRKEHLNRHERSKHINQQAFVCSRCGRKFQRRYLHAYAHPLITTNPLTLDVKISDTLRRHVQKQHKITEPLNRARRACAGCQAGKSRCEGGVPCEECVRRNIHCSLQDRPSIAEDQQTRSSTAPSSSLHREHSQLYWDKTKKWVDRYFDIFHRRWPFIHRGSFNVRRETPLLLQSMIVIGMWTSGEQSAQSAAVELYDQLDSAIQDQRVCLEHQSMMFLIYSCSES

SEQ ID NO: 25738 - protein, 87 aa, A.fumigatus
LVIMAHRSTRLMIPRMLTEVKTAAGRPPASHQTNYDIYNLYMNAPFPVTFASRYCEKSPALINHCVALQTLCAIISISDVSQISLSA

SEQ ID NO: 25739 - protein, 330 aa, A.fumigatus
  UNSURE (3): Identity of amino acid sequences at the above locations are unknown.
IHXYTLWDYFASIFTNNAKKWRDLGKQLELHATLFFWWLGVENSFLPTMKNHHVDGNSATRRWENSVNKIIISIFVWTILNLIEKIIIQLIAISFHLRTYADRIEINKFQIGSLTKLYAFSKAKIEADDDEFEEKNDQSGSGTKTPLRVPMQYAGKAQRIAKGALNKVTDVAGAVAADFTGRKATSSSHPYQVVLTLLRTTTGCQVLARRLYRTFVRDGFETVFSGDLKEAFDNNEEAEAAFTMFDKDMNGDISMEELEAVCVEIGRERKSITASLKDLDSVVSRLDNVLEFFVIVIALIVFLSLISTSAAGVLTSAGSSILALSWLFSA

SEQ ID NO: 25740 - protein, 62 aa, A.fumigatus
WDLTMTNVVQTTVNLKKVELPVKQIVSGKKIKPSGTLLNPQSLDYYYQFAEVEKLVNPRSKL

SEQ ID NO: 25741 - protein, 69 aa, A.fumigatus
HYHPKDTISAAMKTTMLTGAVGLFASAVQNTLTRKNVGPWGVFVRSGGTIGVFGTDAHLIDQLVYGIFF

SEQ ID NO: 25742 - protein, 68 aa, A.fumigatus
INWSTESFSDSCSPAAMGGTYEFVKNASANLREKDDHYNVALGGFFSGAILGLRGLLYFLGIRTYGNC

SEQ ID NO: 25743 - protein, 122 aa, A.fumigatus
FWALARTFPALLGYGAALATAMGAFEFTGGTLWGKKAQSDLDEFDRRTQVRKAYRTPAEQTFAELGEGRGVLLSKLSGHRSYGGFTKLFALGIYGPGYAERRAERLKETYGIEVPTSAAPAS

SEQ ID NO: 25744 - protein, 134 aa, A.fumigatus
  UNSURE (81): Identity of amino acid sequences at the above locations are unknown.
RARLTPSLLCLSPFERPTLPPAPPTPPSAPLDPPQLPTLPPPPPSPPRPPPPPPPPPPPAPPPPPARPPPPPLPPPPPPPXYFPPKTVKGYPPRPPPPPPPPPPPPPLPPPPPPPPPPPSPPPPPPPPPPPPPP

SEQ ID NO: 25745 - protein, 169 aa, A.fumigatus
  UNSURE (54): Identity of amino acid sequences at the above locations are unknown.
GGGGGGGGGGGGGGGGGGGGGGRGGGEGGGGGGGGGGGGGAGGITFDSFRREIXGGGGGGREGGWGGASRGGGGGGGGRGGGGGGRPGGGGGGGGEGGELWGVEWGGGGCGGGGGEGGSFERGKAQKTRCQPCSSLACGCCKNIVYIRHKNDRQVRKLKATHILSSRVI

SEQ ID NO: 25746 - protein, 63 aa, A.fumigatus
HSPSGSNLSIWISDASKPPDPHDADGEMAEFTPGGGSSSGVSHLECHILLGGSTAFRKRRRHV

SEQ ID NO: 25747 - protein, 323 aa, A.fumigatus
  UNSURE (319): Identity of amino acid sequences at the above locations are unknown.
GDQAEASAPDVNCVDRQKESKQFVRRGVRILKEWFRDHRDFPYPSEDEKARLVRETGFSRKRMSTWFANARRRQKERFDTPPAAQICRSGSPMPASRLTLMTPMERWQNSPPEEEAVPESAILNAISSWEVAPRSENEDAMFDSFLNLDETSSHLGSSLSSMGSRRSESSTSVSSAWSHHSGDSSLPFPLHHPRPRVRRRTRPRGPMNEGQYQCTFCTQSFKKKHDWLRHEKSVHLQLDAWICTPDLNDLQPGNLPSGCRFCDHRASSIDHWNDHEFEVCAQKPIADRSFSRKDYLWQHLRKFHGCTKLPIENLDQWRXARSD

SEQ ID NO: 25748 - protein, 142 aa, A.fumigatus
NHGYPHASISASETSQRTFFMLAMAASAEETNRQSNAGRRSVISPSEAPPEAEQSDVYQTPPPGLKEWLFILILCSTQLFVQGAFGYILIPLHIVGQTFGQGPSEATRMTWHVGGYSLTVGTFILIAGKLGDLYGSKRILVL

SEQ ID NO: 25749 - protein, 143 aa, A.fumigatus
ERFIYAAIFKLVIGRRGKLTVWIIPEFVSSCMHKINTPYLFATTSSLLRRLHMNIPSFLLRLRLRCLHPTTPLHIPSTLRSIIPNNPTFSHRHFHSTRIIMSDVVLQLTAPNGRKYSQPIGLFINNEFVPSKSGEKFATINPS

SEQ ID NO: 25750 - protein, 72 aa, A.fumigatus
RPSGKPYSVAFNDDLGEVINTIRYCAGWADKVHGQTISTTSAKFAYTLRQPIGVVGQIIPWTSSPRGRKNPR

SEQ ID NO: 25751 - protein, 81 aa, A.fumigatus
RNRDESEIASVYAAGEEDIDIAVKAARKALKDPSWKMLPATDRGNLMLKLADLVEQHRETLATIETWDNGVLPLFGLPASG

SEQ ID NO: 25752 - protein, 309 aa, A.fumigatus
LTAGGFLDRGEDIEGTIAALQRLMTYSTLVGIYPEWHPRLFGPLSRFSWSGAAGRAYIVRFVQEKIRGLSVKADPGQVERGPLATQNFVEKMMLARDKDPEKVTDYHVFMMGLSNVIAGSDTTAISLSAIMYHLLRYPAVMEKLRREIDAFATDGKCSDSVTFRESQEMPYFQAVIKEALRMHSATGLPLWKVVPDGGAEINGYFFPAGTVVGINTWVAHYDEEVFPDATTFRPERWIEAESNPEKLKAMTEMYMPISLNHFSRIPHTDDGNSALGTKDVFWKTLLPSWKFRNLIPPNRPENLEFHYHE

SEQ ID NO: 25753 - protein, 93 aa, A.fumigatus
WMMDAERTVAETRKRFSSLYSMTSLVHYEAFVDRCADLFCMRLREFAARGEEFNLGHWFQCYAFDVIGDITYGQRFGEWHTRVQWHGRVRATD

SEQ ID NO: 25754 - protein, 190 aa, A.fumigatus
  UNSURE (71),(76),(78),(80),(87),(88): Identity of amino acid sequences at the above locations are unknown.
RIPTIGRGGRGLECSIFPIFHDIYIPMRDYGSRIPDKQSKLHFLSLTSTTKMFFIIVIPMVILLYPFLSTXYTTSXTXSXRRTPGPXXTRLTKLWYFYRVRAGHFETDNIALHRRYGPVVRIAPDHYSISGSAAIKTVYGTGSKFTKSAWYEGWKHPDPNQWTLFPDRNIKRHGMHHPRCSLGSDHCCDG

SEQ ID NO: 25755 - protein, 144 aa, A.fumigatus
NVVLPALSCRLVMRSCGLSGMKAYIRKTIGLGNIFADLVRSRSDLFEIITKPAFCLTVFRIKSPSLQSNAESSVPRIDDASNAITKEVYELVNSRGEIFITSSVIAGVYAIRVVSANPAAEEKYLRRAFEILVQTAEEVLQKQQ

SEQ ID NO: 25756 - protein, 115 aa, A.fumigatus
SCHRKDTKFFEAQPNWRNVAHNSSRVLVTGATGFIGAHVVDSLLDRGITVRGATRSLSKGEQMRAARPDHASRLEFVQIEDFSKLGGFDHVMEGVDAVIHVATVCLSPCHSTQDD

SEQ ID NO: 25757 - protein, 78 aa, A.fumigatus
TYGSNVNDCVNSLHDMVKPPQFRKILDLNKLEPGSVVRSSSSHLLPLGQRPCGPAHGNASIQQAVYHMGPDEASGSCH

SEQ ID NO: 25758 - protein, 161 aa, A.fumigatus
VQLEAQKTPHRNPECPTPPFECNLAVEFTMSLRKTSCRACVAAKRRCDHRVPSCSRCCKRSIACHYPYPPPQAKGDKTTPLDDYVGSSLQLDPTLLSACGPSLTDSIQTTMISDRGDDPMWFPKGTPTSNQLWNFPQEMSAGVLFPAQQMVLLQHYPDWNA

SEQ ID NO: 25759 - protein, 282 aa, A.fumigatus
  UNSURE (224): Identity of amino acid sequences at the above locations are unknown.
DLPESQRWIFYINFPFIGVGTLAILLFLKLNIIPTSLAEKLRKIDFVGTVLFVGSLASFLIPLTWGGVLYPWNSWRTLVPLIIGACGLAVFAYYEVRFAADPIIPPTIFQNRTATVSFLGSLLQGLVLWCALYYLPLYYEAVKEYSPIVSGVALFPETFTVAPSAMVVGILTTRWGHYRWAIWLGWLLSTLGVGLICFIKVDTSIPAWIFLNIVPGIGLGLLFXSLGFAIQASATSDTLAIAVGMFSFFRAMGQAIGVAIGGVLFQKRLYHNLLQYPSLAPR

SEQ ID NO: 25760 - protein, 293 aa, A.fumigatus
CPLWHISLSPRAVFQPNFASFSSIFGRRPLVLVALAFFFVGTVVAAVAKNFTYLLVGRSIQGVGGGGLIALSEVIVTDLVPLRLRGQYFGILSAMWSVGSVTGPILGGGFSQDVSWVSFFSGGWTRSDKVGLTRIPALDILHQLPLHRSGNPGYPPFPQAQHHPDLPGRETPQNRLRRHCLVRRQPGLVPDPVDMGRCSVPLEFMADPCPSNHRRLWPGCVCLLRGKVRSGPNYSANDLPEPYRNCILSWKSPTGTCALVCPLLSALVLRGCERIQSDCFRSRSIPGDFHGSP

SEQ ID NO: 25761 - protein, 68 aa, A.fumigatus
TKKLSRGIVAVWYITKCPESQQHLDELRGASSAPISFYKIKSHFSFHCDLLQALECTEFYSDELSKEP

SEQ ID NO: 25762 - protein, 233 aa, A.fumigatus
  UNSURE (13),(19),(20),(47),(73),(146): Identity of amino acid sequences at the above locations are unknown.
NWPPIICDFACRXDTVGSXXPWYQPSLHQPLGPVNMSSTALPKRVAXHRNPTTESSVPSSVSHSPFDSLRQSXSSTSLSSMASDAEKTSSKMIDTYGNEFKIPDYTIKQIRDAIPAHCYQRSAATSLYYVFRDMAILASVFYVFHXYVTPETVPSMPVRVVLWTIYTVVQGLVGTGVWVLAHECGHQAFSTSKVLNDTVGWICHSLLLVPYFSWKISHGKHHVFTPGGWKISV

SEQ ID NO: 25763 - protein, 168 aa, A.fumigatus
LRGYALQQAKPVMLRNSIHKPQVLCSDDPILTYGFINLINMFEKLTPNLYDWISAGGGEGFCEMPPISSIQSSLCKPMSLDGVVEIQRVDILVTQQWLQAMIWKLSMAHVSQPGSREDAVLPFHLPLLVGKAVMDVIGAASQGSIDAHGIGMVSLDSHPPSLLTRPIH

SEQ ID NO: 25764 - protein, 153 aa, A.fumigatus
LSCISFQEQKLFDIGMAVADVTRSLGSKASHHLAESAVDPRELLWGLLSILSRIRGSPSYLFPTLLNRSKSILGLDCSISMSNFLPLITAPPSGPTPSWRDQSQSRWDLLTAAEPETEESDHAASVPVSVPASVSHIPSPMTFHDTHLLRAAR

SEQ ID NO: 25765 - protein, 66 aa, A.fumigatus
IGHFRQPNIIFLAYLFKSRMIGTLGDGERYMPYGGGSLCLLDSNCEMEIILYFSSKGTLLNNATEE

SEQ ID NO: 25766 - protein, 199 aa, A.fumigatus
SAFPSSPVVKTPTGVAASAGDPEDKEVLNYHILLIENMNHYIEEVDVRGLPVLERWRDRAQQDYEEHLKLYLDLVIQRPLGKLLEFIDAAEGLMAGGGNPADIASRPSHSRSVAKKVLAMYDSKEIRRGIELLKKRVDKHFGDADDPGLSRSLVLKVLRACERRYEEAYDRTRHVLDAVYEGQLDLEWRKEDVIAMFNR

SEQ ID NO: 25767 - protein, 368 aa, A.fumigatus
  UNSURE (291),(345),(362): Identity of amino acid sequences at the above locations are unknown.
STLAQKRKKRRCLRKILITPLLRHPLTVKPVYLALHIRIRPLIRHGALPRPLPQRGKLPVALFLGRALAQMQRPPRRSRQLDQRICPVLAHTLIHLQRLGDARRRGVRHAAQGDGDRRAVLDRLRGALCEMRQGGVAGVADEGGLFVDPGGEGFVDAQLPLADFAFGHVVEHALDEGAEVGEDTEHGGLGALGGVGGVGGGGEVGVGLGGGEVVDGVVGDRVGDDVAALADPADHPVAVDDGLQLGVVLALVLVNHDAVGGLVGVLDGGGDAERLQHRDARLGLDAVGGEXDVRLDRVGGAAVSGDGCKGCTRGERGHILRGRGKMELDLVGATPNTPCTRRWPXNAVGDHVEGIRMFRRSXRVERAR

SEQ ID NO: 25768 - protein, 142 aa, A.fumigatus
QSNPYISRCTSASAHLSGTGPFPVPCLSAANCLSRSSLAAPSPRCSARPDAAASSTSAYARSLRTLSYTFSALVMLAGEGSGMRRRAMAIVAPSSIACAAPCARCGRVGWQASPTRAVCSWTQVGRGSWTRSFHSQTSPSGT

SEQ ID NO: 25769 - protein, 331 aa, A.fumigatus
  UNSURE (54): Identity of amino acid sequences at the above locations are unknown.
WPTPCTRGVWGCPDQIKFHFSTAAEDVTSFAPRATFTAVPRDGSAPYPVEADVXLAADGIKSKTRVAMLQTLGITATVKDTNQAAYRIMIHKDQCQDDPELQAIINSNRVIRWIGERRHIIAYPVSNNTIYNLSTTQPDTNFAAATNATYTTKGSKAAMLRVFADFCPLVQRMLNYVPEGEVCEWKLRVHEPLPTWVHEQTALVGDACHPTLPHLAQGAAQAIEDGATIAIALRRMPDPSPASITKALKVYESVRKDRAYALVELAAASGRALHLGEGAAKEERDRQFAALRQGTGKGPVPDKWADADVQREIYGFDCQRVTEERCDEYFA

SEQ ID NO: 25770 - protein, 137 aa, A.fumigatus
SAGSASAATSSPTRSPTTPSTTSPPPSPTPTSPPPPTPPTPPRAPRPPCSVSSPTSAPSSSACSTTCPKAKSASGSCASTNPSPPGSTNRPPSSATPATPPCRISHRAPRRRSRTARRSPSPCAACRTPRRRASPRR

SEQ ID NO: 25771 - protein, 275 aa, A.fumigatus
  UNSURE (7),(25),(78): Identity of amino acid sequences at the above locations are unknown.
LGHVQLXYFGETYGYPQHGRPPHLXANALYKGCLGLPRPNQVPFFHGRGGCDLVRPACNLYSRPPRRQRPLPGRGGRXTRRRRHQVQDARRDAANARHHRHRQGHQPGRLPHHDSQGPMPGRPRAASHHQQQPGDPLDRRAPPHHRLPGLQQHHLQPLHHPARHQLRRRHQRHLHHQGLQGRHAPCLRRLLPPRPAHAQLRARRRSLRVEAARPRTPPHLGPRTDRPRRRRLPPHPAASRTGRRAGDRGRRDDRHRPAPHAGPLAGEHHQGAEGV

SEQ ID NO: 25772 - protein, 70 aa, A.fumigatus
LWHSARQRRTHIPNPTTQYVAYQKLTSPPFAPVAGGYHGATTMYRFERMEKPTTTFHALYPEGGMLCRLR

SEQ ID NO: 25773 - protein, 104 aa, A.fumigatus
DMLGSSAMRYSYRQNPVKTLRWSAPLSLLLVATLYMLANIAYFSAASKEEILGSKVVAASIFFQKVFGTSSASRALNFLICLSAFGNLLAVLIGQSRLLRECGR

SEQ ID NO: 25774 - protein, 97 aa, A.fumigatus
SVAVPNETRQGVLPFTKFWTSTRPFGTPLGPYALKWALTVLMILAPPAGDAFNFGAIFSPTNIHVYTDVRSRRPGRLPHQCIRLIPRHWTIAHPSSP

SEQ ID NO: 25775 - protein, 212 aa, A.fumigatus
RISIGITGLVVLGGHTKIEDPKANFRDAFAGSSSASVYGATNALVKVAFSYAGFENAFNVVNEVKVGHAWIFRYAILISAESCQNVAMERAALPPARSNPIHARQHRLFLRRIKGRDPRLKGRGGEYLLPESLRHEQRVTSPELLDLSQRVREPACRSYRAVPSPPRMRKVSQCHAWAEASPSLTRPDKESSRSPSSGPRPVHSARRLGPTR

SEQ ID NO: 25776 - protein, 144 aa, A.fumigatus
HRLRFRNTGNSAMDDTQIEHPRPIPIFYCCYLLRSTVRHASLYIGSTPNPARRLIQHNGVVKGGARRTAAEKLRPWEMVLVVEGFMSRLAALQFEYVSHYLSCVQNLTFPKMGLAKSLVLTPLTIRRKLSSRGGQAQENEESKI

SEQ ID NO: 25777 - protein, 87 aa, A.fumigatus
KTAFRMKFRYFKYLVMLFRLTNTPALFKRFIKEVLHKVLHCFVVVYLDNILIFSENKEEYVEYIREVLQELQKANIRLKLKKCEFHV

SEQ ID NO: 25778 - protein, 80 aa, A.fumigatus
FIGLMNYYQQFIKGYIKIMMLFFELLKKGKEFEWTTECEIVFTRIKEKIITAPILVQYNLDKETTIKTNATDYTIRMRMT

SEQ ID NO: 25779 - protein, 127 aa, A.fumigatus
LHVEPLLIKPLTSILVRYMEADLTCYLGKGHCIALASSCIYSTLSFLCAWNHAIMLFSPFLCPFLSASLVWISYRRVDDNRWFLVSSMGYFKILTNTLKRNLYYYDYYYYYYYLTILMHDAAGLGLS

SEQ ID NO: 25780 - protein, 76 aa, A.fumigatus
DRSNCLRTSSANEEVHHYGGIHKRTVEMNSLHKSASPQTRQGDMAAKISLNLFLEVIYINSTAIDNMEPLLTLIGS

SEQ ID NO: 25781 - protein, 155 aa, A.fumigatus
ELAHGLRYTTFGYSHLRVQALNSSSSAYVPTSGETKPAPTYGEIGSAADYLYPEGLKRITKFIYPWLNSTDLEDSSDDPNYGWEDSEYIPEGARDGSPQPLLKAGGAPGGNPTLYQDLVRVSATITNTGNVAGYEVPQLVSDPHVPCVAIWLTRF

SEQ ID NO: 25782 - protein, 77 aa, A.fumigatus
YVSLGGPNEPRVVLRKFDRIFLAPGEQKVWTTTLNRRDLANWDVEAQDWVITKYPKKVHVGSSSRKLPLRAPLPRVY

SEQ ID NO: 25783 - protein, 602 aa, A.fumigatus
  UNSURE (284),(576): Identity of amino acid sequences at the above locations are unknown.
AIRRTPAKAGQSCTTDPELNIICFSSLVHSDCAGCCRSAVDGLSGGRWACQTESDTGTLGGLFDSAIEVFGKWDSPELEPAAENALVEFKDQFSDVFGQALMGAAKEEVSFRVTALEGFLRLSILRDYFQDNEIGLFVQYLDEILLKEECAGRGDLKKKAIAALAEISKHKPRLIMDITFPAFVATLPDSDEGPNTDYITTLENLAQISVERDIFETLVRRLLSKLTILLQKERAGSIAYPRAILMTILYVMKQRNLDKDPNLELYYDKIVRGLCRGVADAATXKSTNRILNDAVVIDILGRLLQSHWFGVCRSKNQDEIAQNVYTLFASSSTFTPVPFSQAANEDQQRTMIISTYLLAGLPADCAHLPYSGRDLAPLLSDLVTRSLTECEPPTHLAFLRHSALLVNKFLPRPELSVATNILNKLFSAGAEEKKVPSGTIKTIFWLSKALIIRLAPTTTEILTSLLSLLSSHDELTSTTAARGFAILLKDDDVLSADNGANIRLLAKQRVFTTLTPLISNRIREVNVAGDDSSTPAHIKPAHLTALSGILSTISPSLVMPELPTLLSLLLASWDLXNADSQGVRAATLETLARIIPENGRRI

SEQ ID NO: 25784 - protein, 419 aa, A.fumigatus
  UNSURE (389): Identity of amino acid sequences at the above locations are unknown.
GNILGSHADSCAAKRFSGMQLQPQKHYNYILGSMLSIKFLPLHPDVNRTSKSACMPSSTPMSSSTMASPIMDTVSEQPPPEEPISNPDHIDGVAYLYGHPLLNSLSPPLHQTIYQSLGLNWTQIPLSSVYGTSETYPPPYTRSPPIPKFLASIKSNPKFVGSSVTMPWKVTIMPHLDDLTEDARQAGACNTIFLRPEADGRTSYVGTNTDCIGIREALLQNSTGEKAFRNKPALIVGGGGTARTAIYVMRKWLGCSKIYVVNRDAAEVAAILEEDRQRNPSSDKAPLIHVTDRTVAARLEPPAVIVSGIPNYPPKTPGELQAREVLQVFLGEAPATTATPKGVILEMCYHPVPWTEIAQLASTAGWKVILGSEALIWQGLEQARLWTGXDVVAEPGLVEKVKEVVGKLIAERVPSKSNL

SEQ ID NO: 25785 - protein, 66 aa, A.fumigatus
  UNSURE (2),(37): Identity of amino acid sequences at the above locations are unknown.
EXWSQRESAWNPETDPIEEARLASRLYLVFRPVGPSXTETGRQTQERTVSEVWKRVRELDYTRPGA

SEQ ID NO: 25786 - protein, 96 aa, A.fumigatus
  UNSURE (12): Identity of amino acid sequences at the above locations are unknown.
LSLLGQAPQPRXYQSTAVPAPGPARSTPPNQESPSTQPWRPAAQSPSTGQGDSTSPESRLWGLPSLPGPPLETLAALPWLGAPPAFWEGNWGSPRQ

SEQ ID NO: 25787 - protein, 100 aa, A.fumigatus
LARSGLAGPGASLSAGFAFGIPPIIKYGSKDLQERFLPDLLTGRKRGCIAITEPEAGSDVANITTTATKTPDGKYYIINGTKKWYLLEDILQLMEVSNTH

SEQ ID NO: 25788 - protein, 136 aa, A.fumigatus
SVERSYLNLNQDQLDLDTLSSQRTMAEVSPNPIPFSEPPYLRGLPSPYYTASHRRFQKACRAFLWEHLLSHAMDWEKAGTVPEHVFNDFCKHNMLLPNLPAPLPVDWLKKLGIHDILGVKVEEWDYLHTGIYCDEV

SEQ ID NO: 25789 - protein, 64 aa, A.fumigatus
SILIVCMVGAAGCWMWVQVETPEWIQEVEPRYASVNVQLTFIALWTRQSFGQGFQLAIRRYIAP

SEQ ID NO: 25790 - protein, 164 aa, A.fumigatus
LLNSSAILLQVQAALIVQPTATPQQILVGTQIHYSLQAISLAAFLTAFTILEINKGDHPRLTSLHGILGLITYICIILQALLGLVQYFFPVKILGSADAGKRLYKYHRHFGYLLLVLELATVSAATQTTYNVAVLHIPLWGVLVAAVLIVAGVGARIKKHKLGF

SEQ ID NO: 25791 - protein, 96 aa, A.fumigatus
TQPTYYFKLQASYHQTSGWISNLSSITHISTSKTFWKTLTDFYSNIILMASATGVPQEHPQTIEAREDEPLLGRPGAVTQRESDPIYRNLIKGRRC

SEQ ID NO: 25792 - protein, 291 aa, A.fumigatus
IACPSSPVVKTNVGGSLLMGFFLEDKNLFREEWSQPPPRNPSEDSDAARQYAQNHKSVKKTIPLYIGLTTGFCGSFTSFSSFIRDVFLALTNDLPDPSVSSITSRNGGYSFMALLAVLLTTVALSLSALICGAHLALAFDGFTPSFPFRLTRRVIDPLFVLLGWGCWLGAVFLAIWPPDRSGSSINAPDTWRGRAVFAIVFAPLGCLLRYYLSVYLNPRVPAFPLGTFTVNIFGTIVLAMCFDLQRVDGVGTVIGADARSAPYAILTSCQVLQGVTDGFCLHSAAGRNTPP

SEQ ID NO: 25793 - protein, 157 aa, A.fumigatus
CLPRPDKRPPRPLRLINHFPKWRLQLHGPPRRPPHHRRPQPLSTHLRRPPRPRLRRLHSILPLPSHPPRHRPALRPAGLGLLAWRRLPSYLATRSLRQQHQCPRHLARARRFRHRLRPARLSPAVLSFGLPQPARACVPAGDFYREYLRHDRAGHVL

SEQ ID NO: 25794 - protein, 76 aa, A.fumigatus
VRGCGALISRYSQFEPCRYGSACFSGGAPHEFVGVWLIATPSGISAPLAHSYPIVGKLTFIVTDHADAVTIIPALI

SEQ ID NO: 25795 - protein, 165 aa, A.fumigatus
PNLTQLVLYAALHSLYNIYLHSLSRFPGPKLWQTSYIFRHIASIRGTLDVSIKAFHTEYGPVVRYSPDELSFISAEAWRDIYGFRENALPKDPSLYGLIQLSRDKSPSIFTADQDHHPRVRKALSYAFSEKAIRDQEPFVKHYVDLLIQRLRGIADAEDNRVDIV

SEQ ID NO: 25796 - protein, 263 aa, A.fumigatus
EESTLTSLFTQSSRIPRQMSFLMESSAVGQPSPLSFSNTLNALLGAVRTQFTTPGVKRLTHNLILRSSSYMPPCTVCITSTYILSLASPAPNSGKPATSSATLPASEALSTYLSRHSIPNTDRWSAIHPTNSPSSPRKRGGTSTGFARTPFPRTHPYTASSSSLGIRARASSQQTRIIIRASERLSLTRSQRKRSATRSLSSNTMLTCLSSDCEASPTQRITGSILCSGTTLPPLILSATWPLVDHSTASVFYQRSRRIRAKN

SEQ ID NO: 25797 - protein, 60 aa, A.fumigatus
LTLLSSSCVILDPIYSVDKSFILSHLRVWVYSVDNWNYDDWGRPHRARQLGYMTPLNNLH

SEQ ID NO: 25798 - protein, 64 aa, A.fumigatus
TLTLPKPLVEFGNRPMILHQVESLAAAGVTDIVLAVNYRPDVMVAALKKVHRSLLLHGLIRSCG

SEQ ID NO: 25799 - protein, 61 aa, A.fumigatus
SAIVARSTKNNTTSEIEFSVESETLGTAGSPETGKKKFGARKNSPLLPFSTSDNNLGITPL

SEQ ID NO: 25800 - protein, 185 aa, A.fumigatus
TGGNGMGISPQIEQWVTLLIFGALARAPRNRMPGVSGEQYAVHMRDVVMAMVGLTHTMNTRVGKDFVRGVSGGERKRVSIAEATLSGSPLQCWDNSTRGLDSANALEFCKTLNLMTKYAGATVAVAIYQASQSAYDVSSISLPLSAALALIRLLGIRQSDCSVRRKTDLLWTHRRSQGILYQHGI

SEQ ID NO: 25801 - protein, 115 aa, A.fumigatus
VFDKVTVLYEGRQIYFGRTDEAKEFFTNMGFECPERQTTADFLTSLTSPAERVVKPGFEGKVPQTPDEFVRAWKSSEAYAKLMREIEEYDREFPIGGESLNQFIESRRAMQAKNQ

SEQ ID NO: 25802 - protein, 361 aa, A.fumigatus
  UNSURE (246),(341): Identity of amino acid sequences at the above locations are unknown.
LYYGLGYRKCFLQPAGRHKQFLRSWCFAFLCRAAQRLFQCPRGESNWLMWDYHQPADCLQILTLYAQRPIVEKQARYAMYHPFAEAIASMLCDMPYKITNAIIFNLTLYFMTNLRREPGAFFVFLLFSFVTTLTMSMLFRTMAASSRTLSQALVPAAILILGLVIYTGFTIPTRNMLGWSRWMNYIDPIAYGFESLMVNEFHNRQVLCPDSAFVPSSGAYDSQPLAYRVCSTVGSVSGSRYVQGDXYLNQSFQYYKSHQWRNLGIMFGFMFFFMFTYLTATEYISESKSKGEVLLFRRGHAQPTGSHDVEKSPEVSSAAKTDEASSKEATGAIQRQEAIFXMEGCVLRYRLLPQRVEGSAR

SEQ ID NO: 25803 - protein, 135 aa, A.fumigatus
EKSKSTIGSSQLVASRSTSLSSLAEPCRRRTSKSEAFSTQVPCAKSLRRRVKSPYTISVWQQIELCMIRGFQRLKGDSSLTMSQLIGNFIMALVIGSVFYNLPDDTSSFYARGALLFFAVLLNAFSSALEVSQIG

SEQ ID NO: 25804 - protein, 213 aa, A.fumigatus
RFDSANSSNIITKPVMDRLFSKSTSPQPVYTFALDSSGETITCAGRPAFQLATQKSKPHLTVSRLPPPGPWSPAPVPVGTCTVHKFPSSKVDITLHGQEFMLKRDLLKSDNHHFDYPPLGHFKWKPDAWGGSKLELFDSGRRLLARYDKKLSLTGKGQQIEVFVPGDERFVEMVIVTALAMRHYIEVENKDIQKVTDILESSPRGWKDARVGY

SEQ ID NO: 25805 - protein, 73 aa, A.fumigatus
  UNSURE (41): Identity of amino acid sequences at the above locations are unknown.
CLPVTIPGNTCGGSSHFLSGFPLKPHCSPVTPQISNPKSIXYAFPATLLPTFVPLGLSIKIRPPGPISGKFTL

SEQ ID NO: 25806 - protein, 412 aa, A.fumigatus
VLSYTGLWSSLPRLALFGGLYYGFEWFLLVRWSATIPVLEFPADLLFYNFAMPLAIRSIKPSDGLHKLYNWWFHKCARFLRLSSFFFGERHTDEEGYHVRRTWFDLLSGKKGDTEHPIVGEPERRRADEKQLAAYFVRDGKFVRAPASDQVRIPKGKPVFLEVTDNNERVDGAPDPDEGLHGRANDMFTKVYIPPSFRTRIAAFIFLIWVFAATTGVGTTIIPLVIGRKIMLACFPDRPLNDIYAFSLGICIVGSVAYLMFYCRTFLATIQDRLRPYLRSPQQALLGFGNAALSGLRLAYIVLAFSVLLPSLFALVMELYVIVPVHTYLGGTRAHIIHFVQNWTLGVLYVQMAIKFALWHSTSRPAAALNGVFRNGWLKTNVRLATRANNAFLSQSLATLAVAPPTFFRGSH

SEQ ID NO: 25807 - protein, 171 aa, A.fumigatus
QRAFLARTTLKMPSDDDLKAHAASNQDFYALLDIPPAASESEIRRAYRRTALKYHPDKIANPTQTDIDKFHLLQIAYDVLSDPSIRQLYDNAREARERKKRELEMMDAAKRKMKEDLEARERAGAVAMGGAQRGVKRTWMSAGMAGADDDDDEFFGRTLNVLYRHAGITHP

SEQ ID NO: 25808 - protein, 246 aa, A.fumigatus
HEQGRHIQCRYHTASLPEPWGRPIYLHVCLFAPHAHSHSPTLTEPSYRQNPTVRQSVDTSGNLTTVNTSQAAKVHTYLLPFDAPVPTKPRENLAPIHTLDPTLRETIALVEDLFKERPAWTRRGLRNNLKTPEQRYALRHAVPYVGYIFRSGPWRDAIIKFGHDPRTSPAYRIYQTVMFRILSGTSELARDAGSGRRHTIPRPNEVPTGTDAFTPLPTDTHLFTGTPPLPPEGRMWMFCDITDPLL

SEQ ID NO: 25809 - protein, 204 aa, A.fumigatus
PSQVTVRTQPSDNQSTPPATSPPSTPPKPPKSTPIYCPSTHQCLPSPARILHPSTPLIQPYEKPLPSSKTSSKSAQLGLAAAFATTSKPRNSATPSATPCLMSATSSAQGPGATPSSSSAMTRAPPPPTASTKPSCSASYPAPRSSPATPAAADGTPSHDPTRSPQAPTPSPLYQQTHTSSPALRPSHQKAACGCSATSPTRSC

SEQ ID NO: 25810 - protein, 271 aa, A.fumigatus
HVVGLQMVPSIFPSAVQIELLSRLFHRDLSNPEHRTNLHLHYHLTYPGQAASQTDTAVSAPEDGSTVPQTVSFFEEDSSNVLFPKDPQVHKPITVEQMLTKKLRWVTLGGQYDWTAKEYPSGPPPCIPLLILAKLLRTAFPQTKAEAAILNVYSPGDTLSPHRDVSEECDVGLISISFGCDGLFLISHDDGTDCEIIRLRSGDAVYMDGTSRFAWHAVPKIVPGTCPDWLADWPCKSETPDKTAFGKWRGWMAGKRVNLNVRQMSATDSHG

SEQ ID NO: 25811 - protein, 61 aa, A.fumigatus
IQNSLDSSYLRLPGPFSEAAGSLFYGPDIAADPDFGETLLRYLTFSSYGPNMYGRLSAGSY

SEQ ID NO: 25812 - protein, 62 aa, A.fumigatus
SCLFSYHADYSRHSHDCNSSNYNYIPNLQTLDLVEPLRGRDLLSDSRTLPKTKAGFTEITFY

SEQ ID NO: 25813 - protein, 76 aa, A.fumigatus
AVFEFLIVFVSGFGFLFDLLAFMMFIYTYSVQTCWPDDTYLVFAKAITSELVSDLTCQCHLISPNVFSPESGAVSL

SEQ ID NO: 25814 - protein, 159 aa, A.fumigatus
EHPLSVRLRYPRLSLAHILLTVHLQLSPSVTMPSMHDRIREDLIIKERALWTALTSADPGPAIEKLSHQEVNMIFPQTPILTLEGENKIQDAVKPPFHRFDTYSLDEVRVIIIDLMAGTVTYRVTATRGNKTYRANGSTTWQQASDGEWRIICHQETLV

SEQ ID NO: 25815 - protein, 100 aa, A.fumigatus
VGGTVQTCSYSLTQLLISRFVNGIGTGIMSTLVPVYQAELCEARKRGKLVCSLPLAVGVGIVLAYWFDYGMTYVTGSISWRLPIACQEIFAVLVVILVAG

SEQ ID NO: 25816 - protein, 78 aa, A.fumigatus
LCAFPGYNQGVFSGIINNEDFLNIVNHPRAGMLGFLVSIYNLGCFFGTFIAFMTTDRLGFQKSMWFSMVYVVVSAARE

SEQ ID NO: 25817 - protein, 161 aa, A.fumigatus
LWYDLCYGVNQLAITYRLSGNIRRACSHFSCWVSRPVPCTTALEFILVRSNGCDRLPESPRWLYRKGRNEEALQVLCEVYDRAPDHPKVLAESEGILQALELESARGEYRWSQIFLKRDDLQTGRRVLMAYGLQFINQMGGTNIIVVSDPHARLQAVRTDK

SEQ ID NO: 25818 - protein, 75 aa, A.fumigatus
RLHLFGVANWLLVSSNRLQTCMRVTYNDDIGTAHLVDELEPVSHKNPSTSLQIISLKEDLRPSVFSTRAFQLECL

SEQ ID NO: 25819 - protein, 229 aa, A.fumigatus
SVIRSERLDSVGQKARLPRSVQALYLRPLRRKPEFGLPVCDLQLRSYSVRNLEFFADFALRAAYYLELPVSGPVPLPRIVERWTFPRSNFVHKKSQENFERITLRRLIQIKDGHPQAVQAWLAFLRKHAFYGVGMKANVWDHESLGMASSRYTYCLTKIVSSLYAYGLLNLDVARNMDESLPDIEKSLEPYLSHFGYRSDGSDQSAVFDLLESERFTHNKSPLTDIRKG

SEQ ID NO: 25820 - protein, 152 aa, A.fumigatus
  UNSURE (140),(142),(143): Identity of amino acid sequences at the above locations are unknown.
PIIDILGVPDETVWEYGEALRRMAVEKELHHVKFIRLFELLEHPWIPLTSAEQAKSYYLAHAQCLRRELMYRFEDRSFDADAAIRSDNDTCLTYRGYIKFLTKDLAPQMDTQYTSKKARAAHIAQIARSMIVRGKMFAAXSXXEQTRIPQKV

SEQ ID NO: 25821 - protein, 214 aa, A.fumigatus
GTRRNEASLQQPLSEVDRHEQPAASDNTQSGLDIPPVTVSTPQSSDNPLVESKEAVPVTFKDEGKGTKDDPSHLLAEALETTNGEENSPISEDEATAIAVLKVIERYGVNFEKTGESWQGLTSFIPTVVEQVKKREAVRMILPAFPFKSPNARDKVLGVMPDLGEELALYHLNGLCENIGRVYEPGADVYISSDGLVYNGKSLLHSPRFHRANQ

SEQ ID NO: 25822 - protein, 244 aa, A.fumigatus
  UNSURE (1): Identity of amino acid sequences at the above locations are unknown.
XSLHRGSFQPRGEDGNIPLLALTILSSSWTTGSNAVGITNLVSGTAAAGVTGPRERETVITQEIPVKVLHESAVEGLHEPRCRDPDVHIILPSLAHLKSISERFSKLAGDARPAASGGIVSSTLTSPKLELSANMHGSLRLAIATDALRISSVWSDLVNPPLDPAGMSQREIEQLPSERMRALGSDDEAGWAKVRIDAKDWSRVLSIGRLSPKVVACELYYGGCLCLRLYACANTPTRLSRFYP

SEQ ID NO: 25823 - protein, 81 aa, A.fumigatus
TFCNKPCVGAEYPVYLTKTPLLFTIQYGDALSIWMVTGRSADSNATCCKGYILSDERDRHISSYLWIPLKLMLVFENSDSP

SEQ ID NO: 25824 - protein, 73 aa, A.fumigatus
AAMVAPRHNAYAEESAEVEVLYANLEKLKLLTKKIQGSLVRLETGGNVVKHAIGPIYSNTQSSLQSGRTALWL

SEQ ID NO: 25825 - protein, 70 aa, A.fumigatus
HCSVGYIDIYIYYISLSAQKVSRQMTLSHGIRSSELLACTLTDDKKASCTSVIEISADIDIYKAGWVLTI

SEQ ID NO: 25826 - protein, 62 aa, A.fumigatus
QLYLSDLCLLNACRFSFNINTVLFTSTHADFWELANLPYDVPILQRLGRPHLQRRRMALHIH

SEQ ID NO: 25827 - protein, 175 aa, A.fumigatus
  UNSURE (167): Identity of amino acid sequences at the above locations are unknown.
NWFQNRRAKAKQQKRQEEFERMQKAKAEAEEAARNKADSADDTSDSNQSDSTTKEETDKANDTKTSESGGPGEQTKTSTSSRSKHQKTRSESAREATFASLQRALNAAVAAREHYGSECEQDRNDGNSVGGSASPTTFPLSARGNDHDDSESAHSALNTPFFGVFTXRRAKDSST

SEQ ID NO: 25828 - protein, 179 aa, A.fumigatus
EYLLGSAARGEKHLYRRHLPYSTILTFPNSSAMNYLHHPYAFGGHNAVQFDQSIAYDPAMAHHAMVHPMDGYLYPHPPYEMVDYYHQPIMDYEEYAENLSRPRLTKEQVETLEAQFQAHPKPSSNVKRQLAAQTNLSLPRVAVSLILRRMQYVTCADPGIELVPKPTSKGKAAKETGGV

SEQ ID NO: 25829 - protein, 332 aa, A.fumigatus
TGNEYNGRMGLRISSIFVIMVGSMLGAVFPVFARSFSTSKFLRRAFFVAKYFGSGVIIATAFIHLLGPAEEALTNECLTGPITEYSWVEGIILMTIVVLFFVELMVMRYARFGHGHLDDLGHDDHTHPSLDAPPATVESKSHMPGEDHLGHSREHRDTESGRKASLIEEYSAQLTSVFILEFGIIFHSIFIGLTLAVSGEEFITLYIVLVFHQTFEGLGLGSRLATIPWPNSKRFTPYLLGIAYGLSTPLAIAIGLGVRNSYPPEGYTTLVVNGVFDSISAGILIYTALVELMAHEFMFSPSMRKAPIRTVLAAFGLLCLGALLMALLGKWA

SEQ ID NO: 25830 - protein, 72 aa, A.fumigatus
VRLYPLSQLCLDSNSTSLFPSSTDQAGFEVQEAMHIFDDISSAVIFMDQLVRQGSTMKYMKLPLCPIEYTTA

SEQ ID NO: 25831 - protein, 78 aa, A.fumigatus
ECSVFSPNHENGILMGESNTFKFYAFSMRTDSKLTIDYLGISAAILIFDADAIAGFEEILVCDMSRFHCISWSKQIHE

SEQ ID NO: 25832 - protein, 86 aa, A.fumigatus
LILAEYNSFDDDPWILKLVEYTKQAIDDQRVKILGICYGHQIIGRALGAKVGRNDAGWEIAVCDVDLTEQGKKLFGKDKLVCHLFL

SEQ ID NO: 25833 - protein, 64 aa, A.fumigatus
PDLVSSRISIRLALVLSSTCAILLADGPFESRGFFFYFFFFFFFFSISNSFLQSTTLLTTTLGF

SEQ ID NO: 25834 - protein, 99 aa, A.fumigatus
QQIQQMHRDIVFDYPPNVVPLGSSPRCAVQGMYRPGHFITVQGHPEFKQDIVSEIVKLRMSMGAFSKEQGEDALARAGKDHDGIAIGVAFLKFLLGDIQ

SEQ ID NO: 25835 - protein, 154 aa, A.fumigatus
  UNSURE (14),(66): Identity of amino acid sequences at the above locations are unknown.
HLQSILLFPDCVNXDTLDYAYSGTQNWSGSFRPANRCPAGMKRIPQLRFSVRYDLRKLLPNGWSGXPPLELACGSSYCWHGDFINGWVPEAAQNMLKATDKREFMQIDGPLGGGKDGSKCGAKNAHDQDPNHGTSDYEESVKMMSSKRSIGQRR

SEQ ID NO: 25836 - protein, 136 aa, A.fumigatus
SVPVWCPSSSVTSLAKHNSSHRPLESVYSPDSIMTARYADVHKNPQGPGDARPTAMQIIHDEGLEGKLADSSILITGASSGIGVETAKALFTTGATLYLTARNLPKAKHALGDMASSPRVHLLELDLESLASVRGL

SEQ ID NO: 25837 - protein, 83 aa, A.fumigatus
ISSTDDTSDGWFSEQSDMWPGQAMNLKVNQILHHEKSKYQDVLVFESTDYGTVLVLDNVIQCTERDEFSYVCPPSAHCSSGGF

SEQ ID NO: 25838 - protein, 123 aa, A.fumigatus
TSRSTRSCTTRSPSTRMCLSSRAPTTAPFSFWTTSSNAPSGMSSRMYARPAHIVRPAASNHVVLCYCRYQEMITHLAMNSHPNPKKVLVIGGGDGGVLREVVMHESVEDAILCDIDEVSFYLP

SEQ ID NO: 25839 - protein, 61 aa, A.fumigatus
MVSIADLVKAVIRVSKKYLPGMSIGFQHPNVKVHIGDRFQFLKGAQRTNSDVLSPWTALDP

SEQ ID NO: 25840 - protein, 76 aa, A.fumigatus
  UNSURE (8),(11),(30),(43): Identity of amino acid sequences at the above locations are unknown.
LSRERPHXFQXDLQNIGSEMIFAGFSQKCXSIRRPMQVTVSQXFIKPCTQSVRSKNLPFRAFHVIKRWVYSIALFC

SEQ ID NO: 25841 - protein, 238 aa, A.fumigatus
LRIRPPSRGEDRDLIPTYNASGYGNIHRQVDDQSDESQFSGIFERAVETRNKGQLHAYFWRNTTASPIPPSINSVLEVFPVQHHNNTPRVLHIDEGNAHHGVGGYNAPGYEKKDDMPSYGNASAQHHDVSVKSIDVGSSDIEAHGNTDPACTGGTYDAHHDVETIGSHTSESLNARTPVAQAYVQAVEEPAKKPTPTFAKQSDGGRRKNGNHGQSWYVLVLVNPFPPQWTSNDLYRIC

SEQ ID NO: 25842 - protein, 397 aa, A.fumigatus
IHNCGSVHPLVVKTATSSRLTMPVAMETSTVKLMTKATSLNSLGSSKGPLRLATRVSSMLISGEIPLRLPFLLVSILFLKYSLSNITTTHPGSYTLTKEMRIMALAATMPLAMKRKMICPAMATPLLSTTMSQLSLSMLAVPISKPMGTQILLALVAHMMLITMWRRSEAIRPKASMLALPSLKPTSKLSKNLQRNQLLPLPNNRTEVEEKMATMAKAGMSSFSSIPSHHSGLLMTFIEYARSEPVHSDLSGEKDESSETQSTSQRNSGDNTPPSANIESFIDPALTESTRNNVPKSGSANMTSHTAHNAEKAYGTPADSQEAQLAYPSSSQGVPTSMQDQSQEDSNGLAVLNRPMNNQAHQSPTMQQSQHRSSSSDAAPNNLDPSLYSATGPESPN

SEQ ID NO: 25843 - protein, 255 aa, A.fumigatus
ATWLGITSGPLCNQSVHSTVCFVYSRLHADRLAGEALRIMMNSLKLLVVSPEINPSNRKARSIPVLNPFDRYGRVFFFSWLGFMVAFLSWYAFPPLVRQWSPIRQALGNVAQLTENGCLVNGDHSQRSSYDTATSRKLEHCCSSGYVSIERKVLSEFNHADEPRFLVRFIAGPLCDRFGPRLVFIGLLLCGSIPTAMAGLVTTPNGLIALRFFVGILGGTFVPCQVWCTGFFDKNIVGTANSLAAGWGNAGGGIT

SEQ ID NO: 25844 - protein, 234 aa, A.fumigatus
  UNSURE (45),(227),(233): Identity of amino acid sequences at the above locations are unknown.
DAPGPGRSTAMGLSDICPRSFVMPAIYDSLVHSQGLAPHKAWRVXYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIAVFTTGVEXSALSLXL

SEQ ID NO: 25845 - protein, 298 aa, A.fumigatus
MSWGGAVSLVFPDGFKLSFSGDCRPSTNFATIGRDSTVLIHEATFQDDMAVSAIAKKHSTTSEALEVGRMMQARTVVLTHFSQRYQKVAHVDHGAGAGTAKPEPEPKPAPMTRVDLDVPDDEPEPAPEPVPSTLTVTPAENENKPPLQAPVTAAFDYMRIRVGDIPIAQAFAPAIEKLFDILERASAVEANKQKKIREAADALAKEKKQKQKKKGAAGAEPLSSATPAAATGEAMDIDQGRSVWSASESENGWGSNDDEWMDRFWRGKHSRSRSHSRSKSASGRRSSPSIRTKSGDAV

SEQ ID NO: 25846 - protein, 229 aa, A.fumigatus
PSPPRKTKTNHPSKPPSPPPLTTCASVSATSPSRRPSPPPSRSCSTSSSAPLQSKQTSRRKSVKRLTPWQKRRSRSKRRRGPLGLSRYPLPLPPPLPARPWILTRVDLCGALAKARMDGARTTTSGWIGFGVGSTVGVGVIVGVRARADGARARVFGRRVVMLFRLEYSMIDGSPERIHIRTELYPWFHFALWVHAFTQVYYCWLLTSQRLYYKLCLFSTTGGPKDHMH

SEQ ID NO: 25847 - protein, 72 aa, A.fumigatus
KSREWAKVAGKGGIGILEAQPEDIALVWHTSGTTGRPKAEWLTTPEKKAIILIAIWEQVRLTHKNLVTTMSE

SEQ ID NO: 25848 - protein, 308 aa, A.fumigatus
SITEYIRDTYLLTPEDRTYLVMPLFHVHGLLAGLLAPLFSGGSVIVPLKFSASEFWQDFVTHQANWYTAVPTIHQILLKTPLPNPIPRIRFIRSCSSPLSPKTFEDLERTFKAPVLEAYAMTEAAHQMTSNPLPPGRRRPGSVGIGQGVEVKILDQAGEEVPQGKEGEICVRGENVTKGYLNNPAANKSSFTKDGFFRTGDQGKKDRDGYIIITGRIKELINKGGEKISPIELDNTLLSHPQVAEAVCFAIPDEGHYGEDIGAAVVLKSAGSATEADLKAWMAGKLAKFKTPKQVFQCPLCPTYFPEQ

SEQ ID NO: 25849 - protein, 179 aa, A.fumigatus
TKRTYLVRTLQGIAHHKSLRMTFLSGAVNVCGAGLVHDPAHPKDHKTMYQIISSAVVNSPPPSYIIKLLHSSHKPLYIPANGHRSTPSQPTDTKEDMMEIFQTDVTGQTREYRKLMGRRNYVAIVAYDPEVVNTMYGQNMSHGSGKLNLAVDFMVQGDGTYGNVIKYGPVIVPSLEHGK

SEQ ID NO: 25850 - protein, 71 aa, A.fumigatus
RMTMNLCLRRAQVWVIPETNEVFTNYEPYLQRMDFYKQKRFICEITGHSGLTFFEALRSEVRHLILVGSVF

SEQ ID NO: 25851 - protein, 163 aa, A.fumigatus
IHDLPQDGRVFDLAGRLCTGRIIPSNKTRRGGFASGVEKGRYRKEAKESCGEEKRRERKRKARGDEDSRGGGVGGEENEELKSKRKERRLPRPKEATAEPSPITFEDHCGKRPSSQELGWSGRASSEAYNNGDWPRGGGQDPDKTFSVGRRVFSNVKVRYGQG

SEQ ID NO: 25852 - protein, 183 aa, A.fumigatus
PLFPGYCGTTQAHCRSPDCQLDFGHCDAHETPEGPPVEDIPRPHVGAVPYGPHVIRSCARSGTIALTYDDGPNRYTADLLDLLDRYDAKATFFISGINNSKGPIDHPDLPWASLIQRMQRTKHQIASHTWSHQDLSKVTPEQRRQQILKNEAAFRNVLGKIPTYMRPPYSSCLPETGCLNDMG

SEQ ID NO: 25853 - protein, 83 aa, A.fumigatus
QWQLFNKHQSLLYSSLKSSMPDPESQVMTVIYGHDSKNSLSLKTYTKGLDSGCVKGGKLTAMVVEDGGKQSIVQVRCRDRRKE

SEQ ID NO: 25854 - protein, 133 aa, A.fumigatus
DHALAGALLGWRPQHRHIRQDPHIPPHTPRYPTAARRRTSPNHHRRHPMRYRHHPGHRLSQRRPSAKNACHLRRPDRHRSRAPSCATHEPPHPPLHPQLALSPRDDLADAAKSVVFGTPDGIVHQRNRPLGVR

SEQ ID NO: 25855 - protein, 255 aa, A.fumigatus
DKTMLWLGPCWVGALNTDTFDKIPISRLTPHDIQQQPGAVPALIIIVAILCGIVITQAIAFRNEGRLPKMLAIYGVLTAIVLALLVVPHMNLRIHHYILSLLFLPGTTLQTRPSLLYSGLLMGLFINGIARWGFDSILQTPAALLDGAQLGSALPQISTPLVVSAQEIVFTFLKNLTSEADGISVLVNDVERFRAFRSGDGSVESFNWTRRRAEEPEYFRFGYIKLNALGGLWYEDFTKPVVWDVDGSWNRSAPT

SEQ ID NO: 25856 - protein, 207 aa, A.fumigatus
ETLSNASIHDFIILEYRDTIGGRAWHTNFGKDENGDPYVVELGANWVCYSSFYVEPTNHSDVEQIQGIGTPDGPQNPIWTLAKEFNLKNTFSDYDNVSTYNENGYSDYSHLFDEFDAADEIANAAAGTILLENLLDQTAQTGLALAGWKPKKTDMEAQAVEWWNWGKSASTFNRNEINSADFEDTYSPLESSLVFGYAGSNLTWNGF

SEQ ID NO: 25857 - protein, 75 aa, A.fumigatus
SPSYYTVLDPKARLRMTVPALRFLCGLVGPNHVRRKRLSQCLLFLPSHGERKAKSNATSKLAGAIIVSLVIILLL

SEQ ID NO: 25858 - protein, 86 aa, A.fumigatus
ETTKIILYLKVAKQHQEGKTGKISLPDDDPEAINIMVQHLYGQNYEDTRPDLEDYGEDRALLNLKVYAIADKYNITSLEESAKAAF

SEQ ID NO: 25859 - protein, 89 aa, A.fumigatus
KRPNPGLIVPFHRYLPFIPIPIPINGSPTSLSLSTQYNIVIMVKLAILPLAVLAALAPFAAADNCKTGLNYCGYNLLNIGMQTFHSRPT

SEQ ID NO: 25860 - protein, 96 aa, A.fumigatus
LTQKYSSRYFSPCFLTWSLNQSSTIGCFHKLECLDLFDHLTVDNRVYYVWVNHCFECKLTCPLSESSYFASLSYTTGVHCYRRWRELESKSYPWVL

SEQ ID NO: 25861 - protein, 66 aa, A.fumigatus
CVPLKQRGWSDQASAPSYDRILSPTAATDATCSQTTYDFAASSSAVISRPCRRCRTRRHRRPARAS

SEQ ID NO: 25862 - protein, 130 aa, A.fumigatus
CPVLTINTPSSKATARARVNTSREDTPKVATDNSLTLASNTARSMANSMVSNTVNTEALVTTTTSSAITTRISTASTRRANTANMANTTTSMVNNTKARGHTGSLGMSPAPPLSSHSHKLPVTSADIFSL

SEQ ID NO: 25863 - protein, 110 aa, A.fumigatus
  UNSURE (40): Identity of amino acid sequences at the above locations are unknown.
HQLTFSLSSYNDQNAPGGAQEGERRLRGAIAGGLAGGFAXPKTDHRILRTIGGAIMGSVLEDAVKKHKHKDGSSGHSNYGGSQYGSHQGGHGSSSGGGLMDNLGGFFNKK

SEQ ID NO: 25864 - protein, 144 aa, A.fumigatus
VNHTLSPLESSILSTFYYSNTIPNTIMSGPYDQYSQQQGYGQGQGQYQQGGYPQGGYGQQPYSSQQYGQEYGQQHGQQHGQYGGSGDYYNQQRNYNQDQYGQHPQSQYGQHGQHDHQYGQQHQGQGSYGQPGYVTCPTTLFSQS

SEQ ID NO: 25865 - protein, 201 aa, A.fumigatus
KMIGNLALLTWLVFSFLKFGSCIFIDGELNLYGFSPYPGDRTTETNTLTVSVHGLVHATASTFTHTSAVPSRTMSVADSISSTAPSSSISGASSLGWHPVAITLTKKPTPHWNYNITVPKSSAKYSSSTTPTLTVSTAESSAREASDMETTGFWKDQSTPTTITALSNNTMISSSADGSRSPLIFSAVMLFGVNLLTGVLL

SEQ ID NO: 25866 - protein, 64 aa, A.fumigatus
CWKMSLSDGDEACETRFDNWSEATPILQDNYKYVVIRNITHFLHTSTSMAEYHLYHIFRGQNKL

SEQ ID NO: 25867 - protein, 476 aa, A.fumigatus
SSFAADSDWQSEESGRFDDAEESMLDEQPPHSRSAHSSKRRRSNDWPLQPGEENPAPKDNGNHCWPFKNSSYGSPRRTGRQGGGGDKSSRGRPSRFIEAHMNDSVSEKPPSIFIRGDAGASEQNDCGAGQRQSGIFRFGRAIASAFNPFGVWGNVSDIWRGSQSEHRPEGDARARAEKAYAELKKAGYKGTVKGSYMQGMQTSAPVAEQHSRRASQAQSDGSKTLGRHSRQNSTEGYGSGSSIRSSLQELRKAKSSLGIPYIKRGSEDLDRPEVRKSRSRKELQRQAKLLKRVSDLEGKLERARRELRELTGEKEEEPVRTLCQERTYHRPFVPGALPTLPSERFYENNATTVPDSQAVELAALSETSGNIQRMAESQGNGLATVESPSLKRKSPDPKSVRDKVHQMTEDSPNKKSLYEEPARSDETNTPRKATKMGKSDSPGSVERKRAQDQSQPEEHECPGVLTSELPIAVILH

SEQ ID NO: 25868 - protein, 123 aa, A.fumigatus
LKVAEIKIIGSPDPADVHKMLVPQLRSVKKAADECHTRALQMDKKFEEWLWFAADLHSNCVQEQSSNEERLLATKVNMSVAQRQFDSQKNTVEEAKKISEKLGKQLDVASEAYKKASDSFPSG

SEQ ID NO: 25869 - protein, 115 aa, A.fumigatus
PKGGSGQPRGEDSTLLLLSAIFFTTGGLKDAKMVDQKELLAALEVQHKRDNRPGITRKAVAEIKSSAIFQVNWEDLLKSAPISINALGAALVASSSETATTIEFTPPKGGFKFLQ

SEQ ID NO: 25870 - protein, 129 aa, A.fumigatus
GCRQRRQKCPKSGEAPPPPPPAPPKPKSPLPQYSDDPAYVQVKPAMVYLTVLNALLTSGKDGGVNWESAVDSPDKPDKTASFTSKMLKDTLERFEESATENPHSQKLLEVLQTATEVKLFRDRNHGRLS

SEQ ID NO: 25871 - protein, 375 aa, A.fumigatus
PTQGEKKLDCDGTRLLAQMNQCIANAREGRQLAGSPERLDKSIEAFAARVGPSMDDSGLRAIAAVGQQRPHVLRESGHQRVVTWPHFDEGNEYLKQDVQVSHLVDNLISVVSQTCFRFPQMDILQIGTLGGSVHSVLREMGRSFRSFTYAAPSQPTDGPGLERPGEVQHRTFDVDRNPLEQGYQDHAYDMVLFTTARFPLEVAVAHIRRLLKPRGFLVLMVRTNPNITHLNLLFGHPARCTETCSGEQVITKEHWIELLSTNGFRVESLDAPPEMAGHQGFSLLLCRASGEYKEPSPRGDLLLVGGGDKNADCVISELAELVQGKFDQVLRSPSLDLMEITVRSELTALILVDDQDLTEASLSALRRLITPTSRA

SEQ ID NO: 25872 - protein, 81 aa, A.fumigatus
  UNSURE (28): Identity of amino acid sequences at the above locations are unknown.
LRQVIYLYTTPMSEDTAQDISTLVSQEXSKTPYECSSLTRLSGGTANFVYRVFSLGHSRMGRKPLLLHTERNLLLRIETSS

SEQ ID NO: 25873 - protein, 171 aa, A.fumigatus
PKLFEETILKALNDFPATTDTDTDNNTSCTVKTPRLVQFNRDTNTQILEDLPGALDLKSFMLLPTNSQNVSRELAASIGRALGKWLLSFHTWASEESQKELAKTMEKNEVMRDIKFMVNYDNVVKMVDQFPNLLKESQHILGEVKNVAAAELGRKDGKEFGIIHGDFWSGK

SEQ ID NO: 25874 - protein, 171 aa, A.fumigatus
FTETFGQESKLIYLFTWRTFDEIDETSVLIPSTALDQQNDIPLLVTDWELCHCGSRALDLGQMVAELYQLKHFLNIDAGVWLIEGLLDGYGPVDEDMAFRIAIHIGVHFICWGSTIPGWGTNDQVEGVVKLGRDLVVKGWQKDRDWFGEGWLKCLFPVAYNWSDQKEDIRA

SEQ ID NO: 25875 - protein, 460 aa, A.fumigatus
  UNSURE (2),(421): Identity of amino acid sequences at the above locations are unknown.
DXQPATSPQSPNPKIALSGSFLNGVLSKHAVVDHSIFSTPFRGQEFGHQQEEITNAGPRSRAPSLGSYSSSYVIKAPTSPLVHQAINTDLDFSLKSEFSEHPPASDIASRRRTLPPETFRNLQDSSPSYSRVININTGHAPGSFHDSLSFQARQSRKPLTSSYSLQLASSVQHPSWRARRPSLAGELSCKTHAPLVGSYEESILRGRMSMNPSKPLDFTAQIGVLGKGNCKSSLKCPPHVTVPFPAVFYSYPTSGKGRSISDDNPSPYVGLIDLENSLPKDNSYVTRRHRHHRSPAGASKGQRTDVDVGPEYQTQEALRMREKRNRRADSPKCPPGGCYRIPQQGQLQIMIKNPNKTAVKLFLVPYDLSEMEPGTKTFIRQRSYSAGPIIDMPLSARKNLGTDRPEASLSVSENPKDKPVXRYLIHLNICCPSKGRFYLYSSIRVVFANRVPDGKEKLRS

SEQ ID NO: 25876 - protein, 114 aa, A.fumigatus
ERVSFQPPWLKTAYLNGILYLMVATFPDVWTTIYHESESIGSLNYLSLTVGMTIAMQLGTRIAGRVYQRLCANNGGVARPEFRLPILCAGACIVPIGLFWYGWSARQSIHWIMP

SEQ ID NO: 25877 - protein, 67 aa, A.fumigatus
RLIPFSDRSNSRDGMAKYIGLLFQANVAGYVAFFSINTVINLLTCSMTYVVCGKKNTACPVFPAELD

SEQ ID NO: 25878 - protein, 323 aa, A.fumigatus
  UNSURE (9),(11),(16): Identity of amino acid sequences at the above locations are unknown.
QEPPTSRDXQXQTPQXGLRLPRLLSLFGFRVCCSLPPLDSTSRLVNAVISCPGSNGAPSEGRQFLAMSIPLSSAATPRGTRSLNVPATQNTAPVIKFRCLFTHDVRRKAKRWHDGFLRYHTFNKRVMVYDTTGYFIGDLHWRQDDGIQDGDELELDKGVLIQVCEPVEQTQTDLSTLYNNKKKAQDSPTQAAEPSAPTLRASAPVRSSISSQQPRSLNDLLGIRKTHAGLSVSPYEERQRQKQKEDNRLASERAAKRQKTTPAHVPTEQQPRRSVANPPVLIDLSDSPDENAPERRQKPNKLPENVSLQKKNPGSNGLCTSPR

SEQ ID NO: 25879 - protein, 88 aa, A.fumigatus
  UNSURE (33): Identity of amino acid sequences at the above locations are unknown.
LVSRRWVVLEWPKLTEADSYSKGLDSSPAPDEXVTIQLNRALTFLKTHQFDAALHDLETVLADSNPSEKTLFRKAQALYHLQRFPESG

SEQ ID NO: 25880 - protein, 148 aa, A.fumigatus
LLADKPRSLMARLQYIKSSIVISYLRSVNLSVHAPSNSMSCPYDKPIVDITQYVFHYQIDDQKAWSAARVALLDAMGCAIETLSTSEECQKLLGPTVPGTEVPNGFRLPGTNLSLDPVKGAFDMGTLIRYLDHNDALSGAEWGHPSGS

SEQ ID NO: 25881 - protein, 200 aa, A.fumigatus
  UNSURE (112),(126),(161),(184),(195): Identity of amino acid sequences at the above locations are unknown.
AAQNGDIPLVARLFLHIGVSSTDDRGKDNLGAILAVADWLCRASASGRYKHTGPPLTMRTLLTALIKAYEIQGCYQIRNAFNAFGIDHVILVKLASAAVVAWLLGLTEEKTXATLSHVWMDGHSSXVYRTGANTIPRKGWAAGDACMRAVHLALLVRAGQXGAPTPLSSLPFGFYARTLGRMGXKCNGRSGWDHXNTLVN

SEQ ID NO: 25882 - protein, 341 aa, A.fumigatus
  UNSURE (266),(320): Identity of amino acid sequences at the above locations are unknown.
GSSIASSPSRRPRDEHNSSNSSRSVTPGSDSPSPALPRQPSARSMRRRLIRLKRKHEKVLQKYYSTGTSYSEPISSLVYSLASELGREDNDLLWLAIVGVSSLELSGRTMSGVGISNPSESGGSAGWGGERGERIRQILRDEVHRLNPPDPYERDRDIRGEINGVIPTTAKSPTDKSIRLSPEPRFILIRHWSLYESMLHSPYLASRLHVWTENGRKRLHKLLAKMGISLSQCHQNYTHMDMELKRVLRQRLLKYAPMYGLKGLVXPDASGHVSFREGWGFWRCWGWKACLSATDVGVIIGAILEVGPKRNPPRQPGTQXRLSRPTGPYPRGTAPDGSPRF

SEQ ID NO: 25883 - protein, 319 aa, A.fumigatus
PNQKPQSATIFKDMGPPRSGASKKPTSSKNAPGRDSRKEKKRPQQSKQETATPRHDQTGQDGKQIDLCATIPLTLQQLLLNVFKTALLTSDGPHDYGYDHECQSEHRTQTPRADTDSEPEARTAAPAGKDEIDIKSVVQTIKSHSYNRDFESAYADANEDFLRAYALRWSASRALGYAGIFKSVLRMLLDGGDGAQVQVKAKEKQMHHIVCIGGGAGAEIMALATAWRDMMDENALSDRVGTVTLEDESGGQSQNQNQDTAVAVTSFPRPGMTVTAVDIADWSSVVDRLARTIRSPAVPARTLILPIVTQPEAEKTPRK

SEQ ID NO: 25884 - protein, 70 aa, A.fumigatus
HSHLRVTGGEVGAQSALAPKIGPLGLSPKKIGEDIAKSTGDWVRTQKESKDEEYRIANMIFVRPYRRVSV

SEQ ID NO: 25885 - protein, 83 aa, A.fumigatus
ELIDDRVPMPRFIVCDAGGSQARFLLSKLNPSTTHTTGGYGGGVTSQTIFTDDVSLQTFMDHLMKYVIRKCFTNVMNEANPPI

SEQ ID NO: 25886 - protein, 126 aa, A.fumigatus
KGLRVTVKLTIQNRQATVSVVPSASSLVIKALKEPPRDRKKEKNIKHNKSIPFDEIVEIARKMRHRSLAKELRGTVLEILGTAFSVGCQVDGRSPKDVSDDIKAGEIDGKSCCLHPRGWAGSALKY

SEQ ID NO: 25887 - protein, 242 aa, A.fumigatus
  UNSURE (12): Identity of amino acid sequences at the above locations are unknown.
TLRGSFRLLGEXRTARAVHHARQGNLPTALSIFTSVLKARRSLPPPPPDAKPFVLPSIPKSTRDPFVSLYNSIKTMLVPAEYPPPLPSGDEPPLRTTASACEEAGLMTYIGEIIYASSSRETGLAWTRDAVDLAESTILELGGFEDHNPQHRCAECLRVGLENWKTMVSQLVAQAEREERESIEKAKHSWFGGEKQMEAKALERKRWEAERLILDDRIKKLWPIIDGGSGLEGIAPNSSLFI

SEQ ID NO: 25888 - protein, 104 aa, A.fumigatus
HTSARSSTRPPPGKPVSPGRVTQSTWPNPPSLSSVASKTITPNTAAPSVSAWVWRIGRQWSPSWLRRRKERNARASRKPSIPGSEARSRWKLKPLSESDGRPSG

SEQ ID NO: 25889 - protein, 358 aa, A.fumigatus
HGFFVEMLFVSITAALLLAVLDTLPAGMQAQDAEGWYKAHPGMARISQVNQDTHQIVDEFGRTRFFHGTNVVMKEPPWYRPFEWAPGVSSFGEQDVQNLHALGLNIVRLGHSWAGAEPVRGQYNQTFLDIMKKQTKLAEDYGLYVLVDVHQDVLARQFCGHGVPDVSRMRGPVGTAATDMAVQWFVKEDWVPGWKMYPFPLKPTPFPVDNKGFPSPQSLCGTVDWSLSYTSAAVCNAFGRLYNNYDGLGDAFAAYWKKLASEYVETTNVVGYNLLNEPWVGDSMADPTLLVPGVADHKVLEGLWNRAAKQIRTVDNDTLLWFESATIELWSGFNNVPPGKRLDFSPLIPPTTAPPQLS

SEQ ID NO: 25890 - protein, 84 aa, A.fumigatus
  UNSURE (14): Identity of amino acid sequences at the above locations are unknown.
ARYLPARRLKTSSXEAQVHNNDFIGAASYNIFVGVSVATIFGAAFFFDLFWPERHESKSVRLAWKISGVVVSVMMLASALTMTV

SEQ ID NO: 25891 - protein, 186 aa, A.fumigatus
LPTRATTHTDLVLRAREMGIESKVIPNASIMSGIGCTGLQLYNFGQTVSMVFFTENWKPTSYYDRVKENVQLGLHTLVLLDIKVKEQSYENMARGRRIFEPPRYMTVAQCASQMLETEEERKEGVFGPDSLAVGAARVGGPDQKLGVGTLQELSEVDMGPACTAWGCLEEKHMIWSRFISKKFAGG

SEQ ID NO: 25892 - protein, 76 aa, A.fumigatus
QFLKSAHTQFLVRTADSSSSNRKAVGSKDTFLSFFLGFQHLARTLGNGHVPWRFKYPPSSSHVLIRLLLDLDIQED

SEQ ID NO: 25893 - protein, 147 aa, A.fumigatus
QAPGHRRCSSPRTDPATGTVIWKAGPLVPNAPKHYGLTAFAATLNEITPIEEKRLPVTDSRLRPDQRALEDGDVDRAEQVKVQLEEAQRARRREMEAAGESWTPRWFKRVDADEDAEDVWALKPGKDGYWEERARGTWTGVVPVFEA

SEQ ID NO: 25894 - protein, 162 aa, A.fumigatus
  UNSURE (23): Identity of amino acid sequences at the above locations are unknown.
PVGKMPVLNETTGQKSVSTFKAXGMFSGRSEEVITKAVDPYNNELPLGLTGTWTSSLQLTKNGSRHGHGDLEGRAPCAQRAQTLRSDGIRGNSERDHAHRGEATAGDGLAAAAGSAGAGGRGCGPCGASQGAAGGSATGAAARDGGGGRELDAALVQAGGCG

SEQ ID NO: 25895 - protein, 119 aa, A.fumigatus
LYGQVDIMIAGQFLHLFSWEGQKQAGKRIVALSKRGTVLIGYQQSRRRAREYMRPWGMMFYHNRDSFLQMWREISLETSTDWKVEATEVDLAEWGMEAEDTEWMPADRQGLNFVLTRVH

SEQ ID NO: 25896 - protein, 167 aa, A.fumigatus
KKKKSSLNPAHSKLYEATTSDEDHVKLSVYSPPDLQRPTFEEATSHEFTPTHIGASFGPSWSTHWFRIRLTVPRDMLDKERLEFHWDANNEGLVWTDDGRPVQGLTGGGERIQWVIPDAWRDGKEHTFYIEMACNAMFGNAPGGDSIQPPAPDKYYTLHTARINAVN

SEQ ID NO: 25897 - protein, 152 aa, A.fumigatus
  UNSURE (72): Identity of amino acid sequences at the above locations are unknown.
EISDDLMECWSTLVTQPKPSALQQAQQLAYVKYTAPVPDADADADGTPSGEHRANRTIITCESRGLILSAGXTGFRTWEAALHLGSFLSTPAGQALVRGKRVIELGAGTGFLSMFCAKYLGVQSMVATDRELGLIQNIRDCSLHHGAGRTRA

SEQ ID NO: 25898 - protein, 122 aa, A.fumigatus
PDRPKHLYYYIIVQAFAQWRKSVEGNMSLGLSSVEDDSDGQNDNYVSFDKLVAQYFQQVEPHLLEFPDGRTMIKSAAQSALYQRMFNEAALWPIPPLNYRARVLKNILSILEESISDPEEDV

SEQ ID NO: 25899 - protein, 114 aa, A.fumigatus
RNKQNQPFIYTFLFDPQAPSLNDVSFYKSIHRQLAPLQRPLSKSTSPANAAERISMSENAIDFNKRFSTKNLPVYDLIYDPTNLTIRSSIPNIPDLGYYSLENSPLSRVESLNN

SEQ ID NO: 25900 - protein, 89 aa, A.fumigatus
PIIMELERSENVIIVTHQAVLRCIYAYFLNIPQEQSPWMEVPLHTLIKLTPRAYGTEEQRFKADIPAVSTWRAKGTSAKHQEFPTEVKH

SEQ ID NO: 25901 - protein, 336 aa, A.fumigatus
LILIAHRFVDCPGHDILMSTMLSGAAVMDAALLLIAGNEACPQPQTSEHLAAIEIMKLSHIIILQNKVDLMREDGALQHYQSILKFIRGTVADGSPIIPISAQLKYNIDAVNEYLVSHIPVPVRDFTASPHMIVIRSFDVNKPGAEIDELKGGVAGGSILTGVLKLNDEIEIRPGLVTKDENGKIQCRPIFSRVVSLFAEHNDLKFAVPGGLIGVGTRVDPTLCRADRLVGFVLGHRGRLPAIYTELEVNYFLLRRLLGVKTADGKQAKVAKLTKNEVLMVNIGSTATGAKVMGVKADAAKLSLTSPACTEIGEKIAISRRIDKHWRLIGWANIVA

SEQ ID NO: 25902 - protein, 63 aa, A.fumigatus
QIMWPLINYYWLLLATYQEHSPQYPRKSNGLEIIQFRDNLPLILGILSRYYLASVKPAQTLTG

SEQ ID NO: 25903 - protein, 71 aa, A.fumigatus
SSEVQALWWMSLTLLCMDDSIEAVAGTSDFDLLSAFKFLSTPPLKAYFSRATANEVDRLRRLAWCVYRKNT

SEQ ID NO: 25904 - protein, 61 aa, A.fumigatus
QWLASSSPVTFVYYHPLDDYEFAQKLNYSVLRDYTYLVTVSRVWYIDYINRISLLDRNQTQ

SEQ ID NO: 25905 - protein, 184 aa, A.fumigatus
HALISAPAVKTLYTNESTSGDTHIPSLEISYASLAAVENFFLSSSIVTEWVVGNFINADFGVAAALSGDVDLSNRFDRMATAMTDYLRYGPNTQSAQGEIYQTEPFVFIRWGYFVVPIITEGLAILFAISTIYNNRRSRRVPLWKSSTLAVLACQHEAGLGLLQTSSKDINEIQHEANKAEARL

SEQ ID NO: 25906 - protein, 259 aa, A.fumigatus
RLILGFFFFFLAAYIICSELVRAKPSKGEILVFPRGKIPAFVKKSRRDGDLEGAPTFEKQQLDNAGHDSTAAIVKQTSIFHWQDVCYDIKVKGETRRILDHIDGWVKPGTLTALMGVTGAGKTSLLDVLANRVTMGVITGEMLVDGRMRDDSFQRKTGYVQQQDLHLETSTVREALIFSATLRQPASTPHKEKLAYVEEVIKMLNMEEYAEAVVGVLGEGLHVEQRKRLTIGVELAANPALLCFFDEPTSGSDSRTPGS

SEQ ID NO: 25907 - protein, 349 aa, A.fumigatus
CLSLDVESTTPEGSPAPNYIPLGGSQQQQQANGASSTTPAQAAPDTSSILKALADMAKQNTTTPAAPATTNPLNALNMQGTVSQPVTSSVDQASQVQAGQSGVNPYAAGTMATPFAALNNLAQNPALIPSQSQSQTPPNPLAAAANPLAALLPQATSAAAQPTPSIAPDALQQQLQLLQLLAAQGIPQEQWATALQILSLSNATNMANVNPGQAVGFNLPGQAAAAWGSRPDSQSRDFDRGDRERDRDYMRSPPGQYRRRSRSPGWDRRRDVSPPRRRDSPVYGEYHGDSLGRRGDMRGRRGNDYRQRSPPGRRRRSPTPPRKDPTLPPPGPKFIEWDYSIGQGNIKGL

SEQ ID NO: 25908 - protein, 100 aa, A.fumigatus
ENAVYARAGCADGNHCLVDHACLPDDQENHHDTLHKQGYHGGEEATHHDVGPTQATEICDDTGLEESACSRDLVHDRLDQNHVTVNLDGYPRQQLLDPVG

SEQ ID NO: 25909 - protein, 83 aa, A.fumigatus
LFANTHQLEEQMQLSIQNSYDRAGNVIRNADAEIARTRSILASIDDLENELAKIGHIREIVKAYRGRIESLDQRIDQAARRRH

SEQ ID NO: 25910 - protein, 70 aa, A.fumigatus
RVLTNVLTKLPAEDTDAAYTTISFSHRISASILVAHTYSNSYELYETNDMKSFAPEAVAYQLPDYRLTDE

SEQ ID NO: 25911 - protein, 87 aa, A.fumigatus
LINTNCGVRGFLGTNLNSYRFPRSSLHQRDPRASSLFDSYGGGSRPASRSPASVGGYSYGGYSASNADGYMNGGSTGGFRKATPNAK

SEQ ID NO: 25912 - protein, 71 aa, A.fumigatus
YYRQLTLAIGDEIRDTSTISELNDAFDNTRVRLRGNMTRMLRMAERTGVGWRAWLGFFLAVFLIFAYVWLT

SEQ ID NO: 25913 - protein, 91 aa, A.fumigatus
ALPSHIPDVTQVTNSSIEGMGVTVDSDGSYPYSTYEGSDFAKNLAAPDIDFGVFHLYTEDCEYCSTLVVTGLSIDASYQGASKTTAGATAG

SEQ ID NO: 25914 - protein, 175 aa, A.fumigatus
RHNLQKAGLKILRTWGFNDVNSKPSSGTVYFQLHDPSTGTTTINTGADGLQRLDYVVSAAEKRGIKLLIPLVNNWDDYGGMNAYVKAYGGSKTEWYTNSKIQSVYQAYIKAVVSRYRDSPAIMAWELSNEARCQGCSTDVIYNWTAKTSAYIKSLDPNHMVATGDGTLSTPLSHT

SEQ ID NO: 25915 - protein, 100 aa, A.fumigatus
RIVPGGIKDNSWGNGWVTSHAKVCKAAGKPCLFEEYGLKDDHCSASLTWQKTSVSSGMAADLFWQYGQTLSTGPSPNDHFTIYYGTSDWQCGVADHLSTL

SEQ ID NO: 25916 - protein, 90 aa, A.fumigatus
QYQPFFSLSAARIGTPAMKKAGGASLCTFPSSCPQHATAAQQLIMHHNAMTVQDPSLLICTLPGKWVLFTLLRTTAKAVMLLHCLVSFLS

SEQ ID NO: 25917 - protein, 386 aa, A.fumigatus
  UNSURE (11),(14),(15): Identity of amino acid sequences at the above locations are unknown.
PQVSFRFVHYXIDXXGTGVATLVACAQAGADAVDPATDSMSGMTSQPSVGAILASLEGTEHDPKLNLAHVRAIDSYWQQLRLLYSPFEAGLTGPDPEVYEHEIPGGQLTNLLFQASQLGLGQQWAETNKAYESANDLLGDIVNVTPTSKVVGDLAQFMVSNKLTPEDVVARAGELDFPGSVLEFLEGLMGQPFGGFPEPLRSKALRGRRKLDKRPGLYLEPLDLAKIKNQIREKYGSATEYDVASYAMYPKVFEDYKKFVQKFGDLSILPTRYFLAKPEIGEEFHVELEQGKVLILKLLAIGPLSEQTGQREVFYEVNGEVRQVTVDDNKASVDNTARPKADIGDSSQIGAPMSGVVVEIRVHEGSEVKKGDPVAVLSAMQMVQFR

SEQ ID NO: 25918 - protein, 114 aa, A.fumigatus
  UNSURE (5),(10),(12): Identity of amino acid sequences at the above locations are unknown.
SFPRXDNLTXIXSTPSGEDYTFPFDRLGGRIPTLLISPWVAKAQVEQKGKNAHGETVSYSAASILRTLGYLWDFEPFTPRVEHAASFEHLIRLHARKDTPTALPSAVPFRNRNV

SEQ ID NO: 25919 - protein, 300 aa, A.fumigatus
YLCIEMHVLKRSCCGDCVCGDSRAKQGLTEPVPVFIQPQSLTASQSSDLLSAQISCPSLSPSPSPDSATFISHPQSILSAEPSGSDFCDPRQLTVESSVGAPAELPPLPTLSCNEEEPKVVLGSATVTLPVHEGLSPSFSSSSEDPLGSLPTFDSFSDLDSEDEFANKLVDFHPIGNTYFQGDKRQRLGTYLLDEDEFLSERSLEDLDDQEAFAQSGLPSVESSDFLAVGGDATQSTEEMSSKKRVTSRRSLKKASTSESSSDSLAKEDSGFRHQPVWSLRHDFHRPAFDCFFASELDRP

SEQ ID NO: 25920 - protein, 231 aa, A.fumigatus
LTSVQSQTQQPITMDATYTMAQTPVQGQPSFAYYPTESQSRQQHFTSHPSEMQYYGQVSSYPQQQAQQQHSMQEQQPVYAAQPMLNMHQMATTNAFRGALSMTPIASPQPTHLKPTIIVQQDSPALMPLDTRFVSNDFYGFPSTPPLSTSGSTISSPPSSNGSLHTPINDCFFSFEKVEGVKEGCESDVHCELLANTDWSRSDSPPLTPGESNDFLMFSLVFCSHLLIFVY

SEQ ID NO: 25921 - protein, 218 aa, A.fumigatus
DESFRLHNSFQNSIVYHKKVYASNSEMADGSRLPESATSTTMETNTNEHAKVLSPDAETVPSSSVTATSSELSLDGRWGERDQGEPVSRRGAMEDFEEMRRELTQLSLRRTRSVGKDAHRLRSRASGRASQVHDEEKAIDEEDSTIDGDGDGYQGGFDLGEFLMGWSLERRTTTCKPANKVGVLFKHSHGERCSNGNLLLCRTPPRMLLLAHFGPVSV

SEQ ID NO: 25922 - protein, 552 aa, A.fumigatus
GLTFQTPPNTDIQKMTNPRAAKRGRLSNIQPADKDGDIQMRDDGQNPHSVASSPTGQGASPTTSKTFRQQPEPDGGEDTAMNGAGDNSASVETPSRNGLRSSGRQRKPPQRYEEEVLNTPSSVKRTRSSVGQSERTPRSTRRSRLVPATEEAEENSPQHQREGLARTRSKRASARYAPTEKQDQEDQPESREQSLQSPTPDDYQDGLDDLVSMQLQQDTTHQDAIEYDDSMVTSNPLPDYAERFLRLVQGGLSEELRLLTKVLLKKLNGKQLIPLKGLESEYTKVRQLIEQTVTAGEGNSMLLLGSRGCGKTAIVETIISSLKREHMNEFHVVRLNGFLHTDDRLALREMWRQLGRETNTEEEAGKVSTYADTMAILLALLSHPEELFGPSGNPKAITAAKSIIIILDEFDLFATHPRQTLLYNLFDIAQARKAPIPVLGLTTKVDVTEMLEKRVKSRFSHRYVYVPLPRSFETFSEICFAALNLEDDEKQCFFDEVAPGKGNTLLEGWRTYLQVYSFLGSACLSEDTNSHLIGPLGRRIVSTRRRMEGMKC

SEQ ID NO: 25923 - protein, 85 aa, A.fumigatus
HQSLFRPSMEGKYSSDPEWASIKPIELNDGSDFGAMPLATISYSPEYLEATSYLRAVMAANEMSERALRLTGDIISMNPAHYTVW

SEQ ID NO: 25924 - protein, 166 aa, A.fumigatus
SRSEASQKLPDMVSIRFCYTLHPFYLTHFNRHHRQVLMSSRAHFPTLPPREQDFLMEMFAQDAKNYHVWTYRHWLVRHFKLWDHPREIQDVEALLKADVRNNSAWNHRYMLRFGPRDENEFDAGLHNTTGPSSEKGRLPVVDEDLVDSELQYSQSRILEAPENRSP

SEQ ID NO: 25925 - protein, 150 aa, A.fumigatus
MRGDMENGASSIIAVLFLTQLNVYFYNHLRRIPEKYRDMASVTPLPTFDNLTIDPSGPPGNAWGLFGKNNELGMLNLLTPETVRRAAAEEIRDGVRFSLDLPLDRIKNPSFGRKPFARELVNKAPRIVNDDILVFNTQCSTQWDGFRHYG

SEQ ID NO: 25926 - protein, 129 aa, A.fumigatus
  UNSURE (118): Identity of amino acid sequences at the above locations are unknown.
QPLAWVKHGGIVGRGVLIDYASWATKNSIPLSPFTTTKIPLSAIKQIVEENDIRFRPGDILFLRTGFTAAYDKLSPDEELAISQRETPQFAGLEAGEATLRWLWENQFAAVTSDSPSXEPSPIAGPQGR

SEQ ID NO: 25927 - protein, 63 aa, A.fumigatus
QTDCAAGNHRHKRYFNGHSLEDLKISPVIGIDGKSAIYNSTYFQLTASSMGQARRDCRKRRAN

SEQ ID NO: 25928 - protein, 359 aa, A.fumigatus
DVFLDGGKVIDENLPGLEQPKPKARAPADPAVSSQGQYAAFNPHSGSTNQYPLSQHNVAGDGTPNQFDSAGFQFDLPGNPPSASPVRTQGSVDHGYNGQQDAYEGPLNNQYMEQQGSGGPAVAAYENGPPRPYRVNQPEYANQQPEMVNEMNELDSQQNPDGLPRHPAPFRPGHDQGSKPPPVRQYDNSNTTGSPTSTVPQAQPIAQPDPAPAPVTHQELERLQQVVRSKAADQKTQLLLAQKLVEASTVLVENSRMDPKTKARAREKYIMDAHKIVKKLVSSGYADAQFYLADCYGQGLLGLPVDPKEAFNLYHSAAKQGHAQSAYRVAVCCEIGQEEGGGTKRDPFKAVQWYKRAAS

SEQ ID NO: 25929 - protein, 464 aa, A.fumigatus
  UNSURE (26): Identity of amino acid sequences at the above locations are unknown.
IAAWDGNLTYAKLNELSSLLAFYLTXLGVGPGLLVPIDLDKSSWQIVAILAVLRAGGICLPVDAAQPYEFIEKLLIDKDIQVALASPNKAQLLERTIPYVVPVGRSLFDYLPRFDDVPHVSHKAMDHAYVVFTGGSVKEPKGVMLQHLTVLTRAENFASALELNKATKVYQSATYTSDMFLNVLFGTMMRGGCVCIPANDGFNNLPRSINASRANTVVMTPSLASLLQPSEVPEVQLLALYGEILTNQVRTIWSEKVRTHSLYGAAECSSSCIHASDCQTLGEARNLGLAAGCITWLVNPSDHDLLVPIGSVGEVVIEGPVIASGYLLHNGHVKGGFIENPVWRMNFERDEPSNDLEKRDESSTLTRRMFKTGDLARYNSDGILVYMGRKERQTQRLQADIWDVQQCIDTFSLPGHPCVVEPIRCLDDDESVEHLAVFVQFASTHLEKADGQRSVIGQPSPQFF

SEQ ID NO: 25930 - protein, 404 aa, A.fumigatus
KMPSQSRSSSSHWAGQSPSSLLEESFGGINMNGGSPLNGNFNFASNGFPFGINFAPSPPQNNMKAEATQRHVLTVHPTSLKSRVETQIPIRLTLYPMPSGVKKLRLPTHTISKPKFLAPPSADRSADTLQLHTSLVCTSAMQDQTKLRKAFARARGETRYRASSSSPNATEELPEDDKPLDGGEVKICAGCIQRERKRAFRKKQRKPEEDELFQKDEEKRVIVFNTNEIKDWAEPSKHAMPGYTDAPAPVIPAGAMQVELPMRIACYCRHQNEKLGFQVIFTVKDHMDNVIAQAITNSIMITDDHKTHAPPAPPAPGPSPSLPDGTQLPGVGVFPSGLPVETAKSPVQSFRSSSTTDLQGLQQRFNSQYQMSTGSFTTSAQNGQNGQKNATARSSPRAWKVRDW

SEQ ID NO: 25931 - protein, 75 aa, A.fumigatus
GSGTIYTPELTGFQTRTRPFKGINLDEYSGGLSFKAKPEVKSHWLCDVLCIRIAGSRWIHLLITRAALLNNSEVS

SEQ ID NO: 25932 - protein, 71 aa, A.fumigatus
  UNSURE (13),(21),(34),(42),(51),(52),(60),(63): Identity of amino acid sequences at the above locations are unknown.
LPSVGVTIPGTGXKVISTPTXMVTSVRRTATSAXGTGNGAGXSTSFPTSGXXEEQLSYIXFVXKSLLQYIA

SEQ ID NO: 25933 - protein, 342 aa, A.fumigatus
WLRDSTNQLSGYQALAKKDKALHNLILGAINTQAEFVIQSPYCNAFQPPPPSGLKPTPNGQDDKVHPAYEPSVVFECKYELDSLAHFLALGTQFFENTGSTEFLTERWYMALNTLLSVLDAQSQPTFNEEGQFVTNQYTFQRTTTAGTETLSLGGIGNPLNNGTGLIRSAFRPSDDATILGYFIPPNAMMSVQLKKTADVIKAAGGSADLVKKLRQRGEELDHAVREHGVVHHSKYGDVFAFEVDGYGSRILMDDANIPSLLSLPLLGYVDEKDQVYRNTRKMILDKSGNPYYLTGFAFHGIGGPHSKFISSPSINLSMNKGDANHDSYAVGFAERLGQCHS

SEQ ID NO: 25934 - protein, 68 aa, A.fumigatus
ENVRWLIKLAFEVRLRTSPIVIARKHTFDASAFGKVSGILKVDDLNPFNRGIFTTGLAFNHNIVWLDI

SEQ ID NO: 25935 - protein, 121 aa, A.fumigatus
QCIYAMLGRVIFGPDEDFRKHQTQGALPALIRLQRQVSYFGDSEGINGLLKHITDDEISCQVLRMLWDGRSDEHIPYKPFCKWPEIVDPIFKDLIQQLTNLDPTKRITACQALEHPWFRDY

SEQ ID NO: 25936 - protein, 68 aa, A.fumigatus
RGSFDPRGENFKIELHRLLNIEVGQLQVLSRQRSVRAGDLCELSNHVAFHDGRVKLKIVEVRKGRRAM

SEQ ID NO: 25937 - protein, 63 aa, A.fumigatus
KVSRRKGIMPLSDEAPDPNPSKLLYNCGHMASVYLLEDLRTYLIDFLSIQLFPKTQDIIERIW

SEQ ID NO: 25938 - protein, 98 aa, A.fumigatus
IAFCILLHAFYIYTIPQTIFSTEEGKKLITFSILYDYASRHTSFYLIADPLGAYAVYLNNLRISYHGHTLSTYSSSIRKLTCSWAVNRTMLYIISYIV

SEQ ID NO: 25939 - protein, 121 aa, A.fumigatus
QSDLQLNSISLEQFVADYVMESENVQRLEQSQFSEQPETVLNSLCSNGSTEDLQSEKVPSVKVAIPRLARPRTTSNRRIRTACAACREQKAKCSEHRPCLRCISFGIACTTLESKHESRQR

SEQ ID NO: 25940 - protein, 67 aa, A.fumigatus
EFIIAGILNVRPMHPSLPRILLPQDHRCLMSWAMNQTAARCNDVNNGSVNQNHNEDSYILQDILIQN

SEQ ID NO: 25941 - protein, 85 aa, A.fumigatus
SCGKRILGREGCIGLTFRIPAIMNSHSRVASIASRTVSTKTASTTGPLIFDEVILYKASFVSIITVQSAHDSNVNASSPTINLRD

SEQ ID NO: 25942 - protein, 84 aa, A.fumigatus
SCMSIFLPPTSRKLVLIIYSLFLCVAAYLIFGSWLNYNRYGARGWDLLPHGDTLRDIPYIFQDWLRRVINTLQGSGSRGGYSAV

SEQ ID NO: 25943 - protein, 88 aa, A.fumigatus
SGPEFWVINADEMLEKPAAMFEAFCASVGLDNDPSMLCWDTDVDHKIARDAFEKWRGFHNDAIESKGLMAKEPVALPFSSPFLANRRN

SEQ ID NO: 25944 - protein, 251 aa, A.fumigatus
  UNSURE (192): Identity of amino acid sequences at the above locations are unknown.
ARYAMESACHTGQMCVYDTVEDKGWRVALSTHRIEAVISDVLEVYEDIPPCAPEEECYDCELWKFFKSNGSESTTTSTTTTTTAPTTTRTSTCKTPGWWGCLDESTTTTTTTSTTTTTTTTSTCKTPGWFGCKDPTTTTEATAAPSVTTSIPTPTTYPTSSTSTCKDPGWFGCRDPPSTTASITSSPSTTSXCDDPGFFWGCYDESTTATHPITSGPSAPYSTPSPTHEHTCTSSIFFGLICVGSTGTELR

SEQ ID NO: 25945 - protein, 61 aa, A.fumigatus
LVAESMICIEVIGFIEAAIYKRFPSRASERIEVPNGGIIDDLSILFARPKICSFLIPNCSS

SEQ ID NO: 25946 - protein, 71 aa, A.fumigatus
PHPCRFCGKSSWTNSYYIITLPLHGGQNLYSAIVNVQLNRGIPKFMLASSVSLGCLKITIIESHPSFLYLQ

SEQ ID NO: 25947 - protein, 91 aa, A.fumigatus
TELPEVNDILPPGVTHEEHTFLGPDKNPLILSIFRKESPPDSFPQKRPAIYHIHGGGMIMGNRFCTLSGLLEFVREHNAICTTIEYRLAPK

SEQ ID NO: 25948 - protein, 125 aa, A.fumigatus
TLLLQQFELTRDSQNSSRPSSTPMEPSSSPHSAQSFSFADVFPGGNELEIPLGHPFDSVYEFSPPSPYNATTIPDLYALNTSYSVPIPSYSSSYETQFAFTPSFEDSLLAQYSLSTSASSSDSPK

SEQ ID NO: 25949 - protein, 85 aa, A.fumigatus
LWTSRLSKPYACEDCGKAFTRSADLKRHQSSVHYPVYQDCPVEDCPRKDRNGFPRRDHLIEHLRSSHHMDLPKRRMTKRVSKASA

SEQ ID NO: 25950 - protein, 162 aa, A.fumigatus
PRQLGHFGLGVRNLQDMVTFYTTTVNVVPSDFLYVEKDGNKKDVALFAHIDRGADYVDHHSFFMSTNPTSHVHHCSFEVHDFDTQNLGHQWLAHKGYEPVWGVGRHILGSQLFDYWWDTTGNMIEHYADGDLVNEETPVGYGPAGDESLAVWGPQVPKWFLD

SEQ ID NO: 25951 - protein, 76 aa, A.fumigatus
SMLYNEYYGARAVDDNSTVKTRMTVLLLIHQLEYVIMIGRVLHTEHILLGWRQECPRADRPWNGEVMDAADHWATK

SEQ ID NO: 25952 - protein, 306 aa, A.fumigatus
  UNSURE (293): Identity of amino acid sequences at the above locations are unknown.
WVLWRRSARHKGFLAARVLPVSCVRSRRLWKRGVGSPDRRTSESILGTAPQSSPLSNRTKRPSIISNYVLPPRKTADSLMDVYWGFVFPLYPLVDSIQLRAEYSKLWTGETLDSDENMLMCTFNVIFALACQLADFIPPNEREASADAFFSRAKDLLHFNLWHGGSAALIQCLLLMAQYLQSTDSAHQCWIVTGLAIRNAQSLGLHLPQTIARLPSFQEQQLARKIWHGCVLMDRVISMTFGRPAMISKASCGAVPLPATVDEEYIPASLGDEVRQPAGRPSVMAFYAKSPEXCAILTAGKRLASK

SEQ ID NO: 25953 - protein, 119 aa, A.fumigatus
FAYPHSQKYINSYGVHNNYHCMIYIILMSSPSPRHPPSDEVSGKRPKRRKVAVACDECRTRKVRCDGIQPGRSRWLFFRLPCQCCFGTRTVLLTAFSHSSGFSLWAVYEAIGCAMCLHW

SEQ ID NO: 25954 - protein, 123 aa, A.fumigatus
QRGTFQPRGEDETPVSFCALFTGPHGRSEDVRHYESILVIASGFGIAAAIPYMKSMIYGYYTRTIKARRLHLVWQVWSRAEITAAEHLLNNLLEDDHKDHGYVRITMLRDSLWTADNDRGFRS

SEQ ID NO: 25955 - protein, 65 aa, A.fumigatus
LILGSGLETFWQPAAAALGRLCRQQYVSWVMCWETYLRGFSPSNVRKHSQTETAFYTGGEVMNFP

SEQ ID NO: 25956 - protein, 86 aa, A.fumigatus
RPVIAILELGAWFGALYSGLLCERISRKYTILANVAIFCIGVVIQTTAATKGGNSSHILGGRFITGMGVGRYAYFSRGRSTFNRRC

SEQ ID NO: 25957 - protein, 200 aa, A.fumigatus
CATDRTTGSQRFSGRTAATCHHLRNHGKSDDRSFVVLVKTQALIDISAGFFLVGSYLLPMTFFPDEYRINYGTNHIGGTGPTQKDAAWLLPLALQLVPAVILGAGMIFMPFSPRWLIHHDREDEAKKVLTSLRGLPADDPLLQLEFLEIKAQSLFEKRTEKEKFPHLERTNTWSYIKLEAAGFASLFTSWPMFRRVMVAT

SEQ ID NO: 25958 - protein, 105 aa, A.fumigatus
DSPFRMKTSVGTPTASVMPSEDSRIEPLPPEVVAKIKSSTSIINLNRVVVELVKNALDANARTVSVTVDFHRGGCVVEDDGDGIPPAEFESDGGLGKAHRTWASS

SEQ ID NO: 25959 - protein, 67 aa, A.fumigatus
  UNSURE (23): Identity of amino acid sequences at the above locations are unknown.
PRDAPDITRNMSRDTCCQLQQLXPSRQLFQTLGNKHGNDTDLSLLIYKADFSSGVAVILEIRCYIIV

SEQ ID NO: 25960 - protein, 208 aa, A.fumigatus
VALADTTTIIDTSLTASLPLAGNRWHIECFCCSTCGTLLDSDAHLLLLGDGSLICSNCTYSCSSCGNKIEDLAILTGEQAFCAQCFRCRNCKRKIENLRYARTSQGIFCMDCHESLMQRRRKKKAGVPTSKKPGPGVKLDKSLPSLPPEEPEPHRAPNDSILDHYLDDATSREAPDSGRNERPPISRQHTDNQGKLMIWNMRITRSDR

SEQ ID NO: 25961 - protein, 211 aa, A.fumigatus
LCVLADNLILPSSTYRSSRHSVVPREAEAESGGEFLIPVAFDPSEEGRSSRTQSPPTAHSHHPPAGSASPHIAYQERGRERTDVDSSRWRGDDVGASASASPRSTDNLQRGTSNRSSRADLPINSKETSTFSTPSPESTKSSGIVKDSSIVDSAGSRTLDSSVTAPSRPSNELRELHEKGGSVDSTRSFSSPSTAQPHPSLHHGAGKCGSI

SEQ ID NO: 25962 - protein, 100 aa, A.fumigatus
YYFPLLSIICSYPADRLVVQLSDEWADSQMPVDGTNGCLRAFTQLKTQYSKLKVILSVGGGGKGSENFAAVAGSQSSLETFVRTAKGLVDEFGLDGIDSM

SEQ ID NO: 25963 - protein, 213 aa, A.fumigatus
RLAVDWEHPSTPAEGSDYVRLLARLREVLPSPRYVLATCLPAGEWALRNIDLCKAQNYVDLINIMAYDFSGPWTSETGHQAQLYSPSRDPTGGISCQSAIAYVIAQGVNPKKILLGIPAYGRSFLGSNHIGQRYSGCGGEDGVFDYCDLPRPGAKEYSDEKSGAAWCVGGDGGFVTYDTPETVQQKAQICDQDQTGRSYLMAQRRGCTRNPFP

SEQ ID NO: 25964 - protein, 72 aa, A.fumigatus
SEPSAGVEGCSQSTASRQHQPKQLERTVLHTINPIESKLIYESLRGPYKGLQTALTSRYSSKILTSLASSSD

SEQ ID NO: 25965 - protein, 101 aa, A.fumigatus
RSLVTRPVEKWRIEKGYIFCQKVAALDIDLQILLSHISFDRDVTYSAVPRMVWVVKRVTVPSRFGYLAPCFPAFKYHFPQLFNVTGISGPSESHANNGNRY

SEQ ID NO: 25966 - protein, 101 aa, A.fumigatus
SPTMPINSFEGTGEPVQLPSAPDVDIEDGASNSLDDASISIAIIGMGFRGPGDASNVEKLWKMILEGREAWSQIPESRWNSDAFYHPDHARHGTVSHVTVK

SEQ ID NO: 25967 - protein, 230 aa, A.fumigatus
NSSGILQGEKVGTIFQIGVHTKFMRPVGLRTEVSGENNTATYHFVEGDIDSVPGPGIAGFYDGPYYSYYKFPRSLSDPDGSEEESLLEAYNLLYDIIDEDGPFDGILGFSHGGTLASGFLIHYAKTYPHEPPLFRCAIFINSLPPFRMDSGENPVIDSDLDGYIKVPTVSIAGAKDSLFEYSLALYRLCDPSRSTWIVHSKAHDIPNDKKNVALMAAGIRKLAIEALAIW

SEQ ID NO: 25968 - protein, 305 aa, A.fumigatus
LSADPSPPVVEDDTAPDETTPAGLLSVLATHAVFGAIHGSTQSLSDQHPSYEEATVLWNTYVQNVEPLCKVLHVPTVAKLVDTIAKQPAAASKSVECLLFAIYYIAVFFMSDADCLQQFNQTKTQKMSRYRTAVCQALVNASWLKTTAMPVLQAYTLFLIAMRTQVDSHTFWILTGVAIRLAQRMGLHRDGESLGLPPFEVQMRRRLFWQLLPLDGYAGQVCGTGISISPTSWDTKPPLNINDDQIFPGMTQKPQEQRGASEMIFCLSRIELSNFYIRTGIEMKEIGGTIQFKDAKEIERLVHYV

SEQ ID NO: 25969 - protein, 193 aa, A.fumigatus
KKLVVLYNSRMQKKLRGSSTMSNISSETKFLRYCEILDPLHVFTMGIVRSATNAVRLRAQMPLLLKQTITDAQRRCLCALAEKILDTNSAIYRNPSMNRFRWQMQAFFLWDALLCILLSLTQVGFYSTSELNSTWNRVAEVYANHEYLIKRKKALHVTIGRLTLKAWIANPPSNSSPEPAFITTLRAQHEPKV

SEQ ID NO: 25970 - protein, 221 aa, A.fumigatus
LFHLVYKLAAYLPPSIVSFVEDKVISIRRFLEDNGILPKKEESSTGESKAVTEAREGLEKTKTSLAELYTQLKNHQADLETDYGKAGVFRALKGVCISKDSGEYTYEHCFLGETKQIPKKGGATIRMGKFGRIGSVIIDNVNETGVIVPEERVSLEYTNGQTCWNGPARSTTVILECGEENEILKVTEDEKCVYSMIVTTPAVCPGGEEEGDVAPRRKDEL

SEQ ID NO: 25971 - protein, 78 aa, A.fumigatus
TCDLPAACVRREEYGAREDVGNLGNSARDRDLDEIAKPDDNTSGVNWEQWENEEDETDAGSCLIYFIAYAGSVADSSI

SEQ ID NO: 25972 - protein, 83 aa, A.fumigatus
SQLKPTLQPRGEDTRLYELAYVAYGISYRGVWIPRLNCWDTIRQMANYIKTQGKWRLLNCTKDDAPNPAAQSSACVRIMTIED

SEQ ID NO: 25973 - protein, 61 aa, A.fumigatus
LIPAARLDDTILNVDICLMIGYPRNIYNNVRSTYALRDLVTHGWLGYQCHRERGGTVDTKQ

SEQ ID NO: 25974 - protein, 78 aa, A.fumigatus
EEEYDPKLWIEATVKKEMLSVPFDQFVQLQLCFCWCTVSVYLTTSGNTCMYQECLSETQLAILNVLGWRAQPANWLLT

SEQ ID NO: 25975 - protein, 207 aa, A.fumigatus
KPKLRLAARNRPKRASCPTTSTRNSQSGTTTYARNMASRWTAATSTRRRTGSSLRWRSPASARAARSSSQSPNGSTRPSPTGRSRISTIQRGAASSPAPISSRGRSSAAILRSWRCSVLVADGRWRRWRSSMITPIGRRCRSGWRLLPKPWRSCRRSLIFGGMGPTMGSCKIKKNCSELPVWELLAMVLRWICPMYLLIMALIVASV

SEQ ID NO: 25976 - protein, 210 aa, A.fumigatus
  UNSURE (29): Identity of amino acid sequences at the above locations are unknown.
YPDPCARGEDGPGLPSTTYTPTPSSASTXEGTDSFPASLLKAQTPLGSKKPSKTGFVPHHIYQKQSIWYHYVRQKYGLPLDSRHLYTKTDWEFFAMAVASERTRSEILESVAKWVNETVTDRPFTDLHNTEGRGEFPGPNFFARPVVGGHFAFLALQRACGGRAMEALAFLDDNSDRETLQEWMAAAAKAVEELQTQSDIWGYGSDNGEL

SEQ ID NO: 25977 - protein, 234 aa, A.fumigatus
NRAGSKFGGGGVASHSATNADRRERLRKLALETIDLDKDPYFFKNHVGSFECRLCLTVHQNDGSYLAHTQGRKHQTNLARRAAREQREGKNQDPAMLPGAMGVQVKKQAIKIGRPGYKITKIRDPLTRQLGLLFQLQYQEITPGVKPRVRFMSAFEQKVEEPPDKNFQYLVVAAEPYQTCGFKLQAREIDRREGRYWTWFDEDSKEFWIQIMFKTEREERFSGVPGLAPMGPKT

SEQ ID NO: 25978 - protein, 84 aa, A.fumigatus
FSEWDFSREYTLKTHSLSLGYFLRGIAYLLSVYKNVLFHRCMALQGSTFIVDTLRPGERHMYDLAKRQNSQSSHGLHASEYERS

SEQ ID NO: 25979 - protein, 60 aa, A.fumigatus
LAKMCCIRKESKGNNTIIFVCLQEINSKIGAMAIKDKYLFLSPLCIFIYYLNKALKLLKG

SEQ ID NO: 25980 - protein, 415 aa, A.fumigatus
AQCLNLSEALLPIQNTTDTLDEFLRHIVAKVYEPHIDLYLAEELDHFRKKSAAVVDEWDRQLSEQAASTESFLMSNVNRQADKRDFLTSFKKVIMAPVNILPSFSSSKSSETKSDHESIGSEPSSALKSPNRFSTIASPALTPTVEAPPTTELAAKAAVMKSKLEGIRSLFSIEIALSVIHSAKSSLDRAAQFVKIGGETGAAAKQQCEAIFVSLLRILGHQHLIVGFNKAVDHLSNYRPREQGERDQAGVEPLVTFLELVNVGDLILQMMDVFYEQELVGAKITDRNDFLDPAVKEKKKFEQILDERVAAGLNKGIDVLMEEVDYILATRQQATDFNPDASTDPYRKTMDVAVSEAAAAVVDVVSSHTQMLVGSTDKSTLDVFNQEVGLRLFTALCKHLKRQRISIEGSLKLIR

SEQ ID NO: 25981 - protein, 60 aa, A.fumigatus
SLRCKYVGFSCLVLLPSERGWPRLRFYSTFILFDLVFEPTEELLNCLLIALGAYTKKVLQ

SEQ ID NO: 25982 - protein, 67 aa, A.fumigatus
PGLPMIHVLCSSTLYVPKLVSGKKQGTESRSQGKYRPSITRHMDRVYGASTELSFGLLIAVGKSLVA

SEQ ID NO: 25983 - protein, 110 aa, A.fumigatus
VILAIIFLGFCLSCPLLIINFVFLFTFLPLSGFEIILIYLSYVVVLGYYEIQYPHSMARIALISGLTFKQSREIMYRLCFLSTFQAGFCLIKLGGIMSCGLHQATNLYTD

SEQ ID NO: 25984 - protein, 141 aa, A.fumigatus
TRCHSRRSPNLAAAINKMHIAQLSNSSASHSKSSQSHSTSAYGPRPSTSATNMTDLSEETSSVNAKQANPQLLTQYLNKDHGLLVQKTTALAVSQNVNAHAFLAGVEGMLNRPYLSDINHGDDKMQALAQHAKLGKFDKHM

SEQ ID NO: 25985 - protein, 93 aa, A.fumigatus
NSKVVQCASCLLRQRGWESVDYGNEFTWFSSTVPTDIEEPLPLLMRFQIVLALLTVERVLTYRTLAGFVSDNNLELSVAGTEKRVLLATTSSP

SEQ ID NO: 25986 - protein, 164 aa, A.fumigatus
  UNSURE (5),(16),(28): Identity of amino acid sequences at the above locations are unknown.
HGEDXDLALQRETHSXSHKTTYVSTSVXRAPEFLLRAGEYSAPVDMWAVGAMAVEIATLKPLFPGGNEVDQVWRICEIMGSPGNWYSKSGTKLGGGEWREGSRLAQKLGFTFPKVRRFVLVTELERIANVGRTDGASFYGEHPAASSLACIFEPFRDLVPDVGP

SEQ ID NO: 25987 - protein, 358 aa, A.fumigatus
GSHFQRYGDSSWSRSSRELLTSVEQMAPHSMESILQPPHWPASLSHFVTWCLMWDPKNRPTSTQALNHEYFADAVDPLRPKSSTSRLLGRKQSDRSFRSPTPQSSDSPSVSSKPSWFRRSLIGRSESPAPALETDQAVRPSVVSYNTTPDLQANKTRPAAAKRATWANGAPMPILPSIRPVSPLSNAVTAQASSTLAHGGDNAQSGAAKASKKIGRQLSLNSHGNHYADVHRQEAERTLNGAGTTNATLNQKESFFSHLRKRARRLSGRNQANLATDDIEANAGCMPWSNRSSLALDSVNAGDAKQNSDLNDLDRALQNVKYSLDSAALGNVPVQITSTGDVSKPQFFTTNSRPALTN

SEQ ID NO: 25988 - protein, 136 aa, A.fumigatus
  UNSURE (132): Identity of amino acid sequences at the above locations are unknown.
SSSGISNALLSLWTLTNRHSCFTDCAAATVLAYEAAEADVLLRPPRKPKKERLVNWKLILQAYGVIGMLETLTSFAMAYWYLQRNGIPFSALWFKFGVVPANVDPDWYTARLNEASSVYFINLVVMYAAPHXACTR

SEQ ID NO: 25989 - protein, 148 aa, A.fumigatus
SPCAGAGSCGRRTWMLADCLQSRAPLDILIDRCTHVVNVDGNVQALNASTLTRLKQIKDQWSNEGKRVILLARKTFSAGQIQSSPLSHLFEAEVMNQIKTGLVLVGLVGIVDPPRDEIPDVVRTLRRAGIRIFMVGVASSPFIYKSGD

SEQ ID NO: 25990 - protein, 203 aa, A.fumigatus
SEWYKVTGDFGLTALEIARQCGIVTAGVTVDDATALKRYPSVNDKFNEKSRSPAISLSGRELMALNEHQWDQLGQYEEIVFWRTTPEQKLRIVREFQAREEIVGMTGDGVNDAPSLKAADIGIALGSGSDIAIEASDMVLLDSFSAIVEAVQYGRVVFDNLKKTIIYLLPAGSWSEFWPVMTSVVFGLPQVLSSFLMIIIWYF

SEQ ID NO: 25991 - protein, 91 aa, A.fumigatus
MMVFFKLSKTTRPYCTASTIAEKESRRTMSDASMAISDPLPSAMPISAALSDGASLTPSPVMPTISSRAWNSRTIRSFCSGVVLQKTISSY

SEQ ID NO: 25992 - protein, 64 aa, A.fumigatus
LKGVLVIVCLSYCAEIPERQSSAMSSAVAELENYLQSMLALKPPGVSGSKINSITSLCTANVQV

SEQ ID NO: 25993 - protein, 62 aa, A.fumigatus
  UNSURE (61): Identity of amino acid sequences at the above locations are unknown.
WGCALKGPFIPKGLVNIPGPKTASIRAFGYATRNVHWGPALPVGWPCLERGFYHGRVTESXQ

SEQ ID NO: 25994 - protein, 230 aa, A.fumigatus
GLKAYAADLPSSHASFVLSNNCSVYHLGSCELLSIMREVNFSIPNVNKAYVNISTTLYDRRALDCTSTLPLINSLNHLAYLTTSSARIRDILTVDGGIERLVCILKEGRSRDLMEMWKWSLAFQCVVNIGVRGSESVRTRVVEADMVPVIATILDNYIKVVDKARARADSESQRQSSRHHSKAVPTSNDVSGRPSFLEQPLTAEQRTSRRHAPPSLEIPPVLDSGPWKIR

SEQ ID NO: 25995 - protein, 73 aa, A.fumigatus
IEMDSYFTRYHEVKTAEVEKGLDIHMGYMDNAVMSYACFGVYEELAKYLVQRYPNNFRLQKYYPAQLTREQFQ

SEQ ID NO: 25996 - protein, 106 aa, A.fumigatus
FVVKSWLQINDLVVEPWQSDFTMNHFHAMPYDKALKRGAKSLHFSTFPILPNKSHVLGPLGMVIGQRVRPWLQIKKVDHYGFQLPKILIVSRLYLPLFLKNSFGSL

SEQ ID NO: 25997 - protein, 660 aa, A.fumigatus
  UNSURE (25): Identity of amino acid sequences at the above locations are unknown.
DSALAVILGNTVSSSFHTRFCTGEXEVRREKCASLVEMAATAAGQSSMPWKSYFDRLGRSGMTFTRCIKACEDNRGSYKIPPPPTRHSGRSGVAYPRPPPQLVRLTSGTLIVVPPNLVDHWEEQIARHSQGLKVLVLRNMSNATPNSDDLLQYDIILFSRWRFDQEAGEAVNNRRGVFNNTMESPLFSLHWLRIIIDEGHNVAGSSQTSRTRYLLDKLHIERRWIVSGTPSSGLYGVEVSLASHETNTSSDTDLSEATEAVLQEKRKIEARDDQDLRKLKPIVVNFFDLKPWSNPLSNDHAEWTKYMRLVGKDGKRRKVQALRATLQSLVVRHRMEVIHSEITLPRLYNKVVYLEPTFYDKLNLNLFIFVLAVNAITSEREGDDYMFHTKNKKHLRTLINNLRQAGFWWAGSNLDLSATVKNALEYLEKKRAHMRQEDITTLTEGIEIAEKAFSSGPWNAFRQLNELGVYVRDFPSHARGLWALDPSKPDAEPLHMGIYQACRAQQFVKEHLKSVDPAEGLAGAGIKARREQTEAAKRQGPELGFATFPKASKKAPKKSFSKGLMKSLPPDSPLTQTKLLGTTSAKLSYLLSRVMELHSEETIIIFYDSTNSGVWIAEGLDLLGIEYSMYASTLSPELRTSYLNLLRESEENPIILMGLR

SEQ ID NO: 25998 - protein, 123 aa, A.fumigatus
TVYVTMVMYGPTAFLTKISLLWIMTRVFSPYRKAVFFIYIFLVIMLLYYIPAVIVKIRICNPIGKFWDDSINGSCLDQSAIILADAVVSVVSDAIILILPLPLTLSLQMSMRKKVRVTGPLGA

SEQ ID NO: 25999 - protein, 72 aa, A.fumigatus
PYLHILESRGYPTVQLTLNVAFHIIMNDHVHSSHVICLTAVWPQITRIITIKKYHSLEAMSKPSINYYLSSS

SEQ ID NO: 26000 - protein, 510 aa, A.fumigatus
  UNSURE (149): Identity of amino acid sequences at the above locations are unknown.
RTKGGLHSPFKRYEEPGRSTQHRLRDSTLTPSKPKSFFFSSYATLTAVVREASYATLPPITIRGRSFHFAPLGPIAIILANLVVVLVFCFYKLDTTNKWKWEDVGYRTGFVAISQLPLIFLLAGRQNIIGLFVGLSYKRLNWFHRWISXTLWLTATIHMGFWFRNWARYDYITYELQNDVLTQRGFAAWCILTFIVISSAAPIRRLSYELFVLQHLVTFAGFLAAVWLHARAEVKAWVWISIGFLVFDRVARYVWAAYANLSIFHASKSNPHPLWANVATFTPLPGNVTRITVENPGVRWKPGQHVFLTCHSIVPLQSHPFTITSIPDDGKMEFFVRAEKGGTRRFFRYASKHHLALGSGEVSTAQRPRTVFIDGPYGRIRALRQFDSVVLLAGGMGATFTIPLLRDIVAGWKAECAGNSTRRIAATKRIRFVWVIKSRAQLSWFETQIQSVLSDVDKCRQAQPDMIREWEVSIYITCELETGTPTNRKTPGLQTAIFLPTKTPKGIEPP

SEQ ID NO: 26001 - protein, 157 aa, A.fumigatus
REIFSHFGNLTYPHILIDLAFMVSDSKDDTLGMLTRMLEEVQNDPDPKMTFGEISVIQKDFGQKVQQDVESRHGFAAQAGRRKLMAQARNWLLSATLRPTHSWVYWRDADVETAPRTILEDLMRHDKDVIVPSRLYPLDFCDLRSNRPGNRCLATTP

SEQ ID NO: 26002 - protein, 148 aa, A.fumigatus
CGMTKMSLYPVGCTLWIFAICDLIGLAIDVWRPLPDWLGGEQPYDLNSWQESETALALAETLDEDAVIVEGYAEYATWRPHLAYLRDPFGDPDMEMELDGVGGVSILAKAKVFRSGVHFPAFSFEKHAETEAFGKVSVVLIPCAVRKC

SEQ ID NO: 26003 - protein, 96 aa, A.fumigatus
MAKRMGLSVIGLPHYTIWHLYEPSVDDLRHMEEMEQERKAREREEKEQAERAERMKALFVEPGPQWDIDKAFVQDSIQTDKEGRFQHATDGQLSNL

SEQ ID NO: 26004 - protein, 220 aa, A.fumigatus
  UNSURE (3): Identity of amino acid sequences at the above locations are unknown.
CYXCRGAPKLCRNFQTNCITLSRVLLLLTQVSYVYHLFSNDGAIANAAANVGSHFILNNLFTLAWILLWTRGHFWASEVMLAANYLNQHAAYWRHRTLPTFVHLSAIAGPYAWTLMALFWNGAVAVGSNSFPARIAANIFIWLIFAFGSTHILATQDDLLGYCLTFLTLGKSGLPCMGETQRLTLCSLGHRATSNQGHCSAMDLCLCHLRSLPRRVDLPL

SEQ ID NO: 26005 - protein, 71 aa, A.fumigatus
LFAALAIEQLAIKVIALQWIFAFVIFAVFLVESIYLSSTKYSGRDSLFRRITEPEPTDREREPLLNSAANP

SEQ ID NO: 26006 - protein, 62 aa, A.fumigatus
LLMCTKSHELYHVLSPLHLLPLPSSLLPLTQISDNNPSDWLKLIDYLLELTFCCVVLLYCLP

SEQ ID NO: 26007 - protein, 148 aa, A.fumigatus
VSGRISGARSASQLPCRVFTLSVRQQAVSRGTVLCEIHQNHASRKNGWTDAHYSMHQHYLVPPVAGPMARSITTIEYFMQSLLDSNPWDIDPGCIPIPWRKELAAMPDRKLKLGVIFDDGVVKPQPPITRALREVTRKLAAAGHEGIL

SEQ ID NO: 26008 - protein, 91 aa, A.fumigatus
WYACCLSLSTSADKTQMSDSYNHIFGQSINAFNHELISGGSSGGEGALLGARGSILGIGTDIGGSIRIPAALQGLYSICPTTGRVPWDCSL

SEQ ID NO: 26009 - protein, 304 aa, A.fumigatus
  UNSURE (7),(11): Identity of amino acid sequences at the above locations are unknown.
FTHHFCXPSAXIDHGLYDGTLLRIFGEHFQAYQDNVPVDRFTSFKDFAFHIWQMDKSRTLSFWKQSEKHPIAFEFPSSSGTEPRINSVHVHTINLEFDAFAKSTGATVSIIFQSIFQLWLALRSNQRDVAFDYLYTGRNIDLPDPQTINGTCANFLPMRSKVDPSMPVSEFLRQTQDEFWQYTENSTVGMDEIHEACETTREGFSNKTLFLFQPFEPAPATAKQYEKWIVMAKSQVTMPQPYAVVFEVVKTADVNEYKLKFAFDKRVYEKEQVQGEAQVIEKLLAKVMENAEASVGDVLGSFRS

SEQ ID NO: 26010 - protein, 229 aa, A.fumigatus
  UNSURE (7),(11): Identity of amino acid sequences at the above locations are unknown.
LRITFAXRQLXSTTACTTERFSAYSASTSRLTKTMFLWTASLHSKTLHSTSGRWTSRARCRSGSNLRSTLLPSNSPAAVAPNHVSTLCMSTPSTLSLMRSPSPPVPLSPSSSSPSSSSGWRCAATNATSLSTTSTPVATLTCLTLKPSTAPVQTSFPCGRKWTRQCLCRNSFVKPRMNSGSTPKTVRSAWTRSTKPVKRRVKDSRTKLSSSSSHLNRPRRQQSNMRSGL

SEQ ID NO: 26011 - protein, 67 aa, A.fumigatus
SPSNNCGSGLLRGEDLVLYYQFDVRALRKLEIWYIAIITSLVSIPAIVFLFIHTPEKGPMYGGVTVS

SEQ ID NO: 26012 - protein, 397 aa, A.fumigatus
  UNSURE (270): Identity of amino acid sequences at the above locations are unknown.
ALDPPVATLDEFVKQVLPADILSKKDLTVTPPSADINLPRSSVHGGLGETDMLKLLETYRKQIDISGKSYLGTGYYPTIVPPVILRNILENPAWYTSYTPYQPEISQGRLESLLNFQTLTADLTGLPFANASVLDEATAAAEAMTMSLATLPMAKQKKPGKAYVVSHLCHPQTIAVMQSRAEGFGINLVVGDIMANDFELVKKQGDNLIGVLAQYPDTEGGVYDFQALSDSIHAAGGTFSVATDLLALTLLKAPGEFGADIAFGNAQRFXVPMGFGGPHAAFFACADKYKRKVPWTVVRGVQGTSGQPGLEDGFGRPGKNTSVGEKATSNICTAQALLANMSAIYAVYHGPGRPQVDRSACHGHDIDAAGEAHCLGLQCSCQGQRYFRHPDCRVWQQ

SEQ ID NO: 26013 - protein, 93 aa, A.fumigatus
GDRHQVHSPQLGTDLPLSYPPGVQHTPFRNRNATIHPPPRVERSVSRSFHDSSWLLHDEAQRNHRDDPRLLARVLPDPPLHARRQSQGVHADD

SEQ ID NO: 26014 - protein, 422 aa, A.fumigatus
VPYMRYTTVPAGLKSIAQRVMAMTSTLQEKLTALGYNVPVKGSAIFDTLTVEFGSSEEADALIATAQEQNIFIRRVSSSKVGISLDETVGREEVKSLLQVFAKHAGKGEVELSEEIGIKSIPPNLERTSPYLTHPVFNTHHSETEMLRYIRHLESKDLSLAHSMIPLGSCTMKLNATTEMIPVSWPEFSQIHPFMPADKAKGYTQMIDDLERQLADITGMAEITVQPNSGAQGEFAGLRVIKKYHEANGGEKRNICLIPVSAHGTNPASAAMAGMRVVSIKCDTKTGNLDLADLKAKCEKHKDELAAIMITYPSTFGVYEPGVKEACEIVHQHGGQVYMDGANMNAQIGLCSPGEIGADVCHLNLHKTFCIPHGGGGPGVGPIGVAEHLRPFLPSHPASEYLQSKRAATSSPPISAAPWGSA

SEQ ID NO: 26015 - protein, 275 aa, A.fumigatus
GATPRSSADGGRRGRRTLGLQVLTGRVRRQERTQVLGNANGTHAGATTAVGNAERLVQVQVAHIGTNLTGRAQTDLRVHVGAIHVDLSAVLVDNLTGLLNTWLVHTKGARVGDHDGCKFILVFLAFGLEVSQVQVAGLGVALDRDHTHTGHGGTGGVGAMSRDRDQADIALLASVGFMVLLDDTQTSKLALSTRVGLHGDLGHAGDVGELPFEVVNHLRVPLGFVGGHEGVDLGELGPGDGDHLGGCVELHRAGAKRNHGMSERQIFRLEVADVS

SEQ ID NO: 26016 - protein, 289 aa, A.fumigatus
  UNSURE (89): Identity of amino acid sequences at the above locations are unknown.
AIDLRPAGTVVYRIYGTHVGKQSLSGANVASGLFPDGCVFPGSAETIFKPRLPRRSLDPPNNRPWNLPLVLVGAGKESCVRTTESHRDXESLGIPKRDIRTELTGSLEEGQCEEIGSNAEGATSGVDAVAQSLEIVHTTLGIGVLRENTNEVVTLFLHQLKVVRHDVTHHQIDPESFSARLHDGNGLRVAQMGHHIRLAGLLLLSHGEGGQRHGHGLGGSGSLIQDGSIGEWQAGQIGGQGLEVQERFQTALTDFRLVGCVAGVPSGVFQNVAEDNRGNNGGVVAGSQV

SEQ ID NO: 26017 - protein, 61 aa, A.fumigatus
FMDRKNALKTTSHIIQGILHHFTAELQIGQSELLTTANTAYVIVADDPRESFDWQLKIINT

SEQ ID NO: 26018 - protein, 191 aa, A.fumigatus
  UNSURE (143): Identity of amino acid sequences at the above locations are unknown.
SGLIVLLGQHKSPAKTSTVDLEPFVRKVVLNAMVKIVCEILCKPGFKEFYLEKHRWYVEKLWRYVGRLVPDIPNYQTEGRTRIAQIIAKGQGLSVDMLLTPLEYVHYFPESDDVFDPIEMVNMDPTNDRSPGELRRLWFRIKXAYTPVTYIRANFEESSNTELVFRSEVLLMPENSAALIPESLISGLDGN

SEQ ID NO: 26019 - protein, 122 aa, A.fumigatus
GVNYLLAPVNFGILLAFPRLRVWAAPAGFVTMSLALALSSLSTTTTELIISQGVFYGLGASVAYTPTIIFMDEWFARRKGLAFGIMWVSIPTLCSLYYHTKKKRRQEQVSPVSYFQLCYNGF

SEQ ID NO: 26020 - protein, 114 aa, A.fumigatus
FCDEALSTEGGEYTALVTTPIKRENVNDRWTVAYTAVGESFTFGDKEIPAKPEDFEFASRFWSLAEKLLAEGKIKPHRPRVCPDGLKGVLNGLQLMREGKVSGEKLVYNVAETP

SEQ ID NO: 26021 - protein, 70 aa, A.fumigatus
KKKKAGTGLAGVVLPVVLQWLLNTYGYRVTLRAWAVILFVLAAPLLYFVKPARAYLGVVQHAHVQPLFRP

SEQ ID NO: 26022 - protein, 111 aa, A.fumigatus
VHMPNAWVWPANMSQGRPMRVRNNAYIQNWEENRREEMKELTSKGIIPVEHDFENLGDDVDDETLDNARPFLMGKVSAVVSEKKPAKAIVDEIVSDAAALLKQGNRMLAKL

SEQ ID NO: 26023 - protein, 296 aa, A.fumigatus
RSVSSVEQIRTTVTDLVKINHPVLVAGMNVAAGPKLAAAVTNAGGLGVIGGVGYTPEMLREQIAELKSYLHDKNAPFGVDLLLPQVGGSARKTKSELLPFYIYSMLGPRMLTRLFSSYDYTKGKLNELVDIIIQEGAKLFVSAVGVPPKHVVEKLHAAGVLYMNMIGHPKHVQKALDAGADIICAQGGEGGGHTGDVPTTILIPTVAKLCQGKKSPMTGQPVQVVAAGGLFNGNSLAAALMLGASAVWIGTRFILSDEAGAPVAHQEAVRTAGFEDNVRTIIFTVSPHAECMGMAS

SEQ ID NO: 26024 - protein, 310 aa, A.fumigatus
  UNSURE (7),(23),(27),(39),(40),(49),(50),(66),(73),(86),(94),(102),(113),(124),(125),(127),(132),(135),(141),(143),(155),(156),(158),(160),(175),(187),(195),(199),(203),(207),(208),(209),(210),(211),(: Identity of amino acid sequences at the above locations are unknown.
QPKKNTXNHNPPTKKKNPTNTQXKTNXTPPNPHTPKKKXXNHQQQPTKXXNKTPPKQPKKTPPKKXNHHQKPXPKKNNPQKKKKPXTKTQPPPXKTPPKKHXPQKPKPHPKPXHTKQNKPTKKXXKXQQPPXQQXKQNKTXKXNQKKNPTTTQPXXPXKXTKPKTPPPQKTHPQXTTTKHPTPNHHXQHPHTNNXHPQXPKTXHNHXXXXXXXXXXNTVHPSPSPIWPARLLLSPRRLPLQPFPPIAKLLAVGWPPLLAPDILPAEFGALEGVRFGDGVDACGGAGCYGAGVGIAAGAGADDQETEATPF

SEQ ID NO: 26025 - protein, 291 aa, A.fumigatus
  UNSURE (6),(23),(27),(38),(40),(48),(49),(66),(73),(85),(93),(102),(113),(124),(127),(132),(134),(140),(143),(154),(155),(158),(159),(175),(186),(195),(199),(203),(206),(208),(209),(210),(212),(213),(: Identity of amino acid sequences at the above locations are unknown.
NQKKTXKTTTHQPKKKTPPTPKXKPTXPHQTPTHQKKXPXTTNNNPQXXKTKPPQNNPKKHPPKKXTTTKNQXQKKTTPKKKKNXQPKPNPHXTKHHQKNTXPKNPNPTQNQXTPNKTNPQKKXTKXNNPPXNXPNKTKXQNXTKKKTPPPPNXXTQXXQPNPKPPPPKKPTPKXQQPNTQPPTTXPNTPTQTTXTPNXPKPXTIXTXXXTXXXXXTPSTPPPPPSGPRDCCFRRAVSHSNHSLQSLNSWPSAGRPFSPQIYFRPNSARLKACGSATAWMHAGVLVVTARA

SEQ ID NO: 26026 - protein, 246 aa, A.fumigatus
  UNSURE (6),(22),(23),(26),(38),(39),(48),(49),(66),(72),(85),(93),(101),(102),(113),(124),(127),(132),(134),(140),(142),(154),(155),(157),(159),(174),(186),(194),(195),(199),(202),(206),(207),(208),(2: Identity of amino acid sequences at the above locations are unknown.
TKKKHXKPQPTNQKKKPHQHPXXNQXNPTKPPHTKKKXXKPPTTTHKXXKQNPPKTTQKNTPQKKXPPPKTXPKKKQPPKKKKTXNQNPTPTXQNTTKKTXXPKTQTPPKTKXHQTKQTHKKNXQKXTTPQXTXQTKQNXKXKPKKKPHHHPTXXPXKXNQTQNPPPPKNPPPXHNNQTPNPQPPXPTPPHKQXXPPTXQNXTQSXXXXXQXXXXKHRPPLPLPHLARATAAFAAPSPTPTIPSNR

SEQ ID NO: 26027 - protein, 331 aa, A.fumigatus
TRTVVKLLVHVQPFLHHADLARAEEGEDPNLCERQSNAHQLTNEVHYLWNDRIDVDIVADDRRVVPPQLQRHPLQGLRTTRHDALARENRAGETDLVDARVLRDHRAEVIASAQRLDHPGREALRRQLGELQAAIRRKRGGLDDHGVPRVHGGDDLADGQQDGKVPRHDGPADAERGVPLDDLVFVRVFDDRFGDLDCRDGSSPLHGHSDLDGGLAERLALFLRHEPGQCLLVCFDLVGEVVESGATLGERGLGPFAERLASGFNGSIEVLLSRNGNLGVGLPVRRIDAVTGLRGRGQLIVDHIVESLDWLVDGDRGERIITVMSKDMMMN

SEQ ID NO: 26028 - protein, 230 aa, A.fumigatus
QTRYITFGMTASMLTSSQTIAGSFPPSSSVTRFRVFAQLAMTRLPVRIEPVKLILSMPGCSVIIGPRSSPPLSAWTTPGGKHCAASSASFRPQYGVNGEGLTITVFPVYTAGTILPTASRTGKFHGTMAPQTPSGVYRWMIWCSSVSSMTVSGISIVGMVRAHCTAIPTSTVDWLSGLPCSCVMSRASASLFASILSAKWLRAVRRSANEVLDHLRNAWRADSTARSRSS

SEQ ID NO: 26029 - protein, 269 aa, A.fumigatus
PVQTFHNVINNELTTTSQTRHGINPANRQPNPEVPVSTQEDLDRAVESARQAFRKWSKTSFAERRTALNHFADKIEANKEALARLMTQEQGKPLSQSTVEVGMAVQWARTIPTIEIPETVIEDTDEHQIIQRYTPLGVCGAIVPWNFPVLLAVGKIVPAVYTGNTVIVKPSPFTPYCGLKLAELAAQCFPPGVVQALSGGDDLGPMITEHPGIDKISFTGSILTGKRVMASCAKTLKRVTLELGGNDPAIVCDDVNIDAVIPKVMYLVC

SEQ ID NO: 26030 - protein, 228 aa, A.fumigatus
LKCEYGAFDNEHVVLPLTKYDHIIDRDSPRPGQQAFEKMTAGLYLGEIFRLALIDLLDSRPGLIFQNQDTSKLRKPYLLDASFLAAIEEDPYENLQETQELFERELNIKPTLAELEMIRRLAELIGTRAARLSACGVAAICKKKNIESCHVGADGSVFTKYPHFKARGAQALREILDWAPNEKDKVTIMAAEDGSGVGAALIAALTLKRVKAGNLAGIRNKDEMQKLL

SEQ ID NO: 26031 - protein, 60 aa, A.fumigatus
  UNSURE (12): Identity of amino acid sequences at the above locations are unknown.
RAVIKRCGDMSXVSLLQFYPQYLFYLTYCPCGIIQTAELHRKMWQTLAYKIRKMERNLKS

SEQ ID NO: 26032 - protein, 71 aa, A.fumigatus
NARYCYEYYNHCYYEGVPFWIERIQADYQSNDLYLTTELCMYVILDPTKASRPGNTSLFKTRVPNRADNNK

SEQ ID NO: 26033 - protein, 342 aa, A.fumigatus
APGDRLAGDVFNILGAVLQGVLPTMIILAVYYTRADIVLLGQCFYYRGFTLRDKLSNPTSPADINSEEEPSQTRKATEHTSLLPPKSNGHSHHVLAQEPHYQSGQAGPAAAATTSQVRPLPSHPDHRRHSATSFREIIHLNVDGTHLSPATPFIEPTSKEYLSARRISTLQTVLFNLTTIALVCAAGVLGWYVSPSSSKNEESDLPGDDRDSSSLTFDTVGQVFGYLCAALYLGSRLPQILLNYRRKSTEGVSLLFFLFACIGNLTYVLSILAYSPVCKRHSHHPHDCRPGEAAALYGRYVLVNLSWLIGSFGTLLLDMCIFIQFFLYKENGDGIDGSSACD

SEQ ID NO: 26034 - protein, 65 aa, A.fumigatus
QRYKSEMDGKKALVWKYSLGVLLVGLLIMILCTQNAYIGEKEEKAIVKFVRKISFLHFTAMQEFP

SEQ ID NO: 26035 - protein, 195 aa, A.fumigatus
  UNSURE (2),(13): Identity of amino acid sequences at the above locations are unknown.
QXAIQFPVPSGAXYAFTLDPLFAPIDPSASKVSVMSTKIELVLRKKTAGQKWGALEASSSSAKLADRQAIIGATPAAESGPSYPTSSRRGAKDWDKVASALTAKKSKGKGKERSAEKDAKAGDDSGDDSDGADSIDSDYGTGDPVDAFFKKLYANADPDTRRAMVKSYVESQGTSLSTNWKEVSQGKVEARPPSD

SEQ ID NO: 26036 - protein, 114 aa, A.fumigatus
PCWLSFCPIAFSVEDSSEAILLFAIAKNHRFLTDVLLLTLITMIVTGVYVYLPDHLRSIYGHLYYYWAGERPFVSTGLPSIGAVFRDNSTKTLEMVYDTVKDAAATATGPIAEL

SEQ ID NO: 26037 - protein, 601 aa, A.fumigatus
  UNSURE (10),(502): Identity of amino acid sequences at the above locations are unknown.
PPPEDSHSIXSRRSVRSIPSIIVNDVGSRPGSRPGSRPGSRWSERKWSALRGKRSGEFDRRPESPPPPPQIERPFNKISLDIPNGSLDGLGPQSMRFSKRGSLIKEEDRQRLQREISKHELPQQDQPQPAAESSIEQSEQTETGETSAPVTVAEENSAEPELYGAQRRRTKPLSYLRARHSSVPSRAISADEDMLSRRVRLMYEKGDENVTDSEVAKSLAMENGVLWEEVAPTPTEASAVSGRSASGGESVGPESSNGSGPKREPHELAGGIEYWQNIKAGDVDRYGFIRSTTFNSADGTEHSPIQRVSTSLLLASETPRRKHSIRPPSALGGNRSFSGRSPTRKISAPSMRPSSSQSTYSATLRRSTSRFRQAANHLPHNRDRRFKDEARDMLTLPSDAAASGTGRDSAVARAMRKKEWQREDKWTKMAKPTRRTALGGGMTFEFDTQSPKLIERTWKGIPDRWRATAWYAFLEASAKRRSDSPTEQELVEAYNEFQLISXPDDVQIDIDVPRTITSHIMFRRRYRGGQRLLFRVLHAMSLYFPDTGYVQGMAALAANLLAYYDEEHAFIMLVRLWELPRMERVSQSGFSGSEWNPPNEL

SEQ ID NO: 26038 - protein, 78 aa, A.fumigatus
LAAEHISEPTMDFILILICILLFSSIIVLSYELIFEIETRDTSSESLIVILFHLSYSRYKNLILSVNAKWFESHYAAF

SEQ ID NO: 26039 - protein, 112 aa, A.fumigatus
FLDTKQPGFFSLQDNHWRYRSPFRTDTFNNCNLFAVPLDNCTRSLTMFYCSNNLRYYTESHCKASFVKVPDIIFMYAVFLNSFAYSLKPLSDNLRILLFCPLVCNPLIISCT

SEQ ID NO: 26040 - protein, 174 aa, A.fumigatus
ARAVIVALSIPVSVSVPVPVPIPVPVSVPVPGSTAITVPRSIPVTVSFALFSSPALISFLSFLFSLLFKSPFLFPLALTLCTSLLLTLFPSCPFFLLLLAFDLALLAFLFGLSTSFLLFEFSLFAHRLLPFSFAYLTLSSYLRSEILVCFVAGLLLFRSELVSDLLTTDLPDRI

SEQ ID NO: 26041 - protein, 160 aa, A.fumigatus
SRSRSLSLSLSLSLSLSLSLSLSLSLVRLRSRSLDRSQSRYLSRSSRLRRSYLSCRSFSRCSSSRRSSSRWRSRSARRCSSRSFRLALSSSSFWRSISRFLRSSSAFRRASCSSSSLCLRTVSCHSRSRISRLALISAAKSSSVLLPACSSFAASSSPTC

SEQ ID NO: 26042 - protein, 141 aa, A.fumigatus
ELSVRYANENGRRRCANRENSKSKKLVERPKRNARSARSNAKRRRKKGQDGKSVRSSDVQSVSASGKRNGDLKSNEKRNDRKDMSAGDEKSAKDTVTGIDLGTVIAVEPGTGTETGTGIGTGTGTETETGIESATMTALAQ

SEQ ID NO: 26043 - protein, 323 aa, A.fumigatus
RPELLSRERGKAATLIEGAVDRSDVYKKAEKLIDALASNHLQFILDSVREIRRQQVGDELAAKEEQAGNKTDEDFAAEIRAKREIREREWQETVRKQRELEEQEARRKAEEERKKREIERQKEEEERARRKEREEQRRAERERQREEERRLEEQREKERQERYERRRREERERYRDWDRSRDRDRSRTRDRDRDRDRDRDRDRDRDRDRDRERDYDRPRSIGYRSPRYRDSRREKSVTPKEPTQAPPPPPPPPVAVDDKSLEEAALQLLLKEGEELAAKARQKPEFDFEEAEAIENGLKPPPTKAKGATESSIPLHHGMTERV

SEQ ID NO: 26044 - protein, 547 aa, A.fumigatus
AQMRIFYGVWQIYMPGSCGRFLRIRKVKCDEAYPACRRCLSTGRTCDGYGIWGGGSSNRPTKPSAVAVNSALVVRPMIDSRLPTRITNEEGRYLQWFKERTVSKMSGSFFSEFWSGLVIQAGMSEPSVLHAVLALSSVHRQGVLTDGGVKAGDMEMITLTRYSKAINFLQPHFKAKNRTAFRTALIVCILFIALELLRGHFASARIHLQQGLNLLEGSGLLRRQGGVLVGQSQVYVDDWIVHALSRLHIQLELLKQVHRGSSLRLEIPFLECKSLTFPSVKEAWSWLHHLMGKAFNLNREVREQFCTESNLPAELLRRQRSVHENLTCWLNTYNHTIQGSMRKDQAQIYGLLRTYHTMITIMVATCLHPGDEMIFDLHTDQFLEMITTLAQLWKFLSTFSAFGSRPAQFFMSRSIGDLGWIAPLYYTAIKCRVHRIRLHAIRLLEGSFHREGFWDSQILAFVARKVMEIEEVDFYQLLDSRDDFELHCPPDQEDLLFPPLPGSCRLSDVEVRLLGDPVNTISILCSPNDQGTDRKICVASYDVAFYR

SEQ ID NO: 26045 - protein, 106 aa, A.fumigatus
  UNSURE (70): Identity of amino acid sequences at the above locations are unknown.
NTYCKTEEHRTSRVTMTPSTYDMHMRSQQIRWSLRASAKNYTSQSDSTFGHVKLEASPRVFIDCETGTGXHRTTMSKLTPIVTQDTLNPETTINHACPLLKDDTVP

SEQ ID NO: 26046 - protein, 342 aa, A.fumigatus
  UNSURE (62): Identity of amino acid sequences at the above locations are unknown.
ILIPLRLHVDQDAVDFICRFFEFRDDNAPTPSSPADIPFLQRVEVNAVPVKLDFKPKRVDYXGLRSGRTTEFMNFFVLDGADMVMRHVIIYGVSGFDKLGQTLNDIWMPDIKRNQLPGVLAGLAPIRSLVNVGGGVKDLVVVPMREYRKDGRIVRSIQKGALAFAKTTSNELVKLGAKLAIGTQTVLQGAEEMLTAPTATTLGSEEDMIDEEEANKISPYADQPVGVVQGLRGAFRGLERDLLLARDAIVAVPGEIVESGSAKAAAKAVLKRAPTVILRPAIGVSKAVGQTLLGAGNTLDPSNRRKIEDVSVMVKYVSRVCLLTSLLRNINAIKTVGHIGQL

SEQ ID NO: 26047 - protein, 135 aa, A.fumigatus
GTQRSIPDNCQNRVRSNFNSVARERLDVGTVNLLQPNEMMIDLNNTPQTSASIYVVLKVYVTGQCRDHERELHIYKQINQVETNHPGRNFIRKLRDHFYIQGPHGRHVCLVHEPLGTSADVLVKSSPRGWKEPRH

SEQ ID NO: 26048 - protein, 152 aa, A.fumigatus
IRRPHIHHCVATLCLHALLAAGSFALIFMMQRAARNAWTICVPGAHRGFTIFLPSASCRRRVSPLSSLRTTVVPRRTAMSSSQWTCTPRTFPTSGFELLDQSIELDEETLPTYRPEKYYPVTQGEVLNDRYQIIAKIGYGVTSTVWLAKDLM

SEQ ID NO: 26049 - protein, 148 aa, A.fumigatus
DECIVEYRQPIKYVQAGKHKHRRLTRPSGFICRIPTVHACSPLDTNQPTGARLHHPHSVIAQPEACPVARGPSPRTARAGRGTATCGSRRATRRRCGRRRRGCRDTRRGRRGTRRAGRSGSRSGRRGSRRSSSGTHSRRPRPRPGPRT

SEQ ID NO: 26050 - protein, 248 aa, A.fumigatus
RRSHPSQKPAIGHNLADVPGHHAPKGREALGVRDDLRQRLHRNVPASRGGRAPRHAEEDLDVLVARDGLGPGVPGGEVEVVLGRGAGVVRLQAAVVVVELDPDGVEGDGAVEHGPVGGVRVGALRGGGEVLLLGGVGTEQGAELVGEGRHVGDGGLKVQVEAVHGRFAEGAESGGVVAGRAEGLPDAVGSGDGGGLTGEAAFGVGCTANGEEDGLAEGLTDGDVFSVGRLVVCTLLEGVEGSTLSEDS

SEQ ID NO: 26051 - protein, 232 aa, A.fumigatus
RHKPPQLSSDRVLPSTPSSNVQTTKRPTEKTSPSVNPSARPSSSPLAVQPTPKAASPVSPPPSPEPTASGRPSALPATTPPLSAPSAKRPWTASTWTLSPPSPTCRPSPTSSAPCSVPTPPSNSTSPPPRNAPTRTPPTGPCSTAPSPSTPSGSSSTTTTAACRRTTPAPRPRTTSTSPPGTPGPSPSRATRTSRSSSACRGARPPREAGTFRWRRWRRSSRTPRASRPLGA

SEQ ID NO: 26052 - protein, 67 aa, A.fumigatus
RVSGWGASGARFGVRVGVGVDDCESHYCFDDYLYVHSYYHYVQHDECPDDLDECHDNLDDVVHNDDE

SEQ ID NO: 26053 - protein, 98 aa, A.fumigatus
TPNREDIPICQSLGKTILLSIGGATYTEGGFTSESAAIAGANSVWQTFGPPSNNPSTLRPFGKAAVDGFDLDFESPVANMPAFANQLRSLFSSDPSKQ

SEQ ID NO: 26054 - protein, 255 aa, A.fumigatus
YLTAAPQCPYPDAADGPMLDGAVSFDAIWVQFYNNYCGLQAYNPGSTSQNNFNFATWDTWAKSVSRNKNVKVFLGVPGSSTAAGSGYVSVEALAQIIAYTKGFSSFGGVMAWDVSQVMANSGFLAGVRAALGSGSGSGSGSTTVSPTTASTTTSTSTPTTTTSSTTSAPTTSTSVTTTSTTSSTTTTSSTTAPTGSCPTAGARCSGGGAACNGASFGLCDNGVWVMQPCPGGLVCIQGGAGVYCGYPADKPAGSC

SEQ ID NO: 26055 - protein, 139 aa, A.fumigatus
QTQQNKTNSAVQLIHKPTGIVVKSQATRSRSQNEKIARQILADKVEELLKGDASRNAIRAERARKKKASKMKKTRRKYRELGKGAQNEKHEDGDEVDVEDDTGDGSEVQGAPHVSRCDAEDSTTQKTCDNHAAEQKQLG

SEQ ID NO: 26056 - protein, 105 aa, A.fumigatus
  UNSURE (3),(55),(56),(89): Identity of amino acid sequences at the above locations are unknown.
QPXSQPHLPSQEHPPGHELSTDRREHPSEQEGSSPTTSLPTSANWIWTGGTTKAXXNKKLPLHWAPQTGLKITSAAGRKFSKTPLQPGXGPVKSTSAPYPSTSGA

SEQ ID NO: 26057 - protein, 147 aa, A.fumigatus
  UNSURE (81),(133): Identity of amino acid sequences at the above locations are unknown.
RSHYLSTCLKGRFWSLPSRRTTQQIGVTLRKPSGQPTQWPAFTQLRAATVDATQNGLNFSGSSTPTVRVLGPNSEDHDNHXANLISQVKSIPQDTSSLRIEENTPQNKKGHPQRPVYQHPRTGYGRGVPQRPXRIKNCPCTGPLKRV

SEQ ID NO: 26058 - protein, 73 aa, A.fumigatus
WSVVQIQYRLISSSLSLILSLFVCSVCCLCVSCLRQHGICSQDYMINLINSIHSLSLGYGNYILGSMEGYSLL

SEQ ID NO: 26059 - protein, 82 aa, A.fumigatus
SLRRRSPLHPLVRAPFSATPRSEMSATTAEKASTGRTLEKKPVKFSNLLRMSLPHHESYATPAILAAYHPILIQLEIQSVQD

SEQ ID NO: 26060 - protein, 228 aa, A.fumigatus
THRISRSHSRGPGLRPPPKGAVLLFVASEAEFRAKVLGAPDFLAGIAGGMTGGVAQAYATMGFCTCMKTVEITKHKMAAQGVKPPGTFATFMDIYRKEGIRGINRGVNAVAIRQTTNWGSRFGLSRLAETAIRKVTNKDENQKLSAIEKVIASGLGGGLSAWNQPIEVIRVEMQSKKEDPNRPKNLTVGKTFKYIYETNGIKGLYRGVTPRIGLGIWQTVCMVALGDM

SEQ ID NO: 26061 - protein, 153 aa, A.fumigatus
VEFIGATASLKGGSGLSGFAMSKFAIRALSQSLAREFGPQGVHVSHAIIDGIIDTEKTKEYSREVPDSKIDPQWVSGQRTSHKSPILIPDFRLRNHTGSYTPSPGHRSRMNWTFGHPRKRGKAIAAVFMVDGLCPCSGYRTGPQSQVPSPYEQ

SEQ ID NO: 26062 - protein, 100 aa, A.fumigatus
EGLYEGSPSLCQVWDSFKKDPAIKMTSRIVSLSPDHSEINMKAESQTQAQKPEDMDQKKEEPMPPVRQDAFGDEEFAEVKYKVLKWWSVSRPFAHIPRRR

SEQ ID NO: 26063 - protein, 157 aa, A.fumigatus
  UNSURE (35),(79),(100),(123): Identity of amino acid sequences at the above locations are unknown.
LLTPSNRQGGLLMVAETISLGILSLPAAVGTVGLXPGLAILISMGILASYNGYVIGQIKLRFPHITSMSDAGEVLLGPXGRELLNATQILLLIFIMASHXLTFTVAFNVMNGHATCSIVFGVXGTVISCLLSLPRKLEKVSWLSLVCNLCCRGTGTG

SEQ ID NO: 26064 - protein, 506 aa, A.fumigatus
MQCADGPAPEVKRKGKKLMNHLQPWTKNPDFIGHPKLEYLKQVVLNHFMDRGEGTAANGDQSQSATRIMIFVHFRDSAEEVVRVLKRHEPLIRPHVFVGQSSAKGSEGMDQKTQLSIVQKFKKGTYNTIVATSIGEEGLDIGEVDLIVCYDSSASPIRMLQRMGRTGRKRAGNIVLLLMQGKEEESYIKAKDNYEKMQQMIASGTRFTFHDDKSPRILPPGVRPVAEKRQIDIPVENTQADLPEPRRRARPPKRPPKKFHMPDDVETGFAKASSLTGKVTKKAETKRAVRKPTPEPVEVPALEEVLLTPRQQQDLERRYCHIAGTSPEFIRNPRVDAYPRLQSVPRPTKAVKHGSLTSRMIGTLQKMGKVSVDCESRYRKVLALDSSKEIVDSVLSRDPWPPAKNSGRLGEKTHAFKRPSATPRPNNVHVREDENEDNCTPELVSPEKLMSSFLEPHTERPLYSSQRSQDAFELDFPDVETLLNRSAERHVSRKRNRFVLDDDSDE

SEQ ID NO: 26065 - protein, 137 aa, A.fumigatus
ASGMHRRRQGIYRPGRTDFCLVAVSAKDNSSHNIYMYGGKGANELYDEIYVLSIPSFTWTKISEGKSPRYGHTCHLVANRQMLTVGGASSDDLSTCDWEYRGVAIYDMSTSTWGSVYDAFAADYAVPAKVYQVIGGG

SEQ ID NO: 26066 - protein, 135 aa, A.fumigatus
LALKHRSEKSQRQRIIVFSCSPIEEDEKTLVKLAKKMKKNNVSIDVIAFGDLESDQTKKLEAFVENVKGGDGSNLAIIPPGPNLLSEELQATPILGGEAGVGGAGAEGGDGGFNFEDAAENDPELVLQPRGLEGH

SEQ ID NO: 26067 - protein, 115 aa, A.fumigatus
QKRRLYVRIPWFFQALISSDAQGLTTCSSTRWQAQVDAVSVIHSAKMRAHPQSAVGLMSMGGKGPEVLSTFTSDFGSILAGLHRTKIHGTAHLSSSIQVAGVCDLSSVSSFVDGY

SEQ ID NO: 26068 - protein, 422 aa, A.fumigatus
ARGTSSPCVKTETSMSSINYAPSGEDSLCSIRPVLRVSSRRRKSSFGNLTRRWLSINSAVQTSIAQPAGSQPGRKCVEHARSVGPTQTQRVESTSDKGGNHYTVPSETGHCADYESSTSLHRSETRSEDSQNATRENRRPFNLFANTQTSTTNSPAKDKAIGVMESLSIRDRKKLRYRLYLSRMGRDHGSRDNGGRWTKVGDFLEAMQQESRLWPKKGPVQKELLLPEETVALMAGITDMAMKENVWYVPVRNGCRVHVLHPLESEGQHRKVILSGSKRSVELVGDHIMRTRMLQEQGDPLVDIRKPPVPVYPSIEAMRRKNLPVPLVRGVWDFYQAFKQPAPLHTLLNSSANISSVREFAEHVEELTRSRPSSKVIRGKPGTHHRERVAAALVALFQNDANREYFSTAALNRALSFLFDNE

SEQ ID NO: 26069 - protein, 227 aa, A.fumigatus
AVFLIDVHWQPRGEDKLAKNIYSMDAYIFMTLRLPHLFQLVPFATQHVAPLVNLHHGLSLRLANFLEGTGSHQATLDTDALLAPLLHLPADALLDRQHKLHIPLSDQRDGLAAAARTRRTTDTVHVVVRVAGHIVVDDQADGRDIETTRGDVRGDEDAGRGGAEAGEVGVPLGLGKETMQGGDAVGEAAEHALEQVGGLGVIAEDDGRFGGVALGGEEDVQEGFAMR

SEQ ID NO: 26070 - protein, 222 aa, A.fumigatus
KWIDHVRLTPPLRGRLFLPKNFEEFQHRKRYPTSTMTSPVPSEPVSEDTHDSSSGSEVEPSKTSTRAPKRRRLSESSDDSDDSYVAPAPLPTLSRIKKKGAPDAKPAAPAGQDNPVLIRDALEIGLREEASSFAALNVAPWLVGSLTTMAVRKPTAIQKACIPEILKGRDCIGGSRTGSGKTIAFSVPMLQKWAEDPFGISGVVLTPTRYASLRDGMEIDRY

SEQ ID NO: 26071 - protein, 188 aa, A.fumigatus
RIAKPSCTSSSPPRATPPNLPSSSAITPRPPTCSSACSAASPTASPPCIVSFPSPSGTPTSPASAPPRPASSSPRTSPRVVSISLPSAWSSTTMCPATRTTTCTVSVVRRVRAAAARPSRWSDSGMCSLCWRSRSASAGRWRSGARRASVSRVAWCEPVPSRKLARRSERPWWRLTRGATCWVANGTS

SEQ ID NO: 26072 - protein, 355 aa, A.fumigatus
VCRELALQIFEQIKAISAPQSMKPVLITGGTDMRPQAIALAGRPHVVIATPGRLADHIKSSGEDTVCGLKRVRMVVLDEADRLLASGPGSMLPDVETCLSAMPPSSERQTLLFTATVTPEVRALKNMPRSANKPPVFVTEISTENQGTIPPTLKQTYLKVPLTHREAFLHVLLSTEGNASKPAIVFCNHTKTADLLERMLRRLSHRVTSLHSLLPQSERNANLARFRASAARILVATDVASRGLDIPTVSLVINYDVPRNPDDYVHRVGRTARAGRRGEAVTLVGQRDVQLVLAIEERVGRQMEEWSEEGVSIEGRLVRTGALKEVGEAKREAMVEIDEGRDVLGRKRNKLKKVR

SEQ ID NO: 26073 - protein, 318 aa, A.fumigatus
TSDMYPYDFDAEGADDERTPLVGSTRVSRSRHGGRRPGSASLRQMEYMQQRQRSYFSRYSICLIIGFLLLLAIGGATSFIIGITKPLVDVQVLAIQNVLASEQEIMLDLRVQAVNPNLFSVAVDDMDVNFFAKSRFVGTDKLWRDHSSDPDGFPRVEQSRKRAELTRLAPCGRDTECTPDVLAGESLKITGGVDKGTDPIPTDPAGDPQTMLLGRVFHFDSPLAFEPSPWNHISTTSKGQIRLARPGNKTEEGGTERWERVLQHPFELIVRGVIKYQLPLSSRYYSSPVSSSVKVVPNDDNHDLPLGSGRSAAIVGGI

SEQ ID NO: 26074 - protein, 83 aa, A.fumigatus
RQFNLCKLMIIDSSLLERWPWPILTLLPRTTAYQRASSSAAFAEAQSQAKRFESEAYEKATSKVCSPPGSSNRLLIKDLAGRL

SEQ ID NO: 26075 - protein, 289 aa, A.fumigatus
RILQEDYDRMCQDAIDAAEASGSVAPMISSPDQLQHEPEEGAWTGGESIGPFKGCLHVFDGLHSTIYKSKREDGAVVAVKVTIPHLLTPPHDAEREVRLLREAASPHVISLLDSLKVDGGRLILVFPYLKYDLEHLLRRDMLTATLIKAHLHDMFSALAHLHELGIIHRDVKPSNILLDSPDGPAYLADFGIAWKEGDKGSEPADKKITDVGTTSYRAPEILFGFKGYGTALDLWAAGCVVAEAVAVGHKQLFDSGPVGSDLTLVQSIFKTLGTPDESTWPVRHPSILS

SEQ ID NO: 26076 - protein, 177 aa, A.fumigatus
GWKDRANIYGQIHSADELVLTELILENVLSEYEPEEIVALLSAFVFQEKTENVPTLTPRLEKGKEAIIRIAEKVNDLQIQYQVIQSSEDSNDFASQPRFGLAEVVYEWAKGMSFNRITDLTDVMEGTIVRTITRLDETCREVRNAAKLVGDPTLYAKMQHAQELIKRDVIFAASLYM

SEQ ID NO: 26077 - protein, 191 aa, A.fumigatus
LFSADAATPVVKTQANSKHTEAIKFADKELSKLCASWTSPIWDEMDWARIKELQVRDILEKRQAQAAITQSCRCLQCPSFMKHVSCHRLYNWFLVNYIVTDFGQFEMQHDEWQVKENISQLKQLMSDQNLQLLPDYEQRIQVLRDLGFIDEQSRVQLKGKVACEVSHQIFCEAGRTELISMDRFTRLMSWC

SEQ ID NO: 26078 - protein, 258 aa, A.fumigatus
YLPMYFQTVLQAPPIVSGVYVLPLVLSISVVSAGTGIIIKKTGRYRELIVGGLGLMTLGFGLLIDMKYYASWPRIIIYQIIAGVGVGPLFQAPLVAFQANIHRSDMATATATFAFLRQASSAISVVLGTVVYQNDLARQQPAIEAATGPETAAILAGSFAGSTGSLVKSLPEAARIVVLESFTHSLSRLWIFYTAVGGFGFLVSLFIRPVELSKAHTFTKTGLAEQERARKEILAEQKAEAEAAAAAKRTDPLPKAEV

SEQ ID NO: 26079 - protein, 78 aa, A.fumigatus
ILLPTPDCLAAEYESLSKSILLTPPCSCLPHSLSSSSLSTLLSPSLTYFLTASLYFFSSPLVKYFLKLFPPLFSSLLL

SEQ ID NO: 26080 - protein, 103 aa, A.fumigatus
PCSAYPSWDLIGLNSRTLTDLCRSMYSADQFMNPGPAPRPPTDRPKLSLPSNPSGVATSFSQMSLNSPSTPGSANLSLFPNTSSPSLSQTKTNQTGQGALPSS

SEQ ID NO: 26081 - protein, 184 aa, A.fumigatus
TPGRQLHIGDHTSFFPRHNCSTLRLPSSSSWIIKSERIRLVAAMNTTLPSWKDRTQNQFGKLQIQVPWRTIQLLVPHRMRRKIRSKLRSRISPTSSISSLQTSFSPVDTLRSLQSHRWTLYDFQYLLLLIVGIFSLSVMESPGPLAKTAAFTLLLISLLLPITRQFFLPFLPIAGWLIFFYACQ

SEQ ID NO: 26082 - protein, 219 aa, A.fumigatus
ALWNHLDHWQRPPRLRYFSSLSFSRLRASSSCHSSRLQDGLYFSTLASKFTSLGTITICDEYLCLPERFIPSDWRPAIWVRVLPALENILYGANISNILSAHQNVVLDVLAWLPYGICHYGAPFVCSAIMFIFGPPGTVPLFARTFGYISMAAVTIQLFFPCSPPWYENLYGLAPADYSMPGNPAGLARIDELFGIDLYTSGFRQSPGIRAGMRNASET

SEQ ID NO: 26083 - protein, 270 aa, A.fumigatus
SEEKFFSRDVTHVVTSRPIPPEIDTVPPAELNATSADQTPVDTVNPSLLEKTADTHLHMSLKTDQRREPSNMDVLYRARRMKMKIWALEKLQRMIAAINDGDPGGHSSHSRIHNAVGGNTKARGESDLSQVLRKELVSGPSDRDPLSSLKELVLFKGPFIYIHDMDEKTKPVMVREYPKVARRQDGIWPQFRSAPLGKCPFIDEPPSKKEIERQRARQQEKEKKLAPKAPAVKEVPKFDAPDVGPVNLDNRLHHGAGRISALHFQGLQRG

SEQ ID NO: 26084 - protein, 109 aa, A.fumigatus
AKETICDQASVEAKLCEADQIGSFILAANASEASKFPIISQAVHLKNPTAINYPVKKTGFYCVSTYGYSGKDYKAAVEFRNSYGELPAAQIAKLPFYGGLTIVYAVIGV

SEQ ID NO: 26085 - protein, 175 aa, A.fumigatus
PVADFQNRHGLNIGAKVLMVIVAVLNAGRNSFSFFLLLIVCMGYGVVKPSLGRTMVYVRILAITHFVFGVIYAVASLSITPDSAGPLVLLIVLPLAGTLTAFYVWTLNSLNATMKDLIDRKQKVKAMMYKKLWWCILGSIIVIFGFFFINSFAFARRSEARFGPEQSTPAVEINV

SEQ ID NO: 26086 - protein, 417 aa, A.fumigatus
  UNSURE (38): Identity of amino acid sequences at the above locations are unknown.
VDAKPAQEVITPASMETPSKKEPAPGKLGKWSRFAGLXSPLPGSPAKESEHQFGTKSPAPQPSTNDADQEGFQRILQMLGGSKSRNATPQIDSAQAPRPTVAQVDSALNALSSPSKDSVRRPETMAVPDTHPHSTVPSIPENMHAHDSPFKDPQPRDREHLLRLMQQVRVSPVAPQSHGLQGQPQSAGPAPGVMNVPEVLSRPPGIPTAQKGHNFLDDPAIANMQRPDADQLRRRPANGPPMGYFDEVPFPQGGHMPITPGGSRPPQGQGHPGMGIQRPPGFEHLPPPGWNGPQMPPQQGGGPSPLVPPPGIPTPTRGVNPNFMMPPMHGNVPPPNERQPFPRGAGPLPPGMMPPPGYMNVPPPSAFPPMPHNSDALLGLGHGQGPFEGNPGPQGPPPSSRHLLDMFGQVGGPGQFR

SEQ ID NO: 26087 - protein, 61 aa, A.fumigatus
YTAPIEYMPIDDVETLDRYRPGGYHPVTVGGQLGGRYSIVHRLGFGSYSTIWLARNQDAGR

SEQ ID NO: 26088 - protein, 150 aa, A.fumigatus
ESSGHLSSVVVVYFDISIEVRCSTVPGLGAHVAMRFHCAYNHVCCSPLFKRLVNLKSCTTISAYIQPWRTMNFCRYRPRLVLVSSSRLMKLAFHPNCTTLSSNPYYYTSHTGRMGSKVAEENCDTQHQSNTCRLMMLRRSTGIVQEDTIR

SEQ ID NO: 26089 - protein, 129 aa, A.fumigatus
AWLRFILNDLAGKKPGRRTIVAIKIPVATRGSTETRQIDILRWLNKTGLGEKAHPGAAYIPSILDSFSLSGPNGVHHCYVTEPGMTSLGEAKDASSIRLFQLPVARAMAAQLVQAVAFLHSQGIVHGGN

SEQ ID NO: 26090 - protein, 92 aa, A.fumigatus
WRATYMIVCTVKSHGDVCSKSWHSGAPDLYTDIEIDDDYARKVSGRFLSANQPIFRNFTRIYAYICVFCVAQRTQYDALALPLLLRLRNLMF

SEQ ID NO: 26091 - protein, 76 aa, A.fumigatus
QGADSVIATVTRADGSAESTFRALFLVGADGRKSTTRKLLGTQFKGHSWPERLVAIDVRIKMLSLTRILRTSLFVV

SEQ ID NO: 26092 - protein, 245 aa, A.fumigatus
ILKGYKTIITLPEKMSAEKVSVLRALNATIIRTPNEAAYDSPESHIGVAKRLEKEIPNAHILDQYGNVNNPLAHELGTAEEIWTQTNGKISAIVAGAGTGGTITGLARGLKKHNPNVKVIAADPHGSILAVPADLNKEHENEPYKVEGIGYDFIPQVLDQSVVDKWYKTGDRESFQYARRLIAEEGLLVGGSSGSAISALVQAAADHTFTKDDVVVVILPDSIRSYLTKVQSRPWLSLFVKSDRS

SEQ ID NO: 26093 - protein, 117 aa, A.fumigatus
FADDDWLAANDLLPSLSSETTLVSQSVQPEAPKDKFAGANVKSLRLKPITTVRSNIPCENAIEIMRDRGFDQLPVLAPSGKKLVGLVTLGNVLSRLTHGRATKKSLVADVMFDFGKI

SEQ ID NO: 26094 - protein, 112 aa, A.fumigatus
LKLDILISIWPFLGPIAHTMSSKTSPTVPPVALDAITQHIGNTPLVRLNRVPKSLGVEATVYAKLEYFNAGGSVKDRIALRMIEEAERSGRIKPGDTLIEPTSGNTLVAPSP

SEQ ID NO: 26095 - protein, 249 aa, A.fumigatus
  UNSURE (8): Identity of amino acid sequences at the above locations are unknown.
IGGKARDXEPFKRFPTWMWRNREMQDLVEWMRNRNAKLPNEKKAGVYGLDLYSMGASIRAVIDYLDRVDPPAGKEARRRYGCLQPWVDEPSAYGLASLRGMEDCESGVLQMLRDLLDKRLQYAQHDVRDGEEFHSGEQNAFVVRDAERYYKAMYYSSASSWTLRDTHMFDTLRRLFRHKPAGAKAIVWAHNSHCGDARYTSMGTHRNEVNIGQLIRENFGRENVAILGCGTHTGTVAAAHEWDDDMQVM

SEQ ID NO: 26096 - protein, 120 aa, A.fumigatus
  UNSURE (110),(116): Identity of amino acid sequences at the above locations are unknown.
VRPSRDDSWETIAHDTGIPSFVIDLRKEHLDPASRTAMAAENSRLERFIGVIYRPDTERISHYSQAYLHNQFDAYIWFDVTEAVKPLEKVQPKTPLGQDETYPFVVSVSXSPHGHXHQRR

SEQ ID NO: 26097 - protein, 208 aa, A.fumigatus
  UNSURE (7): Identity of amino acid sequences at the above locations are unknown.
LAARPAXWSPSSAFLPGCGATARCRISSSGCATATPNCPTRRRPGSTAWTSTAWARRSAPSSITWTAWIHPRARRLAAGTAASSPGWTNRPRTGWPRSGGWRTARAACCRCCATCWTSACNTRSTMCVMGRSSTAASRMRLSSATRNGTTRPCTTVPPPRGPCVTHTCLILCGGCSGTSPLVPRPSSGRTTRTAAMRAIPVWARTATR

SEQ ID NO: 26098 - protein, 236 aa, A.fumigatus
TAPVDCFQRPSPYAKLDRGVPCADQSQSWGSPYRGQWSPSCHHGTAAPTSPAYRRPIRGRRPRCQYACHIRGLRHSHGQNSPGSTGRYSPRCGACPYWYSAHRRSASCAPRRWPWHQRACAGTAAAEYQTCVCHAGSTRRRNCSTWPCSTVPRRGRQTHSARRCGTPPHHAHRAARIAGACPAGRAASAARRSRSPPSPGARPARTRTVRPPRAGGSRTGGEPPCPRVDPRGPGNR

SEQ ID NO: 26099 - protein, 345 aa, A.fumigatus
  UNSURE (338): Identity of amino acid sequences at the above locations are unknown.
GSLWLHLLQWFHGFSNVEPDIRVELVVEICLRVVRDTLRIRTIDDPNEPLQSTVFSGHRRTRSWIEVFLAQINHKAGDPRIVGNGLPAVITGRPHLHHLHIVVPFVGGGHGASMRATSEDCDILTAKILPDQLADIHLVAVRAHTGIARIAAVRVVRPDDGLGTSGLVPEQPPQSIKHVCVTQGPRGGGTVVHGLVVPFRVADDKRILLAAVELLPITHIVLRVLQALVQQVAQHLQHAALAVLHPPERGQPVRGRFVHPGLEAAVPAASLLARGWIHAVQVIDDGADRRAHAVEVQAVDPGLLLVGQFGVAVAHPLDEILHLAVAPHPGRKALEGLXVAGLAAN

SEQ ID NO: 26100 - protein, 186 aa, A.fumigatus
  UNSURE (4): Identity of amino acid sequences at the above locations are unknown.
KSSXQFPSLLSYGQSCGFGAIFVELYFIMTSLWTNKIYYMFGFLFLCYGLMIMTTAATTVLLVYFLLCAENYRWHWRAFAGAGMTGFYVFINAFIFWITRVSFGGLTGAVLYVGYSALIGFLVFILTGMLFVLEPGWRVWSWCLTHFAQVRLDSSPAGRLCNASTARSRSTNLRTLFMPFKVIIIR

SEQ ID NO: 26101 - protein, 215 aa, A.fumigatus
PQTQWCHIGKRSLDRAIALYRKTYPGGRNDTITIKWRPFYLNPNRHGRSVPKSVLIDERLKDKTPEQRAAMVKRVEKIAQSVGVRINYGGMIGPDTRDAHRLVYLSREDPAISSEIHGELVERLLEAFHERAMDITRPEVLKEAAAAAGIEAAVVERWLAEDVGNVVDEEARKYREVEGIKGVPRFRFQGKYEWDGEDLQECMEIMGKVKAEEGS

SEQ ID NO: 26102 - protein, 131 aa, A.fumigatus
TFLSDDVFVEQRIDAPFSPHADHDKLNYLHAYISFSYRDRTPYLSVYLQSFETGDWAVGKPIYLPNKTFIGSLIMDVILTIHQQTYPNQRSSVRMRPVNPQLYLQICQRQGYIIPVSTDEQLGTYFRAVTR

SEQ ID NO: 26103 - protein, 136 aa, A.fumigatus
PFMYDYLVTMGSHSPLKFEYMRLSGLGLFSPCITSSLSLTPDQPDAFTSPCSTHASQSIATPKSHDQRQVMADQVGFHRLFRSLAFILSAEAHASPYIQQRQDDDTLNIPPIFLGSPTSAAMAINPCMAVSVEESG

SEQ ID NO: 26104 - protein, 65 aa, A.fumigatus
LCTWFTRTVIGRTRYLRKLELWRGDITVLATDYSLLPHRYANTLTERMILISINLHHKAEDPRKV

SEQ ID NO: 26105 - protein, 112 aa, A.fumigatus
PGRRWGRQPAQSADGGSIGWSLSKRSARGGFEELAALRVGLEDGKCVDHAPCIEEENKAGGNLQLYHESAIRRLSAQAYNYGLLIHLHLPNMMHGISSDLAHEYSKIVFTGG

SEQ ID NO: 26106 - protein, 325 aa, A.fumigatus
  UNSURE (144),(171),(173): Identity of amino acid sequences at the above locations are unknown.
GRGFPPVVKTDNSGNRPWTPPSSTVTPGPGMSYSPVVENRPYNYGAPPPPTTSYERPHNVYPSQTSEGMALGFSPQTKPQQYDNEYNNSGPPPYTQHSYGSPQSYPPYPTHDTYPAHPPTQPPYPQDRKDERGFMGAVAGGAVXAYAGHQVHHGVLGTIGGAITGSVAEDXIXKHKKKKKKEKKEGKWGHGRRSSSSSSSSDSDNGRAHHQQHPPAAASLRSNFSASSTENYLEHEYELTARCRSISGEMHRSSISLNSVLSNHFGSFVWARGGNFGASARNVHLAEGGRVLDAELADGNGHWKRAWVRLDERITNQNGHLVFLD

SEQ ID NO: 26107 - protein, 122 aa, A.fumigatus
QFESSDVNIMASSAISGADLRSFTEYLKGCKRILALLGAGISASSGLPTFRGAGGLWRSYDATDLATPEAFEANPDLVWQFYSYRRHMALKANPNRAHHALAELARKNRDFITLTQNVDGTV

SEQ ID NO: 26108 - protein, 218 aa, A.fumigatus
TRLTSGRFDVGLSQRANHPSEQLHLLHGSLFTVKCTSFYCNYVRENDFTDPIVPELAIPKGVPDLSPSAEDKTGEEASKALSNALRMEETELDISDENVPLPALSQDVLPHCPECKEGLLRPGVVWFGEGLPLHTLETVDKWLNSGPVDLILVIGTSSRVYPAAGYVDKARARGARVAVVNMDRNDVGYSGLKKGDWFFQGDAGVIVPEILQGVIGDI

SEQ ID NO: 26109 - protein, 74 aa, A.fumigatus
FARCERPTSKRPLVSLVQLDYTSTRICSLDSTINILCECDKIPILPCKLCKGVVRAVRVRFECHVSPVAVKLPY

SEQ ID NO: 26110 - protein, 62 aa, A.fumigatus
DRQRPPAPRNVGSPEDADIPAPKSASIRLHPFKYSVNDRRSAPDIADEAIMFTSLLSNCYVS

SEQ ID NO: 26111 - protein, 80 aa, A.fumigatus
SPESLNVSNDTLQYLRDYNTRVSLEKPITFFQARIPNIIAIHIDHSDSGPSRTRLINVACSWVDSRTCSNHQDQIHGTRI

SEQ ID NO: 26112 - protein, 207 aa, A.fumigatus
VTQYLLPLSLAHPLSEVVGRRPVYGATLLLAFIFVIPCAVSKNLGTLIVCRAIDGIAFSAPMTLVGGTLADLWRNEERGVPMAAFSASPFIGPAIGPLVGGYLCHAGWRWLYWIQLILAFVAWVLITFTVPETYAPMILLKRAKKLRKSENDPKYVTETELDARPMGERLRLFLLRPFQLLFLEPIVLFISIYMSVLYGLLYMFFVA

SEQ ID NO: 26113 - protein, 108 aa, A.fumigatus
LPRYVFFNFLNDGIVLIVTTVDTYQHQAASALAAKTFLRSMWGASTVLFTEQMYDRLNDRWASTLLAFIALACCAIPYVFYFKGASIRRYSKFAFADDEEQQGPGEKH

SEQ ID NO: 26114 - protein, 126 aa, A.fumigatus
QLISRYPIVYQKGKGWGSGPTGLMFIPLAIGVLCSAACAPFVNKHYLTLVKKHGGKPPAEARLIPMMLSCWFIPIGLFIFAWTSYPDIHWIGPCIGGLPVGFGFIFLYNSANNYLGMFSSISSTMV

SEQ ID NO: 26115 - protein, 91 aa, A.fumigatus
ICSENNVIPIYIPTYSLYLLQPLDISCFSPLKCVYRYLVETKIYLRFNYINKLDFLKAFPQAYIEIYITSNICSGFSATRLVLYNLERVLS

SEQ ID NO: 26116 - protein, 70 aa, A.fumigatus
IMTFTAAWWCLYMWFNCRKPWIPRHSILSFKDLILLLESLLAFLDRKNLYSIKLPSRSLIFFKLFLIHSL

SEQ ID NO: 26117 - protein, 102 aa, A.fumigatus
KMIFPSYTASSSRNKEILKLIKAYIITSLTIWTNFNPLVAWEGWILIPPLYIDLSFKDNIRRKHLTRGINILNRSNLFPIAWLYKRCFPIDISSSYYFSSSY

SEQ ID NO: 26118 - protein, 121 aa, A.fumigatus
RTGPPPYGNRAGWRPRAAEDFGDGGAFPEILVAQYPLDMGRKGTATTSNALAVQVDAEGKVKYDAIARRGHSENRIVHASFQGSDSAPAAGGYGRNLARPSVGGRGPGADGEDQECAGEPG

SEQ ID NO: 26119 - protein, 306 aa, A.fumigatus
LSWFTMYREPALHHMATVQDGDLEQLRISATVARSPRSWLRSILSTWAARVLRRHRTRSRCRLTRKAKSSTTRSPAGVTVRTASSMLPFKDLIPLRQRVDMGEISLDRPSEEEVQAQMEKTKNALASLVEGAVAAQKPKNVKGGRRAEPTFVRYTPANQMGDTTRKNDRIMKIVERQQDPMEPPKFKHKKIPRGPPSPPPPIMHSPPRKLTAEDQEAWRIPPPVSNWKNPKGYTVPLDKRLAADGRGLQDVTINDKFAQFAEALFTADRHAREEVRLRAQMQQKLAEKENPQQEDFHQGQAVRDTH

SEQ ID NO: 26120 - protein, 87 aa, A.fumigatus
CDGSCRCVGGPRPASDIKGHSQGRYHPVTLLWTSLTVCKFQILGFYDPAPLLPKKLKIWYTYRGNEHFVEANDSEGIACPMRTHLVG

SEQ ID NO: 26121 - protein, 67 aa, A.fumigatus
GGKWGNGMQLRPCYLNFRINFYIFFSAHPDKFNLKPMDLHHCWALSIKRLNTWAFVDLTARRKIVPP

SEQ ID NO: 26122 - protein, 380 aa, A.fumigatus
AWVLIPSEGVQVEPEATDLFESADSMARPSLSPSNPLGFTPWPVTVITAVVYLALVVPLLVVHHVVPSAPSSSPKGLNLTEAWADLQELTHGFHPYNSHRNDEVHEWLLKRILELIDSAPPASEYGSVGEEKPDIVVFDDTQSNLTFSGRGSGLGVYFESTNIMVYIRGWEEDRERWWEDPHGRPAGKGGVLVNAHYDSVSTGYGATDDGVGVVSCLQLIKYFTTPGHVPRRGLVLLFNNGEEDFLNGARVYSQHPISQLPHTFLNLEGAGAGGRATLFRSSDAEVTKPYMRAPHPFGSVLSANGFEAGLISSQTDYVVFEGDLGLRGLDVAFMEPRARYHTDEDDARHTSLASVWHMLSAAVATTEGLSSPRGWKEPRQ

SEQ ID NO: 26123 - protein, 181 aa, A.fumigatus
RYAVEPYFLRPRLGPRGVFREYQYHGVYPGLGRGQGALVGRPTRPAGGQGRRPGERTLRQRVDGIRGHRRRGGCGLMPPADQVLHHAGACPAARAGAALQQRRGGFFERRARVQPAPHLAAAAYVSEPRGSGRGWAGDAVPQLGRGGHETVHASPSSVWVRVKRERVRGGPDQQPDGLCGF

SEQ ID NO: 26124 - protein, 308 aa, A.fumigatus
  UNSURE (261),(272): Identity of amino acid sequences at the above locations are unknown.
FLIQADFVTDASRQDIVRSSARNLKLLTAIAQAFIQAVKQFCTHTSLAYQWMRYLPDFEWGSQDRYWKALPGEIRRQLQLTDTMWTRSHLNMRCIADVRLLPSSMCDKYGKPLLPDLDTEQYLSPHYALKDLNSLRDYGLQLMNRHEFVDRLRQDIKSDSSLMRNPNTNEDWHSAVAKYLMGVLGPKNPKTAEKIKKIKLIPLMGGHWRSSSALDIFPVYFTRAQGHAIPTDGILDLIAPSAEINPDRKQLFVLLGVQEAXVRDIRREIILXSASWAHGLETSQSYLRSFILLLNWIESTDSPVPIRF

SEQ ID NO: 26125 - protein, 311 aa, A.fumigatus
RVCRSTSLAKNLYTGTARFVFELLQNADDNSYNVARSRSADPFVSFRVDNRRIIVECNEDGFTHENLVAICNVGKSSKTGAQGYIGEKGIGFKSVFMVAWKVHIQSRDLSFSFRHNVGDSGMGMISPIWEESEEVLPRPLTRITLYLHETGSAADLATQRETTLQQFRELKAAFLLFMKNLRRIEVKLCDSLDKEISRTTFSMRCEDEGRVALKQEIVQDGDLQECTQYYHTTKLTASNIPRSENREYTDVELATKAYSETNIILAFPLTRDSVPIIEKHEVFAFLPIRNMGLPVSSPSCTGMFSNLVPSS

SEQ ID NO: 26126 - protein, 105 aa, A.fumigatus
ILFLTVRAQGGKTPQVTASPLSATDITRDNMASGMTQSSTRNLLEWLKNICLERDNYQCIVTKLWDPVAVNPQEQCKMTGNTQLAHIIPFSMGHWGNDQKVSFCP

SEQ ID NO: 26127 - protein, 100 aa, A.fumigatus
IVIYLLDQDTDNTYKIKTYPWHQNFCDQFYEKPITFTTHNGSELPSKFLLETHAAIAEILHASGQGEKIDELLREWEDIGCLASDGSTDLESLLLLLSVH

SEQ ID NO: 26128 - protein, 260 aa, A.fumigatus
LNLVNDTVSFLSKQSTPDSSDETQLPTIDSIKPRIREERQAESKAVSQPDAQPTQHEALSASEAALKSPQELEDEAGQEAAFNPETGEINWDCPCLGGMAHGPCGEEFKAAFSCFVYSTEEPKGMDCIDKFKFVQSDLSAYHSECSHVLTLRYRGMQECFRRYPDVYGAELEDDDEADAAAATAAGVSEPSEQPASPTVSAPTAEIDASSDSEGKEGRAKDVHAQVKSEVAEKAEQAESDDLVPKAWHDTEGTKAQQTEK

SEQ ID NO: 26129 - protein, 191 aa, A.fumigatus
HASRGLWPLEGQQRDLRRPDLPCHQGWLPSLRRRLRSVAPHILSPAKRQSDRVLTIADYGNEVEAGKGVARAIQEGIVKREELFIVSKLWNSFHDGDRVEPICRKQLADWGLDYFDLFIVHFPIALKYVDPAVRYPPGWLSENNKLEFSNASIQETWTAMESLVDKKLARSIGVSNFSAQLLMDLLRYARI

SEQ ID NO: 26130 - protein, 71 aa, A.fumigatus
ESPYPSQDQNRFKSAEFTVFTMTTPSIKLNSGYDMPLVGFGLWKVNKETCADQIYHAIKAGYRLFDGACGQ

SEQ ID NO: 26131 - protein, 126 aa, A.fumigatus
  UNSURE (102): Identity of amino acid sequences at the above locations are unknown.
APFNKPGVGVQDSSNVLNQFFGSWFATLGGIRKYPRANGPFGFRSTTIPREVGPNQNTLFRYHHHDHQTSASRESHPPTGFEGLMDPDDLMNKIVGSMPDDXGMNGAGPDHASAAYADTNATEAGQ

SEQ ID NO: 26132 - protein, 177 aa, A.fumigatus
RSRFVLSNMPSRQEVAYFGAGPAPLPTSVVEAGAKAFVNYNDCGLGLGEISHRSPTANKILEDTKASLTTLLDIPDDYEILFMQGGGSGQFTSVVQNLVGVWVERRTTEIPEAREFSAYRKIKDELGSFAEYHQNGRFREGNLNLGITFFPRGSIGPFEKGSFQGGLHPSWRGVATN

SEQ ID NO: 26133 - protein, 230 aa, A.fumigatus
  UNSURE (219),(228): Identity of amino acid sequences at the above locations are unknown.
LGPILMPYITRLLYSMASSTTLARGYKHLSLAVHITDSQWRSCFSGKPSSQSTWSKSISSRLRQSIRQRYGALTHSRIRHRLKHPRQSYDLFLHNCNNFTQDLAMFLVGKSIPEHIQNLPQKFLSTPFGQMMKPQIEQALRGVTQTAAPAPQPLPRAPVTTAAPTHPGTVRQVSNVNQLEELLESAVKSCAVMFFTSATCPPCKKVYPTYGQEPEESDXTERQARASXKR

SEQ ID NO: 26134 - protein, 113 aa, A.fumigatus
CTSDTPKQAQNRLRSIMEGTEFAERLSPIFARINILVTYLQGFDVKRKVYVNPLGSLNDKFLRGSILFQCVFDTKRRDVFAAAGRYDRLVQDFPSEGPASCFKHKQLALNLTG

SEQ ID NO: 26135 - protein, 396 aa, A.fumigatus
RNDCRAFWPLWRRHLWYMYSLGIIFFEMCHPLPTGMERDQTLRAIREEHHTLPPTFHYSEKAVQGNIIESLLSHDPKERPSASELLQSGKIPLQVEEETFRRAIVHLLSDPNAPDYKKILSAIFSQSPKKYEDIAWDVDSRAAPAANELLVQSLVKERLTAIFRRHGAVETTRQMLFPRSQHYRSGAVRLLDASGNQLQLPFDLTLPNARSISRQDPSLEKTFAFGTVYREMPHGSEPRTHKEVDFDIVSHNTLDLALKEAEVIKVLDEIIEEFPPLRSSPMSFLINHSDLLQLIMEFCRITPSQVPLVKEIISKLNFGKWTMQKIRSELRSPAIGVASTSLDDLARFDFRGSFHFATYETAANAHQTLLSRLKTVSGPSWKVPSLPSDCRPFSLA

SEQ ID NO: 26136 - protein, 70 aa, A.fumigatus
GRNYPIPCLAFSCLTSAGFWVTPSTGITCRRVVLQHTIAWFVQLANIKINGRWWNSVTSVSLAASDEKAG

SEQ ID NO: 26137 - protein, 60 aa, A.fumigatus
EDNKGWNKVAIYTNYFHNSYILLISITRRERRLLKLSSNYLLIFINSNLEACLIKVIEVL

SEQ ID NO: 26138 - protein, 154 aa, A.fumigatus
FAARFLLAPGCRQEVKETIGVTVPLSTFLARATDLANEDLPRSPRSKPSADELFDEILGAEPIKTSPGDYVPELNALEAVEYESAQPVKEDIIDILSGKVPKKAPRKASMEEYPAGSATNVFSLTVPVGDETRARVFLDRVKTLLTVEPGRLVL

SEQ ID NO: 26139 - protein, 416 aa, A.fumigatus
FANRGSFHGGFVKTADQIGDLESRCAALQSELDSATPTSLLRKNQDPTSWLPRSPARHILEGHRNPVTCVAFHPVFSSLASGSDDTTIKIWDWELGELERTVKGHTKAVLDVDYGGPRGGTLLASCSSDLTIKLWDPSDNYKNIRTLPGHDHSVSSVRFIPSGAAGSPMSGNLLVSASRDKTLRIWDVTTGYCVKTLSGHVDWVRAVAPSIDGRFLLAAGDDRIPRLWDLSSAETKSTFLGHEHVIECVAIAPAASYPHLAVLSGLKKPPPASSSAEFFATGSRDKTIRLWDSRGNLIKTLVGHDNWVRALAFHPGGKHLLSVADDKTIRCWDLTQECKCVRVISDAHGHFVTCLRWAPPLIKDGGANGEAETNGTPAATSTTNGVRPDPNVATKISIRCVIATGSVDQKVRIFAT

SEQ ID NO: 26140 - protein, 141 aa, A.fumigatus
LHNFLSCISMLLKPRMPVLPPLPSLTTILLCVTSCLYSLACRAEKRHLMTRSCLSGRSFSTSFFRRLSRKGRRTLCKRRMTSSCSSSESSMRSWPPVFANGVLNHSSNDLTDLKMFGKTKLSSAHNSGRLFCKGVPVKIRR

SEQ ID NO: 26141 - protein, 500 aa, A.fumigatus
FRSTTNNLNGILADEMGLGKTIQTISLITYIIEKKKNNGPFLVIVPLSTLTNWNLEFEKWAPSVSRVVYKGPPNARKQQQQQIRWGNFQVLLTTYEYIIKDRPILSKIKWTHMIVDEGHRMKNTQSKLSSTLSQYYTSRYRLILTGTPLQNNLPELWALLNFVLPNIFKSVKSFDEWFNTPFANTGGQDRMELSEEEQLLVIRRLHKVLRPFLLRRLKKDVEKDLPDKQERVIKCRFSALQARLYKQLVTHNKMVVSDGKGGKTGMRGLSNMLMQLRKLCNHPFVFEPVEDQMNPGRGTNDLIWRTAGKFELLDRILPKFRATGHRVLMFFQMTQIMNIMEDFLRLRGMKYLRLDGSTKSDDRSDLLKLFNAPGSEYFCFLLSTRAGGLGLNLQTADTVIIFDSDWNPHQDLQAQDRAHRIGQKNEVRILRLISSNSVEEKILERAQFKLDMDGKVIQAGKFDNKSTNEERDALLRTLLESAEAADQLGEQDEMADDDRL

SEQ ID NO: 26142 - protein, 299 aa, A.fumigatus
  UNSURE (225): Identity of amino acid sequences at the above locations are unknown.
VRSAVPASLVAKTPSGDDSLKLKALIEYKMLHLLPKQRLFRKQIQNEMFHFDNLGMTANRSSHRRMKKQSLREARITEKLEKQQRDARETREKKKQYDQLQAILNHGAELQNAANQQRTRMQKLGRMMLQHHQHMEREEQKRVERTAKQRLQALKANDEETYMKLLGQAKDSRISHLLKQTDGFLKQLAASVKEQQRSQAERYGEDEHLFEDDDEEDVGSDDDEXGGRRKIDYYAVAHRIKEEVTEQPKILVGGYLKEYQMKGLQWMISLYNKQPEWYFGRRDGSWKDYSNHQFDHIHY

SEQ ID NO: 26143 - protein, 78 aa, A.fumigatus
ILVHLPSFFFLFPLADMNSFHKHVSFDAYLLPLLIFVARRSLSLGCSLRILHALSNQSRNCIFRPHIKNFHFLIKVTL

SEQ ID NO: 26144 - protein, 228 aa, A.fumigatus
SKPTVLLGALEFYFPSPFFYFFSSNTMSLNHTSLDAAATERKARLAKLAALKRKQPEPETLTEARAGDHEPEDAAPDVTRKYLSGRNFDAETRGPKLGFDQAPTEGAKTLEAQAAEIAKATAEQAKKDEEKDQPIDLFKLQPKKPNWDLKRDLDEKMKILNVRTENAIARLVRQRMENAQRAAKAQGATRNEDEQGEEVGIEGDMLVEGIHVREREEKEERREMDEDS

SEQ ID NO: 26145 - protein, 132 aa, A.fumigatus
ESSIITNTEPVQISTLEPLFLPFAIYFFVLFLPPPRSIPDFELAEYLPFRPLFFDRLFFFPRVLTINRQTVLLRLSSDFLFSAILSWPDCRCCVLTTSKVLPPYLGSITSAIDAVARQFNLCFQNGAHKSCQ

SEQ ID NO: 26146 - protein, 120 aa, A.fumigatus
VSTPPATPKTIDCLLCWLYVLLTWYPFKIVIGSGPAAHTAAIYLSRAELKPVLYEGMLANGTAAGGQLTTTTDIENFPGFPDGIGGAELMENMRKQSIRFGTEVITETSLQPQGVEGPAI

SEQ ID NO: 26147 - protein, 128 aa, A.fumigatus
LVPCIKIAMSSVSPLAGRLCQIFTARNYTLFSVGILSVGLFVTAASQSLPVFLFGRALSGCGSAGVMVTSFIFILDLASKRRRGLFIGLLNVGVTTGISCGALLAGLLTPVFGWVCHLPLRSSETIRS

SEQ ID NO: 26148 - protein, 162 aa, A.fumigatus
RFGGEKITDMLIAILNTCSKEELEDETPTSVSPSAPSPPLPMDVESSEFKRRAIKNKILAIGRLSRVFQVLREESERVTELKTAAGGRLPAGTLMLGAEGIKQAITNFEDARKVDLQNERLPPSHEEVIKRSEEERRAALERAQQEADNDTGLATVARRISM

SEQ ID NO: 26149 - protein, 90 aa, A.fumigatus
GPDVRSSTSSTLIEHASALFSNFNQRLSALYFYHAMYGPIEQSSLESGRSQLGYLPNLFRPAHSHRLEQSPLLNPARFRHKVLYSFFFEA

SEQ ID NO: 26150 - protein, 346 aa, A.fumigatus
SRLFLPRNGRNFSDPSVVSKLVLIVSQPRLDAQPPLDEAVKKIRVKNPIMQEFHGSHGTYTQANIERQRTYNLPQWKALCEESSHQPPARRGERRRNQERVTRTPAAPKPQTTTSNSQKRGPGRPPKRANQVKVKEEPPADDVLEKTKPEGPPTPVSPESNPVETKSEELSDGESLPGLKPKGRQPKSVTARRKHNKGDNIDSVDEEAFKNFDYRIHDQEEYTQERCEELETAYWKSLMFNNPLYGADMPGSLFDDSTTSWNVAKLPNLLDVIGQKVPGVNTAYLYLGMWKATFAWHLEDVDLYSINYIHFGAPKQWYSISQEDAPRFEQVMKSKLAPLQPYSALW

SEQ ID NO: 26151 - protein, 169 aa, A.fumigatus
RVSWHRSSHILRCGDTDTFSSGIWPSDAKSCDQFLRHKTYLVSPSILKSQYGITVNKLVHYEGEFVITYPYGYHSGFNLGYNCAESVNFATEKWLDYGRVAKKCNCEADSVWIDVDEIERKLRGEATPEYYDDFDSDMDVIEGASDLLTPPRSVPEKKSTRGRETPASW

SEQ ID NO: 26152 - protein, 84 aa, A.fumigatus
DNKLTMSVQLPPVTHRKRAFPQGELEAASTLKLGADQNTHTLSLSEARLVINKVLENKRRGGKKYEEPEYVALRWVARHPIFPL

SEQ ID NO: 26153 - protein, 71 aa, A.fumigatus
AMGHYYQLINGIVFVLSGPGFAHETNIANSLGQLLMHAAMYIQSTTPAHYVLHFMIDYRQLTNPSISTIRL

SEQ ID NO: 26154 - protein, 229 aa, A.fumigatus
  UNSURE (58),(197),(221),(223): Identity of amino acid sequences at the above locations are unknown.
SKARCGTSNSTVPLNNIPSRSALIPWRKLARGYRQVQPPVAPVEDCGWQSCLGGLGSXESKPSGNDDSQPSLGWKATLLNATLHLPPPTIVNALFLRRMSPTMQLSLAVCSTRGAPLSNSAPQASLLGQLSHDTGKYSNEYLFSTDNSLFGWRGLWNFGPDPRHPKENSSPQLSLLSAGAEAYYSPVSSLIGMSTGXRFSTLPAATEMPSSSSSASSTTIXSXSAEKPE

SEQ ID NO: 26155 - protein, 106 aa, A.fumigatus
  UNSURE (47): Identity of amino acid sequences at the above locations are unknown.
FETSLTMLDFMDYIQLAFAEATNWNRDNSYSSLTATAQCMWITSYLXSDNHSLNLTAYSITRLLDTGAPTRASFLPSHSSFREQLNPSAHWIDRRLGVVPLTALCL

SEQ ID NO: 26156 - protein, 135 aa, A.fumigatus
KMCAPNSLIVGKSPRRYALLQCAIQLRKHHRELQSLIFNSLFFGKTKVMAVALGHNPENEAAPNLHKLSPYLTGAVGLLFTSRDPESVLSYFDAFRPLDFARAGTVSTRSFSIPNGLVYSRGGEIPASEDEPVSR

SEQ ID NO: 26157 - protein, 68 aa, A.fumigatus
YLKMPRSKRARIVHESKVTKKSHKEQTRRLYANIRECVEKYDHLFVFSVDNMRNTYLKDVRTEFADSR

SEQ ID NO: 26158 - protein, 75 aa, A.fumigatus
YLITDEIELGRGRINSTLDSTINPHSWTEVSNVLFLSQPLGVGMHQTTGALQFSRLSTHNTAMQDFPTARQNPAR

SEQ ID NO: 26159 - protein, 199 aa, A.fumigatus
VSLNAGNVADMGKTDSYQVTGIAWAQGQFMGLSTPMVPPFPISDYGTGCMGAIAALTGLYHRAKTGGSYHGMASLMHYDLLLFAVGKYPDAVQEKMRAAQPPEFFKLRHCDSVDRISSTVLKIMQARFPHLYVAPDVAGQEALTEKWFSKAYNADIEVVKPIVEIDGVDNSFSRASRPNGSDRPSWEDFKLPEEDYKKA

SEQ ID NO: 26160 - protein, 96 aa, A.fumigatus
INHSDSLSQTNRQPSSTRRTLSEPSIIKMSYKITTDPTLSPPFANAMISFMESFYQISDDESQHEQYVASFTSDATLIMGPKVPNGADGSLPSHKD

SEQ ID NO: 26161 - protein, 202 aa, A.fumigatus
TTRSTMEIDQVKPERHDIAPDGDLILLYKKHANRPVELRVSTTILKSQSIYFEALSGRWLETLPVRPDGLREMAFERFDPDAMLIIMKAAHLKFQGIPDELNVKLLHKIAKYVHMFDMFPAVCTLARPWIQYVRMFVDQCNSTELAGYLLGIMWVFNLKEQFKKATRSIVVDCNAVDIDLSRTLIDQSSLHHGAGRIRGGVI

SEQ ID NO: 26162 - protein, 133 aa, A.fumigatus
TLRVSETFCLRLWQSDTQPLYRTGPYAALNLNLDFARKTRNCLLELLLQQRKWIATNLGPLRMRRSMKVCSLHYDVNSVLKIAFIVIDYFDGLPSQRVVPTIEPGYLRPLIPENPPEEPEQCLRYSRRVEDPC

SEQ ID NO: 26163 - protein, 72 aa, A.fumigatus
LVGPNYHPIGTASMMARELGGVVDSRLKVYGTENVRVVDASVIPLQVSGHLTATLYAVAERAADIILDGRED

SEQ ID NO: 26164 - protein, 253 aa, A.fumigatus
AYYRGILPAPEVKTSGSKYPSPILSLRVITSGVAREDKHIAVGMQSGLLSIKTRLSGQQKIRERERRKEMQALLEGKLEEHDRKVAKQKKLRGSGWEKRLRGRDFIGEGVEIVIEGQDKKKRKKEQTWEYDLRKARYSAALDQVLASSDKTAQLTLFTALRHRSALRAALQGRDEETLQPVLQWVHRNITEPRLVTLCVEVAMNVLDIYSGNLGQSAQIDKMVERLHRRVREEVEMAHQACQTKGMLDMLQAV

SEQ ID NO: 26165 - protein, 278 aa, A.fumigatus
RQAGRARPEGGQAEKTARVRLGEAAARAGFHRRRRGDRDRGPGQEEAQEGADVGVRPAQGAVLGGAGPGAGVERQDGAADAVHGAAAPLRAAGRAAGPRRGDAAAGAAVGAQEHHGAAAGDAVRGGRHERVGHLLGQSGTVGADRQDGGAPASAGARGGGNGASGVSDQGDAGYVAGRIARTRARVQRAIASILRRGQKVFIYLDLLHYGYLEGVREFIVHYFFFFFFFFFFVFLQSSLPSNIISAALSATAYNVAVRCPLTCSGITDASTTLTFSVP

SEQ ID NO: 26166 - protein, 438 aa, A.fumigatus
FQKMQKFYLSTYAKPSLGGLATGSITHGYGQWMPENIRLRRAWLSHLLDKAKPEIPRKLRDGQENPVEALRNLIENNSTLYMLAHSMFDEVPEKAPYDRDPTTLKKQVRNYKTMLYLFNTLLTEVPEYFLVNDPDVPSGLIGFPFNVIVDWPMGTQSGRQFFLDPRVNGCLKAILNKWNDFLSDPTGGTGQEGGGNQALIDAGWSSDIAVQQLEKKANDATPGSKRKFTELFIHPEGGTQENFFKYACWDDFFTRKFRPGVRPVGDGAVVNACESFPLSFDTDVSGRTTFWLKGMPYSLHDMLGATQDDRVSQYVDKFVGGTVYQAFLSADSYHCWNAPVSGTVVYQSRIDGTYFAETPASGFGGSSGPDPAGPDMSQRYITHVAARGVLIVNTNVPNGSQVGFVGFIPVGMSEVSTCRWEDKIVEGCTITKGEDIGA

SEQ ID NO: 26167 - protein, 83 aa, A.fumigatus
CLIATTLLPGPSRGVAEEIIPFIQDGFQTPIHSGIKEELTTTLRAHRPVNDDIEWEPNKTAGYVGVVYQKVLGHFSQQGIEEI

SEQ ID NO: 26168 - protein, 183 aa, A.fumigatus
ARNKSGRLQAFITEYDPFLMPNLMTYIYTRGQNGKVNGFAALRWIGEKNGYHVDPCIAAPRAPKGISDLLIFASMAWLRQIGISLLSFGYEPSDSLAEVSGMPSPLAHLTRQIYRYTFQRLPIGGKKAYFDKFKPDEEQDSPLYLIFPSTIPEPRPIIAMAHVANISIRKLWFHHRSKPAVPQ

SEQ ID NO: 26169 - protein, 106 aa, A.fumigatus
VQSQTIMACTTTFLDLPAEIHLLICEYLDPASAVALKSASKYLRSIITVDMDELELEYWEVFYITLEMWPERVPLNHNECLSDIDGMILTLTYLQIRQSLLLHWML

SEQ ID NO: 26170 - protein, 73 aa, A.fumigatus
IARTRIVMGTHDNRFWTIPWWVGHFIYSGECGNKVVRDVWYCNGVGSEGSEGSGYGDLVARSPSSASSGPGRL

SEQ ID NO: 26171 - protein, 261 aa, A.fumigatus
  UNSURE (220): Identity of amino acid sequences at the above locations are unknown.
VGFCSDENTTCILMVIVAPKLRMGPLEPRVLVGNVSTEFANPAYLITHCSTPVTLAMDPEAAGSTCLDLELVGQAYHNYQAYISAWSDLAKTNNGTTSTLAARPPPTGSLYDNTTVTGSWIDIGNMTELSLRYGRMVNNVTAAMPHAGVIAAAADPRNGIRQPADVTGEGNFEIEASVPSPAVNVLCVGMTEEELTPLVYERLADRHNFNPLNWDYEGTXFVPVERFHRTVVDELFGWDPTGQRRSPAKPRPVFGKLAPPP

SEQ ID NO: 26172 - protein, 324 aa, A.fumigatus
NPLTVGVHPLPSFPVGLDKFRTAVRASESQQSKQYLLPPVSELLRRDDTTNKNNNHNDNEDHSFLPKSWNPFDRSPSPDRDYIRYQPASSTNDDPASPPAPREPALGLGITNTFPQSPYKRPGPDDADDGDLATKSPYPEPSEPSEPTPLQYQTSRTTLLPHSPEYIKCPTHQGIVQKRLSWVPITILVLAIYSTIFSGIYLVLALVKPRYGKKIGEDGGLAPSTASLLSALFAKTIELSYVTVCVAFLGQVLSRRAITKGSRGITISDMSMRTWIMQPGSLIVHWETVRYSALTVLGVITLTATLVAMLYTTAAEALGGFLLR

SEQ ID NO: 26173 - protein, 83 aa, A.fumigatus
LTMLVPSVPLLNLINDGRKLSMLRNATWTLSNFCRGKTPQPDWTTVSFSRLCSDDNVTFLTLPRLPLLFLCLPNSSICSMMRS

SEQ ID NO: 26174 - protein, 312 aa, A.fumigatus
QRHFSNASQIAPALPVLAKLIYMLDDEVLIDACWAISYLSDGSNDKIQAVIEAGIPRRLVELLMHASTSVQTPALRSVGNIVTGDDVQTQVIINCGALPALLSLLSSTKDGIRKEACWTISNITAGNSSQIQSVIDAGIIPPLINLLANGDFKTRKEACWAISNATSGGLQKPDQIRYLVSQGCIKPLCDLLACPDNKIIQVALDGLENILKVGEMDKEAAQTGEARVNRYALFIEEAGGMEKIHDCQNNANEEIYMKAYNIIEKYFSDEEEAGGDIDELAPQQTQTGFALGTNQQQPGGFNFANGGDSMDM

SEQ ID NO: 26175 - protein, 83 aa, A.fumigatus
FHLNFFFINAEISRQLKFEPHPLFSIRYSPAIYLSKTVNQWQYVHINPINTCPKVCHTKLIRPCLNVLPFKKQPMIGRLPPSV

SEQ ID NO: 26176 - protein, 328 aa, A.fumigatus
LDTHSADPSAPVVKMVSGHYVFSKLIVDGKPTQDFEYIRRNTNNYMPTLPSEILSNDFRCNKGSMQSAANTKVYKVAPGTELGFQLAYGAEMKHPGPLQIYMSKAPGDVRSYDGSGDWFKVHQEGLCADTSKGIKDEDWCTWGKDTASFKIPQDTPAGQYLVRVEHIGLHRGFLGEAEFYFTCAQIEVTGSGSGSPSPTVKIPGVYKPDDPNVHFNIWYPTPTAYSLPGPSVWTGGSAGGASPTAPAVNNNAVQAAPTTMTTVSSPANPTAGAEAEADCGSSESSSAVAPEGTLKKWEQCGGLNWTGSGSCEARTTCHQYNPYYYQCI

SEQ ID NO: 26177 - protein, 100 aa, A.fumigatus
QSLPLRLKLIKHSIPILSRHLTIGGADLSVTINVVLPHQPTSKGSAYPEFLRWCFCGGMVWFCSNQTASLYPWTLKSHVSPQYSSVFQLRLSIYDCVNTD

SEQ ID NO: 26178 - protein, 185 aa, A.fumigatus
  UNSURE (90),(165): Identity of amino acid sequences at the above locations are unknown.
ACVFANAAIVQFKLTIQAVRYLRNAYPSDKLVFRVVTLLEPPKALMIPYLEAERSGKRDVTAPKRTAFVQFYKNTTAEFREVHIELDTGXITKEKDLAGRHSYVDPEEMQAAEDACIASTEVQEAIRLLELPEEAVVCIEPWTYGTDGMNDMSERIIMVWYSVTXESAVVTFYTVLLLHASWEPR

SEQ ID NO: 26179 - protein, 143 aa, A.fumigatus
RLWLVERTFLAWLRTSLAFASIGIAVTQLFRLNATNAPSSDVSSQQFPSLLSPPFYDSATIQITSESQRLRNIGKPLGTTFIGIALMILLIGFHRYFESQYWIIRGKFPASRGSVALVAIVAAALIVTSFVVILAISPSATES

SEQ ID NO: 26180 - protein, 299 aa, A.fumigatus
SLADRDRRRQRAACTAFKVSNCAPFYEPTFNDPKIRDTYRLGHSSGSGGLLLTDGVASLNAGLELASADILALGKSHIQRLAVDHSLVHFGDGLGGLIGAAEADETEALALSKNLLLCLLGLLLGLLGLLLGLLLTLLLVLLVRLLLFLLLGLGGLAGSDGVTHDLRGGDGAEGAEELAQLFVINVISEVLHVKIDTLVLGGLLQASGLVLLAELLLTFVLLLGTANVKLLALDLLVVHLVNGGLRAIVGGEVDEAETTALTLLVAAQSGGGDLTELLEHLAELLIGDFLVHVLDVELG

SEQ ID NO: 26181 - protein, 213 aa, A.fumigatus
MQYMQPAVFYGPGQQGFIPAGQRGGMPFAPPARYGDGHPWRTPPASTPVPSLVSRVDVAWALTSRFFPTSKVFPMGAMQGPGGIPNGMGYPQMAQVQFGRGAGGRGQVPGMPMGQGIRGPGYGQGRGGAPVQGGLRPQGGRGQPAGGPPAAGREEVPATGGLTAQTLSAVPPPQQKQMLGEALYPKIQAQQPELAGKITGMLLEMDNNELLGL

SEQ ID NO: 26182 - protein, 356 aa, A.fumigatus
VRASLRRGRPISTKFYIKNMNQEVTDEEFRKMFEKFGEITSATLSRDQEGKSRGFGFVNFSTHDSAQAAVDEMNDKEIKGQKLYVGRAQKKHEREEELRKQYEAARLEKASKYQGVNLYVKNLTDDVDDEKLRELFSPFGTITSAKVMRDTVTTGETSESEKEKEKESNKENEKEGEEKTEEKPKESEEEPKKTEKKILGKSKGFGFVCFSSPDEASKAVTEMNQRMVNGKPLYVALAQRKDVRRSQLEASIQARNTIRQQQAAAAAGMPQPVCIPDFRIIKCWLVKWSTVANFKCSTCSPLSSTVPVSKASSLLVSAAACLLLPQPGMVMGIPGGRPRPVPRSLPWSAGWTWHGP

SEQ ID NO: 26183 - protein, 84 aa, A.fumigatus
EYRVSDRSYPDYRYLWFGLVWFWFGFGFIIYSVRHTRRMVWMGRTIVIIGWPTTIWLKEITIGIEIVRINRHTQPVLSRPCSCS

SEQ ID NO: 26184 - protein, 67 aa, A.fumigatus
HNGVHRQTPDPPSLPLIPRLSRRDLLPTFNTPGKLAAVQPPKIEFGAFRALCLTSFKGGIIAHIGLT

SEQ ID NO: 26185 - protein, 113 aa, A.fumigatus
WPRMESRRACSRKPCKQQFWKTFCLAYFKFGAAFRPSSLSLEDTHQLRQFSLFGKLFVDDDICRSSFLHLFDVQLVVRDILGDIVMSFSKLTDYPTLVAHRSVKLQIWGKMLI

SEQ ID NO: 26186 - protein, 193 aa, A.fumigatus
PSCLPYLILTWWPRKHQKRHDRPYGCTFPKCSKTFGSKADWKRHENSQHYHIQSWYCTLCDPTKGKRYARWYYRQEVFVQHLKTHHHVDNEGARVAVANNLVGENGQSRFWCGFCREIIPLHSQGREAWNERFDHIDFEHFRRGQRIEDWVHCCHSSDDQECEESKGRNMASGSDESPFPTDFLHTRQNPLIV

SEQ ID NO: 26187 - protein, 78 aa, A.fumigatus
YGSRFQRLNVLINNASKQYMNKNFADIDLNKVEDIFRTNIIQMMALTKYALPFLSKGDSLVFLKPQHAQLTHRTYINS

SEQ ID NO: 26188 - protein, 71 aa, A.fumigatus
RAYSSGIGRAVAILMAREGADITIVHFPEEIDDAEETKRAIEHEKRSCLLVAGDLRAHNMCRRAVEEHMNK

SEQ ID NO: 26189 - protein, 122 aa, A.fumigatus
YLRTRKGPTQPSDVEAQTKTSLVYSNLAISSKWRLRWVRKVLFNRLRHRRVNKNRGQCSVPTGVTLNDSGTKDLIIRLEKHMVPPSEATKLESKGHFVEYVGSGKLKDKKVLITGGEYVHQF

SEQ ID NO: 26190 - protein, 97 aa, A.fumigatus
SRRRMCLRRCAPSGRRKATPALFEGEGAYLGPWAKYQDDDRVYYEEAALSYQELGNDQEFVGGSFLILSLSNFLNPLPWFYFNFLYPPLFPTLLSSL

SEQ ID NO: 26191 - protein, 490 aa, A.fumigatus
  UNSURE (207): Identity of amino acid sequences at the above locations are unknown.
VTKTSRGRHVLSHRYSFFVFNNLMVFSLLSAAWTFVAAVVDAKNHDEDAWQAIKDGALYQKVMSALCQVSPFWVTWLLQRNLGAAIDLVQLVTLFWVWFSKTFVAPTPRQAIEWTAPPPFDYASYYNYFLLYSTVALCFATMQPIVLPVTALYFGLDAMLKKYLLLYVFVTKTESGGQFWRALFNRLVFATILSNVVIALVAKTKGXWTMVYCVVPLPFLMLAFKFYCMKTFDDEIKYYNRANLTDAEAFAVDKSGRKGSDRLSSKFGHPALYKPLITPMVHAKAADALKQIYRGRLGASDVHGEYSDIAMDPMSATQPGKAMDAGQSAPFEVVPENHLDFSYFKDRPDFRDEFGGGIYGRPEDLMTERSHTPRSHLAEWSPATSRASSPTPSLPSLSGLKMPEGYDPIANDIHPAFRTPLSREESAAMGTGLYHHRSASESQQLLSQAQVPGTSEITPAPLSRWRTGGYGPVEQDDPNFTSYEQYRHAR

SEQ ID NO: 26192 - protein, 212 aa, A.fumigatus
TIPPRSDWYATALPPTPSNTKQAKALPRHVVERVHNYAISLLEKETKMYTEAQQASSSSSHKFYTTIMSTGTLSDKISALTLAVQESPVHNTKQLENLIGLGRKRSRAQAVEVLRSLKDMFAQGTLLPSDRRLKSFGNQPALMAAFQGAGSKWSEGDPLPGGLQNSHLIMWAYEHFLNDQYFEVLKILEVWCNDEIEFSRSRTRSYVYELLK

SEQ ID NO: 26193 - protein, 286 aa, A.fumigatus
SKSTTSVLSVWPFHDASMAKGKGKSSSGANAVPVADSKSAGESLPQLEEGAFAGLRQKIEQKLKDEQAAKQNKAKNKKNQNLDKSTPKKEKESAPKSEPKREAKSDKNNKGKKRDRNGEVIAREEKKLGGNQDDTLRQEILALGGTEEDFDLLAGVESESEVEVTETQKKSKNKSDEDSLRKELSAMLAAAGQVVPDDIEDENEVAAAFGSEGEDEEEKEEEEDDTQQSEDGDQSEEEEEASSAPVSRNVEPPKKEKAKEPAAENIFPKEFSKLVSISKFLLLEMY

SEQ ID NO: 26194 - protein, 257 aa, A.fumigatus
TSKLGTAATARGIFYPSWAWHTSITPIFPNIGSRQGLASSVKLFNPKSFTLTIGSCIFTFEGIGLILPIQSSMKHPEKFDGLLYTVMIIITVLFTAVGALSYGAFGSDTKIEVINNLPQGDKFVNAMQFLYSMAILIGVPVQLFPAVRIMEGKLFGQVSGKRDPWIKWKKNGFRSLIVLACAVMSAVGAADLDKFVSLIGSFACVPLVYIYPAYLHWKGVADSPLAKFGDLTMVVLGFVFMIYTTLSTAAVWIQGHK

SEQ ID NO: 26195 - protein, 84 aa, A.fumigatus
NGVVSLRLGIGVVVVVTCIIALIICSYLVIIYYNTSNFILSSLIYYFNIMTSLTFTYIAYLYFYLIFITSSLYKELLLYIISRR

SEQ ID NO: 26196 - protein, 88 aa, A.fumigatus
TICVISAAESPFGGVRESGLGREGSKYGLQEYQNIKSATLGNLQAGWVSPGLVDLYRFERMRLSPVVVGTFWLGCFLLKPTQNVPYAR

SEQ ID NO: 26197 - protein, 117 aa, A.fumigatus
CHILPSVKSWRPRHDLHISSVKPHTIIVSCFQTFLSTLTATSHLWLLGLPLHALTAVYFVSIADDPLDIFFCVYSACSISLHWPNFFFTLENDPYPLIAGQSISMCDGDLTTLRTPT

SEQ ID NO: 26198 - protein, 82 aa, A.fumigatus
LLVCFWDLMPHITFSEKLAATARFAYIKCEASYYHCFMLSDIFIYFDRYVSPLASGSSSSCIDGGLLRFNCRRPSRYLLLCL

SEQ ID NO: 26199 - protein, 76 aa, A.fumigatus
AAESLYTLSALPLAYSHRHLRHEDNKFPLTINTYYKWNMIGKIENVETLSFKLCDIISHKQLYLQNTPPPKMVYHR

SEQ ID NO: 26200 - protein, 226 aa, A.fumigatus
NSDEEDEIIFDVEEEERVTVTPEAGSTSSASEGNRDAVSEEAREQMHAEAEGEAEFEMDISQTTSQNTALTTATPQPSATATAAAATPTLRHRHQSGPTAVTDSTAIATGSATSTSKLQETEQTLDAHRAEQEDLTTSLLSLATQLKASSQAFHSSLEAEKSVLARAVEGLDRTTTNMGAAEKRMGMLRRMTEGKGWLGRMMLYAWIFGLWIVAVLIVFLGPKLRL

SEQ ID NO: 26201 - protein, 72 aa, A.fumigatus
VLIVSGNLLSSCRRCLWEYARGRADKVYKLSAAYSSMACDLQPSDSISVSNFRASASSLSPTTFSIGQGAQK

SEQ ID NO: 26202 - protein, 265 aa, A.fumigatus
LKVDISFSPVVTVLLVNSDNASASDLNSEFKTAGIVDYAYTPSTSAAPSTWPTLQTLINNGTRLMVFVASLDSNTDAPYLMDEFSFLFENPYDVTSPSNFSCNPDRPASVKNDLSAAISSNRLPLMNHFLYATTILNIEYPNSTYVTTTNAPSGGVGNLGDTATKCQSAYGRQPAFILVDFFDKGPAIDTVDKLNNVTSPVGRTNLTTSSSSSTTQTSSASTYSNVFKGLVELVQQAKSGSNPSMGDWVWVGGDWGSLLGGGITM

SEQ ID NO: 26203 - protein, 68 aa, A.fumigatus
  UNSURE (25),(47),(50),(60): Identity of amino acid sequences at the above locations are unknown.
CNIRLRMYSLPQVRDVIPKYGSAEXFSFLPFYFIFFSFPSRAETEIXVGXHLLGYRGKSXFRRPQPTS

SEQ ID NO: 26204 - protein, 374 aa, A.fumigatus
ISAMEAIYGFDRMSIDEPAPEAPAEAPAEEPVVIRPCAYCSEDIEGEQVRPCKECGCYCCTECIRQIFLMACKDEAQMPPRCCQPIPLAVARRHLSDEEIALYKLKFEEWRTVNRCYCPVSTCSGFIPPSYIQQQWKNLVASSGFYRQLAASGATPSLPVSPLYISFPVLCPKCFAQVCWKCKKLYHHGSTCQASDIDPELAQTLQNLGIKRCPKCRAAVRRMLGCRHMQCRCGAQWCWYCCRAIEVCKANICDKGREAEIDVHEDNAEEIATQVDEGEAKEEEDEDEDAEGDSDDEAYWSRYGGWISDPDETDDEQNDQAAYEDDDNKNQAPEMPLARPVEHNHFAAEAGSDVDLDARSDWEEVFKRWQRRIN

SEQ ID NO: 26205 - protein, 136 aa, A.fumigatus
AESSTEDQTLPAEWNANDTHSFRYAHSQSSMQFLLKIGRLGNNAVVLALALGDDKTSSFDLLVKDYISDSAFPITSADDLARTLRDVFISEARLNDLIGLFKVNVILKLAPGLYKEGYEDTTQALRRKTTRKATTT

SEQ ID NO: 26206 - protein, 183 aa, A.fumigatus
LLVCTRKDTKTPLKPYEERQQERPPQHDPLRDDTLPQPARPYPFDDPLAAGPRRPAPPGDFAPPGFEDEYEIYRPPRGYPQGNGGRNPLSIGDRDLYPAGLGPNDPIRGGVGPGLGGGGGGGMHPTFDDPLFGGRRDDGYNPQAPPGSRYDPVGPGGAPSGRGRGPFGGGSGGGFGGFGGDII

SEQ ID NO: 26207 - protein, 257 aa, A.fumigatus
ATGPYPALDLISLYGLGPVAKSVARMDPVTGEKINRLRKSYEGKLKGLGLAGRNKPVKHDPSAPGGLRHLTMWPEEEWHNQKVHGKEIKVADVDSASHNLQMKAMHMEPGTVPNNEYWEDVLGHDKPSKHAGHGDGKKAATLPNTARSPSQANETPLPTEPERARPSRGRKRHYDDNSFVGYGEGFADDDDDAAFYSNSEGMGKKKRKKVRSHAIWDGSWTRLIVLVFLKEHVSKVPTPLPDRGGSYGVGMFGIGAR

SEQ ID NO: 26208 - protein, 75 aa, A.fumigatus
NSVKQWISTNYASMTGAAATATGNSGSGSGSKGSDSQGPASSSSSQGAAAAPAATGAIAASIVGAAGVLGIALAL

SEQ ID NO: 26209 - protein, 234 aa, A.fumigatus
LVIFTVSRSQLAFVSCKGLESPSDSDVSATNCLHYLPTVYFSSSYFGPSGASDPRPHIPVELIIYPLKWRFYFLNKSFFRPKENNPDQIHMVRLNAAMYPSIYDANQAPGKPLLSASDSDTLDSDMDQDIEAQRSYRTFHTPRADSDSVSSGSSTPRSRINPRIISDAILGLSDGLTVPFALSAGLSALGNTKVVVLGGLAELAAGAISMGLGGYVGAKSEAYVFPLTSLLYEG

SEQ ID NO: 26210 - protein, 341 aa, A.fumigatus
RRIGRNWGGGSAFGAVVQGAGPVRIILGGSPREARCASSQVTACCTTGTIFMRTGEPMEYDPNGQLAWLISELQAGETAGQRVWLIAHIPTGGTDTLHDYSHYLDQIIQRYDATIAALLFGHTHTDVLQVSYADPAHPSADSASAVGYITPSLTPTSGPPAFRIYDIDPVTFAVLDYTVYTANVSTEATPQWTKYYSAKESYGSLITPPVTDPTAELTPAFWHNVTVLMETDNSVFQAWWARTTRGFKVRECNAQCARDQICSLRAADAQYGCVRGTLSITKRDGLNLAGVAPASASGPQVHVHSTRPQCEEGGLARVLAAVIRETDDLQGLLLQRAELYI

SEQ ID NO: 26211 - protein, 73 aa, A.fumigatus
YGAAPSSPVVKTPLSPFPFFPPTIPLRMLPVTQMQRALLPLNLKLKTRTEIQDADLAITEEETPPSRRVLVRV

SEQ ID NO: 26212 - protein, 68 aa, A.fumigatus
IRTQNGHIRKGNIVSENLILNQEVKAPQTISPLFNDLDGRQQGSYTCIWDVHFNIVACQQKQTTMLRL

SEQ ID NO: 26213 - protein, 90 aa, A.fumigatus
TTKKQYEADVSFQPHNIAATRRSPSILDQERFQTSAGEMLTSAILVPSLLTAVPASSASSLLRYDATLDKGRIECVYPISGQYALMQRVL

SEQ ID NO: 26214 - protein, 83 aa, A.fumigatus
TRQLHQNLARTNGTWMTRGRAYIVLRNVYISFHAGFHFYSNLWRMGTLNVDQNARVAIIKGGRSVDSLTPSDYSVWDVTGRQA

SEQ ID NO: 26215 - protein, 64 aa, A.fumigatus
TLEMGLDLLGYQKIHWWGEIEGVFMEYIFLLRGLGGTWKQGTSYTEAGYFPQNIVSKSLVHALY

SEQ ID NO: 26216 - protein, 248 aa, A.fumigatus
PTSGKLQAGTKSTSEEANQPQHGCRPCLDSRSPARQSPISIAPVRTSVLGGKLADASTNEKIKMKTENSSSASSSVAVSSSCAPPSSAASSPCEASTTSTPAPSGPSAKPYVPSPLPIKMFAPLTAHHQFVALIAVNAPCIKPLFSSSVWLGSSKDPSSKNAHRYGESGSYSLSVFGKSKPDPLVSHTSKLGDHASDEFILREQRENGPTYVNDVSGGHGQHTDEESGKFSGGGIQVTTMYEVRTGRA

SEQ ID NO: 26217 - protein, 125 aa, A.fumigatus
TGQHGANIGLTNAQRAAMTPDQVKSLVIGSKCLLAGWVCYVTLIWCLKACMLFFYNRLTYVFPVNPSAPVLTMIDWVSCTRSSSRSNAVLCALAYVAVIFTIFFLGLPIQKHWQIYPDPGGKRHC

SEQ ID NO: 26218 - protein, 423 aa, A.fumigatus
LVCTNLQIKTSREFWGRVERIILMVALTVSSSHTKHALEDLHPNIAVFRHPDHLPDRQGLASSITSSLQNLTLDTVSLAKMSGDALKGLYGMSDDVILYWAHHEKLCLIDGRIAFMGGLDMCFGRWDTYQHAIADVHPTNLDDIVFPGQDYNNARVLDFQDVVHWEKNQLDRKRTSRMGWSDISVSLHGPVVEDLRRHFVERWNFIYDTKYQVRKDARYARLVLPGRPGSPSPQQYNAQQSAPHHQPRPQQQAPGLSGYPSQPSVGGQGTPGYQSSPSYAGYSPSQSGGHQSTYTYTGDSFPPPPPGPPPSQHNPAPPSQFQAQGHGQAPYFPPPPTQEGSHSQTRGFDDSYELARGQGDSDRGSGFIPRRLKDELTGYGNIIRGQLAGTVQPYQDRLTSFGRHSSQPRKQHVLSDCGALGRI

SEQ ID NO: 26219 - protein, 69 aa, A.fumigatus
LFVEVSGRVNQQMNYDRCYSVDCYATQEKGGKIKASKDLLCFAQILINDFTSSLPNGTKTFFSTDGREI

SEQ ID NO: 26220 - protein, 148 aa, A.fumigatus
LFYQASWVRHLSKDYPTLAFHASINNSFGKGSLIQLLRQFSSLHSDRKQISVGLIGYPNTGKSSIINTLRKKKVCNVAPIPGETKVWQYVTLMKRIYLIDCPGVVPPNQNDTEQDILLRGVVRIENVHNPEHSRLHHGAGRSDGSAFN

SEQ ID NO: 26221 - protein, 281 aa, A.fumigatus
LNGRDAKKVKHLNMFKDGKPRRDAAGNITVAASYQSRDAPTARIEPNRKWFGDTRVISQEALTSFREAVAERASDPYSVLLKTNKLPMSLIRDNVHTVNGLKQHEAKMAIETAPFSDTFGPKAQRKRVKLGVASLEDLAGQTAKMHDAYVEKTDQATDEDGTIIASGDVSTDDKTFSEAPTARESVFSKGQSKRIWNELYKVIDSSDVVIHVLDARDPEGTRCRSVEKYIREEAPHKHLIFVLNKCDLVPTSVAVSKLSVHSFLPSNLLHNTIITLHLHAP

SEQ ID NO: 26222 - protein, 85 aa, A.fumigatus
RSGLMLELGPCRIKTGGNLTERNPYSWTRNSSMIFVDQPVGTGLSYVDSCQDIPTTSEIAAEDMYIFLQIFMTESFLNADIFPFT

SEQ ID NO: 26223 - protein, 375 aa, A.fumigatus
SNRGCGGLVVKILFNHDSASFSTIWMRNTSRVADSLPHPQARALQRPSGSTIASLCKTYSLRHETIELDAGSAFPLATLHFIDCDPTARSPSGNVLLYFHGGGYITPLSTGHFKFARAAAQRLTAKCVLLEYTLAPELKYPGQLAQAAAALRYLLQHHDAAEVTIAGDSAGGNLALGVLAHLRDPHPLVRPVFEGDLRQQEQKLCAVLCVSPRCANTCDAESYTYNASKDIVSRALMEVFNSHWEPVKEEVWATPLAGTKEFWGSVPAKKVLLLAGTDEVYVDDIRRFGELLGSSSQAASTELVLCAEETHAQAIRDVAVNNWDGVMLKVALNWLQNLGTLNDRGLPLPPNSKGVCAVWNDTINVMTDSDTRHAR

SEQ ID NO: 26224 - protein, 103 aa, A.fumigatus
GGPLTAPQLLYNGLYFSPEREFLEASITASQKTVNGQVRCRAYKGSISILGRSSETEKLYDMSESSMDEIGDFAPTETTGFIGVSAIRLKKYGQMKQANGEKM

SEQ ID NO: 26225 - protein, 73 aa, A.fumigatus
PAHVSLQHTGPARCWQPDSTNRATPQTAGYHPHKPRPCPRGATPSSQEQTPRTPSSQPAASPTPPPSQAPSAN

SEQ ID NO: 26226 - protein, 135 aa, A.fumigatus
QGCKVGKDGKVFSYGNSFYTGQIPSSAALTKRDFSDPVTALKGTTNTLQLPITVDSASSESTEEKESYVFKGVSGTVSDPKAKLVYFVKDDGTLALAWRVETDIDSNWLLTYIDAKSGEEIHGVVDYVAEADYQV

SEQ ID NO: 26227 - protein, 125 aa, A.fumigatus
  UNSURE (68): Identity of amino acid sequences at the above locations are unknown.
LTWCSAWGINDPTEGERTVIKDPWDSVASEFTWISDGSTNYTTSRGNNGIAQSTPSGGSSYLNNYPPXSSSLSFKYPYSVSSPPPSSYLDSSILQLSYADNFYPDLPYPLCFPDEAGTFEFYTRG

SEQ ID NO: 26228 - protein, 172 aa, A.fumigatus
IRHRSSPDHILNMRGLLLAGALALPASVFAHPAHQSYGLNRRTVDLNAFRLKSLAKYVNATETVIEAPSSFAPFKPQSYVEVATQHVKMIAPDATFRVVDDHYVGDNGVAHVHFRQTANGLDIDNADFNVNVRYDSVPCISLADRGARSEKMERSFRMATLSIPDRSPARLH

SEQ ID NO: 26229 - protein, 120 aa, A.fumigatus
SRFLPGRVEDGGIATGAEVIKTEEEQKMFGGVAGDAFDPCYHQLCDDVSNVNLTAWEVNTKVRVDFCVYTRRRLLICTQLVAHSIATYARSFDGFPKRIKVESMKKGDEQRKYHGHSLLY

SEQ ID NO: 26230 - protein, 302 aa, A.fumigatus
  UNSURE (1),(3),(20): Identity of amino acid sequences at the above locations are unknown.
XGXVVFRELASNKSLDGRSXSSSSEERKYWGFLVFIKVLGECPLQLASVVFTKNLVRCLTNQLAVEDRYLHRMAVKAAKSIQARVAKDPEFAAASVIGLMGSAGSVTFDQATKTKTIEKIVVEANLDALKQIVPFFEKLIASRGADDAKAAAASRQSLAGLLLSIVRSRASANDESQDGLQAVLEQILFTFVRFGYFLPKDEAAVQPALTQQSQELFRNRISSCLNSLIANPKYATTLPYAVVKKIRDAAKSEEYGKFIINMDETLRDSVKTAFKSLKKLSSMVSIATFPTVPFVLTETGKE

SEQ ID NO: 26231 - protein, 112 aa, A.fumigatus
LKQEKNEVSGVEAFKLLYSMTILQVYNGDADAVSMLDELDFCYTKFLGDKKSKDEEASDASDALVEILLSFASKQSQLFRRMSEQVFGAFADKVTENGLESLVSVCPLPPEI

SEQ ID NO: 26232 - protein, 68 aa, A.fumigatus
TLRCFRLKITELEFIRDIHAFIVCESSYTHPALFDSLDRFGIMCSVWCLCNFLLQINVFSILYLPTNV

SEQ ID NO: 26233 - protein, 187 aa, A.fumigatus
TMFIGIRGVLVRYASSASGFTNLNRSLSLKSNYSMRKASWGGRSSVANKENESFPEEDENQSGDESDAGTERRTSYTGTYTDSMTYGTESVVSADRRVSAASSTNMPTAAPHSIPEDSEDDEQQEEEHGTADEDEDDAQTTKGNESADDQQEGETGADGDDLVSTKMVLYGQHSDSGLGAEIASAAG

SEQ ID NO: 26234 - protein, 60 aa, A.fumigatus
SNIASAPTTGSDASIPPSQPVAIRQARSNTPFRSESSDDNPLTPRNDSGPLAFDGRAGMP

SEQ ID NO: 26235 - protein, 60 aa, A.fumigatus
  UNSURE (4),(30): Identity of amino acid sequences at the above locations are unknown.
IGYXVQVDLVQHNLYTDATTPLRVVNKYEXTPHPVSYCSEECFVAWIAFVIVVFDSHLKD

SEQ ID NO: 26236 - protein, 65 aa, A.fumigatus
HDAKLVWVARTVFIHLPMVKYTHHSMAEGNMEMEVIQVDIVCMDTDCGHSFVDGLTSFPTQISDS

SEQ ID NO: 26237 - protein, 230 aa, A.fumigatus
LEDADSNRGAARRSRVAIDATAEHSDTERSTKGRCAVSMHQPTPLALPGRPNFSNVSSPRGSAHHHGSKQAQGAQLQTSSSHVRDKGGPVHASTPQNRGTSVYNKKIDLLSFDPLLDYTSSDLSRSGQQIISDPKERAKRDEFLRGLHDMFAATTAPGKTNTVPADTDVFASQPRTKRVQPKSRRLFQDRPAALKSAPDGGTETNALDADQIRQQSVRIYNLAADAVKDF

SEQ ID NO: 26238 - protein, 161 aa, A.fumigatus
PQFRPCSPFPRPGQALPSRNINPLQGGKAQAGFPPVSPTAVLPGEGLDWMNTFLQSCTECGISALAVQWYGNSAEEFKTFVNKAISFASEKGLESVWITEFALSNDINTGALSSESEQFLTEVFPWLDSQPMVARYAYFMCANNYLLSGSGFTSTGHVYVS

SEQ ID NO: 26239 - protein, 144 aa, A.fumigatus
ITLAVHPSSPVVKTIMFCTLFSHVGFAVNVTSILLSISTILGGVMSLNVNDVLQAINHLSPIKYSIANLAPYAMRDQHFTCTASQLLANGTCPIQTGQQVLQLYNLDKNAPMNVMALGICTIIYRLVAYAMLKVMREGFWRRLR

SEQ ID NO: 26240 - protein, 90 aa, A.fumigatus
WQLLENEVNCVSQCPTDDTTVVDWSETKAALPRLCYLLINNFGSLCHCSDLHTALVQWRLRYDPPVCAIYVRQDGTRIMEKCTVRSRDQL

SEQ ID NO: 26241 - protein, 77 aa, A.fumigatus
  UNSURE (5),(11),(22): Identity of amino acid sequences at the above locations are unknown.
HSFGXGQHFNXIKQQTPIKRRXQLGTAMQDLSVYSVYAAWNIQSKCTMEVWPCLEATLSQIQLAASRTCHWPTVRLS

SEQ ID NO: 26242 - protein, 68 aa, A.fumigatus
IFNVYNGLELPNSQDLISKTLEVLSLVNPSRIAYVGFVKLVARDSADRNFTIFATWQPTGVLRELAVL

SEQ ID NO: 26243 - protein, 488 aa, A.fumigatus
RTIKEGPKHSHGKLLAQEGFSDVLTKPRRETPLKGISYHSSHNTSRQGASSAIPWSQPAADASESTAVFGGLSTPKAKKQGFFKKIFESAKTGAANARSSIAVGNSGGSYSRTKGRAISPIRRDTTRDAGTGTVDWVQVRRDVNRASSPSRNERIERAERCQMMDHPVIYAVEELHETAEGDESIDGLPISEPTNFNTVNLNLVDKSARFVNSLPPMTNPMSLAQGYVCRPYKSDVQRLRAIFTWVSEKIAWDEPVEEIGIDLKRILQTRRGSPQEVAFLVKEMCAAVGLHAEVVQGFLKTPGELFELDSLSRPNHWWNTVLVDGEWRVIDCALANPTNPRRNQFVTSGSSTAESWYFLARPLEICYTHVPLYPEEQHICPPISPDVLLALHTACPPYFKLNLQFPDYDTSLIRIEGLELLQIRLLVPPDVECAAEVEAPAFARDADGDFFESGEVIRKRALVQPDWVGGQKRFTVKAVCFLSEAAAR

SEQ ID NO: 26244 - protein, 79 aa, A.fumigatus
PQPSTQDLTSRISGVTSVEAGTQIKQVGKDEQPIDLSDEKNVEMFMKHFSGWSQRMREDAATMNLYGYVDLPKGEAYRG

SEQ ID NO: 26245 - protein, 374 aa, A.fumigatus
  UNSURE (11): Identity of amino acid sequences at the above locations are unknown.
KISKRTAPNSXYKAAMTERMSSWSPTDLKARGVPSRELINLYKRWGEGGYGLISTGNIMIAYDRLEAPGNPIIDLENPFHGERFDAFRELASQAKRHGSLIIGQVSHPGRQTEERLQPNPVSASDVQLDKEIMGMQFAKPHAASKDEITDFIRRWTHAAVYLHKAGYDGIQLHGAHGYLLAQFLSQTTNRRTDEYGGSLENRARLIVEIAQSIRKELPASTGFILGIKINSVEFQAGGFTADEARELCQILEENEFDFVELSGGTYEFIAFSHKRDSTKQRESFFLEFASLITPALSKTKSYVTGGLRTASGMVGALETVDGVGLARPACQEIRLPRDILDGKVTAAINPRFDQQDFGSHQRRSGYANKASGKG

SEQ ID NO: 26246 - protein, 192 aa, A.fumigatus
LLPNRLRDLHNQPRAVLQTPAVLIGAAIRRLRQKLCEKVPMRAVQLDTIIASLVQVHSGMRPPPDEVCDLVLGRSVWLGKLHPHDLLVELNVAGGDRVGLESFLCLPARMTDLADDQAAMSLGLRGQLAEGVETFPVEGILQVNNGVAGGFQPVVSDHDVTSRYESVTAFTPSLVEIDQLPAGDTPCLKIGG

SEQ ID NO: 26247 - protein, 158 aa, A.fumigatus
SHHQNKTRKIRGKSNMPSAQPPASLASSSSEPSYSPIPASASTTAEDGHTRSSTTPTGPSSSKQAAASGTATDRDKPRLTEQEKKNNHIASEQKRRAAIREGFDRLTELVPGLEGQGRSESVVLRKTVDFIHMKLQERQELIAEIESRGGHIDDAFRT

SEQ ID NO: 26248 - protein, 65 aa, A.fumigatus
PYYKPLSSSFNDTASKQLPLSYSSFLLDLYFSIILLAVTTQSYIAASIHNCLHRGAGRSRLLKDH

SEQ ID NO: 26249 - protein, 170 aa, A.fumigatus
KGYSECWANGIYHCLFCDGYEERGQETVGVLALGPIANPARALHLARMALRLSESVTIYTNGNEQLAKEIQQAAEESPVGASGLKFEARPIRRFEKGDVAKTVIVHLGESESKTEGFLVRCPVYSTEISLLTAANRSGVQPPNGGQWTVCQAARLEYDRRRGYPDHAALL

SEQ ID NO: 26250 - protein, 91 aa, A.fumigatus
PRQTAQVYNPQTEVNGPFAKQLALNMTEGGDILTTPPFYETSVPGVFAVGDCATPLKAVTPAVSMGSLAAGGLVAQLQAQALPEFRLDQEL

SEQ ID NO: 26251 - protein, 119 aa, A.fumigatus
HPQDGRQIFNDSNSTMATSTPSFEYNISFTTPANPPSCEPKLTAKDLWTGIARVADAPQEYAPYVSKCEVLSRNGHALERKLTMANGAVHKSDGEIMYQDVWIADRLLVVLSLPAVLPP

SEQ ID NO: 26252 - protein, 258 aa, A.fumigatus
QQTTFVMQTRPLSINAIWHLVLPLLATSATAAPYQTRILATGTTFNAPDPYGPWSLTPSANKPGPDLAYIKTSNTGTGKVEVHLASRASNYQTRTLEVGTTFFPEDNGVWQLIDADGDGRDDLVYIKTRNTGTGRVEVHIATAASNFQTRIKDVGTTFLPEDNGTWQMADFDGDGILDLIYIKTRNTGTGRVEVHVASGASNYQTRIQEVGTTFYPEDNGVWQMIDFNRDGKLDLVYIKTRNTGTGRVEVHVASGAST

SEQ ID NO: 26253 - protein, 168 aa, A.fumigatus
  UNSURE (6),(53): Identity of amino acid sequences at the above locations are unknown.
MSIRTXNPETVPILLDFDTGDWVHFFITNNITFEKVHFPRNLTPVMHRMHLHXHDFAILAQGRGEFDPSIVPKLDNLPRRDVVNVDTGSYVWIAFQVNNPGAWLLHCHIAFHVSSGLSLQFIEQPKKVKPLMEAAGVLGEFHDRCAKWTEYYDSVNIPDNHTIDDSGI

SEQ ID NO: 26254 - protein, 427 aa, A.fumigatus
LFLLSKGNGLMTPQDKNFITRIQLQQLVAAAGNVADTDLEAVLAEDFYYQVYSQIRGAPRQHPHQPLGHFAQTYLLQTGNRLGGHGRRNLQSADNHMQRMQQQVQRAVEAAKAKPKNKQLIIEGSLGKISFSNAKAPKPILNIKRPETSDGAKAAKKQPTDLSPSDRKSILMNIENVYSTLMEMEDMERTMPPLPDENDAEAIQKHLEWRQKIRSLNQKLWQELKVMEPIVPNTDTPHPFIAFLSYPKGKKAIPRIFRHIDQEQRVTILTMIVVHLDTLDVVRSAQPIPGENQPSLAVREAIDLFSQAVMPSLLGYVNEAPFNIIIGLLGLVIAQTHVQLVARTRIGLGILTMLLSRAEIVKEAGQAAERDWQQWVEKFNVLFDTLEPIFGEIFPASINAGDDMYVWQFLAAGLHHGAGRIHGVRKS

SEQ ID NO: 26255 - protein, 219 aa, A.fumigatus
RMTGVFWTIPFFRFHPATKSTGFGSAEMDNKIEADGKPSTWKKHSRIRIDGLNIDHLNRGVQGPFSWIYEGTVDIVADIMFPAENDESLAQVMAGLYDRLEATVISNQYQEPDSRRQPGMDGTASSDDKRFLVTDLRLQLNNVRAVVPLFNRDLSYINNALIRPIVAYINSRRTFIPIHCRLVKRLADFDGSWTTFDSGLMDDLSAAVSFPRAIGIHTY

SEQ ID NO: 26256 - protein, 60 aa, A.fumigatus
NNYRLEQTLAFSISILLPVSHLSVLSSEILQLLVAKILRKKTQCKRQNYTQMPVLFQYYQ

SEQ ID NO: 26257 - protein, 64 aa, A.fumigatus
PVRAPSSSWWIIGRVISHDVDLPNEDGTTYSHGNGNDGKVHSRKVKAADANMLSRKNIPPKQTG

SEQ ID NO: 26258 - protein, 88 aa, A.fumigatus
VPLPQRCTGVRRRHFPTVTAVVSHMPFALVPFSLPMLFFEQALVTKGWVPVFAYGWDHWVDKTGTVGAIGGMGFVSVILCNVSCEALH

SEQ ID NO: 26259 - protein, 130 aa, A.fumigatus
RSRTCSTNLSRLLQFAGTNIGTTILLSRVIQAWKQINDEHGTFISDRTFWATVYSMAIGVNYGAFSTAFSASLAGLLWRDILARKHIRVRSLDFARVNLPIIAISMAVGCTVLVGEVYIMRDNSPYNPPR

SEQ ID NO: 26260 - protein, 62 aa, A.fumigatus
LRLAGMVKLSFAVAVHHSDSFKHSNRIPNNSQMYSCEITPWVPVRDGELMMAYNGWNPMEQP

SEQ ID NO: 26261 - protein, 173 aa, A.fumigatus
RWNTIMTFVRFRKYIYAGRAMLSRDDKVKTQNQTNMYSRKLLNFPLRHFATRTPILRSARPHQPWQTRTMSLMQRGQRHPGAGFPSLSRALTDLESFLSRPVGSHDLLGQYPRFDVRETKDSYRLDGELPGVDKKDIDIELSDDNVLTIKGRSERESTSEDPDQSCLHHGGRS

SEQ ID NO: 26262 - protein, 68 aa, A.fumigatus
GSSQRGAGFRGYVFFFFFGLNMNRERYANMLKVIARSALAQEEAEEFNGEFSDPINIHLDSDRDGCAC

SEQ ID NO: 26263 - protein, 70 aa, A.fumigatus
IWDTAGQERFQSLGVAFYRGADCCVLVYDVNNSKSFEALDSWRDEFLIQVSPRDPESFPFVRSHLPLTDL

SEQ ID NO: 26264 - protein, 69 aa, A.fumigatus
CANGQMVTILQVVIGNKIDVEESKRMIFSKRAMTFCQSKGNIPYFETSAKEAVNVEQAFEGMFFFFFLA

SEQ ID NO: 26265 - protein, 371 aa, A.fumigatus
  UNSURE (369),(370): Identity of amino acid sequences at the above locations are unknown.
ISPDPRAFRVSSIPSLWLGILLVSRSRAVFAASWIVIDHSLVPSFRWHEHDPLELVDSVYTCIEEAMKTFLALGHSKSDIEAIGITSQRETTLCWDWETGEPLHNAIAWPDTRTKNLVRELKEQEGSDELPAICGLPLSTYPSSVSLVWLLRHSPKVKQAYDEGRLAFGTVDSWLLYNLNGGPQAGRHVTDVTNASRTMFMNLEALQYDDRLLNFFGIDKTKIRLPKILPSSDPDGYGYVRFGPLDGIPITSCLGDQSAALVGHCAFTPGTAKNTYGTGCFLLYNVGEKPVISKHGLLATVGFQLGKNRKPVYALEGSVAVAGSGISFLMNNLGFFRDSRKVSDLAATVPDSGGCVFVTASSPARGEGXXV

SEQ ID NO: 26266 - protein, 90 aa, A.fumigatus
  UNSURE (23): Identity of amino acid sequences at the above locations are unknown.
GTRPRPFDLTENDFAVKEQHAHXEICASQSHDGNRSLLQNENRRGDNLKDRFIGAIDQGTTSSRFIIFDCTGVPVAKYQTEFRQIHEHSG

SEQ ID NO: 26267 - protein, 100 aa, A.fumigatus
RRSDKNATSAVGNSSGKITNFARITEEPEVVHEEGNTTSGDGNTSFKGVHRLSIFTQLEANSGKQAVLRNYGFLTDVVEQEATGAICVLRCAWCKGAVTD

SEQ ID NO: 26268 - protein, 87 aa, A.fumigatus
SMWAGAFLKAQEPSSRDIACSGRACLINRRFLQCSQFLCNPNRIPLALQSIDPYSIFCEVIVRSNKRERRGQCRKPIAPWPPGYKTR

SEQ ID NO: 26269 - protein, 70 aa, A.fumigatus
PTVVKTWYSKYNEVKDNNSAWSELGNQEVFFWKITTIKNGNLSVSVNVLRIEKSHNCTAAARVEIWKDEG

SEQ ID NO: 26270 - protein, 60 aa, A.fumigatus
LVKVYCIRKESKGNNTIIFACLQEINSKIEAMAIKDKYLFLSPLYTLIYRLNKTLKLLKG

SEQ ID NO: 26271 - protein, 75 aa, A.fumigatus
SIFCTGRAICFGFVAQKPIYLALGGHFSSQYEALRFVELSYTQNLLFFAGRNGCFHKEDLGRACQQRLAPKRIIV

SEQ ID NO: 26272 - protein, 64 aa, A.fumigatus
SSDIAREFSSYNPDQDSYPEVEYSEVMSDDAALLRWFDEIVSSSFTQGMLNSSHQSSTNGVSVL

SEQ ID NO: 26273 - protein, 182 aa, A.fumigatus
RCVCSPFNLRRPSLWRHETDGNSAYPTYTDRPGMPVVAKLPNGKYIYTYEYGSFFGTDSYSFPVYYRISSDPENFLSAPHQRLVTTTGYVPTSSPYVVWTPYGGVNGTIIVSAYSSSSVFINQALGEGPWREIPTGEPNAYTRSLRVLKKDPKMILINGAGELNGENNKVTVTLLNLEEALR

SEQ ID NO: 26274 - protein, 178 aa, A.fumigatus
PRGGSPFLKVSVSFRGSKHIVPVQFLTIRDSNGKLICYYSDQRANATHGQKMVHQVSTDLKNWDPVVDDVYVPPSTCVDHHCGDTRLTVTVPTQPTPIVPACPWSPSSPMASTSTPTNMAPSSAPTATLSPSTTVSHPTRRTSCRLLTSAWSRPRAMSPPRRRMLSGPRTAASTAPSS

SEQ ID NO: 26275 - protein, 297 aa, A.fumigatus
  UNSURE (34),(36),(39),(107): Identity of amino acid sequences at the above locations are unknown.
VETKWTFLWRSLCSMTFHALTRSINSGIHAEMRXGXGYXGFLFGEPAIQISLDKCEDLMDSLIECAEDQADLLAEHAVEVSDVMLLPSYEEVTRGCQTVWTSLADVXEFGSLEYELDRAVDRLICITTILRNLSFTESNFGLLSTAPVVQFISTIIRYLGTRNMLFRTHQNTLDFMKDAVIYLSNLAHVIQLPSKEEALCLLNFLLSFAPFPPPTLGTDGVMFTSYNASIHKYTPAAVDSLAKLLARDDPNRTFFKAIFSGDGAPGSQHELLTRAFGLAICPVPGVHHRGRKVRAKR

SEQ ID NO: 26276 - protein, 262 aa, A.fumigatus
DVGQFTWIPIPIVGGRPINLVQLYATIMKLGGSKKVSASNMWRVVAQQLQFLPMQFHMAVQEIREHYQRNLAAYEQAFLSTQQKQFADQMQQNSLPRQPSDSSAVQFQSPTVKQAQGFEVPQPVGASPGSMSVANNAQQSLPNGFATPTQVKASNKQQQHRLSVSRQSQPPATPQDCTGQLPNQSPAQSTKPLGGTPGKSAKSFEQPSDQPLKHPIQDPFKPMVLPESNLHGPIVLDEMYQLGEEITRLKPNGPSFGGVCVQ

SEQ ID NO: 26277 - protein, 159 aa, A.fumigatus
TSSGKAGPKRADKSNGFDLLCSGQTPRTEVEKAEYERVFEEVPAPFTQEERDSWLSKMGEVAVSSDAFVSDLTTLFRVFVACTDAESNSSPSSTTCSVQLVRVPSTSLPPAVARTTAPSLRRPRSLVSSSSNRAPVCSTTRCEEFTTVLVGDDTAVMFA

SEQ ID NO: 26278 - protein, 257 aa, A.fumigatus
HFGPQDNRRPVNGDGFGVGFYTDPKLGPEPCIFTSTLPAWNCENLERLASKTCSNLIFAHVRATTEGTLSDTNCHPFQHQTLMWMHNGNVGGWHYIKRTLADSLADKWYLGVKGGTDSEWAFALFLDLLEKEGVDPSSNPGPEGFGQALLRKVMVKTIAKINEFIRDIPKRHNVSGVETRSLLNFAVTDGHTVVCTRYISSKTDEPASLYFSSGTKWKERKDKGHFKMERHDKGANIVLVASEPTPSNAVSQSIHPL

SEQ ID NO: 26279 - protein, 234 aa, A.fumigatus
IGVLTISQQSTKRSTGGRVWPSYIRQYTGANIYDYAWSGAVCDAVVANTVRNGIKQNQIPTFLEDNIYVSDITGQPTLINPPDETVYAIWIGTNDIGYGGFLTEVQPAGMSLTYMTDCVYAQLDRLYAIGARAFVLMNMAPLDLTPLYALPQNGGSLDAQYWTDKAAYDSNITRSSEKMRQYVTMVNAIYDYQTPYDVVVANRYPHSRFAVYDVHALVGLRFSSTPPLGCGTFD

SEQ ID NO: 26280 - protein, 71 aa, A.fumigatus
  UNSURE (44),(58),(60),(68),(71): Identity of amino acid sequences at the above locations are unknown.
LNAIGEVDQIFAPGTALRLIEFVFQLSGRTIISDLVVKFGGACXNRGTFIPGYSGTGXGXKALPDLGXCGX

SEQ ID NO: 26281 - protein, 64 aa, A.fumigatus
ICSNENNMGYELPESFGPHSHMRVPNVLLAFTTFFGNVLKNSAYNHILRRNNEYGNMVTSCQCG

SEQ ID NO: 26282 - protein, 128 aa, A.fumigatus
SALEQEGEKIIAMPPPGLFGRLIQNKRRLLWEKREGVDATLIVADVKFGVHSMILGAESPILQSRFQASLRKSGLREIIIEEADIHTVWRTLMLIYLGYYSTSPCPKVATSGAFISSSSTTGAGRNRA

SEQ ID NO: 26283 - protein, 187 aa, A.fumigatus
AVRQSRGEDGMLIAHKFWENAMNILLFQEKDSLSPLVRILTKLRLPQVICEKVEKSDIATIDKKKYLVPADLTVGQFVYVIRKRIKLSPEKAIFIFVDEVLPPTAALMSSIYEEHKDEDGFLYITCVIPPLSSLRTCINSRSDTLARTLSVTAEYQWVLLSKWNSPHRQGVRFTNLRFKFVSKSIDP

SEQ ID NO: 26284 - protein, 125 aa, A.fumigatus
  UNSURE (2),(5): Identity of amino acid sequences at the above locations are unknown.
AXIFXPRGEDVASYDQIKSLPYLRAVIDESLRLYPPISHGLPRETPKEGMMIMDQWVPGNTTVSMSAYVAHRDPAVFDQPESFVPERWLGEQGAGPANPFYRLLSWRTRLYWAPDLLPTSQHPPS

SEQ ID NO: 26285 - protein, 75 aa, A.fumigatus
ESKGRALQTRFIAFSAGARGCIGRPISYLQASILLANLVHQYDFEMWDPKWKPSTRETMNPIMGPMPVRIHKRST

SEQ ID NO: 26286 - protein, 70 aa, A.fumigatus
ANTFDPWLSGRHDVAVCEAGCRHVGLDIKGKDQANPSAMILSGSMLLRHLGLDDHANRISKAVYDVIGEG

SEQ ID NO: 26287 - protein, 192 aa, A.fumigatus
  UNSURE (4): Identity of amino acid sequences at the above locations are unknown.
LESXLSFRLKIAILNDPINSSRAFKCTFKRQTHAKVSRARLKHRPLAQLPAPIAAQAPFATTAAGPKRKNTQKPAPMSVEEAARIAAEEDKRRRNTAASARFRVKKKLREQALEKTVKETTEKNAALEARVTALELENQWLKNLITEKNGKSAEETKKSETDIANMFKKFLSSQKADAERSSSESKIGVGTA

SEQ ID NO: 26288 - protein, 479 aa, A.fumigatus
RGTIACAADSHAYALLDVEHQQKIPLFPISSSNEAFESGHVEDMPSAPSPTSQGTRSHARSPSSNTLLGMLQPNPPHLQHDRSRSATPELSPDSGTPRRSVSRDRSRSASPRASTEIRAGEPQPGSVSDTKPLPPLPKQLKPHIASPTPSEFLLVTGTEEKEPGVGMFVNLDGDVVPRGTLNFHRYPEYIVIDSGEGNNLVDSREKTHDQYILAVIETDEDGKRCKWLEIQPWDVDPREEENCKSWLEVPSTEDMPPCPVGICHTISSSQLEFGELGNLLQMVRLKTPSLSPYLPVTDPRTQASIEQLQKEKELFESQELTDSDGVRRGDGSPEQGWEAERNNEKTKFARALGQAQSSLVMWSGRRIWRVVRNPLTTQLDSALQAAQGSKDLMYEDLKRDSILDVFEEIQAPQPRSETEFLGLNFLKQKSSLLLFGDLLFRDAAAPKEAAGQVTERVLNNWKVWIPRMVLLLIPQPKGA

SEQ ID NO: 26289 - protein, 198 aa, A.fumigatus
QADHSTGYSIPLLDSDVSVAKKMFDVNVFGVVTVTQAFAPLLIASKGTIINIGSVLGKMPLPWQAYYNASKAAVALLTDQMRIELSPWGVRAILVNTGAVRTKFFDNLPNTPVLPESSLYYPAKDVIEPALAGSEVEKNAMDVNSYAEAVVNNATRSSPKKHLWIGGGALLTWLASTFGWSTIWVGSFPYPKPTGLPY

SEQ ID NO: 26290 - protein, 348 aa, A.fumigatus
AGKEWYVVSAIRLSRSRFHRTEFFAAQFTGSPIELHPQFNPMIGPSPYVQINMGARYTPCMKNVDKIQNSQVEFLFPCPNATSTADFVCTLSELCGFDGVPNPVPGGTLDDRPEPNQWFRFIIPMFLHTGIIHIGFNLLVQMTMAADMERTVGWWRFAFVYLASGIWGFVLGGNYAAQGESSCGCSGSLFGILALYILDLLYTWGERSSPWAELVIMVLGIAISFVLGLLPGLDNFSHIGGFIMGLASGLCIMRSPNALRERIGLARNPYVAMTGAAGATADPGNKVTNPGSTIAEFFKAHKGSKSSKDSSALGFFKGRKPLWWAWWLVRLGVFTTGLEGSALVLCHT

SEQ ID NO: 26291 - protein, 254 aa, A.fumigatus
PVCDACAVFLHSRVVSLRLPHYCLISAGCPGLIFQASHGRYTCHIPRPNRGHNCCFKMPNPSQLFLLADHIKLSLLERQRAISLNLEPNSQDGEISRSLESLREGIESVESEVSRLGEANDVAAIDLKDQLHYLQSQYRDLSSQFHEQDDSVLDSDFSNVKKSSPDLKQPIPQHPPSKSVRFMDSAAEDADENRRNLFQPYRDSPSPPSPDHSNMSNQQIYDHHAETLREQDEQLDRLGESIGRQHQLSIQIGA

SEQ ID NO: 26292 - protein, 103 aa, A.fumigatus
PCFFSRFIQEHVKQLCPSLRTTCPDCQTTVFRKVLRDHIETCPEAIHACAASKYGCPVKDKRADLATHEQACPLIAIGPYFEAQNARLDSLGVQHAVEGPYLR

SEQ ID NO: 26293 - protein, 112 aa, A.fumigatus
ALRVPHAPIKRSHLSESDRYRTLLPTMNLEELLMMESSCDREEIVDLRALEYVSNYDDHLMCAICHCPFIRPVRLQCDHVFCQKCLNSAINTFAAGRDEFTCPSCRTTTRDV

SEQ ID NO: 26294 - protein, 137 aa, A.fumigatus
GRAIMGATASSTTTYVDSPAATIPGRPWRSWRAPFESLHARWPFRRPPFIEYTEQAQRFPPAESQHKCHGTISTGAARTVPVARSLVPANPNPASTGAGIAIAIAKPGAAHRETPSSAHPPAVHTVSHSSAAAAAAA

SEQ ID NO: 26295 - protein, 495 aa, A.fumigatus
FLPRFEQVSPYSSFFNISAVGLGGTLSSYTWICLIINFLQTREPPVLPSLQARPHKKRVTTDGLVCSFDDDLSSLVGYGRKNKQTLGELLFQFFRYYGHELDYEKYVISVREGRLISKEEKGWHLLQNNRLCVEEPFNTSRNLGNTADDTSFRGVHMELRRAFKAVSEGNLEDCCEQYEYPPEEERSWERPPPQPRPTLTAPPQLSRGGRGGRGGRHSNHYTRGGHSGGRRSSNTPNKPNGFRQLNPSISATELSLQAQHAQYLLHDHLYQQIQILQAQEQELRLQLQNQALLTGRPPPVLIRQPFIQFPIPQQQPQPQPESSVDDGSRSRSGTHPPLSASLRPQAYNNSAYLPVAVTPAQGSSTNPPSPSAVSALPELRRTPRRQSIANGSPGRSLRAHSQPARPANSPAFPSFAPLYSVSQPVDNSQLPKQRNNSISPPEGNQSEDENSFMPSSLPNVSRAPYLDENRPSEYMGYYLATSSHTGLAGSAIELG

SEQ ID NO: 26296 - protein, 207 aa, A.fumigatus
SQGVDILCSDKTGTLTANKLSIREPYVAEGVDVDWMFAVAALASSHNIESLDPIDKVTILTLRQYPRAREILRRGWKTEKYIPFDPVSKRIVTVATCDGIRYTCTKGAPKAVLSLTNCPKEVADVYKNKAQEFAHRSFRSLGVAVQKEGEDWTLLGMLPMFDPPREEYAHTINEAQNLGISVKMLTGDALAIAQGDMQNARTGNQGV

SEQ ID NO: 26297 - protein, 301 aa, A.fumigatus
RWPPVMESGIPVPRAPPRQCFPLPTVLKKLPMSTRTRRRNLPTEASDPWVLRFKKKERIGHYLVCFPCSIHLGKNTRIRSMKPRILESVSRCLQVMHWLLPKETCKMLALGTKVYNSDKLIHGGLSGVMASDLVEKADGFAEVFPEHKYQVVQMLQERGHLTAMTGDGVNDAPSLKKADCGIAVEGATEAAQSASDIVFLEPGLSTIIDSIKVARQIFHRMKSYIQYRIALCLHLEIYLVTSMIILNESIRVELIVFLALFADLATVAVAYDNASFELRPVEWQLPKIWFISVLLGLSSPR

SEQ ID NO: 26298 - protein, 223 aa, A.fumigatus
IIVGEGQVVPADAKIICDYNDPNGWEEFQRMQEQGDLSSTSESDVEDNEKEGKEGKGEQESSRKRSHPILACDHSAITGESLAVDRYMGQLIYYTTGCKRGKAYAVVQSGAKTSFVGKTASMVLAAKGAGHFEIVMDQIGTSLLVIVMAWILAAWIGGFFRHIPIASPPQQTLLHYTLSLLIIGVPVGLPVVTTTTMAVGAAYLAKKKAIVQKLTAIESLAVG

SEQ ID NO: 26299 - protein, 79 aa, A.fumigatus
  UNSURE (26),(48),(56),(57),(69): Identity of amino acid sequences at the above locations are unknown.
PGLPSVPAFLNDIDSNMLKNFFIRLXSSHFTIDFCFRNQHSKFLEPVXFEWSTELXXTFEGSTTSLGTXVTSPSRHRET

SEQ ID NO: 26300 - protein, 387 aa, A.fumigatus
  UNSURE (1),(23),(31),(32),(43): Identity of amino acid sequences at the above locations are unknown.
XRVISQLIFASATSTVNSLNRSXSSGLLNCXXRLKALLLRSGXPSLPHRGIEKPDIVPNNQGASSDILAAASMLYQNGMAGSDINPGFGQQQFPSMSELNFNHSIANGHGKNQQSSNHISSKQPNSSHTRLPVGFHTSEMLFDVREPISPEQQASAKIRPLHWGSDVSFMEQGYIAPPDQPNEEERTKELLGNLECLEPQSSAANTRAPSPERTAGGYNSHWGESGGPVPLNSLQREYNPDLDDYSQPKKRQRTSIKQEDDEQSDADSTRPRSRRSKSSASGKARRTSNDTIRKPKLQQGAKAPRENLTEEQKRNNHILSEQKRRNLIRQGFDDLCSLVPGLKGGGFSKSAMLTQAADWLEDILRGNEILKAQLAELKTMNGLVMPR

SEQ ID NO: 26301 - protein, 455 aa, A.fumigatus
GTLPMDKGRKILWGHSICVCIGEHPDRLLFGQADGRRTDHATFTFGDPQSPFYTMHTFSTDELSIARAHPMKPHSSVSVMMLKLEDRKRRLPPNDGLVTLLFSRLAAMLAISEAEEVAKQHHLSSTEASKVEGNALKRAAAQESCRLLWNNEKRLYELQHPSHCKQPPPALVGAAGFGAAGIPLSPVRSKYAGILHISVSTPSSDSQSRQPPTIIVTTPLSPNALEAAPQAATPRTSTLPLTDSDEPLASLDLGTMTLSISATAIINTIPSLYAIDSLVAAMLAVAASDETTNPVLADMALYDPKQESHHFSSLSNPAGGGVFTGELVATLAEREDAKESDRLMAKIKSSTFKPGTPTASNSNDKRSFWSWRRPKPAKPKSKSKQIMIEQFDLEKYGRYGSSSSREGQKLPGPTRGILRLLFFGLNIIVKTLTVLVKVVAWLLVSITRCVTSEKF

SEQ ID NO: 26302 - protein, 133 aa, A.fumigatus
SASAPESGTALGSVSAPGSASALGIASAPGSVSAPGSVSAPGSASALGSASTPGSVSAPGSASALGSVSAPGIASALGSAGKPGTFVVALPGVSALAGVSALPSIKYPGRCNSMTLNFHRYTRLPTSLAPIDL

SEQ ID NO: 26303 - protein, 140 aa, A.fumigatus
CYSIASYKSMGAREVGSLVYLWKFNVILLQRPGYLMLGSADTPASADTPGRATTKVPGLPALPSALAIPGALTLPSALALPGALTLPGVLALPSALALPGALTLPGALTLPGALAIPSALALPGALTLPSAVPLSGALAL

SEQ ID NO: 26304 - protein, 88 aa, A.fumigatus
IPRMLNAGLDEWVFSQEQRQVFMTWDCLQDITYAKFSLSFNIYLFIFLFIHFYFIFYSLFFSLFFVVFYFYFYFFFDACVRSTTLHKA

SEQ ID NO: 26305 - protein, 294 aa, A.fumigatus
RGSKCDRVKPCSACCLRGTPSECEYGTSKRDHHYIQQSALIDSLMKTCEDLKKQLAEARALANLPPVKPEEPFSVSSPEDHREKTVDEERSQNPESRASSSLIKQSADPAGRSFAQTTNTPCTTDRSSRSLSDDKRILTDPAVASSFVEVFVERLIDNFSPQPASVYGGTVALREASRMRILSPMLCTAFEAASLTFAGRREQIREVEAVGHARYVRVLRQLQTALNDPKQNKSTEVMVVVLLFTIIEVRGVSPCRIRFPLTSRAGLQAQHQRFPAEAPTRAMMSARPDDSVRI

SEQ ID NO: 26306 - protein, 103 aa, A.fumigatus
ASLRMQLKGHPSNSTQYVLNRPCIFHVRRISSITTLLVLLTYYLGEGLMFHVIHLNVIYLRLYSLPSETDQLYMSHTLPITIQIHTYRILSTLQCTLVLVRCG

SEQ ID NO: 26307 - protein, 267 aa, A.fumigatus
SRNLNPGSAPFWSVIPRFHSGEFKDHSASKDWVVRHPNLEGNGRGIGFPTSSYFDRLPPPSTNPSMIGMSPRPSPIAPYSANATPPLHEMSPNPSTTSLPTQSTGAHPLPQRAPGHGGLQKRVIDKTQISEPTFVSCTSNVPTVGLPPGASLSNGMETPPIPPMNPRRRRQTTTQTIIGALKGEKHESHHPASTVSSPPEEHSTFNDNNNKRPKSKHNKLRKTSSEGGSLNSKARHQAMAAAAAPLPPAPAVPQYAPPNVPIEGGMF

SEQ ID NO: 26308 - protein, 65 aa, A.fumigatus
LGPFRPLPNWGTALLTDSWSLQMWDYQRYTGDPWSDIECRGTLPGTVPCRDGSVYMPGTPDHGVV

SEQ ID NO: 26309 - protein, 164 aa, A.fumigatus
FLTPWLFEHSDSLRRHIHNEHDGLPKPHHGRVSQACRRCRLGKVRCRGGSPCIQCRSKGHRCIFDSPTSAETNYQLVRLCPSLEADETAQVKQYVHLYFARFHPHWPILHRATFSIPNEPPLLLQTVLMIGLWVSGKTSARNAAVDLHSKLGLSIHEQRVRYRP

SEQ ID NO: 26310 - protein, 111 aa, A.fumigatus
NKNHEEITDTFSLKIQGVKWQKYSLHRGRIICNYSLSGINSTLRPPMMGPTCAQMPALRYVIWTLRLNIMINGPKVAVWKLRGNLPHPVEATALLTDAILHDDAQKNSIFL

SEQ ID NO: 26311 - protein, 380 aa, A.fumigatus
HACEYIGPITCAPAKKQSVYLTILRRPYRYFLRSYLTFVICTLGRPGIFNQRDTAEIWAGGDGRSHRERLAAATGGASEASSKQNMLAEMYRPPFDIMSRLPWDLARQEGRENEKWLLVNIQDQSIFDCQVLNRDLWKDPAVKETVKEHFIFLQYSKDDSRATPYLQYYFQASDVSENYPHIAIVDPRTGEQMKVWSGPPVVKPAEFLMQLHEFLDRYSLKHNVRNPVAKRKPEKREKSIDTMTEEEMLEMAMRNSLGDEVAQAHRVMDPDDLTRSTEDVKGKGKAAPTDDVLMDEGDLAEEPVEEASSLFWSIPDNRPHTEPPADPATTTRIQFRHPSGRVIRRFALVDPVRRIYEWLKADPPLPEKAGIEFELNSMGR

SEQ ID NO: 26312 - protein, 244 aa, A.fumigatus
EQDYVKATSPIMHFLTYADNYAIGYFKKQGFTKEITLDKSIWMGYIKDYEGGTIMQCTMLPKIRYLEAGRMLLKQKEAVQAKIRAFSRSHIIHPPPREWKNGPCKIDPLSIPAIKESGWSPDMDELARQPRHGPNYNQLLHLLNDMQNHSAAWPFTQPVNRDEVPDYYEVIKEPMDLSTMEEKHEKDMYPTPQDFIKDAMLIFDNCRKYNNENTPYAKSANKLEKFMWQQIRNIPEWSVSVSLG

SEQ ID NO: 26313 - protein, 80 aa, A.fumigatus
SIMQTMWSFSIILESVCVLPQLLLLRQTTVPTVIDSYYLLALGSYRAFYILNWFVRGFGPEETLGSNRYDIWYRSNCLLR

SEQ ID NO: 26314 - protein, 156 aa, A.fumigatus
EASVLKKHWDPIAMIFGIVQTAFYVDFAWVYYSRQRVKLRNGGVVDSEDYSKSWIVNKVFNIRRRRESLDEEQNLTGEGMEGESGDGGDRPRNNRWGARGISISADDMLDEHTRRKPGDADNEGLEGFLEDEDNSMDDQTGGRSPLHHTSVTSNRD

SEQ ID NO: 26315 - protein, 71 aa, A.fumigatus
GGLISDEATMGGPGTLNGGTPAKDTDGDGIPDEAEKQLGTDPNTNDSMKLHSSGYTYLEVWANSLVPSTYH

SEQ ID NO: 26316 - protein, 382 aa, A.fumigatus
VTFLSFGCCTDHPALAATCPSVRSSPQLQSITTLPDPFSWYPLQKTGRVSTLSDWQCRQSHISSLLQQLELGTKPPAPSSVTSTFSQNKLTITATNAGNTISFTATITYPSSGEGPYPAMIAYGGLSIPLPPGVAAITFDNSQIAQQNDQSSRGQGFFYTLYGANHSAGALMAWAWATSLIIDRLEATPAARINTSRIGVTGCSRNGKGALVAGAFDSRIALTVPQESGTGGSGCWRLAAASEGAPQNVQTAGEIVQENVWFSTAFNAYANDEDRLPFDHHMLAGLIAPRGLLSIDNAGYQWLGPCSSLGCMGTARLVWQAMGVPDRMGYSMLTNHPHCSFPDQQREDLFAFINRFLLGMEVNTTVQKNYAGIFTTGLEGDA

SEQ ID NO: 26317 - protein, 305 aa, A.fumigatus
RQATVFGRRSAHETTASPSRLHHHRRIYLVGELFPLSGWLFQHLFASWCLLPEARFVICSQVQSTLLISAAPQNKKTMTDSIPATFKPALIIHGGAGNIQRSRLPPDLYAQYHASLLSYLRSTKDLLNSGASALDAAVHAVSLLEDDELFNCGRGSVFTSAGTIEMEASVMVTSVNKPTDETPSPIKRGAAVMELRNVRHPIQLARECLLRTGHDANGNPNGDGGNMHSQLGAPYVEELARAWGLEFKPDEWFWTKRRWEEHQRGLKGETEPVSLSQGTVGCVCLDRWGELASSPRGWKEPRHKE

SEQ ID NO: 26318 - protein, 74 aa, A.fumigatus
PVLTNFFSAVIAGFFTGGALAVRGGVKAARNSAIMCAVFLAVIEGVGIGFQRMMADNTKLEVWSLTIALCYDCG

SEQ ID NO: 26319 - protein, 105 aa, A.fumigatus
SDFSAHIDCTIFSFAAGVAGIPQVWRWRRESYCAERGKGKLRCSAADQRMKQQPHHLDCITIEESIWLVNFSLCLVGYFSIYSHRGVYYLKLDSLFAARSNQPFS

SEQ ID NO: 26320 - protein, 87 aa, A.fumigatus
AIGGAVWHGVKGFRNSPYGERRIGAITAIKARAPVLGGNFGVWGGLFSTFDCAIKGIRKKEDPYNASTLTSSFYLTVVAIRHTNDLF

SEQ ID NO: 26321 - protein, 67 aa, A.fumigatus
WFNIAATILYVGTEFPIHVLYYYVSLFSGVGAGHFIFNEAWHRGFLLSYCASSPTFGLALSTGICQR

SEQ ID NO: 26322 - protein, 248 aa, A.fumigatus
IRYLQPGPINPSHKRRPAKQENNDRLHPSDFQACPHYPRRRRQYSALEAASGPLRSVPCLPPLLPPLDERSPQQRRQRPRRSRPRRLIAGRRRALQLRTRQRVHLSRDNRNGGLRDGHIRQQTHRRDAISHQTRRSRDGAKKRPAPDPARQGMSPPNRPRRQRQPERRRREHALAARGAVRGGTRSCVGAGVQTGRVVLDQKAVGGTSARAKGGDGARFLEPGDGRVCVSRSVGGTGVFTTGLEGAAP

SEQ ID NO: 26323 - protein, 126 aa, A.fumigatus
NHTSLPLERAKQCFSLHAPSQYERVARTGEMSVNPTSFRQVLYSSMVDRCGSAVMLLAHPHTVGDHLTPGPTYHLISLIDFQNNQTSTAHNSTNITLIKVALEVIKLLELGELINYTFFINKYSVS

SEQ ID NO: 26324 - protein, 82 aa, A.fumigatus
FCYPGIRIVALLPSPFHFSCRNGSLTHYSPITGYSMTDTGNCGKIFVQETEATKRTSPLLFFFFKKKLFIHFLFHFPLKTNL

SEQ ID NO: 26325 - protein, 98 aa, A.fumigatus
ATGINYSSWALVNFAFNHVIKRRFFAWWTKYNYVLAAALDTGLALSGIVIFFCISYPGAVFPDWWGNTVYLNTADGQGVAWKPMPDVGYFGPPNGTWT

SEQ ID NO: 26326 - protein, 622 aa, A.fumigatus
  UNSURE (365): Identity of amino acid sequences at the above locations are unknown.
RSVVFCAMNTRFSYSFQSCVVRAVVPETDDPHMPVNTLRMWMLGVVFTILGSGINQFFSLRYPSVHIVSLVAELLAYPCGVFLARILPVMTVRCGPFGSFCLNPDRHFNIKEHAIIVIMSNVSFGYGSADSTNIIQASSSNFYNFGLKAGFSVLVVICAQLLGFGIAGLAAPWLVEPASIIWPGVLSNCAMLESLHSRVNPIANGWKISRLRFFLYVTATGFLWYFFPGLIFTALSYFTWICWIAPKNVIVNQLFGMQTGLGLSPITFDWSQVAYNTNPLLSPSWAAVNVFAGFAIFFWGVVPALYYTNTWYTAYLPMMTADVYDRTGAVYDTARVVSSQHTLDIDAYKQYSPPYLGATFAFVYXLSFASITSVLTHIAVWHKSDIWAALKGQNNLYIHARLMKSYRKTPWYWYAAVIVIVTAIAIVLVVVYETKLPVYGVFLALIIPALYMVPCGIVQGITNVDANQLNVLSEFIGGYMFEGKPLTNMLFKILSTDVVVQGVYFAMDMKLGHYLKIPPRLLFGAQGTATILWALTQAGVTLWMLGNIDGICTEDQPYGFSCPNGRTVYSSSVIWSLVGPRSLYSRGRMYSPLSHFIWIGALAPVVTYFLYKYTKTQHLSRP

SEQ ID NO: 26327 - protein, 67 aa, A.fumigatus
STTLGMASKEQTQDHNVKTIHAGDHPEVEIGRLDELEVDLDSALEEHEYDYESEHSPFSEGLLSFAP

SEQ ID NO: 26328 - protein, 66 aa, A.fumigatus
MQPVTTSIGLFSVFPFIGGDIVRHPLYEQCTFNLYSPQLIGQNLQNSPFKQANASLGPGYGVDQLA

SEQ ID NO: 26329 - protein, 229 aa, A.fumigatus
  UNSURE (6): Identity of amino acid sequences at the above locations are unknown.
EVRTKXFGQISLNLTEDLSRFEDYTDDGRGDIPKDGYVSSLDRRRARMANLMYAFFLLAGAGGVAYLGRNWETEEEAKAHPDIPSGWSFSSWYNRMKARLSDITSYYKDPAFPKLLPDEDPNLRQPYTLVLSLEDLLVHSEWSREHGWRIAKRPGVDYFLRYLNQYYELVLFTSVPSMMADQVLRKLDPYRIIRWPLFREATRYKDGEYIKVGQDSSDPAFRQNSLKYL

SEQ ID NO: 26330 - protein, 194 aa, A.fumigatus
DLSYLNRDLSKVILIDTKEEHARLQPENAIILDKWLGDPKDKNLVALIPFLEYIAGMGVEDVRPVLKSFEGTSIPVEFAKRERIMREKFEKELEEERKRRPKRGVGSLASALGLKSTRTLDGEQSPSEGLAQGKMLWDQIRERGQKNYEMIEKEIRENGEKWLAEMAAEEEKARQEQMKMMKGSFTSMFGAGKQ

SEQ ID NO: 26331 - protein, 84 aa, A.fumigatus
NDLIVRGICLGGGLQSLDRGFLRAFIALSFGRVLFGLVLRAATSFLLFAWHSGHKGSTRFSNNMLYSSFWFFWFDFLSAQEILR

SEQ ID NO: 26332 - protein, 389 aa, A.fumigatus
NFLSGEKVKPKKPKRTIQHIVRKTGRSLVSTMPREKQKRGRRAEDKAKKDAAKRKRDEGPEESAVKRLKPSAETNTSNNEIISGADYIPLGQDDGGNDVPMNDAPANDMPFYGLLDSEEQEYFSKANEVLELNQFHDAEERRLFVDSVYREADGKELKVACSQSCSRLMEKLISLSDMRQIRRLFSKFIGHFLHLVQHRFASHCCETLFINAAPGVTEKISKSKGRKAEVDEEDEPEPELSLAEMFMKVVEELEGNWGYLLTERFASHTIRVLLFVLAGEPVDLSSTDSVVASRKKERLGIVNTEAPEEKAAAEKRKVPEVFEATLKKVMNDMVSGLDNTYLRALATHPVGNPVLQVLVFLELSHFGKASAKDPNSIIIFNTRGDLSMG

SEQ ID NO: 26333 - protein, 120 aa, A.fumigatus
TAPSTSPKWTPQAAAAPSTPLVQPTAQATATRSASTPVPGSTARPTPSAQVPAARRWTSGRPTRAPQFSPRTRAPQPACTRAPAPNATPSATGMAAPTTPTSSAQRITMATVSPLTPPSR

SEQ ID NO: 26334 - protein, 333 aa, A.fumigatus
  UNSURE (5): Identity of amino acid sequences at the above locations are unknown.
PSLCXDKVTCSQNCVVEGITDYSSFGVQNSGDAITLRQYQVQNGQIKTLRPRVYLLAEDGINYSKLQLLNQEFTFDVDASKLPCGMNGALYLSEMDASGGRSALNPAGATYGTGYCDAQCFNPGPWINGEANTLGAGACCQEMDLWEANSRSTIFSPHPCTTAGLYACTGAECYSICDGYGCTYNPYELGATDYYGYGLTVDTAKPITVVTQFVTADNTATGTLAEIRRLYVQEGMVIGNSAVAMTEAFCSSSRTFEALGGLQRMGEALGRGMVPVFSIWDDPSLWMHWLDSDGAGPCGSTEGDPAFIQANYPNTAVTFSKVRWGDIDSTYSV

SEQ ID NO: 26335 - protein, 66 aa, A.fumigatus
TQAPCPSPEPRPYAATHPAPRTSSTTSRKPPSWRRPNCRSPYPPARTACGSRPEFLSRCYRPSRTA

SEQ ID NO: 26336 - protein, 127 aa, A.fumigatus
FDKYIARSRWKRNRIRDCDAASKQFWSCMFLFRAFYFAECTLPETFPCFFHKPYSSTSMAGTEFGEGYAGVITSLGVRCQILTHNVPDANILSLVEAKITSVDLARMLVIMEATRVVKHFERVGEWC

SEQ ID NO: 26337 - protein, 148 aa, A.fumigatus
  UNSURE (85): Identity of amino acid sequences at the above locations are unknown.
LIRRRVTSALSNYISIYLSIYIYILLSPHPVLGVILYMTHFSSLSPPDRDRHRDRHAGHPTHHSLRQGRPQSPARGHHPRRTGSXAQDHRGASLQVKEPDYVAINPNGRIPAIYDPNTDLTLGGSGAIVEYLVSTTNPTTGSLSRRAS

SEQ ID NO: 26338 - protein, 94 aa, A.fumigatus
  UNSURE (47): Identity of amino acid sequences at the above locations are unknown.
HISHLCPHQTETDTETDMPDIQPITVYGKGGPNPPRVAIILAELDLXHKIIEVPLSKSRSPTMSPSIPTGASPPSTIPTPTSRWGDPAPSSNTS

SEQ ID NO: 26339 - protein, 273 aa, A.fumigatus
LVQIVLHSSDMPYAVLGATGNCGTALIQNLLQSSTSKVHAYCRDRRKLLYLLPHLADNKQVDIFDGSIHDLPLITECVRNCHAVFLVISTNDNVPQCRMALDTATAVIQALRILHGEGASMPKLVLLSSATLDDQLSQNTAPWVRWILLKSASQVYQDLSQAEAFLRQQQDWISTIFIKPGGLSVDVQRGHRLSLTEEKSPLSYLDLAAAMIEAADDPDGRYDLRNVGVAYTDGPARFPRGAPMCIFMGLVRHFLPFLHPYLPATGPNQGFLC

SEQ ID NO: 26340 - protein, 307 aa, A.fumigatus
PAVSGHITNHLDLVYLSSLLEVEMASYRRIENYIQELPQEVSSPNLDACAVEHWPTRGLISIKNFGASYALDEKEVLKGVNYRANAGQRTAIVGRTGSGKTSLALSLLRLTTRTRGSISIDGVDIEAVPVEKLRQSISFIPQDPTLLDGTIRFNLDFNGEYAEGYLQSILDDVAGTRKWKLDDTVELNGRNFSQGERQLITFARVMVSKHKILIIDEGTASLDKSSEDRIMAVLRDRFSECTVIAISHRLHSIIDFDQVLVIGDGQVLEAGNPRQLLGGENVFKALYLQQCGTDAVVSGNLSGIRQS

SEQ ID NO: 26341 - protein, 178 aa, A.fumigatus
  UNSURE (112): Identity of amino acid sequences at the above locations are unknown.
GPGTRIFHPVVKTRKIESLHHWNSWYTKDVVKMTTVAAAAGRKSVLRRWVFDQEEYVNNSTGKSVRTFWVMTNGYSLVKYTYDENTPDDAINFDHTEKTWEEDPRGYEGRLXPLRLKDQAGVTKDRWLLREAYVVGDNVHQWYVREEDEGHSVIEIVWLGPKGGGGAGVHDYAVRKQH

SEQ ID NO: 26342 - protein, 106 aa, A.fumigatus
LVWRCVVAAAENGALKIGIKWVFRKEHIPFKVLDWFWLSICLFWGTFTLDLTCYPGRVFLPLLLHTPTRDFLLYMCLVKIEFQAELVSLLLEISVEHLSLCRNIMT

SEQ ID NO: 26343 - protein, 65 aa, A.fumigatus
YIDTVDADTKPGDLLIKYSRRPEMASVFNYASMAHNNHFFFNCLVSTSQRRGPLSDRPRLICLLQ

SEQ ID NO: 26344 - protein, 99 aa, A.fumigatus
SPTPTQIPDKFAKDIIDTCSSVESLKLDFLATANAMFGPGFVWLAKNLEREGLMHIFCTYNAGSPYPAAHSRRQPVDMATHSPDAPLGNMYAGSMVPTP

SEQ ID NO: 26345 - protein, 74 aa, A.fumigatus
KPVAALPRFQTRQLHRVPQLTHDAYFKANGIPELLSPEAFDFAWTQYQTLLIDKLNLLTQGETFRKTFIFIALG

SEQ ID NO: 26346 - protein, 186 aa, A.fumigatus
  UNSURE (70): Identity of amino acid sequences at the above locations are unknown.
YYREIIPDSVSTPRYLSRRGCPTFNQTHTTATMPPFISSLALRTLRTLVQRHSLIAIPAVSRPILSRFQXVFRTPTAITAARAAGAGPITRHFSTSPFRQATYNQVRRGCRVSQRARRSRSPALVGRAQMKGVCLKTGITKPKKPNSGERKTARVRLSSGKVVTAYIPGEGGTLPSVNCQRDRRLC

SEQ ID NO: 26347 - protein, 221 aa, A.fumigatus
  UNSURE (24),(26),(49): Identity of amino acid sequences at the above locations are unknown.
SSLQFLEQPSLTHSQSLRIAPPAXYXTQASNTTTRNPTARPSKGAPSAXGLPDTLRDKITLPAPVGPPFSNQTAVPSSTHPLEARLLAWRQTQDAMKMETLRRAYGIAEPVRRGMELKIVRDGTFRPAVLGGNKGGNVHEDILVLGGRDTEIDWEDIFQGWLNVCIPAAGMTRLILLIQETSSGNHLPSMTRWRKDSGWSSDWGVSLFCLLLNFRMSRYVF

SEQ ID NO: 26348 - protein, 76 aa, A.fumigatus
  UNSURE (5),(7),(30): Identity of amino acid sequences at the above locations are unknown.
HPQQXMXPRPPTQPPETPPLVHQKAPHPLXVSPTPSATKSPSQHRWDPPLATKPPSPHRHTPLKPACSPGVRLRMP

SEQ ID NO: 26349 - protein, 68 aa, A.fumigatus
  UNSURE (67),(68): Identity of amino acid sequences at the above locations are unknown.
TKNLHYYKSLNLSLSAFNPPFHHHRRRNGRSCSFNRHDQYYIIKLAIPRTAVTNALTVSPHSTPSKXX

SEQ ID NO: 26350 - protein, 85 aa, A.fumigatus
DSTNRCFSDIIQNLLSSSLEQSGDKFYIRHAPMSSQEGNPETHCPNVKACANIYQPMLKLFSWLLGAFNGWIAVQSRTQGVLVFF

SEQ ID NO: 26351 - protein, 63 aa, A.fumigatus
LAPEIKQYVVEYLSTSGAFQHCQEFLMQLENSIVTEIDRIEKVTNEANPMLRLLLEKLSVKEN

SEQ ID NO: 26352 - protein, 96 aa, A.fumigatus
SVVIRMFICSVRLQTCLIETESMTANNMRNSKKLHMAAIAFSCWGRFNQGRRLMPAYGATEMPDLKNAFHDSSNNLVDITTCFYLLSFCSPGNPPD

SEQ ID NO: 26353 - protein, 74 aa, A.fumigatus
  UNSURE (53),(57): Identity of amino acid sequences at the above locations are unknown.
RLSKRRIRKYGTEVTGRIRMFIMPAKVQRKNLSEGTFEVEFHQDLERYVQFPXPNSXVAENVCKAGQSGPQATL

SEQ ID NO: 26354 - protein, 402 aa, A.fumigatus
RHALAVQEKLKNHYIPEITSIQYEGNFVEPPRPVPWYPDQLAWWMTTPKNVVRRFKPFASFQKFLVAETDVGNITRQEVVSMIPPLLIDVRPGMTVLDMCAAPGSKSAQLMELLHAGEEDAMRQVAQQVKEGKAGPEPMGPEGLDDDGRTTGLLIANDSDFKRAHMLVHQMKRLSSPNLIVTNHDATMYPSIRLPPLPEQDGKPQKNRYLKFDRILADVPCTGDGTARKNISVWREWGPANALGLHATQVRILVRALQMLKVGGRVVYSTCSMNPVENEAVVASAISRCGGSANVEILDCSNELPGLKRAAGVRTWKVMDREGRMYNSWKEVEEQREREGINGLGRIGEGMFPPTGENADLPLERCIRVYPHLQDTGGLFITVLEKKSESSRRGTKHTRRGN

SEQ ID NO: 26355 - protein, 106 aa, A.fumigatus
HTLWQGGRGGGARGQRQNYADIPKTNEKLERFYTEQGFIPEEEREAFWEALRRDLPNSFRFTGSKGYVMAGRHLPAALNSDILKTRPCCPGKAQESLYSRNHLNPV

SEQ ID NO: 26356 - protein, 372 aa, A.fumigatus
PGSSMSVSSESQSTSPHTYEAVSPVDIVRGHNHFPMTASSQPGGARTERSSSESSVSSSLRSPRTARFAEATSVHSPTEPRGASTSPFADPPGHSQSQPDVSDVGFGYVAASDPAQHASHQLPPASPLKSALKVPGTPGRTLNPLSPTFREEFFVEKQEKATEKENARDLVSGPRESANYSRTLMLTHCSQRIKLRVRLAKIFLRFVNFSCSLIVLTILATTLTIFHATIHLPPRNDLPPWAKGTNPWPQYLFLSLARISLFSSLVVFWAYRKGGHRRAEKVAVYYTVFSVCFFTFSVIMWIVAAAIYQNSKANGNGQDVWGWSSKQNLREQLFHNDIDYALLCRLQVSRVLLPSSLRPGFHHGPRRIRTKR

SEQ ID NO: 26357 - protein, 125 aa, A.fumigatus
SWKQSNEMFDGFTYFAINDQGTDRQMVRASYFTVVRQIARMPGSFAVLLSDTLESVAPNFVQPVFQLFNVAVAQCAGKLFPQRLTSFKLMKNPTTASTPSGRIVVAFVRSARHFSPHLDPSAVFT

SEQ ID NO: 26358 - protein, 459 aa, A.fumigatus
RSSLLPLEAKLKLKQLQKSRARSNSLESNNIQSRPTSAVSFSSRSQEQASRLRSPIHTTRRHEPDDVHVPLSPVRRAAPPIEPASPRRYLLGFDKGLKSSDVSLKRPPNSRLGTRPSSMHGALEAAMSHSGDIFASRAQMLAAEESGKRGKTFSERIAESRTAEKSRRERELRLQINRSSAFQFDKTEMETFRTAAAEARTNAPPRSPTRSRLIETFSRDDVVRSFQNLKPSIKRSQTAPSVRKDAGSEGPRPFSHRRPNQSETGPASSQSRGDPVSDIDNEIRDEVTTKTPDSSKFEPYSSLHLSNRILPHSFLTRTLSDKKILRIPDLLRTVRGPDFELPEEIDGDYVVFGIVASKSEPKQIKDAKNVSAKEVDPFDDGLNNSNRYMAITLTDLKWTIDLFLFDTAFPRYYRLSEGILIAILNPTIMPPPKNKIDTNRFSLSISSSDSSSREWKLPV

SEQ ID NO: 26359 - protein, 203 aa, A.fumigatus
LAFAPISRISDNGEHHLYPWRYVRFHLCLTMGVAALLYAKKPPQYTLSSMDLVKDVSLLMATYLVGLFASLLLYRTLFHPLRQIRGPWAAKISSFWLSFRLRRGPSFRILHELHEEYGPVVRVGPSEVSIIHPEAVRMIYGPNSRCSKNTFYDNGHPMMSLHSYRDRIAHDQRRRVWSAGFGDRALRGYEQRMRVYRQKLFVF

SEQ ID NO: 26360 - protein, 107 aa, A.fumigatus
YVGFISLSLALNVLTAARACSVGWIDPEHTAPPIHFFEGDQGDSAIGVYSVQYTATDRVAWSGIPGTEKCPFEGLCNPQYIFYHNGYQIVLNTWREFRERFLDSMAL

SEQ ID NO: 26361 - protein, 79 aa, A.fumigatus
VVPECIQVVHVVADGNSTQNYRERDLLHRVFTEKRVGIYVGVDPTAPSLHVGHMLPFMVLAWGYVWGLPVTYLVGPASP

SEQ ID NO: 26362 - protein, 109 aa, A.fumigatus
RLNRVDIIADKQQLGGVTSRIGDPTGRLKGREAMDSSVRKANMASMHMQLKKLGASVEQYGRKHGYHKEKIWRRALVNNNTWWNSTSLLEVLRDLGAHTRLGPMLGRET

SEQ ID NO: 26363 - protein, 173 aa, A.fumigatus
TTTHGGIRHRYWKCYGTSAPIRGLVPCLVERRESITLFHSVGHTITDLDDYSVKNRMTKGDGMSFAEFTYPLLQAWDWWVLFRKGVQVQVGGSDQYGNILFGMDAVKSISKNTAIEQDRNPLEDDLDKPIGFTTPLLTAANGEKFGKSAGNAVWLDKDMTSTFELYQVSQSSS

SEQ ID NO: 26364 - protein, 317 aa, A.fumigatus
IQSRVPPIKAENGQKKPPAVSFIALQLEQDAIRPKRGMYEGTDAEIHRVEGGKDDATVAKRGEDFEEVDETFSYLRRPEPGQGDKEQRFIRWSQSTEIGDFIRDAARAKEFIVTIEGAPAGLEQIHVAVPSFDERTYFLRMRLRKISGRIQGLAEIKHECDALAHRGAQRVALGGFGILAFWWYIVYKLTFETDLGWDTMEPVTYLVSLSTLMGGYLWFLYHNREISYRSALDFTINARQKKLYQMKGIDLQVWESLIDEANAIRREIKNIAAEYDVDWDERKDEQDDRVTEALKKERRLKNGSQKEERPNDDRDDD

SEQ ID NO: 26365 - protein, 151 aa, A.fumigatus
  UNSURE (28): Identity of amino acid sequences at the above locations are unknown.
LLKQAVAADSAIGTSLWMTVESCPADNXQVLLSEILDEFEWQFGFKILRSGPSETKKEGEKKEPAQNANKGSMQNANPSKQGIEKDYDLITKAREVLKSKETNRIGIKDVAEAWNLADTELWRFVRAYRYVLPCPLHPMPRRQFIDKVHYE

SEQ ID NO: 26366 - protein, 79 aa, A.fumigatus
RARRPTGLASKTWLKLGTWRTLNSGASSELTGTCFHAPYTQCLGDSSLTKFTTNRARSVVERKKWEAEEKDFVGAKVRE

SEQ ID NO: 26367 - protein, 92 aa, A.fumigatus
APVDIPMAPGSLTAPVVEEQPSKAVSLAQLTEDWDDTIRFYLNGTKVILDNVDPELTLLEYLRGIGLTGTKLGCAEGGCGACTVVSQDDIDI

SEQ ID NO: 26368 - protein, 81 aa, A.fumigatus
AYLCDRNSYFLQVVSHINPTTKKVYHASVNACLAPVISVDGKHVITVEGIGNVKKPHAVQQRLAIGNGSQCGFCTPGIVMV

SEQ ID NO: 26369 - protein, 77 aa, A.fumigatus
PYFAASYATRNTVSAMKAANSVVLHKSRTTHSYRGVVWEQLRNIRAPLEPKLSSNIDVSYYPIDEIPEEDTNAIHRA

SEQ ID NO: 26370 - protein, 176 aa, A.fumigatus
CLSLPSNSSAELDKMIRDPSISKEKKRQEAEIAARKESTFLRFLRTKETPANFQTIKIIGKGAFGEVKLVQRKTDGKIYALKSLIKTEMFKKDQLAHVRAERDILADSKDNPWLVKLHASFQDSAYLYLLMEFLPGGDLMTMLIKYEIFSEDITRFYMAEIVMAIEAVHKLGFLHR

SEQ ID NO: 26371 - protein, 181 aa, A.fumigatus
SYTDTNSAAFSDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRDSESLIRRYVPVPVCSFVT

SEQ ID NO: 26372 - protein, 210 aa, A.fumigatus
SFALIVVHFPSTSIRSLWYHDSPLNALFNCNIFSMPVFTEYAASSRELRVLPSFAPPLPRLSPRFTRPEGIEKYEVVIVGAGPAGLMLHLLLARYGLNDDSLLCIDAKPGTLKSGQADGLQPRTLEVLKSLGLADEILTDGCHMEEVAFWNPSPDKEKVIERTSIVPDVAVPARFQHEVTIHQGRIERILETDLLRYSKRGVQRNTKLVD

SEQ ID NO: 26373 - protein, 72 aa, A.fumigatus
SPSDRLIVSLVDTVIADSGSSVGHSLDTTVNFTSITPRSYASEVCFTRMTTFKTNPAQEKLNPLRSNISRTI

SEQ ID NO: 26374 - protein, 178 aa, A.fumigatus
VALKRLLRSYEVPPTSTPSRIPPTQTSDNDRLRIAHSLCLLVFLHIRAQQSILNESFFQTLEKMKLNSLISFLCIAASALCTSSDPNKYEKYKSVSPVAPIGLTDVTYHDLTSKPRDFHVAVLLTATDARYGCALCREFQSEWDLIARSWNKGSKSDDLKLLLATLDFSNGKETFQKV

SEQ ID NO: 26375 - protein, 143 aa, A.fumigatus
KMFSPLSADQLYTWISRHLPEGAKPPLIRPINYMRIISAITLLMGVITLFTVLSPYALPIIRNRNLWAGFSLIAILLFTSGHMFNHIRKVPYVVGDGKGGISYFAGGFSNQFGMETQIVAAICKSFTFRSLHHRGRGTRKVRR

SEQ ID NO: 26376 - protein, 62 aa, A.fumigatus
  UNSURE (3): Identity of amino acid sequences at the above locations are unknown.
CYXHTSKEGTDHAKNKACIYRPKDGTDVFDVSLVLCSDPCKLFIKKITGVLFFSNTMVLSER

SEQ ID NO: 26377 - protein, 67 aa, A.fumigatus
SWTQIPYRQERVLRHTDQLVRRTVWDPNSENHSVPTNSVGTLYPPSTKFKHPPAPILCVFWFGISLN

SEQ ID NO: 26378 - protein, 61 aa, A.fumigatus
DVRFNFMQQTWFQVTLRYLSLTLLSKGFFHSNFSSRAYIHGHSSLDESAAFYTKAKLTMSR

SEQ ID NO: 26379 - protein, 72 aa, A.fumigatus
HESVVLQVLRYSALVAGLIYGVYHQNSITAQAKQAEADREYARQERLIQQAKAEWKKKTAPKDTKAESGGRF

SEQ ID NO: 26380 - protein, 76 aa, A.fumigatus
FSVVLLTYRPSSETCTYPGVAVYLYTIVGPEEQEMCGLSGFAAHLLSPGTINYFVQVVCDVASRLHRPGLAGHALR

SEQ ID NO: 26381 - protein, 138 aa, A.fumigatus
FDVASRFNIVKSGNMTETVFNKERHIKYYLRCLKTFLPHQYTSNDSNRMLLAFFTISGLDILGALDSKITAEERKGFIDWLYHCQVPSGGFRGFTGTDFGIDKRTPENEAWDPANVPATFWAAGSATSYSRPAGRKRA

SEQ ID NO: 26382 - protein, 163 aa, A.fumigatus
SQDLGIGTVLKGILDLSEPDTTTMVNNPSDPVGLDWGKLHWSIKPPNSGQEYAKGCQILYTQRVILTGHLRQITVSSINMEDTVHITGLKLSFDDGTNTQLGYRSQDNSSTDVVAFGGFVVAVGTTGIHGLQIIDNRSDSTKWFGSNRRCLHRGAGRSRSKGE

SEQ ID NO: 26383 - protein, 66 aa, A.fumigatus
  UNSURE (4),(50): Identity of amino acid sequences at the above locations are unknown.
VYLXRRFMQTRLPISFKKYLVAINLVNQSPLESTLSSLPMFMVLVSFIEXNPPAGRAVPRNQIPRT

SEQ ID NO: 26384 - protein, 322 aa, A.fumigatus
SSEAAVMTSSMSPLPSAIPRTIPRPNDLQSSQRQTTSSRVSPKPEPELPRPKFRLHLNDLRHPATLSFISLVPDVASTLDTALKAIVRHLYTPPSLSPNESSNAPARKCPRPSFTPCIPPTRSVTVLVRDISGVAYTTGIELDDDHKEIHLSLSYVKTSAENNPDPAAEITGVLTHELVHCYQHTTPNGDESASVPRPPGGLIEGIADFVRLKAGLEPPHWKRPTSAKERPSKWDQGYQHTAYFLAWLEDVRVGKGAVGMLNDRLLRVGYVGEDSESENQDTQSFWRGLFGKGISELWEEYGEYLDRSRNSGNWEDEIINPE

SEQ ID NO: 26385 - protein, 102 aa, A.fumigatus
CKSIDIMFLSRRKSNHQVTAGRGDSCHPMLPYLAQGANSSMEDGAALGTILKSVTRKEQLPNALHTFEKLRKLRSEAIARETFKQVCTIVFYHGGWPDPRLG

SEQ ID NO: 26386 - protein, 245 aa, A.fumigatus
VGAGLQVTPNGSRLLRIWDLPQTLWDQAAEPTQLTVHRYSGAVLAREVDFDKNIRRKYGVPFVDLHRGDLQQGLYQRAQQLGVKFHLNARVQSVDPAVPSLTTLSGHQYHADLIVGADGLWSRTRECFLGTADPPKPTGDLAYRIVLSLDQIKQSPLRDWVSHPEVHFWIGPRSHAVGYSLKAGKMYNLVLLVPDDLPPGVTKQPGNVEEMKLLFEGWDPVYAEFDLPLCLPTFMTDSIQGSLNF

SEQ ID NO: 26387 - protein, 150 aa, A.fumigatus
  UNSURE (94): Identity of amino acid sequences at the above locations are unknown.
RRCGMSKKLHATGEKAPPAAGGVSVAFKQVFFSYPARPESPVLHGLDLSIQRGQFAALVGPSGAGKSTIVSLVERLYAPTAETVAIDGHDIAYXDTSFRSAIAYGPQQSVLFNGTIPIQPDPSGRDPGKQVFQERTSGKRCKASQHPRHE

SEQ ID NO: 26388 - protein, 311 aa, A.fumigatus
EQGTHRDIMDARGENAELVSMQNLNINGSEEGNSTAAASSKCSTEEISEKAGALETSTVADVPHADTREPADEVVEGERTFSATAQSMGALLRPYSFVLVIATVGAIVIGGTYCGSALIFGNVVSKLSYCEEPGSIRHAGELFGLLFFILAIVEFTANFSSWSLFGWVAEQVVYKVRVLSLRSILEQDLAWHESQGRNPSLLLGLITKDSTALGGLTGSVICTLLSILVSLVATITMTHIIAWKIAIVCLSVVPLLLGAGYMRVTTLARFEEEHLEAFANSNAITVEAVKSIKNGDGAFTGTRKILDHTRR

SEQ ID NO: 26389 - protein, 159 aa, A.fumigatus
PALKRNIWKRSQTPTPSPSKPSNPSKTVMALLLEHEKSWTIPVVNFKKPMRQITKHSAWANLWLAVGYGLSNFLYALAYWWGSTRIMAGEYTPTQFFIVQLALLVSSQLWGQAFALAPDVSRAFSATRRLLNMLDMGSTKKLSAPLTPVWDVEEATRNW

SEQ ID NO: 26390 - protein, 289 aa, A.fumigatus
TKKIKCDETPPYCNQCTRRGYDCPGYSRPLKWSSKYEVANTELGSKSNARRKRLDCSDSDDKVLRLEVMLSHNKRQTEMQRDVFAAEEHTSYAAGKEQSSGDTVQSHLQEDDLEPNLALPIFSNVEFNDLHLDVTSSLEHELDASTSVTMLWNDSFTPTLITFEDRNTSLLRHYFSVICHINCAFDSEKNPFRVCVSDMMKGCPLIYHCVLSMSAAHLATQVLEVSSEALEHRTKALSCLQAQIAKMGKGKGPSDDYASSLNLGALFGSILLGMTDVRLARASYLLNRS

SEQ ID NO: 26391 - protein, 77 aa, A.fumigatus
TEGPLGFYKGLSQNLLKLTPPVSINYLVFENPNTKLGIEITTLIPRSKKSFFLFCLSLLIFSLLEICVRIPIKPQLP

SEQ ID NO: 26392 - protein, 149 aa, A.fumigatus
LTRLSRMQCDTVEGGLKGNQLIAATARKVWNKAGFLGFFRGLPLGLVGMFPYAAIDLSTFEYLKRALLARQARINHCHEEDVPLNNFTTGAIGALSGGFSASVVYPLNVLRTRLQAQGTVLHPTTYTGITDVAPKTLLNRRPPGLLQGP

SEQ ID NO: 26393 - protein, 333 aa, A.fumigatus
TRHRPDTHIPTILFDIDEVFTIPPSKVYSTSMEQTAGEDQGVVLCGLVRYGSISVGDELLVGPLRATPQAEPENFLSAPRSQSSRSRPPSEEFSTSFSQGFLSGKATFPAQAIWQRVRVVSVRNLRLPVRTLIQDQVGTIGIELLSTQNEHTPRLGKVRKGAVLADFGPSGSPAKPSLFHTGFVASFPASEFTSMSPPLLLGGNAIAYVSNIRATVKATCVTLAEDEIISSPPSPTEPDFFSFDSDAVDRVKEHVSEVTNVVNSAKNASHGDVKISFSFVTSVEWVESGSRVLVIPGSSTVLSSTQGSAPPFGLGGFVGRVCNVMSSELQESR

SEQ ID NO: 26394 - protein, 135 aa, A.fumigatus
EPLKLPLMSSGSAFQPPIEIPTRKSSAGMADRLHTSSSVMDGSQLQGEGPQTNMDSSRRHTRNRSSFDGTKYRDGKWSQEYEKILMGPYDYMQQHPGKDIRRQLITAFNVWLQVRPESLSIITKVVGMLHTASLL

SEQ ID NO: 26395 - protein, 265 aa, A.fumigatus
FTFPARVDDVEDNSILRRGIPVAHNIFGTAQTINSANYVYFLALQEVQKLNNPTAIDIFVQELLSLHRGQGMDLFWRDTLTCPTEEDYLDMVGNKTGGLFRLAIKLMQAESTTGIDCVSLVNVMGLIFQICDDYLNLSNKTYTQNKGLCEDLTEGKFSFPIIHSIRSNPRNHQLISILKQRTKDEEVKLYAISYMESTGSFAYTRKVVREFRDKALSLIDEIDAQCDGKQAEGQKDGAMVRAILDKITESTLRDDNGADDAGGGK

SEQ ID NO: 26396 - protein, 116 aa, A.fumigatus
GGEDIKRLSSGLRLPSSTKSLNSSTLVALTFFPLSVLRTILLILFQISMYQKSLLFSLLASSALAAQFPIPDSKGSVTFDEPYEIAAGETYDGGYKTYGRGVSCTVFTTGLEGAAP

SEQ ID NO: 26397 - protein, 139 aa, A.fumigatus
TGPVRQSLTSVDYYTWTRDAALVTKVLVDLFRNGNLGLQKVITEYVNSQAYLQTVSNPSGGLASGGLAEPKYNVDMTAFTGAWGRPQRDGPALRATALIDFGNWLIVCSPYEPQEALLTSTGQRLVFTTGLEGCATSEF

SEQ ID NO: 26398 - protein, 165 aa, A.fumigatus
ECYEDSPAEHTKNSLTGNTFETHDDDGDKTWAVNIYKKRDHTPKLPLASGFRTINLIPSPSSSFRLLLCLQTVCNRAMPRLSYALCALSLGHAAIAAPQLSARATGSLDSWLGTETTVALNGILANIGADGAYAKSAKPGIIIASPSTSEPDCENLPELALSGSH

SEQ ID NO: 26399 - protein, 105 aa, A.fumigatus
RHPNTLEDGTTSGALTRYFISSTLPPASDISVHFHSSPYTISSLFNQHFMMATDIATRELRKPVDVAEYLFRRLHEVGIRSVHGVPGERSSSPRGGRIRGSGNSM

SEQ ID NO: 26400 - protein, 79 aa, A.fumigatus
FSGIFGYINYLVERDRKYIIDTLLNGMGFPPFALIAILQYEMQDSPDLNTAVTTRQALRWTVTKRMKFAPSRKLVRSRN

SEQ ID NO: 26401 - protein, 80 aa, A.fumigatus
NAGLSRLEYRGYDSAGFAVDGDKKNEVCAFKEVGKVAKLKELIEESKPDMTKTFESHAGIAHTRWATHGTPSRQNCHPHR

SEQ ID NO: 26402 - protein, 257 aa, A.fumigatus
VHQWSQQVIWHSTGNYNSDTFTELTHILSDRSDPNWEFAVVHNGIITNYKELKALLESKGFRFETETDTECIAKLAKYLYDQQPDIEFTVLAKAVVKELAGAFGLLIKSVHYPHEVIAARKGSPLVIGVRTSKKMKVDFVDVEYSEDGPLPAEQASQNVAIKKSATGLLAPPDKSLLHRSQSRAFLSDDGIPQPAEFFLSSDPSAIVEHTKKVLYLEDDDIAHVHEGQLNIHRLTKDDGTSNVRAIQTIELELQEIM

SEQ ID NO: 26403 - protein, 95 aa, A.fumigatus
  UNSURE (91): Identity of amino acid sequences at the above locations are unknown.
GKFDHFMQKEIFEQPESVVNTMRGRLDVANKQVTLGGLRQYISTIRRCRRIIFIACGNSYHSCMGVRGVFEELTEIPISVELASDFLGRAXRWFS

SEQ ID NO: 26404 - protein, 98 aa, A.fumigatus
TFTIVSAFHLYATQDTLEKRAMQNPMTFDEGTKCLKSFRDGMVRYYQELGDLLTLDSFKVVFDPGTYTTTTFKNMNGFTGWPLTRVEAQTNSRFLPAK

SEQ ID NO: 26405 - protein, 478 aa, A.fumigatus
CGAAPSSPVVKTGEMSKPTSNLPPFASSSTEQSAAVTELAPLIQELKAICDNCDKQTFASQQFLTATESLLRLRHTFLDNDRPREAQEAFRHLNGFETLLQLVKKLSHLYEPTELSAEERRSLLTLYKDALAVLAESLKGNFGNRRYFARRISGGGTAALQEALDIIVPKLSSAQGDTEQFYGGILAAALCQEAVADIFTTLNAKFQPVQELLQQDVKAEVDRRMGSSETVEVPELLGPFLKGWLKQSGSSPSDYRVQRLVLPACLCQLAHQSQRNLTALHATGILSSILPILLGSDRLESERIIYQDMAQLLCAQGLTSLEDAATLYRQAHGCARILRFLVDVLKCSKEPPLIQFDLSLHGYSSLEFSTLGRPFPPVTSSGYTIAVWARFDRFDPSTHTTIFGAFDASQSCFLLVYLERDTRNFILQTSIRGTRPSVRFKSMAFEPNRWYHICVVHKKPRPPSHSRASLFIDGEFVE

SEQ ID NO: 26406 - protein, 119 aa, A.fumigatus
NSHLGESLLLISPLGAIKVIKGQGMPSYRHHDFGNLYIQFDVKFPEKDQLQNLGLLERVLPPRMEQPQPPADSMVEDFELEDIDASEGSQRRAHGAATAMDEDDDDVPPGAERVQCASQ

SEQ ID NO: 26407 - protein, 198 aa, A.fumigatus
EEFLGSVSMCGPFGIFPGVLLKIPCEPDSRKLTVGKLSDDIIPAIKNISKKHGVVTSRSIFLHWFYIIIDALKSLLAGHCQGQIPRMESIRCEVQKLKTRSQSCFTRQGARDGGYPTKYNMYLYLIDRASQPILHALCHVFLIEDQHYSNHPDFSSLSPLSYSANSMSRNGRVYGAAASTCIRSGIRSAVRIDSLFVS

SEQ ID NO: 26408 - protein, 61 aa, A.fumigatus
RPNVDLELFPSKVIKNKRVYKLNYKLRVTFGAREGVLKFEAVSQGQTVGQTSINFSAAKYY

SEQ ID NO: 26409 - protein, 90 aa, A.fumigatus
NQWRNIDLEVTTPCFLEIFLIAGIMSSESLPTVNFLLSGSQGILSKTPGNIPKGPHIDTLPRNSSYVAVKILKAKASISEGPIELSMLMS

SEQ ID NO: 26410 - protein, 91 aa, A.fumigatus
LSRSACPSSPVGLRQCAPELELEFGFSALMDINNRGLTSANSNARHLMNGFCYVLVCLAFSTGTVAYCGNGEYTRSFRDASEISCTGGGLP

SEQ ID NO: 26411 - protein, 426 aa, A.fumigatus
  UNSURE (53): Identity of amino acid sequences at the above locations are unknown.
GWANWIRNRTVSALQGAKVDIPLRLSGDRPWPFTTRNLDDDSPAMKKTFWQEXSVCQVTQKGHYNLIGVTDSSCPGSVDQAARDFEVSWIPRPHIAAVDGSPVVIGSPIEKRDVCQGEDDSVELRLTGNPPYTIQCEQQRKMGRGTSSIRTRSLKTALHVTSMEMDTSEAGLYTYKFKEVGDSLYDYDPRSEPVLVTQRVNPLPSARFNSPGHIYGFCKEDVSGEESIPVTLEGVAPFFLEIIIKHHSNAKPEVVSIPNISSNRYNLPIPRRYLNLGQHVVSIHKVRDARGCQRTFENDASTVRVAVSDVPTIIPLESKIDYCVGERLSFSLSGHAPFDVFYTFDGVSRKATSRTTNFRRIAERPGIFTITAVSDGASGKCKAHKNITKTIHEMPSVRISRGQTSVVDIHEGGEAELQFEFWGTLS

SEQ ID NO: 26412 - protein, 471 aa, A.fumigatus
GGNCADSGLLVREDASFLMAASLKTRGRRRVIDSFARGDIWASRPPVEGVIDNLDDFFPDIDLDAPYLDGQGVSPPSSPANRAPPENDLHKKENQPSSSYTGEMNANAGDTLGSNEPTLKPQGGDVVARRNINRSGGGLTRGKSIREVAKGANQASRSRSIHTGNQKSGEILRRKSTKMFGAKIMQIKPKPGSRLSQLDPIPQNNTPSGVPQRQPTFRIIRGQLIGKGTYGRVYLGINADNGEVLAVKQVEINPRLAGQDTDRVKEMVAAMDQEIDTMQHLEHPNIVQYLGCERGEFSISIYLEYISGGSIGSCLRKHGKFEESVVKSLTRQTLSGLAYLHDQGILHRDLKADNILLDLDGTCKISDFGISKKTDDIYGNDSSNSMQGSVFWMAPEVIQSQGQGYSAKVDIWSLGCVVLEMFAGRRPWSKEEAIGAIFKLGSLSQAPPIPDDVSMTISPAALAFMYDCFTV

SEQ ID NO: 26413 - protein, 366 aa, A.fumigatus
FTISSISSSLRRDCFLWPLTIVLSALRFMLWVSFDHLLYKTGPATDTVHFLGFVFFVSSLQKGHYRFQFTQFAWTHMALYLIVVQAHFVMNNVFEGMIWFFLPASLVITNDIFAYVCGITFGRTQLIQLSPKKTVEGFLGAWICTIIFGYFMTNILMRYKYFICPVNDLGSNVLTGLQCNPNPVFVPQPYSLPEWTGLSKTFYVEPMQFHILVFATFASLIAPFGGFFASGLKRTFKIKDFGESIPGHGGITDRMDCQFIMGFFSYMYYHSFIAVYKASVGDIIEAAINGLTVEEQFEVVRGLGKYLYNQGTVSETVCSIDFFFFFFFWHERTTCSQIIQILDCLNGELKRREMIAMTSPFPARGP

SEQ ID NO: 26414 - protein, 154 aa, A.fumigatus
SGRRGAHQGSRNQLNHLAIGRLIYSARNRNSLNVPNMREKKQTFITRTIWTFVMIFLFFIAMFSGHIYIIGIVTAVQIISFKEVIAIANVPSREKNIRFTKSLNWYFLATTMYFLYGESVIYYFKHILLVEKGLLPLATHHRFISFTLYVMGKF

SEQ ID NO: 26415 - protein, 483 aa, A.fumigatus
GESLLYAIMSSSMRSSRQRISSLSRPIRTSRTRVQSYLEDSSSDDRLDEDTDSDQERSRRMSLSLRPRSSNRAPVSYREESTDDDFERSSNEDHSAVAPVEAPTRYTYPFPQSAGNGTSSRPKRNRTVKTRSQTSKSKRPPAKNRLELGRPLNKRPKVQADDMLPIGSGVIPPWHTLPYHILFDIFFRASFPLMDEKTTTRNSSTQWLVSVALLCRAFHEPALSALYHSPPLIPIKCHALLNLLCQPQETLSTNYRNKIQELHIDVETLLLHKSGPTLGYFDLPKLIEKTPQVKKVRLYHKDDFIVGLAPWQIQRSKWVYPESLFESINTSLIHLRSWDWNSRFMEAKQLIPFLLGKHHDQAFRGLRELRLLHVASEDIDHDGSAEPSNEREVILATAIKELPYLRRLEFSECSIVNEHLLLNMPSALTSLTINNCDEVTTSNLSAFLAAHGQHLRELNLNHNRHLSMSFVVGFHHGLGHPSS

SEQ ID NO: 26416 - protein, 265 aa, A.fumigatus
NWTISYVNRSETSRLQGSQSEADGNDSAADGARETAGSVAQDVGSRRSRGAAGRGRGLAGGTGGTRARRARRAGRASSGARRGAGDGAARGTGRRGGVPEAGAVVGAAGSFADGEGGLSRVSGSGSETRSLAADHGRGRGASGGGRGGGGRRRSRAGEVKERGGAQSAADDTEAGVGGHRVGILEDVPPGVGLAEQGASHLVPVGLGVGQVGDGEILGLAADGPASLGNPDLLALGNSLGLGHRFIEESLGIGDGVFTTGRKARS

SEQ ID NO: 26417 - protein, 253 aa, A.fumigatus
LGLTARLPPRGEDSISDAKALFDESVAKTQAVAKGKEVWITETGWPVSGKTENLAVANLANAKTYWDEVGCPLFGKTNTWWYILQDADPVTPNPSFGIVGSTLSTTPLFDLSCSASSSSSAAASSTAGPSASSVIGGKASGFTTAAANSAKPTFTVGKGPGGSYNGTGFWNSTSSARPSSSAISGSSSGSAAGSSGSSGSSGSGASGASGQSSSSTGSSSAPSTSNILSNAASGLSGSICGAVVAVCLALAAL

SEQ ID NO: 26418 - protein, 83 aa, A.fumigatus
YRDALLSPTLTALPFVSPRTHSLRILIWAKASRRGGIPALTLTTNTPEPQLTDPLPTETMAHYPQHISARAGGGYKYYSINHF

SEQ ID NO: 26419 - protein, 112 aa, A.fumigatus
DKVTCLGFESLLTEIPNPLEIGYDFWHTAPLPRFNVPSVRVSDGPNGVRGTKFFDGVRAACLPCGTGLAATWDQSLLYDAGVLIGQECLAKGAHCWLVPQCVSNGRPLGAKG

SEQ ID NO: 26420 - protein, 76 aa, A.fumigatus
VRFIRYCHLEEQAVGMRAHAGEKAVAPSVNSNNDESNMRTPEQQPEEKNLEEPTFDTGALAWLQVLGSFFLFFNSW

SEQ ID NO: 26421 - protein, 381 aa, A.fumigatus
SLRRLRGVINTWGAFQTFYEQNLLSNVSSSSIAWIGSLQSFLLMLFGVVTGPLFDAGYFRALVIFGTFVLPFGLMMANISSQYWHLILGQRICIGLAAGCLFVPSVAILPQYFKQKRGLANGLAASGSSIGGVVYPIMFNKLQDQIGFAWATRALGFVAFGTCCVSLSLMRMRFLPTEKRKLVQLSAFKDPAFVMFAVAMFLGFLGFYNFLFYVQSYAIDTGIVDANLGFYLLSMLNAGSTVGRIFPNFVADHTGPLNMLTPAVTVTAVLAFAWIGVHNVPGIIVLSVLYGLFSGGFVSLPPVVMVTLTKDIRDLGTRLGMIFATTSIGLLIGTPIGGAILSNTHNYLGVQLFTACCIITAAAIFAALRFSRTGPRLLVRA

SEQ ID NO: 26422 - protein, 75 aa, A.fumigatus
LSGGAWPPCGRRPASSFAWVTPIFELYCVASPNANRNALAQSASKVVQWVQREEERLFIIGGAVGHSQEGPLAGY

SEQ ID NO: 26423 - protein, 82 aa, A.fumigatus
VLFLDQRGTGMSSTITARTLALQGNAVKQAEYLKQFRADNIVRDCEAIRRCLTTDYPEDQRKWSIIGQSFGGFCAVTYLSML

SEQ ID NO: 26424 - protein, 103 aa, A.fumigatus
IYKDMFESYTELQQVKDVANILATTAEWPQLYDEARLADNEVPVYAATYVEDMYVHFDLASKTAAKIKGIKQFITNVMYHNAIRSKADEVMQQLFALRDDTID

SEQ ID NO: 26425 - protein, 124 aa, A.fumigatus
SFDPRLVKTVYQHRSGLCRLLRSIPMSGQRNVPMFDTPSDLPCWRLPHLPSSLRHKGLPAAVCLREIYQPALYYAPALACSGSLVVTNYHTPFDIVNVYTVLCEILQKVPALAKCVKFHNAAHY

SEQ ID NO: 26426 - protein, 102 aa, A.fumigatus
VTSLSPCLILQSKSIFSAKVAFTMYGVTGEVTEEVKHAVSSIQKNSRITIWIHISGGGTKLGETKRIDSGPDDEDSPLFKIKKEADNFYQELKDGKLKYRRL

SEQ ID NO: 26427 - protein, 340 aa, A.fumigatus
  UNSURE (333),(337),(338): Identity of amino acid sequences at the above locations are unknown.
RHAKSLIESFSRELTSNLFGNPHSLSTSSQLSTQRVDDVRLRALRFFKADPEEFDLVFVANATAAIKLVADGMRDSTRQGFWYGYHVDAHTSLVGVRELAEKGGRCFTSDDEVEDWISRLCDVRSESLKLFAYPAQSNMNGRRLPFSWCKKIRDQGETTGGNVYTLLDAASLVSTSPLDLSDASAAPDFTVLSFYKIFGFPDLGALIVRKSAGQIFEHRRYFGGGTVDMVLTRGLQWHAKKQSSIHDRLEDGTLPFHNIIALDSAFATHERLFGSMQNISSHTRFLAKRLYDRLNALRHFNGQRVCELYKSPRSDYVFTTGLEGPKVTLFQKXFSTXXPP

SEQ ID NO: 26428 - protein, 246 aa, A.fumigatus
KLKLMLGQLLLNISRLGPHGDQIRDQEVYLIGIYGSRLHILRAFFLGQKTSHLWSGRHNRSSSDADVIDPNPSTVYDRFYTGKNLERLRQQVEWLSAKNLDNNPNPRHFRVLGSREFDLWCKQDFRAAVKMIVALFIYMMSGQARCGVLQKVFQNYPIDEESDDELEEVHDTRKRVAIEEEKLAKKEKELEETERKKREEEQKMSKSKGKRRSYIHGRFQGFKGWRKPCEDFAWQKETDSSLDDDL

SEQ ID NO: 26429 - protein, 198 aa, A.fumigatus
EPLGPVNQLVRYHEPAFPLMFSELLTLLEVLTVLTQRQASGTLSGTISVDGRPVDESFKRNIGYCPQMDVHDETSTIREALEFSALLRQPVSVRKEDKLSYVDTVLHTLELVDFQNAIIGSLDIEKKRRVTIGVELCAKPELLLFLDEPTSGLGSQGASSIVSLLRRLADQGLAILCTIHQANQEQFEQVSLNEPWRL

SEQ ID NO: 26430 - protein, 215 aa, A.fumigatus
  UNSURE (196): Identity of amino acid sequences at the above locations are unknown.
FDKVLALSPGGRTYYFGEIGRSGCCIFDYFKKYGDQPKKITNAADYLIEVVVGGMRDTDHEVDWADIWNRSAEADALQKEISNIHRARSQNTESCDSTKQTHSMPPLYCQIGLLTQRTLRQYWRSPEYPYSRLYASFFHALINGLTYLQTGNSSTDLQSKAFSCFLVLMLVPEFINAISMRFILKRDILEYSGKDXWCVFLGCVLHGAHNLQNNV

SEQ ID NO: 26431 - protein, 201 aa, A.fumigatus
AQSHRELEELVKMLSADNQHTKAAALAVFQDEAKLAYQALRSHTPTQAHKLLAMAIAGAAKGDTDSDWEETCAEIAKELTDPYARAILALVSKGDWKSVIHESTLPLRYRIEVALRWLPDAELSGYLKETIAEVIRQGDIEGIVLTGLGHSALDLFQSYINKFNDVQTPVLAMSHTVPRFIRTGWGQGSIMKNGVRPIAGR

SEQ ID NO: 26432 - protein, 205 aa, A.fumigatus
  UNSURE (65),(78): Identity of amino acid sequences at the above locations are unknown.
CSDAGSSHEPHSPTLHQDWLGPGLDYEEWRETYRWQMNSWKLQLERARFDVGSRKFAVTWDGAKXVEPPRQQVSLTCXYCTRHLTQHDASSQFSPSASGEGVHQTAGNPLGTAVMSGMVCARCGRPMPRCGVCTLWMGSPDPMSRACIAADAGQEQRKPTEADIMRRFIVFCINCNHGFHAHHAREWFAKHKVCPVAECSCICDR

SEQ ID NO: 26433 - protein, 107 aa, A.fumigatus
LAAGRFSVVQPYTYRIHKCLTTSSPTGDATLTEPKNGFNSTQLASLFTKRSVRATSTAVSPSTLATSMLMAMSTRPRAAAPSLSGSTIARVIISSITSAATISTLAF

SEQ ID NO: 26434 - protein, 93 aa, A.fumigatus
  UNSURE (5): Identity of amino acid sequences at the above locations are unknown.
TLNPXGNPVLYGTPGADTYMTPGLITLDMNTLEWTNASTTDMDTFGTIGDGYMSLIESVGDQGLIVAFGGYTYPVGEKISFLAARQNETTHRV

SEQ ID NO: 26435 - protein, 129 aa, A.fumigatus
VVRILLSITCSRTSYVFGGMGQTTAESDGDVYVLSLPSFQWIRVYRDNTIRYKHKCQLVQKHTMLVIGGIIPIDGMEYYPQSRNCDTATFANGIGIFDLQTLSWRTNYNATDVVGYAVPSQISDVIGGG

SEQ ID NO: 26436 - protein, 75 aa, A.fumigatus
  UNSURE (13),(22): Identity of amino acid sequences at the above locations are unknown.
AFDKIPSFDLCAXTATLRNDVXAAGFLAPSLPCFCGLDDNSCDKITISRLFLTEKGIEREEIFAPRKNQGIRRVK

SEQ ID NO: 26437 - protein, 98 aa, A.fumigatus
RKCHLSKDRVYGLPAELRFRVVITGLGAKDNGVSFNAAILPLGVLNVFQILGLQIIYVGAFRRREKGSSCQKRCKALGQRPCHHSAGRENEYIANFIG

SEQ ID NO: 26438 - protein, 151 aa, A.fumigatus
DSVGQLFRVNQNNTHTSITRLSLTLTKDSSFRKTGQLLSVRAQLNLYSELTDSLPDLFWDSRHELGLEGYYEQVGRALDVGIRIKLLNEKMDYAQEIASVLRERLSETHGLRLEWIIILLIAVEVGFEVLRLWKERAHELEAKAELSSEPS

SEQ ID NO: 26439 - protein, 119 aa, A.fumigatus
NNSRLCSESGGNRHVVFTPSSCTALQSFDVNMLQSIPGPQHILKALTGSLGLSTIYEPDHEASQNSFQCSKPELSCHAQYHGQDTCCFNYPGGQMLQTQFWDADPAVGPVDSWTIHGLW

SEQ ID NO: 26440 - protein, 209 aa, A.fumigatus
KAVTAYAVAEQFDIRKVRDILQEKGFEPDPFQTGLFPQVVHIQVPIDSIRRVSNLTTTDLSSDEVGDVFVFPSGTVVAWSLPEGFTSFLATRTLLPAAEGAHIDNLETEDLEYIEDPQRENSSIKGDTIILGTKSGNDDPESKLGRQSVDTVLTKVAFSSGLARSTKLAVLETLLANYFESTRTIPTLLSQGSRLPSQKIHPFARPANC

SEQ ID NO: 26441 - protein, 167 aa, A.fumigatus
AVTPSTMARTLAASTIPEGRCSRRNFGMRILRSGQSTPGLFMDSGELYVVLPKLLLSQTCIVLNKTLITGHPPRPDFCDGGFDQYCDSKRRYSNISLILVDSGRADLLEYMSDFWKDFRGDDEDLWEHEWNKHGTCISTLETTCYADYYPQQEVVDYFNKTVEIFQK

SEQ ID NO: 26442 - protein, 92 aa, A.fumigatus
TDHCTGIMQIAALAATFALALVPSVSAWRVFFYQLKEGEGPSITNAGPGNPGFRCHPNVDPLNQNISSMRYYSDNPEGTIRCCLTVFHSPGC

SEQ ID NO: 26443 - protein, 73 aa, A.fumigatus
LASGFCYRLVGITFDMDTTLKWHWDTVQFVLNCGERTCRRILYKASPIPLKVDIHKPAQPRQEYSDRNKLITR

SEQ ID NO: 26444 - protein, 143 aa, A.fumigatus
GTTRTIRRVLSAAVLQYSTVPAAKATLDIRPVGTSSPYFAEIGHELYVISFLTELFLTLHSASVLLIICPLYDYGSTIPSQYIFPFLSSFSSPPMFFPPLLSLPLSPFSIFFLLSSPNHSSFSLIPIILLSFLILHFFFLLPL

SEQ ID NO: 26445 - protein, 84 aa, A.fumigatus
TALSNFELTHASATFNEKLLLGQGLSITPLDEGAGNGSIGPKSLYEVVRQIDNQKDFQDYILSYEYNPGAVTSEEVQYQRHPVR

SEQ ID NO: 26446 - protein, 199 aa, A.fumigatus
  UNSURE (14),(50): Identity of amino acid sequences at the above locations are unknown.
GSCLALFKDGASGXDNRQGTYGSSYNDLNGFHGRMADHGLQLAVSLQQMXDDLHELATNIEKGRKQWKQTGLSAEKRVTEAEAAAEKAKAKYESLAEQYDRVKTGDKQGGKFGLKGHKSAAQHEEELLRKVQNADGDYAAKVTAAQAARRELISTHRPQAVQNIQKLIAECDSGLTLQLQKFGMMSLRPDIEPLCRTLS

SEQ ID NO: 26447 - protein, 224 aa, A.fumigatus
LRRRFSTSVIRYVNLYRSLLSACSFRVRHWEVRPTPVAPASQPSTQNKRQSIMFPSSFSQQHLPVSQPSTQPSGPAATPSPPPAPAQSTQPSSFQPHPDSFSSPPPFQPPYPTSSGLPAPDQHNVNTLPMAAPANPLPPPGNNFQQNLPPLRPVFGVSLEDLYARDGTAVPMIVYQCLQAIELFGLDVEGIYRLSGSANHINHMKSLFDNGMCNHSLTRFSSNR

SEQ ID NO: 26448 - protein, 69 aa, A.fumigatus
PLWMADSSQVDFTNPENFYHDVNSVAGLLKQFFRELPDPLFTSRYYSDFINAARKYIDSNPGCHMTRAE

SEQ ID NO: 26449 - protein, 68 aa, A.fumigatus
LTRISVGIDDDIQRRDSLHALVNNLPDAHYATLRALILVSNSGIAPSFYLPRSNLLDSSTSTKSKNIT

SEQ ID NO: 26450 - protein, 152 aa, A.fumigatus
PPRSLRLSPLPVEIHQPLLILPAESCQVIIPGADLVVVIAVARKVKPALEILVHARLFLEPPLGAVEGGGVDGADVCGALVDLADGGFGIVVVSIAKVRGRAFLGAFVVDSEDVGFRGFGGSRAAASGGLGAFGDEGGELGGEGEGRGRGGG

SEQ ID NO: 26451 - protein, 96 aa, A.fumigatus
PCRTSISVSSVSIHPTFAAPCCIGVLTHAYNPCIASVSGVGTAFLNQLARLPNAPKLILLARSTQTLLAPTPAYSPAIPAGDWNAAAETPSLTKSG

SEQ ID NO: 26452 - protein, 221 aa, A.fumigatus
NIHHLTVTIRAHKMSNTNPSLYGLPRHSQKASAQSTAPSASTLAFTTQLSSLITKGTESSTRGRPRPSKSSKSDIFAVHNKGAQKRAAADLRDADDDDAETSVRQIHKRTADIGAVDSATLHRSKRRLEEKARMYEDLKSGLYLAGDSDDDDEISSRDDYLARLRRKDKEGLVDFDRKWAETQRARGSDDSASDSDGGDVEADDNASIVSYEDELGRTRRG

SEQ ID NO: 26453 - protein, 272 aa, A.fumigatus
QKQLFNRGVAGQRLSEWCLRHTRLSNQHRQSCLLRRVQTFTALPSQKIRSETSIISQSPFEHTKCQIQIHPFTASPDIAKKPPLNQPPPLPLPSPSPPSSPPSSPKAPSPPLAAALDPPNPLNPTSSLSTTKAPRNARPRTFAMLTTTMPKPPSARSTSAPQTSAPSTPPPSTAPSGGSRKRRACTRISRAGFTLRATAMTTTRSAPGMITWHDSAGRIRRGWWISTGSGLRRSERGGQMIRLLILTGEMSRPTIMRRSSRMKTSWGGPGAG

SEQ ID NO: 26454 - protein, 99 aa, A.fumigatus
LASFGKLQLICLLVTAGVRENVEQLLNYSQNEKKRNFLETVELQIGLKNYDPQRDKRFSGTIKLPTVPRPNMTIWYVNFADRPILRWNVLMRIIGRRMR

SEQ ID NO: 26455 - protein, 81 aa, A.fumigatus
  UNSURE (2): Identity of amino acid sequences at the above locations are unknown.
TXRSRPCQTTTHQCMFADELKKLTQNQKLLQKLLRNFNAFLGSDTLLQQYPPSPGFGSCPRVLIFRPRQNPNARDYPLTKN

SEQ ID NO: 26456 - protein, 94 aa, A.fumigatus
KRCSFQPRWLKTRHYGLSPQSEVSNLAYRISQDLYRTFAPIKQTTSTMAFCSLELAGRLLDQRLEPVEQGSDYEQWRTSREEVMGGSPAVFSSL

SEQ ID NO: 26457 - protein, 198 aa, A.fumigatus
VVNSSGATDGSLHSPQRGDLPTYFLQTIPKKYLSFFRMAQPKNHIIYAPSEETPRGVKSVFLAGTTSKVDPGDWRETLSTSLSDLPVTIYSPYRPDWDSSWREDIDFAPYREQVEWELDKLDKSDTVVIYFHPATQAPISLLELGLCARVPGKALVVCPEGYWKRGNVQIVCEKYGVEMVDNVDALRDAIVERLSVRS

SEQ ID NO: 26458 - protein, 541 aa, A.fumigatus
PIVAILHTLYGIYHLCRSPVTRPAGSQASYMVFAATLDLGLVPYYVFSAYIAYKQITNNAYHWSTLLSAETGITDKIAHSTFILSIVNGSFHLTSLCISVWLALIFRQISQLPPDLNPLEDNLTARPHKRNKSEISEKHRSLSTVASATSAEEPLIGPARQVPFMHTRNQSSEDGSSRFSVINEKRRSQQSTYRDTVVPPVPPVPQHSFLAQHDQQASVQSLLADSHSDHAQQVSRDVPDRAQCVSPDSGNWIAYPSRSPSPAEAGLNENLARREPSSAYSQTESLISAGSSFKDWLTSAQRYELHLNEAISEDVRGEYESLAFHEHYANDEDIHDNPQATRFYDNAEQDIGDHNINIFLDHNDRERQFSASLQVNPLALNPPTPQPVQDETDNAPHPPARAPLTDIPNLAPNPPASPTSPDSPEKKGRFYGELNNKPWLSVARSVSGQNDPDSRDLDRKRSRLVKRNSQKLNTYSSLKQHDADDSDVENEIPPVPTDPAVADGDRKGRVVSNSGADIGRHDFGSGSSCLHHGAGRIRGGA

SEQ ID NO: 26459 - protein, 312 aa, A.fumigatus
LMTFQAGGEDIRTGRRPDAYDNRQHARPRSGYGNGPAPDYRSMPPSRPEYQSPPVPDMHPRHAYESTSRPTSHHSNRQFPAPEQYGYEGDVLRHSHGHEAAQYSPHSSTRSYNPPPVDYTHGAPPGPEPEHHYRLHSNSGASINSRHRNSLAHETFHPEYAAMQPRVDDDEEEEGPPPPPPAHRSGLVQPSQQLVPSPTSSYKAYSPEFAPSPRNTTDMTALQPLRPSHGNRLQDHPHMKNPSVPRSLVAGFDPAIAEGEAARTARERPANRRRSFFEEDAMIRAAESNPASPTLTLPTPIRLPPRGLEDPA

SEQ ID NO: 26460 - protein, 299 aa, A.fumigatus
SSAPAYASLPAPGRKYLVHGEKYQVHLACVGPLNGTADGNGKKPPTVLLEGGEGPVEHSLQPFIDDVYKQGLIDRYCYWDRPGYAWSDNAPSPHSAGMAADALSEALALAGEEGPWILVSSGIGSIYSRIFSSRHLLETQGIMLIDAMHEDYLGQVGNAGRGFLLWLRGVLSPLGLDRLFGALFKGRTREDRVYGRSAYQTDKFLKAKLQENLVAESMTASEIQTARHVQMPDTPLVVVSSGIEVRRSDKWAKTQEDLTKITKNLKEWDIVKGAPHEVWKTTEGRQVLGKRLKEMVKGE

SEQ ID NO: 26461 - protein, 236 aa, A.fumigatus
  UNSURE (8),(11): Identity of amino acid sequences at the above locations are unknown.
GGLYTAGXADXTRTARFRVSISCFYYQVSPYNLWSVRALRAFSSFCLAVSFVWWTFLLVSIFVSPPMMHSRGSGFFSFAYTTLTVGYLVIALLFFTIPSLAMTISGIVLAVFLFVDMCIILCVPQLRVEYGWVGIASVVWATLISIFNVLHFRTVAWGKREGRGTPYRTRGNPAVPPGMDRCAYRPDLHGCVCDSFHPLHCYSDLPRPRMPPSPPRDESTSSTVRSTKSTSPVSVP

SEQ ID NO: 26462 - protein, 98 aa, A.fumigatus
SEYHTMTGRSSISQPPATDSTPLLSSHAASQRFSVFTNGQKRLIILAAALASSFSPFSANIYYPSLNSIAADLHVTSSQINLTITTYMVSLLVDLVPF

SEQ ID NO: 26463 - protein, 393 aa, A.fumigatus
VKTGQVMHQLPVGHYAMVAVMSYSGYDIEDALVLNKGSVDRGFGRCQVFRKYVTNLKSYSNGTKDRLNPPTYENGAPIRKHALLEADGLAAVGEQVNAGEVYINKSTPEQSNLSGIGSDAGRPVQYTPTPMTYKLHDPAYIDKVMYSVQENENQLVKVLVRQTRRPEVGDKFSSRHGQKGVVGIIADQVDMPFTDSGINPDIIMNPHGFPSRMTVGKMLELVAGKAGVLAGHHGYGTCFGGTPVEEASRVLIDHGFSYGGKDYLTSGITGEALPFYVFTGPIYYQKLKHMVQDKMHSRARGPRAILTRQPTEGRSRAGGLRLGEMERDCLIAYGTSQLLLERLMISSDRHEIDVCEQWRLHGLSELVSAVQVVPERSEDEDPPRRQASHSGNG

SEQ ID NO: 26464 - protein, 138 aa, A.fumigatus
SSRLPRMPPFVPRKRVSSEDPPTAKRQNATPIVEIADFDEDSDSESSLSDAPSFDDEPLAKRDLQKQKKQASDGSESESESDDDDEVDWEDAIDSKLTCTSISTPAPAVQDLELTLDKNEVHLADIADGKKGPSKTEL

SEQ ID NO: 26465 - protein, 82 aa, A.fumigatus
KRTQGGRSSESVPVYIQTGGPVPLQRTVMKISRRKKEQKTKKKKKKKKKKKKKKKKKKKKKKKKRKKKLRVKKKSPYHQTAQ

SEQ ID NO: 26466 - protein, 103 aa, A.fumigatus
PQLREDWSHEIQFALRAILFKLSIWDHNASYGAALQGLRYVDSRSKGPVHSTPTKWQKSLYGLLTVGGRYAWEKWESWLISQEGGYEEVLSGTFFVGTYMDLC

SEQ ID NO: 26467 - protein, 242 aa, A.fumigatus
LKQPSRDVRMLARLTGLVSTTHSIAAFVSFLVFLVNGRYRTLVDRILRIRLTPPSAQSAREVSFEYLNRQLVWHAFTEFLLFLLPLVGISRWRRWLSRAWRKAISAIRSRDDDEVEVEKRGELAFLPERTCAICYKDQNPASTSENDIITASAGGIVGSAQTDITNPYETVPCGCIYCFVCLVQKVEGEEGEGWICLRCGEIVKKCKPWNGDVLEEVRPSTTSGKIVGFAMLHHGAGRSAAN

SEQ ID NO: 26468 - protein, 146 aa, A.fumigatus
  UNSURE (9): Identity of amino acid sequences at the above locations are unknown.
STGLDWSLXSIYFSLEYTHNDSTMSSTNFAAAQERVLERRRLREAEARKRLAEQQRASPLNHPALNRLPYPLNRIPQSGVTLWNSIKGREGSRPAFRVGQVDAELLDEELLGLLKGQVGNALKYFGVWPNVAAIPVAYLSITNCLS

SEQ ID NO: 26469 - protein, 295 aa, A.fumigatus
AASPLSLADASPLPTAANAMTGLAQCPAQVVEEIDAYLDLTDVGNLRQTNRRLRSQVTQGRFRLNFRSKRVKITGAHLQQLGLLTQRGWLGCETRHLTLVGVVNDTMALDAGLKADATNPRKRDLAILQQRRQDYEQLLESGKIVQLLSQAFKYLATNSAERKLQSLSLEVTVYRQDAEREVTPLAGSSWRLVWQTTAETFRIVLAALQKSLLAVDYLNVFNGSYMQRCSLESRELSQIDYHNERLSKVLGALKALSISVSDRILWLTPQDAQRSSDGSADVIDWSDDEHDRRID

SEQ ID NO: 26470 - protein, 265 aa, A.fumigatus
DPGLLRLPHSANTVTYLHNIMLDILSLRTEAEHGLADSILTATHQYALLQRASILDNRLAQWEDRVAPENKPITIAHMRPGSDPYIEVGHWPGPLHMYTDLRAAALLNISRVARCYLLDIILRLKDMQADTGNDDKERATAVQLIQDFTSSIPYHLVEDLHSFSMSVQRGNPIEPPGRAVGGLLLMYPLYIASQLSIVSVQFQDYFKRCLVWIGQNTGVGYASLLAKVRYTVTGHSLCYANGQSKAHFNIQDLTAGCIIVYGGLL

SEQ ID NO: 26471 - protein, 139 aa, A.fumigatus
CCVVLLVTKLMEAGALNMSRALGDLQYKNPLNNDTMGPSTAGQEIAAMTPSIEQGSFVSSEPSIIRVDLRQDRRYILALTTDGVTNVLKDSVIINEIKTRHEGGLGVQQVADELVRGVTQGERRDNATCIAVFLDGCLS

SEQ ID NO: 26472 - protein, 191 aa, A.fumigatus
LLRWCGESFSSDMLAGTARECLDDLFLLERRSPFFSEACINAARRTDRLTDHATSPRHASTASPIKPRAAPTAINTVPSGVFDFCMYGASAVGGTVTTGKPSVEDADVAVEPAESVVETVDVVAASVVVEASVVEVSLLVEAFVVVASVVDVESVVFPVSVVAGSVVFVPSVVCAVVAASLVEGSRWAEAS

SEQ ID NO: 26473 - protein, 131 aa, A.fumigatus
CSDDVDSLYHRLSRLDCNVCILYRRFPCGDRATDSGCAVHAKIEHARRNGVYCCRCSSRLYWAGSAGMAWARRMVGQPICPPRRVDARLGKERTPSFQEKEVIKAFPRCTCEHVTRKAFPTPPQQLQPKST

SEQ ID NO: 26474 - protein, 364 aa, A.fumigatus
APPTMRFRNVGRAKPHQRSMTLLLFLLIVVLAQLASAQRDPSTNDAATTAQTTDGTKTTDPATTDTGKTTDSTSTTDATTTKASTSSETSTTEASTTTDAATTSTVSTTDSAGSTATSASSTDGFPVVTVPPTADAPYMQKSNTPEGTVFIAVGAALGFIGLAVLAWRGLVAWSVNRSVRRAALMHASEKKGLLRSKRKRSSRHSRAVPASMSLEKLSPHHRNSYNPRAPNIPSTGSGLFFSPTAGAGMHTSGNRGSSYLPAGYYAAGNAAPTGSQNIPYSTPEMRPHSQGYIRTKSNPSPPRSPGLSPSGFHDTHYDPSTRHSYVAGSTSSLNLASPTHGRTPSAFLEDLFESHAPQSDNGHR

SEQ ID NO: 26475 - protein, 245 aa, A.fumigatus
SSSHFHKFAFIPESFDDCDLSTLSTMIAVVPVSREHLSQPPLNLQRRAMAQTYYLDSPDIATFKNPLQHYSQRDCPSPITSSAPSSVPPSPHFAPVTEEQLLPTPATLSSLSLSVSNDSDDEIILPSYDSSHFNDLNEIVSAVASDQASESFLTGPPCLHVHTPAADDTSVEEEPTRHVDYLSHEWKEEDIWASWKYVVCRRDIYSNGARLENASWRTWAKLKNNLGTVSPETLNWSVLHTLAFH

SEQ ID NO: 26476 - protein, 75 aa, A.fumigatus
LSQSDNKVMSMYSNMFHQVERLRCNMALWSVEVVHQVYKSVAEYLPTAELPRNPLVVCGQGSRSSHGAARSENIP

SEQ ID NO: 26477 - protein, 372 aa, A.fumigatus
  UNSURE (333),(336),(341): Identity of amino acid sequences at the above locations are unknown.
SKCCLQHLFNSNLAPSPFAPFKDRAPLVSKSCIMTDSSTPDMTLTVHHHGKPHTFTLAPDATLQDLSSTIADTLNIPIENQKILIAPKPGMQKHPFAPTPLSTLLPLTSPKFKLTLLGTPAQEIESLNAQTAETRRRLEARAAAAAKHRTRRPAPSIAGGIHTLSSAGSNTYTFHRLLPLSYLPNPSRSLEFLARLRDDPGIRAAMAKHRFSVPLLTEMDPAEHTTSESRTLGLNRNKGEVIELRLRTDAYDGYRDYRTIRKTLCHELAHCVFSEHDRDFWDLTAQIEKEVERADWKHGGKRLTDEEFYNPGEWEREKDAAVVDEKGWTGGEXVLXGLKDXNTGVESRREIIPRAAEEKMRKKEDNIMGPGR

SEQ ID NO: 26478 - protein, 146 aa, A.fumigatus
QTQSPWNVIEVLPPASIQLQSCTQSLRSFQRSGSSCLEELHHDGLINARYDLNGPPPWQTTHLHPGPGRNTARPLLHHRRHPQHPNREPENPHRPETRHAEAPLRADPALNPPPPHLSQIQTHPPRHPSPGNRIPERPNSRNPPPP

SEQ ID NO: 26479 - protein, 140 aa, A.fumigatus
  UNSURE (74): Identity of amino acid sequences at the above locations are unknown.
SRKTRMSAQLKRQRRSKIACEPCRTRKRKCNGQHPCEMCTDSEYTCHYDLGSRKKRNKGLVLESLMTVRPAQMXHAGSHWERPTAPTPRRPSPPVERFTNTVQQSIGTNSGAFLVQNLGTQDRPWSTPSNPPVFPLEYPG

SEQ ID NO: 26480 - protein, 263 aa, A.fumigatus
AQTSRLERDVADPNRIHKMILDDLGVRQIAAVVGGSMGGMLTLEYAYFGKDYVRAIVPIATSARHSAWCISWGEAQRQSIYSDPKYEDGYYSFDDPPATGLGAARMSALLTYRSRNSFESRFGRNVPDPSKRQNINGTERLPTPPNEHWAIHNDGHKAGMSSRASSERNSPGPQQSSEVQYMDPQFSGTKTFSSPVSNSDRKRPPTYFSAQSYLRYQGEKFVKRFDANCYIAITRKLDTHDVSRYRGLHHGVERRCHANKISS

SEQ ID NO: 26481 - protein, 149 aa, A.fumigatus
LLGEQLLNPVERVASLPENPYAKLITDQSIAIIPSFTLESGVTLYNVPVAYTTRGEMSPNRDNVLVICHALSGSADVADWWGPLLGGPGQAFDTSRFFVICLNSLGSPYGSASAVTYKDGNPEKGLYGPEFPLTTVRDDVRLVSSDIQT

SEQ ID NO: 26482 - protein, 77 aa, A.fumigatus
KFPHVLFHGPPGTGKTSTILALARQLYGDAGMSQMVLELNASDDRSVHNVQTRIKAFASMLTSPLLDQSIPNLVSFS

SEQ ID NO: 26483 - protein, 174 aa, A.fumigatus
GTRPIFKVPLRESPYNMFKLVILDEADTMDHTAQMALRRIIEDYAAFTRFCIITNNIHRLLPALISRCARLRFPPLRPSAIRTLLLQVATTENIQVRPEALEYLSTTSHGDMRQALAVLQECHLNSTFWSDDESTTTISRIKFLMMASETSQQASTSNLPAQGVITVETIREYT

SEQ ID NO: 26484 - protein, 358 aa, A.fumigatus
MSMSTQLAHCTATKSLHRYSISELSTKKIAQHNIPLVQNTAANPYALYKALRQTPDSTDNDKLFDYQNNVMMGNSHAADLLVQKYDGIIRSASKSTLPSSLSLPPMLGPTASPSTAQRHTHKAKPGPKALKAIFRVLERRPKDIGLVLTVVQLYVNAGNTTSAINTLEKLLQNLDESIAEQDKDIRFSPGLLTVLVSLYKLEGRKGQIRSELAKAASHWRNRAEAPVPLLRAAAASLLHSSDRADLSLSGELFKDLYRNGTGDQFAVAGYVASQATLDYAKVESQLESLPPVDELIADVDVAALEQAGISPSSATAAAAAAAIAGARKRTAAESQIRATKRIRKSRLHPRGWKDTRPG

SEQ ID NO: 26485 - protein, 67 aa, A.fumigatus
YYQTTTPYSASQDPYEQAISTIQNSTSLHNGYWSSKFTRLARFQGTEAGSDLFRKINYMRLALYYWP

SEQ ID NO: 26486 - protein, 187 aa, A.fumigatus
ALYDTTFHFIHAEFYSRFTGLKAIFYDMTSLHFFNVVLSLLALFPVVLAQTCWRNTTCSGPKDSAFEGPWERGIYAPSSRTVRPKKVLSITDLSLSSAYAQAMPATLHGNGSLVIFDFGIEVGGIVTLNYTSSGSGALGIAFTEAKNWIGEWSKSSNGAIKGPDGALYANFNSGWKGLDTMPDETLP

SEQ ID NO: 26487 - protein, 101 aa, A.fumigatus
  UNSURE (86),(99): Identity of amino acid sequences at the above locations are unknown.
SHAMRPSIISLVALSLFLGLAYAGGVEKDKRDNVCTVKANGKQKDDVPNLLRAFNECGNGGTIIFPEDQSYWIGARLNPVLNDVSXQWKRKWTVGPPAXCL

SEQ ID NO: 26488 - protein, 289 aa, A.fumigatus
  UNSURE (234): Identity of amino acid sequences at the above locations are unknown.
PILTMPPASTRTCRWMVRQSARWSPSLIARRICRIERLWGNRTRTVLHGWGRKRRKQRLTCAEGRRRNGIAPLSLERSNHADRNARDQELRFTVHESPDYFRLKVSVFNDDKKTDLIGETWIDLKDLIIPGGSQSDQWHPLQYRGKYAGEVRIEMTYYDTRPEDEAVIERRTQAAEKAHAKSNSSRPAPAAPVTSSSSSSSSSSSSSLSGPRQLEKVKRRPFPNDPTAATPARXGPPEKTSPRLVRFIRLQGRPVHHEHAHFMPAMNSPDHIRYSQRQAPKAPDDAFSF

SEQ ID NO: 26489 - protein, 111 aa, A.fumigatus
SRSIIFPQATRASAAVDALRTKMPGFADSFWTPDYATGLGVLYGKLQQGVTENRQILTIASLRADAEEQYGLKLGEIAPSVDRMTAGFAKDDGASVRKVGYSSPFRGRLIC

SEQ ID NO: 26490 - protein, 71 aa, A.fumigatus
LSLLLNVRSGRSLGALIYILLKPMPAADLFYPGICKCDKKKRFGRVWSLIIPFAFLSAVEAASGVSQRVVV

SEQ ID NO: 26491 - protein, 214 aa, A.fumigatus
VILHPFEGGSFADRMRSQAYEGVRSEMIEASKNHQKIASNIRELVVSPFRRWCDQHEARIQNSHDDLQARIKEHTKQVELTKKLRSHYFNKCRVVEDLEEENKLAFQDPETSPKVKATPKIVLPEEQAEEEEPIELGDRVYAPEDLKKLLTHMLDNIKIGEVKVPIIGTYQNTSNGADIVEYIQKYMNGTSISYAERIGQDLVVLLPQGAEGTA

SEQ ID NO: 26492 - protein, 154 aa, A.fumigatus
RREAFMWMMAISGLSSIFTWGSVCFAHIRFRKAWKVQGHSLNELAFQSQAGLVGSWIGFIFNCLVLVAQFWVGFAPIGYSEMTSGELVESWFSVYLAAPVVLVFYFGYKFYYKTSFLRAKDMDLHTGRRELDIQHLIEEERAEQAAWPRMEEGL

SEQ ID NO: 26493 - protein, 474 aa, A.fumigatus
WEQVYTQSMSSIHSWRAVVSRAKSSPNKLTAISLNTMYFFDSNSAVDGCKAKSQPGYEHMEWLRVQLQLLRERGMKAILIGHVPPARTVSKRNWDESCWQKYALWVHQYRDVIVGSVYGHMNIDHFILQDHHNANIVDVDLHETSLEAPNDTTGDISIRSRSAYLSDLRHDWAKLPSPPRDFPMDNSTLDDWFGEGATFENDDDIQFKKSKKKRRQFLKEIGGPWAERYSVSLVSPSVVPNYFPSLRIVKYNITGLEDINAWAGTSVGADILLSLTEKSKERRSHSESIEDPDVDELEKRKDKKKKKKKKKKKKPSFKVPEPPSPTAPPGPAYSNQPLTWLGYTQYFANLTKINIEYYERYGFSTDGLVNETSDKDIFTFEVEYDTTKDDMYKLADLTVRSYFKLASRIAKKASTKDQMSETGATDDLHAAIDNDGDDSRNMKDTKGKMMRNRVWKTFLKRAFVGYYKGDEIDD

SEQ ID NO: 26494 - protein, 301 aa, A.fumigatus
AAGIAAVGVELLTHPLDTLITRLQSPAYASTYQRANGRINPVLYRGLYQGFGPTIITSIPASVAFFTIYEATKSTLQPNEAIPSSKTRELATYAISSAVADLVACAITNPAEVLKQNAQVVHAQSEHSRSPLLSTVRHFSRHPTKLWAGYTMLAAGHLPGTSLTFSIYEYLKSSWFAVPQGSSDVRVHFKGSFYGGALASAVVSLLFVPVDVVKTRMRLAAGTPTFARLPLKADIRPIPPSVKAEGVPSANAVAVAKGILLKEGVRGLFRGGALTCLAAGLGGGLFLGCYDALKVYFGGQG

SEQ ID NO: 26495 - protein, 78 aa, A.fumigatus
HDTQASKAMPYQKDDPLYPQLRKEAVAHFDNMLSFANHLGMFSEEVAISGEQIGNTPQAFSHLACVSAAMNLGEQGER

SEQ ID NO: 26496 - protein, 71 aa, A.fumigatus
TVAQTLDGNSLIESAMHNPVDKDVRYSRTLYVLRHGIQKPIFYTMFMKIRDIYYTSSQRRVEKAAGMSNAP

SEQ ID NO: 26497 - protein, 193 aa, A.fumigatus
RHAPHLIFGAISPETLQWNYSLTGSLGVVDLPVMASLSPTGGINGRYRRYEMMRIQGSVRTLKSPRGRKFDIDAGEIVWSLEENNLQRSGLPREFTFAMLIQKPRADSRIVFSLDIEPTLQSWYGSYPDWWLSLPKYQPQSRRPVDFRSEVGQRFEPAESKKGFNFATLESSFDDYVSMPGKRIAFVGSPKPQ

SEQ ID NO: 26498 - protein, 138 aa, A.fumigatus
LAETETNGNLYRIPANCAFTSQHATPDKAQTNGAPSDRGLGLCNSGLLVINPSKGVYDRIIDQLNSPATMNYTFPDQDLLSDVFRGRWVGIPYIYNALKTLRRKGVHDTIWRDDKVKNVHYILSPKPWDEIDSAAEGH

SEQ ID NO: 26499 - protein, 288 aa, A.fumigatus
IIIATPGLHVQRPLHSCLCRVQTLLHHAPQQWCPPQHCRNQRYAQAESCDPPIDKLTDSFRAVWATLVTNTNYLPGLFTLEYSLRKVGSKYAVVVLYTDSFPAEGHAAVNARGLPKQRVPHLLPTLPKEYTNDPRFHDTWTKLTAFSLVEYERVVLLDSDMLVMQNMDELMDMELDAPELEGSGSRVFAASHACVCNPLKKPHYPKNWYDLSVSRGSSDWLRPRLTETCTGSRPTARLHHSMPLPTRPRQTEHHRTVDLDSATRASSSSIRRKESMIGSLTSSTPPQR

SEQ ID NO: 26500 - protein, 135 aa, A.fumigatus
PVFFMKGSFGARNVPKVLKNVEILGIIQSRKWNVGSLNEFRKFFGLKPYETFEEINSDPDVAESLRSLYDHPDFVELYPGIVAEEAKQPMVPGVGIAPTYTISRAVLSDAVALVRGDRFYTVSHTASFGFSLPPP

SEQ ID NO: 26501 - protein, 182 aa, A.fumigatus
QLFQIDYNPRNLTNWGYSEVRYDLSINQGCIFYKLATRAFPNWFKPDSIYAHYPMTIPSENRKIMKDLGREIHYSWDRPQYTPPRVDLVSYSNAKLVAEQQNQFRAAWGDTVEFVFGKASKEFKLYQDSAFIQKHADVMSKLLNKEEWHRSVKEFYEDITAKLLEDKTRRFGGINQVDITNE

SEQ ID NO: 26502 - protein, 74 aa, A.fumigatus
SKRVAIVGGGCAGVTAFWASQKPPHDVHLFETSAMLDGRIKAVPFEHAGNKVTVNTVPPVFNATASRQCILGSG

SEQ ID NO: 26503 - protein, 202 aa, A.fumigatus
NRRQSYPSPLNYNHFPKSICTSPNEVVCHGIPDQRVLLDGDILNLDVSLYHGGYHADLNETYYVGDKAKADPDSVRLVETTREALDMAIEIVKPGVPIREFGKIIEKHAASRGLVVIKTWGGHGINSEFHPPPWIPHYAKNKAVGTCKPGMTFTIEPILALGGNREKYWPDEWTNVTVDGKRTAQFGVYGPSSCTRCILTWP

SEQ ID NO: 26504 - protein, 125 aa, A.fumigatus
FQNRFPSQPSSLGSGQTRFISFFPGNGSVPPNLLKSGPDWAQRWQFPGVKMGLTSSKLGPFGIKKGQQAMRKVCRLAREVLDITAAAVRPGVTTDYLDEICHNACIERDVSTSHSCMHMSSCLLK

SEQ ID NO: 26505 - protein, 265 aa, A.fumigatus
DSTHTNEVEKHLMAGGAISYLDCFKRVDLRRTEITCCVWISQQLCGTSLMGWAAYYYKQAGFDTSHAFDLTVGTFGLAIAGGVISWFLMPRVGRRRLYLSGLLVLFLTLLTAGCISVASSTQWRLWALGSFLIFMTFVYNITVGPICYVLVAEIPSTRLRVKTVVLARVAYNFSGVLINWMTPNMLSPDEWDWKGKSCFFFAGTTLLCLLWCYWRLPETYGLSYLEIDILFEKKAKKSKFRELQANLQDRGYFGLREDECPFRGY

SEQ ID NO: 26506 - protein, 89 aa, A.fumigatus
IDSLLFDCKYNDLLVKAQVTTEYCVSSLLSSDVSHTQSSIVSALHLWHDYWNKPITKTLIPSRLRSNTSNRARLISWVPSIGRNVMNRH

SEQ ID NO: 26507 - protein, 129 aa, A.fumigatus
CGSFQPRGEDDGETDSTHDTSVYEDTIDKWADMAGAVYSGVTSITVACRWAIKLQPRYVDCVRERKPLALVILAYYCAILHRLRHNWCLDEWGPRVSKALWLVLDERWRPLIYWPMRDIFGQAFEPNLT

SEQ ID NO: 26508 - protein, 157 aa, A.fumigatus
MRAKTIMIRCTTGAGILVTDNQSIGENVIVGGLFVQIIFFGFFVISAFVFQRRITAHATPESVAEYIPWKKHMGALYASSILILVRSVFRVAEYLQGWDGSLLQSEVFIYVLDGLLMWFVMAIFLVVHPSEINCLLGRGKMMTAKGGLQVCEAAPPV

SEQ ID NO: 26509 - protein, 61 aa, A.fumigatus
AAQGPELNKLYILNISAAPDFDISFRFSLSALVQLLLDSKIATPASFLAWLRLQCTSPIHD

SEQ ID NO: 26510 - protein, 66 aa, A.fumigatus
KVSLSNLTRCDVQLTLGDIGDRNQSDYERGPMVTSSMKPCALAAIKIFLPVFCQSLQLDPLLLSLM

SEQ ID NO: 26511 - protein, 134 aa, A.fumigatus
PDTRSQASDLATTSRILVTIVTICKDSGNWNLLNDQVLLLSKKHGQLKQATTRMVQTVMKFLDETPSMDVKLSVIDTLRTVTEGKVNAPARRSSTLSLMSFADFRRSREGSCNTHFVEHQESLPTGLEGAAPCQ

SEQ ID NO: 26512 - protein, 113 aa, A.fumigatus
  UNSURE (94): Identity of amino acid sequences at the above locations are unknown.
TLTMAGSDDHPDGLPVAVSYLAGYIFLSYVVSTMGCATTLELLHRRTSKSGLYNWYNDYCSMYSFTWLTNNYRYILLTSSGTMGGIGIWCMHFXLQLKTMPWFSHLTRDQHCP

SEQ ID NO: 26513 - protein, 61 aa, A.fumigatus
LGPPAGNMLGNLSPEAPGPTLKFFDTGFSILVPGFARAIRLLVLKGHRLVCILQSSQKSRP

SEQ ID NO: 26514 - protein, 138 aa, A.fumigatus
TTPAQDQRTKMAASEKRPEIIALARELKDVPMCEEYERMVSGMMYNPNTPKLLEARHRCRGLTADYNGLDTKTVPYEQIAEKRLELLRRVVGRVGDGTFIEPPFMADYGCNIIIGKNCFINWKYVDPCSRPAIFVVLA

SEQ ID NO: 26515 - protein, 123 aa, A.fumigatus
AELTGGISLTVLDTSLVVIGDRVQIGTNVSIITAGHDTSILSRRKNVEFGHPIFIEDDCWIGANVVILPGVRIGQGSTIGAGSIVTKDIPPFSVALGSPCRVKRTIPSAEEEEQDETNPFRNL

SEQ ID NO: 26516 - protein, 145 aa, A.fumigatus
RQRAYADSHRFLARLTPTSPMERSNYFVEVKRPDETLFEILYRPTTLSEDNPDPAPEDIVIRRERQTFRRLPKTGTIVFGVKTFLTTLDELPMQELQNLAKETKSWPDYVGEYKGREIWGPKVLEFCENRTRSFSQQLESEKLDV

SEQ ID NO: 26517 - protein, 77 aa, A.fumigatus
ESAYALCLYEAIQDYLLANRTSNLLVPRMHGIVKLGDCPTDAFLDCPANRDETGTGGSIGGVSRGQTVSASLQRTSY

SEQ ID NO: 26518 - protein, 200 aa, A.fumigatus
IKKEFLGRDVPNQEDWCNFKKGFRASLFQGYGPPPWGPSTPSLWWTENPRFISTSDDKYMRAWEYAFPVPIKFIAEPNMFAMTRAAPHPNGKYVAFQSGDNQIVVYGATDKFRQNRKKSFRGHNNAGYAIDVKISPDGQFIASGDSGGYVCFWDWKTGKMYHKIMAGGKEGGATTCLDWHPQETSKVVTGGLEGVIKYWD

SEQ ID NO: 26519 - protein, 60 aa, A.fumigatus
SHRTQDAPFIDSPSSPGSIVIILHPATPWSHTPSLHADAYSLGIPEPDRARGEGTRRYRR

SEQ ID NO: 26520 - protein, 71 aa, A.fumigatus
LSILLLLFLWGFWINSFVNCRVLFYSRIFALNMPQIGAVSIIKCVSFNWHACGYSHCERSYSAFVNNCMQL

SEQ ID NO: 26521 - protein, 598 aa, A.fumigatus
  UNSURE (484): Identity of amino acid sequences at the above locations are unknown.
RPPRLVRAWLYKPHSATFLIFSIDPPMEDNSNIRITRSARASRDARAHNMNIPSTPSSTNNTTPNNLNNGRPSRIITLSTRTARANSARQAQANSVREAQANNAPVADTATSTANPLRETRTSRARAAAAAAAGSTVPSTPAGPPAPAPAAADSVASTNIPETPRHKRVKRTPTVEETPRTTRQSARLRGNIQPVSSTEKTFSNSQAESKQPDGSPSAGMAPGGRTRTRSRQMASSLNQKTGDSTRVTSSPSKKNAGRNEENISPLDTVASQLSTRDQMSDLVDEKLSKDNGPDNVENKMNGPLDMESEEKHEPETVPPNSLKRKSPEPDDGRAGEPTPSSDSPRKKPKVENPELDRALDQQLQEGTVINVDDKAALQSQSPGGVDAISAEGEVEASENGALKARATSVAADADVPNVQVAEISALSAANASDKSLEVADAADNDTTAARGSAAGDESRQITEEVEEQVSENGVELRSAVDEAXVVAVGVEAVAWEPSRAAGACRKGKGKSKGPAKGKGKGKLVNRGRKRMGNMNKNSGPDPNLWGPLLRIQATRRSRTRQGELDKGFKKGTAAHTTGFAWVNPTFLRATWRGIKNAL

SEQ ID NO: 26522 - protein, 169 aa, A.fumigatus
TNQSQGLSAETDLLMLYSCLASKTTFHFAAGLCSGLTSSILLQPADLLKTRVQQSQKTASLLPTIKTILSSPHPIRGLWRGTLPSALRTGFGSALYFTSLNALRQGLAQTEAAMAIAASSSDGKSRTSSSALPKLSNWGNLATGAVARTAAGFVMMPVTGSSPGAEGRP

SEQ ID NO: 26523 - protein, 78 aa, A.fumigatus
PRGTVDMKFLSQSRWFLRCCLVGEIVPFATAEIGSCSETEECQTGCCSKAGYCGFGPDFCGDDVCISNCDAVAECGGM

SEQ ID NO: 26524 - protein, 79 aa, A.fumigatus
HLYYSFAGIDPSDFTITTTHDNDADYWEKFTALKQKKSTLKTYISVGGWDLGGKVFSDMVRFPGSRRAFIDSAIAMMNK

SEQ ID NO: 26525 - protein, 69 aa, A.fumigatus
LQAVLISLIYISTWLAYPRLVAWYFIHFLPIESVLPWFLAHFPPISLPFTSHLSPIYLPFTSREPTQNG

SEQ ID NO: 26526 - protein, 88 aa, A.fumigatus
NARSSYFPHHLILFNLSLVFTISSKMPAVDVSSVPVVSGKETAQAVAVLEDLIKNLNISTSADEVHAATGNLATYFSGPIPEQTLPLK

SEQ ID NO: 26527 - protein, 77 aa, A.fumigatus
  UNSURE (63): Identity of amino acid sequences at the above locations are unknown.
LSTRILSASFSSSSSVSPNLRTFPRLFTCSVPPLSFPMSLGPTLAIMVPLLDRGLVERETAIXRKSAVIVDNMCKLR

SEQ ID NO: 26528 - protein, 217 aa, A.fumigatus
  UNSURE (163): Identity of amino acid sequences at the above locations are unknown.
KSLYVLMFDSLRAVEVFQKQLNNKKDATARERACEAIRAIASHQTIAPGVEPHLVSLLGPVLAASGDKMTAVQKAAQSAALAIVQAINANAVKAVVPVILNSLQNAQKWQEKMCALDCLNCLVESAPAQLSFRVPDLIPAVSEAMWDTKADIKKAAYSTMEKXCGLIVNKDIERFILELIKCIAQPENVPETVHLLGATTFVSDVTGPYPRHHGPSA

SEQ ID NO: 26529 - protein, 72 aa, A.fumigatus
SLKARPLRSVHTCAIFLESKYSINFSLLSKIQRPSFTTSRIEARLSSVKIISEASLATSNLPGLSRSQHPHA

SEQ ID NO: 26530 - protein, 72 aa, A.fumigatus
ACGCWDRDRPGRFDVAKDASDIILTDDNLASILEVVKEGRCIFDNNEKFMLYLLSKNIAQVCTLLRGLAFKD

SEQ ID NO: 26531 - protein, 231 aa, A.fumigatus
QHTRILTIMMAVGTKCMVKRNVIVPKLDYLEALGAVTNNCSNKTGTLTQGKMVVKKVWIPSKGIYSMGVSNEPFNPTVSDVTFTPVPPMHFDQEKEGAPIDSLENSVAGNPRLEEFLNVAAMANLSHVYRSEQGEWHVHGEATEIAIQVFASQFNLNRDQWTKDEGAIWHQKAEFQFHSSVKKMSVVFTRLEGQTECSMVFTKGAVERIVDACTSVLWEVSPDPVALMDDH

SEQ ID NO: 26532 - protein, 126 aa, A.fumigatus
QDKALEGANLQCNEVERDLCFLGLIGLYDLLCPETAGAICACYQAGIAVHMVMGDHPGTAKAIAQQVGMVLANLSTAAADVADVMVMTAGEFDKLMDDNVNALPTLLLIIARCAPQTKVWIINTLY

SEQ ID NO: 26533 - protein, 200 aa, A.fumigatus
CRGMLLLVCYRGLSFARTSDPVFCRKKSPWQTLRQDEQMRADISQDVDRCLQENYFFREPATKAKMIDILFIYAKLNPDLGYRQGMHELLAPILWVIHGDAVDGKVLEESSVKEEGDDLMLHLLNFDYVEHDSFALFCSVMQTTRVYYEHNKERSANGQMDEIPIVNQCQHIHQNLLTTTDLELADHLQALEILPQIFLT

SEQ ID NO: 26534 - protein, 92 aa, A.fumigatus
PHTTTTSKMAWAPRDTLRPFLLVARLFAWISAVIVMGITAWAVTKRDGYRVIYPLVIVGLSRYMTGTMLLTLAGRSNNRVFYSCDDSISYET

SEQ ID NO: 26535 - protein, 606 aa, A.fumigatus
ILFGSLASAFQGISLGTMPYHEFYHKLTKNVLYFVYLGIAEFVTVYVSTVGFIYTGEHLTQKIRENYLEAILRQNMAYFDKLGAGEVTTRITADTNLIQDAISEKVGLTLTAFATFVTAFIVAYVKYWKLALICTSTIVALVMVMGGGSRFIVKYSKKSIESYGAGGTVAEEVISSIRNATAFGTQDKLAKQYETHLAEAEKWGVKQQVILGMMIGGMFGIMFSNYGLGFWMGSRFVVGKEVNVGQVLTVLMSILIGSFSLGNVAPNGQAFTNGVAAAAKIYSTIDRRSPLDPYSDEGKVLDHFEGNIEFRNVKHIYPSRPEVTVMEDVSLSMPAGKTTALVGPSGSGKSTVVGLVERFYLPVGGQVLLDGHDIQTLNLRWLRQQISLVTQEPVLFSTTIFRNIEHGLIGTKFEHESKDKIRELVENAARMANAHDFIMALPEGYDTNVGQRGFLLSGGQKQRIAIARAIVSDPKILLLDEATSALDTKSEGVVQAALDKAAEGRTTIVIAHRLSTIKTAHNIVAMVGGKIAEQGTHDELVDRKGTYYKLVEAQRINEEKEAEALEADADMDADDFGQEGVTRIKTAVSSSNSLDAVDENARLELK

SEQ ID NO: 26536 - protein, 196 aa, A.fumigatus
QLGTAIDFLYEASKANEDGTDHVFLHQAILNAKGATQLDCVKTAELNGGITRRVILTKDPENIKAILTGQFADYGKGEEFHEQWKDFLGDSIFATDGELWSRSRHLIRPMFVRDRIVDTEIFEKHVQNLIPLLEGSNSPSGSKAVDVGSLFFRFTLDAATDYLLGQGTNSLHNPETRFAEAFGYVKHRQSEIFRLG

SEQ ID NO: 26537 - protein, 300 aa, A.fumigatus
LNTSDGISMFSFIVAKRKFRRELKVMDDFFQPYIKRALSLTPSELDQKISKRETFLDALARFTRDPRVLRDQIVAVLLAGRDTTAAVLTFCIFELARNPDVVAKLREEISARLGLGPSAQKSSYNDLKEMKYLNAVLNETMRLYPPVPFNVRYSLRDTTLPRGGGPDGLSPVGVRANTRVIYSTMIMQRSAENYDPPGSPNYFDPEKWLPDRWLSGWQPKPWQYIPFNGGPRICLGQQFATIEMGYTVVRILQAFERIHAMPANGKERVEDPVLKFEVTLYPGFGIELCFRARRRRYFTF

SEQ ID NO: 26538 - protein, 375 aa, A.fumigatus
  UNSURE (34): Identity of amino acid sequences at the above locations are unknown.
LLSCIRVCCSVCAIIMPESQPLEERLLKQKRESXQAKQKVAYALAMYKRTFLQSPRLTQAIRTLCTRHPLLSPTVRLLKHWFHCHLFKGHVCDELMELFAVRVFTQSYPWDTPSSVMAGFLRTLHLLSRWDWQQEPLMVDLGGQLDQNAVEVIRTRFDAWRKIDPAMNNVALFVASDIDTDGISWTQYEMPSKVVAARMSSLAKAAVRLMREKGYALDVSDLFHTSLAPYDFVLSLRSKALTEVLAPPPPSSSSSSSKFKNLQQQIIPERADRLTVARTFVRELQACFSPNILFFHGDEQCDVIAGLWNPSTVKPKVWSLKMTYSTKPVALVKPEVKGSEDVSINQTAILNEIARLGAHLIEGIDVYNEDAENSA

SEQ ID NO: 26539 - protein, 71 aa, A.fumigatus
EDHWAVICIGPSHDLIRRLTGNSTYYGRTAIGWYLGLTTLYSLPLRPFRLLDFGELWPVTYITAFTIESCP

SEQ ID NO: 26540 - protein, 84 aa, A.fumigatus
RHQTSQSLDIKRAEDLSSVELLNPLGSLYPHVVALQLQSDDTPWIRAKNSPGYRDPNSWIDVYSTEDYSKPSARRNCGEFIHHI

SEQ ID NO: 26541 - protein, 272 aa, A.fumigatus
  UNSURE (194): Identity of amino acid sequences at the above locations are unknown.
FHGLDPSVPWRALLLDQVLNDFNGLQQYALVDIKYAARVADTGLSDDEAATIPVNVATGFVVFFAESGFGLPLPDSGVDFDYASQKLVVIGAATNCGRYAIQFAKWLGFGVIVAVAGLRTAEELRELGATHVVDRHADDVLRQVRDIVGDELVYALDAFNFGPKQELGVAVLSDSRRGTLATLAPAVGELDRAXIGEKRAGYERRFIRGSCANHSDDFTKLFWERITGWLKAGVIRPSRFRVIDGLDADEINAALDEYRDMTGMKVQVHPNV

SEQ ID NO: 26542 - protein, 182 aa, A.fumigatus
SQTVVTEAVAVALHDSEVDVSSSSEPPPPPSWRQLPRRATEKLCQRHARWANYDIGAWLLNTVDSPDPHPGPQPRRPHPPPQNPKPQPPSHPKKPHSPPQPKREQSIFPQPVVSPPELHPPFEGAFPSEYVSMGILVPGGWIDVAVGCGATVITCELPQKVTGMGVYDVVLVALATATPDMG

SEQ ID NO: 26543 - protein, 70 aa, A.fumigatus
  UNSURE (9): Identity of amino acid sequences at the above locations are unknown.
PPPRINLVXGGYLPSPACTHAVQSGIVSDCTEFYKAIAGDGCYAIATAHDITLAQFIVSYARLRNTINPY

SEQ ID NO: 26544 - protein, 215 aa, A.fumigatus
HNFSVARLGSCLQEGGGGGSEEEETSTSESCSATATASVTTVCDYACPDGASTSCATLCTSLTISCEPTGLVNFAPGTVDADALPLTLLEASDEAMTSAAESVASWLNPKYTSLDPVMISGTTITASATAPAVTTSASITSATAISASSCDIKSTSSSSYCSCDGGYGVTLSTKANKSKTTFLVCDVTPALTISTIKPTTTSTKPSSPRGSKDPR

SEQ ID NO: 26545 - protein, 172 aa, A.fumigatus
LHMIGESGLGKSTLVNTLFNTSLYPPKERTGPSHDIIPKTVSIQSISADIEENGARLRLTVVDTPGFGDFVNNDDSWRPIVENIEQRYDAYLEAENKVNRTNIVDNRIHACVYFIQPTGHSLKPLDIEVMRRLHTKVNLIPVIAKADTLTDEEISLFKQRVSSPRFSSILGQ

SEQ ID NO: 26546 - protein, 76 aa, A.fumigatus
  UNSURE (59): Identity of amino acid sequences at the above locations are unknown.
ILADIQHHSIQIFEGPRYELDDEETIAENQEIMSKVPFAVVGANTEVTTADGRKVRGRXYPWGVIEVDNEEHCDFV

SEQ ID NO: 26547 - protein, 220 aa, A.fumigatus
SAVPSSPVVKIRDSFASSYVVVPTSPPTPRQLSLVILLSSTCYNKTMSVASENPTVEEHLPLESLSPTISSLQQKPGSTTLSLSSLLPGTYPSRSESRIPYDFADSSSDDVASPSSPANGTPASVKESPAPSSPGSPYVERSNPMGAGNAQTVSSKDPKAVAQAATDMKNVVRRKLTGYVGFANLPNQWHRKSVRKGFNFNVMVVGKFRPNGVRKRSQFR

SEQ ID NO: 26548 - protein, 184 aa, A.fumigatus
YVTACFQVNLGQAYLLRGFYFKYCWLLTLWLSMFCWSASFYPQPISNFRRRSTVGLAIDFPTINVLGFVCYTAYTSAFLYSPVIRRQYAARHPSDEESTVRFNDFAFALHAVILSTLVYTQFWPKIWGFKVSRFQTVSKPVLGLFWGSNAAIGIVVCIVLVKSPDGGYDPSTWAWIDVVSGLDD

SEQ ID NO: 26549 - protein, 200 aa, A.fumigatus
RPKSSRIGRPVVKMCGAFGMCVSQLIVAIVGTATSSDVGNKVLIAFVCIYIFFCACSWGPVAWVVTGELFPLKARAKCLSITTATNWLLNWAIAYATPYMVNSGPGNANLQSKVFFIWGGFCFIAFVFVYTCIYETKGLSLEQVDELYGKVSKAWKSSGFVPTVHFTDVRDVAEGHQKASLSQLEVDAQEKHKLEHLEKA

SEQ ID NO: 26550 - protein, 165 aa, A.fumigatus
LGSCSRSRPVPSVSPSPPPPTGCSTGPSPTRLLTWSTAARAMPTCSPRCSSSGVASASSRLSLCTPASTRPRVSLSSKSTSCTARSPRPGSRVVSSPRSTSPMSGMWPKDTRRPVFLSLRLMLKRSTSWNIWRRRKSVSFPLVLLGACIFGSLALLTAHMEIPGL

SEQ ID NO: 26551 - protein, 159 aa, A.fumigatus
LCRWYVAARPWRTRSHLLISWSHKILVVVATVFLTQCVQHGFGKNLLLLVKEKPHDVQLVLKYIAIQVPIVTISTTIARCSFVLYLLAILGNNKKYQIALWTVMVLQFAGNVVSAVLPLSICRNVRILWDPTTKTTCGDVHAVIKFAYYSNSRSPLLSP

SEQ ID NO: 26552 - protein, 61 aa, A.fumigatus
RVIAANSACDLFLAVFPTLIFWNLNLKMRIKISLIILLSLGILYVASPPPLIIMILTRPVP

SEQ ID NO: 26553 - protein, 266 aa, A.fumigatus
PMSSQPLPRVLFFDVFGTVVQWRTSVSEALRDAAQSALRDPEKNLPDAVRAKASSMTQSDWLDITQEWRESYYHFTRNSDLSKPFVSVDEHHYSYLLKLLQAHGLETLFTDAQRWDLALSWHRLAPWPDSVRGLELLNRKFRTCTLSNGNVALLQDLCRHGSLPFTEVLSAEHFGAYKPSPKVYGGAAERFGLEPGECALVAAHLGDLKAAKACGFQTVYVERPKEETLDMEQAREEGYVDIWIDAGCDGFVELARRFSLDIEAKA

SEQ ID NO: 26554 - protein, 92 aa, A.fumigatus
TAWQVQQIRRSLHQSRYPHIPPPVPAPCPTSPPSDAPHKPSGTHRLWQLSDPPDAPPQAHTLPAPVRTSPQPRRRPLATACTPQSALRLAPL

SEQ ID NO: 26555 - protein, 164 aa, A.fumigatus
PAALSQPSTAFSLNCMSPSSSNGNSHFEADHSLIGVRTTDEQTTAFTRSISHLFGAGDQNTFLELLVRGVRLPYLSCVLKDLFDFVKVCLGLNVLCNIIMWALFTRALTASPSTTKVSITNTSANFLITALLGMIVFREKVSGLWWLGAAMMGGGCILVGMRDS

SEQ ID NO: 26556 - protein, 111 aa, A.fumigatus
KKCTVYAPRWVLFPGLDCPVFLGLALTTGSGIVVAAYNLGCFAGSIPTIWVGNWLGRRKTIFLGSAIMVVGAILQCTSYHLPQLIIGRLVTGFGEFIRLNRDIPDSSRSMC

SEQ ID NO: 26557 - protein, 168 aa, A.fumigatus
AVWSSVPDVVWGRWDVDLHGDPGRHCQSRHRCIQSRLCRLPLCVQHLLRHWLVGYDLAVPCRNCASEDPCPGQCLGYVLELDFQLHGRHDYSRGIREHQMADLHYFCRHVSYPYSLVPVQTLTPDSNAAIFPVVYFFYPETTRRSLEEMDRIFRKNRSIFSVVQVATD

SEQ ID NO: 26558 - protein, 143 aa, A.fumigatus
VWDGSIFSGIGAFRERYLTVFSTSYDQGVTGGLLTLESFIKYFPTIALNGPYFESLSPSERSAQSTRQGGYYFQALIALFSSVWRLQLVQVSLLLPIIWDVSPVRFPQSGWVIGWVAARQSSSVLRSWWSERSCSVHPTISRS

SEQ ID NO: 26559 - protein, 331 aa, A.fumigatus
TGISPTQADPCADSDDTGNGMNTSTVPTWQSECCRSNRRGQMVMIEGAMITCGITTSYWIDFGLLFADPNEVAWRFPLAFQIFFAAIILAFVMWLPESPRWLVLKGREDEARQTLTALLGHDADETFVDTEFTAIKATVLEMSKGSFRDMFTMTEDRHFHRTVLAYVNQMFQQISGINLITYYIPVVLEQQLGMDMIKSRLVAACNGTEYFIASWIAVFTIEQFGRRSLMLFGAAGMSISMVILAVTASLGTDASKVACAVFLFVFNTFFAIGWLGMTWLYPAEIVPLKIRAPANALATSSNWIFNFMVVMITPVAFENIKWRTYIIFAVM

SEQ ID NO: 26560 - protein, 121 aa, A.fumigatus
ESFISTRIVMRGSNILEQITLIFVIMINSTFQIGIIFVVLNILLDLLVARYKYFDNGTSGGGWSPIRSGTEPDDPFASFSSTNIITVKTIHSPYHCLVKENIIIDITNNNYSKESGLLSLF

SEQ ID NO: 26561 - protein, 114 aa, A.fumigatus
LSSFLSLSSLLLSPPLLRTSLPPTQQPSPNLRTQTQLSIHFPSISFHPSISLISLSLLFNFSFFFFSVVFRLNPISVTMEGTWFLDTSTALLGFPATKQPPVPTPLLLACSTPI

SEQ ID NO: 26562 - protein, 191 aa, A.fumigatus
  UNSURE (177): Identity of amino acid sequences at the above locations are unknown.
PPCFRVIWGILEFSLGIQLSDEDIKQIRHILDVADRIFVNTKDYFSWEVERDRDPRGQNTVKTVMDSEGKSEQQAKEKLRVAILEDERKYKLLMKQFALSTLDAPAHVQRFLVMLEVLLGGHHIWSAACGRYKRRAPSVGNPFLRRESIIPNRVEDANESAASPVALGNSALLDPSXYIRLHQPPWKIKNP

SEQ ID NO: 26563 - protein, 139 aa, A.fumigatus
RYPILVLLAEVEANLAEEDVRDRDELGHTTDYHKMAASALRASLGVGTVSSMHGLKGNAFMSRHLTAFMTKYGAAGKALMARCLDNWVQPQESRVETEPVNFEDSVARRVVTVGTRYVFLAMAESASLTSLFQGDMGDP

SEQ ID NO: 26564 - protein, 79 aa, A.fumigatus
  UNSURE (15): Identity of amino acid sequences at the above locations are unknown.
RILYFPGRLVKTDVXRWIQESRIAQGYGTRGALIRVLDSVWYDAFSPKEGIPHRWSATFVSSTGSRPDMMAAEKHLKHD

SEQ ID NO: 26565 - protein, 604 aa, A.fumigatus
  UNSURE (62),(84),(85): Identity of amino acid sequences at the above locations are unknown.
PNLYNPDSSLFFRKRYQFRPFSPETYSMPKNFPDCLFGPIPMGNLKLLVSGNYIVWASGVSXKVYVSALNPFSQSCAYQCLGKXXTSVQTREARRYSTSSSSTDPDASRNDSPHGSAVSDYPVVALRGRWLAIVPPSSTYRASICGRVPASLIQGKAFGLETRSPPAKPPVTSATDVGEGESLFDKVARGVTQELVRGARWMGDQGLQAWNSYWNKDQSQNTSSRRSPNFMDLPQQGYSLFPPTHAQETQTTSSTEPDFVSILDLRRLDDGGEAKNAILNPIVTFQAPNGCSFLSFSPNGLMLLTASKKGDVQYVWDLMQARHCRAGVFFSEDSTPPSANVRQVARFARLTTSSIVDVIWSPPSGDRLAVITRKGTVHVFDLPRSAFQWPPFRRARPQPHKSQANNSPTDEATDRGAVTNPLSAAFKLVGGKTQPILAAVRGRTPSASSAFPAVSAFAMPSAAGVRSGRAVAAGLSKSMGAATGTVNTLRHAGENRLHLSGLARDPAAFRVVWISNKGQSFLGVVNNGFFPLYRVKRSMSSHRNRQLQSVIGNKEIEYKLPANLQIPCGPLLIGKFAHEHTVSAILTLPSFKLAGPPIPPRSDA

SEQ ID NO: 26566 - protein, 94 aa, A.fumigatus
DTFFILAQGMRCTNQQILGNLAILEFEESNFIISANALFTLTLLLQEGYGSMTGLCVTTILHHFQYVLLLAGCIKHRLHFLLPVIAGPWFWRLQ

SEQ ID NO: 26567 - protein, 333 aa, A.fumigatus
GEEIRRLLATEDELRSKLYLTMWFSKEGFLWIPVSTKEGLRTDAVIQRSVHIRQSYDVIVIGAGFAGLIAARDLSQKHHLKVLIVEARDRIGGRTWTAQVLGEEMEMGGTWVHWAQPHLYAELHRYGLHRNLKTSSGTYSPEKQFFKQAGRPVEEISLNKAAEALERVAQMFFTVDSTDSRGLMPYPHDPLREPAKWKQYDHWTVKDRLDRLEGLPMWEKQLFESIISTFGSAPGKDIGFTEALRWFALGGHSMKGVFDLAGTYKLGNGGMTSLARAILDEFLGDILLNTAIKEIHQSSPGIKVVTAEGQQLKAKTVISTIPLYGNLSLCIET

SEQ ID NO: 26568 - protein, 205 aa, A.fumigatus
  UNSURE (185): Identity of amino acid sequences at the above locations are unknown.
FHSRYSVRNCLGDVNFDPPLSPVREAAIARGHINKGAKIHFKLKSTEAGWFVTTDPSGDSSYVFGFSDHNGTNSACQSGTWCIGFGYNGHLTDKNDHRHIIKKFQNDLRFSADIEAYATHDWMNDPYAKGAWACWGPSCASMYLEELQRAHGRVIFASADWANGWRGCINGAIERGQCAVQEVVXMLKEKIWHSPATFMMVENAK

SEQ ID NO: 26569 - protein, 218 aa, A.fumigatus
  UNSURE (201): Identity of amino acid sequences at the above locations are unknown.
AALVSVSFLIPFAIYGVTLYNGQMVKCNDGSIVGSLDQCINEYLSSPYNWDVLAPRVASNPFYDFDNFGDALFILFQIVSQEGWIDVQNSAMSITGKDMQPQSFAAPANGLFFIMFNLLGAVFVLTLFVSVFMRNYTEQTGVAFLTAEQRSWLELRKLLRQISPSKRSLDRKSSKWKLLCYRNAGKKHGPLARCVTSILGXHSLLVVPEFYPDPYFGN

SEQ ID NO: 26570 - protein, 187 aa, A.fumigatus
  UNSURE (17): Identity of amino acid sequences at the above locations are unknown.
QSCSGICFNALLGQERXNQRVEGVDPYKPVWYTFSAFVYAAIVAMVLIACITTPIYQRNYQVQWHGEVMPWYVYTDTGFAILFTIEALIKVIADGFFWTPNAYFRGSWGFIDGIVLITLWINVGSSLFKDWGVSRAIGAFKALRALRLLNVSDSAKDTFHSVIIVGGWKVIAVSLGLRFVIWSKDAH

SEQ ID NO: 26571 - protein, 414 aa, A.fumigatus
VMSIKLRSSSAASIVLLVSSIPPMPLSIAMTPKNQAAWIPAKKARPFKVGDAPYTPAGPGQVVVRNTAVAINPFDWVLQFIGPAIASYIKYPFIFGTDVAGEVVEVGPDVERFRVGDRVFGSATAIAKEVNRPAEGGFQLYTVMRQHMLAPTPAHITDEQACVLGLGLLTAAWGLFHPNYLGLDMPQVPAPTGAVGKSGLPRAVIITGGASSVGSNAVQLAVSAGYQVLSTSSPKNFEYVKGLGATQVFDYRSRTLSKDLLAALRGHELVGALTIGRGAVEACTAVMKHHDVRLTRKRIAVAGAIIPAEKLTTFVGKGTYLMGMVGGMIKSNARRRRTGVEAKFILLDGLVDPESIVARIYREFLPLALERHQFVPAPPTHVVGKGLNKIQDALELQRMSSPRGWKDPRWRDVR

SEQ ID NO: 26572 - protein, 317 aa, A.fumigatus
RLKRRARQLAGIDVRKAAQTMQEFVPETHETFLKALEDDGYKQYQYLLVVVESPTRDVAEAGAPRNVANWMIERYVQLLCRYNPSHVAEFVDDLRAGDVHLEELLPAMEESGVVDAAVILLVRQGQVRAAMDRLIAHLGALQSGLVGILQSARESPDSASTAEAITDLLESLDKYAHVGIWLCQSQSQTTKTSRPERNGTGSKVALDQPLSFNETLWLDLIEAVVRTASSVFALVRGQQVYDGKLTQMAPETSSPGDNTAQLMSSVRTLVQQVFTALLSSTVKLGGATPSAERTDVTFLRILRAFLTRAASWSPSRL

SEQ ID NO: 26573 - protein, 83 aa, A.fumigatus
ALKFFYSNQTNLALKGIIGIEAMATISKLTHHADAATNRSAIAHDYIDRWQVLGIAHEADPPHTTLSYGSNDSHGQFHFSSSF

SEQ ID NO: 26574 - protein, 210 aa, A.fumigatus
VYTVAGICLTLAMFQLEFFHYDYSTANKLSSALDERIARDSVAAAGQDYLTITSLSARQAFAATQLCGTLQNPYLFMKEISSNGNMNTVDVIFPAHPVFLYTNPELLELLMKPHFEIQESGQYPNAYAMHDIGTHYPNATGHPEGNDEPMPLEECGNMIIMALAYALKSSNTDYLNEHYPLLEQWTSYLVDEAIYPANQISTDDFAGPLA

SEQ ID NO: 26575 - protein, 80 aa, A.fumigatus
SITGLLYNLYADRELGLNLVPQSVYDMQSHFYPTVQKKYGVPLDTRHQYTKGEFLAFRIPTCLHCVFAFKEIFSNLTRVF

SEQ ID NO: 26576 - protein, 84 aa, A.fumigatus
WMATKPKAVEVNYPPQMFLGWTTNRITGYINQIVSSTASNPNLAQVGFKAGLESVILINPSQASVSPGSSPRGWEDPSRRTCHR

SEQ ID NO: 26577 - protein, 80 aa, A.fumigatus
STMTRSHMSLDERADVVEDIIHYDFNNRSILYEALRSAGALALTGRAHRSDGNKDLAQVGDAVLQLILVMDGYEAKGSRG

SEQ ID NO: 26578 - protein, 410 aa, A.fumigatus
  UNSURE (15): Identity of amino acid sequences at the above locations are unknown.
RVEETEQPVIPLPSXVNSHKEFLLSSDKPDILALKPPSILPACRFLLSRPLSLYMRSLAYRNETWRIPQVVAEVQKAGFPLTTFNWSTYVQMMASSDKPSDQVEAFTVFERKFMPNFPGWNNLRRGYGVRPPGVPSTIDVMENPRRAKPPNMLGKESRRYWSKIQPDFMQPTYVSMVYLASALQAFRERSIYDGGLEVGTLFKVAPKTIAAIADMPYLREKFQGVLLRRRQEQGDKKGDSGDRDHFVWTGGILGVGGKPRSPTAVERPAMEADQEENASASARPQPDVTDDEAPDAPNAPAVEAGLSPEEVSAPNAKSIDPQDQFDIEAEALLGSRRALLEASEALLDNEHRASADEVDETDISSLIDDLANPDEDAPKSADGRQQQEPPTEHQGQPEQEHHNNGMAHDA

SEQ ID NO: 26579 - protein, 251 aa, A.fumigatus
IDSITGPYASAVLRFQLRFPDSYPELPPIVTFSTDVFHPLIVPLTTYTFSTGASTEDPVSATDEERLPPGGFSLRHGFPHWFGRARKTGRQSTGSSRPVSVNGRNAGEGETASTDGPSSPSSDQPTGAEGGQNLTKDKGTASDARKTVPVAVLLNYIRSTFDDENVLDSLPLEAAGNPSAWHAWKAHRRENSESATSNSKRGSPQARLPGDWHWDGIWAKRVQYEIEASHSDQMLFGNAARGATDEMVCMR

SEQ ID NO: 26580 - protein, 125 aa, A.fumigatus
IPKRREHPLLVSIPVPIASQTFWITLIMSNDWFYRYQTTILAVVLVFVPIIVVCSIFMTALACSEYWSTRRGCSFSYFTCICGLRSRSQRQRPLSDTDDANSSERTVSSRPSAENKNPVLRTERA

SEQ ID NO: 26581 - protein, 77 aa, A.fumigatus
LGFYSGAFDGVIAACSRFPPMLYIGLTAFFSGVTCAGNPILNSRPSCPSARIPFRREDWGLSYLAWDVVFKQSSFPI

SEQ ID NO: 26582 - protein, 139 aa, A.fumigatus
YGKPRGKSRARKAAMKLTPLAVEQLRKLLSQPDPKFIRVGVKNRGCSGLAYHLEYVEKPGAFDEVVEQDGVKVLIDSKALFSIIGSEMDWQEDKLSRKFVFRNPNISESLSFYTSLPRYSSSNVEITEEQCGCGESFMV

SEQ ID NO: 26583 - protein, 353 aa, A.fumigatus
LVQMRPSSRDEFSTAIICALTLEAEAVEELFDEIYDRLSGYYRKQPGDDNAYINGRIGNHNVVVCCMPGMGKGNAASVASSLKISYQRINLALVVGICGGAPYPSSGGEIFLGDVIISDSVIQYDFGGQYPGGFEEKTSVKDSLGRPNKEIRALLAGLQAKNTRRDLQARMLRHLQAIQRSNPEWHWPRSADDILFEASYQHKYSSPTSSVYCCLDGKSRDVCKSALDMTCIHLGCDKNRISRHRCDAEKCIPSIHIGTVASADTVMKSGEHRDRLVKADNVIGFEMESAGVWDNASCIVIKGVCDYADSHKNEAWQAYAAATGAATAKAFLEYWIPTVREGKYTNLGEVFLY

SEQ ID NO: 26584 - protein, 63 aa, A.fumigatus
GMYPFRINFPVVPGSDGAGEVVEVGSKVTQFKKGDKVVTLFNQLHQYGPLDTRSLHGRVQVSV

SEQ ID NO: 26585 - protein, 99 aa, A.fumigatus
LKASFDHNIPSIDSPENSTPYVRKMAPSTMKQWVVADKENGFDSLNFKEGPVPKCGENEVLVKLRAASLNYRDLIIPKVRRFIYARDSMSKSAFCHAHF

SEQ ID NO: 26586 - protein, 325 aa, A.fumigatus
VVNDDGPPSNKSSPYVHSLVHTLQSAGHVVSVVLPHQQRSWIGKAHLIGASVRPTYFRPGILHEDNGTIHDFPRTDDDDDGDEWLLIDSTPASCVQIGLFHYFQERGPVDVVVSGPNYGRNTTALFALSSGTIGGALEAAHCGKRAIALSYAFSSRNHDPVVIAEASQHSVRLIEYLCENWAEGVDLYNINVPLEPGMSKCKVLYTSMLDNRWTGSCFQAVDAALPDETPQVQEQRLRDQGERLGEKPTAAPGAGPRRRIRFQHKHFQWNPDFTDVWKSVEASGPGNDGRAVREGMTRYVCILDPVSYSSLYWSVADSLRSVLPL

SEQ ID NO: 26587 - protein, 319 aa, A.fumigatus
GLIPGIGVMLGEPSLGLGTNPLYRTVGPEDMLSILALSMPSFTALLGDSDRIISAVSGISSHVIGPLLRSRLFPNNINGSVMSLLQHIAKVPAAAKIWKKDIADAFNDPRFFGFQVELVRSGWMKLLRQWVIADKDRLTELMSRLPPPSTAGLMFGVGASAARLEADRKAQLNLRRISLLILSANDDYFIGELPELLQKLEDLLAATSSSSPSSTTRAEIFMVLRALALKSSTTTLAPFWPLITTELQEAISSIPLGAQQEVYNAYSLLQACKLLDTLLVLAPDDFQLLEWLYVHDTIDAVYPPEHRESMALADENSQT

SEQ ID NO: 26588 - protein, 79 aa, A.fumigatus
SQGWLPQHYSNPRDQPLSLPVKIAGSTANNSSWLKFKTGTAWGKTWGKTYPLGSFLFRSMVPQRVFSPTLAPYKLSPNS

SEQ ID NO: 26589 - protein, 74 aa, A.fumigatus
LTLSTASSTFLKRKGGLFKKAHELAVLCSVDVAVIIFGHNKKLYEFSSCDMRETLGRYQYVRSLHYPHQFSTLT

SEQ ID NO: 26590 - protein, 374 aa, A.fumigatus
SGPLQPRGEDTISTLLLTAPSLSAAFYLPGVAPTSYDEGQAVPLYVNHLTPGLAQQDEQLHSVFSYDYYHTAFHFCRPADGPKDIRESLGSILFGDRIQTSPFELFMGKNESCKAVCGEVKFDSRSAKFVNRRIAQGYNINWLVDGLPGAQLNLDAVTQSKFYSPGFALGTLNDDGQAILNNHYDIVIDYHRVGFGSKDKYRVVGVLVQPASRRDSKVLEDGTVDCGSDNAAVILSEDGETPVTWTYGVYWRESPTPWATRWDKYLHVYDPKIHWFSLINSAVFVVFLVGMVSMILLRALRKDIARYNRLDTINLEDLDGTSAAIEDGIQEDSGWKLVHGDVFRCPRDPLILSVLVGNGAQIFMMTGVTVGKFF

SEQ ID NO: 26591 - protein, 159 aa, A.fumigatus
LPVSSNSVSVSPDDSRSSPYPSSPWENSVCVLFRFFPVRAACSAAKCVLVDPEARALAASPMAASTQTPHANSTSSLSSSARRSTPRAASASERTAVCTAMPGGGEMAYLNVRSETRMAPSEVAWDVILGRETRDFWATARARESVPWVSTASMWMGFG

SEQ ID NO: 26592 - protein, 230 aa, A.fumigatus
  UNSURE (162): Identity of amino acid sequences at the above locations are unknown.
KAGIWGWNNFFQGLKVGIIIPQFKTRSFLFSPRFSGVSGTLLKKFGLGFILLPSPLYELTCIPYLPNGAPRSFPWFLEQELRPASYTMGSISPEKAKLSSSLPWVETPLVESLGLSRAQGCRIFLKLENIQPAGSFKSRAMANRSLSHLVKPENGGPAGAFXCFLGGQCRSRCGVRCPELGLSLHRGCAPLDKAPDGEQTAGGGRFGRHPVRRDILGSGRVYAGSDNEGR

SEQ ID NO: 26593 - protein, 422 aa, A.fumigatus
  UNSURE (36): Identity of amino acid sequences at the above locations are unknown.
NSRTFSQRDPSNPVQWQTDPSRTSSSRKTVGRPVHXYASSGGNAGLAAVCAARSLGYPCTVVVPLSTKPLMVNKLRAAGASDVIQYGETFSEAGEYMREVIMKADDGDAGTDVVKIALHPFDNEPIWEGNSTIIDELAAQLPPVTTREEAIAYSGRALPLDAVICSVGGGGLLNGLIMGLERRRHLQNQSSHYSNDIISSQPNPIHILAVETQGTDSLALAVAQKSLVSLPKITSQATSLGAIRVSERTFKYAISPPPGIAVHTAVLSDADAARGVLRLADDERLLVELACGVCVEAAIGDAAKARASGSTSTHLAAEQAALTGKKRKRTQTEFSQGDEGYGDDRLSSGETETELEETGSQPQGHPTENTLSPLHEFQSKLKQLVPNLQPDSRVVIIVCGGSNVTIDMAAEWRKMLQEGWDA

SEQ ID NO: 26594 - protein, 354 aa, A.fumigatus
RTPIKYFDNKVVCSLIEDKRPPGVFAALNDACATAHADSSAADNTFVGRLNFLSQNPNFENRQGQFIIKHYAGDVSYAVAGMTDKNKDQLLKDLLNLVGTSGNQFVHTLFPEQVNQDDKRRPPTASDKIKASANDLVATLMKAQPSYIRTIKPNDNKAPREYNVGNVLHQIKYLGLQENVRIRRAGFAYRQTFDKFVERFYLLSPKTSYAGDYTWTGDAESGARQILKDTSIPAEEYQMGITKVFVKTPETLFALEAMRDRYWHNMAIRIQRAWRNYLRYRTECAIRIQRFWRRTTGGLEFIKLRDQGHQLLNGRKERRRMSLLGSRRFLGDYIGVGNKGGPGEMVRNGAGISG

SEQ ID NO: 26595 - protein, 76 aa, A.fumigatus
  UNSURE (27): Identity of amino acid sequences at the above locations are unknown.
QTNRHVYIIAQNLVNNQLVISSERTIXIGAFKAGGASNLKDEWVSMGVGSHKNLTLLVTAGSERVFKPLDKALGGQ

SEQ ID NO: 26596 - protein, 79 aa, A.fumigatus
HYLTDPFNVSLRGPACKILEPNPCCFHFLYFCFCFGSPSYSEGTFTLSSTGPHFTCEPDEGDNCDRNSQLHWDGRSTVS

SEQ ID NO: 26597 - protein, 62 aa, A.fumigatus
WSMPIRRLKILRDMMKSKAQLRPKYLFVEQQPLDSGIRCVGDDLSYLVTWLCSERDTDTLHD

SEQ ID NO: 26598 - protein, 206 aa, A.fumigatus
WMFGWIIHPFSCVTGPDMLQPSSESSLAGKTCLVTGGAGGLGKAIASTFLAAGANVVVCDVNEDRLQQTSSELGETDRLKTVRADITSASAVQTLFDEIIADFGKLDILVNNAGIMDRFDPVGDLDEALWDKVIGVNLTAPFLLSKLAVRNMLAQPTPDGCIINIVSVAGKAGWATGMFSNDRGNPLANTQLGAAYTAEQPRSWSD

SEQ ID NO: 26599 - protein, 211 aa, A.fumigatus
WVQSDQDRGCSAVYAAPNWVLARGLPRSLENIPVAQPALPATETMLMIHPSGVGCASIFRTASLLSRKGAVRFTPMTLSHSASSRSPTGSNLSMIPALLTKMSSFPKSAIISSKRVCTALAEVMSALTVFNRSVSPSSEEVCCSRSSLTSQTTTFAPAARKVDAMALPSPPAPPVTRQVLPASELSDDGWSISGPVTHENGWMIQPNIHHA

SEQ ID NO: 26600 - protein, 155 aa, A.fumigatus
VSMPALISLCARNLEDSDVSPLTASDFEGCGARVQTDYVIHFSELCTMISYIVRERFGLRVSSERRKAALQEADEALANWSLRLPEHLRLRASDMDPWSAMLHLTYNNFLILLHRPHPRASAYSDEYGPHDAKICTAAAGVFTSIFEKLRLNDRL

SEQ ID NO: 26601 - protein, 357 aa, A.fumigatus
NTDCRIEHKKKRLAVRSILNPVPIRCRPPSTSEHVPEASPPSTISEPTAFTTAFRGVQPEAAAPPASVAPNVQSKAQHLHSNSYSQTSPQAQECHLPPASDRFAEQDAHADFEKRLVKLIDDEEGSGPREIQRGVRAIYVGHELSNMSFLIRQQRDKDDDVYHFAGSEIPRRQLKTGHDQLLVDALTLPEPALVDELVQAYFTHVNPGYPIVEEDQFMSQYRNRDPSDPPPILLLQAILLVGCHVTHPKEERDALKAIFFRRAKWLFDNRIERNRDTLVQAALLLTWHSDSPDDDVSANAHYWVGVAARIATGLGMHRNPVSSRFAPRDRRMWRRLWYILVQLDVMVSLSYGRPQAM

SEQ ID NO: 26602 - protein, 170 aa, A.fumigatus
TTIANTSANLWTSRWSVCSAAARTLLSTNTREGRSRLEEPSRQRQKQRRVGEKGERERPPERRPERRRERLRRRLRQNRQSAEVLLTKPMKSRTPRRPEMTLKKLSLSRIKTLQVSVAPYMLRRHAGSQAMRRTISQTTATTDSQALRTTDGTRGVIPCKVRTVPGTTEL

SEQ ID NO: 26603 - protein, 370 aa, A.fumigatus
  UNSURE (349),(355): Identity of amino acid sequences at the above locations are unknown.
EKMIHYHRTTPLPPPKEVKKGGNKGRKSKEEKDKEEEDDDEEDEEEKKKNRDPAKTGALLSFPDRAAAIVRIFHTNKSTCKRMLDYHCKYVSEFVDVPLECLLRCRANIIVNEHKGGQIKTGRAVEAAAKTEAGGGKRRTGKATGKATRKAKGKAEAEAEAEPPVGGGSADEAHEVEDAEKAGNDSQEIVAVQDQDTSGQRGPLYASAARGQSSYAQNDQSNYGHNGQSSSAHNGRHSRGYSMQGQDSTGYNRVMSNAEHNQGMTYTGQYQGVTNAGHNQVISNHGHVPGMTYTGQYQGVTIAGHNQGMNNDRHVQGITYTGQYQGVTNTGHIQSMTYNGYNNIGTGVXNASPIXRCLRSDPEVILVTAT

SEQ ID NO: 26604 - protein, 482 aa, A.fumigatus
RIRSARFLPYTVNFHDNDSEDPAGDLTSPPVSNPPSQAVTPAPNAAISLFERQNDARKAGLTPGATTDHERIFTSDITKAEQEPSSYPFPAVPDDANLLTESEAHSPAWGATTALNQPKARPPISPSPSILKHQEPTVSVLEPIREKTPLKIEPFRSHPPDKAEDRSRKTSFSKAEWTVETAEQGNGGLRNAVRSATDAGQLEDKVWVGTLGMPTDALSPHTKAAIAEKLEDEYGSLTVYVSDGDFDGHYTHFCKTILWPVFHYQIPDNPKSKAYEDHSWIYYVKNTPGVRGAHREDLERGDSIWVQDYHLLLVPAMLRKLLPDAQIGFFLHIAFPSSEVFRCLAPRKELLEGMLGANLIGFQTDEYCRHFLQTCSRILCVEATNEGLELEDRFVNVGTFPIGIDPTSWDKRRQAADVEQWVKTISERYEGKYLIVSRDKIDSVRGIRQKLLSYELFLNTYPEWRNKASTFLAAICAITRLR

SEQ ID NO: 26605 - protein, 78 aa, A.fumigatus
LTSSSRVENLKDMVLYRFGSTGVVQCLSRAAELLGLVPVFPVKNVHTFSSGSGNAVFRDCVLVKKWVLLQSDINEVYD

SEQ ID NO: 26606 - protein, 85 aa, A.fumigatus
  UNSURE (15): Identity of amino acid sequences at the above locations are unknown.
NITDDNSLLLGRDSXNHLTSFILHTDYRFWCLKNFLLNWRSLLKPSLLGHACWLGISANPAPSFFPLQPGTEISVRRYCFSRWPP

SEQ ID NO: 26607 - protein, 128 aa, A.fumigatus
DSLSYQCVCSNGISPNTSEYSQTIPYYLCTEANNECVSRCSEADSACQSACRSEHPCGAQNPTRYNVTTTSATSNPTNNPATTTTLAAFTGEATNKNAAVRISPVDIGHVYGLCVVVGCFIAGFAVLL

SEQ ID NO: 26608 - protein, 218 aa, A.fumigatus
  UNSURE (47),(79),(126),(127),(128),(129),(130),(131),(132),(137),(138),(139),(141),(142),(143),(145),(149),(150),(156),(157),(161),(162),(164),(166),(167),(170),(171),(174),(178),(190),(192),(195),(19: Identity of amino acid sequences at the above locations are unknown.
RTRQSGGNDTDLRVRLVAQVDDDGALARGTALLDCEADTALREGLRXGRQLRENGGGAVEVGRCGVAAVLADDPAQGRXGRCLCGGDVVAVKAHACLEAEGVAGREAGEPDLLRVGQKELSDLSWXXXXXXXGGGGXXXPXXXGXPGRXXGGGPGXXGGPXXGXGXXAGXXPPXPGPXRRAPPGGAPPRXPXPGXXXPAPAPGGPRGAPXRPRAXXPP

SEQ ID NO: 26609 - protein, 166 aa, A.fumigatus
PVVGYTQGGSNADVVLADAYVKGISDGIEWEAGYATVQKDAEEEPYYWSNEGRGGLNSWKSLKYIPVEDFDYVGFGTMTRSISRTLEYTNNDFTISQMARGMKKTADAEKYESTSGYWRNLFREDQTSFVNGSDTGFKGFFQPRYLNGTWGSQVGLPRLALAEFAD

SEQ ID NO: 26610 - protein, 247 aa, A.fumigatus
LDSSFVPHDMAALVTLLGGPDRYVQRLDYLHDKGITYIGNEPSFLTVFQYHYAGRPAKSASRAHFYIPNLYFNPTPAGLPGNDDSGAMGSFVAMSMMGLFPIPGQSVYLISAPFFEVVRIQSPLTGRTATVRAVNFDPTYQNIYIQSATLNGKPYAKNWVDHDFFTKGKELVLVLGRNESRWGTAEEDRPPSLSTRGGASSSGLRQRMVDFDPAALQFGEYGHARRRRHSFPFAYRHHAVAKEFTHT

SEQ ID NO: 26611 - protein, 219 aa, A.fumigatus
  UNSURE (3),(4),(9),(21),(22),(23),(26),(27),(28),(41),(44),(45),(48),(49),(52),(54),(57),(58),(62),(69),(70),(74),(76),(77),(78),(80),(81),(82),(86),(87),(88),(89),(90),(91),(92),(93),(140),(171): Identity of amino acid sequences at the above locations are unknown.
GGXXARGRXGAPRGPPGAGAXXXGPXXXARGGAPPGGARRXGPXXGGXXPAXPXPPXXGPPXPPGPPPXXRPGXPXXXGXXXPPPXXXXXXXXHERSLSSFCPTRSKSGSPASRPATPSASRQACAFTATTSPPHRHLPXRPWAGSSARTAATPQRPTSTAPPPFSRSWRXPRRPSRSAVSASQSRRAVPRARAPSSSTWATSRTRRSVSLPPDCRVRH

SEQ ID NO: 26612 - protein, 148 aa, A.fumigatus
  UNSURE (41),(73): Identity of amino acid sequences at the above locations are unknown.
ALSVQPGASPARRPRGPRLPPPRGRHVPLRQRHLHRTDTSXCGLGLGRRQGPPRPRNGQLQRRRHHSPAAGVXREDPLAAPCRLHSREGQSRARGRHRRRPGRRVAPADRCHYLRTAESVTRRYEYRYGLYQERHAQEGDRGWGVGPE

SEQ ID NO: 26613 - protein, 269 aa, A.fumigatus
  UNSURE (3),(4),(9),(22),(23),(24),(27),(29),(41),(45),(48),(49),(52),(53),(55),(57),(58),(62),(63),(69),(70),(74),(76),(77),(78),(80),(81),(82),(87),(88),(89),(90),(91),(92),(93),(140),(172): Identity of amino acid sequences at the above locations are unknown.
GGXXRAGPXGRPPGAPRGGGGXXXPGXGXPGGGAPRRGAAXGPRXGGXXPRXXPXPXXGAPXXPRAPPXXPPGXPXXXRXXXPPPPXXXXXXXPRKVTELFLSNPEQVRLAGLAARDSLRLEAGMCLYGNDISTAQTPPXAALGWVVGKDRRDPATANFNGAATILPQLASXAKTLSQRRVGFTVEKGSPAREGAIVVDLGDESHPQIGVITSGLPSPSLGGTNIAMGYIKNGMHKKGTEVGVLVRNKVRKATVTGMPWVESKFYRPKA

SEQ ID NO: 26614 - protein, 106 aa, A.fumigatus
GSTALTWNFSRESGKLVKDLSHIAVTFGRPEKNVISIEMHHGARKGVATLRTVRTLINNLIIGVTRGFKYKMRYVYAHFPINVNIEKNSETGQYEVEIRYAAHNPN

SEQ ID NO: 26615 - protein, 70 aa, A.fumigatus
TPIDLERILKLTWELLISHGVESCNGNNAPTDFKSLLSSIPGTSNSNNNYFSPIRLLQNLSLGASFILSE

SEQ ID NO: 26616 - protein, 71 aa, A.fumigatus
RVVLTGFAIVRNFLGEKIVRRVTAQPGVEVAISSNVKDELQLTGNSLEAVSQSAADIQQICRVRNKDIRKV

SEQ ID NO: 26617 - protein, 113 aa, A.fumigatus
DRLYARIQSPHFRRVSGMRNISTTVTPDFLRLYNANALLAVRVVHDGNYLHAGTTCRISFRNAAADFLEGAGARDTEPVTPGYGEGETQGSQGGRAHVNITTLGEGADMAWWD

SEQ ID NO: 26618 - protein, 539 aa, A.fumigatus
IHVSSLMPAIASPATDAKLLPTAKATNWFVIRAIESGGFNAENDPRAFEALLKVTPHVVPPWSNNTSPMEEDVESLTLGQLYDDTSALAGLMEYNIRFFASQRLCTDALDAFSWLQEVVDASKLQRIREFSERVGQSDTAGLPSFDANSLESFKPFESSMPQMSIVTVAELLDLVTTSRAFAFGEWLFFSNDIDGPPIPPSAYGNQALAPSIIRFASATKNEALCNSVVRSLSQPLSLNTMRALLNFRIAMGQWDSATMMLEYVRDYRLKSWGYSNVTALAAALVRMDHALKQQPSTERQSDLDRAKDLLLRLLNGEFNESCHSKTSFQDRFIHSIRRVFLTIPGSLREVAQKTHLKYKATARSNLPYIPATAFHALLSAVVDTHGSAAGKRLWEQWCLDVRSPTFSRLQEGGITRLYLQRERDPRKGDPHFDPRYFAQTQKKAVLPNPNTVRIIAQQAVKEYTEFDEARRRQQADQHKQQDSNPAREVVEFCIRQFQAFRVPWREINRELRGLVYRMHREKKKERKKMGRDGASTPNK

SEQ ID NO: 26619 - protein, 426 aa, A.fumigatus
CDWLTFSIEAGNYAIDIFKRAGETAGGVASGFFQELQNVAEQTHRGWQKTTEDIEVPEWLQKILRLDEGSHDGSGGSSGGGSPKESRAGAGVVGVAAGSAFGYSQSDEDEVRHARQIAEDDQMMLLTRKMIEIRNILQTVGQSGTLTLPSIVVIGSQSSGKSSVLEAIVGHEFLPKGTNMVTRRPIELTLVNTPNAQSEYGEFPALGLGKITDFSQIQRTLTDLNLAVPERDCVSDDPIKLTIYSPNVPDLSLIDLPGYIQVAGKDQPPELKQKIADLCDKYIQPPNVILAISAADVDLANSTALRASRRVDPRGERTIGVITKMDLVDPERRFSILSDQKYPLRLGYVRVVSRVPQNTALFSRVSAISLMRFSRMRMPTFRLIRPNSVLHPVYQWAFPRCQGNSFLFLTQHCRQPNPVLRELFPQ

SEQ ID NO: 26620 - protein, 376 aa, A.fumigatus
  UNSURE (375): Identity of amino acid sequences at the above locations are unknown.
RRPVTNFVTLSYRLPRTGRSAIRSWRRQYANGNGRAPESSAPSSNWLRTALGLGGTAAATFLVYTFATTRSDQLESAIEAKTVTPKIAQDLDSQYVQEKKSLKSPGVYLWGNNTYRVVDPTSKESVVKTPRQLPYFEGQVLRDLKISEKSGAAITENGDLVQWGKGYSETDFKPTKTLTGKDLRSLCMSSDRILALASNGNVYSLPIAKDDQESGRKPKEGSWFPFSSGRAGVSYRLLEPALRLGEKVTAISGGLQHALLLTNSGRVFSVASSTEGYPSFGQLGVPGLTWSTRPQGPVDTCHEVKTLSNSKVTEVATGDYHSLALTKDGNVYAFGDNSFGQLGSEFDPAQPFNDTPTLVPLKLFYPRKSCLRQGXE

SEQ ID NO: 26621 - protein, 234 aa, A.fumigatus
  UNSURE (40): Identity of amino acid sequences at the above locations are unknown.
SMLLSFHAVHTGRWSNQDRMAGAQDLDRPFLAFSQDMPPXWQPERRILQYPLPHVYGQEMDIYRDRHVTQTWNVVRQVRIQLNEYLVDCYETLNAVHGVNQLAASEAALSDIAALSLEVYASVPQYASYACRSKRSQGQADNTDLSVVSQKGCNKVHTPSELLDCYTLLFPMYVAARSKAATADQRRWVSYMFRYISDHFGIRNALLLAQLLDQNSDISPWCIYAMLGGYGFAA

SEQ ID NO: 26622 - protein, 265 aa, A.fumigatus
NTMFCNTSIHSLEVPTEVSSRARMLTGVDDRFLTDSIGNVFAGASLPYGMAKAVADTNSPSNQGGFTLDGSNITGFSSLHDSGTGGNPSLGNFPLFPYPKCKGDDVNGCAYPKKERHIGYHADSVKASPGYFALTMNSGIKVDMTVSHHTSLFRFQFPTDGASSPLILLDLTDLSDSRQDNGTISVDASTGRMTGHARFLPSFGSGSYVPYFCVDFQSNSAVRDNGIFVNSRASTDVKELRISRNIKGYPLPVSQLAGSFNRNLF

SEQ ID NO: 26623 - protein, 117 aa, A.fumigatus
LPSMLSCARSRVAAFSTAWTPRFVARASYSTTMPRLTENRMQANDPTSRTPEPNVSATNATPTDSQGVWDAPLREEPEAGERNRQLQAPNRATTWAASQQPREKAMTGPRFEQTIME

SEQ ID NO: 26624 - protein, 82 aa, A.fumigatus
AQQVIRHLSAGIRWEFTDIEETVKYYRSHSCIYTMLKCTCLILEDCTQYQTEGPLPALFTGCANCCLVALLDNSSCRISRIL

SEQ ID NO: 26625 - protein, 177 aa, A.fumigatus
GNLVLCIFRRLRAVHSTLSPALMSQMLELITKALACARQLVDANCPWSHVANVPFQAICTLLAVDSPESLSLLDDAVQTLKYVTDVYDTEVLREAYRTAGSLILLQQRRKEHDAGRLTSIWGRHFGPDNDTMSQRRPSIQDSESFRDLVADLSSSENFDFAQFFIADNPWNALGMDS

SEQ ID NO: 26626 - protein, 80 aa, A.fumigatus
SHWVIPQSRHTDIHTHIHTDNGREMEAKTAKCDDTQFDKADDIPLSSNYTEIPTLPNSPDPRSSKSGMDGIRAPSPTEQN

SEQ ID NO: 26627 - protein, 229 aa, A.fumigatus
  UNSURE (49): Identity of amino acid sequences at the above locations are unknown.
GGDSTTLGTPPTNNPSELQRKTRTILPPRIQSWYVLVAGHGLLAAMWLXDTVKGIDEGHLGLDSRREARTAMDFVATLGGDNALPVGAIAQRSCKGRDSLANRIQFYHDAVNEAAFLTEPWTLVLIRCFAKAAYILLDDITPQSHGARPDDPSEYARRNCEFCISALWCLGTKSDMAFVAARSLSKLLDTRLGKGVDQFCSVGEGARIPSMPLFDERGSGELGSVGISV

SEQ ID NO: 26628 - protein, 111 aa, A.fumigatus
  UNSURE (50): Identity of amino acid sequences at the above locations are unknown.
TVGILPRLEHHLQTILQSCNAKPGRSCPRASSRGTYWSQGMGSWRPCGWXTPSRASTRATSGWTAGAKPAPQWTSSPPSAGTTRCPSGPSLSAPARGGTPWPTASSSTTTP

SEQ ID NO: 26629 - protein, 214 aa, A.fumigatus
  UNSURE (50): Identity of amino acid sequences at the above locations are unknown.
RWGFYHAWNTTYKQSFRVATQNQDDLAPAHPVVVRIGRRAWALGGHVAGXHRQGHRRGPPRAGQPARSPHRNGLRRHPRRGQRAARRGHRSALLQGAGLPGQPHPVLPRRRERGRVSDGAVDARPDSLFRQGGVYSARRHHAAVARRAAGRPVRVRPAELRVLYLGAVVSGDEIGHGVCGCALVVEAAGYATRERCRSVLFRRGGCSDSVHAAF

SEQ ID NO: 26630 - protein, 62 aa, A.fumigatus
  UNSURE (53): Identity of amino acid sequences at the above locations are unknown.
LGFSRSYGYKAQSNVAQSFSQKGTRNFIKLGIIQRLRGWRWGWWIPPMGLGPXLLLTEEEMA

SEQ ID NO: 26631 - protein, 166 aa, A.fumigatus
DITSLFMADQLALTYSIRTFTGLGHTKELYSRFRQPPLRPPAWVFGPVWTVLYGMMGYAAHHATASTTLLTPATAVASFQTLYTTQLVLNYLWMPLFFGARKPGWALADIVALGGTVGKLMAMWWDFDRTAFWMMLPYAGWLCFAAYLNVSVGWLNNWDFDSRDGR

SEQ ID NO: 26632 - protein, 61 aa, A.fumigatus
LELLLTKLSLPAHSINHYNHVFIQLYNMSDPSLGSRFIDNTPLSYDTYSIVIESASLSLRR

SEQ ID NO: 26633 - protein, 506 aa, A.fumigatus
RGSFDPRGEDTRTGAAFVPIDPDAPIERMQKILKLTNACCILTSASLAEQTRAKAPARVAVFAIPLDRSARMSTDSDLMPGQSIVSHEAVYVLFTSGSTGIPKGVVVTHSSMKSSLKAHGRRLGLSESSRVLQFSNHTFDVSLLEILTTLAYGGCVCIPSDGDRVNRLSEYMRDAKVNFAILTPSVAQILSPVSVPDLRTLALAGEAWGQEIVNIWRDSVRLFNAYGPTEATILSAIGEVDAQCFRPNNIGSGSGALCWVTSPTDPTRLMAIGAAGELLLEGPILAQGYLGEEEKTRAAFIDPPMWRRELSSHGAPPCRSSLYRTGDLARYEEDGSITYLGRMDGQVKIRGQRTELSEIEHHILASDAVRNAVVLLRKNKLVCVLSLQSTSLTPALSRPGDIRPVSDDDRDAALRICLSIRAGLARKVPEYMVPDLWVPVIDLPLSSSGKLARKGVDDWLASVDTKHLINLSLQKIPLSTTSPSPNIASSSVERAIRQVIAGALQL

SEQ ID NO: 26634 - protein, 119 aa, A.fumigatus
NEIRRISGGNITDIKRWWQPNTLQLCITQLESDNYSDMQDTTATSLPLYLHCTQSGFLKGTLSLTSSLYWPLTFGSGLMGPFGLPLPNLQDASANPVQPLHGWFPFLLIFTQHSVIFSA

SEQ ID NO: 26635 - protein, 219 aa, A.fumigatus
  UNSURE (12): Identity of amino acid sequences at the above locations are unknown.
EFVPTFDPRTKXYSLDPKLPSVGEALADLAGSTVLLGSRNAPFVQFFNYTKPDNVSSALAEPVSQYFEATVRAVGYASGGTEQWQNVFYLILVFAFLTSAIILAFMLFEVRGRQITDFTEPQNLFALAMNSPATAQLQGACGAGPQGRQLNERFYVAMEEEDEHYYIRTKAEENVRPASMRARRSMASMEVDEMPKAVSPAMDEYRRLSSRSSLLSRFY

SEQ ID NO: 26636 - protein, 157 aa, A.fumigatus
LCNLWMRKGSHNLRAQCKFSLLIYTAGHLGRRGACANDPDYQLPWSTCNDDLVDLFSTIGKVERAEIQYEPNGRSRGTGVVQFDNAETAETAIGMLPLENIIDRTQANPSTAKFTGYQYGGRPLGITFVKYLNVDQGQGEPMEGAETTTGITQDQIM

SEQ ID NO: 26637 - protein, 120 aa, A.fumigatus
  UNSURE (100): Identity of amino acid sequences at the above locations are unknown.
AFFSFHARRADKGSGIVAFESPEDARNAIQQFNGYDWQGRTLEVREDRFAGSGPGFGGRGGYGGYGRGGFGGRGGFAGRGGFGGGGFRGGYGGGGFGGPXNFEPVASVPPNPFTDFATSG

SEQ ID NO: 26638 - protein, 253 aa, A.fumigatus
MLDKMGRLSVFNRKRRAADGTTPSAGSNESLSPPATAAPLNDAEKIKPVSETAAIEQETEQDPEVAALPLEVRQLVSLTDDPTLPTITCRYFLLSLLFVVPGAFLSQMSHYRTTQAPYSVFFVQIACHYVDHFLARWLPAWTIRIPLTKWAFSLNPGPWSIKEHVLVTLTAASGATYNLGYAPISMAELFYGERVHPAVAIFFMFAIVWIGYALAAIARQILLYDPAFIWPQALMQTTLLFSSTRSRHPPRVS

SEQ ID NO: 26639 - protein, 81 aa, A.fumigatus
  UNSURE (28): Identity of amino acid sequences at the above locations are unknown.
QRRLLGAPEGAFQGSFRGLASRHPNHHXGKLAIPINIKHVAIPHVILGAIHQLSNISLFGGNPAIDLVDNDVGDFMTHRSS

SEQ ID NO: 26640 - protein, 60 aa, A.fumigatus
GPLRLGFSSEGVIEWLSTASSAISHRTGDTYILTLLLCEYGNGPSLVIKISACWISKYGC

SEQ ID NO: 26641 - protein, 186 aa, A.fumigatus
SINMSKHNPSWLYSILFFTPSSTPLAHFSLLSNSPLNKPGNTLFAFACSSSNTGPSHPFCLHITTASSNNPAPTPFPRYRLSTVHAQITPVIFTFFSPAGTGTPRNTTTPIILSANFVTRISCSSPCPRSLGLVRLGNSHSPFPTLSASSIYPPVNPLTTNNPAITHPALVVPMSGRSEESVYSAL

SEQ ID NO: 26642 - protein, 192 aa, A.fumigatus
GNLIVMCAGAIPGYWMTVATVDTIGRKPIQLLGFIILTIVFIVIGVAYEPMKKSHNGLLGLYVIAQFLFNFGPNATKFIVPGECFPTRYRSTSHGISAASGKVGAIIAQCVFGPLVHKGAKDPSQSPWLNHVMQIFALFMLCGCFTTLLIPETTRKTLEQLSGEEYESDTLVQNSPMIQAEKKVDNSSAADV

SEQ ID NO: 26643 - protein, 105 aa, A.fumigatus
  UNSURE (81): Identity of amino acid sequences at the above locations are unknown.
RGKPRHFLEASYVLWKRIVGPSPYLILPNYVYQIMVVEACTFFKLCKSFFSAHIDMDYTKTLFNRTIWAIRGVSVSSNDLXERLAEVLAQMWRMGSTPATESIRY

SEQ ID NO: 26644 - protein, 109 aa, A.fumigatus
YFPFSPAYLKNPTNPDSNSESSASSTAGPAGRTSSSTPGLPADPSLASATMIPQGSLGVAPASGVTNLPSGFLEPNYEVFDPLNWLLDGLVDLPYSYSAMSGMEPQTIA

SEQ ID NO: 26645 - protein, 169 aa, A.fumigatus
RYRGDTMSAESRKTTTKIGTGTTTASYQTHRPASSLLIASKRLLVKPSPVPQTITPNVHPASITIKPSLSSIATPTRPTDRSKAHTVEMDLSQPPQPFLDPGVWERMKAAGRDASRGPSAEREEGEEERRRRREREAEFGQMAVRGRMGGLGRQEMIGPRRPSLTSRSS

SEQ ID NO: 26646 - protein, 117 aa, A.fumigatus
  UNSURE (20),(21),(22),(23),(24),(25),(26),(27),(28),(29),(30),(31): Identity of amino acid sequences at the above locations are unknown.
CFTTTTITLSPSPAACLARXXXXXXXXXXXXEHCKDYMADYISTRGGYLENPSATSDCTFCTISSTDTFLSAVSSHYSDAWRNFGIMWAYIIFNIFAAVFIYWLARVPKGKRTKGST

SEQ ID NO: 26647 - protein, 68 aa, A.fumigatus
LFDALLVRTVGSFLFSFPFLFLTFLTVQKSPYLFTFHLSLYINFRFLVIIPLVYFVAGFNTSCLAVSS

SEQ ID NO: 26648 - protein, 61 aa, A.fumigatus
GHTTFHVFVKIVLSALIPKRVGATIVSVCGPGAFADEVRAAARNNIGKGAVVDFVEEAFTW

SEQ ID NO: 26649 - protein, 110 aa, A.fumigatus
QTQDVAVPGGQRIYVDPRGALRFTTAHSGSIPPGSSTGPFVHSAGTPFGHFAYKGQGAKGFIACPKSNGTATHWQVYASVANVASGAECLGFNALAVPSNDTRAAAWEYI

SEQ ID NO: 26650 - protein, 68 aa, A.fumigatus
PAVLQGASTKQTNCNKVTPCNNKETYLSLSQSLPLSAHKPATVSNRQNPQTIPTETQAQAYTPSAHHS

SEQ ID NO: 26651 - protein, 229 aa, A.fumigatus
PSGPVVKIPVLFSLLTLASAVSIPIRNNGHSNSYSYHTSNSTKFSVMSARSGSPIHLLPMNAAHGNFWLGESPSTFCPEPVEKVSGCPPGTTTRFASANALVRPALYSPGLKCTDKHRTSPSPAASASTLTPAVPSASPPLTRAPSPLAPLPVPLSTAPARHSDTSPTRARAPRASSLAPRAMAPPRTGRCMPLLRTLPAVRNVSVSMLWRYLRMTLGLPLGSISKSRP

SEQ ID NO: 26652 - protein, 161 aa, A.fumigatus
LGGHRFAWLPQLLTFCILAGSAIPQFDLHAKSVGSSDEINAKRLGFFSLCMSSALSWAPSAADYYVYYPSTIRPWKVWSVTTIGGCGAMIMSILLGVGLGTGVASNIRWQALYDGTPGSLLMAGYDRLGAFGKICGFINVLTVVSNNGPGTYSLAMNFQML

SEQ ID NO: 26653 - protein, 157 aa, A.fumigatus
DIWSRVPRPIFTIASTVTYTACAIGGRDFLYQIFKNFLPLIGYWIIIWFTIAVEEDVLFNRCRGYYWSIWNDWRKLPVGVAAGVSFLIGWAGAIVGMVSEGFLLFSEAPATDPCLLTARAPNRTKSITLGQLRMRQQEDVILGSGSVWGSPPYLFLL

SEQ ID NO: 26654 - protein, 82 aa, A.fumigatus
VMTRYFMGYYPNKVCCSLNVLTNLGYGMINAMVGGQILSKLSGGTVSVIVGIIIVALGSAIMATFGMRVFHIYERYYPCAQC

SEQ ID NO: 26655 - protein, 68 aa, A.fumigatus
RIPPFFRGACNRPMFADSSGAKQDQVYYTGPVANATTGGCDLGIWLGLGFTAISFPALRLLELQMLGR

SEQ ID NO: 26656 - protein, 64 aa, A.fumigatus
STPCHILVPYKLHYYILYSLGPMIYSTIFSILYSLRPTAYVVQSTLLYMSYSTPYLYNLLQSTS

SEQ ID NO: 26657 - protein, 76 aa, A.fumigatus
YMLVYKFLLSISFKYIYTNYSIFIKHSITILLYIDNILILLNSNNLINNFLKQLGKLFKYTNNSKVSIYLGINMLY

SEQ ID NO: 26658 - protein, 62 aa, A.fumigatus
LILVTYLDITFTISKLTYFTRNPSPNYFIIVKYVFCYLVEILLLLLFYPSMLSKLNSFINTN

SEQ ID NO: 26659 - protein, 275 aa, A.fumigatus
  UNSURE (263),(267),(268): Identity of amino acid sequences at the above locations are unknown.
ASLTLAGSERASATKNRGERLLEGANINKSLLALGSCINALCDPRKRNHVPYRNSKLTRLLKFSLGGNCRTVMIVCVSPSSQHFDETQNTLRYANRAKNIQTKVTRNVFNVNRHVKDFLVKIDEQMNLINELKAQQKESEKLAFAKFKKQTEKKDAAIREGVSRIRNAYDHSLLERQEKINTMIKLKQVNRRIGMLSSWIAAFDAVCANSGNDEPLSNLQAIRKTAQGILLELEGSRQHYHQRLAKNNWDRAMNSAVENPIRXFIRXXEGSSVVR

SEQ ID NO: 26660 - protein, 227 aa, A.fumigatus
HAQRVFDPPEDNPVQKFSRSVVPNGKRVKDQTFAFDRIFDQNATQGEVYEATTRTLLDSVLDGYNATVFAYGATGCGKTHTITGTAQQPGIIFLTMQELFERIEERKGEKHTEVSLSYLEIYNETIRDLLVPGGSKGGLMLREDSNKSVSVSGLSSHHPQNVQQVMDMIMRGNECRTMSPTEANATSSRSHAVLQINIAQKDRNADVNEPHTMATLSIIDPCGKRAS

SEQ ID NO: 26661 - protein, 464 aa, A.fumigatus
RYKNQLLHGCQDPDCRTPTCASYRRRVSEGPYRRYTELSARTLACYLASLDNPESGLCRNTQRLSSELSSHDHPRSSRRSSRGALTDLTEARSPSSVSSRRTPGDLPADRALLNQDTASAKPSDNTRIGSDSYTESRQQNVSAPVDGDSATQRMKDPKSFTQNLFDTLSLRMVEWLPLRRSPDVLDSDADRLGNQYVRSPKREGCEHTDTTVGSTCAKRRANLKNKSARVAPHTPSSQDASRRVPRVESKPEHQVKRISLVETDQHQQSPRTVKEGKSRLDLRPSRKLSYNSHLETDASVNIPSPPALKHRPQKHRGRNEHLDGSFTQAQRKKKERRVSWDSAKFLNDTQNQDAEKPLAARDSHLASETQSSNDDQLNFKSPYEKVERPLTVQTLSHLNSAIIDGLARMMVQSDEEAHRWRDELRYIESTGNFENPEWQFATWRQRRVYIFLAQSVFYALGSTN

SEQ ID NO: 26662 - protein, 61 aa, A.fumigatus
INIIVPKIDDHPIKIFYGVLRYRLSKRPIVPTLSFCLNFFLSLFFFTVASVQILIQLIDQR

SEQ ID NO: 26663 - protein, 72 aa, A.fumigatus
VNVSKWVARLHCGYQQDTDSLSVVLDGTIQTLSTQNAPDKGPVRGLLFVPTLNSQDPCTVFTTGWKDQVSWD

SEQ ID NO: 26664 - protein, 87 aa, A.fumigatus
NYCYNSLNPSSQPCLQYIYNLNMFPRCFASRATLTSRPSTLTPFPSTLIQNRTFAITSPTMTRLADAIKDDHRELEEAYNKILSAKT

SEQ ID NO: 26665 - protein, 156 aa, A.fumigatus
PAAQVLTHVPFTHLSILYKVSECWVSRLTLCLFYSFESFVLSPGEEKVEVETDTRKFFNQTSRCKSTTTDLMHLGIPSSSIFTFNKEDHTLGNLLRSRLLQNSHVIFAGYKVCPPMEAVFSSILFEVLGAFLESFGMHGSDELSQVPHPVVPKVFT

SEQ ID NO: 26666 - protein, 88 aa, A.fumigatus
PRTTAFEGHQRTYKPDNPRLVRGVLCTKLPRGVIRRLWASVSELKIWMEECSNEEGLSSLGLTIKMLYQIQSFIIYRVFTAGLEGAAQ

SEQ ID NO: 26667 - protein, 229 aa, A.fumigatus
  UNSURE (41): Identity of amino acid sequences at the above locations are unknown.
PEIFWFEINSELFGIVSTRHLGLRRPYPNKFSLSKQEYKLXVDCSLVEPRQQEGSFAIHPVVQDWCFHIAASEERTVQLYELALVSVGYTVPRKDDREYAQLQQRLLPHADYVIQREKYSWLEDKVAVWRALSRLGNLYTNQGRLQEAEEMYQRALAGYEKALGPDHAKSCKLADDLASRASLSATQEMPDSMPSNPTAGQPRAVSALQPSLPESLQKRHVFSRIFCRR

SEQ ID NO: 26668 - protein, 64 aa, A.fumigatus
FVDDKKIMTRRCHGAASQAQKNEFNGAQDVPGQVYCEVFACLLKAVPLIVEASAASSGCAGDIA

SEQ ID NO: 26669 - protein, 96 aa, A.fumigatus
GSGGGSTFLFQVALALLKLNEQQLLTTCSTPAELYTYINHQMTNHAISIDGLIQASEALRNVVRREDVVARRAEALREMRELGGSTQSADAEANSA

SEQ ID NO: 26670 - protein, 500 aa, A.fumigatus
  UNSURE (488),(495): Identity of amino acid sequences at the above locations are unknown.
RPTLRYPVLHPVLPHIASIIPQSLACDLLDVYFTSSSSSHLSPQSPYVVGYIFRKQSFLHPTKPRVCTPGLLASMLWVAAQTSDAPFLTSPPSARGRVCQKLLELTIGLLRPLIHGPAPGETSPNYAANMVINGVALGGFGVSMDQLGAQSSATGAVDDVATYVHLATVISASEYKAASMRWWTAAWSLARELKLGRELPPNTPHARPDAERDGDPDADLSKRHPPPLITSMGHGPGNTIINITEEEREERRRLWWLLYATDRHLALCYNRPLTLLDKECEGFCKPMNDDLWQAGDFATYRQAGPPVECTGHSMFGYFLPLMTILGEIVDLQQARNHPRFGLAFRNSAECEAQVLEIARQLDVYAQSLKEFETRYTSSLALGAAETEAAMDGSHPNHVSPSGRSSSTVESRVNESIVHTKMVVAYGTHIMHVLHILLAGKWDPINLLDDNDLWISSESFVAAMGHAVGAAEAAAEILEYDPDLSCTPXFVSQPSXEGTVV

SEQ ID NO: 26671 - protein, 61 aa, A.fumigatus
NQLRLIGVPLIQAKINDRGIAALAYNVLLRPGVTLGLGASFDTQNLNQAAHKVGASFTFEA

SEQ ID NO: 26672 - protein, 248 aa, A.fumigatus
LEAKYVDLPTGKRPITRKPPDPSTRKTGEARSMFSFTCGQVSSAYFRFLFMTRIVAHSVMLILCPHPGLTLTQAWTTANALDTKLELDNNIAKGLKAEILTQYLPSKQSKGAKLNLYFKQPNLHARAFFDLLNGPSANFDAVLGHEGFLVGAEGGYDVQKAAITKYSAAVGYSVPQYTAAITAGNNLTVFSASYYHRVNQQVEAGAKATWDSKAGNSVGLEVASKYRLDPSSFAKACRSVFFCEINLG

SEQ ID NO: 26673 - protein, 90 aa, A.fumigatus
PRSVLDSGATRTECLVGCLLHDIFPEKFFYLPHTISHRIGDSRHVMTYTIGAGNAFNMVLSHRDTSDPATWDKQTALQDMKAEFQGWDPV

SEQ ID NO: 26674 - protein, 81 aa, A.fumigatus
VSFCVSIRRPPLLMCPHSLTKIIGMVEKTIKWPLMSGSLLTRWDRGQVVILGDAAHAMLPYMSQGRMDAPPFGLKSHLPVP

SEQ ID NO: 26675 - protein, 197 aa, A.fumigatus
EQTPTYPSNCLQFAKTLEGALPDVPKPTGNVGLNILLVGAGLGGLATAIALTQAGHKVTIYEQTPMLGEVGAGIQIPSNSTRILFKLGLEPYLKPYVTEPESISFRRWQNGAVIGKTRLLPDFIDNFQAPYYVIHRADFHSALCRKANDMGIDIRLGARVVDYDPVLGSITLKDGTSHRGDLVVAADGTPSLCYPYL

SEQ ID NO: 26676 - protein, 64 aa, A.fumigatus
SSPTASADFPASSIKEDDGITYYFLASIIKDTQQFLRQMPRIKLVLVVASYQSTTSNIWIRPGP

SEQ ID NO: 26677 - protein, 378 aa, A.fumigatus
VQSSADTYSMVTMLKHVLLATAAAFLVLNVVAGELCNSTAPVVVHPTPPGVSKYDSFAVHVRSNAEKTQEYTVQPFLVQVGEANTTSGASIVHNTSVAYFDFCGSVQVSLTSNNGPIHSVVVRPHSYNIVPNVHGDVVTFSLDSPKNVVIQVNHDIWDVLTLLTNPIETEMPNPSDPGVIYFHPGINNSTAITTNKSLLIPPGTTVYVASGATITLPIAFHNISDASIRGRGLLLKAPITIEYASRIAVRDLVLINTNIGVAVSSDVTVSGIRSFSIGAWGDGFDSYCSRNVLVDSVFMRNSDDNIALYQHRNNWSGDSSKLTIQNAVLWAEYATPSISEHMVIHPTPENKERRLYQEHRRARPSRSRRCWYQGMLAY

SEQ ID NO: 26678 - protein, 232 aa, A.fumigatus
RQAQLKGLLSAWMQDSYSPFEMVQSDLEAIFAPAQGLQVSEYNEENQSGLVVPERRDMKNELCTSVFPLLVGLHSQNALPALLFNYARTTCEKIAITTLEILVKAEDKYKSGASWRQKMADYEKYRKLATKKAHTNEKSKKKGNPKQPREETERTAKDVEEDNSPFKRFDPGRPLEQFSFADTQKFDWKDLLEEIEIMKGRKVKPLLLEALKRGVGVHHAGLNRHYRQWYEM

SEQ ID NO: 26679 - protein, 202 aa, A.fumigatus
PPSYEHWILANYLHSVERLFRAGFLRVVVATGTLALGINMPCSTVVFCGDSVFLTALNFRQAAGRAGRRGFDLLGNVIFHGIPRHKVYQLMSSRLPDLNGHFPITTSLVLRLFILLHNSKDSPYAARAINSLLSQPRINFGSAESKDRVLHHLRFSIEYLRRQGLIGRHGEPIRLASSIAHLYYTENRACLHQPAARTTLVL

SEQ ID NO: 26680 - protein, 65 aa, A.fumigatus
RFSAADSYNKEHSKIFDVPYDIAETKPMLDQLHTSSFSSTPADYRATHEDRFPQILATSMVHLHC

SEQ ID NO: 26681 - protein, 284 aa, A.fumigatus
RFLGHVLHICTSPTSLLPAEESSYSQTHCAMATQSSTELPQINMTTAEPTSANKRTYPWVKLPHPYLTSYAIHVVSESTPRVLQLRLHDDQKGQALPEPLHSASLTYTDIAFDEAAQEIPDNDNSPWARSRRAPGTSFHWTGQEPPTLGQIWNVIHALFLTYPQHEIVRLDLNGSGKDIIRDECLRTGLAVPFPSPRVPFGTENRASETDTLILLRSAFWQRAGSPVGPRPIWAVDHGIHGLLRPSGSSYPPLAQNYEFSMKFPSERIYTRHPRPPARNQPQDH

SEQ ID NO: 26682 - protein, 155 aa, A.fumigatus
CSPSIVTRTLSGLFLEIAVAISTAVANNWSCSTTRFTSPHRSSWDAEKLNPLRAISAARCFPSTRTSRGSEPATAAIPRCTSGRPKVAFSLATTISQLATISKPPPRQYPLTAAMIGLLPRRRGRPANPGAVISLVIPRALRSFHSMGCIVSCFP

SEQ ID NO: 26683 - protein, 169 aa, A.fumigatus
GKQLTIHPIEWNDLNARGITNEMTAPGLAGLPRRRGSKPIIAAVNGYCLGGGFEMVANCDIVVASENATFGLPEVQRGIAAVAGSLPRLVRVLGKQRAAEIALSGLSFSASQLERWGLVNRVVEHDQLLATAVEIATAISRNSPDSVRVTMEGLHYGRNGHLNDAAGRY

SEQ ID NO: 26684 - protein, 231 aa, A.fumigatus
IQSQTVYCISDLQTTTMSTEAHSTVQGCLVSFPTPHILVLTLNRPEKRNCISLATSAEIQRLWTWFDTQPALYVAIITGTGESFCAGADLKGTLLLSLFDGNISILRKTTDNTSHRMERPQRAWYHQRNDSPRVSRPPSPTRQQTNHCCRQRILSRGRLRDGSQLRYRGGQRERHLWSPRSATRNRRRRRLAPSAGPRAGKTASSRDRSERVELFCVPARAVGAGEPRGGA

SEQ ID NO: 26685 - protein, 134 aa, A.fumigatus
VHLPSRSDGLELVAKIKARQIASNLQLLESTCKTIVTRLLIQGALGRFYNGNSSDSNWTSSVTDVQSALGSNNYMDLYQVIIFSRNGQGDRHGLLNVTAKDIAEIALPYTHPDGTAVMLGEEGRLTPTGVEGNA

SEQ ID NO: 26686 - protein, 180 aa, A.fumigatus
CIGLRIATSGGIHLLPCPAKGTNKWCCSINGTDCCDNAATVSIGTIYGYTSISASSASSSTSTATGTGTIATTTVTTTAAAGNGTEVCSDSSSKATAVGAGIGAGLGTCLVATLFALWFQRRMYQKKLQQTSGYAGYSPASMAYAQSGYSNPSSGVRRNVSELQSNQEVIHEADGQETRK

SEQ ID NO: 26687 - protein, 409 aa, A.fumigatus
FERYRRTSRNKISPEEEQAIPEAYHYSTMGDFVMRSQLDAYDPRLPGTGMFDLKTRAVVSIRMDVRNFEHGLGYEIRHRFGGYESYEREFFDMIRAAFLKYSLQVRIGRMDGIFVAFHNVERIFGFQYVSLSEMDQTLHGQSDTSLGDTEFQLSLALWNKILDKATAKFPKRSLRFHFETRDAQTPFMYIFAEPVTDDEIHAIQTKNQEKIEAYQRRILNLPTKERIKPKPTAAPSELKAGSQPATLAKDHTAESSDKKKGSSQKISTTSDVDQETPATSEGSPASGSPDAPAEDAQEAPRELLAMTLIVKNKMNGYYVERPTNFTASDKWTVQWELTEVKQPQAQSLYTACQNRRAKALEIRGEGETGVAANVYIRKLREIAKQGREFRQKEDELDKKQGIVVLDGAV

SEQ ID NO: 26688 - protein, 144 aa, A.fumigatus
TLEKTSSAAAEHFLRVHSSSGSSPNSESSISPSLRSSSSSSPAAVSPLACAPDLERSKRAAFDLANWGLRSSSRSSSSASSPSPDRRIASSSSYTMLRSSTGTIFGMCGAKGCCSFACSPATSQNSAASSASSGSSALFCCMMI

SEQ ID NO: 26689 - protein, 701 aa, A.fumigatus
  UNSURE (456): Identity of amino acid sequences at the above locations are unknown.
LTKLFFVFRFDRSLFKRHPPPDYVNYITYFFCTPQIPPAVGMDDDTYNLVRFAAAMNLKTKIRVAYNTISQPSLAYIRSATLAGLRDSNLQVRNSAGSIITELLQQAGLLAWPEVLHELLSLVENASGDVPVLAQEAAMSALAKVCEDNRKVLDRDYEGQRPLDVIIPKLMDFTSSGSPRVRSMALSTIHVFLPSRPQALIASLDLFLSQLFQLASDTDTDVRRMVCQTFAQLVDFAPEKLVPHMEGLVNYIIMQQNNAEDPELALDAAEFWLVAGEQAKLQQPLAPHMPKIVPVLLRSMVYDEDDAIRLSGEGDDAELEDREEDLRPQFAKSKAARLDLSKSGAQANGDTAAGEDDDDDLSEGEIEDSEFGDDPEDEWTLRKCSAAALDVFSNVYHQPIFEIILPYLKETLRHEQWPQREAAVLTLGPVADGCMDAVTPHLPELVPTLISLLTNXQPVVRQITCWCLGRYSEWASHLADPLERARFFEPMMEGILRRMLDGNKKVQEAAASAFASLEEKSDANLIPYCEPILRQFVQCFGKYKDRNMYILYDCVQTLAECVMGELAKPHLVDILMPALIDRYNKVTDQSRELFPLLECLGYIAAAYGDTFAPFAPPLFQRCTKIIYENLQEYIASVNNQAIDEPDKDFLVTSLDLLSAIIQAIDPQKSGELVATSQPRFFDLLCFCMEDPNYEVRQSSCL

SEQ ID NO: 26690 - protein, 76 aa, A.fumigatus
HIFLLRSSIGRIKAFKPTQDRPFVLGLPTGSSPEIIYRTLVQRHRTGEISFKNVVTFNMVSPPRWHYHDSLYAAIC

SEQ ID NO: 26691 - protein, 64 aa, A.fumigatus
STQDEYVGLPRDHPESYHSFMYKHFFSHVDIPPQNINILDGNAPDLAAECASYFFTPGRSYAYG

SEQ ID NO: 26692 - protein, 261 aa, A.fumigatus
TRTLPPRGEDYRDRLSFLFQRLAVVGTSVFAIAGDWGANNNIIDGQPHVGWPGSDPWVTCVGGTVVGNVRSSGAFTEHAWSDRDNPDSQFTIDGHLGVTGGGMSRVFATPPYQLSSGISAVTDCNGERWTGGRFIPDITGMVGFRGFIVNGKRNYFIGTSCSTPLYAGLFAALASALGGGGEGGVLFGPLNTVLYQIDRGVYRDITFGHNDSGDMPACAYFAAGEGYDTVSGLGSVDGRRMLEELRRIYWPKTKGFGCFRN

SEQ ID NO: 26693 - protein, 89 aa, A.fumigatus
  UNSURE (2),(10),(11),(13),(21),(23),(26),(30),(32),(33),(34),(38),(42),(43),(44),(51): Identity of amino acid sequences at the above locations are unknown.
KXGQPRHAKXXIXPPTTIQPXIXSGXWGGXNXXXSGAXWGRXXXCGIFARXIKPKKGDYVYPFSLMHTSAILSRIIFTTSSYLQTMARG

SEQ ID NO: 26694 - protein, 208 aa, A.fumigatus
VVLWPVRCYNDFSDSFGLRSYTGMALVWLYSRQIPRALLPFSVYSVFHVATYTRAHLIPTLQPPSQGATSVTSPSTPGSPRPAAKQSPLADTIGRFVKQYYDASMDLVAGLEMALLFRLVVSLLTFSKGSIVLFILYLAFFRARYSQSSFVQQAVRHFTARVDASVSHQSTPPAVRQGWEQFKNVVRQGYEITDVGRYTSGAAVKKPQ

SEQ ID NO: 26695 - protein, 80 aa, A.fumigatus
CSRVWLLRPRLPTQQDRPGAEQRSRVHDGREASLPARLSADPTRKWLCPWSRIRYTDHQSTRLARQLYGPPDDGLVGNRS

SEQ ID NO: 26696 - protein, 328 aa, A.fumigatus
LGLYRDKIITGSRDRTIRVWDAHYPWPCRKIIGPPPGEISSIGQVNNPTQQSSGKPPFLTICPPPTLAAGIVTPIDQSSDYHSASILCLQFDEEIMVTGSSDYTCIVWDIKNDYRPIRRLEGHRAGVLDVCFDDRYIVSCSKDTTICVWDRQTGALVKKLLGHRGPVNAVQLRGDLVVSASGDGVAKLWNITSGLCVREFSSKDRGLACVEFSDDARTILTGGNDQSIYQFDANTAEMVRELKGHAGLVRSLHLDSMNQRIVSGSYDMSVKVFDAQTGELSIDLPGWTTSWMLSVKSDYRRIVATSQDSRAVIMDFGYGLDGIELLEE

SEQ ID NO: 26697 - protein, 64 aa, A.fumigatus
  UNSURE (44): Identity of amino acid sequences at the above locations are unknown.
ATTTLFRLFRHSSIKLEHCPILELRNYDFFITAPRLSADEEGCXVKAFPNYDIKVILMYSKPLS

SEQ ID NO: 26698 - protein, 171 aa, A.fumigatus
EVKRKTQLWPPTSCAQQSDPTSSDSSTSGTTAPSASTVSMSCIANTKHQRHNQTRHQSSPRTVSQQDLPLITGVLSPSPSSTPSTKKSGIFADSQTIKGSKADKRASHNVIEKRYRTNMNAKFTTLENVITTCRNKQKASTIRPCSMKKCEILTSAIKCIQDLEERNRRSE

SEQ ID NO: 26699 - protein, 444 aa, A.fumigatus
  UNSURE (436),(439),(441),(442),(443): Identity of amino acid sequences at the above locations are unknown.
AQGKPSPSQLLPSSTSATHRSSGTSTYEWNGHIEWRDISKLESASLEAALLAAWALTISGYTRSDDVIFGELLLEQDSSGLDSTSDKAAPVVVPRRLQIAEDMSIAELMRKTQERLVAASPFQRAGLQRIRNVSADTSRACSFNNLFCFTRFDCKVQTLALAYPLGIFCIVANSELQLSACYDEQILSAPQVERILVQFARYVEYLKADLRSQETIGDMALRKNQTSYLSSPETVYWRKYLADVESCVFPSLNPDGERSGFSSAKLAIENLADLRRLCQKIEVTEDIVLQLVWGLVLRCYTGSEEVCYGYYQASPQPEGSKYLKVLPSRFLLKDDSDLESIAQQRKSELDEAMEHPISQIELQLELGLDWYSLLNTVFKFDRFAELPNDNNSTLDLLNDTEKGIWTIVVNPRFSFVSADILCLHHGAGRIRACVQXIQXFXXXP

SEQ ID NO: 26700 - protein, 130 aa, A.fumigatus
YIYTPHNRKMTCNVDKYNEVDPNRNDMAVTQLAPPLSLFPDGLKTTGQHPPLYEHLQPFERFPKEITGPTVWTADEYRAHPEKWTHRFTPEELDELSRAGDEFINSKIPLTGISKVPSLPPPAPFHCPTR

SEQ ID NO: 26701 - protein, 100 aa, A.fumigatus
KNFPLPTLSAYLLALRDELLNGRGFILFKGLPVQTWGNHKSAVVYMGLGTYLGYFVSQNSRGHVLGHVKDLGEDPSQIDKVRIYRTNARYLPRPRHAPKS

SEQ ID NO: 26702 - protein, 179 aa, A.fumigatus
YNHNYQSKHLSTPIPVPTKCRNNNRKTPPNPVTGSENSNHITSTAPNSSTEYPTSRKRRRENRMHLHIAIFDLDVPVPTVYTTRGLYSSQFTRLLAAAAARLSQSQSLAPGKEITIRTSSYDVIGGIFPPAHLLQRSPPGAGGKERIDGILLTGSSASVYRADSHPWMLLTSEREGGAQ

SEQ ID NO: 26703 - protein, 90 aa, A.fumigatus
KNAKLSFITDFVYSEGHAIKNHLASTSIAVRALTGHHKWILSGTPVPKQVLLLLISRYQSANRTTTASSLSSIRTSISWSIQTRMITVSS

SEQ ID NO: 26704 - protein, 80 aa, A.fumigatus
SPDEFDHLGSVPQDNLHDTELLQTLNNVDATHSALSTVYKDVTNSVLLTMLDDLALPVHIIRIHFMKQNSTDRSYQCPTR

SEQ ID NO: 26705 - protein, 225 aa, A.fumigatus
QWCLSSWGGPYVELCMSPSQFSKSKETADPARPKATRHGKRASMVSSMRRGPSSRRTSHPRTYFMNTPVKPSTRVETDQYSFKAYLARWMGDVAQLAPWTRDTIATRLRASATAAAAQCVGGKTGTYCGGMRWTTGEYDGTTGVGQQLSALEVVQANLYNTVAGPLTTSTGGTSKRNSAVERGSSERIAVSDDSSIVTMADRVVAWVATGGLGVLLGGYLYLVVT

SEQ ID NO: 26706 - protein, 287 aa, A.fumigatus
WPADNIKEVASQLAWDLVSFYTGNNTGDVPGNLPAPYYWWEAGAFFGTLVNYWRYTGDDTYNNITMQAILHQAGTGDFMPSNQTRTEGNDDQAFWAFTALMAAEHNFPNPPEDSPSWLAMARAVFNEQIARWDDQACGGGLKWQIFPFNNGYTYRNSISNGGLFNIAARLARYTGDATYAEWANKVWDWVTETGLIGPEYYVFDGTYESDNCSALNRVEWTYNNGVFLHGAAHMWNYVCLLVSSPRAKRRLTLPDPRQLVMESAHRWSPRCAEDLPLAEQVIRERTL

SEQ ID NO: 26707 - protein, 132 aa, A.fumigatus
LCSGFSLSNIGNYFVSTYTPVFCAFYNLDLLLGSGDQKFPPDVSPDDLEKLANGDPTTAELSVKFRDALFRTLPQNPGCSQVNTSPNTFLSLEKGTPEQFGNKFSARVQIWGKLPDFISPEHYYKWKEKTFP

SEQ ID NO: 26708 - protein, 77 aa, A.fumigatus
MEERGSSFSLKRDCVLNRIKGEHLILDFYTPYTYCKAAALISWMIDTSLVTLVPCSDKDKSTTASEIASKAAVAGSL

SEQ ID NO: 26709 - protein, 63 aa, A.fumigatus
DTCRVNVAGKLDIVCFDKTGTLTEDGLDVLGVRTVTQDLRSAPLDVSYRCVLTKTIQIHRSKT

SEQ ID NO: 26710 - protein, 80 aa, A.fumigatus
VPIELGVLRNFEFVSELRRASVVVRQFGDGGATFFVKGAPESLKTICLPDSCQSTTMTTVLSVYIEPNELTMLDSTTRFR

SEQ ID NO: 26711 - protein, 141 aa, A.fumigatus
GESVPVSKIPLTDDALKYLNLSTPSVHPNVAKHFLFSGTKVIRARRPHSVDDGEAIALAVVVRTGFSTTKGALVRSMLFPKPSGFKFYKDSFRYITVMGVIAAFGFIASFVNFVRLGVSLAQGMIQGLSLHCTAFLAFNHC

SEQ ID NO: 26712 - protein, 134 aa, A.fumigatus
GLHLLMYLIDVCSLRQYRFTDLKPDLASLASTSSSCIGASVGPQQHKNIVHAMATCHSLRVVDGELMGDPLDVKMFQFTGWSYEENGSESIEPHGPKYETIMPPIARPPNQISDLSGQIGTSQTVSFPPPEKST

SEQ ID NO: 26713 - protein, 89 aa, A.fumigatus
QCWTVPHDFDDLLSFYTHKGYRVIACAGRYEPKLSWMRAQKLTRELVERDLEFIGFIIFENKLKSSTTGTIAELSNAGIRNVMCTGDNI

SEQ ID NO: 26714 - protein, 78 aa, A.fumigatus
AYIAQLSWHLIIVRALDLITIVVPPALPATLTIGTNLALSRLKGHKIFCISPQRFELLSICCHIYSLRYLQGERCRQA

SEQ ID NO: 26715 - protein, 79 aa, A.fumigatus
LTTVRKANGLQTFWCAFDEKGCSAISKLSYDDTRTAQFRHELKIPENSEFYWYLKSVSFELVMCCAPYVDFSGGGKLTV

SEQ ID NO: 26716 - protein, 138 aa, A.fumigatus
ILYVFLIHGDATLLQGDGNGLPRADTHEQGLDTDNAGGNILADDLLAEALSGGTLHQQHGGSTVGDLRGVTGVDGTILGESGTNLAEGLGGDAVTDAIVGLDGNGLLLTGLGISPLDLERNNLLVEETGLLSLDGLLV

SEQ ID NO: 26717 - protein, 202 aa, A.fumigatus
RQSGKKARMLINVRPGRPGAVTEFSELLESHPESANCKVPMGVLSEQMAKDRNISRAVQDAFAASSYQKAVKAQKAGLFNEEIVPLQVKWTDPKTGEEKTITVKADDGIRDGITPESLGKIRPAFAKDGSIHAGNASQISDGAAAVLLMKRSTAERLGQKIIGKYVAASVVGVKPLLMGIGPWKAIPVALEKGGITMDEEDI

SEQ ID NO: 26718 - protein, 284 aa, A.fumigatus
  UNSURE (233): Identity of amino acid sequences at the above locations are unknown.
EQLNSSQNQTDVEFLKFLQDAYRFVLKHAQMINMAPLQVYCSGLAFSPTDSIVRRIFNNKQPSWLPVLPQVHKSWSAELQTLEGHSSWVSSVAFSPDGQRIVSGSDDNTIKLWDAQTGSELQSLQGHSDSVHSVAFSPDGQRIVSGSDHNTIKLWDAQTGSELRSLEGHSDWVHSVAFSPDGQRIVIYGSKIRLWDAQTGSELQSLQSHSDYVTYAFLGNFRVEHKQGSHISXESSWVCFRGERVIWLPPELREPSCRAINHDILAPGYLNGLVLIIRFRAHSD

SEQ ID NO: 26719 - protein, 105 aa, A.fumigatus
PSVLMIVLTNREHSLKMSFVNVGTQSGDSTNNTPVINHGSAPVLASVFSEPFQVFSAKKFPGVIESTQLSKCFALQGIKIPIRKDGVKGPRGRGGDGDDDADDYE

SEQ ID NO: 26720 - protein, 91 aa, A.fumigatus
TIYTGEMLSGPTIWTNPQASYYPPYYAGGQMPPAGMSPAQQPVPAGPGGMFTRNLIGSLSASAFRLTDPDNKIGVWFILQDLSVRTEGTFR

SEQ ID NO: 26721 - protein, 72 aa, A.fumigatus
  UNSURE (8): Identity of amino acid sequences at the above locations are unknown.
SPARSPSXLQYVVQSAPAFLRDLNPGCFYVFCGYIYPQSETTKYKVTRDHQRELQAYGEYTSNKAKLQSMDS

SEQ ID NO: 26722 - protein, 96 aa, A.fumigatus
SCLSTSYIYCSVLSRVLRISLTLRFSSEYEVALVEEHELTAGPLSLLQTATRTHTQVLISCRNNRKLLARVKAFDRHCNMVLENVKEMWTEKPKGG

SEQ ID NO: 26723 - protein, 373 aa, A.fumigatus
  UNSURE (38),(266),(332): Identity of amino acid sequences at the above locations are unknown.
GIPAGTEADTTGFFLLLNELKQEMPAGKTVSVTAPASXWYLQYFPIEALSLVVDYVVYMTYDLHGQWDYINKYATPGCPSYDQGLGNCLRSHVNLTETINSLSMITKAGVPSNMIVVGVSSYGRSFKMSTPGCWTEQCTYTGPDSGAYPGRCTNTSGYIADYEIREIIRQNPTVQELWDASSYSNIVVFNDTEWVAYMDEDNKATRKALYPGLAFLGTADWAVDLQSETGGGSGSNPNSSSGGTIYVNPDIWNSAAPVVTAPPRAXLIWPPMPLSTPTTITFLPWNNTISYSSLTRAQTLCLTAQPRRSPRTSINSWLTVITIPPCEHTLAXPPHSLALSLSLSLSLSLSLLSLSPPLQGRGVTCPLMDASLP

SEQ ID NO: 26724 - protein, 75 aa, A.fumigatus
  UNSURE (14),(25): Identity of amino acid sequences at the above locations are unknown.
TIRHLMSGGSPLPXNAVSTSNSCAXPHHLEKTCVLSPPFHVTRSPASLNHLVTSLKKHFLLFSHATLFLLLSLRR

SEQ ID NO: 26725 - protein, 64 aa, A.fumigatus
  UNSURE (17): Identity of amino acid sequences at the above locations are unknown.
YLELRGACGDCSSPRIXHLAPHASIYAHNHYVSSVEQHHLVLQPNTRTNTLSDGTTSTFPAYVY

SEQ ID NO: 26726 - protein, 328 aa, A.fumigatus
RSPSRAEWRSSDLLSVRPQPLSFGMASPREITDLSRQRPDPKNKTVLAPPKDLRMVAGNPMDRKFKGTHEAEARSYACLDYNGPAKPETNGFPNYNCPNGLRSQVFFPSCWNGVDYDSPDHKSHMAYPIDSYNSGACPESHPIKIVSIFIEVIWKTEAFADMWYGDSQPFVWSNGDKTGYGLHADFVNGWDVPVLQEALDTCDDMGGDIRNCQVLKLYDDAITEGCLLEPSIDEKLDGWLDALPGCNPVQPGPDDAVPVKNCAAPGIGEPQHYYTDVTKELGWAWIGCARDYINFEHILAESSSSSDDMTVQKCTQTWQKGGVYLCRG

SEQ ID NO: 26727 - protein, 114 aa, A.fumigatus
DVHLCPGHLSCIAWNSCLPSWGFWNAQQQYQSTPYARLADIYGFIAVYPESPQGAWDAASSESLVHEGGGTSQSIANMAKYVLNTYSADASKVYVSGVSSGGTMAVSNPHLQSI

SEQ ID NO: 26728 - protein, 126 aa, A.fumigatus
LNNGPMQNTMAGTYPDVFKGVIIYSAGSASNIRSMYPGYTGTYPKIQIYLGSEDTVIGSAAFNTTLAAWASVLRYDTTPDELLANTPRRRWTTYVLGDKLDGIWAEGVGHPVPIQGDEDIKWWGFA

SEQ ID NO: 26729 - protein, 151 aa, A.fumigatus
RSISMMSLLTLLATTLPYLMCYASPLIKRATLTEVTNFGGNPASIRMYIFVPDTLAASPGIVVSLHGASGTLNNNTNLRHTQDSPIYMALLPSTLSLPKGLGMQLRASLLYTKAEALASQLRIWPNMSSIPTALMQARYMYRVCHPVVLWL

SEQ ID NO: 26730 - protein, 82 aa, A.fumigatus
  UNSURE (79): Identity of amino acid sequences at the above locations are unknown.
DMMIVGCKLAQEAVQKLTHNLLRVSKQAMYVFKNKDLWLLVRLTRFMYGYVTWHLSSKRCRMNEICLHHGAERIDVPHXGGG

SEQ ID NO: 26731 - protein, 115 aa, A.fumigatus
DSYSSPASAPHAPSLPWSLPHEDRSPQPQTGSARCPPTHAPLHRPRYPDPANPPPRVQEESAPGQASAHSPLAPAQSQTPLPPHTTAPNSCPGSDESEHASPATDPSAEPASSGP

SEQ ID NO: 26732 - protein, 167 aa, A.fumigatus
IRTCQSGHRSVGGTSVVRTVISPSTHGLHSTSATGTLSFWPGTTAVPNLTGAHFHFTAQVAHPSRLSARVLSGASCWISGPVGTLNANADEYANLQYFAGEAFIGQATNWAGLRRKWWPPDGWLQRSCCGADTTSTGGWADGEGASGVAQKGCESGRRSTTRDLRLQ

SEQ ID NO: 26733 - protein, 374 aa, A.fumigatus
ALRLDPSARCGEDRLPVSVRLPPPSPLQLPIAANKCSNMYMAEDYNSPQSVYWSLKSLVVLLLPDSHPFWATPEAPSPSAQPPVEVVSAPQQLLCNHPSGGHHFLLNPAQFVAWPMKASPAKYCKFAYSSAFAFSVPTGPLIQQLAPDSTLALSRDGCATWAVKWKCAPVRFGTAVVPGQKDRVPVAEVEWRPWVDGEITVRTTLVPPTDRWPDWHVRIHRIQGRNLERLYAVEGGFAIERVPKGNVQTPGRERILPALEGEDWLDQDIGVGEGVHVSEDSVLILSAAGASGLRGAATMARTEHEALKPDSNTNLMAQRTLIPVVRHGLLDGDRQEAVLVTAVFAVASPQDQSRRSLRARWMDYPREASSILLE

SEQ ID NO: 26734 - protein, 207 aa, A.fumigatus
EDNEKKQSKAQRAAEAAQAEAEARRAEKLRETEANLADLSKLVTEPIKKRKSRKQKSARDAEDSDFGDEDALTAKEAEEKARQKRSLRFYTSQLAQKANKRNAAGRDAGGDADLPYRERLKDRQARLNAEAEKRGKQRPDKMEQLGGDSDEEDHRLAKEIRGEGAGTDDDEYYDMVAARSKQKKDEKKARAEAYAAAAREGGRVEIQ

SEQ ID NO: 26735 - protein, 79 aa, A.fumigatus
  UNSURE (5): Identity of amino acid sequences at the above locations are unknown.
EVGPXGKRAITYQIEKNKGLAPKRNKDSRNPRVKKRKKFEEKKKKLGSIRQLYKGGEGPGGYGGELTGIKKNLVKSVKL

SEQ ID NO: 26736 - protein, 227 aa, A.fumigatus
  UNSURE (85): Identity of amino acid sequences at the above locations are unknown.
TPKPRNVVSKDQTRWSSLAATVMRKTIGWPRRSGAKGPEPTMTNITIWSRPAPSRRRTKRRRAQRLMRPQPAKVDAWRSNRRLGXTANVPSPTRSRRIRVLRRSAIRILATPVSRRGRSSKRRRRSSAVSASFIREVKVLVATVVNLLVSRRTWSRVSSYRPRSLLFGYMHYGRSLCSLNYGLACTYIFSLMIYTFQFLTFYFPPAPPSFPRYHQILNKILGIRKQK

SEQ ID NO: 26737 - protein, 146 aa, A.fumigatus
QSFISPEGEIVHHRRKLKPTHVERSIWGDSQTDSLKTVVDSPFGKIGGLNCWEHLQPLLRYYEYEQGVQIHVASWPAMFPMTKSVPWGFCATGDGSKLASQFMAIEGQTFVLACTQILTKENLAKQNLVEEGIIQVVRTSYPISDI

SEQ ID NO: 26738 - protein, 65 aa, A.fumigatus
SSDPTVVPLVEAPPPGVECILQADIDLQNIDYAKAMADPVGHYSRPDLLQLRVNKTAAKCVVDME

SEQ ID NO: 26739 - protein, 224 aa, A.fumigatus
  UNSURE (212): Identity of amino acid sequences at the above locations are unknown.
CNPTDENSTPLVSMTPAAAPAPAYQGQGPEYAPVINPMAMPPPPPPYLQPFIPIFTDQLPSIPHSPSLAHSFCDTLAFAMLPTYPIPPLHLPHPDHSFTNTNGNNSNTNPRPRTTFHPRKPSSSDQTQQNPRFSPRRTIFIQNLSPTTTPHDLDLFLQDAGTIEQCENALNPDTGRCKGFARVTFRSADEAKRAIALLKNGVFSWRRKSGLXMIGVGYFPPGQG

SEQ ID NO: 26740 - protein, 155 aa, A.fumigatus
LQLQRQPQLTRARAQSMHRSSTQWPCPLLHPPISNPSSPSSPTNCRASPTHHPWPTLSATLSPSPCSPHTLFLRYTFLTPTTPSPTPTATTATPTPDQEPPSTHANPQAATKPNKILASAPAAQSSSKTLAQQPPRTTLTSSSKMPAQSSSARMP

SEQ ID NO: 26741 - protein, 95 aa, A.fumigatus
VFRRTYQEYLSLAPYLKHVIQIFYLDTSQPFSILYMALSIDLPQLSSTIILSLNDQQHQTRQYSTSPASLTIILYHPHSLGLCITSSCVSQEATI

SEQ ID NO: 26742 - protein, 200 aa, A.fumigatus
LQNSRKEQRREEVLKNLDEKKAAKAKRAATKQVSADGVQDMPGSEFFAGDDKQTDSTQTSRRASIAIQPQNAMGITPATSEDLLPSDLPATQLLPLPEVPSSYPLFAHLHAEGYYLSPGLRFGCQYLAYPGDPLRFHSHFLVVSAEWDEEIDLMDIIVGGRLGTGVKKGFLLGGAEEKDGDSSNEAGSNVRTFSIEWAGM

SEQ ID NO: 26743 - protein, 138 aa, A.fumigatus
  UNSURE (7),(18): Identity of amino acid sequences at the above locations are unknown.
NGTSLDXTLQDLHNSVLXRAEEFPSHTMHGHSFSHHSIPSGLSHHGLPAMPIPQYQAIYDNNIENHLPEHVLDDNENSETGAKKKKGSNSSLANDNELRKLLRQYEGYSLKQMAAEVLKHEGAGGKAEKVKQVFAMIW

SEQ ID NO: 26744 - protein, 140 aa, A.fumigatus
SGKRTRVSHCYRQEIWYLWMLRLKENCRKSSGSVRRDRVYCCYAEKCGTERVSVLNPASFGKLVRIIFPNVQTRRLGVRGESKYHYVDLTVIEEKQQKPPPLNPQVSSITNGQIGGTIENKFDGTMQKRFCQYILDSPGR

SEQ ID NO: 26745 - protein, 71 aa, A.fumigatus
KSGSKYLADLVITAGQTSTERVKDVFTGRKFSGSPVFLISANFHSPAISASSAAVTLGDYIDLLDSRLPSV

SEQ ID NO: 26746 - protein, 64 aa, A.fumigatus
RNVGNTIFLGLGASGQPSSKPWGWLKSLTSIVSFFIGALIFSNVTRRTGARRRGTLFTSFMVQT

SEQ ID NO: 26747 - protein, 360 aa, A.fumigatus
LLSALSAPGEDFILLEISHVLTDAVSIDIIWRDLQLAYEGALTTSKAPRYSRFVSYLQGTSQKDHMAYWLKFLKDAEPCFFPHLGTGNQKGATRAVSVTISRAMTDHIRQFCASLQITVANLIQVMWSMVLRSYTGMDDVSFGYITSGRDLPLDGIDDLVGPLISMMISRVRYTPSMKVADVIKQVGQDTVASMAHQHCSLAAIHREVGLKSRSLFNTVLTVVRPHSTQSIDSSLQLTQIASSAGTSEFDVVLEVSDSGVELDTTLAYSESALRSEDATNLSHAIVCALNWIIAHPESLVDHLSLCSPDLISQMTAMNNASPGVGVAAVSARTYLLACTSATGFSSPVDRTGNNDLLGTR

SEQ ID NO: 26748 - protein, 132 aa, A.fumigatus
TTRAQEWELRQCLHELISLRAHRQPDSPALWTGQGTMTYSELDSKSTMLARQLISLGVRPGSLVPICLSKSTVAVLAMLAIMKAGGAFVPLDPLHPTQRLADLVQRTGAKLILSSANTRNSAEFAGPRVVVF

SEQ ID NO: 26749 - protein, 356 aa, A.fumigatus
  UNSURE (16): Identity of amino acid sequences at the above locations are unknown.
EASSVSISKGSGGFVXDVTIVCGLYGFNIGNQQFTMRNLHISDAVVGISQIWNWGWTYQGLTLTNCTTAFSIANGGPGAQLVGSAIVLDSTIEDCPVFVETAWQSSSQSNGSLILENVALNNVPVAVKGPSGTVLAGSGGAMTISAWGQGHKYTPSGPTNFQGAITAPTRPSALLSGGRYYTKSKPQYETSPTSSFLSVRSAGAKGDGSTDDTAAIQSALTTAVGSGRIVYFDQGVYKVTGTLYIPPGSRIVGEAYPVIMASGSQWSNINQPVPVIQVGKAGESGSIEWSDMIVSTQGSTPGAVLIEWNLAASQGSGMWDVHTRIGGFAGSNLQAVQCPTSAAVSVYTPGLEGIAL

SEQ ID NO: 26750 - protein, 89 aa, A.fumigatus
APHALPRFTGLSPCQPVLGLTDMRSFVSVITGTILGAIVIYVRRLKPFIVAGTLVFMAAFGILIRFRGGADGTNHAGIIGGQILLGFGK

SEQ ID NO: 26751 - protein, 128 aa, A.fumigatus
  UNSURE (77),(103): Identity of amino acid sequences at the above locations are unknown.
LVQLVVCSLTPLKPAFRSPPSISVSLAPPGAFAMLTTTDLAVITGIYLATYNVGSALGNTISGAIWTQVLPGELENXLGNATLAAESLCQSPSPSPQVNPVCXPGRGRRSFWPYTMRKKWWLYTGYLA

SEQ ID NO: 26752 - protein, 382 aa, A.fumigatus
TDGSSDPRSAAFSTFTRAALKAWKTDPVFQPYFHETGFIISGHTPALIDHIRKDEVEPSETNFVKLETAEDFRRTMPPGVLTGDFPGWKGWLHKSGAGWIHAKKAMISAFNEAKRLGVRFVTGSPEGNVVSLVYEDGDVVGARTADGRVHKAHRTILSAGAGSDSLLDFKKQLRPTAWTLCHIQMGPEEVKQYRNLPVLFNIAKGFFMEPDEDKLELKICDEHPGYCNFLPDPNRPGQEKSVPFAKHQIPLEAEARARDFLHDTMPHLADRPLSFARICWDADTPDRAFLIDRHPEHPSLLVAVGGSGNGAMQMPTIGGFIADALESKLQKEVKDIVRWRPETAVDRDWRATQNRFGGPDRIMDFQQVGEDQWTKIGESRGP

SEQ ID NO: 26753 - protein, 166 aa, A.fumigatus
KCCNLLLSKGISQAAMRAYSRISRCNSTSACAMEVISSSWKSSSASSTRPNSSSSSSAQKPRDLSGTSSNRSPTSFSMSLTLFSISANLAARTCGSLNSSIMRRCSASKASRSSGDSISYIDRSSLLRRSGEYSGTSGNSSSGEGPLAIGGSSGTNLKGVTENGRD

SEQ ID NO: 26754 - protein, 74 aa, A.fumigatus
VMIHDILFFCHSLVYIYLFPLLDIHECVRLVSIISIPISRSIRCRQRSTDYNSIDIITPQWENVQTKTRSRIGK

SEQ ID NO: 26755 - protein, 402 aa, A.fumigatus
  UNSURE (85): Identity of amino acid sequences at the above locations are unknown.
NPDSLQTAHQIFQPRAGCQRLSLNPKPLVEPFECFLRRVSKRTNLGLEPSVRDIRSNPFLLIHAILETRQAVVDLVGRGGGVEVXACPGSRHQGRALHISQVFRAVCLLQSVGAKATHDIRIRRGAGGPPQVVKLPPGLKRKFLENAEDPVEHPVGEPAAHEAVEERARHPAAHKARQAVESIHAHACLDPGVGSRAEGKVAPHRGTRHGNVVQVQLQFGMARSQVEEVIQNGTRDGFPVRAHWQLVATEDDSLAGPLKRQDCVAQVRPVRRIDKVDLFLGRIAPARVEQDRDLATRDAPGGRRQVQISRQRFAALVWDLQEDRLAITILDALSEIGNGSFQGGKDSFVMSDGAFVEHELRGPEVVGGAQVRAPCTDTISRGLGLLCDGFCLATYYDRVKIR

SEQ ID NO: 26756 - protein, 397 aa, A.fumigatus
  UNSURE (318): Identity of amino acid sequences at the above locations are unknown.
AYFHPVVIGGKAEAIAKQAEASGDRVGARRAYLRSSNYLRAAQFMLNEGPIGHDERVLPTLERAIANFRKGVQYRDGKTIFLEIPYEGGKTLPGYLYLPPAARRIPGRKIPILLNSGGGDSTQEEIYFVNPAYGPDLGYAVLTFEGPGQGIVLRRDKLPMRPDWESVTGPVLDHLFDLATRHPELELDLDHIAVTGASMGGYFALRAAADPRIKACVSVDGFYSLSSFVGGRMPGPLFNGFMSGWLSDWMFNGILGVLKKLAFQARWEFNHLRWATGSTTDADVMRSFGAYTLQKADGTEYLADVKCPTLVTGAGASXYFDPATTTDKIYDCLTSLQDGVDKEKWIATDVAYGGLQAKIGAFGYSAQKTFEWLDQRFGIQREPLAASSRLEDLVSRL

SEQ ID NO: 26757 - protein, 363 aa, A.fumigatus
FASSVFSTATAVTAKEYHVSTEVMTLATSLVVFGFALGPIVWAPMSELYGRRLPLFLGYAIFVIFQIPVAVAQNVQTIMICRFLIGVFGCSPLAVVGGAMADFWDPIDRAVAIALFSAATFVGPTLGPIIGGFITESYLGWRWTAWITMIPSAAFGTLAFFIVPETYGPVILQRRAARLRRETGNWALHSLLDESRPTASEIVNKYLLRPIQMLFLEPILLLITIYLALVYGILYLFFEAYPVSFMEVRGWTNGGIAGLPFIGILLGVVCGVALIIWQTKTRFARKLAKHRRVVPDERLGPHDCCIRASGRWSFLGRLDPHPPYVVGCSSSCRFSPSALGILGHPPCQGSPPTSSQSCFFSTS

SEQ ID NO: 26758 - protein, 83 aa, A.fumigatus
SDLWNVILAKGLLADTPHNRAEKNPADLKAVCVTNGDDVQKKIANTCGDSEQAALSWFADTCDAAGYKVGMFSRAYRGASRGS

SEQ ID NO: 26759 - protein, 92 aa, A.fumigatus
LAASLMTYFLDIKSSTTTSESATGTSTKGSASNTGFVTATATGSSSSGENKSGTSSSSATSTSQTVSAGSSDRQVSAAAFAAVVFFGFAATL

SEQ ID NO: 26760 - protein, 256 aa, A.fumigatus
RLHPLIQPPSKTKPAAEWSSSSQTLIYPVAQFTPLLKPDTSTEFPAVTAILRLLSTSSVFSGARWLFTAGYFNIHPVLSSLLIASTSTSHTASTTRGTVLTASPWANGFYGSPGVSGMLPAAYTHLSAKFLDRVSEAQRTNAIQLKEWRRGTVGEPGGWTYHAKGLWITLPKEEHPSMTFVGSSNYTKRSYTLDLEVGALVVTNDQELKQKLGAETDWLQKDSQAISREDLRRTERRVSWKVRLAMWIVEKVGGAL

SEQ ID NO: 26761 - protein, 62 aa, A.fumigatus
FNEVMDDFLAGWDDKTSAQAKRKGAKAKRGKNGNEAIGIKMLDEIRQGLGPARVPGKVSGRA

SEQ ID NO: 26762 - protein, 174 aa, A.fumigatus
RLNFGQMGFVFIEANVKKWGLAPMTGSLAPPPPYGSEQGSILLESGRESAAQISQRVYQDARTSSTVRIPPSRSPGPVRSPTDISLAPLAHIPSHEDVGEGSSHANTIADEQTALLNPTDLDQVPPPEYSSPDGSRRGSDITGDLPNQSSPPIPSYDAAVGNQADNTLMPDGDH

SEQ ID NO: 26763 - protein, 83 aa, A.fumigatus
  UNSURE (73),(74),(80): Identity of amino acid sequences at the above locations are unknown.
GESKPPGLQLFSLLPPDTITLSHEVKPEFAGLFNSERIWFKLIQHHILQLSWEPLSSQNISLDIEAIPPAPLXXFTDGPXTPT

SEQ ID NO: 26764 - protein, 268 aa, A.fumigatus
NAFAVLHARCEDCFDVVCPDCFSGWKQVFDGHVEPTNTIKCQVCDGWIPISYSTITVEGLEEYLTEHEQAKQSRRQPKTLGEYEGPHTKTKALLAHLSESAEESKRLNAEPPIKSVVFSAWTSHLDLIEIALKDRGMTGFTRLDGTMSLAARNKALEDFHTNDNTTILLATIGAGGVGLNLTSASKVYIMEPQYNPAAVAQAIDRVHRLGQTREVTTVQFIMKGSIEEKIFELAKKKQQLADMSMNRGKLDKKEIQEQRMREYRSLFK

SEQ ID NO: 26765 - protein, 63 aa, A.fumigatus
PAQNVWNVCVSTSPPPPHSPSFGFATKSNEHLTPLCGRHTYHSLTIDVHCVNASSETSRKYRL

SEQ ID NO: 26766 - protein, 75 aa, A.fumigatus
  UNSURE (9): Identity of amino acid sequences at the above locations are unknown.
HRIDSSNNXQLGGTTVLHSAWLSCFGRRKSLKAIWTVNTIKFDPFNLLTAAASVMHPIIWTLEKILWASKPRVSK

SEQ ID NO: 26767 - protein, 84 aa, A.fumigatus
AHCGVAGSATDWLMLWTIKQIQGQISAITDLEGITAEEHIISTPSSIAVDHVLRSFYHFDVGKLSQQDLFSFCLYCSKILDGST

SEQ ID NO: 26768 - protein, 151 aa, A.fumigatus
EASIISTSESFPSKTCSPSVCTAQKYSMAPHKVVEGSPTQQIISDHVWKRKRPETDYERWQREQDESYEPGGRPQYGPPNEFRKDDYVADGTEELLHGQHYSVEHRAPSHGYFVSSTAPAKPITSEGSFISYCQERLYSASGAKARTELMV

SEQ ID NO: 26769 - protein, 258 aa, A.fumigatus
LWLSRGYASITAGACSTIVTNPIWVIKTRLMSQSLKSNSEGYTAPWQYSSTWDAARKMYRIEGIRSFYSGLTPALLGLTHVAIQFPLYEYLKMAFTGYGIGEHPDNGGSHWIGISCATFLSKVCASTLTYPHEVLRTRLQTQQRTSPAPSPEGISFRGGLDHPQDRGRPPGAASSDGMPNRPRYTGVIRTCQTILREEGWRAFYSGIGVNLFRAVPAAMTTMLTYEYLRKLIGHLQHEGELKLRMANDRELALLQQDE

SEQ ID NO: 26770 - protein, 70 aa, A.fumigatus
SLNAPIAAFTMAIILCSYCISSINSARREAQSSPVTATTRAQKFSVEKSDQSWVQQALETRDAEQQNRSR

SEQ ID NO: 26771 - protein, 482 aa, A.fumigatus
  UNSURE (471): Identity of amino acid sequences at the above locations are unknown.
RFHSRACQQVREWNAALPERPDRCAHEIIEQQVLSHPTSPAICSWDGEFTYEQLDRLSTKLAKHLVCLGVKPEIFVGLCFEKSAWAVIAQVAVLKAGGAFASLDPSHPDARLRGLVDDIGAHIFLCSAKYLDKARQISRAAYIVSEETLAELPDVSSTASMTRPSIHNAAYAIFTSGTTGKPKVTVLEHIALSVSSPAFARSMGMDTTTRALQFSSYTFDVSIKEIIIVLMTGGCVCVPSDEERMNDLSGAIRRLNANFISCPPSVSNTIQPESVPSVKTVVMGGEKMTASHIDRWGDRFVINAYGPSESTVMATMSVKVDEAGVRVNNDCNSIGAAICGRTWVVDPNNYQRLLPIGAVGELVLEGCNVARGYLNNDQKTKESFISDPAWTKAPGLKELFKRKERMYRTGDLVRYNPDGTICFISRKDTQIKFNGQRIELEEIEQQCISFLSGGTQVAVEVVEPESKPLQXFSKGAQIRPVV

SEQ ID NO: 26772 - protein, 79 aa, A.fumigatus
  UNSURE (35): Identity of amino acid sequences at the above locations are unknown.
LPAPLNPFSLGIGRHFSPAGLGCPFWDWVEHVGGXCSGRNDLVNANTGKLNPRHMYGATNQDVFPVANCAMGRGTAIVG

SEQ ID NO: 26773 - protein, 397 aa, A.fumigatus
TPGTCTVRPIRMSSRWPTVQWGVERQLLGSYITTLLFPGILLLLWGEEQAFYVLDATATNYIYGRQAMSPATAWRDHGCFSLNSSQYYKWPIQAGREGCHDDTVAYDHRDPSHPVRNILKHMYQLREQFPVLNDGYTLNNLSKSTFPVQYPGSNGTETETGMWSVSREANLEVQDFGSDDLNSPVWMVYQNDNHTVDYKFDCNSETDALIAPYPADTVVKNLFYPWDEFTLTAGPTKRTFGNATLPAGCYGNLTLKAFEFRAYVPKKLHRKPRPMITKFSPGHDVPIASTVAPDASENVPIELHFSEEMDCDGVTKSISLTSSTESLKIPSIDAGSVHCERITNFNTSWTAQIPSMWKWQATLTNVYNGIHQITVKEPKTSSGNASTNSTDHFLFRI

SEQ ID NO: 26774 - protein, 188 aa, A.fumigatus
LKHERFFQPRGEDGNPCVFVRASDLGVPGNLAPDKIDAHPTLLSQLDSIRRQAGVKMGLAGTTKEVPGSVPKICLVSSPSDAYTSGMMQTPKDVDLVVRALSVGQPHKAVPITVALALATAARVSGTVVADVVSDKPVDPAGITLGHASGKLLVGADFDPTGHVSCATVYRTARRIMEGRVFWKGVST

SEQ ID NO: 26775 - protein, 186 aa, A.fumigatus
VLYSFERRRVVHMPIGWFWFGWTSYPSIPWIVPTIAVGCATMGIFSVYLATFNYLADTYHRYASSAIAAQSCCRFSILLFCSSLLTRRSGRNLLGGVFPLVTNALFTNLGYPAASSLLGGIVSFCVYERGVEANLLTGSLAVYRPMGPSAVWTQDSRQEQICKCKCPQYIRLGPTNCTRNLHTSSL

SEQ ID NO: 26776 - protein, 143 aa, A.fumigatus
IRLPAFPQTGSPKYSPRDLNRETAPHLTSNKSIIHGQHILNAQCSELSSAQHKQPRDPPSTSTHPSSLAPSIPGPIRTSSTAKPSTLNEPKTPSLGPTTLSHGTPPPMTPRPPLQRPNRRRSRPNASSSARWIPCSSAQRTAR

SEQ ID NO: 26777 - protein, 370 aa, A.fumigatus
SDSWAIIQALWWILIMPDRRLSQLLKSKLLRRSSTTATTSPKQNQKPVNAQKKAAVGADPLVDPNSTSDLSCSLPPHLLTSNEGEGDAKSRAYSIISSIPLDHPSSPDEIPGPATGSSAGCEQYFTHFDRSGANSRQEGSQNGSIQQSPTFTRTLRHKQLTEEKGKGKLQSREGDQRGEYGYQRIRNDSNDSDPQYSLTTELANKPSTPQTPAGDDSLHSPSATPLPLSPSLPGPTGASSLQAAYRPVRENSSVPLVESQLTPSLGAVAEDSSGESAFHFVGPSSSSPFPKRPPLGFRRQSLFPASHQHLISGLMGFGPYQNLGQGSGHPSTVNADMIPRKVWVKRPGGSATLVPTMEDSLVDELRDPGI

SEQ ID NO: 26778 - protein, 62 aa, A.fumigatus
EKKVHGDHKIIHLKHPILCSTEYWTSHIGHPAIYTSMTSAVSTNELYTYIRWASSAPNSSEY

SEQ ID NO: 26779 - protein, 159 aa, A.fumigatus
CRGLLSGCYSLPKILTRSLMGFWVFSPDSPARLPKTSCAMRRHSEGMSHWLANGAVDEGGVTLDVPPLFPTVFLSVSPTWLPHFDSYLFLLDRSVCADWRSISTSEHLGPSCTIDCLLIPCIGNVPIEWLTYALYSEEYCYSTTRSFTNPIVDSDRSTV

SEQ ID NO: 26780 - protein, 77 aa, A.fumigatus
ESKWGSQVGETDRNTVGKRGGTSNVTPPSSTAPFANQWDIPSEWRLIAQLVFGSRAGESGEKTQKPIKERVKIFGKL

SEQ ID NO: 26781 - protein, 130 aa, A.fumigatus
LEYSDSILWPLLHYHPGEIVFDEGAWDAYREANLLFAKTIVKEAQDGDLIWVQDYHLMLLPELLRAELRAAGKKDNKIGFFLHTPFPSSEIYRILPVRGQLLRGVLHCDLIGFHTYDYARHFLSSCSHLL

SEQ ID NO: 26782 - protein, 149 aa, A.fumigatus
LRPLRPSSPVVKTYEFSMSSGGLVTGLSGLSKTTTFQWYGWPGLEVPEDELGSVKKRLKDEFNATPVFMDDKLADRHYNGFSSKWPPPTTYHSPRLAVCERQHQQSIADWSIQTRSYGPSFITTPARSFSTKALGMPTVRPTFYSPKQL

SEQ ID NO: 26783 - protein, 140 aa, A.fumigatus
LLMALYRGLVTTPSSVKYEGRSVAVGAFPIGIDPDKFTDGLKSPKVQNRIASLENKFQGTKLMVSVDRLDYIKGIPQKLHALEVFLQNHPEWVGKVVLVQVAVPSRQDVEEYQNLRAVVNELVGRINGKFGKRDPLAQVR

SEQ ID NO: 26784 - protein, 116 aa, A.fumigatus
CHIADTLTQTGTVDYMPIHFMHKSVSFDELIALYAASDACVVSCTRDGMNLVSFEYIATQQKRKGVLILSEFAGAAQSLNGSLVVNPWNTEELARAYHEAVSMSDEQPHDTLSARS

SEQ ID NO: 26785 - protein, 455 aa, A.fumigatus
EGGRVKFFPGLERGNWKNLRGKAPNGPELAPFIKRVGPEHEREDWRMRPFGKHAEETGEADDDLGLDKVFDEELDNMLREEFEGMAMEEENWLSEVGEEGSTEAPVPRQPYEVTLNDAESHPYVDKLNECLRRLNSDPSDERAKQYLWKWYRRCRQVIPNFLQSIPEEALTMMWESQANGDLTRASRATRLQALAEDAISAGRSLATSRTLVYIQSLQESGKTNLALDQWEACQTSLSQSKEDLEAYWKLGVQLFAAADDPQRAQDIALAFLANDKSREPRILLPVITAWGRQPGREAEVKAWALYLQLKALLESKMKMEDYDFVSIGLLKAGKLDLAIAVFKDMMVTAQDPANDSAALYKAALGLVGNLQMSSIREQDVNKISLSTLTVLPRRFQNRFFYASWIKKLIGMGEVDSAAMVIELMYERGVKPDSKHLNGLLAAVFTTGLEGSSALS

SEQ ID NO: 26786 - protein, 139 aa, A.fumigatus
LTVRGPSAPLVKIKGSLHSILVNTVSSEAEVEQAKKIIETAREYILAMSIELERRSLSTDTPENLKRSLELSAYFTIPKLEVAHRQLALMAAMKLAFANKNFSSALSFANRMLANGGSAKLLDQVSLLRFCKSLCSIRY

SEQ ID NO: 26787 - protein, 83 aa, A.fumigatus
AKKIKAQCERSPQDKIDIEFDQFAEFDICAASFTPIYGGSPSVSDPFTGAKYHEQYKGTVCRISEVTEIGAPASGLRLFVPSQ

SEQ ID NO: 26788 - protein, 87 aa, A.fumigatus
WEQSTGSWNSAHIRPMLDLRHGGLRPYTLKSSPFPKKHPIMVLGSSYYQWLLDSSLFAVNHFKKASPDLRETMHYICLVTIHRDITI

SEQ ID NO: 26789 - protein, 60 aa, A.fumigatus
  UNSURE (5),(59): Identity of amino acid sequences at the above locations are unknown.
WPLFXEHSNKMHFPVFDFLTLGTTNFDQVTKANQCLGIINLHWKGEGDYDRRFSVGLLXP

SEQ ID NO: 26790 - protein, 114 aa, A.fumigatus
LPGPAFATFLHLSPRLALFLSPLLLAFGLIVGVPPSLAPLSVSPWRSLPRLFPPPPSGIFAFSLSRNLLFPPLLSYPFISLLAFAPSPSPLACLSPLVPPLPLLHLGPLFSRSY

SEQ ID NO: 26791 - protein, 193 aa, A.fumigatus
  UNSURE (12),(13),(14),(15),(16),(17),(18),(19),(20),(21),(22),(23),(24),(25),(26),(29),(30),(32),(33): Identity of amino acid sequences at the above locations are unknown.
TPILYNNTGGCXXXXXXXXXXXXXXXVGXXDXXPPTPPAANRPATPVQPQHHPPPASPGQTPRLLSLTVSDFRALLSPHFCTCLLVWPSFSLPSYLRSVSSSASPPLSLLSQSHPGAPSLGSFHPPLRASLLSLSLATSFSPPFSLTPSFLFLLSHRPPLPLPASPLSSLLCPSFISVLYFPAPTSMVLPISL

SEQ ID NO: 26792 - protein, 233 aa, A.fumigatus
LEKPGVLFAFSHVWCRSRRVSHSVSIPRSLEASCTDYFRVVSISTLCPSLGWPPPYLFTSADLGLFTLSSFIGIIIAFPIAGPLTDYVSQWLRRRNNNIHKPEHRFPALLVPFLLCPPGLIIFGYSFAHQRHYIGPAAGAALSAASLTLVPSVMLSYVVDSYPRTSGEALVLVNASKNVVAFGLAKGSYSWMALVGVDKMFYEFAGIQWAVIALALPLYYAGPWIRAKTTNFV

SEQ ID NO: 26793 - protein, 390 aa, A.fumigatus
RFPRGRNGADKRYFRPENFGYPRGTGHWASGNQIVDLWDAKAVISTIELEENEAAFSMAAVPFSSQEDEAFLVVGTAKDMIVNLPSSAGGFIHIYRFQEDGKELEFIHKTKVEEPPLALLGFQGRLLAGIGSTLRIYDLGMKQLLRKCQAQVVSKTIVGLQTQGSRIVVSDVRESVTYVVYKYQDNILIPFVDDSVSRWTTSTTMVDYETVAGGDKFGNLWLVRCPKKASEEADEDGSGAHLIHERGYLHGAPNRLDLMIHTYTQDIPTSLHKTQLVAGGRDILVWTGFQGTIGMLVPFVSREDVDFFQNLEMQLASQCPPLAGRDHLIYRSYYAPVKGVIDGDLCEMYFLLPNDTKMMIAAELDRSVREIERKISVSQPFPTLFLKLCH

SEQ ID NO: 26794 - protein, 335 aa, A.fumigatus
  UNSURE (319),(320),(323): Identity of amino acid sequences at the above locations are unknown.
SAFSAAQTQVEFPPASQLLEMDPTRSGSFVPPLPEPAAEYDKKGSLSHSQHLSSSCSSSLSLQPPENVHSGQECILDPPLSSALRPSPMNTPRGLKTSLSGRRELGFIPITGPAPPKFTTDSPAKRTPCTTYSCNSSSSSAMPQSALFTTFPSANNGKQSSKEKRQLAESCNDNFADFPEPSFASKPLKRTLMDAAPLKERTIKKQKREDVDVTRLPNPEEMSPIEDDGTKPPYSYATLIGMSILRAPNRRLTLAQIYKWISDTFSYYKHSDPGWQNSIRHNLSLNKAFIKQERPKDDPGKGNYWAIEPGMEARPLRAXXECXDKPRSKSTVWRE

SEQ ID NO: 26795 - protein, 85 aa, A.fumigatus
  UNSURE (29),(32),(42): Identity of amino acid sequences at the above locations are unknown.
SVGLYHAWCCRGRDQRRRCILPSDSARTXPAXAPPEKKKSQXQRRKEKKKAEEEKKAKNATVQEGMLNPTAFCAPSKRSIELITA

SEQ ID NO: 26796 - protein, 159 aa, A.fumigatus
PVLGNKDAAADDFELAITHNKDDPDIYYHRAQLHFILGEFAEAAKDYQKSIDLDRTFIFSHIQLGVTQYKMGSVASAMATFRRSVKNFEDVPDVYNYYGELLLDQQNFSEAIEKFDKAVEMEKQSKPMGINVLPLINKALALFQRKHDVFTKSSRKDPT

SEQ ID NO: 26797 - protein, 285 aa, A.fumigatus
SHPSCFSWRPLLECSQLLLQTRKAYAAKLKAAGNKAYGSKDYNRAIDLYGKAIICKPDPVFYSNRAACYNVLSEWEKVVEDTTAALAMDSEYVKALNRRAIAYEHLEKYSEALLDFTASCIIDGFSNDVSRNALERLLKKVAERKAKAILEAKGRKLPSPTFVSNYLQSFRPQSLPEGLEESADLSEESGKGQLRKGLVAMSKKTGDGYEEAAAAFEKALELGDLGEYEALALNMRATFTYLEGNAQSALADLNKSIELQPSLVQSYIKRASLHLELGKYMPSLL

SEQ ID NO: 26798 - protein, 94 aa, A.fumigatus
RPFKTFPWTLGVDLQNQENLVKSKVKLILVSKQLIDGTASKLYQVRPLKKSYPSYLSLRGSVCYVLDLADANIQTACSSPPSLLINITTNMILS

SEQ ID NO: 26799 - protein, 70 aa, A.fumigatus
IEKTSITTNRLRTIMTWDLNIQQPKKQGSVPDYLSFRDVYLTQKQTPVRSMNFNFLDGIAAQCCRNYSIS

SEQ ID NO: 26800 - protein, 284 aa, A.fumigatus
YRYSSGSAQKTRFRDLITGGRTQHFRRMLIGSSSQIFQQLGGCNAVIYYLPVLLKESLHQSNDMALLIGGINMIVYSLFATFSWFSIEKIGRRKLFLGGSFLQTISMVITFACLIPGDEQTSKGAVFGLFLYMAAFGAAWLPLPWLYPAELSPIKTRAKANAVSTCSNWLFNFTVVMITPVMVAHIGWGTYLLFAALNASFIPVIWLFYPETANRSLEEIDLIFTKGYVENISYVKAARELPKLIDDEIEAKAAEYAFASGDSLDEIEKAHAEHNAAQRLETTQ

SEQ ID NO: 26801 - protein, 183 aa, A.fumigatus
FAGGMVGAIFAIFFGDRTGRRWMIFSGAIVMIVGVIIQVTSFVGHIPLLQFFIGRVITGIGNGMNTSTIPTYQAECSKTSNRGLLICIEGGVIAIGTAIAYWIDFGAHYGPDDLVWRFPIAFQIFFGLIIIIGMFFLPDSPRYLISKDRIQEGEYVLAALAGREVHDHETQIQKQSVIESIRA

SEQ ID NO: 26802 - protein, 253 aa, A.fumigatus
KQVQSCWWRPEWGDSAVSMALRSGQEAIATFLADHGALLLRGQAGRRASIIASRRGLQRLVRRLTVYYEAIAGRPLHRQSSRIVSGLPEIPEIPWERPSYFHTESGERDEVSFAELMEQYDIQTGFHQRYHMMEQIGKGHFATVNLCSNRVTGVLFAVKMFQSHRPPSSSDFESLHYEIQLLRELQKHSHPNLMRMADLFADFEKNRICLVMDLGKEGDLFDLIVAKGKFTETETRVLFTQLLSAIKFLVGPL

SEQ ID NO: 26803 - protein, 149 aa, A.fumigatus
MWRRRVLQTSRSRSYGFGVDVWSSGVVLYICLSGFPPFSDELYTEENPYTLAQQIKMGQYHYPSPYWDSVGDPALDLIDAMLTVDVDKRATAEECLAHPWMCKESISPDGATDASMALPLDIRMVQLMPKQVLDSEGSALTTGLQPGTI

SEQ ID NO: 26804 - protein, 151 aa, A.fumigatus
HDRGWVHRDVKPENILVMDKNLTIQLSDFGLAKKLPTDSGSEELASTLCGTPSCMLSTSCHLFAIADPSRCGAGGSSRRLAAVHTVLEWTCGPPALSYTSVCLGFPHFLTSCTLKRTRILSHNRSRWVNIIIHRRTGIPLEILLWISLMQC

SEQ ID NO: 26805 - protein, 186 aa, A.fumigatus
SITPKGNVFKIDSQGEKGINMLLFSNNKCDGKPSGQATEIFSKASSQDLLGFQVVALSTEPTATATTGKSVSRVATTFPASETASTGASDDGSMTIQPTDKMTIQPAGEMTIQPTDEMSTTAAATATATATTTSTPESSSTASSTTSSAASGTTSNAAGQLVALNGDTVKGIIGTVFGLGLVQWII

SEQ ID NO: 26806 - protein, 195 aa, A.fumigatus
RPHAQGCQSQTPSLLPGLDPPPTQHPFAVCPPHANRLGIRQQHAQRHAGPPAMEQVLWQTNRHPFRRHDVWPNRWHPDLRAGLLPAVRALRPPVPHLRRLAHHHPGLDHPGRRRQLRHVRGLALLGRPGAGHRRYRRPASPDRGRLPVPARQARLLLSHHLVAGLPHRRLDHLRHLQDDRSPLSYTTGLEGSASR

SEQ ID NO: 26807 - protein, 236 aa, A.fumigatus
AHTALADLSTSNPPAESAVRQTDTMTSHHDRQERPDEDNFEGLTLKDVNPKRPPFYRDWTLLQLNTLLLCALLTQIASGYDSSMLNGMQALPQWNKYFGKPTGTRFGAMTFGPTGGILISVLVSSQLCERFGRRYPICGGSLIIILGSIIQAAAVNYGMFVVSRFLVGLGLGIVATAAPPLLTEVAYPSQRGKLVSFYLTTWSLGSLIAAWITYGTFKMTDRRCLTRRGWKVARPA

SEQ ID NO: 26808 - protein, 284 aa, A.fumigatus
  UNSURE (284): Identity of amino acid sequences at the above locations are unknown.
DPPTEYPEFVPQKGPSTGRYVLRESSLWTCGFFPGLLYVLLERAIQYPSAFPYLGHPHSLDPASLRDHLVALCTKWTAPIYPMSLRTDTHDLGFILAPSLRRSWELTANPNSLRALLTGAQSLASRFVPATGAIRSWDVLRQSDVDITSLETDCLVIIDSMMNLDLLYYAAAHLGPQLAAIATTHAKTLLHSHLRRETIPGTARAGYSTIHVVNFDPATGAIMERRTAQGYAADSTWARGQAWAITGYAQTYAWTRDRQFLDVAIGLAEYFLARLEGAPPCVEX

SEQ ID NO: 26809 - protein, 144 aa, A.fumigatus
  UNSURE (122),(127): Identity of amino acid sequences at the above locations are unknown.
TSIFSTTRRRIWVRSWRRLRPRMRRPSSTPICAGRRYPERRGRVTPPSTSSILTPPRVRSWSAALRRGTRRTRRGRAARRGRLPGMRRRTHGPGTGSSWMLPLGWPSTSSRDWRGRRLAWSXRWMAXGSAGTCRCGTLMRRSTK

SEQ ID NO: 26810 - protein, 279 aa, A.fumigatus
GGTRYLPAPSCKTAAIGHLEGAVGDPGGDEGAQRPGGEIEGDELASLGRVGDLGQERRGGGSDDAQPQADQEARDHEHAVVDGGGLDDRAQDDDERAAADGVPAAEALAQLGGDQHGDQDATGWAKRHGAETGAGWFAKVLVPLREGLHAVEHAAVVSRGDLREEGTQQKGVELEEGPIPVEGRAFGIDILEREAFKVVLVWSLLSIVVRSHRVGLADGRFCWWIAGRQVRKSCMGLCTHPDAEKTWGNIGSIPESIVRWPSIFPGGSDGFGAGECARA

SEQ ID NO: 26811 - protein, 224 aa, A.fumigatus
TRMVTDTGVGPSNRVSGVRPSKRTLDRALCPPRILLVDLRLLPRALVRPPRTGHPIPLGLSIPGTPSQPRSSQPARPPRRPLHQMDRPHLPDVPANRHPRPRLHPGPVAPPLLGTHRQSQQSSRSPNRRAKPRLALRARHRRHPQLGRPPPVRRGHHLPRDRLPRHHRQHDEPRSSLLRGGASGSAAGGDCDHACEDPPPLPSAPGDDTRNGEGGLLHHPRRQF

SEQ ID NO: 26812 - protein, 160 aa, A.fumigatus
TLTLVDPLDRTTVLDPISRFCAYFPDINECIKKRNHKLLDYDAMRAKVKKLVEKPDKDATKLPRAEKETEMAKQAYEQLNEQLFTELPQLIDLRVPYLDPSFEALVKIQLRFCAEAYSRMAQVQQYLDAETRDQYARGDLDNRVEEVLQEIRDLSIAGTV

SEQ ID NO: 26813 - protein, 184 aa, A.fumigatus
TESGPKLVRQLSSWLSTTQSEVLGRVVRQGDVALPANFGDYAYGANAEWQLRGVDPRSLKSFRPTLVILHDELEAPLGKVRVKRGGLEKASLRGHRGLISVMESLRGKGLYPPRTGQAAQGANAGLSILRVGVGIGRPSTRTRNDVADYVLTEMNASELAAVRAAAVPVLDILADELYRESNDD

SEQ ID NO: 26814 - protein, 154 aa, A.fumigatus
SWIGRVCCASSSALLSESRTSSLSLFCASYSAYYACMPVLLSNTLDSGTDDLSISGLILIFIEVPFLLRICLPSSKFDAFIRRFTTNWMRAAMYGVMSVVQWLSLLPGSGASSLIVAAVFLLIASIFYALAGLKSQEFVGSKTLGGQGLVQMIV

SEQ ID NO: 26815 - protein, 80 aa, A.fumigatus
TMRRCKHLCCREGLEKPPKLTRKQSTNGNQVKSGLNQLTLSASIPRTKAGRTSTIEARDKGSGKTPPKGRGIHGHQLRYH

SEQ ID NO: 26816 - protein, 61 aa, A.fumigatus
ISQSRVSFNRQNLPEKKTLTNNKDSGKGSTIFKQSYRTRAYLLRKVQRAYYTAGMEENYPP

SEQ ID NO: 26817 - protein, 123 aa, A.fumigatus
SKQRDVSHLISHHPNHHEFRDYHHSNLSSFAMETTLTHRPWEPTTTGPQNAPTSSAQTLPSISTLTASMASNIPLPAEKSPGNASLNTVERDSGTWSMPQSTSMISCSTSAMPDFTRGCESAQ

SEQ ID NO: 26818 - protein, 85 aa, A.fumigatus
TTTNSHLIIISRLPQFEFHLSVANTLYASDKETPHYQPDEQKLDARFFPTKPPGNPVSSSPEAQSINKARHFHIKTIAQAKSQLM

SEQ ID NO: 26819 - protein, 198 aa, A.fumigatus
RRAAAMSLSMAILAGTTSVTDNTGATVVAVIFLFVFQFIFTVGYSGLTFLYATEVAPLQLRAAISAVSTAAVWTFNFLLAHVTPVGFNSIGLQYYIIFAVLNAAIEPTVYLFFPETNGRTLEEIDEIFIRSKSIFEPAPRRAQPAPDAFCRSGRRRDGIRGRPLQINQGLNCQRFDDSRLDWVDPEGFRQVSGQRSAG

SEQ ID NO: 26820 - protein, 140 aa, A.fumigatus
SNPPVPMVHPRLAANLSLPKPLACIQEPSLQGRCSGHPDHHCTSSASSSIGLPMQMQILTRETKDSSSSWNGQTMMRSEIIPQKAAGVNLGQGHLYYHFSVSTLATNAPDPSLEHQIAFFEVPPLSPTAPSCSFLKDFLS

SEQ ID NO: 26821 - protein, 155 aa, A.fumigatus
TRTNPRPAVLSTGMILFFCYPCARAATDFSSDINTNNGGQYNALYWYMVGVRLFRDRAVANAPRTPATSKQKRIAWGCTAHIRCTLVAAALRAPTLIRLSLRILIFRGNVPDSARGKVSGKASGADSTFKWVVHWYAENPMSALNVPMLIIQVQR

SEQ ID NO: 26822 - protein, 171 aa, A.fumigatus
GCTRPTRACPAGARSPTPSEAPRCLTSPWLSSSRSTAPSRSSSPRRPRRPAPPRCASARPCLLRVVAPKSRYATGQLSSPDKKLMRQVNSWTGPIPSAPKDLNSRGVTRGAYRGLGEVYDVAIPAGTIVAGTNTVRGNSFLSSSYRDDNRNRLPLVSSLAAPETRSSVLTL

SEQ ID NO: 26823 - protein, 64 aa, A.fumigatus
RGTFHPRGEDGIDVKFTVNRSNCDITSINYYGAELQYQGTGSHIGSGLGSASVSATQSGVFRYC

SEQ ID NO: 26824 - protein, 77 aa, A.fumigatus
LSRYNDEAQYWTYTASDGSFTSPAMKPGTYTMVYYQGEYKVASTSVSVSAGSTTTKNISGSVTTGKTIFKIGEWDGQ

SEQ ID NO: 26825 - protein, 95 aa, A.fumigatus
SSPSTGRTATSHRSTTTAPSCSIKAQAVTLGQVSDLHPSLPLRAVCSGTAEDGIIVLTSVCDYIKVTCSTSTLTHYFVVHNGDPIIHMATYITAG

SEQ ID NO: 26826 - protein, 130 aa, A.fumigatus
QHRPTGFRNAANQLRMHPSDSRMSSWGPLTYTVGSSSLSDFPMAIFKSVNSPVTIKFTASSSQTGAATLRIGTTLSFAGGRPQVTVCHRPALFAGQEANETGQLVDRTDSLRPQRPQLARCYSRCVQGAR

SEQ ID NO: 26827 - protein, 222 aa, A.fumigatus
  UNSURE (99): Identity of amino acid sequences at the above locations are unknown.
YIEIWFESLNSITMSAPSEAPAATVSVIDSHANSAPSNSIKDQTSAATTVQSKAQVPPSNTSARDEKDNELDLPTSAADGLVQKPFPRPLDTSKAAAPXELTPDQQSKYEAVLKAVSEWTTLPTTSAKNAPTAPITDDERMFLTRECLLRYLRATKWNVTEAINRLQRTLTWRREYGLEKLTPAYISIENETGKQVILGYDIHARPCLYLLPSNQNTETSDR

SEQ ID NO: 26828 - protein, 418 aa, A.fumigatus
HAWFNHSSTIPIYRTELLLFDDEIMVLGISPPSDPKRAQAWWTEVFLSHPPREVVYAPEFPPRPDEFQEIDWAPNVGSKDAKLAHILWDRPTQKLREYLDSLGQHPFPRPDDDDDTRAMNHTEGLAFEVYELLLREHMYPIAESEWQDKWTQMGMDQAKWGIDDILQDWGHAPNPGPILIRGNDVMTSRQLTVARLKQELRDRNQPETGTSQVLRQRLCDYERKSLTLFSRSDLGHWGISSGKPRGRRIHPGDKLDTLDMYTWAIKLSPYNPTYWISRAYCHYQQAFFDLAIGDAYRAQLLCEVLVDARCRNRQPGLYPRIWHAISQHIMAGMHTDTGDVPPEVEKMRQPNGINYFIPTLRKALHNIIGLSLAALQAREDGKAMEKYLPQRVIMPDRDRRPFERRREVFTARARKQAW

SEQ ID NO: 26829 - protein, 176 aa, A.fumigatus
SVGPSSRVVKMGPTRWGRRHSIIAGGIGLSTTMFLIGALYAADAVHPSSGPGRWLVIVAIYLFAVIFSLTWAICIKVYAAEIQPQRTRASATSLAHGSNWVTNFLVALTTPILLAKSSFGAYFLFGGCTLLTALVCALFMPETKGKSLDEIEEAFKSKSLGSHLAKAIRPITRSSN

SEQ ID NO: 26830 - protein, 284 aa, A.fumigatus
TRSADPSTPVVKTNLYVQNEATAALLSRTVKANEEVLSGLKVSRAHPAFGSAVKPSTSLAELATLGINDPAVAWPVFEALWAELTATSASPGYDMAFKTRPPILATVDGLAHWMKNTEYRSADFEPIHAHDLVFVRHFLSLLKPGAGQPTLPNGGMLLYATSASNNPTVYSFEVALKQVAARQAGLNPSAPEFPQADPYSKVDKRVLDAFDSPKPSSAKEGALELQTIGGLTRDEARGFMEYFARSGLLRENINDEWVGEKWSLAGGGIVGELEKLGRRLRVMA

SEQ ID NO: 26831 - protein, 291 aa, A.fumigatus
RGVVKAIRRKMEADLNKKRHHAPRAHRTRKAPPGTVLALKPSQALQIKPNTTVAEAAQMMAAKREDCVLVTDDDDRIAGIFTAKDLAFRVVGNGQKAREITVAEIMTKNPLCARTDTSATDALDLMVRKGFRHLPVMDENQDISGILDITKCFYDAMEKLERAYSSSRKLYDALEGVQTELGSTQPQQIIQYVEALRSKMSGPTLESVLDGLPPTTVSVRTSVRDAATLMKEHHTTALLVQDQGSITGIFTSKDIVLRVIAPGLDPATCSVVRVMTPHPDFAPADMSIQAA

SEQ ID NO: 26832 - protein, 233 aa, A.fumigatus
  UNSURE (216): Identity of amino acid sequences at the above locations are unknown.
DGIFIYCRSSLLEHEHGLGPSGLDRIRQPPSRTLNLPNRSASSLVPLSPQSNTPSRRSSTASKPSLMRISSNDSISTLEDLHRFPLESLHSFSFAQQSDELLNSRHNILKRSIDFMRDRFGWSAGNSAIANAQARMAGDAEAQSMVELMSKTSIAGKDDRHNYAGLSRGPLTSPADVDSGNLFDQAFTGPGGSAIESKATRQGHDASGGNLLSTGXIPHQRREMKSAPSSRRP

SEQ ID NO: 26833 - protein, 64 aa, A.fumigatus
ASIIVSVVLPRNTCFGHELYHTLGLRIASHASLRVGNGGIASGPAETVTHKIYGSFQNVMTTVE

SEQ ID NO: 26834 - protein, 146 aa, A.fumigatus
QWCGPVLNSRPWPHWQASTSLSTASIRTDTATMADIADQLIEKLQTLETSIFEGQDATRQKLALAARKLFHTLETKEEKTMRLAIEEPVMFSVLQALIDTGLFEGWAAAGGGERDVTELAKLSKRDVEPELLRRFLSAESAIPRGC

SEQ ID NO: 26835 - protein, 73 aa, A.fumigatus
FFSRLDFSIFKRLIIIAMSAPTTPTFKLVLVGDSGTGKASKITLILPFTLEMQYLALLAFYKGRTFLNYLPWL

SEQ ID NO: 26836 - protein, 182 aa, A.fumigatus
SIVRTTRARIIHLRTDHKEVMKHLEKGLHEHFASFQRAQAAVAASGMNGTSVQRSNLGENSLSNAEMIGTPFAKVNSVVPDSPADQAGLKAGDIIRSFGNVNWINHERLSKVAQTVQQNEGVSVRIFVLKVHWADLTQGTIVVKIVREDGPASNNTTELSLELIPRRDWGGRGLLGCHFVPL

SEQ ID NO: 26837 - protein, 70 aa, A.fumigatus
RLWLIDQNLAVLVLGRILSKAIDPWEPTLTTKAGIQANREAAIVTIKASRKRIWPHGLVDNLSSIHSDRQ

SEQ ID NO: 26838 - protein, 60 aa, A.fumigatus
RCTISNSPFLHDNADFNAGIGVVVMLGQSNYLAIVGGGRNPKFPQNKVRSFQFWTACILR

SEQ ID NO: 26839 - protein, 65 aa, A.fumigatus
DSLQLVIWDDAKQKAVITLEFRTSVLGVRLSKSRIVVALLNSIHIFAFSSLHAGAGRIPRFEGNA

SEQ ID NO: 26840 - protein, 63 aa, A.fumigatus
  UNSURE (2): Identity of amino acid sequences at the above locations are unknown.
RXTFGPCGRRIAPSVSVIAVTTCVPTVTYVTVPVSTPSGAAGVHSSVPVIPSVPAGTPAPSAT

SEQ ID NO: 26841 - protein, 366 aa, A.fumigatus
  UNSURE (360): Identity of amino acid sequences at the above locations are unknown.
YWSSHLQWTGFDEGPMRPFSSFIFSSLLSLLSVVSSKWIFLQAIVSNRGSHVIIFEDHEYWFYLWPAVVIWVSDRVLRLIRIVYCNLHVQLGSRSRFQCTECVAAYDKDADIIHLELTPGSGLQPAPGQYYFLYKPFRLTGWESHPFTLGSWSYNDGAPSTQCRSLKRDTTTDVSEIPLLPDTPSSGSDYGSIDTSTDPPERKLALRFWIRPYDGWTRHLRDQCLQSPTRIIQPNILLEGPYGEQCPLWKYESVLLIAGGTGIAAAVPYIQDHILRSSTGQTSTQSIHLVWTARQPALLRDIAGRELKQALSRKDFRVSFYVTSESASQGAIMDGVEFACGRPDLQAIITAHAEEARLGXSSVLVW

SEQ ID NO: 26842 - protein, 239 aa, A.fumigatus
VLSSEPEWHSLEADHIPQLVVKKHPDPVTAYDDGPLAAYVLRLYDSAEFHDCRILLKSGKDNFPPITIRTHKVLIARSPLLASIMKSPAAKQDIPEIVAMAGENFLLVKAFGIALQSLYGLALLNQKRLRSMTLFSLGYTEESIKSSPYPINTALADFALCYASSGAFLQRRDIVETGIKLIVEVINWDNIELIFYFGFCMSKFLITAPQMAELEKSSADQPATADQVFTSGLAGRTHA

SEQ ID NO: 26843 - protein, 315 aa, A.fumigatus
AWEFKHPEFRANSKESLDNIRRKAPAPRKQTQNTDDSVPTQQIDLLNQQIVAQQQQIQHLSDRYAQLTVDHQLMLQELMRVQKTVLNHENVIHQVMNYLLSVDARQRRDSKAAAAFQAQGQGGSNVNGGQVDDMPSSPLQHASKLLSNMNAEVQFNLTGVESVGESSKSAPVVSTPALEAGPRNGVVRPPTAAGANPTNLLYPKMNGEIEPVVYPVGATNGIDPMYSEHVNNLPYPMPPKQEVDDTRRQVPDSRKKSTNVDPGWVRSPHILLVEDDATCRQIGGKFLYSFSCVIDTAVGSPLFPYGRKATDSLAV

SEQ ID NO: 26844 - protein, 144 aa, A.fumigatus
  UNSURE (16): Identity of amino acid sequences at the above locations are unknown.
RDSFVVLEVGCFSALXRRSVRCRTFKLTVLPYRSARNSQKTILPKHFKHSNFASFVRQLNKYDFHKVRQTNEENGQSPYGQNVRLRCSTQAERNLTTYRHGSSNTRNSERTARSRLITFDERRRRLESRLRTPTTPFRHNRSIF

SEQ ID NO: 26845 - protein, 149 aa, A.fumigatus
TICRILCLQNRKWTTLADKFPTVERRAQMSIPGGCAARTFYWWKMMQHVAKLVVNSSILSLVLLTQRSVLLCSRMDAKQLTVLQFDGLEAVNKIQDGSKYDLILMDIIMPNLDGVSACHLIRQFDRTPIIAMTSNIRSDDIQLYFQHGT

SEQ ID NO: 26846 - protein, 116 aa, A.fumigatus
  UNSURE (83): Identity of amino acid sequences at the above locations are unknown.
TSMTGKKILIILTDAKSFPLKKTSGPDAGKTVEQPSGFFLMELAKPLEKILAAGYEVTFASPKGLEPTPDPLSESLAAFAGNXYERRRENDLIDRMKRENGFSRPRPLGTSFHHGR

SEQ ID NO: 26847 - protein, 165 aa, A.fumigatus
GCGGAALQEKGLFNFNTLTYSAEGNTFFIKYNNVTMEEAHAQVFFRQKSIERNATFRIPEVYHAFIVSEGGCTGRGCTYIVMEHIEIDFERTVSDEQRAQAISELISIPPPPGVFGSLSGGRYRHHFFRDSQPPVPFSSATELEYNINRVSLALCPIGERILWLN

SEQ ID NO: 26848 - protein, 522 aa, A.fumigatus
RVSFQPRGVKTKRTHSMSILDTTKDLSALFTKQVRATPDAPALEDDSTTYTYAELDTEVDALAQRLRSYGVGRDSLVGVLLPRSAHYVIACLAALRAGGAFLVLELAYPPDLLADVLEDAKPVVVVTHRAEAKKVKADVPLIALDEPATHANGHTKEPSTPLPAEDDLDRLAFVSYSSGTTGKPKGIANPHRAPVLSYNLRFGVQDLQPGDRVACNVFFIWEILRPLLRGATVVAVPDDVSYDPAALVDLLAAKRITETLMTPTLLATVLARHHDLGAQLPHLRTLWLNGEVVTTDLARRAIKALPSTRLLNCYSACETHEIACGDIREMLDDNAPYCPVGPPLDPKHTYILGEDGKAVPEGESGELFVGGPLLARGYLNLPDTTAKAFTADPFDATPGARLYRTGDRARILPSGLLEITGRVGAMIKLRGYSVVPGKVENEIVKHLAVSHCAVIAHGEGLDRKLVAYIVRDQDSTDDRPVVQINLSGHSPAARQTLAPYLAHYMIPALWVEMDELPTHAGL

SEQ ID NO: 26849 - protein, 141 aa, A.fumigatus
AASARSSRTRVSVLSTLVSVLSSSSSKSITLNQWSRLVISKLVNFRIPYTMAKFVVYEKVVEAVYRKVDKNTISDGAKTGINLGSGLIAGFAAALVSQPADTMLSVINKTQGAPGESTVSRLVKIAKDLGIRGSYAGIGTR

SEQ ID NO: 26850 - protein, 166 aa, A.fumigatus
HCGDCGSFRPLVKTQLGTDVSLSQCSVKTRIQLDPVTYNRGMIGGFRQVIANEGAGALLTGFGPTAAGYFLQGAFKFGGYEFFKQQFINQLGYETASNNRTAVYLASSAAAEFFADIALCPLEATRIRLVSEPTFASGLMSGFGKILKNEGIGAFYSGFGPILFKQ

SEQ ID NO: 26851 - protein, 225 aa, A.fumigatus
EFILRVQREGKPDIFVARRYGEFAKLYRRLRTEFPGRTLAPLPRKNKSSTSTSFFGSADDEASSISSVSTQDTSEGYIGRTLAPGPHHSRSLSRSSMKSSKSGRLSSEGPRECVLYREEQRVSLRAFLRTLLQNKRVSESKAMEEFLTANPVTLNEEELTDVERRKAADAIRIEEQKQFYEIARQRAAELDVYMEQFRRDIVESSKQRVTNDPEPALLTFRTQMV

SEQ ID NO: 26852 - protein, 365 aa, A.fumigatus
LPRSPENCPSRLTITRVAATLYHVFLAEDNSPEMFAQFKRIHSLVPYTLLKNVIRIANPAAVMSGVLDLFLAQPFGSRSLLQRIFSMALNDGIKQFQKSIDSLAAKVDDPVLTGKLKEFTHADENIKNEIRTEAATEDVDLIVAILRSDLIAPELTPEQVGKVFNAYVAWNHAVDNVDLEMQEGAQWFANMKQLLKLYTRQRDKAMILSIIEEPVTLQLFRDLFTIFYEPLVRVYKSANVYSSITDFAQFADDAIAVIEKCHRQDVSADPNQTVQAFIDLCERHQDNFYKFIHEVHLHDNGLFTSLMGWIEDILEFLRHGPQGGKLDMNALFHGAKDVGQIDEAKAIEEINALIKWHEDRKRGSE

SEQ ID NO: 26853 - protein, 71 aa, A.fumigatus
SGFTHGEALGSKHQFVTLHTHNQPFSPTNRALLGIHMSMCNATSTRHLQNLVKKGELDISSLVTHRKFKSE

SEQ ID NO: 26854 - protein, 316 aa, A.fumigatus
VKLLFSTNLTVFYHPFLPISKSLFHSPFNIMKAVVYTQNETVEVLDRPKPTVQQPTDAVVRMLHASICGTDLHILKGDVPTAKPGLILGHEGVGIIEALGSAVQGFQVGDRVIVSCMTSCGSCRFCQRSIQSHCQQGGWTLGHQVDGTQAEFVRVPHATLSLHPLDSSVDTCAAVSLSDALPTGFECGVCNAGISPTGSVVIVGAGPVGMAALLMTCLIKPAFIVMVDLDDARLETARTMGAHHTVNSAAPDAIQQLLDLTENKGYDSVIEAVGIPATFEMCQELVAVGGQIANMGVHGVKVDLHMEKLWDRNISL

SEQ ID NO: 26855 - protein, 68 aa, A.fumigatus
LNRSLAKPTRAARGHTGNNDPVAHLKSLNGGSQCFDDPDTLMAQDKTRFRSWYITFEDMKICATDRCM

SEQ ID NO: 26856 - protein, 202 aa, A.fumigatus
ASSQLIAMWLFRGAQSAVFYYASCTPCAMSFDRRKRKKEAVRSQREKEKVDAVITDQPKPFAQPTPFSTNPGWAEEIALGPGPPARRSGHRNNHRLTDSWNTDPLSPMESIHDEGEASKRKDKSREKHPQGDRRNRKRNLREEEHQRGEEEEEKGSSEGISVRGKADTTEPSKYYIARVPPVNDLHPPIVSGPKSRAETRWM

SEQ ID NO: 26857 - protein, 74 aa, A.fumigatus
QIAGRSPRALSSEFRNRTENALHVVVSATANIEIKLQVPPGQIDTQTLFYTSAFAGLVYIKRCYSHPDLRHHHS

SEQ ID NO: 26858 - protein, 174 aa, A.fumigatus
AMLGELVQGPGERVWAGTGQAAQGCRPPHVPLCAAVCLSLLYRDGILLIPLFRLDIPPFMSYAAAYSLFNYHLADPSKGLVYDNLRLVRAFERGLDPKSSEAGFILTHIDMVKESNGLISGALKVVDTLEQGGPRSEVNDGFREILASMEKIEACMEGKLLHRHSSALTNSTPG

SEQ ID NO: 26859 - protein, 189 aa, A.fumigatus
THRHTLFLSTSTMTQNKVPPTSTTTLKRFPHIHDDPATLPRSLDPFTITTSTGFLPYCTSPTTLPDAFKPLMDLLDRMPVVRQDGSPGLLAKYELGPAVETELPDLTDEVDKLVTADGSRDLYMVTAVFRDYSFLASAYLLEPCWENWCKAPENGYGLGRDKLPKAVARPMYHCAQLYVFRCCIVMVYC

SEQ ID NO: 26860 - protein, 135 aa, A.fumigatus
TPLLPRRKWRQRQHGTLPNWPPFLSAIPINIYLPQIPLLDHLLQIPMPSTPLTKILHEFRAYRPLPHREFLAYIDSKAAEVGVRNFAVQDTETTVLLLKTLNHVRSFRWRHWLFAREYIIKRTPSSRPGAGRYRA

SEQ ID NO: 26861 - protein, 159 aa, A.fumigatus
ATSPSFIRTHELNSRLTTSDMWANSKPAEYLSFRVFIFGITSQSMFPNGVIYDGVLDNKPLYFRGESGANDSMVRSLTGLPFYLQSQLTSIYLRSPCSTTSSKSPCPPPPSPRSYTNSAPTDHSPTVNSSPTSTPRPPKSASATSQSKTRRLPSCFSRR

SEQ ID NO: 26862 - protein, 112 aa, A.fumigatus
  UNSURE (75): Identity of amino acid sequences at the above locations are unknown.
IARNHKIYGMWFDFAQRPPLQIPQAHRDIFNHIANVKAAKFNDKMTRSRNDTNTITGTDSTLHVEKRRLLNAVLXGKSFHSMEPLLVKLVTHWCKLLINGPCTAWSTPRGNV

SEQ ID NO: 26863 - protein, 154 aa, A.fumigatus
EVLSALSWQRSTYTDCSADSSPIRYMSSSSPTRAQNRQSRRSDIPSSSSGLFVSSRPSIESNRAVSRRSDLHSGGFLSSPNRRRRVFVDANGMPATDGDPRSDATFSNIHPDTSEAEALGGSSTRVIWGTNISIQDSMSALVFYHGAGRSRDCG

SEQ ID NO: 26864 - protein, 516 aa, A.fumigatus
  UNSURE (303),(514): Identity of amino acid sequences at the above locations are unknown.
SSGSLLLQVKMTKKSVFDLHDSNMAYRLSGQLRGPTTPVCAPSTAPSQTTTTTSFSPADYAQPFCDFMTAHPTIFQAVDGFTKELESKGYKRLPEREAWTSKLQRGGKYYCTRNGSAFIAFSVGKNYQSGNGLAIVAGHIDALTARLKPVSKLPTKAGFVQLGVAPYAGGLNETWWDRDLSIGGRVLVRDPTSGKVESKLVKLDWPIARIPTLAPHFGAPSQGPFNKETQMVPIVGIDNSDLFQQQVSPTAHSSSGIKPGSFAATQPERLVKIISKELGITDYDTILSWELELYDSQPARLGXLEKDLIFAVRIDDKLCCYAAQQALLASSDDTSTGSIKMVGMFDDEEIGSLLRQGARSNFMSSVIERITEAFASSNYGPNLLSQTVANSFFVSSDVIHAVNPNFLNVYLENHAPRLNVGVAVSADPNGHMTTDSVSYSFIKRVADRCGSTLQVFQIRNDSRSGGTIGPMTSARIGMRAIDVGIPQLSMHSIRATTGSLDPGLGVKLFTGFCXLA

SEQ ID NO: 26865 - protein, 133 aa, A.fumigatus
TDPSAKLYSIICTKVLWFNQAHKSRKIRTSTTFHRPKTLQLSRSPKYPRKSIPHEPRLDAHKVVLYPLNTESAMNNIEEHNTLVFIVDVKANKRQIKLALKKLYDVDTVKVNTLVRYETLVFVVLMILPETVF

SEQ ID NO: 26866 - protein, 60 aa, A.fumigatus
FGVWAAVHHLADVCWKKCITGKISSGRLGQGEESCAQNCVERWMDTNFAVLKHLETLRGQ

SEQ ID NO: 26867 - protein, 124 aa, A.fumigatus
  UNSURE (70): Identity of amino acid sequences at the above locations are unknown.
KLILVLVVMGEYTHHKATQGVETIVVPCSDMSGVVIQVGEGVTAWKAGDRVLSTFLPDHQTGQVTEKELXRGLGLPLDGVLATHRVFPEYALVRASCLFDARRRLLHFPLASVDGVGSLIMGIP

SEQ ID NO: 26868 - protein, 63 aa, A.fumigatus
SIDLSHPIESCAFARCLRITERNSFQPPPNTYAPFCQKADARCMCLFDHAIPGESIYALFVDE

SEQ ID NO: 26869 - protein, 324 aa, A.fumigatus
KLRRGQGITPLSVIPPVYFEDDFHLENPRTFDVVSEKSEVVRPQKLPGKDGQGTNESAAETAITGRKALATNAILQEKLSWYMDTVEVHLISSISSASKSFFTALGSLRELHSEAADSVKRIQILRKDLQKIDREMALGGLKIVNLRRRRENVRMLADAVSQLRDAVQSVARCEELVENGQIEEAADSLEEVERLMAGEQSTNSDEDGASRDRSRKPVDLRRLKALEGASDDLAQLRYRIGMGYENRFLNDLLGDLRKHVENVPSDVTLQRWGSSFQRQRGAQRSGASASPAYMKFDDDMRSRLHTNLIGLARAQYTTPAATSF

SEQ ID NO: 26870 - protein, 70 aa, A.fumigatus
TAVLREMKGLIRKHMPSSSDDDNESVVSVSTHRSQQRCQQEKSSILARNLRALYAEDAYYMLTRVYTGIS

SEQ ID NO: 26871 - protein, 75 aa, A.fumigatus
IVQEPVFVSHAYPVPQLRKVIRSAFKGLESPQVDRLPRSVSRCTILVAIGGLLPSHQSFYFFKTVCGFLDLPVLN

SEQ ID NO: 26872 - protein, 554 aa, A.fumigatus
ADPSSPVVKTLRARFSNVDNNLQQRITDESEGACCVKWHTLEAMDPSYISTALDRCERRIDIFQGPICAVEIFDFPHEQIFFIAAHHLVIDFVSQQILLKDLDSLLAGEELSTPRPLSFQAWSLKQIEYGSNLALSPQAVLPHHENVPLANLNYWGIAAMDSCYADSAVRVLEFDSTVTSSLVGDANRAFNSEPIELFIASLLHSFANTFTDRSAPAIFKEGHGRQTREPRLDPSSTVGWFTTITPIALAVSPQLSTFEDTLRRVKDICRAIPANGFDYFTSRFLNASGSSAFQSHGPMMEIVLNYAGVLNNVQQGGTLFCPIATEEQRQMRYHDINPQLRRFAVFDIYAQVAGGKLSFTFAYSPSLNYQDRISAWIESLRRLLEAISVDLPAKQPQKTLADYPRARLDYTALERLHKDIIPSLYPAKLDDVWECSPTQTVMLRARSYQPLFFSPHFIWKIAGTRASEGNRERLTKAWKRIVARHSVLRSVFTSQLTATYHQIVLANPPFFITWADMAGKESPSEALRRLPPLPSDELHLAFRLTASEDDEGDL

SEQ ID NO: 26873 - protein, 160 aa, A.fumigatus
VSPTTAIPVWSVAVTTVVAVLLALIPIGSAVAFNDLCAMSITGLFLSYIMVAVLLLWRRTTGAISLTAGADETVNTIGAKLVWGPFRIPGVWGIVINVFAIIYCVIAIFFSMWPTYSEVTVQTMNFSSVGTVSVILLSVIYYVLRARHVYEGPIVETVPR

SEQ ID NO: 26874 - protein, 129 aa, A.fumigatus
QSDGEETMSNPPVAAADEVEVSADAGAGGQMSVLDALKGVLRIALIHDGLARGLREAAKALDRRQAHMCVLNEGCEEEAYKKLVIALCSEHKIPLIKVPDGKMLGEWVGLCMYSPYPFLWRETSDVPWD

SEQ ID NO: 26875 - protein, 92 aa, A.fumigatus
VSWFPACKSSSTVFRLRSQATLKMMPMKQAERIKGILKSISLDNIYLPSDPGGAIDLTVDAGEYQARVANAIAEIAKGRYTKAIPSRKVPLD

SEQ ID NO: 26876 - protein, 133 aa, A.fumigatus
TRVFGPQLRFPEISLALRRQDAQIISYASAFLAQTGPAHWETLLRARAIETQCYIIAAAQAGQHNKGRASYGHAMIVNPWGEVVAKLGEEPKEPQIATAEIDFDFFSRVRTKMRLSRGVHGSPVKIITFLPHS

SEQ ID NO: 26877 - protein, 205 aa, A.fumigatus
RTSISPFFRFRLPPFFKLNSVPSPLDTPSSMARFGQQIILPGAEFPLETAVALLDYYSKADYYVYERDDIWYLGLGAHASLVVDPKGQTATEIDSEGRKESSTILNLLTGQVRQFVSKYSIHGKIFGRSGSTTRRAAPGQAYAPSQWPMLSLMVPRVQVIIDRVQIAVTGHAENDAHEASRANQRHPQIDLPGQYLSPIRPRRRD

SEQ ID NO: 26878 - protein, 323 aa, A.fumigatus
LQWIHRLQFGHLPPTASVTPTAPTPSSTLVVSQNPTADQYANVSQAIAALRNDGQAYTIYIKAGTYTEQISITRAGKVTLRGETSFKNDYTQNLVTIQFSYGVLTSAGQDENTPVIYAKKTDGSGLALYNIDFVNTYPQTKNTAALAADFYGSNMAAYGCSFIGYQDTLLANMGVQVFSNCYIEGSVDFIWGFSTAYFHQCYIASNTAGAYIAAQSRSSSTAAGGYVFDSCYVTYTNTYGTTFGQTYLGRPYSQYSIAVYMNSYLDKHINSAGWSIWSTSAPQTDHVTFGEYNNSGPGAWSSSRASLATSSSQGCQAPRYMYQ

SEQ ID NO: 26879 - protein, 240 aa, A.fumigatus
VVGERHSEAYEGTSVTVDEMEVFRNWAQEISRSDEEYIQWEQDLQQDVAEAWMALLLPLVRNVQQLRLVYPKENKYLDRMMQRAVQREKPFDTQPAFRALRQVSLGHLDDTLDSKGTYAPSQVLPFFQLPSMRAVAVDSVVESTSADEQPQPEQEQEQEQEQEPSPTSSVSEIVLNSSSGANGMTSIVAACSAIRSFKYQHSDDHLLAEGYQPAAFYRSLSASKHTLHTLWLDSCGGASP

SEQ ID NO: 26880 - protein, 66 aa, A.fumigatus
GIRSHMNGWVRAHQVGLVKNLRLASNWPIIKCDDASAHVSCINYLAACGSFMTRLHASIAMLTTSI

SEQ ID NO: 26881 - protein, 158 aa, A.fumigatus
  UNSURE (9): Identity of amino acid sequences at the above locations are unknown.
THLKSQYFXRDQCYLWRSYSQHDYSLSEVCYFLRTKGRELPLKLLKILWTFSIWLESTAILPQLFMLQRTGEADTITTHYLFALGLYRALYIPNWIYRYFAENRFQPIPVVAGIVQTLLYSDFFYIYYTKWVNCTRIIFNDRLMKNRVMKGKKFSLPV

SEQ ID NO: 26882 - protein, 562 aa, A.fumigatus
  UNSURE (549): Identity of amino acid sequences at the above locations are unknown.
NATADPSSPVVKTHKELCRGLGLCKGRKFDSEPSEKSTRTPSEHVNASEGEKSERVNAPHRKRKKEVKESQDAKRNQASAQQRVARQEKERRRLEHKMKLMGVSNTDPTRQAVSFGDPTIYLNPHIGQRVKPHQLNGIQFMWRELIQDEKQQGCLLAHTMGLGKTMQVISLLDTISAAAASNDPKISEQVPECFHRSQTLILCPSSLIDNWYEEFLMWTPEESRIGPLRKVTASMIAVSERLREVSDWDKEGGILIMSYDIFRKWIHNKETKKMDKPLRDDEHANVKKWLLEGPNIIVADEAHKMKNSSSGISRAAVQFRSKSRIALTGSPLANNLTDYFTMVDWIAKGYLGEFPEFKANYVEPIEEGLYVDSTHYERRKSLKKLQVLKEILEPKVNRAAITVLEGDMPPKVEFVITVPLTELQRAAYDSYVDSVVQGKTEVGTAKLWTWMAILGLCNNHPACFRDKLLSRANEAQSAGSSLDEMLPGDEPITQAGIPDSEKLVSEQERLFANVPDMNALNLSYRAQLLDRIISESIKGGDKVLVFSHXIPTLNYVEHVLKN

SEQ ID NO: 26883 - protein, 110 aa, A.fumigatus
QITRGKWYKDGDKDAEITSEDVQQKTAPPGGSVNVNSCGRSDASSGTTGGFDLYDGNTKIGRVHWDCPWGSKTNDFDVGERNKNYWVEIGTWNKYGGAIGTVDVEVGRKR

SEQ ID NO: 26884 - protein, 277 aa, A.fumigatus
DVPKEPRSSIAATTLPAGVPEPTPFFPASEQGPEPVTTNLPSSTEPADAVSLSSFVVVAPSDVHKASLPTTSSLSDSPPNHESNTDIRKSVPSPTSYNQTSGLSSIDGLSSTELSTTPWSSEVATTPTVETGFLVETPTSNTVTAAFPSATNPSQNFSDHDSEDVRNRHTLRTILGSIFGTVGLIAVILLMCFLIYRYRRRKPRDGRSIGGSEKLLRDGRHSADSWASSQHAFLSRTSSLSDAPSAPDHHVPALNMAYAHVRPGSSHHLPAGLKVRQ

SEQ ID NO: 26885 - protein, 125 aa, A.fumigatus
LIRQRANNVDPYLRETRLKSFLEPIRKAWQEEEFRTTSSSFEGFCDMLGLQNVGPYMQKNQAQKLEDWSAVPLDNEGKQIPETMTREFQVLSLRPTLGDLTLSLIRAPATTLKGTKISSQSPTRY

SEQ ID NO: 26886 - protein, 62 aa, A.fumigatus
VAFQRLWDTYFLTRNWKTFYDLLEPKIKEITMANRVDDKLHMEHTSILLIIMYGHLQSSSAL

SEQ ID NO: 26887 - protein, 142 aa, A.fumigatus
ESRRRRLRCIAMMMAQPFPAHQGMPQHPGLPPGHPMAPGQHPNAHPGAGMVQAVHPAVSAPGGPQVTQGGPMMGMPPGAGTTGPGGPVQAHALSHLGPAQAHLFQQPQFAQTCTSLSLCTTLSIWRGGGVFTTGLEGPSVLI

SEQ ID NO: 26888 - protein, 166 aa, A.fumigatus
RPQSLCSYFVRILCLNEALVGFSRLTRKQSAFEDSRFTPIPQSLLPSLSCSLTLLGSFEPCTNALDWILGVHGIRISFIHRGRRYGATYLPDIAVEQGWTKEETLESLMRKAGWDGVTTGGVARRLLRGSSGGGHSGSSKPWEQVSDFRVVKYQGLKASASYAEWQ

SEQ ID NO: 26889 - protein, 232 aa, A.fumigatus
SQWVAFAEVRVEHRFHCFGHRKMASPAHCIYCFECLAASYKRHEPIDLAAVEELWERYEQSKKPASLQDINNPVSQRDSADLGREVVVEEEEEEDDDDADEELDTTQRGSMKSKSSRPHSIKLPSVSRLQSQLSSDSSSVSTTPSVMSTSSSRSILSGSTAATTPISESTQPEMAETRQQRLHDQRYPLFVTWNTLSKNGHKSLRGCIGTFDAHELAEGLRAYALTSYVSFA

SEQ ID NO: 26890 - protein, 71 aa, A.fumigatus
SLFKMSSFMFTCKSRLSDPVHSGYKSMLWLFSYENFGPLLSSHLMDIIFMYRSISFPPPEDIYTSIVRHDI

SEQ ID NO: 26891 - protein, 61 aa, A.fumigatus
YRILRLCRFYKNSECIHTDQLVSYQNQREVAQGIKRAFQDIPGLKREDLFIVRRAQSPKLP

SEQ ID NO: 26892 - protein, 106 aa, A.fumigatus
QLQTSKLWNSQHHPDDVEKALDDCLAELELDYLDLYLVHWPSSFKRGDEYFPLVKDSPIPEGDVEIDDSISIVDTWKAMIKLPKSKARAVGVSNHTIEHVSHRHHN

SEQ ID NO: 26893 - protein, 120 aa, A.fumigatus
FLQAFGNNMLGLPLLIASDEFKAVAADVPKRLGQEVSPAQVILAWSQVGGHSVIPKSVTPERIRSNFQEIELTPEEVERVSALGKQPRRFNIPYIANKPRWDINIFGEEEEKPATHKVII

SEQ ID NO: 26894 - protein, 231 aa, A.fumigatus
  UNSURE (224): Identity of amino acid sequences at the above locations are unknown.
ALYSVRRAPRLWQRDISKALEEIGLQRIDTDSCLYTDDKTVVLVFMDDILFLYHHKSKKHADNLIWKLQKQYKFQDLGEGDSFLNIKITRDQMKRKLWLSQRAYIEKIVARYHLDLTNQKARTPATTDRLRPYNGKATVNKIHHYQSKIRSILYAAVTTHLDIAKITSDLSRYLLNPGPAHFDAANRIILYLSSTKDYALEYGSDLTGNIFIITSNAAYVFTTXFRGVPSI

SEQ ID NO: 26895 - protein, 96 aa, A.fumigatus
WYGTALTTSGKLTAGEVLRTFWACLTAAQSIELALPQVIVMEKGKVAAIMLKDLLNDRRVKKRPEELEGASYPRYCEGDIEVCDVSFPANNSCPVF

SEQ ID NO: 26896 - protein, 394 aa, A.fumigatus
SSQPDRPILSSVSFFFPAGETTFVIGESGSGKSTLGQLLARLYMPTSGEILIDGNAIQALSLNWIRNNITLVDQQSVLFNESVLTNIAFGRRAHETVTKGDLRECIDLAMLRDTIDSLPNGLDTCVGPGGSFLSGGQRQRVAIARARLRDTPILIMDEPTSALDGINRIAVMKAIREWRRGKTTIIITHDMSQIVDQDYVYVLEHGSVVQSGYRHELENSPAKEKYFRFSERQILSKSHPKPEVPYVNGETQEIIDFPNTICVSNFGFKETPVLSRRIPSQPKNTQLFDRRMEETQLAAGLRNVVKAASQAEISIPDGVAIPMCELSMAQSRRSLISAHRLRLHRASLPPPVPAINDSRPIKRPQYAGGDTPLSGPHRLSMKPDHADLIAQPSP

SEQ ID NO: 26897 - protein, 292 aa, A.fumigatus
EDASSRFEGLPREDGRIASGSGPKGVWFDLFGSAFVVFELHTLFALSVTLLVVAPLVLLVTSIALARADKMYLFRSSASPEDSDGSEVVPLHGVRGFFRFPFLLVIPTAVTVGLAYLVTKFNPYIIHSSEYAVWSMMISAWVFLAWFVSRVADFARPSAFHRVYTLTWLFLVEWVFLVISTVYENQYGLAGGYFVLFVFAGTFLATWISYLELFALPRKSDYATQLALPSRRTSSHGSRLGTASGEDVEDGEDEDDDGTTAEATETTSLLRGQRTTFANYVRSSPQGPKHPR

SEQ ID NO: 26898 - protein, 154 aa, A.fumigatus
  UNSURE (35),(59): Identity of amino acid sequences at the above locations are unknown.
IFLPEPQPETTACTIETATTDPPSGGLTTSQPSAXTISSSSVDDYTSGMSQSASHPSIXSVISGASSFSGDGSLKDKECDQGVAVPSILRTGETVKARLLRPQRSHEDDESRYYCDDETDSEDDSEDEVLVIGRKKPSPQKPAMCGAQAFKPKS

SEQ ID NO: 26899 - protein, 515 aa, A.fumigatus
  UNSURE (364),(371),(479): Identity of amino acid sequences at the above locations are unknown.
EDQVAETDATELDDARELSKTVGTPAFYAPEVCYTGDDFEETIGSVPKITGAIDVWSLGVTLYGMIFGRLPFVSDDEYSMFQTIVKKDVFIPRKRLQPVEVDPESISQWPRYSNNNKRMEEELVYEEIDDELYDLLKRLLTKDPVKRITVKEIKHHPWVLHGLPNPRAWIEETDPGYQSKGKKIEVSNEEVTTAVSKVPFIQRVRSNVAKLSNYLTGRSKDKDKESRKRTSSTTPSIDSSASSNASLGKYILDGRRGSLREEDLYRPARLATRDAEHPLSHSVTASPVGRDNQTSYFDDLRTDATLDRTPRPDPPHRATSTLSTAGSAKTIRPDWTVTPCASQRVSAPSKIENHGTTHVGGLLXGAGRRLXRGLQTRKWRSDRSISGDTADSVSLDGDRHSEPSLALSVASAVGHVQGSNFLQDEDSHYFHAGSLSAAESGHRRNRSHHLTTKSSHEPFQFAKDVLLKKRRSDIYQAPXDDQVPPEIKSKSTDSLNILTRAATRDNSMHDRNCHH

SEQ ID NO: 26900 - protein, 73 aa, A.fumigatus
IFHSLTEDYNLELQYRKPFLDIWRDEKDDPELGPLSERMGVRDRVTGKLLMTEEEKEAASESLYCGQVVLWHD

SEQ ID NO: 26901 - protein, 137 aa, A.fumigatus
RGSIQCSLSINAFESEEKARQMLRNVAGCLKKGGRFLGVCPNSDVISARVSEINAKKKARQAQAKKEKSDEAPEDGEVEEDDGKVEWGNQIYRVRFPITPPEDGVFRPPFGWKYSYFMEEAVEEVPEYVVPWEAFRA

SEQ ID NO: 26902 - protein, 95 aa, A.fumigatus
  UNSURE (81),(86): Identity of amino acid sequences at the above locations are unknown.
RDAGANSPAGIGRASAHQYAHNGAKAVYLCDFTDTHLETHKREIESLYPGVDVQIRVFDAAEEDAVKAVVADALALFTWPXWPTGXRTASHTAAP

SEQ ID NO: 26903 - protein, 151 aa, A.fumigatus
CDSLVLFINPPSGILFIFILGTLTLLIGMALAWAWGVITMKAALAARPQTETLARLQMLGQEAARQANATGQSAASVQSQLVYDGFMLDARVSVIYFAMTCVFIYFLVRYILVLHFYQVTDMRKKKRPGCAPRIPSSRSSRSSGPSLPICS

SEQ ID NO: 26904 - protein, 303 aa, A.fumigatus
SSSNRPAAPVLPKRANPHLLNLKPEPETPRLSPRAMTVLGVSALTISTYCGYLYASYRREVSNAKSLDVPQDVSDRYNRTAPNFDAEVEMSEKVMRMGKKRQDLVRKARGNVLEVSCGTGRNLEYYDLGERRGFDEDGKAVIRGCRSVTFVDLSPQMIEVARSKFEKLHPNFKNVTFRAQDAKDVVPPSAGEKPAYYDTIVQTMGLCSMPDPVGTLRHLGSITEPNKGQIFLLEHGRSYYDWLNNILDNLAPAHADRHGCWWNRDIGEIVRQSGLEIVEEKRWHFGTTWKYVLRPVRESQDAK

SEQ ID NO: 26905 - protein, 244 aa, A.fumigatus
ADSHVGCGHTKGKSVVSRGEAYARVQAACDARNEGQDIFILARTDALIHGWDEAITRAKEFKRIGVDAVFVEALPDREAMKRCSEEIGIPVFANIIEGGKTENLSALELAQLGFCAVAYPWTLVAAKLKSIRETLDDLKKSMTIGAPPMILGYSEVCEGVGFNRYWVCYILSNLSFRKTYHMLTMARLVKQDMSMMRTGWSIILKTELGRARKVPYIMTVRRERLFRRCCISFPVIYGCCWSSR

SEQ ID NO: 26906 - protein, 103 aa, A.fumigatus
IVLRIRHNLMVYRSGSIAFEKVLSNYAILKTVTPAEDVRGDTLWASGYEAYNQHSPAWKKFAEGLTATHYQSTFNNVIRNQDMELITENRGNLGNSGVISKAS

SEQ ID NO: 26907 - protein, 133 aa, A.fumigatus
CFESSTRNPKQNSFAQALQLRTNSPSRLIRRSQGSPKSFLPGKPHAKWLWANQIRGYIPMENMCRKIQELVRVTASPVMADGDTGYGSPMNVKRTVECFAADGAAGIMIEDQTWPKRRFPFSPGDHFTLSWLS

SEQ ID NO: 26908 - protein, 112 aa, A.fumigatus
GRRDKYEIPSQLMLIVISQQNSIHQIGMVEKGLFLVTLRNWQILGTSFHLEDQQQPYMTGKDMQHLLNNLSLRTVMIYGTFLALPSSVFKIIDQPVLIILISCFTSLAIVSM

SEQ ID NO: 26909 - protein, 78 aa, A.fumigatus
KHLVPFFLLSYFTFIDFYFYFIFSFLSSKIFFSKISNLYLQDGNPNTIYPFKYFLRTSVARARNAKGQAGPEEAVNGT

SEQ ID NO: 26910 - protein, 66 aa, A.fumigatus
SGTQRLQISHYQSSFALQVIIIVVQEPIHVIIPFITSFLLLLGIQIFALFRLLPLGLGIIVVVDIG

SEQ ID NO: 26911 - protein, 365 aa, A.fumigatus
AQTKLNAFFVKPKPPAQPTDDTASDSPKIPIADGVSKSTSQNPTPPQSDYQREFPDFFLQSHTRIAPPHQFERDPQALSHVRERVDACLQSYRNGSAEPLSFRPSELFRLMPYNRRRGRQAASVKEILLRMQSLEQSDPDSARRAQELLRRIKMKSLKFGEDVRPPYQGTFTKTLPESAAIKLMRNPFHRGLPDINYDYDSEAEWEEPEEGEDLDSEEEEEGSDEGDDDMDGFLDDDDDNLEGKRRLIVGDLEPLSTGLRWQGEGGDHELEMYRIQTTMDSVTFPIDPFSTAYWQKPKPTEQLPTGGCGPLHSPFIHGPFLPALNSQTCWPLFPAAGNPTPPVEPEGGPGQISTIDNPKPIGPPF

SEQ ID NO: 26912 - protein, 257 aa, A.fumigatus
NRRDRCETRDWPSPLERYLSSLPSLVWTTGPVQCSLDQDAFPKFNCLIAAPVVFEYSPPRSPAHAGIMTGAPPYNPQSPTQQPRFPVYSPPNKNRSYYPNNDQYQQHAPLTPPAFAPQASLSRSPHYSHAPSPLPATLPPLNGGAPPPGHHPEPSSQYQTHSSAGTPQFSLAKPYSASRMSSKGASSYNHSTASHAVPSARMESLSQSPPKKETEPLYPIGGNGAPGYSSSMMREPRPASPPRETVRPHYEHYGKRM

SEQ ID NO: 26913 - protein, 186 aa, A.fumigatus
  UNSURE (183),(184): Identity of amino acid sequences at the above locations are unknown.
KHARAADPMSFASILSGPTEETSPIKQPSLPEALPGPATTITPAPPTLAPVPARRRLTPPPVTHALPPTSQLKVKEPEPISPAALPRLEKKPSAEKRRRNVEQEPKSAEALPVASTHGAFEPTKAARVSNRKTLTERDAEAINKIIAEIDNADKSDVESPGFEVEYGRYMVKRSSHGAGRIQXXLI

SEQ ID NO: 26914 - protein, 99 aa, A.fumigatus
AVGIPLLTSPICSRRRMEGCAPIWELKHDATLKQFSRGQLKQPLDASGLFNQSDVRETVKRWDEEYELEAVLGRIDNDPNSITARWNESRRSHQKEAGL

SEQ ID NO: 26915 - protein, 308 aa, A.fumigatus
LNSLRTMATTPINGHATKSPSLDAAEARRLKHNHADVVIIGAGVLGCALAVALGRQGRSVILLEASLKEPDRIVGELLQPGGVQALEKLGLRDCLEGIDSIPVKGYYVSYFNDPVPIPYPKPTPASPPPEGRCFHHGRFVMKLREAAMACPNVSVVETKATDLVTCSHTQQVLGVECTSKDNVRACYFGHLTVVADGYASKFRKQHHPHTPKVSSRFWGLELIDTKLPMPYYGHVLLSDNAPILLYQIGTHETRILVDIPENLPSASVKNGGVKSHMRNVVLPSLPESVQPAFIAALEQGQLRSMPNS

SEQ ID NO: 26916 - protein, 131 aa, A.fumigatus
SSSARSSPTSKALERRSRNAEMERKIIELRKQIASVQANPAAMTPQQTCASLHSAHVTPKQESSHVSPAGVYHTPSAISSDQYMGSHEAVASLLDLRSGFEGSNYMRNGNLFKRIEDVVVAPEKVTELFDL

SEQ ID NO: 26917 - protein, 299 aa, A.fumigatus
GFLHRSYQNRFFMFYHPFLPFLDRQRAPDDYYSVSPLLFWTIISVGARRYQTDTHLLNSLAGPVTRLVWSTLADIPQSYHVVKALCLLCSWPFPTSSTSTDPTFMLCGMMMQVAMQLGLHRPSHTQDFSKFRVELIEEELRDKVRTWAICNVVAQRYVRILLLSWTSALTDSSVATGYGQPPSTLYDWTLSASGSVDPNFKLPEDIRRRLDVEIFCDKVTKTLYTNRRDPVGLCSDQERSTLISFLSRDFDDLEDQVKSRTDGKHSQLVPTCDTPLMWISYNRPLSACCQSPSAPVGIL

SEQ ID NO: 26918 - protein, 340 aa, A.fumigatus
  UNSURE (43),(46),(59),(60): Identity of amino acid sequences at the above locations are unknown.
QNAIFNQCRLTGAASPVWCLIRMPLVRNGSSSRGAGQKWVEGXYDXLFRQCLQGTHTLXXDDFFADQDIEPYQWHDQFTGSATKRIVRIEALAARMLATVMRGSSILEAGDVSALESRFLAFRDGFSRLVSEAIEDPAVVGFKSVICYRTGLNVQPTDEDAGVLLQSFARTIRTSEAGYRVEDKPLNDWLVRQTLDLLQASKSSSKDCKNKPLQLHTGLGDNDISLVLANPAYLQPLIARYPQVDFVLLHSSYPYTREAGYLACVYPNVYLDLGEVFPMVSRDAEESIIRDSLDIVPTKRLLWSTDGHFFPETFYLGNKQFRDVLEKACPVVCFHDVPAF

SEQ ID NO: 26919 - protein, 354 aa, A.fumigatus
  UNSURE (77),(127),(231),(263),(269),(270),(274),(276),(277),(278): Identity of amino acid sequences at the above locations are unknown.
LSQVFVDYVRQGDWTVTQAKEAAADILFHNANRLYDLNEQPSFDQISKPITISSTHTLETFMRCNPDVKYVWMQWVXYTATTRLRIFPILEFAKIVRKQRRIGISLCVFWMLQDDSMTPEGTTTGQXYMEPDLTSLSPNVGLGSKSATVMTFWRSEENKPLEGCPRTALQNIVDKLHTDHGIAVTCGFEIEVIFLRPDTDPSTGETRYLPAVTNHSWSQMTSDTRRMLPLXEEIADTLTAIGIPLEQLESGWAGGRLEFVLPXNSPLPXXDTVXKXXXVVANVAERHGLRATLHPRPLPNFAGTASHAHVSISPSTNEDSFLAGVLAHFPALLACTLAQETSYGRHDGAGRKRD

SEQ ID NO: 26920 - protein, 72 aa, A.fumigatus
PACCDCGRVCTEWLTDIHYQITSTKVFNQVVFKEYATASIGRKFTSLFPGLGYAAGYKVSTDTNLRGPESMC

SEQ ID NO: 26921 - protein, 66 aa, A.fumigatus
YSKVLQRIYKYGGQPFVRDYLAKHHGSDFDRAFGKGTGKAIMHATAGRSAIYRNLGTICAAFADLQ

SEQ ID NO: 26922 - protein, 78 aa, A.fumigatus
GLYVQLSLTYNSLIGIGEIILLPLDVLKIKRQTNPDAFRGRGLFKIISDEGMGLYRGAGWTAARNAPGSFAVCSSQLG

SEQ ID NO: 26923 - protein, 118 aa, A.fumigatus
KTDRSIQLFGGSAFAKEYIYGLKDYNKATWGQNFVASICGASASLVVSAPLDVIKTRIQNRNFENPESGFRIVSNMMKNEGFTSFFKGLTPKLLMTGPKLVFSFWLAQTLIPAFGQVV

SEQ ID NO: 26924 - protein, 279 aa, A.fumigatus
PFRQDPAQTENFDSSVSILSVCITHYNQTDRMSYQPAIMSASLGRAWLHDLAYKIDQAAEAGFKGLEIFYEDLEYEARKLSGTDNPTATHLLAAAAHIHGMCSTHGITIIGLQPFLFYEGLKDRTQHAQLLEKMKLWLQLAKSLHTNTIQIPANFLPAEQLIDDRDLIASDLRLLADLGAAETPAIRFAYEPLCWSTHIDTIEKAWDVVRRVDRPNFGVCLDTFNIAGRVWGDPAAPTGRTENADQQLQITLEWMVKEVDVETVFCLLHGDRKDPDLRK

SEQ ID NO: 26925 - protein, 348 aa, A.fumigatus
RPGPGPTMLFNRGRAIVVQGPGSLWGGPIISTLTCLVKDYHGMLVCRLLLGIVEAPFYPGALFMISLFYNRKEATTRMAILYTGNMLASSFSGLIAAGIFAGLDGVHGLAGWRWLFLVQGITTFAVAIAAFFLLPNSPLKTRWLSPEERQMAYDRIARDTTQKENRTSPWKGLREACIDYRTWLFALQCNLHLSANGFKNFMPTVVKTLGFNSTITLVLTCPPYLVATFASVIVSWSSGHFNERTWHITISKLLAIIGFAVACSTLNIAARYFAMILFVGATYGVNNINLAWTAATLGQTDEKKAVAIAITNTLGESGERVHALSVAGCGCAPFLQSHVLHPWVPTGC

SEQ ID NO: 26926 - protein, 369 aa, A.fumigatus
  UNSURE (8): Identity of amino acid sequences at the above locations are unknown.
PDGPRFNXSSTSPREEKDRPGDNDVPAPHTAASVAGQHEWAEFHHLPGRKFEDFALVKQEIEAETARIAGNNKGINRQPINLKIFSPHVLNLTMVDLPGLTKVPIGDQPSDIEKQTRTLILEYIAKPNSIILAVSPANVDLVNSEALKLARQVDPMGRRTIGVLTKLDLMDHGTNAMDILSGRVYPLKLGFIGVVNRSQQDIQSGKSLSEALQAEAEFFRHHPAYRNMANRCGTQFLAKTLNTTLMAHIRDRLPDIKARLNTLMGQTQQELASYGNKQFSGEEHRGSLILQLMTRFASSFISSIDGTSSEISTKELCGGAQIYYIFNSVFGNSLETIDPTHNLTVSDIRTVIKNSTGPPPSLFGSRTCV

SEQ ID NO: 26927 - protein, 328 aa, A.fumigatus
SARPSTPGEDLVGFGLTMEGQEGNEIMYDLLLDQAWSRQPIDTDHYFHNWAKTRYSSGVRGSAVPEELYQAWDILRITAYNNTNLTSTAVSKSIFELQPSISGLLNRTSHHPTTVSYDPAALVQAWRLMDSAASKAPSLWSQPAFLYDMVDITRQVMSNAFIPVYTNLVSTYQAGGSVSTDGSNLIQLLRDLDSVLSTNDNFRLSTWIQSARSWVRNDTEADFYEYNARNQVTLWGPKGEINDYASKQWGGLVSSYYIPRWQKFLNYLENTQASKYNATQIEAQLFDFELKWQEETSKPTRAKTHDLRSVLAKVRRRWPSVFGDQNSP

SEQ ID NO: 26928 - protein, 439 aa, A.fumigatus
  UNSURE (45): Identity of amino acid sequences at the above locations are unknown.
LAPYGTKGTSTWRVSCKTGDVFHVRYLLTALGLLTKANYPDLPGXQTFRGEIRHTSAWDTDLDLKGKRVGLVGVVSSGVQLVPAVEDTVQSLHVFISRPQLCVPSGDRALTAEEREAIFRDFPQIWSEARTSRVAIGFPELSREAMALCPADREAAFERLWEAGSGLQFLFGGFTDLLTDPVANEEACKFIRRKIKAIVKDPQKRKVLTPDEPYARRPLCANGFYEQFNRDNVFAVDIRAHPIVKIEAEGIRTADGKLHELDVIIFATGYDAMDGAYVRVDIQGRKSGETLRDFWKAKGPATYLGIFVPGFPNLMMINGPQTPFANIPPVSEENVNFIVDLIKRAEEISQRMNRPCLVEATEEAQRKWGEHCDEIANSTLLKQVPQWLFGNNVPGKKVSTLFYFGGVGRFRALIADIKATGFTGFKEPLSRKSEPRPLL

SEQ ID NO: 26929 - protein, 74 aa, A.fumigatus
RYMGKKHVLFTDIEIVQNELSELQVVQSLPLLVTMIIRSPVYQAKKLRKDHAAFDTIEEGTGAAKYLVKLLLGR

SEQ ID NO: 26930 - protein, 560 aa, A.fumigatus
DITSPSRRSGVLAYLNRYLPKLGITDRRPSKGDGSNFEDMPHDMRVAVDSVIMPEPGLLIRCFASGLVDEQILVQRNFLDLLVTHLPLSSPILQSRITDDDLQRLMIAAVGVVARRDMSLNRRLWAWFLGPEAASDQPSFEGEGTTGSYAVDDEQLSQSEYFSQFGLKALVKSLLRLNEQDARTPSERAKPFRISLSLMDRWEVGGHIVPAVFLPLMRNIQAFGKSSSKQQFDEVFRSASAFFDGVESGVIFSELLGLIDWRSDNHCNKKRQALDDLQLAQFILDNFNVREEDMLLTHVPLLVLTILVKLSELSSNTRNFEIAPDELLELSNGLMRVMNSLTTLLTERAFARKSESAKVIADNSLMDISDMDIMKRIHNFYDQSRSSLDLPPLPFLPRQLGDLITRKAHDLAASALEKSNGSIPIQEILTLLVALLKRLPKSFVFHDRRFYLAICSRLKIDQAEQSTPSFSTISSIVSAVTSLYFIQAPGYYISYEDVAGLIPTLVRHLWQFLSPASPKFHVEAVRCLWHLHSVSWSDHIVEASITSLMGLHQGQKGRSR

SEQ ID NO: 26931 - protein, 117 aa, A.fumigatus
SYNGYYGDNNDTESTDLPSAGTLSLPTVEGEPQKFTELGLSDKTLKAINDMGFETMTEIQRRTIPPLLAGRDVLGAAKTGSGKTLSFLIPAVEMLSALRFKPINGKDILPLCVRAAC

SEQ ID NO: 26932 - protein, 244 aa, A.fumigatus
  UNSURE (114): Identity of amino acid sequences at the above locations are unknown.
STATGFGIRQLLTCTHSSHTYGIVIGGANRRAEAEKLMKGVNLLIATPGRMLDHLQNTQGFVFKNLKTLVIDEADRILEVGFEDEMRQIVKIWPSEERQTMLFSATQTTKVEDXARISLRPGPLYINVDHRKEHSTVEGLEQGYVICEADKRFLLLFSFLKRNLKKKIIVFFSSCNCVKYHAELLNYIDLPVLELHGKQKQQKRTNTFFEFCNAKQGTLICTDVAARGLDVSHSSTTHRLSALC

SEQ ID NO: 26933 - protein, 97 aa, A.fumigatus
PSFQIPAVDWIIQFDPPDDPRDYIHRVGRTARGTNAKGRSLMFLQPSEVGFLKHLKEARVPVVEFEFPANKIVNVQSQLEKLIGQNVFTPGCKETRS

SEQ ID NO: 26934 - protein, 73 aa, A.fumigatus
IFIITLEDLKATLKIRKAQKEDPTNLLSNKFKDYTNIFFSKKAKRLLLYYLYNYNIKLLEGKTPLFSSLYTIF

SEQ ID NO: 26935 - protein, 79 aa, A.fumigatus
  UNSURE (9): Identity of amino acid sequences at the above locations are unknown.
FGCVVLQSXASPCDFLVPIMIADCDRLFSDSFMLLKARRTRAVLEGHQEPQDKLDMATQAALLLQHVPLSSRSVPTNSC

SEQ ID NO: 26936 - protein, 145 aa, A.fumigatus
LADHFQCAKLMLGAIDSSYDTKDEKASGRPSGPGGPGGPPPPGPPGQYGGYNPGQNYGQQPGYYNQPPPSGYNQPGAYGQGQGYNQARYAQSQGGPPQPGYGQTYGGYGAPPSDPYGRPPSGPPPGGYPPQQRPPYGQPPPPPRY

SEQ ID NO: 26937 - protein, 303 aa, A.fumigatus
RQLYAPQGAPYQGGPGGPPGAPGQAGYGYPGGAPPPARATEQQIGAYKQLLIGTIQEKNLQTFYPPDKLDRLVQSLANEAPAKIDRLVHEWSVPQEVAMDVMKLALFDVILYVDDSGSMEFEEKGMRKEQLRQILGIVATGASTFDQDGISVRFMNSNEVGDGIRSVDDVNMLVSRVRFAGLTPLGTSLRHKVIEPMVVGPARAGRLQKPVLIITITDGQPAGEPHDTVANTIRYASEEVSRTQYGRGAVSFQFSQVGTDTKAREFLASLDEDPQIGGLIDCTSSKYWRACNSSLAQCTRLTE

SEQ ID NO: 26938 - protein, 62 aa, A.fumigatus
CISYVVRVVTTRVRLLIMCCTVEYVSRGDYTTPAGVLTARTAATASWTTADPSSPVVKTEQN

SEQ ID NO: 26939 - protein, 114 aa, A.fumigatus
LMVRTGLTMAAVPAPKTSISLPSSEASATSDILILRSDTVQPLGTSLSRASAKTESLVTPSRMVPSKGAVTSSFCPVSLFFKAMKRFIVPTSVTYSSSPNSHRFCWKPREAAFS

SEQ ID NO: 26940 - protein, 241 aa, A.fumigatus
  UNSURE (16): Identity of amino acid sequences at the above locations are unknown.
RPSLTSDSARGYSSIXRPTMIGTQNTLGVGPPGSAFLFVIASPVGPYYPTGFKAISLEATDYAVRAWPGGVGDKKLGANYAPCIVPQLKAASRGFQQNLWLFGDEEYVTEVGTMNLFIALKNKETGQKELVTAPLDGTILEGVTRDSVLALARERLVPKGWTVSERKIRMSEVAEASEEGRLIEVFGAGTAAIVSPVRTISYRGKMVDCGLKKNEEAGEVALQMKNWIEGIQYGDEEHPWR

SEQ ID NO: 26941 - protein, 528 aa, A.fumigatus
KYPKLDGRDIGNSPTRHVCRFRQHNRYVSNVLTPCAVSAGTDQCLSRSMGDLIGFEGYLNTTTPFSVKEHKALWKTDRHYVDFHFGNDYNETCDYPRFWNETGWPVDQSVRDQLNGCYDSDFDQYGDREAFGVYPDWQRQLAKFASVQDRLREWNPSVRQRLTRHSCMIIEALDIDGFRYDKATQATVDALGEMSLAYRECARKVGKNNFFISGEITGGNTFGSIYLGRGRQPNQYLKSAIDAMNMTNLSDHQYFLREHGHEAIDAAAFHYSIYRSLTRFLGLDGNLAAGYDTPVDWTDAWNLMVISNDMINANTGKFDPRHMYGATNQDVFRWPAIEYGVERQLLALFITTLHLPGIPLLLWGEEQAFYILDATASNYIYGRQAMSPATAWKTHGCFQLTPSQYYNWPIQKGRQGCHDETATYDHRDPSHPVRNIIKHMYQMRENYLVLNDGWWLQKLSKQTREIYLPGSNSTPTETGMWSILRGVTPGIQSLGSDKDDQPVWLVYQNENHTVDYSATRPGLEGIAY

SEQ ID NO: 26942 - protein, 275 aa, A.fumigatus
GRCPSSPVVKTLRIYAAMFAGQSRVALDTAVELEASIPEELLRIESPPMADWLEGFLAVKVHVLVRFGRWEDILALELPQDQDLYCVTTAMIHYAKGVASAALGRVDEADQERTEFHKAFDRVPPSRTLFNNTCRDILAIAEAMLDGEIEYRRGNIDAAFKHLRQSIALDDGLPYDEPWGWMQPTRHAYGALLLEQGQVEKAAEVYGADLGMDDTLPRALQHPNNVWSLHGYHECLTRLGRLAEARIIQQQLKLAAATADVPIRSSCFCRLECCT

SEQ ID NO: 26943 - protein, 210 aa, A.fumigatus
YAISRSLPPRGENEIAKLLGITVPELEAKFLSAFPVQAERFLLRQRALHCFKEARRVLDFKACLAKAHTLDERRIHYLGQLLNESQESCRADYDCSAPEVDEICAIARRAGTWGSRLTGAGWGGCTVHMLPQSKVEAVTKALKEEYYLKRLPDISEEKLAQAMVISKPSNGSFVYVYPCLDDVFIVPTENAESLTAFARITGAAITAVKI

SEQ ID NO: 26944 - protein, 224 aa, A.fumigatus
GCSTSWVISSKALIHHMKGYTENDGQKRIEAYLFGSPVTLADVVSIFQELKHFGNGGLLLTQLLHLKRLSAAPCLLAQALECLLDKLDILDPQLLADDGQITDGIDITFDMDNLSIVEASDDLEDGIDSTDVGKESISQTSTSRGTSGQTGDIIHGQVGGNLRLGLVVFAEPVESLIRDDDTSLFGIDSGIGEVRRVTQRRLGDGLEECRLADVGQSDLINSHC

SEQ ID NO: 26945 - protein, 228 aa, A.fumigatus
VGLANVGKSTLFQAITKSSLGNPANFPYATIDPEEARVIVPDERFDWLCEHYKPKSQVPANLTVYDIAGLTRGASTGAGLGNAFLSHIRAVDAIFQVVRCFDDAEIIHVEGDVDPVRDLTIISEELRIKDIEFVEKALESLSKQTRRGGQSLEMKKLREEEATVAKVLQFLKDGNDVRKGDWTPKEVCFYSFLSIIFCIPFHMMNKSFARYNPARRTASSLITTQRLS

SEQ ID NO: 26946 - protein, 120 aa, A.fumigatus
AISPSIDPSRSLLLFFPSLSSAHCWWALFITSPAPPAVFLFLSLPLRLERSAAGSAFASRLHQSLPFFSPVSSPYFSAFSRRSYSSKKKKKMPPKKAVVQEKVLLGRPGNNLKSGIVCEH

SEQ ID NO: 26947 - protein, 107 aa, A.fumigatus
  UNSURE (58): Identity of amino acid sequences at the above locations are unknown.
VHCEERVYYGICQSGERRRGREIMRCLAENVSKDLYVHIMGQYHPDAHVGKKKRTTRXASQEDRTEFRYADINRAVRDEELGSVKDAAVAAGLWRFCEVNEHGGFHL

SEQ ID NO: 26948 - protein, 83 aa, A.fumigatus
QSTTAANHLKMKPIIAVPAVLALAHRAWSRKTLTPLGIITAVLTAIAHVLHPWSTPFALLAVFYLGGSKVTKVCYMPPFLVGI

SEQ ID NO: 26949 - protein, 128 aa, A.fumigatus
  UNSURE (36),(92),(105): Identity of amino acid sequences at the above locations are unknown.
FWCIYCKERKVSPLMKVGDMCIKSEHDLNWPARDLXLDIYRLDTIDIGYYVSKGPLDERKPYGILVKLMLFRPSINMGRSYLRVQRGLTPNXCSVLDSLNRFVLXKVSLEQIVFASLIISPNWGLVLT

SEQ ID NO: 26950 - protein, 118 aa, A.fumigatus
CCSRRPRRKSTGSRGPCAVLRRNRLPTPGTNPGEKKPAPPPTSGNAAVRHYILNWAFGRWTFTPSEMVAESADPVVVARLTLILARYESGKWKKKLEAGGLIQLGEGAEGESVVERLV

SEQ ID NO: 26951 - protein, 71 aa, A.fumigatus
QNLVYQATKQTKLYGIPAFHIIYPITNRITDKQMNQVQTSTNSGTFSNTPGAQSHRLRSRCKSPRGCPRSR

SEQ ID NO: 26952 - protein, 307 aa, A.fumigatus
GQACKTSSYLRYAAKVGVKQMTLDNADELYKIKACYPDAELYLRILTDDSTSLCRLSMKFGASLDIARQLLELAHELELKVVGVSFHVGSGAEDPRAFLKAVQDARLVFDQAAEVGHELHTLDVGGGFCQDTFEKFAGILSEALDTYFPPHIRVIAEPGRYYVASAFTLAANVIARRDVRDPKDPANDTYMLYLNDGVYGNFSNIIFDHQHPVAKILTCSGETQPSALNAATSEGIAYSIWGPTCDGIDVITQRIVLPGLLDVGDWLYFEEMGAYTKCSATRFNGFSDNHEVIYISSEAGATALLEY

SEQ ID NO: 26953 - protein, 73 aa, A.fumigatus
RSLHVVVVASTLFSSFSVSSKLSVHPAVSIFSSGSLFLSYLLPLSPVPIAFPSNSCPYIRFVIILDEPRLYPP

SEQ ID NO: 26954 - protein, 60 aa, A.fumigatus
GLFRPTLYCSLALPDRSSRCLLWTFCSKPSIASTTQGTNYTTTTITTDCIYLLHIYNYLQ

SEQ ID NO: 26955 - protein, 156 aa, A.fumigatus
  UNSURE (153),(154): Identity of amino acid sequences at the above locations are unknown.
GKYLDAEGVTDFVPISFLQRIPALTSWTTAERRSETHRQFRAAHEGHRPHAGLDASRASTGVVWCTERAIEHGYAEDPSGWANLGQGAPEADDEIEGSFPRPTSIPITSAAREYGPTAGIKPLRAAVARLYNEHYRQGKESVFTTGLEGAAPXXNP

SEQ ID NO: 26956 - protein, 212 aa, A.fumigatus
ARSWQLRGEDPRPPPSSSLSLLHCRAPPPPHLNLHRLYLLKAPLLKKIHAIVISSAFILSTTSTLWLKFSASKLGARCLPSTCRSSTLVPRSCSTVPRSLAALPSKVYSSLLLSNKTHSRFFSTPSRPLYDAMNTNTTPSPSPGPAAKISASPKPNASAAAGTKRKRSAPGKFYAVKAGYQPGIYYEWSDCLTQVTGYKGAVCKCREIRLPS

SEQ ID NO: 26957 - protein, 219 aa, A.fumigatus
YPSYSIVQAFPTYEEANAFLTGTQLPSARGATPSSSEPTRFYGIQRGRVPGVYTDWARAQEQIKGFARPRYKKFSTREEAEEFVRMEQGAGATFAGGTATSQTQTLAGPPGLTDEIPKDEQGNILEPGTGPLPPGAEDGFDPNVLLDPATGKVVYKTKEQKSATKTRPIGPPGMLRIYTDGSALKNGRDTAAAGVGVFFGPGDTRFVLSILCRLYARLQ

SEQ ID NO: 26958 - protein, 372 aa, A.fumigatus
DTTPSCKSRTSPIPLSEKPGCTLTLDTSDYAETKRSSEVLDVLISMLSECDNVPGAEHKFENFHTKTSKQNKKLLSVNSHKKQAQNAWLAILQNDLSHTQRKTLLRNMVYTIEPWFNRPELLMDFLTDSYNVGGATSLLALSGLFYLIREKNLDYPQFYHKLYSLLDADLLHSKHRSRFFRLMNTFLSSTHLPATLIASFIKRLSRLALNAPPTAIVVIVPFIYNLLKNHPTCTFMLHRVVRDEQTKATLEAEGMDDPFDVNEGDPTRTMAIESSLWEIETLQSHYHPNVAAIARIISEQFTKQAYNLEDFLDYTYQGMLQAELGTEDKPFKRIPVVEYHIPKRIFTDRLLEEDGGQDTAPGNFMRGLWNFA

SEQ ID NO: 26959 - protein, 96 aa, A.fumigatus
TGLYAPSLAVAVVCPPSQFLVATVCFCVGLLLYPAAAFYLPSIVGTLGSCESAAITMARVYADVNEHMPRSYWDYDSVNISWGVLENYEVVRKIGK

SEQ ID NO: 26960 - protein, 82 aa, A.fumigatus
VSLVSFNFLSVLTFLRFLGTAYSPGGHGSSLLRPGSRSGVAGRSEQCDVPIVKPGVADLTITSYIQGSTEPNSAPAVIQLRS

SEQ ID NO: 26961 - protein, 186 aa, A.fumigatus
TYLGGFWRTMKWSARLVSEQIQSLHLTGALPLSWMTCATLNSCISKLTIVNTGRGKYSEVFEGINVVNYQKCVIKVLKPVKKKKIKREIKILQNLAGGPNVVALLDVVRDSQSKTPSLIFEYVNNTDFRTLYPRFTDYDVRFYVYELLKALDFCHSKGIMHRDVKPHNVMIDHEKRKVSSIVDVPS

SEQ ID NO: 26962 - protein, 147 aa, A.fumigatus
LRLIDWGLAEFYHKGTEYNVRVASRYFKGPELLVDFQEYDYSLDMWSLGAMFASMIFRKEPFFHGQNNSDQLVKIAKVLGTEELFEYLDKYDIELDPQYDEILSRYPRKPWHSFINADNQRFISDEAIDFLDKLLRYDHAVSLARLL

SEQ ID NO: 26963 - protein, 392 aa, A.fumigatus
  UNSURE (60): Identity of amino acid sequences at the above locations are unknown.
LNFLPVGAIGPTRPTELMCSLEDSGTFRIPMHLWNIQTFRGTGHCTLYTPCSFNPLTVNXFVPLVPEKHTSFASRISMTQDNTMDLFKYLNADPSFITNLLGRPDYWAPQTRWTSDSNSNILACGPIHLLPLISRHGLTSTDFYCQHPRWNLHFQGAPLSVYLRYDAALRLTSYIISHKEGDSNIQALQNIFNLAIKTAPAEQGTRILLDDPFDLAVILSTLNFEASKYHAQRFRRYMWTQINKVDDHLAGLETNDRRKLGELTKELQIISQNADSHLGNADVAIITATGIRTAHARLHEAMGSPARVFERASDSITYVIESMQKQKIWFLNYKNRKDSTMALVYNLVTQQDAASNIQLAASMKRDSTSMNAIAALTMVFLPGTFIAVSNLR

SEQ ID NO: 26964 - protein, 331 aa, A.fumigatus
SLILPAPREDSGGTLCIAPSERLLNNLAEVINEMNVNHVFLTPTVARLLNPKDVPNLESMTVGGEQLTRDVVTTWASRVTLRNGYGPTEASVLVTMKDVDTDTTGGNIGRPLASVGAIVLEADGVRPVPYGAVGELCFFGPQLAQGYFKKPDITSAAFIESEVLNGRRLYRSGDLARYLPNGDIECLGRKDDQVKINGHRIELGEIEQAFLRTGEIKDCVLTVWKHNSTAHLVAVAVFDGASSEKPGEVLPLDGFAENVQRVRSKLTGLTPYMIPKAIVPLSSLPRLPFRQGQSQEAQGDGTVAESGRTDQVLIRQGRRCAVKGCGYPSGV

SEQ ID NO: 26965 - protein, 297 aa, A.fumigatus
FLRQSSPFRHSQDFPSGKANRKKLKAMVQSLSQGELTKFSFDKVGAAQSKGAVIPLASETQKVLQQGWIETLQLADDDFGLEADFLSLGGDSIAAINLVSWLRRKQLKISVRDVLKYTSLGAMADQLKGESGDAHQIQKKTFTPPSEIDAAISAAGLQATEYEYIYPCPPGQAEFLTQGAHPEALWSLMTVRKVGSDFAPRQWIDLVRQLTTTNEILRTTFTRCHGNWYGVVLRDATPVVEIYEDVSNEQRQQIIKSLDDYRFVFGKPFIRYAILHLSTGETEIVSLHTRAWKVRNA

SEQ ID NO: 26966 - protein, 319 aa, A.fumigatus
SDLHVKLPLPDPAFRLLTNNFCRLLETGSTPFIRNTAAQQLADVQKQHPDELFNLLGRILPYLRSKSWDTRAAAAKAIGLIVANADTFDPNQDDGQEIKKAENDDLDVDIKSEEELLSPMDDSLLQLERLDLPSILKYGKRLLGSAGKEYEYSLAAMDPASRLQHQKKTLTSRLGLAGEYIEEDLINDNDLVSKPVVKEEPSFVASREHSIQGTSQPLASPIEPANGEESGLSKRQLNQLKRKNKQSARMGANKVRVVDLSSRRASENVTTPSVATPYPIKSENGEERNGDSKPDYFSLDRSAGDDESKSPHHEAPGPP

SEQ ID NO: 26967 - protein, 240 aa, A.fumigatus
ISSIASLGQTDKWLKDVFFPSLSPTPSMASIPQPKFSIIFPTPDEIRRSLNGYGSGGSIHMKLQSVTQQKQLQYMRPYLRHWAGDSDSSSSTSTPQREAGRCRAAPHIKTYIRFSDAEKMDTIDWAMVTSANLSTQAWGAAVNNAGEVRISSWEIGVIVWPQLFVHEDNTTERHQQAVMVPCFKRDIPLQLPEDMPRCDVLVGLRMPYDLPLTPYKANEVPWCATIAHTEPDWLGQTWGG

SEQ ID NO: 26968 - protein, 141 aa, A.fumigatus
RHPSGRDHQLTLQIFSVNMVLPIINIVYWNHSNWTESNAVRHDYEVALSIVTLGGVLLGQIAFGFAADVWGRSKVYGMELVILIFPTLGLALSSSGAENSMSAISLFLFWRGLLGIGLGGDYPVGSYLFRVRSHPEWRNRR

SEQ ID NO: 26969 - protein, 205 aa, A.fumigatus
DPIRNGVIAADNLRFAPSRLRGRLLATVFFCQSLGQLAAQLIALIAMAGFQHHIPTNPDTITCTETCVRSLDTIWRLLVGLGAVPAFIALWFRLTIIESPRYTAEVTKDSLQAVNDVSQFYQRVSIDSASVNSVEPPSPESGSFRLSATQSVDHQPDRPASAAPFAEQDAASPLAILNDFKHFFGQKDNFRKLAGHNPLAGSWLE

SEQ ID NO: 26970 - protein, 247 aa, A.fumigatus
ARTLAASVSEDAWRGKYLNVVRECGGVDISQKVTDVPHTLDDPRFLDNVNAAYTYANASLLNLLLTKNSLTTRFRSLKHYFFLDRSDFFSYFLELGSSELRKPAKNVNENKLQSLLDLVLRQPGSIAASDPFKEDVKVRMNKIGLTKWLMQVVSVSGIDQDNPEAVLERYQAPQTQGGEDDKDIVGFDALELDYSVPFPLSLVISRKNVLRYQLIFRHLLSLRQLETPANYILVRSEQGCWLAAQFF

SEQ ID NO: 26971 - protein, 141 aa, A.fumigatus
PGSAGRGDRSSRSATSSSSPLPSPSSSRSRSSRPSPSRSASSSARRMEGGSGESSWSCEGTSRSSLPATSEEAAPATRLGRLRLLLERADEAVCPLEASPAVAPEAPASASASLRLALRAARALLRADIEARPLRSRASMA

SEQ ID NO: 26972 - protein, 65 aa, A.fumigatus
VFVHIDSTISVVEILLVVNFIVGCQRFRVVICITTNETILVTRLCWARGSVVAIRNVILIPAPFT

SEQ ID NO: 26973 - protein, 381 aa, A.fumigatus
  UNSURE (9): Identity of amino acid sequences at the above locations are unknown.
DGADPPTRXRRAPPGSGHPILNRFVTESTIGQPPSARRPRPLTQHQLAVEQNRRQRIDYLLAKRKNEAYRILRAKRESEIPFARYGRLLQSLPEGYDTEDEEVSRGKGGLIPHHEEEEDFGESAGYFLSVIRKAARRLDRWDYENANGPKRDRKKEREERQKARQNGYAMDALDLSGRASMSARSRARAARNARRKLAEAEAGASGATAGEASKGQTASSARSKSSRSRPSRVAGAASSDVAGKDDLDVPSQDQELSPLPPSIRLADDDADLDGEGLDDLDRELLGEGSGDEDDVADRDDRSPRPAEPGYEDSFIGGDADDDAEALTSDDEVDDEEDLDDGDGGVDVDENSSTFDGGNGYAASETSSVAGDTTAVLDDGKV

SEQ ID NO: 26974 - protein, 135 aa, A.fumigatus
  UNSURE (123): Identity of amino acid sequences at the above locations are unknown.
KRTSHYPGRQSVHERVIQTSSLGDLPWMGAQEKVLRVSSVQCSSTWCHVLTKVIYDIDDAYYGTNPMRPPSKRPADPDEGYLTPTQSSRSESKRPKRESSLNRSVGQQRLILKTKMEQTPRRXLAGRLQVQVIRF

SEQ ID NO: 26975 - protein, 329 aa, A.fumigatus
HNHLRSSPSRLICNMIPRTEVLIIGAGPTGLVLALWLTRQNVKVRIIDRQEAKPSTSRALVVHARPLELYRQLGLADDVFANGHKIEATNIWVEATHRAHVPIGDVGKGLTPYPFIHVYPQDRHERLLEDRLNAMGVTVQRNWKLVDFEEHDEYILAQLKYTSEQPSSTEKTEFCEARYIVGCDGAHSAVRHLCNIAFEGATYPQLFYVTDIEGSGPTMNGEAHVSLNGSEFMLSLAYDTNRRARLAGAVNEEHVTKDISELTLDDILPTTIKKMGLQIDKVNWFTTYRVHHRLAASFRKGRAFLAGDAAHIHSPVGGSSRRGCKDTRA

SEQ ID NO: 26976 - protein, 77 aa, A.fumigatus
SSCSPRPTPAPAQKPTAKPTTQPTVVTHWSAIQEEKARALFAKYGLTLESGEWRSSSDMTVRLHLRELDESALDVWK

SEQ ID NO: 26977 - protein, 130 aa, A.fumigatus
QLVFAHCDLLCANVIILPSQCPATAATSDKEALKVQFIDYEYATPSPAAFDIANHFAEWGGYNCDYSMMPTRSVRRQFLTEYVKSYSQYRGIPECAQQEIVDRLYEDVDRFRGIPGLYWYVPGHCRWTLI

SEQ ID NO: 26978 - protein, 61 aa, A.fumigatus
SDKYRGVWALIQAQISQIDFDYASYAETRLGEYYAWRREVDGSRVQASEEMPLRERRWAEA

SEQ ID NO: 26979 - protein, 100 aa, A.fumigatus
CNGNDASNASDEADVDALNFSTSTNLLHALHPRAACFSGVAGSGSANVLENNSSDTHPSNPSSKNARATSRTGRYPPRSSSNGNSLAFRDQLMRGGCPGT

SEQ ID NO: 26980 - protein, 135 aa, A.fumigatus
VAHITNDDVTAMTHPTHLTKQTWMLSTSAPPPTSSTPSTPVPHASPAWQGPDPPTSSKTTPATPTPQTQAQRTPAPHPGPGGIRRGPLQTGTASHSATSSCAVAARGHETGGSRRAGRRGAPRRRSGCRRIFGRR

SEQ ID NO: 26981 - protein, 131 aa, A.fumigatus
IDVQKFFYIQIVDGERLSAPLDENHPFHVPGQPPRMSWSRNARLFPFEEDRGGYLPVLDVARAFFELGFEGWVSLELFSRTLADPDPATPEKHAARGWRAWRRLVEVLKLRASTSASSDALDASLPLHHRL

SEQ ID NO: 26982 - protein, 75 aa, A.fumigatus
HPRDRLILCAPRFLTLAEQNFGVDLEARARADRKRVPILVTTLLTYLDNRRPTVSLSCPSAFELTNLLRLSRTRR

SEQ ID NO: 26983 - protein, 291 aa, A.fumigatus
TTRSVSRDGGGVAVHRPNFFPDSLVSSQVYEIVKTIYSTTAHETTEDGRIKVLQSTLGQLRLNNIATLDAIMTHFTRLIDLTSADEAYISALAQTLAPCILRPRVENSLTMNERHTTVLYVTSSLTRMLSSASLKRQSSVLGLGSTSNRPRAISTDESNRRAAMEARNRAIVDRSRANSPAPPRKHRRDRSSGASEAGRFPIHVTSPTERKAATRSSLEVPASAEAPTTGEQFTTVNIQANDSATNGTSSDSPASAVAGENTSSESSSPPPAGNSDGSPTPTPTPGYVTAP

SEQ ID NO: 26984 - protein, 135 aa, A.fumigatus
PIFSGYPELEGDEARRAIWLYDVPLAATHHLRNALNNSKADYNEILQKYDIPIVASVLKLYLLELPGPYPEMVEALQFIDLISFQIPLFLRKYMRLSRLFIQLPLMKRRKTDESKFCKAPLVSFVSTTSQHLTPS

SEQ ID NO: 26985 - protein, 139 aa, A.fumigatus
  UNSURE (51): Identity of amino acid sequences at the above locations are unknown.
RGLGSFQPTHNRTRLPVDKFRGRAREAHDGYKAAVRKLDQIRCKLKEEIVXNLRFMEQCELDRLKAIKAVVLDFSGAISNVIPNLQSTVDHMMLYQETIQPLGDLRYLLENYRTGGFVPRVQAYENYYGSVEGMLTSSR

SEQ ID NO: 26986 - protein, 382 aa, A.fumigatus
HSGLGIQFCSDVLRAGFFPGAVYLCTFWYMPKDLSTRIAVFYCASALSGAFSGLLAAGIAQMDGVGGQEGWRWIFLLEGLVTVILGVMCFFFLIDSPRRSGRWLDPEEIRYLELQHFIKDGGRFKDERKRASWSDIKAVLLNWRMYMLAYILLCQSACSYGQSRSLNSASASQLTRTGTKFTMPTITKAMGFTNTHAQLMTVPPYVAGALSAIFFSKLSDRFYWRMPFVAIPLALVTIAYSIIISFHGHLKEHVGPAFFAVILTCMGIYPIHPATTSWTANNLASSSSRAIGLAFNICIGNIGGIIGSYMYIDSESPEYYTGFGLSLAFGGSGLLVALLLELSYIYGNRKKARIPEAEIRERYTDDQLLAMGTKSPLFKYTL

SEQ ID NO: 26987 - protein, 67 aa, A.fumigatus
TRTEVPSNMLLKSFSRPSVYIGILITCWGIIMTLTGMVRTFAGLMVTRVLLGIFEYVTLRARHTVLF

SEQ ID NO: 26988 - protein, 155 aa, A.fumigatus
QAETCVVLRALTVDIHVAPDNTADIANADVERQPNGSAAGGGEVVGCPGRGRRVDGVNPHAGEDDCEEGRADVLFEVAVERDDNGVGDGHEGQRDGDEGHAPVEAVGEFGEEDGGEGAGDVWRDGHELGVGVGEAHCFGDGRHGEFGSCTSELGG

SEQ ID NO: 26989 - protein, 71 aa, A.fumigatus
LFFFFFKYMSCDLRTEPDKGYARAFESVSKHCSGGCSTSKDSTLFSIKKLVLGYNCEPVYLFGKGNVDSAL

SEQ ID NO: 26990 - protein, 85 aa, A.fumigatus
HFPALNKKQRKRYEKKMAARAATLPPQIPVHHHATDITPADYNRERTEDVLTLAAESIEKRTEITKSARDARRKAIREANFLRGL

SEQ ID NO: 26991 - protein, 88 aa, A.fumigatus
KENCSSVLDAYVQMSHGRLLNPEATSDCQVCPVADTDTFLAQVSISYSDRWRNVGLLFVYIVFNIFAAIFLYWLIRVPKKRSRKIKEE

SEQ ID NO: 26992 - protein, 314 aa, A.fumigatus
ILARSSAPVVKTSRCVVLSHILDAVPKTMQIEKYQFKLFAMMFSSFEEILFLDADAFPLEKPDILFTNEPFRSKNMVTWPDFWADTISSYYYDIASKPMPSKTIRQSTESGELLLSKKTHSKTLLLSAYYNFWGPDYYWALLSQGAAGEGDKETFVAAALTMDEPYYQVREPIVALGHRTQSGLAGSAMAQFDPVEDYALTQKGEWRVHGSKAPAPRAFFIHANFPKFNPATVFDEQAVKPTFEDDGSYTRAWTIPEEVIGKFRTDVEKQFWREILWTACELETKFRSWEGREGICQRVKDYWNAMFPTQSVKT

SEQ ID NO: 26993 - protein, 145 aa, A.fumigatus
TELFSRKASPIMVGSLSLFSVNAVLLMSADDGSRIFAKYYSPPHPPAGAAPNATDYPGANPYPTLKDQKAFEQGLLEKTNKQTSDVILYDNRVVVFKMESDVMIYVVGGADENEVLLYNVVLSLRDALGILFKYDFGCFGSYMLN

SEQ ID NO: 26994 - protein, 96 aa, A.fumigatus
  UNSURE (96): Identity of amino acid sequences at the above locations are unknown.
AINEKFKQLDFQDCKVRVLNVDSQASFDNILISVIGEISNKSEPSRKFVQTFVLAEQPNGYYVLNDIFRYLVDEEEEEEIIKSSPRGWKYRRCHFX

SEQ ID NO: 26995 - protein, 179 aa, A.fumigatus
ISSSFCTYCRLSSHRSFLPLSIYFWPPKTFSPTHLPPQLLTMSDTTQPPMNGNYPAQHAYPDSYNHAHTAVTSVSNFQPAQSSTPTNAPPNDQKNGISKDEVGWYFVEQYYTNMSRSPEKLHLFYSRRSQLVFGTEAESVPVAVGQKVSWMRLELVAPQRALLTRLPIRLGNQREIQAA

SEQ ID NO: 26996 - protein, 169 aa, A.fumigatus
  UNSURE (129): Identity of amino acid sequences at the above locations are unknown.
TCASICAFLTRLHDTIAATLSSSGSNFRHLLTEIALGTRSHLLEHFKRYAVNGAGGLMVTKDMTQYADLLKSWDIDEHVKGPGGLLDVLLEVGSLFVIGPEALLERIRAGASSDASRRPGASRTDTERXQELLETGHIEPGLSVQEIRAYVSRREDSSTTAMQNVLNLL

SEQ ID NO: 26997 - protein, 89 aa, A.fumigatus
SSWIVLWFATMINPWLLITSFLALAILSLVYCAKKLEPEITSSSFDNEPFSLFYFEEPETMLIEHRKWNFFPSFHGGKAGELVDGHMPN

SEQ ID NO: 26998 - protein, 119 aa, A.fumigatus
FLVLEQRVSSIQEQLQLDRANNDKIDPSFNISYDVLPFESGGGPLQLSYGNYLGAYARTWQKSRRNTLADSTLIIAVSLSKVSVHPCRKRTADGLSSPTTFLPRVKKYGGGFPLTASSS

SEQ ID NO: 26999 - protein, 166 aa, A.fumigatus
THGGTTKSNPLCQHHSNNLLCQGHCLRSHRRYPLCENQQSLFHDAWARVPETRRAYNGKMIDVLKVADAMLEGEIEYRCTNYDKAFAALRRAIDLEDKLPYSEPWSWMQPVRHAYAALMMEQGYLEEALQVYRADLGLDTSIIRPRRHPNNVWSLQGYHECLVRLG

SEQ ID NO: 27000 - protein, 434 aa, A.fumigatus
FIISKIFKSFIMSSLLAMSPVLASNEYYDLGSFGRTITTTSTDAQIWFNRGLTWVYSFNHAEGAYCFQQALAHDPECAMAYWGLAYAVGPNYNKPWEKFDQGDLHTSVQRGYNAAREARKHAAVRATPLERALVDAIQSRFPTGEPAEDYPAVNRDYAAAMKTVYETYGRDLNVATLYADALMNMTPWALWDLFTGKPNPKAPTMEVKAVLERALAQEEDGALLNPGLLHLYIHFVEMSPTPELGINAADHLRDLVPDAGHIHHMPTHLDILIGDWRRSISSNYKSTLADDKYFRKSGAKNFYTFYRLHDYHSLIYAAMFAGKSKVAFDAVTRMESTVPEEVLQIRSPPMADWLEQFLPIRLHIMVRFGMWKELKRMEAPQNQILYASTTATTYYARAIAYAATGDIPSAKTNSLSSMMHGRGSLRPDAPTMAR

SEQ ID NO: 27001 - protein, 401 aa, A.fumigatus
  UNSURE (4): Identity of amino acid sequences at the above locations are unknown.
LTAXETRGEDDLPYTILNAITSNIVLYFMTNLRREPGAFFFFVFTSFILTLTMSMFFRSMASLSRSLVQVLPFSAVLLLGLSMYTGFAIPTGYMLGWARWIAYINPISYGFESLMINEFHNRDFPCMDYVPSGPGYTDVGLNNRVCSTVRSVPGQAFVNGNAYIESAYSYTASHKWRNIGVIFAYMFLLGAVYLVASDFITEKKPKGEILVFPRGHKALKKGKSDEDLEGGGGRSATVEKIGSDGLAMIERQTAIFQWKDVCFDIKIGKENCRILDHVDGWVKPGILTALMGVSGAGKTTLLDVLATRTTMGIISGEMLVDGQPRDESFQRKTGYAQQQDLHLSTATVREALEFSALLRQSAHVPRQEKIDYVTEVIKLLDMTEYASSPRGWKEPLYLQFY

SEQ ID NO: 27002 - protein, 425 aa, A.fumigatus
LRWKTCSSFTSCYITMASDGMPPAKRLKSSNLPPHLRDAKRKDIDNWETNRMLTSGVAQRRDFEGDFLPEDEDGTRVHLLVHDLRPPFLDGRTIFTKQLEPISAVRDPQSDMAVFSRKGSKVVRERRQQRERQKQAQEATTMAGTALGNIMGVKEDEGDSAVAMPVEDTYRSGNKFAQHLKKDEGGQSSFSKSKTLREQREYLPAFAVREELLRVIRDNQVIVVVGETGSGKTTQLTQFLHEDGYSKYGIIGCTQPRRVAAMSVAKRVSEEMEVDLGAEVGYAIRFEDCTSKDTVIKYMTDGVLLRESLVQPDLDKYSCIIMDEAHERALNTDVLMGLLKKVLARRRDLKLIVTSATMNSERFSRFFGGAPEFIIPGRTFPVDLHFSRTPCEDYVDSAVKQVLAIHVSQGPGVFTTGLEGSTGAQ

SEQ ID NO: 27003 - protein, 60 aa, A.fumigatus
  UNSURE (27): Identity of amino acid sequences at the above locations are unknown.
AAERILAAYGSCCSPRPLTPQKTINWXYTTTHQQPRDTNIQHYEISPLAYSNNRIVSNMR

SEQ ID NO: 27004 - protein, 76 aa, A.fumigatus
HIVLILRQFRSSLIQDEYVHIRHYTERRWPFSSKDSSRLTTTTAKGTSSFGKRHNKSHTLCRRCGQYFTFRDFSGG

SEQ ID NO: 27005 - protein, 99 aa, A.fumigatus
YDGKEKTRPNTNSMGKHHFRLALKPVTSNARPFIPALSSLRERERDAEFDLVDLGTTGALGSADLEAVLEATVDILEVAHSAGAGGLSSLGLLAPVVCC

SEQ ID NO: 27006 - protein, 206 aa, A.fumigatus
SGPSQPRGEDSPVPQRAPSADEDDLLAAFDASAPVDASTNFPIPSPSPSPQIAQSASTAAAQQQHQTAGMSFSEVDDDPFGLNQLKPKPTATPEPAQTDDDDFLGLLGKPVSEVSRPAPEPSPKPSSPAIHEHHAPSPKPSSGADRAIAELVDMGFPADKASQALRATESGTDVQAAVSLLLTQAHEEARQKSKSRTPAVDREFDH

SEQ ID NO: 27007 - protein, 226 aa, A.fumigatus
TMSVGRAVRGVDLGIYHPDVIYLFFPRLSEPSYELIRTNKQIEADKKEDMKKYALIGTGGRAMFFYTAIVRDFPTTAQLVAFCDTNTTRMAYANSLLEALGHAPVPTYVASDFDKMIADTKPDEIIVTTIDRTHHQYIIRALELGCNVITEKPMTIDAPRCRAIIDAVERTQRQVRVTFNYRYAPHNSKIAALLASDAIGDVHSVHFEWMLNTSHGADYFRRWARQ

SEQ ID NO: 27008 - protein, 171 aa, A.fumigatus
GATRAGMQHGQSPNQEHEQEMTQEDHITPVQNPRNDPIKEKAAQFLATVNEDRTFTVEEEKALLRRIDRRILPLLLGAYFFQQLDKSSPSYVSISGIVEDANLHGQQYSWLGSILYLAHLVMHPIAALLLSKLPTGKLNRVGGTSPGAAHSPIMGGRTKFSPFWPGLRIPS

SEQ ID NO: 27009 - protein, 200 aa, A.fumigatus
VGPTWRRNLATPWETAFSVDRSLAANNSEDCWTGCSIGCWVSGGSDILLTGRNDRRIWILETARSALTGCFSSANLARGLLQTGTEVILYRGHDLPDLMSISGKDSLWHHAQYPPAYLHSQWPIRSSVVSQDGRYIAIAGRRGLAHYSVNSGRWKVFEDPKTENSFAVRGGMCWYGHILIAAVESDGSYEVRPLSTTKLF

SEQ ID NO: 27010 - protein, 64 aa, A.fumigatus
NSLYGYDLPFFTLHMPSMLPYVLMLRRPIYSYHMSYNMILSVETSRQRSHYANVSPTSHISLMP

SEQ ID NO: 27011 - protein, 230 aa, A.fumigatus
SSLFHLTHAIHVAICTDVEKTHLFLPYVLQHDLVRGDLAAALTLCQRFSHLSYFPHALEMLLHHVLDDDVDNERKESKTDDPSRRHEPLLPSVISFLQASLPIKVFLDIVVQCTRKTELRSWRTLFNHLPPPKDLFEQALRLNSLKTAVGYLLVLQAMEDEGEGGHEAPIEDYVVRLIGLASQNSDWELCGELARFLIALDASGDMLRRAISRVGLRVFTTGLEGAAPSL

SEQ ID NO: 27012 - protein, 76 aa, A.fumigatus
YILVYNFLLSISFKYIYTNYSVFIKHSITILLYINNILIFLNLNNLINNFLKQLGKLFKYINNSKVSVYLGIDILY

SEQ ID NO: 27013 - protein, 62 aa, A.fumigatus
LILETYLDITFTISKLTYFTRNPSPNYFIIVKYIFYYLAEMLLLLLFYPSILSNLNSFINTN

SEQ ID NO: 27014 - protein, 316 aa, A.fumigatus
PLDFPLWHMGISGYEATIIAYMSPLLLAIPTLKTAVAKYPRLFHFLSLSGLLAYKVQNPTNRLFVTTFSVACNALTWSGIFHAEKTQSSRLESRILAWGIGLIMSSVAKFACSTNNPVWPTMHAENGGWNKMGLLLGILAVLRSHRKPVPSGGDYFPSTGKKGPSLLAAFGMGGLLFAMHSLLSDSSTMISWVWEGYPVRGPIAVPHGVLTIFAMGAGLVYGLFCPRIAGSWTAFGIGSLGAALLTCYSHWTGFYGRRSLRFMSWPVAPVPGFLGCSAISSRTNVPGSEALATASWTPFQLGVGALSICVPGGSLC

SEQ ID NO: 27015 - protein, 192 aa, A.fumigatus
RITEYFNVALPVGGVFATPFIGLFLDHLSVPNMLAIIVILTTLIEALNFGASSLGGLHHRDVVRPAAPVVLFSHVVSASLSPVHFRGLTSARDYATKVFGFATFGRVYGTIICVSGLVNFSQYALDALTHGPFDGNPIPVNIFLAAAGFVVGTVLVLYVQIAGKHLKEKRLALERDEEQERERLIPIQEEDA

SEQ ID NO: 27016 - protein, 386 aa, A.fumigatus
NQSDSKFLEALRMRDPKRRFDHIWRLSKDVLICEADPPPDEDEPFSKESSKPLRRHGGCGNAQPTIRKEGITLVGTWKPNKSMMDEDEMQQPEKKVITPQMALNVFRNISHEDVRIMGLSNDYARPEWMIITVLPVPPPPVRPSVLVGGSTSGQRGEDDLTYKLAEIIRANQNVQRCEQEGAPEHVVREFESLLQYHVATYMDNDIAGQPKAMQKSNRPVKAIRSRLKGKEGRLRQNLMGKRVDFSARTVITGDPNLSLDEVGVPRSIARTLTYPEVVTPYNIEKLQQLVANGPNEHPGARYIVRDNGERIDLRHARRAGGQQLLYGWKVERHLMDGDIILFNRQPSLHKESMMGHRVRVMPYSTFRLNLSVTTVFTTGLDGSELT

SEQ ID NO: 27017 - protein, 125 aa, A.fumigatus
  UNSURE (67): Identity of amino acid sequences at the above locations are unknown.
STRIFQPFGEYLGTQFTGVNVIGYYQTIMYESLGITGNRATLVAGIYNCVGPLANLIFIIFILDRVXRRRPMMFGAIGISIALICEAALNSQNEDGSRHGYSIGGVVFLFCVTIIFSLSFGPCSW

SEQ ID NO: 27018 - protein, 72 aa, A.fumigatus
LQSRVYMSEVMPMQIRGKGNAFATGIGNWAVATLWAQVSPIALGKLGWKFYFVFVAWSKFAPQRRCDRRETG

SEQ ID NO: 27019 - protein, 80 aa, A.fumigatus
HGVSLRPKEGVIVVKQANVSCLDICITLPVIYFCFKETKQKSLEEIDLLFGGRALGTLPENMADKGEETGISVTNVEHSV

SEQ ID NO: 27020 - protein, 294 aa, A.fumigatus
  UNSURE (271): Identity of amino acid sequences at the above locations are unknown.
YECSFQPRGEDPAVESYVTTKDGVSLPYRLEGSTDPTAPVIGLSNSILVDWSIWDGFVDAFLSNPQNQNYRILRYLTRGRRRDCGETPITVDVLASDIIALLDALRIPQATLIGVSLGGVTVLNTALLYPARVTRFIACDTNSSAPESNRQAWTDRHAMAASEGAVSPDTQEPIIGEKLAEATTRRWFVPATYETQPEVAARVKEVVRANSLEGFHKGMQALCAYDVRERMADARVPGLFVAGEGDGLLPQTMQKMASDLNGGAELKIIPXAGHLPMVEQPQAFTEVVNSFLHP

SEQ ID NO: 27021 - protein, 179 aa, A.fumigatus
SQCLKFKGILQPYSDTPIMRDRLIITAMSTMAFASAQACDIVPAVTHTFYGFPDNDPPGPAIAYDCGRGLTAGGIGTFDDPLTFASAPGEFTQCEVIFSPYLHKYIRFEDLCSQCVEEWTSSGIRHIDIWTGSNTTDGGQDQINCEMRLTPAGDLSVVRNPSMDLDVDGMLPLHLHLPS

SEQ ID NO: 27022 - protein, 138 aa, A.fumigatus
SVHMASTDSVPGRFNGLHRRVLGELGLLTLWHSSLDVKVLCAQRFIRLFAYGGSTLILASYLSALGISDDRIGLFMTLTLVGDVAISFFLTLFADGIGRRAVLALGSALMACSGVVFGLFDNYWILLTAAVLGVISPS

SEQ ID NO: 27023 - protein, 460 aa, A.fumigatus
QRVSFQPRGEDYLVTCSKDKLIKIWNRQELTPLDKDYPSVHKGVGVTYPSYIIDTSEIPSPVLEAELAKNHIRSLRPYSLLMTLDGHGAAVNAIQMNDDEIVSASGDRLIKIWDIHSGACKKTLPGHEKGIACVQFDNRRIISGSNDDTVRIFDHASGAEVACLHGHANLVRTVQAGFGDPPGAEEAMRLEALAIENEFWDAQRSGEGVDLGHSAIRRAGYHQNTAGSRNPRDIKALGAKIPPGGGGSQWGRIVSGSYDESMIIWKKDKEGRWVISQRLRQADAVVNASQAQPSSSRTMVPPPRVPQNQGPALPQGQAAVPPPGQAPSTQHLSPINQIPHQAPIIHPAPGQQNALWNSWNTANANAQVGHAANPALLIQAQHHMQNAQPMPNPLPPHHHHHVRMNRALNPQGGHPTSRIFKLQFDARKIICASQDPRIVGWDFVGDDEELNEACQFFTGL

SEQ ID NO: 27024 - protein, 249 aa, A.fumigatus
APSAAQTIRKEIMETAIRWSRSSNTAEQRFLLVDVTGKTFRVCRVTGFDGKNLEHEVLLTHTKVPAFRAFDWSPVDESLVAVGQSSGDATVLRLSSENAESISFPIRHQRYCNAVSFSRHGLLAAGLDRVRNDFCLNIWDVNQRMINKSAKGYVEPLRKLASSEPITSVKFFRDQPDVLVTGVKGQYVRIYDLRGKCCHSLQRCCALSSSFFWLECATNSLQKALAIHLYNFPRDASTILRSTRLMRTI

SEQ ID NO: 27025 - protein, 66 aa, A.fumigatus
TFDPLVVKTAAQRIVGDCSFCNGHYCSKHRMLEAHSCTGLEDCKKESHARNADKLNSERTQVIKGV

SEQ ID NO: 27026 - protein, 125 aa, A.fumigatus
  UNSURE (86),(87): Identity of amino acid sequences at the above locations are unknown.
PPKGVPNPGLKSFVAKKPFNLCFKGAKRAVLGFSFSRAEPPYFEQTQKPLIGGCLAVGSHPFISKVLKQVHLWPPVCLPPAKKGQXXKESLFQKLSWASILKLKQDKISLETFRYHLLHQYPFKK

SEQ ID NO: 27027 - protein, 502 aa, A.fumigatus
RGSPLSVVKISDALYPVNDAFLENVAAEVVYNVRRVNHHPSLALWAGGNEIESLMLPMARRADPTGYSKYIGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDFQFNSSVVVLRNHHYTAGGLFTDNFKNSSKGMGEMTMGVEAYYPIPSKSDSVANFSAWCHATQLFQADLYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKSIANNAGTPETVSFTVGALNTTNIYTTNISELSLPDLKDSILILSLSGEGRLPNASSKKAFVHQNHFTPVFPKDLSLKDPKLEVSYSPESRKFTVQATGGVSLYTWLDYPAGAVGYFEANAFVLLPGVPKEVSFVAQEGNVTDDWLQRVTVQSLWDQKVRD

SEQ ID NO: 27028 - protein, 63 aa, A.fumigatus
GGKPKFKAYFAKSNRTAFQQISEWMAAGKVRTVIDSVFEFDDMPRAIERIKSGKTCGKIIVHV

SEQ ID NO: 27029 - protein, 104 aa, A.fumigatus
GPIPQMGRFGSNDFVKRVPSMRQVGGPMIYTHCELGGIAATGNGRGFGDKFPLVLAAYSSSPPKTIPGDWKTWTIWQNSDKYKHGGDSDKFNGPMTQLRKLASG

SEQ ID NO: 27030 - protein, 68 aa, A.fumigatus
RGPLRVTGARREDTVSDIAFFDLLQDLGPYVRMAFFVGLDGGGLQMDDLRDAADWCHFSTGYGLVRLR

SEQ ID NO: 27031 - protein, 107 aa, A.fumigatus
RPAGGFIADMLYKYTGAVWSKKVLLSFLGVVMGAFQLAIGLADPRSEATMFGLTAGLAFFLEACNGTNFAVVPHVHPFANGKIPAFCPFPAAPLANDLSLQVPSPVP

SEQ ID NO: 27032 - protein, 66 aa, A.fumigatus
RSVSAGAVSGAVGGMGNLGGIIFAIIFRYNETHYSRSLWIIGVISIAANLAVSWIRPVPKSQMMRQ

SEQ ID NO: 27033 - protein, 90 aa, A.fumigatus
PKQLHSKTNISDSVSRTKSGESSQFPGTVTKLSTSLANMDMANLEYHDKIRQNSMYMKKLVIDILDVDRGQAIPGSGRTCGGEGCIPRLA

SEQ ID NO: 27034 - protein, 72 aa, A.fumigatus
  UNSURE (44): Identity of amino acid sequences at the above locations are unknown.
RRRQSERRSVDSSGRCADGLCLPVAGGPSTINNTTSGQSALAFXTSWFTHGSYQAHSLVCLLGYKCLSIRTP

SEQ ID NO: 27035 - protein, 71 aa, A.fumigatus
TCLSYRYLLEHGLKADGRLDPEVPESHNNGGSFETFFTETNSGKYVPRSIFVDLDPSVRHNSDLSPGSNGR

SEQ ID NO: 27036 - protein, 114 aa, A.fumigatus
TVPYADPRPPYHRKQAFDFGDGGGGNMANNLSIGCDCLGVIKYFDAIVTGPDGSAKKLPNAICLHEQDNGIGWKHSNWRTGRAVVTRNRELVVQFIITLANYEYIFAYKFDQSG

SEQ ID NO: 27037 - protein, 149 aa, A.fumigatus
WLQLRCCILNASSFNQCAYHHSTPPDMAPHPLAILSEEETNLARDVVIAEHPNTVISFREIYLLEPPKDQLREFLALEHAGRLSPTTPRPPRLATCQYDVIGADHIPSFHESVVDVVARKRVKHHIVGKQHHAPLTMCVEKHVSQRHTC

SEQ ID NO: 27038 - protein, 210 aa, A.fumigatus
WRYCRSEFENLVERCFSSPLFKKALEDFDLPPGFEVTIEPWPYGGLDNTEENRRYFQGLCFATDKSKNNPDANFYSYPLPLIPVMDALTQKIIRVDRPATGGKGDGLTEQTFKRDIIGHCKASDYVPELLPDGTRRDLKPLNVVQPEGPSFRITNESLVEWQKWSFRVGFNPREGATIHDVWYDGRSVMHRLSISEMVELFPEESLGQFD

SEQ ID NO: 27039 - protein, 87 aa, A.fumigatus
IMRLSHVLLGTAAAAGVLASPTPNDYVVHERRAVLPRSWTEEKRLDKASILPMRIGLTQSNLDRGHDLLMEMYVTCLNLGVFVVDER

SEQ ID NO: 27040 - protein, 63 aa, A.fumigatus
LHASLITAVPVVSKNERTGYDKLQLASYGLSEHKDKKVPRTSISSIVEVIVHISSIPRCGTTP

SEQ ID NO: 27041 - protein, 100 aa, A.fumigatus
GSRGCLQSRGSQPVLFNICTVCQLLLCPVMTNPSRQIPQGTHPILKAVDGAQAPTSVTNAGPESDLDFQISYPIIWPQNSILFQTDDPSYTDGASRIRGE

SEQ ID NO: 27042 - protein, 89 aa, A.fumigatus
VGCVSFYGFPSHYYKEKFPNVGSKEIANKVLSALKEAGIKAEGVKRGLDHGVWASFKCGKCKCLNMSVAPIGGQIVMIGMQHLTQTPTP

SEQ ID NO: 27043 - protein, 174 aa, A.fumigatus
VQVPQHVRCTNRWANSNDWDAAFDPDSNPLNVPIVQVSLFNTEDPAQHYRLGQAVSKLRDDNILIIVSGMAVHNLRDLQFTWGNPKPMPYTTSFDEALKDAVTKPPAEREQAMSDLLKRPDARQAHPSFDHLLPIHIGAGAAGDDLGKRLWTLKEGSMSWAQYRFGDVGNNSAL

SEQ ID NO: 27044 - protein, 60 aa, A.fumigatus
LYDFANHRSFLQRGYPTMKKHNPQTPILIREAAGTLHRVYARYGTTDSHNRTSQWKSNGC

SEQ ID NO: 27045 - protein, 143 aa, A.fumigatus
LVRTGGGSKTWTIMYDTRLLKEDSDDSTSTSLTVNPTLVATITKDSANPTATIPAEILTAPSATFTKHPGVAQDMPSVNVSSSAAAAASKSAGTSSASASASSSTPSASPSGSAGSGASLSRSVGAAGPIIGAVFIPLVMSWF

SEQ ID NO: 27046 - protein, 628 aa, A.fumigatus
NRNGPRMLTANRHAWLQTTGKIHYEPDSVFSLLAQRSGSEPLDKDAFLAPLLNVKDLAQGDVLPHLLKTRSTIHPKSFLHVDSRFVWLGYWSGALARIKIEGRISFYFGPGEENPKYGIQFEPDTLKQRPGLLNPTIGLYQLRAQKSVYKFLVSCASRVSQPLMLGDHPSDSTDGGTSLSLLSRSARMDYRRPDCIDWSYLQSVLEASADEALDDLWRLRTDAEFWLLRMMEMRKNTSTLLDCAFNRIDTFVCLSERIKEIRLNSGRIEPSIPCDNIDLKNVISLDRVFRSILNRALESVQNMARSSEWTLNGTKTFCYLFDMIKENDPTLRVIGVRTVLRTIEREMSKANIGDLMPFPIAQALNDMSVVAVCMQETSNHYQYIRSLPTEYASVANDAETEWNERERPWILLVESTLQNLGRKVNKLNISISDEAKSLEERHRNFWNTIDKCMRNNVTPSHLVAIIQREAPIPAAPTFGSDASSIAWSTQRTDLEVTETQKKRARGRKVQSHTSRSLRRAVTASTVVEPPSLPLVRIQKEEDKDFWNRLLNDKGQTTFRSWKSFLLSIGFSLTPQLGSGRRFEWKTHEGRCHAIVFHEPHGHNGVDLPLYRGRELWARLHHGAGRAAH

SEQ ID NO: 27047 - protein, 94 aa, A.fumigatus
GLYSHETFCVWHTVIRQLWGEGRYRDMAGLCQRLCWRLALLGDEYDYSQQLQLNFDASLTFYLLGQAQVAQGNLRDARTAFEGSVMLRKSACPQ

SEQ ID NO: 27048 - protein, 382 aa, A.fumigatus
  UNSURE (4): Identity of amino acid sequences at the above locations are unknown.
FLTXASLRFRKDILKMNPSRFEIGPVYNTNPRDRKTLRGGQMKPISKELVFDIDLTDYDDIRSCCTKANICRKCWTFVTMAMKVVDTALREDFGFEHILWVYSGRRGAHAWVCDARARCLPDDRRRAIAGYLDVVRGGSQSGKRVNIKRPLHPHMSRSLEILKPFFAQTTLIDQDTFASSEQAERLLSLLPDKTLNDALRKKWDSSPGRSSTNKWADIDALAKTGKSSTLNPTTLRDAKQDIVLEYTYPRLDAEVSKKMIHLLKSPFVIHPGTGRVCVPIDAKKADGFDPLSVPTVTQLLAEIDAWDAEHSSGNAGAEAGQDESHTPSDSQGSRKLQDYEKTSLKPYIDYFRSFIASLNKEERVGKRGNEDPDEVKSESMEF

SEQ ID NO: 27049 - protein, 157 aa, A.fumigatus
  UNSURE (40),(57),(74): Identity of amino acid sequences at the above locations are unknown.
SRPLFGMFCSRSRRCSYFFKPDFAHAQTAEQDWTRQSFYXVLPFENLDGDLQTFFEXYFEERGINAELANMIPXYIQVKEQKEYVRWLESKFNHCHYAFARVANIAGRRRQELRRRLNTEIFSAKKCSEVLTRSSRALYQNPLKNHNYLSAIPPLYH

SEQ ID NO: 27050 - protein, 317 aa, A.fumigatus
RRKYGSANVWRYCCEVFDYLALGALVLGASSELEPTGSTMNDTTQSTMPIDGAELETEVLNSRGEVTMSTYRRRQRSSSDASTDSRNLSPPRDISAVPGQAPARSGAPGTGASGNGAGSNTSRTGAVLCVHGGLSPLIDTVDKIRLIDRKQEVPHEGAMCDLLWSDPDEIEGWGLSPRGAGFLFGGDIVKQFNYKNDLSLVARAHQLVMEGYKEMFDGGIVTVWSAPNYCYRCGNVAAILELGEDTSNGGTVARSNGDYGRSNGVSGVDSGGSRVVSPGRRYRVFEAAAQDTRGMPAKKPVADYFLVRFSPFPFETR

SEQ ID NO: 27051 - protein, 81 aa, A.fumigatus
AKMGSLPEPAYLYKNVVHDPTVPYVQSAEGMYIHLDNGQRILDATCGAAVSAIGHDVDRVKQAIISQLDQVEYSHPGFFPN

SEQ ID NO: 27052 - protein, 79 aa, A.fumigatus
NLLRPCLCIPACPPSVNQYILQNSITFFSARGYLHDSLLILDQLLLPHLSDIFEIFTLQVPDLLPPGKITSPLPSPPQF

SEQ ID NO: 27053 - protein, 255 aa, A.fumigatus
SMESVERKSESSYLGMRNMQPEQRLSLDPPRLRSTPQDELHDLLCVGFGPASLAIAIALHDALDPRLNKSASNIHAQPKICFLERQKQFAWHSGMLVPGSKMQISFIKDLATLRDPRSSFTFLNYLHQKGRLIHFTNLSTFLPARLEFEDYMRWCAQQFSDVVAYGEEVVEVIPGKSDPSSSVVDFFTVRSRNVETGEISARRTRKVVIAIGGTAKMPSGLPQDPRIIHSSKYCTTLPALLKDKSKPYNIAVLGS

SEQ ID NO: 27054 - protein, 222 aa, A.fumigatus
SAAQNGNVVRLRLVLQQGRQRCAVLGRVYNPGILGQSGWHLCSASDCNNDLAGPPGTDLARLNVARPNSEEVNHRAAGIRLPGNHFDHLFPVSHYIRKLLRTPTHVVLELQPSRQEGAEVSEVNQTALLVEVVEKSKTAAGVPESCEILDEGDLHLGTGDQHTRVPRKLLLALQEADLRLCMDIGSGLVQSRVQSVMQSNGNGQGSGSKPNTQKIMKLILGC

SEQ ID NO: 27055 - protein, 216 aa, A.fumigatus
PLSTVNSQSAQSAATHAFLKSQPSSSSLSSAAAAAALRSLTPTPTPVENVQTKRMIQRRASVTSQTSMTGSLRPASRAALRRSNSSSSMSNRTFREQSPRRPATSNGQVDVVPPLPSMPPGFGGRKNPGRRSVSLEPSVRFNSSPTNKALGRGVSVDRSLRSPSSQSPVQSKPLSTVPELERTSSRNSINFSYPMNGRPISPTVSRSFPTQHEPLG

SEQ ID NO: 27056 - protein, 60 aa, A.fumigatus
IHRGLRQTQVFIGSLIFKVPTSCKLTDATSGIDTPTPAYIIDALQKTINPVATLQYVRRA

SEQ ID NO: 27057 - protein, 153 aa, A.fumigatus
QGVGVPTLLTPSLPILTSSFLLPLQGRPHGRLLRTPRSPPRALTTTSTTTFEAPTTLTTASSTSEGPTTNHKHTTTRTPYTSTYKSTTTLPNGERSTVTAVTVVYPTADSSSPAATTTGPAPGLQTGGAASITGLQKELLVMLGGAAAVAMAL

SEQ ID NO: 27058 - protein, 296 aa, A.fumigatus
PGPSPFPACQPLWVGCEGRNRERCFISKQNGGYYNSVQCWRGIQPAYNPLRPRQSRCRSIMEVNSNNSEYIYTAVWTDWSHGRIHGATITLSAQNAGFLTAFLALFVSVSAGHLWRIISFVVHQFHSSQKPRDALHHQQQVIFKNTTSPVALIWEFALLSWAWRRKAQHPLLRNLLFIVLAIIWLALTGSAAILSARITKPAGSHCLIMSPHCGLYLAAGAGFNASDPYQLDVFDTTQLLETNTATSYARTCYVPGAERLPQCNIYAQTRLALHTTTNASCPFQSGMCLEGDSAAF

SEQ ID NO: 27059 - protein, 133 aa, A.fumigatus
QVEIPDLGNELMGPVTPCALPEPEVERIAAALLGAKRPLIITGYMGRNPRTPPLLAELCDKLPISVIETVGSDVSLRSDHEAYLGVTVSTHPAVCEADVILVMDCDVPWVPTAGKPADGMLFYNFFPPRQWLT

SEQ ID NO: 27060 - protein, 94 aa, A.fumigatus
  UNSURE (41),(61): Identity of amino acid sequences at the above locations are unknown.
ALLFSRVALHILMDVDMNLSFEPSPDYPGIAAAAGNPWGAXVTKTDQFDSTLNNAVETVQXGPCAVVEIRLVFSLCSQAKLNLGNVSLQCGVKK

SEQ ID NO: 27061 - protein, 75 aa, A.fumigatus
ADTCSVGDGTYLFSQMESVYWIARRYDVPFLLVVLNNSGWNAPKVSTLLVHSDGLASKSNRGGRLSFSAEWLSTY

SEQ ID NO: 27062 - protein, 76 aa, A.fumigatus
  UNSURE (72): Identity of amino acid sequences at the above locations are unknown.
MQSVSSPCIRQGSYDLQGCHYHCPISALRAGIRGLWRISSKPLAYDSIWLSDKLSGFDAEFGWEKLKSTAHXLVRG

SEQ ID NO: 27063 - protein, 78 aa, A.fumigatus
ISIVMSHQLTNGLQDKKGNQVDHHILTQGAEICHEVEILDERKDSFNHYPYDQADISYLIIVVQIIGHSSLPEEPHPD

SEQ ID NO: 27064 - protein, 127 aa, A.fumigatus
HSSDPSTPVVKTSPQIVRFISFSLPLPCTESQLTSPPTDQYLRALQRGCFRYFQLGLVDGPAGLLGGLIQKPSVLFVHFFSVALLSLWVLLREYPPYLFPVALFKCIMTFWTACVVIFPYMLIEAFC

SEQ ID NO: 27065 - protein, 62 aa, A.fumigatus
IPARPCSSYIPPSHVGVYKGQMRAFWPVFKDYPLDGLRDLQNCNRTSASVCCISIFGHVNGF

SEQ ID NO: 27066 - protein, 76 aa, A.fumigatus
  UNSURE (1): Identity of amino acid sequences at the above locations are unknown.
XSTRVFHLGVKTIAHAPRKPNGINASTLDSASGQGSNGWQTTKKKQKKNAKPMEPRSGFHAGAEPLPADESLRKGG

SEQ ID NO: 27067 - protein, 110 aa, A.fumigatus
PQAVACFYVRIQDKQQQEPYYRAVYLTERTASDFIDQLSKKYNVQPDRILSLVHINPNSLRVAVDDDVVGAIPEGQDMIAQFTEVPAPVSSDGEGEGEGDSTRYEVQLHF

SEQ ID NO: 27068 - protein, 510 aa, A.fumigatus
YTKLCPSTACEELTLFLQYKSKIKKYVLPEGYSGLTIGRLQLAFIEKFAWNTHNNGVDLPEIYIQDPISGVRHELEDLNDVKDRSVLVLNVDILDEVKKHFDDELGGVRRLIEGVKGTLEGQENIIQRVSDRQLEAAKEIARLAAAPPVSIPTSLPDGSARKGPITGSRSQLAELQSLKRDLAVLRQTYSNFSSDIASSMNAIRAKANFVKSAAADVAVPSYEGDAGRARVNAGKKELADESERLVGRVDDLQDLVEDLRKDVVSRGVRPLPRQLESVSKEISAVTKELKKMQEFLKREKPIWTKIWEKELQLVCEERDQLTMQEDLAADLEDDLEKAAQTFALVEQATKQQALQHNVNGGVALRNTSRNVVIDPAVDPMKAKDDVLGEVRALQPNHESRLEAIERAEKARQKELENRRIGLFQKELGAFVQEGKLKKSGGVEEAERQRRVKDDRIRKEVWERQQARAAEMEKAEAESAAAAAASTQLEQSDQSEQPVFTTGLEGAAPQK

SEQ ID NO: 27069 - protein, 68 aa, A.fumigatus
LGLQSGILACLVNLSQFIIIDSVGPVSSTVIGHLKTCIIVGLGWALSDRPISRGCLVGILMALTGMTL

SEQ ID NO: 27070 - protein, 238 aa, A.fumigatus
VRILARAVCEDAKALCSILYHDSHQNIYSHMSCVYPKYTHINQSPNSPVIMPILINPITNEPYIPLPAPHSSIIITPARAPNTHDSSALLSLLNNPQIFPYLESTPVPYLPEHATEWLQASHEQATALLQAAQNNRFVDGLPFTCIREVTNDGSSDIYIGNVGLVRYAFYEFKKGTAEREEAVRRNEALGVGSPEIVWGFGGKSPFPFFPSALAIYIYLCVYVCVYVLDEDEGDEGGY

SEQ ID NO: 27071 - protein, 109 aa, A.fumigatus
  UNSURE (41): Identity of amino acid sequences at the above locations are unknown.
IQCDPVHESVARLSSNPSSLADSTLLPASQTNTTLDFTPPXRFSGTTAQSSNSNSNRNPFFSNTRILALLSAYTDALITRAFIRGTAHSSITALMTAVMMPLPWYVGER

SEQ ID NO: 27072 - protein, 131 aa, A.fumigatus
PSDAEKWWNVIRDTAKSAPAHSPVSPTSPIATGGAVAATTESGGAASAPPPTTATADVAAVEAKPPAYKEQEGVAPVAQEKTTAGEAATPTTPAAETGLNRSTSAATGHYHMGPGGSAVAPDAPASGVEKS

SEQ ID NO: 27073 - protein, 160 aa, A.fumigatus
  UNSURE (148): Identity of amino acid sequences at the above locations are unknown.
RRHGLFYTTFRASLPGTGKDKTSFNIQDLLTQPHPGFANVEQMPLLNFTVTITNTGKVASDYTAMLFANTTAGPAPYPNKWLVGFDRLASLEPHRSQTMTIPVTIDSVARTDEAGNRVLYPGKYELALNNERSVVLQFVLTGREAVIXKWPVEQQQISSA

SEQ ID NO: 27074 - protein, 222 aa, A.fumigatus
  UNSURE (15): Identity of amino acid sequences at the above locations are unknown.
FERGSSTPSGSKTPXKSASAAQSGIRNLPLILAISLLTIFSGGLITATGHFGSLMVIGSALATVGSGLICTLDIHTGSGKWIGYQIVAGVGLGLALQIPVILNQALVTPSDLSSISAVTLFMQTLGRPICVSAAQAAFVNRLVTRLSVLAPNVDAKLVVATGASELRHTFNDEDIGGILEAYMDGLKLSFLLCTVLAGVTLVISALPKWVNLKGKVQGSGAT

SEQ ID NO: 27075 - protein, 88 aa, A.fumigatus
FIQSEFLEVIVSLTVVVIGHAFRKNAAGAFGPDLARKLSQLVKMEKNVMRSMEMVARERMEAAVCCWSLTHAFTIADSGTLATTLHLG

SEQ ID NO: 27076 - protein, 215 aa, A.fumigatus
VGSLDPKESYINVSIGKQKITDEIAKLKYKDPNSPRIVVLEQELVRAEAESLVAEAQLSNITREKLKAAFQYQFDALREHCEKVAIIAGYGKHLLDLVDDTPVTPGETRQAYDGYEASKAIIQDCEEALTNWVQSKAAVKPSLSTRSRSLSQRAREKNREGLDLSEQDQPMRGDRDSWVPAGQHPSYGEDGEEAASTVDGETRGREETTEAVAAA

SEQ ID NO: 27077 - protein, 66 aa, A.fumigatus
QQLSIWGENCDEDVSDVTDKLGVLLYEIGELEDLFVDRYDQYRVPIKSIRNIEASVQPSRDRKSGL

SEQ ID NO: 27078 - protein, 100 aa, A.fumigatus
SPPVVKNWLPLVLPCQSLVIKKVSSTMHRTYSMRQSRVPTASQIENPPPPLSSTKTNRWLGKGGLGALIHTVRIPGSNSFTNSCGDRPCLSQECRRCLWT

SEQ ID NO: 27079 - protein, 527 aa, A.fumigatus
  UNSURE (37): Identity of amino acid sequences at the above locations are unknown.
AVRQRSGRGIPSSRGLGVPEKRAWKEFQGRHADQLVXSQRTRDQIMRQSVISDMFNSSWRMDALVETPLAEVKMPAVMFVRDPETKDLKPYHGPAPGSDKPLPDIKVLVRQPWPGAGVEKLPPTTRCDEAVSYIVRNHDLRGKFDPQKAKELNVRAGPNFARLTKGENVLSEDGKTVTPDMVLGPPRLGKGLAIIDLPTSDYVDDLVDRPEWNSASVTRGLEAFLWILGPGVGDHPRLREFVARMSHCKHTVSSTDYCPNYLALSSVAGSSIRLARLRGENYPVPVHDNKTLPQPGTPTSESETTKEMIRNSPFEPVKPGLVIDMEPKCELNRSEVVPLFNPAETVQRIPRSIEQRVTAIRTRVMNPQFQEKLAEFRKDLPGANVEIVTLGTGSSSPSKYRNVSSTLVNVPGVGSYLLDCGENTIGQLKRMYEPKKLQEVLQNLRLIWISHLHADHHLGTASVIKEWFRANYPNGVPGAGDVETDMRKILKEKRLFVVSEEMMIGWLEEYAGVEDYGFGKLVPLAAH

SEQ ID NO: 27080 - protein, 176 aa, A.fumigatus
  UNSURE (3),(4),(10): Identity of amino acid sequences at the above locations are unknown.
GAXXLMTLSXLEPPVKTVEITSPVISDQIVPTILDLLIESSSLGDTATRAAKDVLALYEGQSMIRPLIPEQNGKQDWQFTVMNTGGSWLAERSAAKPAFRLVIPLIDDLEWRITDLEKDPNELHPIKNFDLVDLARKLEKQYGPEVTNWVRDAAHVASWWVGENWRRYRYHPDPKH

SEQ ID NO: 27081 - protein, 290 aa, A.fumigatus
CVSCIKPKSSFCLECQHGSDGAEHQSAGGDRALDGAGGALGELGGGGGSGASGGARARARARARAGAGARAGVAAAAAAGGSRFRAGARVRAGAGSRRGGSRLGGSGQGGGGRGLARGRAGGAGGAGGGGGHGRAGGDIDGAVELDALPRARVVRVGVGLGGVGVLDTDGLDVHGVRSRAVVGQATGPLDGALGVAGVAAGPAAKSQAHRSLREASATLGIVVRERTHDRTVNRPGNGILGPVDGVGVESLLRSGNGHVSASVICGGVSFAKVVCLNLSGVTAQYFLRFR

SEQ ID NO: 27082 - protein, 142 aa, A.fumigatus
NANTAATAPNTRAQAVTEPLMEPAAPWESSGVAEAPALVEEPVLELEPEPEPEPEPEPVLLLPLPPVVVGSALELELEPELVPDGVGVALVEVARVEVEGVLLEVELAELAVLVVEEVTEELEEISTEPSNLMLCQEPELSE

SEQ ID NO: 27083 - protein, 125 aa, A.fumigatus
  UNSURE (34): Identity of amino acid sequences at the above locations are unknown.
VFSYDHMIYISLSNDCFAETCPPNKGLAASTYTXDFTSASALDQWEVTAGKVPVGPQGAEFTVAKQGDAPTIDTDFYFFFGKAEVVMKAAPGTGVVSSIVLESDDLDEVDWVSLLVYHVFVLSRT

SEQ ID NO: 27084 - protein, 151 aa, A.fumigatus
PPPPPAPPAPPALPRARPLPPPPWPLPPRRLPPRLEPAPALTRAPARNLLPPAAAAAATPALAPAPALALALALARAPPLAPEPPPPPSSPRAPPAPSRARSPPALWCSAPSLPCWHSKQNDDFGLMHDTHHEGDVRTIHFGIGVSPSFGV

SEQ ID NO: 27085 - protein, 141 aa, A.fumigatus
RCGRAYAHVQRCQGWHSLPSDSYAPETWQLGRRRPQQPQGHHRVGRWLDRLQRGTVHHVRQVRPYRERQPRRVLHLLGQLWLLAEHQVRRLRRYLLQLFRDLLHHQHRQLRQLYLEQDPFHLHPGHFHQGDSHPVWNQLRL

SEQ ID NO: 27086 - protein, 69 aa, A.fumigatus
CTIHIMKGTSELYISASGFRHRLEYDYSIVLIDFILCPYLFLIPRTYNMQHVTYLMKVRYCSGRGICLL

SEQ ID NO: 27087 - protein, 293 aa, A.fumigatus
LGKPACLSCVRLEPDLTKAQEVLGGDTTQVQTNYFGKGDTTTYDRGTYVPVATPQETFHTYTIDWTKDAVTWSIDGAVVRTLTYNDAKGGTRFPQTPMRLRLGSWAGGDPSNPKGTIEWAGGLTDYSAGPYTMYVKSVRIENANPAESYTYSDNSGSWQSIKFDGSVDISSSSSVTSSTTSTASSASSTSSKTPSTSTLATSTKATPTPSGTSSGSNSSSSAEPTTTGGSGSSNTGSGSGSGSGSGSSSSTGSSTSAGASATPELSQGAAGSIKGSVTACALVFGAVAAVLAF

SEQ ID NO: 27088 - protein, 203 aa, A.fumigatus
  UNSURE (28): Identity of amino acid sequences at the above locations are unknown.
SSWIHWPCGPTRGVPNLFDDSSIQNTQXFYVYADDAGDIKAHPFFHGINWRTHHLTEPPFTPKVDGWEDTRYFDDNEDSLDNDDVSITSEDNQGQGEVDGGHAHEPGLERVQSQQKGCQPDQKDSPDLAKKNKHRKKDKHKRRRPRDKLLRDPRVGKTVLDIRKRGAFLGYTYRRPNAVALALVPERGRSMFRRGQLPELYGY

SEQ ID NO: 27089 - protein, 74 aa, A.fumigatus
WTIHRSDLLNTVVYAVGLLATLRSKKLSGQWIGVMVTASHNPAEDNGVKLVDPMVSSYGTFDGGMKGEFADVLI

SEQ ID NO: 27090 - protein, 128 aa, A.fumigatus
  UNSURE (119),(125),(126): Identity of amino acid sequences at the above locations are unknown.
AEWEAYATKLANAPLENIGDVYDELVKEIDVSMENPARVVFARDTRASGSRLIGVLSAALTATEAEFIDMKFMTTPQLHYVVRCKNTLGTQYEYGEPTEQGYYEKLAAAFKRVFTRGGXGMQVNXXLH

SEQ ID NO: 27091 - protein, 504 aa, A.fumigatus
TLQLGFTLRYPPSLQRGRLLCVPFNSAPPHHYLLLLQLRHLSSIEELHLLSSQLDLKFCLPCFLTPTDHFRLCPSTSSARNNQALHFPRSKVGRNCTISGLTANRMADSSSFPGTNPFLKVSTKDDKYSPIQKISEEEEYEVTSPTDPTFRSAHSGATAPTAGNSFNGDNGSNEGGEGIQFNRPFDAGFGQGSEGQGEHVEPPGGARPTAAANQGFPNNYALGRRTSVSAESLNPTSAGSDSWTPPCHPKTEEQLSRLKTAVSNNFLFSHLDDDQFRTVLDALVEKPIPAKDIKVISQGDAGDYFYIVENGHFDVYINPAGSVQPGPDGIGNKVSTIGPGGSFGELALMYNAPRAATIVSADPKSTLWALDRITFRRILMDSAFQRRRMYEAFLEEVPLLSSLKPYERAKIADALDAIKYPAGSTIIEEGAPGDAFYLLESGEAEAFKKDVEGPVKSYRRGDFFGELALLDDKPRAASVFAKTDVKVARLGRDGSSPRGWKVRV

SEQ ID NO: 27092 - protein, 84 aa, A.fumigatus
NQWIKTASQTSGEDLVNFFALSDDDLRLSLLTLVYRAAPPTKGSSTTFSLSCIKAAETALRRHHDVIDVIRKNGSIYFAKYIHW

SEQ ID NO: 27093 - protein, 134 aa, A.fumigatus
NVYSENDSVLALLYRTSSLQLGVAGLQPVEGVSGVENLDVSDLISGHLRYQFLVGRILSVVGLESIDAREVALEEAALEAKDRRQEQERAHNERQAGFMGEGRSPSQRLESQEDLQGEEDRLQKEMGKARVRHS

SEQ ID NO: 27094 - protein, 200 aa, A.fumigatus
LKQDFRAIVPVRCQLVALISAFFFRNRQICSTMNSPKVALITGASRGLGAAIARCLAEEGMNIVINYNSDPAPAERLLQEMRALSQAKVPGANAPRYAAFQANLANQSSTQQLVQQTIQTMGRLDVVVSNVGWTRMTNFMNLEDADNEMDWDRCFSMNVKSHFQLFRVCQEHLERSEGVFIATASVAGVKPSGSSLVWVI

SEQ ID NO: 27095 - protein, 421 aa, A.fumigatus
  UNSURE (378),(397),(408): Identity of amino acid sequences at the above locations are unknown.
HLSELTDFPLGTVPGLPTSIMASTEEPVPPPAPVPADAPASAEVDAEMAPPATPVDSTILSGSEGPVTSPDASIRDKENIKSSPEKTTTTTNRPLSGTAAAKRPSSVSGATKTAASTARAAANGSTLSKPPTRPTTSGTVRKPLSTSTTASHRSRPSVSSSADEKTRSVASSGDERRGISGSAKRMSLVGTTSSRAPPKTTTSTLDRRSSIAGTTTSRSPATRPSTAPSTKPATKPTGVSSTSRTSNSTSTTVARPAARPMATATRPTTTASKRLSTAIKVSDDEAEKLQSLQNKLSESEATVASLKAELETVNEKLSQLSVSHGGASKENDDEVASARRKEHAAETAKLAAEHAEQLQALQAQLDEAETKRKELEDXVLQDLEYAAKAAAHERDDXTTAALEELKQXHQSQLETLEKRTC

SEQ ID NO: 27096 - protein, 199 aa, A.fumigatus
TDLFRSLFYSFVSLAFQIPFAHSPAPDTLPADDPNAYGHGSFVVFWMLNWVGMTALGLPCENMGMILGFPYSALFLIFWVITNVATGFYALDLAPGFFAWGYAFPLHRSKSSILRTALRLSNSCSCRGAPDYSLRHAFLDWTRLWHSVCVDRIVHHIIPICRICHALEDEARIVIFARDRSIHSNQFIILDTSQHNLFS

SEQ ID NO: 27097 - protein, 109 aa, A.fumigatus
  UNSURE (52): Identity of amino acid sequences at the above locations are unknown.
HSILSLSFDMATTNDFLSSDVNSYDYVIVGGGTAGCVIASRLAQYLPNKRIXVIEGGPSDFMDDRVLNLREWLNLLGGELDYDYPTTEQPMGVYSSHILCFIRTSLRVI

SEQ ID NO: 27098 - protein, 62 aa, A.fumigatus
VYAIRSINIPPWSTMKDEVDENSPKLTIDLFIEKWRYQMIIKWVLRHIGACLAKDDNTPKGL

SEQ ID NO: 27099 - protein, 86 aa, A.fumigatus
TRSCRALPIQDSYSLQLYLSLYFLVYSDCLFALNQLSALASTSTVICCFILYIGKCLPSGFKNPAHATLVDTYCNNEEKRLGLWHI

SEQ ID NO: 27100 - protein, 279 aa, A.fumigatus
VKILRQRRCPLPGRLRCCSWPALGTPSAYHAARCAVSLTNLELRKVELDSMASILRVLMNNVRRRRLSSRECSTVAHIIHTETPIEEETLPHYKAEHYYPVRIGNVYHARYKVAGKLGYRAYSTTWLCRDLQCANPSLINPRAALTSHGYRANNYTVLKVSTSLPDYPTAADRELRVYKHLAKIDSSHPGRSLIRELYDSFDLHGPGGTHRCLVLQLMNVTLLKMMRMNPRLFDLPLLRMTIKRLLLALDFLHTEAEVIHTGRDLCFIKVGFDTDVHQT

SEQ ID NO: 27101 - protein, 357 aa, A.fumigatus
NNHPYRPHTLTIKMSSNKALVFKKVPEGYPVPGEHLTIEPVEYDANTPAPENGVVLQSLYTSFDPYMRGRMRPAHVKSYSPAFELGKPIDSTTIAKVLRSNNASFKEGDLVIGFVPIQEYIVLDGSQVARIRPLENPLGIEDIRVFLGALGMPGLTAYSSLYEIGKPKKGETIFVSAASGAVGQLVGQLAKHEGLKVIGSVGSDEKLEYITKDLGFDGGFNYQKEKPADALARLAPQGIDIYYENVGGEHLEAALDAMNNFGRVVVCGLISQYNTAPYPIKNIHNVLIKRIDMRGFIVSDPGMGDKYTEEHQKNVQKWIKEGSFKALLHETTGIDNAAEGLVGIFYGKNKGKAVLKF

SEQ ID NO: 27102 - protein, 140 aa, A.fumigatus
AQTRPSSSRKSPKDTQSPASTLPSSLSSMTPTPPPPRMVLSYSPSTPALTPTCVAACAPLTSSHTLPLSSLASPSTAQRLRRSSAPTMLLSRKAIWSSASSPSRSTSFSMAPRLPASALSRTPSASRTSVCSSVLWVCPV

SEQ ID NO: 27103 - protein, 203 aa, A.fumigatus
RVYEMILLLTCRIFFQRSTSHLELQDSLALVLTVEDTHQTLGGIVDTGGLVQKSLERALLDPLLHVLLVLFSVLVTHARVADDEATHVNTLDQHIVDVLDGVRSSVVLGDQAADNDTTKVVHSVQSRLEVLATDVLVVDVDTLGRQAGQSISGLFLLVVETTVKAQVLGDVLELLVRTNTADDLETFVLSQLTNELSDSAARS

SEQ ID NO: 27104 - protein, 473 aa, A.fumigatus
  UNSURE (331): Identity of amino acid sequences at the above locations are unknown.
THSAVPSARGVKSSSSFGLIGEIRERSPSAAIPPAPKPSTASTGFPQHRRRVNQSAFKQRRANRQQESTPPPAATPSTTLSDEKKSIDEENRRQLASMSPAQIQQEREELMSSLNPSLLERFLRRARIDDDDSITPSEKSSSQPEPPLSSASSAQDASTAKSKKSVSFDVEEDSKTATEKLERSQRKRTPPTVTSSVLTPEDLPPAQPPADLHPASEMPSHEAFHFPTPPRQDKPPNLDPASPSFLSDLQAHYFPEISHDPSALSWLQPPSADPEDPDSTSAYHPASSAEAVHPSALRFSLLGNVLSPATSLSLPTTLGLHHHGKDPHAAXYTIPELAILSRSTFPAQRCIAWQVLGRILFRLGKGQFGERGSPLVEGLWSVIEREGVVAGMLAEADGAPSGPTRSAAAQDSTAADLNHPSPLPAQGTPVPKGATGIGRHASASAWAVEGVWLWQMGGGGDRGILKENTIRSQ

SEQ ID NO: 27105 - protein, 74 aa, A.fumigatus
RPLRDHLSSISQNNNHRIKLTYVESYAQIKKKKICSNQDKSQFTSFSFRLYDILPICTPQTFHRVSSQKLPPQP

SEQ ID NO: 27106 - protein, 371 aa, A.fumigatus
LGQCGKEHPRCSHCMKRHILCHYMPSWKYSRSTSTQNRSSMKTLPSISVLTCVAQSQSQMSPTGPNDAKDNLNVHDLELMMQWCTKTYRSLSHSSNVESIWQTVIPREAMRHPALMHGILALSALHLASSTGGSMYERYIKTAEAHKDLALSGFRKRFTNIDHSNCDAAFALCSLTTISSLAFPLIAGQGQTNTALDDICEAFQVARNSMNVLVQIADQVKSGELKPLLEEDEGGPKMPDTSRLAIMSLSMTNSQLVNRNPKHEREMFEATIRQLGQSLEKLAQGREASIVAFQWMHHIPPRFMDLVHERHPFALVILAHYAVVLHFMRSRWWMGDWGARIIQQVGQLLDSQWRQSISWVLDATGCYIAPT

SEQ ID NO: 27107 - protein, 73 aa, A.fumigatus
QYNASKAGVVQLAKCLSVEWVDFCRVNCISPGFIETDILDIHPKEWREKWYSMVPAQRFADAYELKGVSFPFL

SEQ ID NO: 27108 - protein, 153 aa, A.fumigatus
RKNKKKAHDQVALIYNSSKTADTTAAEIASANNVRAAAYQANVSNKAEIERTIQQIASDFGGLDIIVVNSGITSNVAAEDYTAEQWKEVMQVNLDGAFYTAQAAAQIFKAQGRGNVIFTASVSATLVNVPQKQAAVCGFSCSATAARLLTVAV

SEQ ID NO: 27109 - protein, 144 aa, A.fumigatus
TEYAIYTTKSAQQPYHPAGPLPFAATNQPPSHQATTAAAQHTPPANVARYSPSRQQTAHSTATAPHRCAPASQQDTPPGCPHQTTPLAPPAAPYPTPRAHSTAPAQTGPDSPDCPAARRTQRMCSRSSRSGGYGTRVVPAQRGC

SEQ ID NO: 27110 - protein, 163 aa, A.fumigatus
MGFSPVGRQLQILWQGIRPLTTPWTCTSQITPSVQPTITLIGLGARLLIQPPQIHPIPSPQSRPRPRPSPPMLRGNKQNMPYIRQNPPSNPIIRRGRSPSPRRTSPHPIKQPLPQRNILPPRMSPDILPRDNKLRTALRPHRIVAPQRRSKIPLPVVPTKQHP

SEQ ID NO: 27111 - protein, 530 aa, A.fumigatus
SLTRFQGSSDLAQKMMSTMLSRPAANITPPEVLLQIFYLLNPRDFDNARRTCSQWMRASLDKNLLESMLKRAGWWDAWKQDCHNYRVDPSASEQSLVWRMSRRFATECTLSGSKSNVERAGFLTTGVVDFSRLSQGQSLAKHGASAPHSVAGSVMNPDSRPLATSRFHVSKCANYLLVTSGRMIYVYHLLYRKSGSDVFTTMDALTDLDIAPVTSIICPVEVISASIDTSTPRIVIAALLRDRLGFVCDLNASSERSSAQSEVMQLLDPSFIHYFRDICSPEDPPRSVSICPGRRCVAFGSGTSIELHWVDEKTRENRRKRFPMSQPSEILHFLPNRPETPMEMRLISSLAGPGMPGCECHKVSYGEMRAPCQLHLLTDVQSLTRWTPSNNDSLSIVRATHCHHYRAIPINDGLHILFIEPRTGLLCIGSDAPIGGPTSLTQALVCVPPFGKDCLNVSKDDLAPTVFASGWNLDWGLRVVAAYGDRIVLYSVPVDVYNVIRKERERQGDGVMGDSDLSSPRGWKEPLPSQ

SEQ ID NO: 27112 - protein, 354 aa, A.fumigatus
SLSLVIMSSNTFSDILYYTTDSDYLAAALFFAFGIVILSLWLVNLLVAVITHSFQVIREESKRSAFAVQKLDSLDTENTSTRKTSSFKRFYDRTEWLWIGIIILDLVVQAMRSSTMEEDRANLINVVEVFVTIILLFEIILRFASDWRRFHRSRRNWVDLGLALITCVIQIPAIKHSGRPYDVLTLFQILRVYRVVLAFSVTRNLIMVVFRNATGLLNLIMFVFLITFLASIFATQLFRGQIPAENNGGDEIDINFADIYNSFLGMYQILSSENWTTMLYDATAFTYPFNTAWISAIFIILWFIVANFIVLNMFIAVIQESFDVSEDEKRLQQVRAFLEQKQSSPRGWTDPRLG

SEQ ID NO: 27113 - protein, 101 aa, A.fumigatus
VTDATTMVFLPPATAGELAPIPDNIPISEFMLNEKYGRHPASQSRDPYTCGLTGKSYSVPQVTEQVDLLARALARELNWAPNSGTEWDKTLAIFSLNTVST

SEQ ID NO: 27114 - protein, 138 aa, A.fumigatus
IDTLPLSWAVHQLGGVVSPANAAYSAAELKHQLLDSKAKALFTCAPLLRTSLEAAAMVGLPKDRIYLLEVPPQAGGGKEAGLGFKTVSQLIEKGKLLPKVERLNWSAGEGARRTAFLCYSQWNVFYHEGDEASALSDG

SEQ ID NO: 27115 - protein, 524 aa, A.fumigatus
CISVPTLLTTAADPHRYMSETQAFFLLSVLCDRLLPGYYSTTMYGTLLDQKVFESLVEKTMPVLWDHLSKSDVQLSVVSLPWFLSLYINSMPLVFAFRVLDVFFLEGPKVLFQVGLAILRINGEELLDVQDDGSFISVLKSYFSRLDESAHPKSENPKLRAITRFQELMVVAFKEFSGITHSTITEQREKHKDAVLENIESFAKRTSIRNLGPDSKRLSMDDLGLIYDRFYEVLYDRQQKQRLIDEEKKRQEKKRSERTSILGPPVDQEMGRVGLGPSPTHMDYDAFRDFLAITAKWAVTDSPGPSRKESSADINGSFRGFGKWTSGANHKPEPADHEFMQRLFRKWATDPSEGLSLQNVVNGLARLKGTRDIMNSINYFFDLYDDNGDGKIDREGILRMSEALLFLSRRGFDGTITPSQSLEDLNDRNHPERDKLSTDERFLGSVSSFIRRCFEYADPSKPEGKTTDTANDTNEAPDKLDSFAIGDDDEEDLIDMEENKNPKGSSSVTKRRDNDHDAGCHPRA

SEQ ID NO: 27116 - protein, 139 aa, A.fumigatus
RAFVKMSCNLENGRNATLVRQPTFHKLIRVGLPNRLRGEIWEVTSGSLYLRLRSPKLYTDTLAKFSGRESLAIDEIEKDLNRSLPEYPGFQSEEGIGRLRRVLTAYSWTNAEIGYCQAMNIVVAALLMYISPYPANNRC

SEQ ID NO: 27117 - protein, 142 aa, A.fumigatus
RLALVTGGGSGIGLMIIQALAVSGAKVYITGRTGEKLDRVAELYSHNIPGQIIPITADVTSKQSIQKLVDEISSEEKALHILVNNAGISGTTQDTDSQSAEELHQKLFKDESNSVEEWDEIFRTNVTQLYFTTAAFLPLLNK

SEQ ID NO: 27118 - protein, 132 aa, A.fumigatus
TDLEHGWSSTVVNISSISGILKTAQHHFHYNASKGAAIHVSRMLAHGIASSNLKIRVNNIAPGVFPLEMTANDSDEKQKSSLPKEKYEGKVPAGRPGKDKDMGSAIFSICNQYLNGQTIVVDGGFVLAAGTV

SEQ ID NO: 27119 - protein, 98 aa, A.fumigatus
SCHYRIVQQQKAEFGYSTEVVAVVFLRNQVDLETEDGVTSQMLTRYKFFHANKHRSTKCKCCHIKCSINLKSSSPSLPIAPNLWLTSYIEGIIQYLRD

SEQ ID NO: 27120 - protein, 220 aa, A.fumigatus
GLTQGFAHSLGPQIAWRTVFIIEYLGPLLIHPLFLFPLRPYIYYNFDKPLPEPSGLQLLVCGLLTVHFVKRELETLFVHRFSNATMPVRHIFRNSAHYWVLAGFNIAYWVFRPDAGAATNEPNPALLYSGLTLFVFGELANLNTHLVLRDLRRPGTTERGIPTGFGFNLVTCPNYLFEIIAWIGVYLVSGMSWSVLFFITIGGSTMASVFTTGLEGSAEA

SEQ ID NO: 27121 - protein, 177 aa, A.fumigatus
LSLCDISSKMQFTSKLSVALLAILAAGGEANHQALHGRKFFHPRGLNSTTPASTSTVVVYPTPIESSSAAGDSISAITSTTIPLSTGAPGSGDSGDDNGGQDVTITYTLGSGSTKSVVTTTIHKTSTDLHTVFAVCCIDHITLLLSHCSRLTDFLYRRLPLRILPPQSLPPLPPPLP

SEQ ID NO: 27122 - protein, 147 aa, A.fumigatus
IKGTRTFVMDIVQFLEETSSKQPIRCIDMHTTGEPTRIIYSGFPPLFGTLLEQRDQAKQHHDHIRKCLMLEPRGHNGMYGAIIRPETELVSSGAAHIGVLFIHNEGFSTMCGNATIALGRFLVDTTTTLYSLAARTSSSRQTRRPSN

SEQ ID NO: 27123 - protein, 197 aa, A.fumigatus
CHLHREEALKVRPGRCDSYISSAVHNMENAAYFGEQEDQMNILSRGFSEAEGLEGMNMSELRISIEELTKRMCPFQPPPPPVAYDEAKDASATRETSSFSTVLTIHESTHPDGRKTYQAHASPFVPTQDLEAPGAGENDAIIDIPHGSDNSYIERLRDNNTMHAISTRRRRKLKMKKHKFKKLLRRTRTLRRKLDKA

SEQ ID NO: 27124 - protein, 229 aa, A.fumigatus
VQPFSNPQLNVRQSLLQEDALAWPELENAVTPEVAYDPLIQLYYQTFHRSHPLLIPRKALHSHLVAKIPQYILSIMRFIGAHQHHDPSLKELFRQSAYSVLSALTPRDGFMVQGMVLLAIVEHARGAEDSATRIMQAAVNLALELGMNKAAFAAEHSGGNSILEESWRRTYWELYFVDGFLAAMRDQSAFQLFHSPADVRLPCDEELYNSGDVVRRSKCPSGRAPLITC

SEQ ID NO: 27125 - protein, 252 aa, A.fumigatus
VIPSNLTFKDLTNKWHFDEERRFPSSAYRIQAVRVLGMVMELNRSLDIDLDTQIETIDAVLAALLMQLPSSQRDAYGSHCGLDEMTFQAQMTSYLCVHHLYKPLSVPTNKLSLPSALIYLHHPRSNMRYASIHAYTSCTRLPTIRETTPPSASLDLHSQKLLRAADLLCNLATLPNPVKYRTPFFTCALAMCVVVHTVACLVVSIPEKQESIKARIQLGVGALHVLGKLWPLAKTVRQRLISMYQELGLRCR

SEQ ID NO: 27126 - protein, 126 aa, A.fumigatus
PTMYFNPINHGCHYFGSLRRNRRLSVVCGYCIHFHPPPTIIDSLGSASFPTPVLDFLTASMDSFENIHASKNLEHSKDGLLTNALTGGRAEFPVVCQDSPCGSFANLTFVDIDSQVLFGHLGKYVY

SEQ ID NO: 27127 - protein, 220 aa, A.fumigatus
GISSQQVMTILSSSSCIRSSMMRLVPAFHDAESKLRFKIDFFILTFCCITYFFNYLDRANLSNAYVSGMKEELAFHGNQLNVINTIFTVGYILGQVPSNLALTYFRPRIFFPAMIFLWGGLTMITAAVHSPQGIMAIRFFLGLAESSTFVGTHYILGSWYTEEELGKRSGIFTASGLAGTMFGGFIQTGIHSSLDGVRGLSGWRWLFIVRFLLSQNVIRC

SEQ ID NO: 27128 - protein, 82 aa, A.fumigatus
IDGLITLPIAIYGLFLFPDTPATTRAPYLTESERALAISRLPVTNAERAPLNRAFIKRLFTTWYWWAFVILWVIAGETESFS

SEQ ID NO: 27129 - protein, 383 aa, A.fumigatus
TMELYSGLRRLLSRKTLTGSRGLLTATENVFDGQRQEAEKLYRRNFLENYSDTETAQFSFFTTKLDSVIHASSINSLASIYGPLHTLLDSGEHDGIWWLDVTDPSDGDIELLSRLFDIHPLTTEDIKIRETREKIELFGPYYFLSLRPPQQAEDVPGSRTSGCNVYAIIFREGVLSFTFGNNPHTSHVRSRIKDHQSHLFLTSDWISYALMYGNLLSYVEYILTDECSDDIVDGFAPLINRVEASVETMEDSVSITRPDDIGLALKQIYTSRRQVLQIRQLLNDKTDVIRCFARHCEALGSTREVVSYLSDIQDHVLTMVSNLAHSEQKLSRSQDKYLGQLSFDSTRMRNQIVATLSRLTVIASCIVPMQIITGLFRMNVMGT

SEQ ID NO: 27130 - protein, 97 aa, A.fumigatus
RRDSEQASSQSLPPSQQSNFGILGDSVDSKNKRRRGNLPKPVTDILRAWFHEHLDHPYPSEEDKQMFMTRTGLTISQVSFPAPFFSTPFTDDLRTAD

SEQ ID NO: 27131 - protein, 152 aa, A.fumigatus
HFCPAEDNMNVQLKDITVTARDGRVSHLDQVYIRGSHVKFFIVPDMLRYYIYTVNVVYVLTSAETHPCSVRAASAVEVLALLVVRRQCRGPGDNGGVDLLNFFFSLAFLSCGFRHSSFLMVPYLCGIEKCDSLKTGFGAMTVRYSSSTGTTD

SEQ ID NO: 27132 - protein, 69 aa, A.fumigatus
FNCSHTYALLVLFSLPYSTGLTIYQTAHTNSKSIEHFYLIKMLTCPILALRVQLQRFTRETNIHCLHVK

SEQ ID NO: 27133 - protein, 71 aa, A.fumigatus
LDTTKLNDLIGQFKFPELIGKKDLVSMAKEIEDDDGMPQFVDFISRMLRWRPEDRTTAEDLLSHAWLLASL

SEQ ID NO: 27134 - protein, 119 aa, A.fumigatus
DPLIDEQDLKSDNILLALRNPSILDSVAQDEMNNPSPRKQLDDRDIYLSRNYWGLSPAELGRSVITDFGLAVRGDGAPNSHPIQPEEYRAPEVCLGADWSYSADIWNLGVMVKTSLSLY

SEQ ID NO: 27135 - protein, 63 aa, A.fumigatus
LRDSVAGCLFGERYIAAGTSRILVEMLTYHSSILWDINCLRNIHTVDELYIRSITNAYIDSTP

SEQ ID NO: 27136 - protein, 115 aa, A.fumigatus
RIWLGVGSASFQLMTWLIPNVIGDAVSVAIVGLLLGPVYPCATAVFSKLLPKNIQISSLSFISAMGSSGGAVAPFFTGLLAHSVGTYVLHPICIGLYGVMLVGWALMPKVSNRSE

SEQ ID NO: 27137 - protein, 546 aa, A.fumigatus
  UNSURE (51): Identity of amino acid sequences at the above locations are unknown.
KEAKLTEQFPLIIVCDRFTFIHDLVLYLYQNQQYKSIEVYVQRVNPSRTPXVVGGLLDVDCDEAIIKNLLSTVEPSVIPIDELVSEVETRNRLKLLLPFLEATLATGNQQQAVYNALAKIYIDSNNNPEKFLKENDMYDTLTVGKYCEKRDPNLAYIAYRKGQNDLELINITNENAMYRAQARYLVERADPEIWSFVLSENNLHRRPLVDQVIATAVPESTEPDKVSVAVKAFLDADLPGELIELLEKIILEPSPFSDNGSLQNLLMLTAAKADKGRLMEYIHQLNEFSADEIAEMCISVGLYEEAFEIYKKVNNYIAAVNVLVENIVSIDRAQEFAERVELPDVWSKVAKAQLDGLRVSDSIESYIRANDPSNYLEVIEIATHAGKDEELVKYLKMARKTLREPAIDTALAFCYARLDQLPELEDFLRTTNVADVETSGDKAYAEGYHQAAKIFYTSISNWAKLATTLVHLEDYQAAVECARKANSVKVWKEVNQACVDKKEFRLAQICGLNLIVHAEELQDLVRQYERNGYFDELISGLEAGLG

SEQ ID NO: 27138 - protein, 149 aa, A.fumigatus
RCNVALTGERCVNTIGPTLGGGLGPLYGIRGPQVDSLVSARLVTASGDVITVSRSENRDLFWAIRGAGANFGIVTSATYRIYDQTNGGMAVSAQFAFAPAVNRSVFDLMESMNDEYPLGMSGGMILSYNHTTNEVTILLGSPLSFSSCP

SEQ ID NO: 27139 - protein, 121 aa, A.fumigatus
PSVQWNLLFMGSNEDAQPWLDKIQALGPIDSSIRNVPWHRRDEPEVPYCERGQHYILYNLNLRRTDAATLQSYFDSFVDFSSKNPWFDCDLMYERQATDAALAVPLSERGVGPWRDSKINA

SEQ ID NO: 27140 - protein, 128 aa, A.fumigatus
CYIATLVSCICLYMELKLSAGQKDVRVCTGLFPHGGQKVIKLGIFHPGSDGDHLIVKVQIDEVKQAQFDIYGILHIAKVQLYAVSATSCEKSYIVRGSSGNLIFSLSITGAASLASLVDVLTIAWIIL

SEQ ID NO: 27141 - protein, 60 aa, A.fumigatus
PVYLEGYFFKMCSQYFYKYDCGCTLPEGDVVYCAKRGTSCTGVRQQIRRREGYNCPAHGG

SEQ ID NO: 27142 - protein, 69 aa, A.fumigatus
LRQAGGRSNRKLRILFSFKALNSELGAKKMRHKLIVFFDGETQSPLPPRLVKLMYDFEIRSSTAHRLLI

SEQ ID NO: 27143 - protein, 169 aa, A.fumigatus
ISNALLTFARSAVQRSSYASLYRPHVQPLAQLNSQRRHQSQTIRADRPFRVAIVGSGPAGFYAAYRLLSKVEDAMVDMYEKLPVPFGLARYGVAPDHPEVKVRSMPLSTPSETMLIPFWQIELRGKVYRSGSISEVQLYRQHRTRHKSPSQSAETTLRRHSIRIRGAER

SEQ ID NO: 27144 - protein, 160 aa, A.fumigatus
NCEEKFTEVAASPRFNFIGNIELGTNLPLKALKPHYDAILFAYGAPKDKKLGIPGEDALRNVYSAREFVGWYNGLPEHRDLAPDLTAGEDAVIVGQGNVALDVARILLSDINTLRSTDIAEYAVEELVRSKIKRVRVVGRRGPLQVRWTSFPRYAMLICS

SEQ ID NO: 27145 - protein, 101 aa, A.fumigatus
AAFTIKELRELLQLPSVSFDPVPRDLFPPDEVISTLPRAQKRLMQLLAKGSPNDPNTASKSWSLDFLLSSGMPELVTCLSFPPLVRQVLPHRTGSEQSSHT

SEQ ID NO: 27146 - protein, 137 aa, A.fumigatus
ISFFPPECLNWSPVYPFRLSSVRFSRIELDPSNPHTPSAKITPKYLSSGKRAQVDIPANTFFRSVGYKSLPLPGLEDLGIQFDSDRGVLPNDGFGRITVPTTSGGNERLPDGSLISHLPGLHCAGWCLNAGDGSIRS

SEQ ID NO: 27147 - protein, 61 aa, A.fumigatus
LRKGRVKRSLTQAYINDIFASLLPSIGDLLSHQTNNSLYDRIKDGAQVGTNTSQQHIDRRQ

SEQ ID NO: 27148 - protein, 103 aa, A.fumigatus
TSGGKCGSTAVDRNFYKLMSDRFGDAFDRLPRKRKSPGSEFMRKFEIIKRDFGNSDEDTTFELPLNMTVDNPDPEFFDEEERLVLISRLGTLTDVDQCAADSC

SEQ ID NO: 27149 - protein, 235 aa, A.fumigatus
NVSLSFPLGTVPAANADDNSVLTTPTHAVQFFRNSHRHTKAVNNDSGWLFGEVLGVCVGLLSGTDWKRVRQQVEDGFSRPTAARYTGDLVFLAREYLQNTLLASSEQSLENKGIIHVEPAKTLQFYPFLSVAQILFGRLSPMQRTQLTTLAPLREELFKEVIRGGINRLSIAPWFKSRGVRLLNEFQTQWEQFVEDAYHAAVKRNQSPRPLVIGLWEAYQAGTISKREVSACPDT

SEQ ID NO: 27150 - protein, 83 aa, A.fumigatus
STLGCVDKSFILQISILLCMSDEYSVPWGGQFELFPLEHDTASRPTYLFSSPEPFLESNTYASRSSWRCILGGGGSINGRPYA

SEQ ID NO: 27151 - protein, 199 aa, A.fumigatus
IWYRIMRGSELILIPVGLPTSILGVLLYICLNASYTVAVFTDPGSPLTTGAGRHQYSALPVSELPEYTAYTVSSTGGSRYCKKCQCPKPDRAHHCSTCKRCVLKMDHHCPWLATCVGLYNYKAFLLFLIYTSLFCWVDFAVSATWIWTEVFNDAPYLETMLPVNVVLLAILGGIIGLVLTGFTAWHISARPHHVEEARR

SEQ ID NO: 27152 - protein, 69 aa, A.fumigatus
QSQCSNLFLNLSIRSRATTNCEIIMEYLVAIASVPECCQEIKYMDINKSAATTCISLKISVLDLETSSR

SEQ ID NO: 27153 - protein, 787 aa, A.fumigatus
  UNSURE (233),(237): Identity of amino acid sequences at the above locations are unknown.
NEVFTLSVWFLASGVMKEYPPTGAPATVNTRAILSGNIPGRGSSHKQIDRGQGCCVLIAACSGPACEPSSIMSRTSAGFADFFPTAPSVLQQKRVRAPRDRPCPKDRPEDQLHVQDDNGQSSCSPGASAANVSTNGSPPSVSVSETGTGVENSGCKLVGETNTDITGTDTSILSASLAQCRATQVNEARFDNLTPVTNAESSPPRKLSLHQSKSVEVAEYESNKFATDESKLXATPXHTPPTPRSQTSRSGVIKGCKLVYDPDLEKRSSKEKRRKPQYVDFVVNEQDGCSPDPRLSILNYTRGAGCKQKTKYRPAPYRLKQWPYDTATTIGPGPPVQIVVTGFDPLTPVAPINALFSSFGEISEINNRTDPITGRFLGVCSVKYKDSTSFRGAGPVPAATAARRAYVECKKEQRIGTRRIRVELDRDGAVSDRIVARAIESQRMGHKKNIVGEEAKVEPQAKKNEPPPTAPKGPSRSSTRPVAAVPEGPRASFLKPAIPSLIEETPILAQIKRDPYIFIAHCYVPVLSTTIPHLKKRLKLFDWKDIRCDKTGYYIIFENSRRGEEETERCFKVCHMKPLFTYIMNMESQPYGNPNYERSPSPERLQAERRERAERERLKKEADLDLEEEKKQRAIDLDPCREVLALIVRDLKDKLLEDVKSRIAAPTLYDYLDPDRHAARRRALGIPDPEGIRKHTFRLDADNFGSNNPRSFLPGDRSFSPYGLNILALPRIRKARRLKRANAAFLDEKRKQPVRRKEIRPLYHRMQQLHDVDDSDEEQRSPVLQGF

SEQ ID NO: 27154 - protein, 91 aa, A.fumigatus
GRPTCAGRPRAARAAMCPSQLVTALRHQAAAARGSPRPSRPANWRESMEVEIPRGPAVTGAPPRLRRKVSGPPSKRPALPGPLMGGVCQQI

SEQ ID NO: 27155 - protein, 193 aa, A.fumigatus
  UNSURE (168),(172): Identity of amino acid sequences at the above locations are unknown.
GREVGDRDVVHKDSVLVIDDVGMLALRQLPEPGPFHSRRGAPDLTRNGYTHQGRRYEAPGPPLPAHRLGEAHLRRQTARRPCGHVPQPTGHCPSSPGGGGARVPAAISAGQLARVHGGGDPEGTGRHRCPPASPEKGVWAPLQAPGAAGPVDGRCLPTNLAKDRADAXRLVXTRLLDRLHDPLGHFSRLQRIH

SEQ ID NO: 27156 - protein, 159 aa, A.fumigatus
  UNSURE (15),(18): Identity of amino acid sequences at the above locations are unknown.
SDQAGRVSGQVALLXRVXERQPDPWLDLLANTSHQRARQRRALGGGPRHLSPETRGGTGDGRSPRDLHLHGLSPVGRPRWPRGPARRRRLVTKGSDQLAGAHGRTGGARSAGAGGPPLAGVQVAVAQVLRSGDLDVYTHSASDRARLSWNEKGLAPEAA

SEQ ID NO: 27157 - protein, 207 aa, A.fumigatus
CWLQPCQPGQQQPKPLRCIITAHDPKSGKAVFSNAISEQVSFSGFPVPPGKPPATDYVLAYNTNELPVKGLSPPSSTNPASKADLDIKHYQSHLSQPSPLPPVNGTSCTIIEVPPGSAVPMHRTTTLDYAVIIDGTTELVLDSDEKKVLKKGDVIVQRGTAHAWRNVTEQSDNSGVLRIFFVFLPIEKVQVESGLIDMDLTLSLKQT

SEQ ID NO: 27158 - protein, 76 aa, A.fumigatus
TLIIDPRRVDKLECTALISLSIVRHGFLPSTTMSEEKPLNAAKDQDKDDIVYPTGLKLALLMTSIFIGMFLVSLVW

SEQ ID NO: 27159 - protein, 226 aa, A.fumigatus
PLQDRLIISPAIPQITDEFHSAGDIGWYGTAYLLTNCAFQLLFGKVYTVFSIKATFMTSIVLFEVGSALCGAAPNSIGFILGRAIAGLGSGGIFAGALTVIVYALPLHKRPKYQGAFGAVFGVASVAGPLVGGAFTTNVTWRWCFYINLPLGAVVIATTLLFFEIPDHQNAPKPLKGKLRQLNGLGVLTIMPGVVCLCLALQWGGSQYAVRSHSSLALFTTGIDCV

SEQ ID NO: 27160 - protein, 75 aa, A.fumigatus
WGEGRIVALLVLTFLCLIAFVLIQVWKPEQATLPPRVFLQRSIASGFWASCCFGAHMIVFGESAGFQPPLMGSAC

SEQ ID NO: 27161 - protein, 63 aa, A.fumigatus
IQCRWIGISALRPCWTTATRRNKTTDDMNLTGNSGVVRAQFRHNLPPKSFGATVRVMLYPSNI

SEQ ID NO: 27162 - protein, 185 aa, A.fumigatus
MRFPSSRAVKTNSCGSMSLLDFWDTLRPPVKRRKTTPKEGQESPRTVALRKEGSRIKENEIDSSDSPSDTWDSLPSAQVGDFAVEDESLVPNSQTELESSLPDIPTDQQAIAEYETSHVVGQDDEPNLRQRLQDGKWRKGKTSIYVDAFNLALETVLDEEAHLFNEAELEVFEQWKGLSYESQYL

SEQ ID NO: 27163 - protein, 69 aa, A.fumigatus
QVGDFQRLRTPQQAGYKWAPKSLLNFRTPQLTCPDEKKTAPLEKDNGPVRPSGFVIGAIMGLCLLKTCP

SEQ ID NO: 27164 - protein, 227 aa, A.fumigatus
NEGVPAGDKDRKRKAIRNMRHVYSNAKAVLVLDKFIQKIPSTAPALDKVARLYLSNWTKRLWTHQEGFLPSLVYIQFSDRPVELRALAEEFMTYNREHLEKSGKYLGFPFAANLRLLDLYSALRGLMKLVKEKWMLYEPLAHHLSPRRSTRLADETVCMATIIDIDLDRIQAISCDDDEGVAEERMAAFLEQFGTFDRSVIFNDYERLNKRDTSGLPNPCSTFGLLN

SEQ ID NO: 27165 - protein, 97 aa, A.fumigatus
SLVPTLWSAMACVCNAVCSWRTARSRTMLGSSRLLSVGTAPLASGLAWRMSRSWVTMSPLLTRCMSMAALFCPTRASSRTSMVCYHSRYTNVMNCEN

SEQ ID NO: 27166 - protein, 235 aa, A.fumigatus
QTIPFALIVSSKKPVEFGGNRNYRRDSTSSPLVFSSALSCVLPPSNRGHSPAICSDGQSHSFDLEGFWMDVGQPKIFLTGTCLYLTSLAKRNSKLLAPNSEPYVYGGNVMVDPSAKIGKNCRIGPNVVIGPNVVVGDGVRLQRCVLLENSKVKDHAWIKSTIVGWNSSVGKWARLENVTVLGDDVTIADEVYVNGGSILPHKSIKQNIDGMLPLALYERHELRELTHCIVPAIIM

SEQ ID NO: 27167 - protein, 222 aa, A.fumigatus
  UNSURE (161): Identity of amino acid sequences at the above locations are unknown.
VRDKPCAGERADLYLSTGVFHRVSRLARYSGLWLILDSYHGDRGHPYPSSDDGLLGSCTGMLSCTAVSSCKNVGELLPLAVEIVRLTIHLGLCVMRVREMVDSTESSSGSWSILVSEINEADATSLIGDFVKKRVSTVYDHWKKNIDNTREFPPRRNRTSXRLDRKVSPSVHHPKFSTTLSKKVFRRSTNTSRLLESVVRTTRPICTMTEKFAISSASAPRT

SEQ ID NO: 27168 - protein, 139 aa, A.fumigatus
VALKDSSFQSGLLFSSALYQKTPCAAVQDNHYSLQSRPRKPLAMEDLHRLYLFGDQTISCDEGLRNLLQAKNHTIVASFIERCFHALRQEITRLPPSQRTLFPRFTSIADLLAQHRESGTNPALGSALTCIYQLGCFIE

SEQ ID NO: 27169 - protein, 396 aa, A.fumigatus
  UNSURE (14): Identity of amino acid sequences at the above locations are unknown.
QYQGIPPSSQPYIXAVGSKGLTISAPPEILDNFIEEGLPKEYKHFKAPGVSGPYHAPHLYNDREIRNILSFCSEDVILRHTPRVPLVSSNTGKLVQVKSMRDLLKVALEEILLRKICWDKVTESCLSIVQATNDKPWRILPIASNATQGLVTALQRMGNCQIEVDTGVGAPQMDPAAPNATGNASRSKIAIIGMSGRFPEADGIEAFWDLLYKGLDVHKKVPPERWDVDAHVDLTGTKRNTSKVPYGCWINEPGLFDARFFNMSPREALQADPAQRLALLSAYEALEMAGFVPNSSPSTQRDRVGIFMGMTSDDYREINSGQDIDTYFIPGGNRAFTPGRINYYFKFSGPSVSVDTACSSSLAAIHLACNAIWRNDCDTAISGGLHHGAGRSTVVI

SEQ ID NO: 27170 - protein, 196 aa, A.fumigatus
KGEITDPPTAETNPAVYGPGGTDVPFESVDFTGSGLFCAQCVRNQHLFTSALASYFPSPEDPNYSAYEREYPSFRRNLEERYPQVCANCEPRVKERIRQAGYEAKSDHLRRMMDRSKAGRAARHARRWNWRNLLVSAGAMGYWGSVAGQLSWDTLGALSADHHLRDMYNDLSPPSIAFCARADITETANYQVLCLG

SEQ ID NO: 27171 - protein, 146 aa, A.fumigatus
TAAPKATASSGLIPLEAFLPPKNSSRRAWTLGIRVEPPTRTMSLTSDFLTLASLSTCSTGFRVFLNRSMLSSSNLARVRVSEKSSPLWKDSISMRVDIWEDRVRLAFSTSRLSLPMALMSLETSTLCFLLYCLTMYSITRWSKSSP

SEQ ID NO: 27172 - protein, 228 aa, A.fumigatus
GIMYWASNHTSRRLWRISKGKSIMNQLTYQNSVNPSKVILQFVMSAGLILLIRWCRAIQLASDGVGHIGQLLLLLLKVLGGGSGGVVLQPVGHLLDSIQDGLLVILIDLATKPVLVVDLVLQAEGIVLERVASLNLGLDGLVLLGEFLGLRDHAVDLLLGQTTLVVCNGDGLGLAGTLVAGANLQDTVGIQVEGDLNLRHATRSGRDTRQLELSEEIVVLGQRTFSLI

SEQ ID NO: 27173 - protein, 260 aa, A.fumigatus
  UNSURE (64): Identity of amino acid sequences at the above locations are unknown.
GTPRGAGGIPVNSNFPRRLLSLVRERSPSSEISQYISISSIKYNGKTLTNLDQDGGLVVSGGRXDLRLAGRNDGVAGNELGHDTTGGLNTQGKRVDVHENDIAGTFLTREDTTLNGSTESDSLIGVDTLGGLLAAKELFEESLDLGNTSGTTDQNNVVDIRLLDLGVLEHLLDRLQSLLEQIHVEFFELGASESLREVLAVVEGFDFNASGHLGRQSTLGLLDFALELTHGLDVLGDINVVLLVVLLDDVFHNAVVKVLT

SEQ ID NO: 27174 - protein, 220 aa, A.fumigatus
  UNSURE (197): Identity of amino acid sequences at the above locations are unknown.
GEDFDHRVMEYIVKQYNKKHNVDVSKDIKAMGKLKREVEKAKRTLSSQMSTRIEIESFHNGEDFSETLTRAKFEELNMDLFKKTLKPVEQVLKDAKVKKSDVNDIVLVGGSTRIPKVQALLEEFFGGKKASKGINPDEAVAFGAAVQGGVLSGEEGTGDVVLMDVNPLTLGIETTGGVMTKLIPRNTVIPTRKSQIXSTAADNQPTVLIQVCKCFAIVLD

SEQ ID NO: 27175 - protein, 191 aa, A.fumigatus
LISDEGERSLTKDNNLLGKFELTGIPPAPRGVPQIEVSFDLDANGILKVSASDKGTGKAESITITNDKGRLSQEEIDRMVAEAEEFAEEDKAIKAKIEARNSLENYAFSLKNQVNDENGLGGQIDEDDKQTILDAVKEVTDWLEDNAATATTEDFEEQKEQLSNVAYPITSKLYGSAPADEEDEPSGHDEL

SEQ ID NO: 27176 - protein, 90 aa, A.fumigatus
  UNSURE (13): Identity of amino acid sequences at the above locations are unknown.
ESGNSEDRPEQRXQAVFSEDYFQQIIRFLTALARLPVFKSFSLRDYYSQPVRHEYVSAENSVTNNWDDETDPVYPLPAANCGLNSVVVDG

SEQ ID NO: 27177 - protein, 79 aa, A.fumigatus
LGLESVRLGFTGNVENGPETTPLCGGLPRVFPVIEALLFGQAEETAGPCRLRDRDFSPEDGSIAERGSAAGRRRFRPRR

SEQ ID NO: 27178 - protein, 179 aa, A.fumigatus
GSTVGAGALITMPPSTVFSYWRREHRRASAPPVSSSGQVSSRGKSNGNRPQLPVIQHTPILATTVEESSPCPDTLTPLTSSEYSPADGDTDKGLGVGSTVSTDAPSSAATNLAVPSSTSDKQARPHSSPEDREKNLDLTAQPNSSQVSITASRPEYGDSDSSKPNSPCLTRPGLEKVRA

SEQ ID NO: 27179 - protein, 97 aa, A.fumigatus
LSHSRTAIMGNETVVPSENELKNFNPGNPDVVELIRYAQESDAADRLLTVRQALSKYKKAVFWAMFLSTSLIMEGYDLVIVSTSLLTRERVITKSKV

SEQ ID NO: 27180 - protein, 110 aa, A.fumigatus
QITSFYGQSQFIERFGEFSDKAGKKVITAAWQSGLSNSSMVGQLTGLLLNAYSQDRFGCRPTMMFFMAWMALMIFIPVFAPSLPILAWGEAMCGVSWGVFQVRLSALLHA

SEQ ID NO: 27181 - protein, 153 aa, A.fumigatus
TLSTTYASEVVPTVLRPYVTAYVCMCWGAGILLSSGVVRAVAGIDGDLGWRLPFVLQWVWPIPLFIGAYLAPESPWNAVRRGKVDLARKSLRRLRQDTPDKEREVEATLAYIQHTTKLEQAETENASFLECFKGTNLRRTEIVHSLITMSNGA

SEQ ID NO: 27182 - protein, 62 aa, A.fumigatus
NCVVWAAQTLSGNAILGYSVVFLEAAGFTELQAFDVNISLSACYIVGGVMSSPRGWKVRQCQ

SEQ ID NO: 27183 - protein, 131 aa, A.fumigatus
EISTGIIRLFLLTRLGCLHQHPPTLAPPRRPRHLWRSRHRPVPLGRNANGADRFRRPQHALLLRSSGRLGNPDSIPRRTSPRWPQLHHPHGASAAARPAHLHNNTELQPGQQRRQEAPRARHAQTESRRPC

SEQ ID NO: 27184 - protein, 67 aa, A.fumigatus
VCPGSILIKNGKGAINKTELADNNTMIRTAESTLNGPISDANRHLKSAHPSDGDASAFTNSGVSCSA

SEQ ID NO: 27185 - protein, 166 aa, A.fumigatus
DVFTNTRPLWHPPGARGIFGGAAIAQSLSAAMRTVPTDFAVHSMHCYFVLAGDSEIPILYHVERVRDGRSFITRTVQARQRGRPIFTTTLSFSRANSGGKKRLEHATPKPSLADPAEGTRRSLEDIRGPFETHMAGTVNRKQNCLHSPAHEQLGLGTIREVLRSDT

SEQ ID NO: 27186 - protein, 262 aa, A.fumigatus
TQAIRPIPRTSACDGSLARGAASPRQGATRRTSPRLAYITDSYFIGTVARVQNIPRFSSPAELRRALQALKNPSDLDDEDIARAIKELKEEEAADLRRRLEGALSQATNQPKEDRKEVGMMVSLDHSIYFHNPWAFRADEWMLMEMESPWAGEGRGLAIQKIWSRDGTLIATCTQEVRLRFHSLSRTLRFGLLPARKRPLTLVRVFLGSGAIKTGRACSCEDLAVTGLDLFPFLFFFSLFAIYYILIDSTDTLASFASVYSC

SEQ ID NO: 27187 - protein, 281 aa, A.fumigatus
DTTGPETSLPGLPELTSRNQKLRGADMSSSPDEEPAGVSGFENESPAAHTSQGMKPEEPLEPEAHQPIPIPPQQPRSPTPPTPPPVRDSSPIRVAVPVGRGEVADAHDEQYSPPPVMPTQSLRQAVPDDERLEDTTIDIGREASKSTAFHRPQDEALQAIVQYDYEKAEDNEIDLKEGEYVSDIEMVDKDWWLGSNSRGERGLFPSNYVELVKDNQKHLASVAGAEDPKEIPPAASIHSPGGGKGTSQPTAMALYDYEAAEDNELSFPEGAQIVNIVSGTC

SEQ ID NO: 27188 - protein, 63 aa, A.fumigatus
VGHVEILFAFSSSFSFSLLLARQSSQTTVSLTRHQEFPDDDWWFGEYKGQKGLFPANYVQLEE

SEQ ID NO: 27189 - protein, 220 aa, A.fumigatus
SYEPQIAAVLCFLAWFYPVGLYRNAEYTDSVHSRSTLVFLIIWATFLFASSFAHLLIAGVESAELASALANIMGIMMYAFCGILAGPHALPGFWIFMYRVNPFTYLVSGLLSASLGDAPMHCAANEFLAFSPPANRTCGEYMEDYMALAGGYLLDSAARGDEQCQYCRVDNTSQYLRNFSIDFATRWRDFGLLWVYVAVNTFGAVFLYWLCRVPKGKKRL

SEQ ID NO: 27190 - protein, 157 aa, A.fumigatus
QHRPGTTEPGVWCLCLPLRRHPTHLPDHSNICHPANFIRVSRAPVQDLLLASLRSLQYRRGVCMEHGKSLEGRYAQTQTRTNHMSLRSRQFSVSWPGSTPSASTATPNTPTASIPEAPSSSSSSGPPSSSPAPLRISSSPASRAPSSPPRSQTSWAS

SEQ ID NO: 27191 - protein, 241 aa, A.fumigatus
WTLSSIPPVKTDRLHGRDYADAIVGVPGEGLNVEQRKRLTIGVELAARPKLLLFLDEPTSGLDSQTSWSICNLMETLTRNGQAILCTIHQPSAMLFQRFDRLLLLAKGGKTVYFGEIGSGARTLMDYFVRNGGPPCPKGANPAEHMLEVIGAAPGAHTDIDWPAVWRNSPEYQQVRQELSRVRQLASQPSSVHSDDPSSYSEFAAPFPAQVGQVGRRVFQQYWRTPSYLYSKAILTVGSVS

SEQ ID NO: 27192 - protein, 87 aa, A.fumigatus
PLRKLQSIFIGFSFFKGDNTAQGLQNQVFGVFVFLFVVIQLIFQIIPTFVTQRTLYESRERQSKTYSWQAFVLSNIAVEFAWNTVSR

SEQ ID NO: 27193 - protein, 156 aa, A.fumigatus
  UNSURE (135): Identity of amino acid sequences at the above locations are unknown.
PLFLPCRGESGVGRWTVIVKDTNVNEFTGEFIDWRLNLWGEAIDGANQKPHPFPDEHDDDHSIEDAIVATTSVETGPTKTGVPGSTDDTINRPVNAKPVETQTPSPAETTATKLAPPAETRPAATATSSPTPPGXVPTSFLAKLPCPPSGASQKKP

SEQ ID NO: 27194 - protein, 239 aa, A.fumigatus
RHFDGYTNSIYSITVGAIDREGNHPSYSESCSAQLVVAYSSGSGDAIHTTDVGTDKCYSFHGGTSAAGPLAAGTVALALSARPELTWRDAQYLMVETAVPIHEDDGSWQVTKAGRKFSHDWGYGKVDAYALVQKAKTWELVKPQAWFHSPWLRVQHKVPQGDQGLASSYEVTEQMMKNANIARLEHVTVTMNVNHTRRGDLSVELRSPEGIVSHLSTTRKSDNEKAGYVDWTFMTVAHW

SEQ ID NO: 27195 - protein, 228 aa, A.fumigatus
RHRLIAMLNGTSVAAAEKDGSRFVNFILPSYDYYNLASGHAGHLPEFVEDHVDAGFVHLVCFPCAPGQPCEYDLTDPHCAYTEPYFSLVPEMPMNKQYDYKYLPDVDGNSFSGRYRGFLLSTSLPIKATIYDEWHDSRLIPWAHFVPMDSTFLDIYGIMEYFIGYRGSGHDHAARKIALNGKKWAEKVLRPEDMQIYMYRLLLEYARICDDRRDNLGYTEDMLWVRRG

SEQ ID NO: 27196 - protein, 68 aa, A.fumigatus
SGSRLGRSLVILRLQCPWCPSQIIIVRDTAAHSSSLNYNNNNSATILAGQLAFFYLSVFLLSPTLLQD

SEQ ID NO: 27197 - protein, 89 aa, A.fumigatus
RLITTRFCADTHQSPDALLRKLKPADVKSWFDWIEDNFSGSIKAHGTLSNYWMTLKRLYFMKNKKDMSRSMINDCINVRFILLSARSGL

SEQ ID NO: 27198 - protein, 209 aa, A.fumigatus
YMNEVSKRMRLRKLPLPKDTENSLDLLSYQTAHLVHCKAVFPDEKQRLYHMATLNLSSVTACRAVSLFDTRCQVDLHPDGSPVIPGKIEAGSNGALNSPTPEQSGEAHCDSGYESSRSGRLNVDEDDMLDEISSDGSSDDIMSDIGYVSDCSSVVTDDGYLAGDDQTGTILWRHVEFCIARNPEPGRPNILFAIVTLIHTKGEDRKPRM

SEQ ID NO: 27199 - protein, 84 aa, A.fumigatus
SDASQLYNTIENVKLTANGQSYSTGPIEAVQLVHYRNLTGDGAWVFNESADAILAARLDPIPIDSTEHEASEFTVTGELPQLHN

SEQ ID NO: 27200 - protein, 495 aa, A.fumigatus
  UNSURE (14),(34): Identity of amino acid sequences at the above locations are unknown.
NLGKLEALTPRINXRYEHYVQLMRERQARTSHQXTTSSKQVQPYDPALAGVVEPLEAGKNRDLAVQLARTEISRRATVRKALRQAGVPQEEEQSRRTAGVWNNWEIATDKDGPGMDNDLSRRIQNVRLNIDQQTHANARPQQLKPAEPSTSTYSYPSVPRTKPLEPLPSASTNVSRDETSWRLEVPLPPPKERFGSSSSVIYRGSDPRHYCPTKVSSTPAPAVPEKGQPLAAGGNSRPDLNPSSFTFKPSAYLENGTPLRTVWLPPDLRTHFLAIAGPNTRRNLETCGILCGTLISNALFVSRLLIPEQTATSDTCETVNESAIFDYCDSEDLMVLGWIHTHPTQTCFMSSRDLHTHCGYQVMLPESIAIVCAPSKSPDWGVFRLTDPPGLKTVLNCTQSGLFHPHAEANIYTDALRPGHVYEAKGLEFETVDLRPKGSRGLMIDVGCCDVLCMIWLAIRIPSPAMCCLFSALESLLSSAYITYFTARCHCLLLP

SEQ ID NO: 27201 - protein, 86 aa, A.fumigatus
SSMYACMLSHSLYTKSYITYIFHPTWPVVSTHPLIPAKSCFEIGTEKERGSAIESAAARQNMRYTDAFARGWAFAEVASPYGSPEQ

SEQ ID NO: 27202 - protein, 440 aa, A.fumigatus
GYRTLLSCLVVPESSSALFSSPTEEGRNHSRVKTKPSQLLQRRSVQHPTCFSFLIVIIVSMPKKHHKHSFVKPVSPAHHTLLPSGPRNQNERYHASQPSSSSTSTPSVNDLINHLRRTQVSRSPEDGAGSPTRVVAPRSVHPSLRNLLELPETPPPRPRPEARRVGVTGRLLRRTPGPPPPQSWLLGSHDKDTSDEDLNSTNAARVERIIYRLDRLPGTTFPRKSDLLHMVLKSMASQWAWHIEYDGQFLAVLPSHVKILLLSYIAIYAGDQPLKGLMHGLKPLFEKFSTDDHESGDAGDLTEDGDSEILRLDLSSALGRWMTIKQLSHELLVSNKSGANLVQGNAKEPVPSSWEEIDDEEVDTADESPNMPIPKALSQGLRFQNLRFLSLAHPKPAAANWNALVDLLSRLSTITHLSLAHWPLPTVTPNAMSARIKHPA

SEQ ID NO: 27203 - protein, 72 aa, A.fumigatus
LIFHFALSLRAFFNPCLSETVFGVFIGEASSPPYLQDKIPDLLGNLLSQFDRLFVVQQFIAEHPEGKVARLR

SEQ ID NO: 27204 - protein, 344 aa, A.fumigatus
YLTCVTLWQFLDFVLSSIETGRPGSIRSSSSVRNAAPPVLVSNVGSRAYKPTNGLGSNATGQGNVAAGVKRKAEDQLRRPQKPESEASAKPSAGKPVNASITSKSRPVAASSSAKSTHGNTATAAQKPPQISSKPPPKGSYADLMMKAKELQTKAPAQVGMFKHQPVAKEKLSKAERKRRALEAQIKEKESRLAKKPGTVSGRATGTKSGDGKLARKREHEELTYKGTARPSQTPTQLEYRGTAGLPSRRSSQEPKAQSRASKRARMNEYLATDEEDEGDDYDEYYSASSDMEAGYDDVEEEEAAALAAAKKEDEEELRAELAAKQEKLERRKKLAALAAKSRS

SEQ ID NO: 27205 - protein, 95 aa, A.fumigatus
QGFHRFKMKHLAAYLLLALAGNTSPSSEDVKAVLSSVGIDADEERLNKLIAELEGKDLQEVSNYSSKITDWEFWTGADIERFLPQGWQGSANLAS

SEQ ID NO: 27206 - protein, 91 aa, A.fumigatus
EDLQKAAALLRERNDELARLETLDSGKGYSETSTVDIVTGADVLEYYANLVGGGGLNGETTQLREDAWVFTKKAPLGVCVGIGAWNYPLQM

SEQ ID NO: 27207 - protein, 339 aa, A.fumigatus
HSALWKSAPCLAAGNTMVYKPSEYTPLHAQMLAEIYREAGLPPGVFNVVYGAGDVGAYLTAHPLVAKVSFTGQVSTGMKVAGSAAGQMKYVTMELGGKSPLLILPDADLENAVNGAMMANFFSTGQVCTNGTRVFVPRGMKSAFEKALLDKMQYIRPGPLFDNATNFGPLSSALHLEKVTSYIRHGIETDKATLLYGGLGKPSLPKDLENGFWVRPTVFTDCTDSMRIVQEEIFGPVMSILYYDTVEEAVRRANNTELGLAAGVFTRDLNMAHRIIDQLQAGITWINSWGESPAEMAVGGWKKSGVGVENVRRGIEAWVRNKSTLVDMNGRVATVFAKL

SEQ ID NO: 27208 - protein, 143 aa, A.fumigatus
HDRAKNLFLDNPHGVGAVREDSRPYPEPILQILWKGGLSQPAIEERCLVRLNAMTNVRGYLFEVKSRTQGSEVRCVVKQRPGTDILHLVQKSLFKGRLHASRDEHSSPISTHLACTKKIGHHGPIYCIFKVRIREDEQWALAS

SEQ ID NO: 27209 - protein, 112 aa, A.fumigatus
RAELKGPKFVALSNNGPGRIYCILSRRAFSKADFMPLGTNTRVPLVHTWPVLKKLAIMAPFTAFSRSASGRMSNGLLPPSSIVTYFICPAAEPATFIPVDTCPVKLTLATRG

SEQ ID NO: 27210 - protein, 464 aa, A.fumigatus
HCGKTSDAYDPKAIESGRYEWWEERDLFKPEFGPDGKVKPEGYFVIPIPPPNVTGSLHMGHALTNALQDTMIRWERMKGKTTLWLPGMDHAGISTQSVVEKMLWKKEKKTRHDLGREEFTKRVWAWKDEYHANIKNALRRVGGSFDWSREAFTMDPNLSAAVTETFVRLHEEGIIYRANRLVNWCVALNTSLSNLEVENKEVEGRTLLDVPGYDKKIEFGVLTHFCYEIDGTKERIEIATTRPETMIGDTGIAVHPDDKRYQHLIGKFARHPFVDRLMPIVADTDVDPEFGTGAVKITPAHDFNDFNRGKAHNLEFISVLNDDGTFNKNGGPFVGMKRFDARYKVIEMLKEKGLYVKWENNPMKIPRCAKSNDVIEPILKPQWWMKMQDLAEPAIKAVENGEIVIKPESAEKNYFRWMRSINDWCLSRQLWWGHQAPAYFVKIEGEDRDDSDGNLWGYRAFRKN

SEQ ID NO: 27211 - protein, 369 aa, A.fumigatus
KTPVIDTSHPPEVVLLSGFGFDDDLTILNSLDGRLSEILHLHPPLGLQNRLNNIIRLGTARNLHGVILPFHVQSLLLQHLNDLVTGIETLHANEWATILVKGTIIVQNGYELEVVGLSTVEIVEIVGRGDLHRTSTEFRIDIRIGNDGHQAVDEGMTGELANKVLVALVIRVHGNTCVTDHGFWTGRSDLDSLLGAINLITEVGQDTKFDLLVVTRYVKQCTSFNLLVLDLEIGQRGIQGHTPVDKAVGAVDDAFFVEPYESLGDGSRQVGIHGESLTRPIERTTDSPQSILDVRMVLVLPSPHSLRELLTSKIVAGLLFLLPEHLLDNTLSGDTGVIHTREPESGLSLHPLPTNHSILKGIGKSVAHV

SEQ ID NO: 27212 - protein, 92 aa, A.fumigatus
HPLPSSPAVKTVLIENMREWNNQEIDYGYTVTGVDVDSQLAADPQAYPVKVTAEKNWKTEMFEAKYALVCHSQSLILVIRLSLTSLGLRWCS

SEQ ID NO: 27213 - protein, 68 aa, A.fumigatus
IGDYLCSTEGPIQTFRPKGGDIDSLIEPILVAHGNRHAVELEQIPECFYPVTGKHQIRGGSPNLKNSS

SEQ ID NO: 27214 - protein, 308 aa, A.fumigatus
  UNSURE (137): Identity of amino acid sequences at the above locations are unknown.
ACDGAHSTVRKALGYNMIGDSTDAVWGVMDMIPRTNFPDIRKKTTIRSKAGNLLIIPRESGSLARFYIELPAGTKPKEVKLENLQQTAKSILSQYAIEFVETVWWSAYSIGQRHADFFHKDYRVFLAGDACHTHSPXAGQGMNVNLQDGYNIGWKLATVLKGLASPSLLETYVLERQKVAIDLINFDRYFSKLFSSGGQTSPAEFQEGFIKAGKYTAGMTARYDQSPITFHVNESDKLSTNVVVGMRLPSAQVVRFSDSKPMQLAQSLKSDGRWRVMVFIGDISSAETKTKLKAVGGARLSDALDESC

SEQ ID NO: 27215 - protein, 238 aa, A.fumigatus
IWIGAAPSSPVVKTYMLLQSDKTLPPPLADRPDFEKLFHQARANAKPNEWFAIPEQTLSIGFDDTDEQSLPDVSFGWDNEKPQRTITVRAFEAQAHAITNGEYAKYLQATRQRRRPESWVLTHSDENYPISKGVTLESSQATKDFMDNFAVRTVFGPVPLEFAQDWPVMASYDELALYAEWVGCRLPTYEEVKSIYNYSAQLKETRQHEPSDHERFVNSPRSLSLAMSDRRQQRCEGH

SEQ ID NO: 27216 - protein, 121 aa, A.fumigatus
LCLTEGSNGVKGINRDMVTNGHSKVHQDKPRTPERQPIQPPSQSTMPVFVDLHGCNVGFKHWHPTPVIQNGDRLAGHGELGGVWEWTSTPLTPHDGFKAMDIYPGYTGKLLTYLVDFYKPN

SEQ ID NO: 27217 - protein, 64 aa, A.fumigatus
SSLTKSLHPFAIVSNSSFVAYPSSTAIFENPLDLILASIDPPQYFLSSGLLKHHAPALFLILVP

SEQ ID NO: 27218 - protein, 219 aa, A.fumigatus
LRSEIARVLPQGHVTAIEYVADPLDAARSLASAHGLTNIDFRVGDIHSLDFPDDTFDIVHVHQVLQHIADPVRALREMRRVAKIDGGIVAARESASMTWYPDNSGIAGWKEVTDRMCKAKGSNPHPGRYIHVWAEEAGFQGTRIKKSAGAWCFSSPEERKYWGGSMEARMRSSGFSKMAVEEGYATKEELETIANGWRDFVKDDQAWFGLLHGEILCWK

SEQ ID NO: 27219 - protein, 276 aa, A.fumigatus
TCDSSGFCLRSNRIRQLSHSFKMIKPSILGALALLSCALPSNATQIFRNTGTLAGWDSVNHEHSGTVQQVSNVVYEGSTALKMTQVYDASYTGRYHSEVVKNNVYKRGDTGFYGFAFRLQEDWQFSPAQSYNIAQFIADFSDTGCDDYMPSSMVWLVGNQLYSRVKQGSVCAQKTKTFSNLATVTAGVWHKVIIQASWKSDGTGFYKMWFDGVKVLDQHDIATTVDDNRPFQFRVGLYANGWHDDKGMKGTQGTRQIWYDEIAAGTTFADADPAQW

SEQ ID NO: 27220 - protein, 104 aa, A.fumigatus
LFSQSIFWKILIMVSNTTDPSDYCTLDTCPLSLANFNYVPNLAGNLLYLALFGTMLVANLGLGIYYRTWGYLVGMIGGLALEVIGYVGRIQLHYNPFPFSPFLQ

SEQ ID NO: 27221 - protein, 384 aa, A.fumigatus
TRLTFSPFFQAIHADIAFTLAKYLYSSIMPNSTDAPAINVKNMQVQHGLVARKDRSRPQLIQIRGIADVTRGLVSLSWHLVDEQGRRVEESFATAVAEFGNHEAWLEEWSPMTHLVVSRIDVLQRLADEGTANRLSRDMVYMLFNNLVDYAEKYRGMQMVVLHGLEAMANVTLAAPEQSGGKWTVAPHYIDSVVHLAGFILNGGNGLDPRRNFYVTPGWKSMRFARPLVHGVRYQSYVKMMPIREQSGFYAGDVYILHEGQIVGLVGGITFRTFPRSLINTFFSPPDTMTHGGSQAGSVHQPACSERTLPVAPARQDSAARETLCQGHGLSRTVMDSSDSSPATTLTPPTLPSVAASTESPIVHRAMALIAAETASSAGARGLI

SEQ ID NO: 27222 - protein, 349 aa, A.fumigatus
RQCTRAPHAMLAVCATVEQIRNVLAGQPYEVACINGSSDITLRCSVADIINLQLAIEQHGYKCTRLDVPYAFHSAQMDPLLGPFEHIARGVTFKAPNIPVMSPSLGDCVFDGKTINASYMCNVTRNPVKFVDALETARGMDLVDAKTVWVEIGPHASYSRFVGSAMPPGTATIASLNRNEDNWSTFARSMAQLHNLGVDLNWHEWHAPFESELRLLTDLPAYQWNMKNYWIQYNGDWMLRKDGKSSAAAAASHPHQAIPPALRTSLVHRLVCESVQETRVEVIVESDILHPDFFEAMNGHRMNGCAVATTVIQTESPFLNPTDFFSVFPGDPCRHCFYLGQVPLLEHHA

SEQ ID NO: 27223 - protein, 446 aa, A.fumigatus
LPLANATALANSIISLQELPLFVPPQVPLTTSTSSISPQRRSVGQEGAISPFARPNQRPYNQQQPLPSPQSYGHTEQTYTMSSAQNPMYATPAMPDHGHRLRDRATAQSSGQHNNAAGRYNGPGVLPTPDPTIASCISDEDVAMQLIRLGDASNFSHGRTSASTLDDAFSGAADAASSTGATSDGEDYSEDDDDLPARSRQKLDSSPMLPPGTTKRTHKRLDDILPSFDSSDGSYDGMDEDYQHEELNDSLLKSELDEYSLYRESTPKPKKAKTRPTSTASTKPRVSKTDPPRQGKSGKASSTAVARKVKSTTTVVSQNAAPLSQIVTPTPARKASTSSVNGQTQLAADEEDLSTKPRCQRCRKSKKGCDRQRPCGRCKDAGIGLEGCISEDEGNGRKGRYGRHMGVPVKKALDATSPASNESQLISTMPMPSSSAIADKNKKRKR

SEQ ID NO: 27224 - protein, 385 aa, A.fumigatus
NQGGPGILQRSRARHRYIMQLCRALMRYGAHTHRLEEYMTMTARVLEVEGQFLYLPGCMIMSFDDPVTRTAEVKLVRSTQGVDLGRLAETHNVYKNVVHDLIGVEEAIQELDEIMKRKPRFNKWILVPVYGLAGAAVGPFAFDARPIDMPIIFILGSLVGLMQHVISPRSTLYSNVFEVTAAVLTSFLARAFGSIRITVDGQKQSLFCFSALAQSSIALILPGFMVLCSSLELQSHQMIAGSIRMVFAIIYSLFLGYGITVGTTVYGLIDGNATSETTCRDLSIYGSKYIQHFIFVPIFVICLAVINQAKWKQVPVMIFIATCGYITNYFSTTKLGSRSEVANTVGAFTLGTLGNLYSRLWHGHAATAIRPGTIGPQFPGPKGPR

SEQ ID NO: 27225 - protein, 61 aa, A.fumigatus
  UNSURE (58): Identity of amino acid sequences at the above locations are unknown.
MAVTPKRVHTNHTHLFADVGWGLCCIPTIQPRHLSEPCTSPITTNQVFTSEVPETSNXNHP

SEQ ID NO: 27226 - protein, 79 aa, A.fumigatus
RIDILLATQFIILANLHPTFNVRHDVFISLHMEITFFLLEGMLNFLVTFRCFLGLSRFELQPTGTARGYLQETTLSSKN

SEQ ID NO: 27227 - protein, 143 aa, A.fumigatus
  UNSURE (131): Identity of amino acid sequences at the above locations are unknown.
PRMAQPPSKVCVDNLRLACVITNDLRRRWDVPVNYTDLYEIAPTQTRTIVRFTREGLEGRVTGYHEVTVPAAAAHAKNSTSLLRRPAGRADFVRGAAGFFPFAPGGLDGVEAIAEMESEAQAAERSKTGGXQSGLDRIINFWS

SEQ ID NO: 27228 - protein, 228 aa, A.fumigatus
  UNSURE (38): Identity of amino acid sequences at the above locations are unknown.
EARQDSSHLRRADSTVLRLLLKWNLKHRLRNAQKPVAXSPASTALSIFGAEGGLLEIAPGCSRGLQFEATKTKETAEGDEEVEHALQQEESDLHVERDEDVMSDVEGGVKIGEDDELSGEEDIDSLLPVEFPALEPRAPLLSGVKQRQGGKEWAHVVDVNKHISNFHELVPDMAREWPFELDTFQKEAVYHLENGDSVFVAAYTSAGKTVVAEYAIALASKHLTTAIT

SEQ ID NO: 27229 - protein, 167 aa, A.fumigatus
VGGLSQSTIYIILLLGGGSNGCTKTIWAGVSELLEEGSGYRIAIVIRNSTYLLECLGHKLEEPASGDAIELSREIISQFQNYSAKYDEKFIGAGLPESLVLKCPGLCSQLWFKLDIVPLVLRHVARARTAHDRGEVATFRGWERKALDEQADSMARKCIRYLGAVGG

SEQ ID NO: 27230 - protein, 60 aa, A.fumigatus
  UNSURE (11),(29),(44): Identity of amino acid sequences at the above locations are unknown.
SWHSLAPTLNXYFFVKGKIPEGFVQPFEXISHLLNDTDYPWTWXCDIPVRLATCPKLSYS

SEQ ID NO: 27231 - protein, 169 aa, A.fumigatus
HIVRLLPSAIEDGTDLDPKMKRNAREVEGDTPKAKAKDGSNETQPKPNPTSKRISINREEIAKVMMAQSQAARQATLGLPFQARNEIGKNVPGPKESPSVSAQSHCPSSIAHISARPITSSQCMTEPQRDALLSRTRLSQPSSDTPSRSVTRPRPGFMPMISTKPFKTE

SEQ ID NO: 27232 - protein, 113 aa, A.fumigatus
HNAIIMTDYTDATDTTYGTTGYGTRGYGTTVGTYGTTYDNGYGTTAYDPTTGAYDQHMDYRTDGTTRHHRERVNPSGTYRHRDVDRRDDGTVRVHREYDNPNTGTSYHRDYER

SEQ ID NO: 27233 - protein, 128 aa, A.fumigatus
AVPSTTVTASCDLTSPALEIDCTPYLLQLGLTKSRTSLVWIAGPLSGLIIQPLIGVIADRSRSKWGRRRPFMVVGSGIVAVCLLVLGWTTEIVSLFVKDAEKVCLFCSGPGFGICDSAAHFTRQKMSP

SEQ ID NO: 27234 - protein, 67 aa, A.fumigatus
RPSATRMSAIGQLISYVIGSIDTVSLFGAIIGDTQFKQMTVIAALSLIGAVSVTSYSVKDIILITAR

SEQ ID NO: 27235 - protein, 295 aa, A.fumigatus
LDLGWFPFLFYSTTWVGETYFRYKVPKDAPQSSDFLGEIGRVGSLSLVVFSSITFISSVLLPFCVQPPDSKRSRFTPRPPPGIAALLKRITAIRPDLQTSWMISHVMFAATMIFAPLARSRAFATCLVALCGIPWAISSWAPFAFMGVEINKLAMGPAAAARSSGVTMITSSTIRSSNFDTDTEMDVLRLNHHDTDSDSDSDDDANIPSTGELAGIYLGVLNVYTTLPQFVGTFISWIVFSLLEPGSTKRDDSAQDSQWIRRDKEGPNAISICLFVGALCALVAAEATRRLRYAR

SEQ ID NO: 27236 - protein, 60 aa, A.fumigatus
TPSLWERSHHYYRSCSAAPHLTLAAAKSLSSLADCNQKALHENDVSSSFLSLSFHTFNCC

SEQ ID NO: 27237 - protein, 102 aa, A.fumigatus
KKSTQPLAFWFKIGRLLKNRGTSPVNKSPPSIFYVSVCGKYTTLVLPDNCLRNTPDLSLSTTHTRHGIVARIWVVLAFGMKIIGSRNDMKILEFIVTTKYRR

SEQ ID NO: 27238 - protein, 61 aa, A.fumigatus
  UNSURE (29): Identity of amino acid sequences at the above locations are unknown.
SLPRISPLLQNRIIQLGYYILLSLLAQIXDFVEGGAPTLVYYLLESLWTLTRVLKGWFEFG

SEQ ID NO: 27239 - protein, 275 aa, A.fumigatus
  UNSURE (266): Identity of amino acid sequences at the above locations are unknown.
PLMTTTAFYLRPNSQQKHLWTIYICQHGDDPEPAYTLRYPDPASPSSKNRYAVALCDPFVPDVVYGEVLIIPEWTQPSLSAEAIRLNGGVTPPPEAILPSQFIVQLYNPDQQVTIRYKHKTWNTPATWEFEMPQHTFRQPSASTLDRTQTDPALADTTPKLRFSWRKDSKLSKDLTCLLLGKTSTLPEGRTKSKEPDITVSIFKALRELTLYEPNMYRVEMEDFKGLEIVLLLGAVTIRDVYFTPMKDAFRIVRDEVGRKPGADPXSSGRAGIRS

SEQ ID NO: 27240 - protein, 520 aa, A.fumigatus
  UNSURE (31): Identity of amino acid sequences at the above locations are unknown.
QGDSRIERPASSSASCEEFAHYPVFNPRNLXHNHAASASLCLQSDYCRSRASRAQSSVTWMQDLPRRSLRKARSGLLALRSGMQRRPIPGGHARRSDIHSIWSSRDSREGSSDHFPSSVSDASTEDDHEFGTGLYRTARNQSSSSEALKDHSHSSIPPTSPLPCTVREGPEDIGLRKSLAAQEKRGVNGTSGAGVDSALETATTVGAPREHVTEPEHHCYIPGESSTVVQTSTHAISTSPSASLIELGGIKATTENTAPSETSKAATPKEPMNLQTSEECIKDICSQTHDSKSVITHSPVIDPEKPRAPESPEELVNPNVRKHNESIRGHGNAPPPIASGSTDSMACLYVSSRSPSPTSSVCSRESMFRQIPAVQLMMGTLELVASSRDCSSGGQTLCCSDVAENDLVSRAFHHAPADHTEDGSAPTETEPQQSRAANVGETQITQAGASFTVSINFDDTLRALTKSQEPSEMRSSEQEEESASCLLPGLDDTDSFGIQNNFDPCVARRPPSPRQTEDAP

SEQ ID NO: 27241 - protein, 445 aa, A.fumigatus
IREFNELWHLFERRINMSYPFASRYVDQFPKDKTVQVAGFVAFVSGALASVLALASIVDPELFLGFEITHDRTVLFYLGVFGSVWAVARGLVPEETTVFDPEYALLEVINYTHYAPSHWKGRLHSDEVRREFTELYQMKIVIFLEEILSMIFTPFILWFNLPKCSDRLIDFFREFTVHVDGMGYLCSFAVFDFKKGTNVINQGDRRDPARQDLRADYFSTKDGKMLASYYGFLDNYGANHRGSHPATRRQFYPPPAFPTLGSPPAGEMGTIGDRLDQTQTRHGLAGPFMGQQSVFGPSRYGLTGLGDHASPAPSILLDPHHQPSTSGFRGTSRAAGVQRYRSSRAHPPISGTIADGDESPVATGRSDPSRPAANAAGASSAGGVGTSDSNLGDSWRMNLVEDGDDDNTEGGENVDAIAGGAGVLGLIQQFQRVNKDSRGRTAVGL

SEQ ID NO: 27242 - protein, 98 aa, A.fumigatus
HVSFTAALQLTATHRYQVVIMSNQKRISLQKDLKGGRADSKSLTNFKERVTGVMRQIDIPISVYAATADDENRKPRTGMWKEFVEVFTTGVEGSELSV

SEQ ID NO: 27243 - protein, 131 aa, A.fumigatus
AYRKPGLVNVRVGASQDLQGAELQRLNKMLNGGMFYTQVVGPVSEADFGAPASPVADQDAHMSGTDEKSSVRPHYYDYENQPWKLEFRDIPEAATRSAVTTRLMASASLPKGDVTVPMNAWGYKSVVISLF

SEQ ID NO: 27244 - protein, 107 aa, A.fumigatus
LRYSFVTEYAVEGDIFIHNDIVIFLHRVLHYPTESQEPRRQLPALNEMTPLDRSGGYVLQAAITVQDGSNQETMKIASQHLFGLREQLKSAVRLEQADRLSLDTRAK

SEQ ID NO: 27245 - protein, 84 aa, A.fumigatus
DSTLVVTASGNTFPRDSSDWKWFSPNVPTKLQDLNADGRVACLFHGGTPANCNSQIPSRDHVQPEEDQPAERSEGRPSRFEELD

SEQ ID NO: 27246 - protein, 212 aa, A.fumigatus
TLPSSGYTSQEMYELERRAIFSRKWLLTTHKLRLPNPGDWLRYEVSGFQFVLVKDRDGNINAFHNVCRHRAFPVVTEEKGTSRIFACKYHGWSYGLNGKLAKAPGYQELDGFDKSKNGLLPIHVHIDANGFIWVNLDAGEKPEVAWEDDFKGMDRLPRYEHVKWDDFAFDHTWEQEGEYNWKILADNYNECYHCPTTHPDIPSIADLSAYSL

SEQ ID NO: 27247 - protein, 143 aa, A.fumigatus
SPHFFFMQRFVPLSPTRSIMKYEVYRNTKSSDEDFEKINQIYKRIMSEDKYLCDLTQKNLNAGVFVNGELHPEMEKGPLYFQKTVRDLVVEHYEREQKAKQEIWPARQNLPKTATVSEKDISFCSSLSCQTTECVQPPATIAW

SEQ ID NO: 27248 - protein, 342 aa, A.fumigatus
LIPRVDWESAQTPDTSSLVFGLAAENITFQQFGARNELVIDPRGYSAIINGEAATFLASENGEPSMDPRVRLQTQVTQIEYSDKGATIRNRDGSCVEAAYAICTFSLGVLQNDAVIFRPALPGWKQTAIYKYTMGTYTKIFMQFEEMFWPNDTQFFLYASPTARGYFPVFQSLSMEGFLPGSNILFVTVVDAEAYRVERQSDPETQAEILHVLRQMFPDKHIPEPKAFFYPRWSEEPWAYGSYSNWPVGTTLETHQNLRANVQRLWFAGEATSSAYFGFAHGAWYEGKEVGEHVAALLQGKCVTLQGQKACGERRHYEVLHGTTPLEAYNAINGWPMSSVDL

SEQ ID NO: 27249 - protein, 181 aa, A.fumigatus
TGNPPKHPIPARSSSASPPRISPSNSSGRATSWSSILAATAPSSTARPPHSSLARMASRAWILASGCRHRSRRLSTPTKAPRSATATVAAWKPRTRSAHSPLVFCRTTQSYSVRHSPGGNKPPSTSTPWAHILRSSCSSRRCSGRTTRSSSCTRRRRQEGTFPCSSLCRWRGFFRGRISCL

SEQ ID NO: 27250 - protein, 410 aa, A.fumigatus
RRLAGKPQPLYIRSQILMGLQRRTHRPVGVAPIRPGLFRPARVEERFRFGNVLVREHLPEDMEDLSLRFRVGLPLHPIGFRIHDSYKQDIRPRKKPLHRQRLEHGKVPSCRRRRVQEELRVVRPEHLLELHEDLSICAHGVLVDGGLFPPGECRTEYDCVVLQNTKGECADRVRGFHAATVAVADRGAFVGVLNLRDLCLQPDARIHARLAILASEECGGLAVDDGAVAARIDDQLVARPELLEGDILGGEAEDERAGIGCLGGFPVYTWDQLCRSRSRSRSGGRRTPIPPFHCLCCRIIFPWPPAGQREASPRGLVLQILGHDASCFSRGDAVGLGILALEMSVVGVSGLVVGAYRAVVGTCHCQVVFSCLGLVNICRGSEERRTSCQIGFSVHVSMSLHTGLEGPTVA

SEQ ID NO: 27251 - protein, 167 aa, A.fumigatus
CLGRNYDSHLSDITGCFYYRYRKLVKRLSVYLTNSSYFSKAIAAISTHFHATTDIGWCGATYPLTMCALQPISGKLSSLLSLRWTCLAFYCVFLLGSLICGVANSSKMCIIGRAVAGAGGSGVVSGGLSVIALITTPQQRPVVHWPCKPLFMPWDLSVAPNYRGRFG

SEQ ID NO: 27252 - protein, 252 aa, A.fumigatus
  UNSURE (38): Identity of amino acid sequences at the above locations are unknown.
HCSYFSIRLETPFAVESWLLPSVCTQVFWIPCLWHPRXTPVLSIYGSCFWRCIIAKHLRDYNPWLFLGSAFLCIANGLDTTFTVSSTSASWIGYQILQGLGCGLAAQIPLLTIQLVLKDEPRSIPVGIATVLFTQYFGSAVMQSIGGAIFQNALRRQLHQASLVDKQIEMLLNAGTSRVREVAVQAFPDRLADIIVAYNNAITPVFMSQSFQISHLHLKRTLLTLLVSSSSWQCSSISSIGRNFTGQYNPGR

SEQ ID NO: 27253 - protein, 416 aa, A.fumigatus
  UNSURE (401): Identity of amino acid sequences at the above locations are unknown.
RRCPDENALKDQVNGLPNLSGPDGSSKGAGPMARMATGGALNSESRPLPLDLRQSRAAQKPPLRQLILDGDYYLATVLSSTLTKLVMRHSEVSQDVARTNALRAEAMLIMISIIRVGQSQFVKAPIDEDSIDRIMCCVRSLSEFSQRKELETTFLEDTRKAFRDMVQVEDKKRAAKEAVEKAKTAVQVDDAIPIRQFTKKSGLEGAEEMELDLAKATGGDSTVETVASKLSRVVQLTGFSDPVYAEAYVTVHQFDIVLDVLLVNQTLETLQNLSVEFATLGDLKVVERPTTHNLGPRDFLNVQATVKVSSTDTGVIFGNIVYDGASSTETHVVILNDIHADIMDYIQPAHCTETQFRTMWTEFEWENKVNINSNAKSLREFLKQLMESTNMACLTPEASLXGRLPVLERQSVCPEA

SEQ ID NO: 27254 - protein, 66 aa, A.fumigatus
PRRSTPLLQDWLGDDQPKRHRREVHFPTGRFGEAIEQAHAVVFLASDESSFVNGSDFVVDGGMTKV

SEQ ID NO: 27255 - protein, 185 aa, A.fumigatus
WISRSGIGLETSILFAREGANVLMADISAPALEKALAKVKEVVPNAPRVETIKCDVSKESEVQAMVESQDSWGGTDVMFNNAGIMHADDADAVDTPEKIWDLTQNINVKGVWFGCKHAVLSLRRHKKTRGSIINTASVVALVGSATPQLAYTASKGAVLALTRELAIVHAREGFRFNALCPAPLK

SEQ ID NO: 27256 - protein, 106 aa, A.fumigatus
  UNSURE (45): Identity of amino acid sequences at the above locations are unknown.
KPAALLDTPVSMNIWSDVSTPAMLEGMPVGEIDSNAAFEGVPGIXAIMTSNSMLENQQYHFEPNAFDLMNQVQNDYNKTALYQQLSLPEGQIGENFEFTDFISDCF

SEQ ID NO: 27257 - protein, 155 aa, A.fumigatus
SDAMRGVFWLPVVKTGSHAGSLDEDAWAIRHFMNCKPELEFCVAQSFSKNFGLYGQRTGALHVVTSSSSGTLPQVVLANLSHLVRGEYSMAPRGGSEIVRTVLSDEGLRQQWYEDLKHMSGRIKQMRQALYDELIRLGTPGTWNHVLEQVGLISA

SEQ ID NO: 27258 - protein, 78 aa, A.fumigatus
  UNSURE (11): Identity of amino acid sequences at the above locations are unknown.
KRWDYTKGLVXKLQGFEEFLQENPELAKKVVLIQVAVPSREDVKEYQELETEISTLVGKICGTYGKLLSVCLVATFLC

SEQ ID NO: 27259 - protein, 164 aa, A.fumigatus
FKWQFPAARTSRSIRNSRPRFPPSSGRSVGLMVSCCPSVWWPLFFADYPATPEGVPLIYIHRSVSFPELTALYCVAKACLITPRRDGMNLVASEYVACQENRYGVLVLSELAGAASFLGHGSVTFHPSSTRELANAIHQAVTMDDGEKKRRHQELREFVTTHTR

SEQ ID NO: 27260 - protein, 101 aa, A.fumigatus
GLTSSIEPALQLCNFSFRRHLNLDSLILDILHILLRLFFHFMHVHSRLFFDFIHTFIGRIAYFGITIVDLFTEFGLVHFVLVVDLITTLADSSIDNLVENV

SEQ ID NO: 27261 - protein, 252 aa, A.fumigatus
YLDPWSMSPNNDRRKRLLLPSPQLIGSPTEENTPSTFSPSPPAILPTEFTHASSAGRTERNRLRRLANELRGLSDDLIRELLIQSGHQHLLATPPDVDRDIEKMRFAEIETIERRLKHYVDEMIERRLKSHVLNEIVDRAVSECRDQIYDEHKMNEAEFREQVDDGNSEVRNTANECMNEIKEQARMYMHEMEEQAQQYMKDIEDQGIEVEMSAEGKVAKLKRWFNAAGQSLLSSNSSPSHEPGANARRRSV

SEQ ID NO: 27262 - protein, 61 aa, A.fumigatus
HPAGDVSSGTHWHHPPIFPTEYLFAISIFFPISGLHFVFFRCSSLYHNSFDNRSQLLQPIV

SEQ ID NO: 27263 - protein, 464 aa, A.fumigatus
LSSALPQIPKFPESSRSAMETNAQPSFEDSWKPRSFYEQGVQDDALSPVIDLDAALGPFNTPDMRADRVVGSGFSAVSRRMYSGGRRGEFVGPEMRYHRRAESAPEMPPFDRSFLNNRLINSSSLENPDVFYEEEEDAFLAATSESPKDNQTASESNVVPQPDTSDQITVHSKATSDTLTRRSADAASSTERAGLGIQNNEGTDPEAPAPAPASQETFGDSGLSAHERAVDRLHNARNPFTSHPNSPVEIIKHENWQPNKPPVPPSPEISPRFLPADTRPATSPLELTGTIPQFSLQSTCSLSQSSFPSPDFTLSSSDAPRSITTASTTDHNFSNPSYNPSVDYHQSSVDDVPSLTSSVSTTTNPLNRVSGTFFHGCRISTDRSVSISAPGTRRSSQAHSQKRSSLASLSKLVGGPHGERSKLSYEEKPPSDVSEKSKKKSRRISRLVHFWRTKDKDKLNREAV

SEQ ID NO: 27264 - protein, 137 aa, A.fumigatus
LTHVARSCLQELQTSKSHLDALLSDTSSTLDLLRSLSESFKAVEAQTSNFRKQCEGILSAQKRDTELAEKIQENIQYYEFLDPASRRLNAPGAGNAVRSQDFSDMLRRLDECLDYMETHVSIAVVPWIDESTNSFPA

SEQ ID NO: 27265 - protein, 216 aa, A.fumigatus
WADFSPSVWLLLQLLGRFSLVRSALILVKAFLCEIPGFRRLRLFSVVKNNTLSYPPPLKFWLSRLFKGYDSGVMTDVIASPNFLAFFNTNKTSAIIGAINSTFNGGGMYSLSYCNSAHSLTKTAIAAIGALQGGLTMDRFGRKFTIQMGALICLVGAILQASAMNLAMILVGRILAGWAVGLMSMSVPVYQAECAHPRSRGLIVGLVFTTGWKKAS

SEQ ID NO: 27266 - protein, 459 aa, A.fumigatus
LCLARSRRSPVVEDAQIFVYNNIFYSFGADGVGTFVSEGGDEAARVAVGKDVLGIMAVNQLDINGLFTPGTVVVDYLGKRIVGHSIVPGIFKQREPGEHQIDYGGVEGKDVVATHPDFVSVFEKMSKALRIKKHPVWDKEGKRHDLEGSVETKGLLGTDGRKYVLDLYRVTPLDVVWQEEPGSEDYPHRMSVLRLELVEAYWRSKMSQYVKAEVERRRAAKAQEDAANKEQPSETTESKEGESEEKAEEALDQERVDISGFQLALNPDVCSGQVPQTEEEKKQWAEDEKEVRDACEFLRSKVIPELIQDLHDGDVGFPMDGRSLSQLLHKRGINIRYLGKLAQLSKEKGSRLEALTTLLVQEMIARAFKHIANRYLRNVPAPFVASCVAHLLNCLLGADVNPKPSAEIDASLREIYPEGDFSFEKVTPETLRAEVEKQVTVRYRYTLETECSLPSSPRG

SEQ ID NO: 27267 - protein, 157 aa, A.fumigatus
KTLRSSCTTISSTLLALMEWEPSCQRVETKPPAWPLARTSWESWQSTSLTSTAFSRQEPLSLTTSASASSAIALCRGSSSSASPVSTKLITVVLRAKTSSRHIPTSSPSLKRCPKRSASRSTLYGTRKASATILKAASKPRVFWAPMAANMSLISTV

SEQ ID NO: 27268 - protein, 269 aa, A.fumigatus
AATRLTGVAIQALVVYTGRMKFFPNGTLSHGALGYLIPPWKMHPWFKWLIWINPVQYAFEAIMANEFYNLDIQCVRPNIVPDGPNAQPGHQSCAVQGSTPNQLVVQGSSYIKTAFTYSRSHLWRNFGIIIAWFIFFVALTMLGTELQQPNKGGSSVTTFKRNEAPKNVEEAVKNKELPEDVESGQKENAVNADSEKTQPGETGDEVKDIAQSTSIFTWQDVNYTIPYEGGQRKLLQDVHGYVKPRRLTALMGASGAGSVMPTIILKPSS

SEQ ID NO: 27269 - protein, 154 aa, A.fumigatus
PVQRNEVKRSTTRIENTVHQHQQQQQQRSSSSPPPHDGAPPSSPVQPAAPPSSPPKPSPPVAAAPDDEWQNNDAQPPTQESQGGAEGQYDPWAASDAAQAQNSQGPTEGGWKANDAFAPTQHTQGQSPGNRKVGDGTTTKTTEEAKPAEPEVTW

SEQ ID NO: 27270 - protein, 91 aa, A.fumigatus
DLEVRRRYSEFASLRQTLVNLHPTLVIPPIPEKHTMADYAAKPTKAKEDSAIIDLRKRMLAVFLNRCRRMKEVREDGVWWRFLDPNVSWVC

SEQ ID NO: 27271 - protein, 68 aa, A.fumigatus
  UNSURE (68): Identity of amino acid sequences at the above locations are unknown.
NEVLHSHPASSVPKNNLKAPPLDPANPTAAHSWLPVPSSSAKLKSASSGATSGTTDAAGHRALDLMCX

SEQ ID NO: 27272 - protein, 102 aa, A.fumigatus
SSHSLSCLVWTRSLQVWPHCAYWWHPKMTAHIKLTVLHRSWMTYFFKRKFSLPDGELGSIFFTTSLISAASMLVASSIAKRIGNVKVRSSPSIAFFRRRVGF

SEQ ID NO: 27273 - protein, 161 aa, A.fumigatus
VEESTLAHLTAKEHRSDIFVWYSWIGTAGTALGMMVCGWSINLLKTTRDWQYLNACRIVFFAYAGIGAVKFLLSICLSHEVEAAKKDKNGATASRQPRAADGPETQPLLGERANNEDNQKKSLFSFLGSSDLVSLVVTLFVLFGLDSFASGLASLCVLVAP

SEQ ID NO: 27274 - protein, 150 aa, A.fumigatus
CQGSLFAFNCILPSPCGFLTMRQTMVFTHLPSAICLALIPVPSALPAALTFLILRACSQSMDVAPRSAFLAAALPPEKRTAIMGAINVVKTCSQSLGPFITGVLADHNFFGASFTLAGVLKAIYDIGMLINFAGRECAQRMASDRPGESA

SEQ ID NO: 27275 - protein, 175 aa, A.fumigatus
NSISLSYTSKVLERMKFTFSFIALGFASFAQSTSVSGSSSLLPGNTNTASAAWLTHFDQFRQQHEPLNPAQSAVIDTATDLAKQGQDFDPKAMDDLKNDAISAFGFKDAKSLLATMGNKSLQTRDDAKEDIECGCSTQSDWCDSGYHCAGGGCTQTGSGCGTLYKYACDGLCRLS

SEQ ID NO: 27276 - protein, 72 aa, A.fumigatus
RKAPGLRKRKRSATKKDKARLLFFPRGLRVPPRRNPSSRSVSGVVKVNLDPDMQYATCSGARDYILTRKATS

SEQ ID NO: 27277 - protein, 81 aa, A.fumigatus
SDNTCVSSNECIQKEMEVSTEEFKPSGFSLRCLLPTAEYENDGLKADRQIDGSSALVTCQGRFTTSVASQELAIQRPCGSP

SEQ ID NO: 27278 - protein, 62 aa, A.fumigatus
FGFGVVKRTDFSPLRFKFSHKIMMYISVFPHGHFHAKTNVYEERNLGIYAGGEDEDEPQDPS

SEQ ID NO: 27279 - protein, 223 aa, A.fumigatus
CIFRFSPMAISMRRPMSTRRGTSAFMRVGRTKTNRRTPPSYIGFHLRRQLSFDLWYVFLGLFIIAIVEGNRLQSEDEYAFQMWAVLFEIVSAYGTVGLSFGYPGVNTSFSGQFKVLSKLIIIAMQIRGRHRGLPYALDRAILLPSESLKDKDLQDAERRMRRRVSNLSTMSGMGRTYSQARTENGVATGAEDKDRGATAWTNGDNVIRRHSTMRSQQSQKSQR

SEQ ID NO: 27280 - protein, 64 aa, A.fumigatus
IDPNIKPRNIAIITRVVLGWVWVNPWHKKPALQPMWVSQSNNHWLSPTGRIISGIDINQELRGV

SEQ ID NO: 27281 - protein, 84 aa, A.fumigatus
PSDTPRCQKDHQIPLSSKMGSIGTHEKLSGFDLIQTHYKQIRDHAIRADFIIPKSTFTGKRPVIVRFHGGGLVGSTSRPFMDSH

SEQ ID NO: 27282 - protein, 372 aa, A.fumigatus
  UNSURE (197): Identity of amino acid sequences at the above locations are unknown.
RLQGFNHRAKIKLRTGGSSGKIPRGWCHIEGNNSYYDLTNEDFRRSIRLPVKHRYRSPVVFELHTQGKHGAAGYSILWLQHLVDNEETEIDLPIWSTKNGSRLTQNYITEENWKAKEVPGLEDLHEIGRLQLRGLFTPGIDDSHEQYVVDSNSRETFETWEACMAEGVRPHRVTAEIPANIEKLHEQSLRAVRDVLXQSHPRERKRWIDKQGNNWSGAFGDDPAAYFDSKGRKIAEPGRDQPPQDPVNPPPKEIEPTGAAHPSDYEEDSSESSSEEDAQQEQQEQQQQQQRQPSEPQTITTKPSEASSSNGPSKRAAKRSEQRQQRGLMQWKPARNAVFARDEAKYAMRKVKHKFTGNLSGREPDIETETGQ

SEQ ID NO: 27283 - protein, 240 aa, A.fumigatus
GSGPEAELEDYDVTDDLREMCIQFGYLALFSPVWPLVPVSFLINNWVELRSDFFKICVECKRPWPQRADTIGPWMDSLGFLSWVGSITSSALVYMFSNGHEGPNGEPTTIRCWALLLTIFFSEHLYLIVRYAVRSALAKLEPPNTRRERIERFMMRKRYLDTVLSAESDDDADEVKGVVSSIPPSEITRESLEQDARDWSKQGTDPTERFWIRQRGWKESAEVGLSLITKAKGDETKKQQ

SEQ ID NO: 27284 - protein, 104 aa, A.fumigatus
LFLGALILMYTAFELAYRDIIYFVLSIIEYCLFIKVLAIHPLQWDSFCGRILRSAEVMAVLNFEFESVPHVSSSVNHDSEVRTHARTHPICLVVFMGDYYRSTA

SEQ ID NO: 27285 - protein, 79 aa, A.fumigatus
SKLHSAIHYLIRPIIMSATSPTLSTNQPIKTSTAPPPPPPPLSTNRASTLATVPHPLTVTSHGPPRAFLVKLLIYNSHP

SEQ ID NO: 27286 - protein, 174 aa, A.fumigatus
VSPFPSLHLHYSHKYRSGNHPPPCRRNQAHKDLDPLLTAQPSNFSNIASLLWHAYAALPSPSSSVNWAGFYIRQDKFPALGSQNTRSNSTNNLLLLGPFQGRPACQEIRFGRGVCGTAAEKRETVIVPDVLSFPGHIACDASSRSEIVVPILVGGEVSLLSLVEAVLRCVADAR

SEQ ID NO: 27287 - protein, 186 aa, A.fumigatus
TISLHTLTMSCATQFPIFQSDVEHICIRYTGRLTKHHTIILYIHTYQSQHSAKSDASSSNHFLSSSSNPAGSVQSTSMIATVYRASATQRNTASTKESKLTSPPTRIGTTISLRLLASQAICPGKLNTSGTITVSRFSAAVPHTPRPKRISWQAGRPWNGPSSRRLLVLLLRVFWEPSAGNLSWRM

SEQ ID NO: 27288 - protein, 205 aa, A.fumigatus
QQLHMASARSDTQSDQSQMNITFDRFNPQPYLTYTPAPRPPDMSGSAQFGITRDLPFQQLHMTSASSDTQSDQSQMNVTFDRFNPQPYLTYTPASRPPDVSDPTHFGITRDLPFQQLHMTSASSDTQCGQSQMNITFDRFNPQPYLTYIPAAQPSALSNHQKPAGESGAYMVLHRQLEDIHDGQAERNGYQNEVQHCPEDQIRVW

SEQ ID NO: 27289 - protein, 168 aa, A.fumigatus
CALSFDMSLLSYIASGISSFVVVTLSLFALGQKVPRAAFFARCLAAYGSLLLCACYGVIASILLRLVGYGRVSQWATARSFKWVMRYTTGVQFDIIQGAEHLSTRPAVFIGNHQSELDVLMLGHIFPPYCSVPAKKSWKHIPLPGLVHGAVPGRSSLNGPTRKTTMKG

SEQ ID NO: 27290 - protein, 65 aa, A.fumigatus
PLANSTAASPTFCSKRRGLLTVPPTAINIVTDFVFATLPVFMFHNIQVNKRTRASLMGILSLGYL

SEQ ID NO: 27291 - protein, 89 aa, A.fumigatus
LSQVFLILFTIACILTLILQCIPVSAVWDYTLKATATCYSSQTYLAIGEFNSGKSHVLFQKKRFTDSASNSHQYCHGLCFRHSAGFHVP

SEQ ID NO: 27292 - protein, 61 aa, A.fumigatus
SNPFYPGPGRGYRDFGGGHGENVTIPKRHKLYSAVLDILSGLGISNYRSPDYNIVQPPWCG

SEQ ID NO: 27293 - protein, 72 aa, A.fumigatus
AAVGASVPIASLAPPSTNSLYAKALWQRSPINSGHARNKTGSEWTGCTDAIIPNSPNRLASSGAVSSRCSMR

SEQ ID NO: 27294 - protein, 316 aa, A.fumigatus
  UNSURE (20): Identity of amino acid sequences at the above locations are unknown.
TGLVDMAMDETTWDVLQFYXQRHDPPLHIAAYWLVPFSQNEETNFSHVDRAIQIHAEFHPTKSPNLCIMGIKLICDGVVDGCTAALSQPYGSLTDPVEPIWPAEMLKAVVQRADQAGLQCAIHAIGDKAVTQAIDVLAEVGTPGRRHRIEHLELTAPEDARRLGELGIIASVQPVHSDPVLFRAWPELIGERCQRAFAYSEFVDGGARLAMGTDAPTAAHLPLPNLYNATTRRSALEPGEPAATNPRFGLGLAEAVTAATEGAAYARFAEGWTGCLREGRSADFVVLDMQWEAEELLEGKVCETWFGGKRVYSVER

SEQ ID NO: 27295 - protein, 459 aa, A.fumigatus
  UNSURE (349),(402): Identity of amino acid sequences at the above locations are unknown.
MFLADLIPREQDQDGPPRDDDALAEDLAAEAPFVPIRNNRRPGNDVQQNQGIGADAGIDPNDLDAVEEGDDLEGILELIGMQGPIFGLLQNGVFSALLISFTVAIGVWLPYLWGKIALVLLANPIQLIFGVPVTAVSVIADVTLDTLIGSLGYLMYAVSLVCKVLLGPLSAFVPLGDWIPQTKFITNASLSLIDASSHRLKTVVSAFFVFHESDVPVFSVLSHQALKIHQARISGLCQSIATFVKFIVQDLPLQITTNGLQGALSFGRQGIDLSSLLAQARQQLYSFAERPFFPGKGVKWLDATVKGTASTSLAIDPELAVWDTKDRIIAIIMGYVLASILGLLYLRIXSLFTGATRGQRVEGLVADILHQAGGVMKVILIIGIEMIVFPLYCGTLLDLALXPLFENATIASRLEFTSSSPLTSLFVHWFIGTCYMFHFALFVSMCRKIMRSGVLCKCS

SEQ ID NO: 27296 - protein, 326 aa, A.fumigatus
ELVARMAFATLRSIPSPTRLMRPTMAISQHQSRQISFSSYLVSPRELHEALKKNPTTKISTSPRVIPLCAAWFMPNDPEGRKGIDAFRKHRIPQARFFDLDAIKDSESPYPHMLPTVETFAEAMSELGIRRDDEVVVYDTEELGIFSAPRVGWTLRVFGHPRVHVLNNYRLWVRDGYPTETGEPAPVEKTSYPLPQFDSKLVIPYRELKEIAKEHRKEGSKEVEILDARSYGRWAGTDPEPRPGLSSGHIPGSKSLPFQELLDPETKTYLAPEELRKVFQKHEVDETKSIISTCGTGVTASVIETALNVADYGNPSLRRVYDGSWT

SEQ ID NO: 27297 - protein, 144 aa, A.fumigatus
RQHIHNHNRLRQRQPRPPLLRKTPPRPPRRPAKETPYGQKHGMPSPLPLYPFPVRHNLATNHSGQAQLEDQIYRFEQSYLEETTAGNIIKGFDNYIKGSGSSTGLGASGIALAGGMGGAARRKSQVTDADRVFSRSSASFMRVR

SEQ ID NO: 27298 - protein, 80 aa, A.fumigatus
QNRDRLTLKVDAFIKDETYAYAYKTNRIYKILPLASHLLNTGVQSSNRSQTDRPASDDSPSITNNASPLNLLSRNTQHIN

SEQ ID NO: 27299 - protein, 189 aa, A.fumigatus
AIQPLSALAAQHKMADTVPAQAPAATGRPTGAATATAPATAGASGTTTGTQPSGTNNPTTGNANANTSTTTTDSDSGNRGLPYYEKLRRDLRDALQKKRLMDKSMVCLRLSPYIPSQSAITWQLTTADRPNSKTKSTVLSNPTSKKPPPETSSRVSTTISRGPGQARGLAQAGSRWQGAWAARHVASRR

SEQ ID NO: 27300 - protein, 161 aa, A.fumigatus
IRESSPPTGLKLTALPQTIVQASRTTRPLSTCYQGILSILIEQFNLCQPLLHSTRWQTPSQLRLQPQQADQQVQQPQQHQQQQAHQAQQQAHNPPAPTTQPPATLTPTHPQPQQTQTAATEASPTTKNSAATSATPCKRNALWTKAWYAFASPPISLPSPP

SEQ ID NO: 27301 - protein, 77 aa, A.fumigatus
HNQMLFTWSTKDLCIVFSQWHITGPFSLLMSLIVIVLLTAGYEGVRQATRKYEAAQAQRLNVFSTTTATIGKYFGLF

SEQ ID NO: 27302 - protein, 105 aa, A.fumigatus
  UNSURE (4),(22): Identity of amino acid sequences at the above locations are unknown.
SSSXNPSHKYSPTVRRRLIPSXVALIILILVLVTGPRSAFFLFFDDEDEDPFTLAAAEDVPSPFGFPFDPLYVDVGVGACEGVVCTDDGAGESYDWLDHRLYSEL

SEQ ID NO: 27303 - protein, 98 aa, A.fumigatus
NVLPLSMSALAIARLKPSLTNGVQGNEFADESATTNVPSSQTPNESSPLVAGRDNRRAVEQRRKIILAALYAVQVFYSFFIKLIISPILPVFSINSDA

SEQ ID NO: 27304 - protein, 298 aa, A.fumigatus
TLARSFAAVVKTVLEAFDTNIQYRGANSKMNLVFGGSEPAVALASLMQLASSSQENFYSRPDLGASLIFELFSLEAGAAPTYPDQSQLYVRFLLRNGTGTSAEFRSYPFFGHGPSNDAIPYSEFRAQMEKFALGSTQQWCLECGSSAVFCSGAMGKAKKTSTSGNRLSPAIAGVIGAVVTIVALALAAILIFLVRGFRMRRMRRSSAGGFKGNSKMASDADLTAKDSTREDVKPAESPDSEPFRAGGAVVCGHERTGSWEMRPTPAQNRTTASPFEVEHDDTWNTHSALKPVQAREHV

SEQ ID NO: 27305 - protein, 70 aa, A.fumigatus
LLHCGSFQPRGEDRQSFSEPHPATPDTIAPQTHTKLNRNMSELDYATDEDVEDGNAFSFRPPVSHYSTFH

SEQ ID NO: 27306 - protein, 83 aa, A.fumigatus
  UNSURE (4),(12),(18),(21),(33),(34): Identity of amino acid sequences at the above locations are unknown.
LGEXRSGVIGEXKGKSMXPCXCNAKSITNPATXXRLHLFHSRRRGKTTNPLFTFAIKPDFDTRPLQGVNHLSPFISCYVPQII

SEQ ID NO: 27307 - protein, 82 aa, A.fumigatus
HAPHFDERHTAYGGPQWPVCPGLSLPFAHRHAVIPMLPEDVTQNTGSASQHINHTHPFKAIASSSDKLYVPVSHFPQNCFSP

SEQ ID NO: 27308 - protein, 111 aa, A.fumigatus
  UNSURE (20): Identity of amino acid sequences at the above locations are unknown.
FDRRKRIPRRSPPNWIEIHXFKLRASRRRYTLAFVDNCLDGQYNYRSTNSFRSKISSPSGAQVMGLDPFVVLGLATATCGAVGWLAGPFLGNAIWRLVYRKYKPAFLMVSS

SEQ ID NO: 27309 - protein, 71 aa, A.fumigatus
DSCRFCSVLTNGQREKEFYDRIKRFRVDPSSNSIANPVPDYYGEKIGSVQGYRQWLKDQRAYNRKRRSFII

SEQ ID NO: 27310 - protein, 337 aa, A.fumigatus
  UNSURE (300): Identity of amino acid sequences at the above locations are unknown.
AWNHSTSPLPFPSLLFSLSLSYSPHPSAPFCPIPSSSVDLRNLSVVSRLKSISIYHLGTFRHLSPTHASRPSSLSCSRVHVPLKRVFWASSTNQQLCTANVVPAVSSPLQAALALPHGSPFVYPPVPHFIFLAYSDKSLDLLAFSIVRYSRRSVVSSISLSTGMTQLFASSPSGVTNEKRGNFPGLSLASKKHNESSHLPTRIKNFFRINSSSSNVTPHTGSDRERDRDASPSTGAKAEAKSTFRQSRFIPTIGRNRSTTVASEGNPLDEGVSPTATANPYFVHQGQPSLQHRNDGSFPXSPPDTPELQVDGVSAAEQATTANREESSPRGWKDTRS

SEQ ID NO: 27311 - protein, 65 aa, A.fumigatus
LAQSINVAGGEEYSHRFKIPEMDSLYRYWHMFFEIPHKNLPFAHPKSEIYQIPGTNISPLSSVSN

SEQ ID NO: 27312 - protein, 83 aa, A.fumigatus
LNTLYTRENNTIPIWIFTTLLLNCVFGLPGGKSSESDITLGSLDSLINLARVIESGPAMDLVDQASTVEEKWKSYIEGESHRR

SEQ ID NO: 27313 - protein, 75 aa, A.fumigatus
KIGSEKPYYSISVSNSSRKTQDRHNVQGYDTGHLPPSAVSIIVALITQVTTIILFGFSLFLLFAVFHHRGSADPR

SEQ ID NO: 27314 - protein, 597 aa, A.fumigatus
CCSRASQIQFSKMPIRTRAGSSPIRSSDRHEGPEVMVTSPSHPATGAHFRTGSLGTAVNVNEGRPRRDTTTSSDLSTDNETNEMDPSFKRRQIQFSTTDKIIEYQDPPRSTSNRNVDTMTLGGLSEAAEDSGAESVGSVLSSEFDATAGSGSLLEDVGITGGLDSSSPVALMHKLQNGAGSQTASPRKPRTPAPELQNLPPPRPISRLQPTSLLTQALKARMKAPTNPVEKFAVLSGKGLADALNIKLYLPFSSDPEEPLDLQLARESKLADQPAPVTVAEAIGLALWRYSEEGREPAIERNKLNVNRWTLRMVEDGEVEYDFPPLSRASHIADFTSNNNNRATGVRGRSRGKQYDEFALVEASEEEFEENERLFPQYSQEATSEENVMTPTAPTVPLLQPTPQSKAPAARVNPILGQPFSSALNDNTLTPADRPAVPTSHATPRMGVSKTLKIRFMNLDAATHVTTLNTSTDSYIAEILDSVCKRWALDKGNYILKVAGSNTIAPLDRTVEALGNITDLDLVRRRFGAGPLSLTGSPGSSSPNAPLLIDNKQNTTSKKNKKSGPSMLHPLTQTQELMGGYYRRYHVFNHGGWKEPR

SEQ ID NO: 27315 - protein, 197 aa, A.fumigatus
PSATCAPLTAGHNPSIPTNTTASRPPTTTPPVPSSPSASSTAPATMTVPDGYSPLGPMGFDERALFGLTSAGGAIYTIADITQEKTAELSQRQIAEEVQQRKTQQERFIDMISHEVRNPLSAILHCTEDILNAVHRIRDGAEHAGGDACDDCQSAAVSSARGRDRDEFQGRRGQHVWVRLCRPEKRRRGEASYQPDG

SEQ ID NO: 27316 - protein, 79 aa, A.fumigatus
QVADMLPTGVAIRNHRDEAIFANHRFRNLMTKRDLRSFDCWPQSVHPDEYDRLATAYHDASRAQQPLCIQYRTRDDDCP

SEQ ID NO: 27317 - protein, 71 aa, A.fumigatus
KGVQSIMCDALQETELYDGCEIMYYALAGKSRIYLTCASSESISEEPMFIFLQAYDYKIFYEATCTIMNML

SEQ ID NO: 27318 - protein, 460 aa, A.fumigatus
CNATADPSSPVVKTNTATQLVDFPPEVILDIGDHLGLKDLNSFVQTAKLFNTLLSSRLYALGAKHVGETTSPLIHAVQYCPISAVRKLLDNGADPSVFAGKTNAFLAAITRYRPKVLKILVEPGVSASTPITKLKSPLSIAATRWRLAPLRILLNAAPGHYPDEDGAWMGALGRALVKNRVRAARLLLAAAAKTISSPLQGLSVDKIYSVLYRANCEIIRLLVEFGWDPLAQLGMGGLPLHIAAQTGRADLVRLLLSYGADVNARNGQHATPLHLACANGQLGAVELLLNRGADANAATLFRETPLHQCMRFGSLPLLELLLTAGANTSARDETGVSPLHIGISLRKPLEMIVRLIQAGADINALDLHSRTSLFLAAKYGNARLVQALVDAGVDMAIDERAGSTGPLHVAATEDNFRVIQPLIDAGLDIEAPDSLGRTPLHLATIHNCLIFHEGAHSSRS

SEQ ID NO: 27319 - protein, 178 aa, A.fumigatus
QQFITALYSMRELIRQGADPNRVNHPGKSAAYGAIAYNRTEALKFLLESGADVSRLRQDGISLLHDAATHSAMPRLITCLLDYGADPLAITSDGKTALHYAATNDRYKSIPPLLEAGTPIEARDNHGDTALLIAARSSCEGTRDLLKRGANLNACDRRGRTPLHHCSSHTDSEICTML

SEQ ID NO: 27320 - protein, 552 aa, A.fumigatus
QSFKVLAECPIIVVSIFQTHRNSVSANVKLFVPLIKSILLLQAKPQERAHAEAAAQGTIFTGVCREIKNRAAFGEFITAQVKTMSFLAYLLRMYAHQLQDFLPTLPSVVVRLLQDCPREKSSARKELLVAIRHIINFNYRKIFLEKIDELLDERTLIGDGLTVYETMRPLAYSMLADLIHHVRDHLTRDQIRRTVEVYTKNLHDDFPGTSFQTMSAKLLLNMAERIAKLDDKREARYFLIMILDAIGDKFAWINHQFDNAVKVSKAYKAGKKDIELSSERYLADKENPPDWDEIDIFSASPIKTSNLRDRGGDPVSDNIFLFKNLINGLKNIFHQLKNCNPEHIQIDPNNVPINWPEVSYGYNAEEVRVIKKLFHEGARVFKYYGVDQPAPEVTYSSPFDFLASQYTAPMSREEKELLESFGTVFHCIDTATFHEVFHSEIPYLHELMFEHGALLHLPQFFLASEATSPAFSGMVLQYLMDRIHEVGTADMTKAKILLRMFKLSFMAVTLFSVQNEQVLHPHVTKIVTKCIELSVTAEEPSLHRGRKRGTDW

SEQ ID NO: 27321 - protein, 338 aa, A.fumigatus
  UNSURE (32),(43): Identity of amino acid sequences at the above locations are unknown.
PIELFLVANTNSICNMASTLRSSGCHRHRRDXKREDIGFSMPXIKKNLDSGKVKRNMQDCRSHILATRELAMQIYDQLSKFGASVDIRVTCIYGGVKKDEQREALKTAAIVVATPGRLKDLKDDGSVDLGKVKYLVLDEADRMLDKGFEQDIKDIIRSTPDSTRQTVMFTATWPPSVRDLAASFMTSAVTVTIGGDPSADPRANTRIKQVVEVVKPQEKEARLVQLLSRSQRGAAVGDKVLVFCLYKKEAVRVERLLRSKNFKVAGIHGDLNQHERFKSLEAFKTGSATVLVATDVAARGLDIPSVKLVINVTFPLTAEDYVHRIGRLVTMLSLGWKY

SEQ ID NO: 27322 - protein, 63 aa, A.fumigatus
SANVAIFLICHRLINVLRAAKQDVPDALLKFGTTVKKKQHGAYGAFFKDVDTSKSATKIVFDE

SEQ ID NO: 27323 - protein, 117 aa, A.fumigatus
  UNSURE (17),(61),(71): Identity of amino acid sequences at the above locations are unknown.
SDPILREAPPLRPIMSXSHLPSSFSKIYDPLSSFSSPTPIQSATWPLLFARRDVIGIAETXSGKTLAFRCXVLRKILIQGRLSETCKTAGVIFWQPGNLQCRYMISYRSLGPLWTSE

SEQ ID NO: 27324 - protein, 69 aa, A.fumigatus
KSLDTNRFFFVQAKDKNLIANCCASLRATEQLNKPSLLFLRLNNLDHLFNPGISTRIGGRITTDGDSHS

SEQ ID NO: 27325 - protein, 144 aa, A.fumigatus
LMKLEFVEEQAIDRVHRLNQTVDVKIYKMIIKETVEERILELQDRKRELANLTIEGKSAAGKLTMNDMMALFGRDAEARFSGDRGNIDVIKSGASLTEASASSSKNNGNEGSTRPWGRPSSQGRNRHAEKRAPRTEDSVYGRRW

SEQ ID NO: 27326 - protein, 273 aa, A.fumigatus
AKEEVKNSSSRCGECEPDLKATLGGFDSGKKKSSHKPRVEMDLTDSPSNKFSEMQKARARRNRKIVIDSDDEDEDDGEWIVPEGQRGLPNLGKAGGTDDENAEGGGEWLSSEDSETDEDGPESPTRKPAIVSNLRRSQGSESDTDEDIYLNPGDNETQVLPSTKIRHLMKILRREAADYKFIVFSVFTSMLDKIEPFLKHAGIGFARYDGSMRNDLREASLDKLRHNSATRVLLCSLRAGALGLNLTAASRVVILEPFWNPVSDHGELVITVD

SEQ ID NO: 27327 - protein, 481 aa, A.fumigatus
FLCGFPLTEGCLTSVALTRFRRTLIYARLEVRRLTHTLHMPPALSEIYGGPRPEWLRDILEFLPCLQSLIVSRLPFFDHNAMMALKGPAKYEPPDAAAFKTYSVRLLMAEREPNATSQGLAETLLRFQELVYLDLSYTTPARDLMVFSSLSQLNRLQVLKLRGIGLRDREAEFLANAIGIRVRFLDLRNNLLTDMAVRSLLQASFVPNGPPTNEAEWRGGSFIFHDRLLRRASLDALFVKALTQPLTGRSWVEDLSHVGITHLYIADNQLTVEGVASLLASSRLHVLDVGTVDTVQSLGRARQPLISSPMTEKPARFPGAEKLVPVLGSIAKESLTYLRAHHALCTTDTSFKAPDSTRDLLPELPDEASSSLQGRAEMDAADEIHELSAEAHPVFELEATEIAGISSPAGDVDETRLQSRTHRDDPVPKVRRGSIFAPEVVEPNQRVGSNGNMAADRSETVNYNVFTASIRSSPPGWKEKK

SEQ ID NO: 27328 - protein, 92 aa, A.fumigatus
  UNSURE (3),(4),(5),(6),(7),(9),(10),(11),(12),(13),(14),(15),(16): Identity of amino acid sequences at the above locations are unknown.
ALXXXXXWXXXXXXXXVLCGVGAVGNILMMMIANLVGFALGLDGLKGLLTEILGSYSGIGFLIAACGALFVGAQVMFEIREEELRAGIKMKC

SEQ ID NO: 27329 - protein, 173 aa, A.fumigatus
SSGDLVLPVGGVRLQRASLSKVTKPSRRSLTPAATPLDSSKRKQSTVPPSRASTIPPETSTNASPDTDEDKKQPEPEAENPNRLIKSEYDNDPLLRSYIPSAPSERIMQALLAEPPLTYNAARAGPPLTAKAPRHFCCMCGYWGKIRCKNCHVRTCGLACYKVHEDSRCGAFF

SEQ ID NO: 27330 - protein, 109 aa, A.fumigatus
YVEHRLRGKKSLLDNHGHSTFHDDWTNYRAWPMGRARQALSDPRAGTKGASVAIGRKKQKILQLPSMWKFFNGLICMIHKGYSAKFDDAPQEKLEKIPHVSGQCEHDGL

SEQ ID NO: 27331 - protein, 60 aa, A.fumigatus
TIMATQHFMTTGQTTVPGQWVVRVKPYLTPELVQKEHLSLLEERNRRSCNSLQCGNSSTV

SEQ ID NO: 27332 - protein, 214 aa, A.fumigatus
AGNVNMMDCETLPLTISQVVSIEPEQLYRHCNIQPNSPWGISRVSTRTKLGAPPYSYTYRDDVAGSGTVAYVIDTGINNKHVEFEGRAQKGPKFVSDNVSNDEDVHGHGTHCAGTIASRAYGVAKKANVVGVKVFGDRTGTAQTSDIIKALEWVISDISAKGMGGRAVVNLSLGGPPSDALDAAVASTVHKGVVVCVAAGNEPEASTFATTNYN

SEQ ID NO: 27333 - protein, 110 aa, A.fumigatus
RKLDPIKDSGYTRTRAFGRLVDRLSSKHRENIMFSTTSYSSLAPALASATRIRRNIATAQSHNFRVITNKGTSGSFSRVKCNCRRSEDILTKLATDTTNNDAVVSRLIVA

SEQ ID NO: 27334 - protein, 61 aa, A.fumigatus
RAKGLSMGRENHLHSTYPHNSQCHLRHSKSPLYIPILPNTPDNCCRPAFPSHPRPYVKKLS

SEQ ID NO: 27335 - protein, 192 aa, A.fumigatus
TQEYNTMYGASTGPQTGINTPRSSQSLRPLILTHGSLEFSFLVPTSLHFYASQLKETFTASLPQPTDELAQDDEPSSVAELVARYIGHVAREVEEGEDDAQGTCLEVLKLALNEFERAFMRGNDVHAVAAALPGITAKKILVVEAYYAGRAAAGRPTKPYESGAIPRRLRRKSQYLLSPSVARATSKSTLMS

SEQ ID NO: 27336 - protein, 62 aa, A.fumigatus
IWRYSAPPPKKKPVSTQSFGGQGNIEEYFDELREIYTTYPSFVEDLISSSAVFTTGAEGSAL

SEQ ID NO: 27337 - protein, 184 aa, A.fumigatus
PPSTCCGSSASRMDSASISSTVKTRATTPTSAAMVPPVSSSAVSKSSVPSASCSSLCWPSAVASMSSTAARSTSTAAPSGADSRTTGLPSTPESSTASLPQPSIPPFSSMPPVASASWLPRKPPSTVLKAGTTTPSGATSRPPRMKATFPSATTRVTTPTICASPRAGPGSSVSPPGRAAPSPT

SEQ ID NO: 27338 - protein, 461 aa, A.fumigatus
RSCGMSMTSHHPAANNPSPTSRVQSSVIQSSLTSVTTKMTVTKPTPKHTFAERAAANNLNDAQILNSNNPAGADIPEKSDVVVAGGGIHGLIYAIHAAKYKPGKLNISLIEKGTKPGYKIGESTLPLFSLWCKMHGLTAEYMLRLFGLKDGLCFYFLDRENQGHYTDFCSNGTPGLFLSGFQIERPISELLFTLLAQRSGVNVFHGRQVDFNGSTIRGGFQNNRVAINPGKFDGKPATTIDSSLLVDATGRFRQLASKKASLHRFEGWNYDAFWGYFTAPKDESNIPFRYYEGDHTNHLCFPEGWAWVIRLPSWEGSPIPNLMDMISYLLDCAEAGVPGDQIPSSEELAKMFDLKFRWVTSIGFAVRNDVKYPEDMSAYGTREAERKFNYFVEKYDLIKKFMSNFELVEDLYGPGTTWYIRKSLTYQSPVVSGPGWLAVGDACGFTNPLHCLHHGAGRSRA

SEQ ID NO: 27339 - protein, 429 aa, A.fumigatus
GAAPSSPVVKTVQRVGEATGVADSKPARARDDRGLVGKRLADVPRRSRSIEILNELEVAHELLDEVILFNKVVELALRLTGAVRGHVLWVLDIVADGEPDAGNPPELKVKHLGELLGAGDLVAGDTSLGAVEQVRDHVHQVGDGAALPGGETDDPGPALGEAQMVGVVTLVVAEGNVAFILGGREVAPEGVVVPAFKTVEGGFLGSQLAEATGGIDEKGGIDGCGRLAVELSGVDGNPVVLESAPDGAAVEVDLAAVEDIDATALGQQSEEQLADGTLDLETAEEETGGTIAAEVGVVALVFTVEEIEAESILEAEEPQHVLGGQAVHLAPQGEERERALPNLVAWLGALLDQGDVELAWLVLGSVNRVDEAMDTTTSDNNVGFLRDVCTCRVVGVEDLCIVEIVGGSTLSKGVLRGGLGHSHFGSDRC

SEQ ID NO: 27340 - protein, 76 aa, A.fumigatus
PRAVPHLRLAYVTTMYNMMARECAENQQHWLPLRESRPKNLGTWFLVTKKLMIYYLHYPNCKHKADPTARGDLPSE

SEQ ID NO: 27341 - protein, 137 aa, A.fumigatus
SKTSMQALLRRGTSLFGSTPSGSPKESGGIDEFRKAPSPDVLFPKVDPAVDGEECLHDCASCTVKYPAKFDVDYEDELYGHVNGWATHLLVATGKTDWVRDVADEKGSLMEAIEKGGLVPSNGDVVFSSEPPIRVVG

SEQ ID NO: 27342 - protein, 391 aa, A.fumigatus
  UNSURE (10): Identity of amino acid sequences at the above locations are unknown.
GRKSFLIPPXIGLILGRVLRILNFPFRPNSIPFCRPALPHPHPPESNTSDVDQDDKIRVLDAPAGNPSEDLNAEDQRLLDNWCNSTEQSLAHSKSKDRPWQAIIRREASRHPALRHSTLALSAMELASTSEAGTPQRQRHLQAAESHYTQATEQLPNILDSRTASGPNAAFSTASILFMCDLASSALAGEGSKSVFPSPDNQTPASQESPDPSPSACPSLQKLLDLFDTIRALLPCAETLNKVETGALKDLFTQGDPYHQLPSTYTLTILSMKNLNALSARSDPAHETAVYNDTIAHLDNSLEMLTKGGDPTTIALRWMFRIPSRYLDLVREKQPLALIIFAHYCAVLHHLRDRWWMGDLGARLLKEICRLLGSARMGSILWATDIVGIQT

SEQ ID NO: 27343 - protein, 135 aa, A.fumigatus
LCGFHFTGSEAVDAAMKLSHQYFAEENPDTRRTKFISRRGSWHGCTLGSLSLGDFKPRKARFKSILHPNVTHVSACDPYHALKDNEDLEMYVARLKQELDEEFQRQGPDTVCAFFLEPVAGTVRDSLCLIGLDIH

SEQ ID NO: 27344 - protein, 371 aa, A.fumigatus
SFPTSTLQRKIQTPDEPSLSRDAVLGMVAPWGLCPWETSSRGRLGLNQFYIPMSPTYQHATRTMPSKIMKIWRCMWLDLSRSSTRNSKGRDLTPSVHFSLSQWPEQYATLYVLLDLTYINRYEIQALGCVAAVPGYLKAMREVCDRYGALLVFDEIMCGMGRTGAIHAWQVDGVVPDIQLVGKGLAAGYGTISALLVSDRVVSGLKQGGGYFVHGQTYQSHPLGCAAAVEVQRIVKEYNLVDNCRKMGEYLGMELKLHLGDHPHVGDIRGRGLFWAVEFMEDKDSKTPFDSNLTLSKRLQTKGLEKGYDICLFAATGAVDGWNGDHFLLAPPYTVGKQDVDEIVSRVVKVIDSVFEDIYALRQQHPHHSGF

SEQ ID NO: 27345 - protein, 419 aa, A.fumigatus
PNLLQDVSLHVNDCLDGKPTANSAETHSNAPRQALSRSDRAAVPRPAQRDPFSSGGIKSRSAFSMIMAGNAEDAAWASAAAGEVASRGKQAYQRTCPFYKILPNFSICVDAFRYGAVEGCNAYFLSHYHSDHYMGLTSSWRHGPIYCSRATANLVRQQLKVDPKWVVDLPFEKKTEVPGTNGVHVTMIEANHCPGSAIFLFEKQMGSGPSARVQRILHCGDFRASPTHVQHVLLRPEVDDPTTGQRRQQKIDVCYLDTTYLSPKYAFPSQEDVIEACANLCVSLDQNPEQGVGQSLLQKESSGAGKVMSRFFSAMSGSRGNSDKQAAQAQGRLLVVIGTYSIGKERICLGIARALKSKIYATPAKKRVCECLEDPELSSLLTDNPAEAQVHMQTLFEIRAETLADYLDSMKPHFSRVVG

SEQ ID NO: 27346 - protein, 80 aa, A.fumigatus
GKRASRKTSGPKLEQLRRSPKTSPTFPEKILWRQKEQFSDGVGNSWIDGLKDQPEKQITDEMMKNPKPEWGNDIPDTKEA

SEQ ID NO: 27347 - protein, 92 aa, A.fumigatus
HQGSVSPPISEAQVGDISLTTTFRYWYRMMFDEHFPPTCASTVERWTPTWSKQTDPSGRYGPQLIFGQRFSHADTSISRAIAIHAAKYEHIE

SEQ ID NO: 27348 - protein, 272 aa, A.fumigatus
ILARSVAPCGEEWVQFFYRHKPSDTVPDSLLGNDVCITTQPPPSIQHKNCRKGNSTVQICENNNKRSYEQPRMPRDSNNLPTTKRYITTHSTEGESVFISHSQIPEYIPSKPISDDGDIALLYATVSNPVSVDDEIDVQAYDEYLHTSPGLTTSLGTVLQTIDLHPGKTSPMHRTVSVDYGVVLEGEVDLILDSGQSRTLRRGDVSIQRGTAHSYKNRSDTEWCRMLFVFLPMQKLTIKGRDLDQEVYDEHYDHDTGSENESQGGNGNGKGS

SEQ ID NO: 27349 - protein, 248 aa, A.fumigatus
KDLSSPPSFPHGERSSWTLSSSQSLTRLCMWGNTAYRREMISHTGPSLEKSDSKIESHPSRPYGEDVAPYPKEDALQLNVGGRGATQRRLKNYQVTMIGFCGGIGTGLFVGTGAAYAKAGPAGLLLAYAVVGLVLWCVMQSIAELATLLPTAGSFPHWATRFIDPSVGFSLAISYGYWYTIAIASEVSAAAVIVSYWTDITPAVVITVGLVLILAINVMNVRLYGETEVLAGSVPDPLLLRMCLTAGP

SEQ ID NO: 27350 - protein, 142 aa, A.fumigatus
  UNSURE (111): Identity of amino acid sequences at the above locations are unknown.
VGFKGQARVILPTLSSCIECQLDMHAPRPAVPLCTIATIPRQPQHCIEWAHQIDWQEKRKDDPLTAMNWNISTGFITPLFERAINSTSTGVTFQMTQGVVQKYPSRYWLPXKAVLRNPEPSLEALENSLPPRNPLTWITFLI

SEQ ID NO: 27351 - protein, 121 aa, A.fumigatus
TWVSVSITIRLCVGLTPKDTIDISNLNRQFLFRQTDIGKPKAEVAASFVEKRVKGVKITPYVGKIQDKDEDYYMQFKIIVCGLDSIEARRWINSTLIGMVDPENPESLKPLIDGGTEGKVI

SEQ ID NO: 27352 - protein, 61 aa, A.fumigatus
PTRYGVCEEIAQTSGNPLCIVFSRSTTEYYGSILSSSRSAQYRATYVQVDLLVTSYYRSPC

SEQ ID NO: 27353 - protein, 208 aa, A.fumigatus
  UNSURE (204): Identity of amino acid sequences at the above locations are unknown.
SECLLRERDTSHRRSHVLKIDDSSLPSGTVTPQIHKMTDDKETPAEEEVVESLIQGRARRSTAGRHLSALLNAEADDELALLFEEVDDDNEFSIDAEEEAEEDDMALDSSSDDDEDQGPNARSDDLEGEKEIEKEAKADRQKRRAREDLRLKLARKKVKIDPSAVSAVSAVPAPRPKKKSERISWLPTVEDRPTRSLCTRRGEXKSHW

SEQ ID NO: 27354 - protein, 85 aa, A.fumigatus
SLRMCEQKLQPRIMAFAQLFEKKLNDHGSDDLSLTGLHSRCRSLSRPLPVKTITLEVESSDTIENVQSKIQGYPTPPSILAAEDS

SEQ ID NO: 27355 - protein, 76 aa, A.fumigatus
SADRRVHGPTPTKGAKGSEAAGLYGFGQSASTVGMNKSICATAMIIISNVHILRGDVFIILYSRQQLNKLHLDSAS

SEQ ID NO: 27356 - protein, 299 aa, A.fumigatus
ILTRVIQASSSKRTFIELEAEHKTQMPPYLSICTQVLRSIAEASGHQATSTMTSREALTVAVASVLLAQNQNEASKKIIAILLLHLACLKRLSLQQRRTASLEIPNEGMYNKFVRKFSRAATIMLQTNEWKGLNIIKSWGDLHDLFDGRLFRSCAAYYSVEKVAHLSSLITDDWHTVWTCLNHIEELGGPEVFFSQNFPYTATLQHEGRIFDDEHEDNQDDEEDEGDEEEGDEEGEDDETDGDEATNEEDEDMESKYALLPFENLTFDQHLASVRVVIEDSQGEYPERAFSPRSKQIHD

SEQ ID NO: 27357 - protein, 129 aa, A.fumigatus
VQDRTLLLLMDDTENQGISTQAASNIDRSKYQLAREIIYQHLKVHIQDQYPDLQVHRFPSMRSPEFHQHVQTYSVYFVMCHNGVLQNRRRLIDDTLRVICNMMTLGLDVAIINEIEWRDTKVRIFPLSV

SEQ ID NO: 27358 - protein, 103 aa, A.fumigatus
TPGPTVPGATGSIDFMRELRAMVDNINFLVILITLGNPKGNLLVTVWWISAVGEFNGFSIYDYLRRGFFAWFNKEWPRLFSWNSYLIKYLVMAIILDFGFAVS

SEQ ID NO: 27359 - protein, 109 aa, A.fumigatus
ILLSNYLSRHQSAFFSMRCLFLFLAAALMAPTLAISEPAWMKYLAGLDEPADAAEQINLNYLAHLADIADSVGVANPVSLDELAYLAKLAYLTDSKAKIQNNCHYKVFY

SEQ ID NO: 27360 - protein, 247 aa, A.fumigatus
ISAVEAKVPTPPLYLQICSSWYLPTNIKVCRPERQLACNIEPQPFCSSPSIHPMLTMAEASNGQRRDPSKVQAWLVGSGMACLAAAVHLIREGNLPGKNVHILDLHLGFGGEMGTSGDAQNGYFVPFECHPYFHGDCIKDLLSIVPSPGEPGKSMMDDIYSLEKNERRPPQDSGMTRAIKLGKLGPEVVHFRGIQVGLKHRLELMKFIMESETSLGAKSINQIFEPSFFETGFWTRWSTAYATQWHP

SEQ ID NO: 27361 - protein, 67 aa, A.fumigatus
NHTLYSWLSTTFTIPKGWEHQNVLLNFGAVDYEATVFVNGKQAGFNRGGYFSFYPGHHAICLLRRHE

SEQ ID NO: 27362 - protein, 79 aa, A.fumigatus
IVRNLAQSYFQADSIRLVFVHDPTDSGDYVIPIGKQRLIPAHIFYTPCSGIWQSVWIESAPANYITELDISAGMDGQGA

SEQ ID NO: 27363 - protein, 123 aa, A.fumigatus
RLFLRKLTAKVNVTAVSASGKSMPVDITVFDGSSDKKVAFHKGTSDQPFSFKVESPKLWSPDSPTLYNISVKMGADEVKSYTGFRTISKGTVNGILRPLINGEFTFVFGTLDLGNDPNVWTLN

SEQ ID NO: 27364 - protein, 71 aa, A.fumigatus
RTPPPMDLRNQRAFFMNSVDPTMMLPIGAPKPFEKQRLTLSNRPAYSGKLPAPETTASQSLAPSKCTLTPF

SEQ ID NO: 27365 - protein, 384 aa, A.fumigatus
  UNSURE (371): Identity of amino acid sequences at the above locations are unknown.
TALAFYAGNFLPSGHILPLKRSEGIEYLPWRALQPVSMGPMAGSVVGRVPAQQNSTCEVSSLQCSGRHEELIRKNTQGDTMTKPTPSMLEAICQTTLLDDVFEEDPVTNDLQAYVAERTGHQSALLVMSGTMGNQVAIRTHLVQPPYSVLCDHRSHIVRYEAGGVSSLTGAMVQPIVPSNGIHLTLEDIQKHAVLDEDVHYCPTKLISLENTLDGMVMPLAEARRITEWAHQNGVKVHLDGARLWEAVVSGAGSLPEYAGLFDSVSLCFSKGLGAPIGSIIVGSTEFIKKARWFRKSIGGGVRQAGVIAAAARVALEETFGPDPNGQKGKLRETHINAKRVAEMWTTRGGKLQHPVHTNMVWLDLESSGVXPNDLAEIGRSLAS

SEQ ID NO: 27366 - protein, 321 aa, A.fumigatus
HQELPQTDRPRRQVSYTVTQERFWLGKFPVNYRVHGLSVHALSPHNVPSSDPALSPWIPFFFVILYLVDFADYYPQLSANSDALDLANSRTPNPETWNSHSRHRSSHQSMPQNALNMFRLDQLGNSTSESHAQASNPARHIARHSLEATLLHSQEGGHGNIGPAVSSRPTSLQTSYSTNDVPTIQGDGFNPAITPPQAHAESFQQHNNTPGRIPSPIPLALSRRTPWQHDEPKPQNSLTQQTTLQASAPPFGPQLTAAAVTQNTVTPTAMTAFPAPFYGYGIQTYMGNPVQVNGQLQNFSPTAPYGAYPPYGNYRLAEGQA

SEQ ID NO: 27367 - protein, 73 aa, A.fumigatus
GVAARRSGDGDSNQLSRFTNFPLEHYRGELYTLCKDQHGCRYLQRKLEERNPEHVQLIFDETNMHVVELMTGS

SEQ ID NO: 27368 - protein, 173 aa, A.fumigatus
  UNSURE (166),(171): Identity of amino acid sequences at the above locations are unknown.
NLPHLHLEKHLSSNIVPTDPFGNYLCQKLLEFSNDEQRTALINNAANQLVKIALNQHGTRALQKMIEFISTPEQIQTVIQALRDHVVELVQDLNGNHVIQKCLNRLSAEDAQFIYDAVGANCVVVGTHRHECCVMQRCIDHASGEQRARLMSSPRGWKYQRGQKGXTRLSXFR

SEQ ID NO: 27369 - protein, 94 aa, A.fumigatus
LTDFLYPRIHRYSMPSTGLGSQIRPNIAAFSNTSGLDSFSAAKYLFHNEDDRATVTEEDRIPTPDIKSYLKLTDPDDKFPTLSRKSDSGLVSFQ

SEQ ID NO: 27370 - protein, 174 aa, A.fumigatus
  UNSURE (173): Identity of amino acid sequences at the above locations are unknown.
YHSSVPSTPCGRRQPEEPPRRPSEDTVAGSGGLPDLKYGTVLDELPQDWEVVPGESMGNFYAGNMAIMSADTNFFPASLPNDGLIDVVTIDGTISRLTSLKMMTEIPEGGFFDMPDVRIRKASAYRLTPREKDGYISVDGERIPFEPFQVEVHRGLGTVLSKSGHLYEAEGPXP

SEQ ID NO: 27371 - protein, 282 aa, A.fumigatus
STNNTPIRIGFYHSDRPLTQQALARNLSYALVPTLPRQTLHRFLRAFWITIGRDFHSLDRLRLDKYLYLIRCYVGVAFEIFLKGNKGEQQQSTHTNGASKKRKREEQTAAGKKKRSKADKEDEARDEADVEEGQDGEGDWAELESYMTIIEEGPLCPLNFDPDQPPADEKNPNYVPMPHGPDGLRYHLLDIWIDEIEKVLEFEEGETQDGSSRKVKGQVPMELLLRPIEKLRKESPFKPVRTRAAETLNDDRLVQWGFKTREVEEEDGDDDSEQEWGGFADD

SEQ ID NO: 27372 - protein, 558 aa, A.fumigatus
  UNSURE (368): Identity of amino acid sequences at the above locations are unknown.
KITRNAESRIRKGGDSSDLSFSLHRPISPAHLYLPSRPRPAMASFKSPYICLNCRLTSRLTRRNFAASARTLELLRPATAPKPTPDIKHIRQNAELYSKNSVDRNYPTHADYPYKIQELSEEARRLDQDLKAPRSRIKQLEKTIANLAASARQNGASSAIEEELASLRSEAQRLKDESHAMNTRRTTCTEEIQRLALSLPNLSSADTPVGDDPKLVTYINFDPQSPPEWVSRPDPSRSHVAIGTALELIDFTSSATTTGWGWYFLTNEGALLEQALVQYALSVARNRGWKVVSPPSIVYSYIAEACGFQPRDQHNEQQIWAIEQSDKDKSKPQRSLTGTAEIPLAAMYAGRDLDASSIPLKLVGASRXYRAEAGSRGVDTKGLYRVHEFTKVELFGWADTLPATISSDNLFTELLDIQTEILTALSLPCRVLEMPTTDLGASASRKRDIEALFPSRLRVPGSSSGSGSSSPDLESGWGEVTSASICTDYQSRRLGTRVRGGSAKESRFPHTVNGTAMAVPRVLAAILENGWDEKRKVVVIPEVLRKWMGGMEVIGEKS

SEQ ID NO: 27373 - protein, 141 aa, A.fumigatus
WSHQRPERVSMHLFSPGRDIETSFFSISELQLHSIRVRAGAAQLEPNHCNFESEFAIRNLGSINCIRITSKRNNLGRKYNRYMGALSKKGQTLLTCQNYVKTAIPYSLGDYYIYPLIGPSGAVITGHNSKPKDYLPMFTNP

SEQ ID NO: 27374 - protein, 93 aa, A.fumigatus
YVSIDPPLSSCKKEEQLTFASFDGFGSYPEHMQSSNMFKNIGRIGIEMYLLFQHHTTLDILRNVNTDIDLFTITGIGLAFCQVFRTSCCRRWR

SEQ ID NO: 27375 - protein, 574 aa, A.fumigatus
YAPSGIAGTSTLAGLHAQSAAAQRIAEPYAGQLPRTQQHQFPTQRPWTPTEQPGSQPHGPPTVYQGAEAVESRSPNPPASSYQPPPPQPVATPPHAAAQGQQPPWIPPNALEQDLERMRIISSPPPAYSSVSGSAAPQGYPNEKQRLSASMGHPALAASHPTTMATPTAAAAAPTVSPQDHPAFANEPRQQSPAGFSPQNGTSAGRQPTPVQNAPATSVPGSSTLPPASPPPLPEGWIAHLDPNSGQYYYIHLPTQSTQWEFPKGPTPLNLNETPLSPVGSVYSSHPLASPGFSTFGKPLASPGIPLTPGLAPGYESLQSPVVTGFSGPPPSSGVDLYKVAPTNGVYFGPYLRYTNMDLERGIWLGSILLVTDAAQPPTIHIHQSVDLSPNPRQLKPMSIAVHQRWTFYKYEVDLRMEESGPAKWTYAITSHLGCTRYEFLVAGRYETNWRFVATSGNDFSLNVNANERSRLGGIGFMWKDIMQKHIEIGGFHAQLCCGGQIYADRMWKEIPSLKQWLAISGKEARKNAPWTAAHEEDVSHAYFHYYTSHFDQPYLRESFAQVPYVCQLDDHDM

SEQ ID NO: 27376 - protein, 78 aa, A.fumigatus
AVTWDCEPIHAKCWSHARSQRVRTLLFFFFFSITVGARIADMYSYFHDASTYERPEGFEFFVSPRSGGKITCSAVFPG

SEQ ID NO: 27377 - protein, 70 aa, A.fumigatus
SPLLIKITTYTILAGFPFLALNSSLEKGHSIDIAGWVNILQKTGALRSETTVRLLMRLTYISYKSYISHQ

SEQ ID NO: 27378 - protein, 256 aa, A.fumigatus
  UNSURE (34),(86): Identity of amino acid sequences at the above locations are unknown.
SVAPTIQQAPPPLAIIGPHRYFSFLVRTPPKSNXPRLRKQASSGAVKVLSGLLVVINLSDRSARRQLFFSGAAAMSACMFATAAVXKSSPPAPASPGSSQGSTTALLTPAALATITLIYLDITAYNLSWGPLPWPCVSELFPTRIREPGVAVGVGAQWMFNFVWSFSTPYILSKIKWATFVLFGGLDLLIVGFVWGFVPETRGKSLEEISALFEGNSSLLSSSRGTEGHYEAGPDGDGVNGKDGSILPVAAGSASS

SEQ ID NO: 27379 - protein, 292 aa, A.fumigatus
QLNIELASTLENSTLFEKNPEYRKALAVVSVPERVVQFRVVWEDDNHQVQINRGYRVQFNSALGPYKGGLRFHPSVNLSILKFLGFEQIFKNALTGLNMGGGKGGSDFDPKGKSDNEIRRFCVAFMTELCKHIGADTDVPAGDIGVTGREIGFLFGQYRKIRNQWEGVLTGKGGSWGGSLIRPEATGYGLVYYVDHMIKYVTKGAESFAGKRVAISGSGNVAQFAALKVIELGGSVVSLSDSNGSLVVNGEGSFSPAEDRNHRATQCRPQAALRCCYHRSLWHQVQVSSKAA

SEQ ID NO: 27380 - protein, 95 aa, A.fumigatus
SSMSPRVPSPSPASASPSPALVMSPSSLPSRSSSSAVPSSPCPTAMAPWLSTAKAASPPPKIEIIAQLNVDRKQLSDVATTEVFGTKFKFLPRRP

SEQ ID NO: 27381 - protein, 211 aa, A.fumigatus
GRLGRNLNLVPKTSVVATSESCLRSTLSCAMISIFGGGEAAFAVDNQGAIAVGQGDDGTAELDDLEGSELGDITRAGDGDALAGEGLGTLGDILDHMVDVVDETVAGGLGTDQRTTPATALAGEDTLPLVADLAVLAKEETDLTTGDTNVTGGDVGVGTDVLAQLGHEGHAEATDLVVGLALGVEVGTTLATTHVQTGQSVLEDLLETKEL

SEQ ID NO: 27382 - protein, 127 aa, A.fumigatus
WLSLDRTGANDRDETRGCLVEKSSSEKQAPRLRVKVRLYFGVEYAPGINKAPTRLVPEASTKTLTNRTASWFGGWGHPWNINVTDQLSVYNSLRQTGFNVFDVFLRKKVSEYLLPFHPIRSTLICGA

SEQ ID NO: 27383 - protein, 69 aa, A.fumigatus
PLCRIVTEHANGILLRTNYGRDTTTYMKDHDPVITDRLTKIIVIRLVEESLLLQCIASLQLLGDISPSW

SEQ ID NO: 27384 - protein, 146 aa, A.fumigatus
LLTQTLPALMAFDTRIAVLTFLVWTAEARPVHEISGGEPAGWLDTLTIVGAVSKLDGLLLGLELLHCANRAEDLLLNNLHIAVDIRKDSGFNEISLVTKAFSASNNSCTRLLSVLDVAHDAIELQLRNLRSLERLGIEGIADFVLF

SEQ ID NO: 27385 - protein, 125 aa, A.fumigatus
RLFKRRSSALFAQCRSSRPRRRPSSLLTAPTMVSVSSHPAGSPPLISCTGLASAVHTKNVNTAIRVSNAIKAGSVWVNNYNMIYPQAPFGGYKESGLGRELGSYALENYTQVKTVHIRTGDCPFP

SEQ ID NO: 27386 - protein, 68 aa, A.fumigatus
SIPRHHSVATRNRVLAVNSALMLLRTILRSRQYTSGQAIARSPEAVTQCAFEGKYSDLTNSFVYHVQA

SEQ ID NO: 27387 - protein, 207 aa, A.fumigatus
ALKWASFGIYFNHGQCCCAGSRILVQESIYEEFLARFKERSEQNKVGDPFDPQTFQGPQVSQLQFDRIMGYIQDGKQAGARVVTGGERLGDKGYFIKPTIFADVNGDMKIVQEEIFGPVCTVQKFKTEEEAIKLANSTNYGKCIQPPSWFTPANLMHRSCLCCPHQERQYRNSCIKRHQGWKRLGQQLQYDLSPGTIRWLQGIGSWP

SEQ ID NO: 27388 - protein, 693 aa, A.fumigatus
  UNSURE (680): Identity of amino acid sequences at the above locations are unknown.
AVPSSPVVKTKLGVITGDQAVGFFMKAQLPEEVLAQIWDLADIDADGQLTKDEFAVAMYLVRSQRTGKEPLPQTLPPALVPPSMRRPTTAQAVPPPPPSVRSAADDLFGLDAFSAPPAPAAPSQVPQSTGGSNTPFQTPGSPTSRASPPANSTTFKPFIPTSSFGQSLQPQITGASAGAPPPVRSPPPPSDDLLGDNDPEESSKLTQETAELANLSNQIGSLAKEMQNVQTKRTSAEHELSQTSQQKRDFETRLAQARAMYEQEVKNFKALEERLNASKAETKRLQQEYALIEGSRQDLQTQYNQVSAALTADQQENANLKEKIRQANAAVAQLKPALEKARSDARQQKGLVAINKKQLSTVEGERDKIQEEMDTLSKEQPQGSDESAAPALASPALSTASQNNNPFFRRTTTASSDGQGASPQVSSEQQRAFDSLFGTAFAPPTTATPPPPTSFRADSRQASLHSPVTSGVPTPSVSPPPSVGTVPEPPQSRQFTPNVLPLAETQSVTSSTKPSPPGSRFGGPESSTVGTPAPAGATEIPSASPEHGEVRSPFEEFEESKRFPEVPVVSGETARADTSATANENQTAAKDPSFDELFGGPAHQRSRSQNANDFEEAFAAMKQGAGANQALMVQLLLRSPSSRRSGSSPMMTMTTTALIARHPWGFDEHFPPDWFPPKNXQTLKTGPDGTHLN

SEQ ID NO: 27389 - protein, 240 aa, A.fumigatus
APARIFGSSWTIPRRLILGTGMKDILPETPGLDEAWGKGVYWCPWCDGWEHRDQPFGILGSLVDVVGSVLEVYTLNTDIIAFVNGTQTPKAEAKLAEKYPNWKKQLEAYNIVLNNETVKSIERVQNGEDVYDDQGRQFDIFRVNLADGSSVTRNAFITNFPSEQRSSIPKELGLKMKDNKIDTNIDGMRTSLPGVFAVGDANSDGSTNVPHAMFSGKRAAVFVHGMYLFFPYRCRTWADY

SEQ ID NO: 27390 - protein, 142 aa, A.fumigatus
NWLIFVTRGVETWPSIHFVTAILGVDVLATIFCLFGWFTNETMPTKPADSFVETRNGWTDIVTVVRVWGFSLGVEIVIALVYYMLNKFKWLENLGRAKRDKGDIKIQNLLGHLARLTVEYDQPGQPKGRFFLTSSKEEEEAE

SEQ ID NO: 27391 - protein, 181 aa, A.fumigatus
RSAQVEQSGTYWYHSHTKGQYPDGLRQALVVTDPKNPYIGQYDEERVISLSDWYHDQMPTLLKSFISISNPTGAEPVPKAALMNDTQNLTVAVEPGKTYLFHLVNVGAFASQYFWIEDHTMKIVEVDGVWTHASEANMIYIASAQRYSVLVTMKNETSQNYAMVGSMDTVFASSLQDDAQR

SEQ ID NO: 27392 - protein, 73 aa, A.fumigatus
DLFDTLPESLNYNVTGWLMYNDQADKPTPALVSAFEPYDDFNLVPVDGMALHKEADYTVTLDVTMDNLGDGAN

SEQ ID NO: 27393 - protein, 103 aa, A.fumigatus
SRYVSSLAASSLQQEADHLDPPLGVWLFHCHIEWHMDSGLAATFIEAPLDLQKTLKIPEDHYQVCEASGNLTAGNAAGNTNDLFDLTGQNVSPAPLPAGFTAN

SEQ ID NO: 27394 - protein, 92 aa, A.fumigatus
FTVIPDGHFERLVIGINGQWPPPVLSFTRGDRIIAKVHNALGNETTSVHWHGFFQNGTNHMDGPPSVTQCDIAPGYTFVYNFTVSIGCGRSS

SEQ ID NO: 27395 - protein, 153 aa, A.fumigatus
RWIIWETGPISKSNTHTARLSGSKELGLTFHSAFFNGITYVMPKVPTLYSVLTTGSAATDPAVYGYNTHPIVLKRGDIVDIVLNNDDAGKHPFHLHGHTFQVIARSEENAGHYDPSNHTTFPSIPMRRDTVIVRPQGNFVLRFQADNPGMCLV

SEQ ID NO: 27396 - protein, 241 aa, A.fumigatus
SIRLANTKDRGFWLFGRLYWDVDPYSYLALRVKSDGRRYTVNIQTDSIVETDIHQHRLYTRHHRVRNQTSRDDLPSYPSQAVESPELAETLFPRGIPSSLSDVPPESTIMYSSATTSGGTGWETILLPFHSFVRTNHGLVVEPQTSLLRQRVKSVGIGLTDRVDGPYDLRIHRIWATNGISEEEFEDEKRICGADALPIDEGVRTGWRGDSPSDHPEDKGSQPGGGGKTKGLKGLRSEWEQ

SEQ ID NO: 27397 - protein, 393 aa, A.fumigatus
VALAIVVTFLYLGASYFGMKYLRRMGCSPKYLPGKYLKDKWNRWDPGKFYNQVSNDIRNGSATGAEATEMITARTTNPIHRDASIRSVATLPAYSANPKPEERVIAREGERDGMDTVIEFPETAEEEEARREELMASLYEIRQRRREELAEREARRQARREARERGDRAQLELLRQQDRLRARQRARSRSSTNASNSASNLATALAEHQSRGRGRRIASVNYADVGYVRHDGSRVRATSPDSDRRPLLSNGPSGSFDASNRSSMVDTPSIHSRGESYSSASTGTVDPSALTRVHSQTHSTASTLPSTPGAEEADVGVLSIPPPEYDHLDWGEAPPYQSPVEERNENTAPLRELTVVPTIHIDAASPISDNFPAAAPHESREQHDSRAVPSVTR

SEQ ID NO: 27398 - protein, 79 aa, A.fumigatus
  UNSURE (26),(33): Identity of amino acid sequences at the above locations are unknown.
MLAARSLVVVLHMVDKNCLGGHSNSXSTRSSKXIHNSSSLLFFRPAEFKLTSDHQPHYFAADGNNLDFINCIPSSMALR

SEQ ID NO: 27399 - protein, 181 aa, A.fumigatus
YHHRILIILDLEVLQELGEAEKIGEPRPLENKLEEDEKPQPTTISGGGFYGSKVQNQRGEPRVQPARSSLTSSHATIYPIEAISPYSHKWTIKARCTSKSAIKTWHNRNSEGRLFSVNLLDDSGEIRATGFNEQCDLLYDVFHEGGVYYISSPCRVQIAKKQFTNLNNDYELTFEKDTVVD

SEQ ID NO: 27400 - protein, 88 aa, A.fumigatus
KNSNQYGGYVFPCSTKLPSFTTVIGGYNAVVPGEYINYAPVTDGSSTCYGGIQSNSGLGFSIFGDIFLKSQYVVFDSQGPRLGFAPQA

SEQ ID NO: 27401 - protein, 71 aa, A.fumigatus
LLHLTRCANLTREMVEKVLQYDNQSSTDYSTPVVDSLSEDGREIEPKLRRKLDIRIMPVIILMYLLNFIDR

SEQ ID NO: 27402 - protein, 116 aa, A.fumigatus
SHPQSYGRFKLTLARSNYTAARLQGLESDLHLSGSEYQVGLSVFFVGYVLGPIPSNLLLNYLGRPSAYIGLFGAAWGLVTLLTSQVKGYGSLAACRFILGVVGKPRVFLLGDWGLD

SEQ ID NO: 27403 - protein, 101 aa, A.fumigatus
PTQKWYTQRELGVRMTIFFSAAHIANAFGSLIAAGILNGLDGNRGLSAWRWLYIIEGASKYTCSDDRSTLTNHGESPSSSASSPGTYCQTFQRTGVHYPPR

SEQ ID NO: 27404 - protein, 60 aa, A.fumigatus
ISLGKGFKIMRKTTHSCYLIILPFIVQVTGAVNLYSAMNNLSDSIIRQPRLLSTICYLLC

SEQ ID NO: 27405 - protein, 65 aa, A.fumigatus
QGLTHTAVTPLDLVKCRRQVDSQLYKSNMEAFRVIRNAEGIRGVFTGWSPTFFGYSVSRWFMARF

SEQ ID NO: 27406 - protein, 151 aa, A.fumigatus
SQHSLYKGLYPLWGRQIPYTMMKFASFETIVEAIYKKLPRKKEEYGKGAQTAVAFTGGYLAGILCAVVSHPADVMVSKLNANRLPGEAFGAAIGRIYKDIGFMGLWNGLPVRIVMIGTLVGPPFARVCGHELTTFCTDWIAMDDVSFSLQV

SEQ ID NO: 27407 - protein, 115 aa, A.fumigatus
  UNSURE (6): Identity of amino acid sequences at the above locations are unknown.
SIPNWXTMFPFDSVILEAFNAQNLLNRPKEPKQAGSAALIRREPFPAWSVIDESKRKADAFAKEAAREFDVVSQKAQAKTGKIEPWTPKYYAACTVGGLLACVGLRSDIVYLIYI

SEQ ID NO: 27408 - protein, 89 aa, A.fumigatus
QGAKAQGAFKYGGYEFFKKFYSDLVGPERAHKWKTSVYLAASASAEFIADVALCPFEAVKVRTQTTIPPEFKGTFSGISQVIGKEGVAG

SEQ ID NO: 27409 - protein, 125 aa, A.fumigatus
LFIVGTCGCFGSDETLACFVAGNALNWDGLYHAELQARHDAFNSTLETLLNFGICMYLGAVMPWDQFHMPDTTGITVWRLIVLGFLILLFRRMPAILLGYRFMPKVCRNWREALFMGYFGPIGES

SEQ ID NO: 27410 - protein, 136 aa, A.fumigatus
CCSTFPFLDNHGMKLIVRSMQYHQIVIFTHRPWVSKNYIQPRSPRQGPGYHHARRMCIESSTAIARILHIYEKHYTFRRMNNQVVAIIFSAALMPPYMNLLEHILHPAKNRCEKFPTATAGNGWRSLKLRLLPLWE

SEQ ID NO: 27411 - protein, 85 aa, A.fumigatus
QNHRCAVGSAFEARYHPTFITFPKSLSEFFADRAKALLEIELDTPCVATVQALVILSCHEGASNRDARGWLYSGMWGTKQMDGRS

SEQ ID NO: 27412 - protein, 101 aa, A.fumigatus
NVTLNEIATTTYGENVYIVGSISELGNWDTSKAVALSASKYTSSNNLWYVSVTLPAGTTFEYKYIRKESDGSIVWESDPNRSYTVPAACGVSTATENDTWR

SEQ ID NO: 27413 - protein, 79 aa, A.fumigatus
SKVWPSRCGGGIYWDYTHTYVNAIANELFLSLAAHLANRASDKEYYVDWAPTRVGLVPRQRDDQREPHHQRRADRKLRE

SEQ ID NO: 27414 - protein, 152 aa, A.fumigatus
  UNSURE (138): Identity of amino acid sequences at the above locations are unknown.
PDSWTYNQGVILGGLAELYRACPNATFLESAGEIARAAIAALSDSDGVMHEPCEPSSCTGDSTQFKGIFIRNLRLLHSVAPDEEYSRVITASADSIWVNDRDANNQMGVNWAGPIERVDASSHNSATDALVAAIGLSXPVWWRPWERQRCFE

SEQ ID NO: 27415 - protein, 319 aa, A.fumigatus
PYVVCPLFSQLSVSPSLMVWFALIIPLPWNQSHSRWSPVNIILLVRSAIRQVCCEREKQLVCNRVDVCMRVVPVDASPASRRPHLTLNPVIKWHSTDHRATHQFVEHSLRKIKILRSASDIERRDPRQRPPGIVVVRAIQPLRNINPCAPPTHRLRAMMLNHPVVRVIPPSRRGVRSRGHRKRILKDPDRNLAHRVVHVRQVRNNGHTAGPVPPAAGIPDAAGGVVPGLQRFEGRFRACCRRYSRDRGREDWKDESGAHFVCVCVCVCVCVIVDLQGRASSFKYTTRNADDVSLRKKGSECTTDTCQGWGHSFLERYVP

SEQ ID NO: 27416 - protein, 76 aa, A.fumigatus
GAPRNAVPSSPGVNSVSHDSTGLSEGAQRCVPAGIWASERGVTYHLFRGAGHSVFIKKPREMFAYVRDVVVAQASG

SEQ ID NO: 27417 - protein, 62 aa, A.fumigatus
  UNSURE (39): Identity of amino acid sequences at the above locations are unknown.
NIFSKMRSSSISSKPVSGLIRGTTDVGMGGNVSPERGVXSDEGTDELIRLDLLLDRLRVPQL

SEQ ID NO: 27418 - protein, 82 aa, A.fumigatus
FLVRWVYLGGPIIFICRDFSPYAPGESKYVQPHSRHSSKVYELVRLCDSSRSTYITITIFVSKRPRLANTRITLAQRSQHKD

SEQ ID NO: 27419 - protein, 93 aa, A.fumigatus
LTKRCLDHHGLLDTHIPNHRMQYTNVPQDSPTLILKIMTSCPVYLRITCSAYEQLPFTHATGVKIPVRVLPVRCATGLVPGSLQEDVAFDTII

SEQ ID NO: 27420 - protein, 235 aa, A.fumigatus
RQAWWPSMPSRVPRQPSYQHVVSSPAPQRSIQSNNQHDLMQGGLMIQFDSSFDGSTSADPSFSSVVTSAPMPQENQNMYSHIPVTPQKYMNLSAYATPPVQHTSRSPSLSPRGRGSPTQGSPLRNEASTKTSPHRRGYHGRKLSSQSMNTPKPVKGPNSSSPGSGSNKSLTVSFVNFTPNDSKKILTGVAPSGSSKTKARREQEARDRRRKLSEAAINAVRKAGGDVEALEAVLC

SEQ ID NO: 27421 - protein, 156 aa, A.fumigatus
GPSSPVVKTLGKLTERFTAQWHQWLRYVRADPPSLEEQQQDVIRQIQIKKLAQLADMRWASKPSYLDKPQTQQPGPATRTSDATLHPPMGAVGEGPKSHNAISGAEATKTTGTTTSAPTPTPDVTSRAKEDPWAKARTSDGENWQPESWTPSSSRR

SEQ ID NO: 27422 - protein, 184 aa, A.fumigatus
RPEAQIKELQNLLAKTKFSSTMWSRKGFKTRTDSSVRSALDLLCLDGVDIDTLIPHIESPSGMAYTPSSFDPIIRTRVSIEGRYAPYVKRQEAMARKFLQDESLILPPDLDYSKVQGISTEERQALERVRPVSVGMARRIEGVTPAGALRLLMHVRRAMDASKESSLDADALEGSAESVLRGSV

SEQ ID NO: 27423 - protein, 354 aa, A.fumigatus
  UNSURE (4),(5),(13): Identity of amino acid sequences at the above locations are unknown.
FFTXXDGAAMRKXPANARLAAEISENVMVVDESLVPPWESAPLNPGTQPENALYCVFTSGSTGKPKGFLMDHRAFCTCALGVGELLGLNGASRLIQFSANSFDLATFDHILPFLCGACLCIPSEEERKGDLTRAFNRYRATHAVLTPTVSRLLEPEKLTTLQVLLLAGEAPSREDIRRWASTVGLLNGYSPAEAGCITIVNPSLQESHPSKIGFPVSVVPWVVDPDDCNRLVPAGEVGELVLQGHTLARGYFGRPDQSKAAFIPTPAWVRQFGYETYGRLYRTGDLVRFDAEDESLVYIARKDSQVKIRGQRLELGEVEHALQQFFPRPQIVVVELLTAEGGHHGPKDPPSVPA

SEQ ID NO: 27424 - protein, 207 aa, A.fumigatus
LNGWDIDVLQDAINTCHDGGGDITKCEPITLQPDWVTDGCILERSINERIDGWLDELPGCNPIQPGPDDARPVTGCGAPTTIGEPLHYYTDLTGSHGWEWVGCTRDNVGGHRVLVGSTAEISDLTPAQCVEKCSAEGYQYAGVENAHECFCGNSVDQDDMPRVTPMGNCLWPCAGDSLQNCGGYGFIGLYRRRQGGCKNLEYPIVPH

SEQ ID NO: 27425 - protein, 137 aa, A.fumigatus
INTMLPTWLLSQTKETAASSLILQIPQTESLTGRYFIQSHNIPDGNDSQEWLCPCRLSFLQATPDASDDVAESTGARKERIPSREMFNLALGRHVFAGFGRTGANMAANSPNSPQLVLVNRGVSCEIFTTGLEGNAL

SEQ ID NO: 27426 - protein, 242 aa, A.fumigatus
AHSCHRGLPSQSLTSHLAHSFSIAHLIHMATKMGMGHTVKCAFRLTSLLKKAERSFHQKGKAVDHSHPAVPSLTLPDIDCSDHGLRPLCKEMGMDAYNKDTFSDSDSDSDTNTDTDTDTSSVFIPDLAVRAKPVDADADADAVAGSSSNHPHNGNRKRLVRIVSFKSIAHNRSRWSSSQERELAIAQHELARCQKAWSSEQELWLEYVGYQLTSDTVVNSHLPFFFFLFTSWPTSSRHGADD

SEQ ID NO: 27427 - protein, 87 aa, A.fumigatus
YTLSVGLSARVVRPATVVEEDHRGHEQERAGPQQHPMPCIAKHIPARLRAPVQLPRDLLVAPDHNKRPVARRDHDITRRNLGVGRPV

SEQ ID NO: 27428 - protein, 488 aa, A.fumigatus
  UNSURE (461): Identity of amino acid sequences at the above locations are unknown.
GPSGSLLCQVGVDSFQPTVSTTQWEDSGRRQLSTYTSDQIPTFRRRVAKGLCRIDLHASRLRLGRQDTRRGRLSSNKRVLQVHMLTLMVDSQRIPPQLTIPLLEVCDHLELPPVATYAAVCLWNYKPIFPDEPPYDLDNLACINTLTGSLDERWFYLVSVGIEARGAPAIPLVLQAISAARTGNSRVVTECLQSIAEILDQIGVLLERMYEHCDPYVFYHRIRPYLAGSKNMADAGLPNGLLYDDGSEEPEYRQYGGGSNAQSSLIQFFDIALGIEHRPTGETRPASTPSEDEKEGVTGAPRHGFIQEMRTYMPGPHRRFLEHVSAVANIREYVEPRRSDKALCLAYDACLAMLRAMRDKHIQMVSRYIIIPARDARNRTPETSNARRPSITMNLANVRPGRKKLRGTGGTALIPVLKHALHETGEPAIDPWARPMLVNGPAEPSFPALSPWASIRNGPLXLVGLSRELHRFMILTEGTANWYPDSGF

SEQ ID NO: 27429 - protein, 115 aa, A.fumigatus
ILPTMLPPIPALADYGVSPDHGFLPPEPPLEALPDPYYAKWEWIASNLQSLLHSGRIRDVVNCLPILQTRYLHSEDEWRRAYVVLTFMLHGYVWGGKTPEEVGFLLTSESCRCTC

SEQ ID NO: 27430 - protein, 87 aa, A.fumigatus
WRGSFQPRGEDPTDVRSGYDGSLWAESSVVIGEPLLELSSELTANSFFGTVQSVVDAGSRKSYPLPHGGKCPPRGEFLLFILQQSTE

SEQ ID NO: 27431 - protein, 138 aa, A.fumigatus
GEKVQAVGVCCDKVIVVQRLPASPNPIIPGRNGPQPPGRSSLSTRPFPPSSLPRPGSHPGPAPGPIPSSFTRTTWSRSKSRAKSHKMISNPASIRITPSIRSSHSSLAIRQIVSARRFSSRIRSPFPSSSASRSKMRS

SEQ ID NO: 27432 - protein, 146 aa, A.fumigatus
RQKDKEPELGGWLHTYVAAKDLRLVYIDGMSAAKSSNGTLDSQDRILLRDALDDGNGDLMRDEKRRAETICRMAREEWEDRIDGVIRMEAGFEIILCDFARDLDLLHVVRVKLDGIGPGAGPGCEPGRGKEDGGKGLVERLDRPGG

SEQ ID NO: 27433 - protein, 320 aa, A.fumigatus
ALVILSGDTSIAVCFLISPLFFCLAYLLTVKVMYQAYAVRPIGEEFLFNEGGFYDSSFALPNWAGKKYATDAYWEHAGHFKATNFYQDLFDRGLVDCTYGPPLTSFPFYETVAPMVEAIEEFTRAFVEAYYPDKTLMDVDNELQDWIIEATEAAKVIDFVPAPMREPEQLISVLSHMAFLAGIAHHALNGATVGEASGVLPLHPSSFNRPLPEAKGSIDSLLPWLHNETEALKQASLLVRFNRPLLDEQEGSLPYMFSGSSFLARTGAPIHDADRRFREKMWAISDEIRMRQFDERGLSQGMPFLWRSIDPRKIPYYLCV

SEQ ID NO: 27434 - protein, 206 aa, A.fumigatus
LNKAGGIQSLSSYAVIYENQWATTLPDGVASGMLTNWTQDLLFSMERLSINPYVVRRLHPRKDRLPFAVDDRVVQHLAAGSTLEALHRDGRLFFANHSYQAPYPKTPGRWTAACTAYFFIHPRSGAFLPLAIKTNMGSDLTYTPMDETNDWLFAKMAFEMNDLFHSQLYHLANTHDVAEPVHQAALRTMSARHPVRGYLDRRMFSH

SEQ ID NO: 27435 - protein, 593 aa, A.fumigatus
SGQGRASIEFGRSCAPGFPIRQLNVANVHCFQKRNGPMELEPGGGIRVKLGATPAEKLDSGEPGAQAGGGPLAVTTVKVPLKDAEDHAGQSPKRRRGDPRKSDIREQDATPTAGSPGHTPGPAGASGQKRKRGRPRKQSLNPDTVGGDKQVADSADYQDTRPVEPEMEAEQRWSPLNLAGDVDSDDDALPEGFMPADNFPEDNNMGQPDAAAWDRSSPRIHNERTYDTPDVTAVDQIYGQNHDEEPQSTPSKMPSPSRESQGFSPENTLHAGHTPRPPRSYPSPTSSSLGDDDRAVQVASRAHPEGSGQEQNTTRPTNDPTDEHREFDSIMESEGFSMVSLDTLPSVKQHGLSINSQSGNGALKPFLSREKMANPEKSKRKVSSLNLNPRKHSPDVEVGKESRFQAIEPQALPVSAEKRQSAPLLRESPVPAFVPKQRKPLSRLARIIRAGVALEGALRRPYEGAPVPTPGTPDLREQISSLEAPKRRLELLFSDLHPRLRRELRAGLGFAQELAKRRRKTEIERARQTASVETRLTGNARGATTTPQQIHSGTAVKDTPSTEMKRRLEEWQREREARSPGDPDGECQSSHCD

SEQ ID NO: 27436 - protein, 212 aa, A.fumigatus
KDKADYLYLLLLGRAIAMAATQDMHPLDLPEVKYIWGDFHDLDINNPSNSDDPTATLPFSFQLNILQPMRILEEMELDPYANLARYDTWVLNTLYAKFRGTASGRLSTWDGGPELCAVHPLWCLANHSCDPNVRWEWGGEITFRARTEAERAVWKGEGAPVRRSGEGIKADEEILNHYCDIGLDVKERREWARGALGGLCQCERCVWEAATA

SEQ ID NO: 27437 - protein, 210 aa, A.fumigatus
SRGRRRSISRGRSYSRSVSGSSRGRSYTPSYSRSRSPVPKSRRRSVSYSRSRSPAGRRRSSVSRTPPRRVRGKSYDSRSPSRSVTPPRRRTSYSRRDRSYSRSLSRSVTPPLRAVDARARGRRYSSQSLSPPRRRAERSVSPQRPPPGRRPRGDSLSRSPSPPPRYAREQRRRGNSSSASASRSPPHRDSNRRRSLSRTPPRRGRASDYL

SEQ ID NO: 27438 - protein, 274 aa, A.fumigatus
IETDLRRPFQPRGEDYDEFLQGVPRRETEAIAATITRHANRVRPHASYDGRGVECIIVGGYRRGKELSGDVDLVLSHRDESVTKNLVVDLVASLEAEGWITHTLALHMTTSNREQQPLPFQGDDDSGRHFDTLDKALVVWQDPHFEDGDDDDDDDDAETTAAGGGADTPEEGARQRRKRNPNVHRRVDIIISPWRTVGCAVLGWSGDTTFERDLRRYAKKAHGWKFDSSGVRERTSGGQVIDLERGGETWEERERLVLEGLGVGWRPPQERCTR

SEQ ID NO: 27439 - protein, 119 aa, A.fumigatus
YGTIPRLFTSPIFYLMAVVLPCICLLRDYAWKYAKRMYYPQHYHHVQEIQKYNVQDYRPRMEQFQKAIRKVRQVQRMRKQRGYAFSQADEGGQMRVVNAYDTTRGRGRYGEMTSSRTLV

SEQ ID NO: 27440 - protein, 79 aa, A.fumigatus
CLPGGGHWGCVFCAVLRLLPGCLLHPPRLSSRHHHHHHHHRRPRNADPARRQVPYPGCRSVCPSHHRPGKVEAAVRGSR

SEQ ID NO: 27441 - protein, 181 aa, A.fumigatus
  UNSURE (7),(12): Identity of amino acid sequences at the above locations are unknown.
RPLLVLXCRFFXDMLRSFYLIASRAGPLLMGDIMAVLAECRNRQDCGIDRWGGIRHYTGELVRWEEEKWEPYHWAALDRMPDDVSINVAIEMPWGYGGCPAFSLRRVYGTERFLHEMILHEMIMDQGREYQWAETSSGPQYRPVNKSKYRANLLAVKEHRGRYLSTCSTVFRLLSEVNQPG

SEQ ID NO: 27442 - protein, 61 aa, A.fumigatus
  UNSURE (24),(34),(36),(42),(52),(61): Identity of amino acid sequences at the above locations are unknown.
EGIDVPEDRVRERWIYSPSGLVFXRVGYTGEIGXDXRNSRLXRADGVEACVXTANYCEATX

SEQ ID NO: 27443 - protein, 156 aa, A.fumigatus
EWAYYVFLVAGWFVAGTWGVGYLLQLLLGSTEYVSCNQFTVNGMYQCLIVCVCIVFTSTNQKYHCKTMKPTSQTSLNSAEIYNSKKSHAAINPFTLALKKQQLGGTIPGYWIFWHVEGFHNLPIKIVIVFCYCYSPRAGRMDLQALYTEKGKRKDY

SEQ ID NO: 27444 - protein, 63 aa, A.fumigatus
TFIDHFLDLLNIRQGFFDYLQFLFNVARVGLGIKKCLWYTRTEKFAIILVQLYLSIPNSELCR

SEQ ID NO: 27445 - protein, 120 aa, A.fumigatus
QGCSTTTGRSPQPAESRRTSPSWYNPNSGGENQKRCFGATWCHPQVKSEWTLLCATENLTCGVSTMVSRQGVVNAKQYQLLVCLHVVRPTSITASYSDYLAMMVINRLLWANTPDTFGFF

SEQ ID NO: 27446 - protein, 86 aa, A.fumigatus
AEKARLNADKAFKKELYHYLRWALSAGAPGPGIPETMEILGRAESLRRLQEARELTAEASSVRVPKRTQSQQSEDTTWMGSLAPRP

SEQ ID NO: 27447 - protein, 64 aa, A.fumigatus
AGNIRLPMKHQKQMRRFLQSRPPRAIDIMLSHVKQRNSKILRVFEAAGDAVTQDKDFLGLTKEW

SEQ ID NO: 27448 - protein, 447 aa, A.fumigatus
  UNSURE (109): Identity of amino acid sequences at the above locations are unknown.
KFHESKHIWYSPKAVYSGILTDFFLQYGVLICITCHDYRKQDVVLGSILFALVPCHLFLAYIIELVAAQQSKKTVGRQKKDLSTEEREREQQAFRSTWRYTAFFHTVNXTLCLAVTSFVVYFYINHPGIGTICELHAIIVWLKNCSYAFTNRDLRQAMVDPSAESALPEIYSTCPYPRNITLGNLTYFWLAPTLVYQPVYPRSSHIRWSFVAKRLAEFFGLAVFIWLLSAQYAAPVLRNSIDKIAVMDIASILERVMKLSTISLVIWLAGFFALFQSLLNALAEVMRFGDREFYTDWWNSPSLGAYWRSWNRPVYLFMKRHVFSPLVGRGWSPFAASFMVFSLSAVLHEMLVGIPTHNLIGENLILFANDKSGITDGHIGVAFAGMMFQLPLIAVTAPFEKVNDALGKIVGNSIFWVSFCLVGQPLGALLYFFAWQAKYGSVSKIHV

SEQ ID NO: 27449 - protein, 73 aa, A.fumigatus
LSLFKSLVMPFRLTEAPITFQQFINNTLQDYLNVFYTTYLNNILIYSKTCTKYITYIHSILQKLREASIYTKI

SEQ ID NO: 27450 - protein, 161 aa, A.fumigatus
KTDQIWYLDALTTQKGAPWGLGSISHKGQASTDYIYDTSAGAGTYAYVVDSGINVNHVEFESRASLAYNAAGGSHVDSIGHGTHVAGTIGGKTYGVAKKTNLLSVKVFQGESSSTSIILDGFNWAVNDIVSKGRTKKAAINMSLGKIDPSCSFNWTESNGG

SEQ ID NO: 27451 - protein, 175 aa, A.fumigatus
WIMTGGGYSYAFNNAVENAFDEGVLSVVAAGNENVCIPRFRKVTNEHCRFGRTNMLCQSDASNTSPASAPNALTVAAINKSNARASFSNYGSVVDIFAPGQDILSAWIGSTTATNTISGTSMATPHIVGLSVYLMGLENLSGPAAVTARIKELATNGVVTNVKGSPNKLAYNGNA

SEQ ID NO: 27452 - protein, 191 aa, A.fumigatus
ILGVFWRLTPFWAISCQSFSPSPSPPPYYSANMPSDSEDVFEENHVDGTTSEEEEDGPSGPPVATDLYEVLGVKEDATQDEIKSAYRKLALKHHPGNLLEISAQTTTGDYWIVSLIESTKTRLLPTRKIKRIPSFSRLPSLMRSCRTKSAAGGLIAPAALRKRPPATKISTGRNSTETYTRTRSIRRRLTN

SEQ ID NO: 27453 - protein, 157 aa, A.fumigatus
INKDKAPADQKDQAHSKFQQIAFAYAILSDEKRRRRFDRTGSTAEAAAGDEDFDWTEFYRDLYSNSVDTEAIDKLKKEYQGSAEEEKDILEAFDRHRGDMDRVYESVMLSNVLDDDERFRATIDKAIAEGKVEAYKKYTDEPAKKVFTTGLKGSCKP

SEQ ID NO: 27454 - protein, 69 aa, A.fumigatus
FHRLESLTHIAKQTYHQQLFIIPAAHCTIIYLSTILLIVKPYLTSSQINCSLPTTRGMTASPHLDYLRQ

SEQ ID NO: 27455 - protein, 135 aa, A.fumigatus
YDLRMIRHIEVDAQNNGNLFFWHYQNRHIANRQRTVIWLNGGPGCSSMDGALMEIGPYRLKDNHTLEYNNGSWDEFANLLFVDQPVGTGFSYVNTNSYIHELDEMSAQFITFLEKWFQLFPEYEGDDVGALIFSA

SEQ ID NO: 27456 - protein, 69 aa, A.fumigatus
VPSFSVPDDLGANLLTCHQIYIAGESYAGQHIPYIAKAIQERNNKIQNDQSIRWNLRGIVIGNGWISPA

SEQ ID NO: 27457 - protein, 512 aa, A.fumigatus
RRGWTRTITVHITPGGHKSNRACCMVKVRTAEDQDSVTQIGNKLLVNAQDALILISAQTTYRCDDIDKKASSDLETALLHSTDEIWERHVNDYRSLYGRMELHLSPSNCDMPTDKRIKNSRDPGLIALYHNYCRYLLISCSRNGDKALPATLQGIWNPSFHPAWGCKYTININLQMNYWPANICNLSDCEMPLFSLLERVAKSGEETAQKMYGCRGWVAHHCTDIWADTSPGDTWMPATLWPLGGAWLCVHIWDHFRFTRDKEFLERMFPILQGCVQFLLDFLVEDASGEYLVTNPSLSPENTFYEKNGERGVLCEGSTIDIQIVNAVLSAYLKSVEELEIVDKLAPAALDALHRLPPLRIGSFGQLQEWASDYAEVEPGHRHVSHLWALYPGDTISPETTPKIADACSVTLHRREAHGSGHTGWSRAWLINLHARLLAAEECAKHIDLLLAQSTLPNLLDTHPPFQIDGNFGAGACILEMLLQSHEEGIIRLLSACPRAWSFGSLRNICAR

SEQ ID NO: 27458 - protein, 130 aa, A.fumigatus
PRLARSCLKTFLDPSKPFGAHYGAIIGLHAVGGTEAVRVLILPNLSTYATLLADGMAEDNPRRPEAEKVLGALLAVLSTLREGRKTLANGHGAIVTDELRERLNAKVGDIIASRIADAGEVQMVYAILEA

SEQ ID NO: 27459 - protein, 72 aa, A.fumigatus
QSTGPEKLLEVWFAPSAQELGPAQPAGLKAVPEEIWKDMLDLVNCQVLSIVSSEDVDAYLLSSLNAGMEGMR

SEQ ID NO: 27460 - protein, 64 aa, A.fumigatus
TNYQNRNSRMSQTPSYAYKLDTQGANIGLKMHAKNQTRTRMPMPVYSTRCPNTQSGGRQQEMKK

SEQ ID NO: 27461 - protein, 151 aa, A.fumigatus
SASYSSTAGALPTPISSTFAGNGATSDSGTEPYAAASPQSVSDAAPSSSYCHSIATPAYSPPTGSSGPHMTGTVELRAVLPAVTQPYHSMASGYAYPTVCQQQGQLSLTAPVSRPSWNPNSLAHQPSASAAPSYSYLAPLPYSLPDPSHGC

SEQ ID NO: 27462 - protein, 278 aa, A.fumigatus
IRRFMSTKTGWSRRPEGPPGGKYAANGKHRKSRKSAPYSTDIQRASSPYSSIPKLRTPSSPRSNFNRSPLSSSISTQGSLRFASGGRSPASPEKSLRRTISIAAFPQPPKVNGRSSVASTISGSNNIPLGSARVKSGSRLSSGTTSSYRSSRPPSLLNGNGDSRNGASLDSREQEASPTQSRSSSAQGSYSTSATTCEDPDDATGIAKSNSRTKQVKGNVIVSVRVRPNLTGTDSSASDSDWVVDGRRGLISYKGKEGGVDYLYGVHPDKDLSNDSHG

SEQ ID NO: 27463 - protein, 212 aa, A.fumigatus
RFAWLIDQSTSTTDNVFPPHEHNAKVYDAAAKRLVRRVMEGYHGTVFAYGMTGTGKTFSMQGTATSPGVIPLAITDIFSFIRETPHREFLLRVSYLEIYNEKIHDLLSASGSTGLGNSQQEEIKLREDSKRGVYATPLKEEIVQSPTQLLRVIARGDLARRTGSTQFNARSSRSHAVVQIVVESRERAPTSKPSQERRSCMAPGGVRVSTPT

SEQ ID NO: 27464 - protein, 254 aa, A.fumigatus
PRKQIYHVKAAANTASEDLDLNRAQDEQFPPEKLRITIERFYTSVVVELVGFCRHIARLRSWKEPRRTAVFCAVSYDTEFLMSELDLMRAVQGYFIAWLLDVVIFTLSGLLIALILCPPLRRALFPGASPASTDLENSTPGDPRTQDSIIWTSERHKGEAAEREAQNLVNNVATIAMKSATGKYGQAVPEDAEEVAEPESLADVVDAAEGLDESVTAESQKPMKRKVANATDEIMRTMNDITDTYEKFCKYVSR

SEQ ID NO: 27465 - protein, 66 aa, A.fumigatus
  UNSURE (40): Identity of amino acid sequences at the above locations are unknown.
YRSSPGEMTVQNNQIPAIYARAIEKYKDITKEDLRCRPCXCKLQTVDDLAKEIDEHLTDAAGRTRA

SEQ ID NO: 27466 - protein, 203 aa, A.fumigatus
  UNSURE (9),(13),(15),(25),(43),(45),(95): Identity of amino acid sequences at the above locations are unknown.
PWPSVSDFXTCSXDXGPDQTLTNEXPSVVFASAYRFSVFFLYXSXDSLYTFAPTVGWTAIEMSAGIVSACFPTFRPAFQAIVRLLGIQGALPALXRSRTTPMSKTGQSNPSQNELTKGHPGSGVGHSAHSRRHSFYYLPDEADSAGGQPMTPERLDASLRPEYDHGHMVTNVLGAKGRNVDNASDEIPLHGIRVQKDFTQVKE

SEQ ID NO: 27467 - protein, 62 aa, A.fumigatus
YGVALDCSSPSFNSRRIPARLSSAALHLLTFAPVSMKRGVYKLHAATVKSLVVTSHCLVLGR

SEQ ID NO: 27468 - protein, 277 aa, A.fumigatus
  UNSURE (35): Identity of amino acid sequences at the above locations are unknown.
MSGPRSLFLFLGVTSWALKAQTPLRIRKFESVTSXECLDVFTANEIVELSCPSCGNSNGFSKRSSFRTMPQELVLNARRFEVVNWVPRKLDIPVNVSDEPLDFSPYVGSMKEEGEKLLPEDDPSVSGFSPDQNILNQLLAMGFPKIRCEKALHATGNSDTEAAMNWLFSHMDDPDIDIPLVVSKVTGPANMALQDPSKVSQLIEMGIDEDRAQRALAATGGDVDRALDWVFSHPDERPEYKSGDCDSGSRLPGFNETPAIYQLRAIVCHKGTSVHAG

SEQ ID NO: 27469 - protein, 68 aa, A.fumigatus
VRNLNLSDYRIAKQLRTNRHYVAFVRKTLPGQDNPSWVMFNDEKVVGVDDIQDMKKFAYLYFFSRVEA

SEQ ID NO: 27470 - protein, 187 aa, A.fumigatus
GRLLSTLKDERFKVVYQAPTKSLCSERFRDWSRKFMSLGLQCAELTGDTDHTQLRSVQNSQIIVTTPEKWDSMTRKWKDHARLMQLVKLFLIDEVHILKEARGATLEAVVSRMKTFGSNVRFVALSATVPNSEDIACWLGKDAMNQHVPAHREHFGEDFRPVKLQKFVYGYQSYSNDFAFDKLCGSK

SEQ ID NO: 27471 - protein, 284 aa, A.fumigatus
LDGTATLMAGVAFHHAGLDPADRHTVESGYLQGHIAVICCTSTLAVGVNLPCYLVIIKGTVGWQDGGCKEYSDLEMMQMLGRAGRPQFDDSAIAVIMTRKDRVQHYEKLISGCKTLESCLHLNLIDHLNAEIGLGTVVDVDSAVRWLAGTFLFIRLRRNPKHYQLKERATKDDEDEILRQICERNIKLLQETGLVASDHLQSTPFGDAMARYYVQFDTMKTLLALKPHATVSQVVGQPVLCLTIGETLMALFSYLQLRRQKNSVRYGSRQARSHCIKNSTGPMA

SEQ ID NO: 27472 - protein, 223 aa, A.fumigatus
LRRSSLVAHVMSIDVNWRFATSGPDGEALAERIRSFIHDRFQQVALPRFIRSVQVHAFDFGTIPPELEIKDFCEPFADFYEEDDDDHTSDASEERGEEHSSRWNSTHPELNEPSYREDTAVNHSLRDPFPDGFPTSPLRSPLGEHLNPHFLPRASTPGIPGGTSTLGYHLMSLGGLSGTQTPLAAVAGGNPFASGWSDSGMGPGNRGRSETHAGMQHPRAEPE

SEQ ID NO: 27473 - protein, 69 aa, A.fumigatus
QTGPQAWELTMDSNGLAGHDNRRRRGALACNTCRGRRTKCDGQRPKCSFCARRGKECLYQEVQGLPPSP

SEQ ID NO: 27474 - protein, 73 aa, A.fumigatus
  UNSURE (64): Identity of amino acid sequences at the above locations are unknown.
KELLSTSVRSSARLTCYIQDSRVDCASLFPGKGRPGSDLTYTYKGASHLMFEQVSAIEEQYTSXWFGRISKTH

SEQ ID NO: 27475 - protein, 80 aa, A.fumigatus
QELFLVSQCQAIHARSIFPCQDTPDVKCTLDFNITSPLPVIASGLPVRGSSEAPKSDGKTLYKFHQKVPIPSYLFALASG

SEQ ID NO: 27476 - protein, 89 aa, A.fumigatus
ASWLRVTNGYSHGEPYRHFSAIIGWKALTDSVEHFGPEHDFTKLITNLKGMDPDDAFSSIPYEKGFNFLFHLENLVGKSKFDRFIPHVC

SEQ ID NO: 27477 - protein, 83 aa, A.fumigatus
QSCLDEGKSANHVQYFNKYKGKSLDSYEFKSTILDFFKDDSDASTALNELDWDSWLYALVSLRSRICLHRPGLEGHALWKEPR

SEQ ID NO: 27478 - protein, 487 aa, A.fumigatus
  UNSURE (293): Identity of amino acid sequences at the above locations are unknown.
GTPMRRHVLWIGQFRRFLDEDEIFICKYGLDCYLFLRLLHTALKLLFPMALLVLPVLLPVNYTSRSQSTSGLDRFSIANVTNGENCRYWITALVATLANVHLCYVLFREFKVIVRIRQAHLHRSSRLQAVTSVLVTELPPDLWNGELLAHLYSRFNEGPTEVILPGEDMHAARKTELELLLKKRDDLARNTAIQRRRLPISHLKSCIQVLVSSAHLRWQVIRVRAEVRKLRSVAIIRFSSLFTAHLVLQATTSSEPFKMKAHILSDKAYDGRRHIFKSRLERSIHSISITVIXNVLEIVWAVPIAMTGLLSQLSYLDTISIDLADLSEWQVSAIQGLAPQAALSLLMYCFPYIICALSNFFVHFEGSSVETLIQRHYFTFLYVQLFLVVSISSGITTMIPDLVSGFQSIPLILARNLPKSSNYFFSYLILQAVVQTSTILFQLPDGLWRGLRRGQAKHSMKRVRWSLVYPVFANLICICAYIMKDFN

SEQ ID NO: 27479 - protein, 92 aa, A.fumigatus
RPWATILASSLIRTQFQHPFVTTYPMVVLAIAMNLSAINETVTHAAGKAQRERGLSSQSFLLTLLVYGSVSILSVCLFSYLKDKNLNLLWVM

SEQ ID NO: 27480 - protein, 127 aa, A.fumigatus
RTSTEHWKLCGLRAKCDAGIIFSLLSPLILPIGLLTFKVFLILYSYQATYVLESDKETSGLLYWEAVNYLFVGIYTMDLCLIGLFALQNAVGPTIMAATLLLGVAMVHKHLRSNFSPLIHYISCKSP

SEQ ID NO: 27481 - protein, 69 aa, A.fumigatus
VLIMGLRVIITGGSGKAGQHVIAELLKAGHTILNLDLLPCPNDKVCTLRTDLTQSGQVFNAMSGQFALN

SEQ ID NO: 27482 - protein, 284 aa, A.fumigatus
GTLSLGKETILQLAYHRPSRIYMGARNATKARDAITDIQRQLSTPVDIRHIPLDLASFASIRSAAAKFTSECDRLDILILNAGTMGNPPTTTEEGFEVQFGTNHIGHFLLTKLLLPVLQKTAASPASTDVRVVTLASLANCAAPSYDVMTSTGALLAASTWTRYAASKAANILFASELARRYPNILSVSVHPGTVTSNLYEHAKASSPVSKYSVAALSLFFRSVRSGALNQLWAAGAKRELLTNGAYYIPIGNHAKNNKYATDADMAKRLWEWTEAQISEKFVP

SEQ ID NO: 27483 - protein, 173 aa, A.fumigatus
TGAAGPIIVRPSILRIDRNQHHTLVTMTTEIAAGTPLAEALSNAIQPKLVEMGWTSDGGDDSALIEYIILMLVNGKSQEQIADELSNDLLGLGSEGDTQALDFSRWLFEQVEVLNRQINGGGAPVANETAHTIPSSNDQTATSQEGNDGGDQDATMNMADGSHMDDSMWVPAL

SEQ ID NO: 27484 - protein, 101 aa, A.fumigatus
  UNSURE (59): Identity of amino acid sequences at the above locations are unknown.
LGTYSSVSTPPSMEFLTLPQTIKVLEDAGYVIDSYNMKLCCTFENPERLWVALEELDKXSQLSLATLADTKLARPKSDKKTRDELLDQGLQRLREKLKPKL

SEQ ID NO: 27485 - protein, 477 aa, A.fumigatus
  UNSURE (471),(474),(476): Identity of amino acid sequences at the above locations are unknown.
KGARTTPSVVAFAQDGERLVGIAAKRQAVVNPENTLFATKRLIGRKFTDPEVQRDIKEVPYKIVQHTNGDAWVEARGQKYSPSQIGGFILQKMKETAENYLSKPVKNAVVTVPAYFNDSQRQATKDAGQIAGLNVLRVVNEPTAAALAYGLEKEADRVVAVYDLGGGTFDISVLEIQKGVFEVKSTNGDTHLGGEDFDIHLVRHIVQQFKKDSGLDLSNDRMAIQRIREAAEKAKIELSSSLQTEINLPFITADASGAKHINLKMTRSQLESLVEPLINRTVEPVRKALKDANLQASDIQDIILVGGMTRMPKVAESVKSMFGRDPAKSVNPDEAVAIGAAIQGAVLAGEVTDVLLLDVTPLSLGIETLGGVFTRLINRNTTIPTKKSQTFSTAADFQTAVEIKVFQGERELVKDNKLLGNFQLVGIPPAHRGVPQIEVTFDIDADSIVHVAAKDKSSLHHGAGSIDSVLXLNXHXA

SEQ ID NO: 27486 - protein, 228 aa, A.fumigatus
NTVDTSSPVVKTGLVLGGNVDNGVGINVEGDLDLGNTTVGRRNTNELEVSKQFVVLDKLTLTLEHLDLDGSLEVSGGRECLGLLSGDGGIAVDQTSEDTAESLDTEGKGSDIEQQNVSNLTSQDSTLDSSTDGDSLIRVDRLGWVTTKHGLDGLGNLGHTGHTTNQDDVLDVAGLEVGVLEGLADGFNSAVDQGFDEGLKLRASHLEVDVLSAASIGGDEGQVNLGLK

SEQ ID NO: 27487 - protein, 204 aa, A.fumigatus
RRKFNLSLLSGLTDTLDSHAVVGEIKARILLELLDNVADQVDIKVLTTKVGVTVGGLDLEHTLLDLQDGDIESTTTKIVDGDNTVGLLLQTVSKGSSGGFVNNTENVQTSDLTSVLGSLTLGVVEISRHSDDGVLNGLAEVVLGSLLHLLKDETTDLRRRVLLTASLNPGIAVGVLNNLVGDLLDVTLNLRIGELATDETLGGE

SEQ ID NO: 27488 - protein, 190 aa, A.fumigatus
RLDLSLAATWTMESASMSKVTSIWGTPRWAGGIPTSWKFPSSLLSLTSSRSPWNTLISTAVWKSAAVENVWDFLVGMVVLRLIRRVKTPPRVSIPRERGVTSSSRTSVTSPARTAPWIAAPMATASSGLTDLAGSRPNMDLTDSATLGIRVIPPTRMMSWMSLAWRLASLRALRTGSTVRLIRGSTRDSS

SEQ ID NO: 27489 - protein, 62 aa, A.fumigatus
VLQYNKMRTMACLRLTQENVILASLVPESSAQPGNLAFPLLPVYFSGSSCGISLIVAFQHLV

SEQ ID NO: 27490 - protein, 193 aa, A.fumigatus
ERVSFQPRRCKTLSSARRDDMESLGYVMLYFCRGTLPWQGLKAATKKQKYDRIMEKKMTTPTEVLCRGFPNEFSIYLNYTRSLRFDDKPDYSYLRKIFRDLFVRESYQYDYVFDWTVYKYQKNAAMIADATNNKKDKEADGRQNAAGAQAPMATTATAAKPGAISSQRRKVLDHNTLNNTPDTNRAMGGSDRM

SEQ ID NO: 27491 - protein, 153 aa, A.fumigatus
AAKFHCDQRYQILPALVLSSVFQGSTNSSVFENFIEELLYHCGRWPEPKSSLIMDNASFHHSTTLEKICAEAGVSLVYLPPFPLDLNPIQELFAELKAFMRQYWQVYEDNPYQGFDSSLNGALLGKWPGRIHHGQRMKLSRYRVEVNYVSQIL

SEQ ID NO: 27492 - protein, 104 aa, A.fumigatus
RLGLYLLENIGVDGQGYSGGAGKAIGLWFYETWVYTVILSVVYGIAVGWVSRELLHWAEEKRYVDRESFLVFAIALAVRLAPLHLETPSVADHVYSSLFSEPVA

SEQ ID NO: 27493 - protein, 169 aa, A.fumigatus
PASSQETSSLRSKFPARDPSMLYTHANSDWFRLETMDDSLQPTIDMLLNLAVFMWFGAVCPWSSFVNNDIIPIYRLICLGILILLVRRIPIIFAMHKYIHQIEHLFQAGFVGFFGPIGVGAIFYLSVTREYLRTITVEGTVREDAQRVSEAVDVVVWFLVICSIVSSHP

SEQ ID NO: 27494 - protein, 282 aa, A.fumigatus
LSSMLTLLCHFSVIGVERPKSRLTTAKSEPNWAVVSHTGPAEELPLPSSRPASQEGEKIDALYVSSSRQVDELFRDMMPHFEGRESEDNWIRREKDVLTLRRLTHGNAPDDYSPAYLAGLKTLLDGIFKVVNSLRTTLSTIGCLLIQDIAKRCGPRIDSMVEIMMQNLIKLCSGMKKISAQNGNATVDALIENVTFTTRILQHVSGACQDKNVQLRLFAAGWLKTLIQKQSHHKSSIEHGGGLDMMEKSVKKCLADANPGVREAMRSTFWTYYRVWPNRANE

SEQ ID NO: 27495 - protein, 71 aa, A.fumigatus
RGAPHLTESLRLRVVGELSHLEIFSEICNFVNVIAILPLALIRCAITKYEYYSTHCSPPTVLKKSQLVCHT

SEQ ID NO: 27496 - protein, 221 aa, A.fumigatus
LRMSQFSPTYPALLPVPSSISDNTLNYAARYRSRARVPVLTYRHPINNCSITTSSQALVGVRQNRSIQDEKLLAAIFSTSRTDRPLANFTPPHIENDSSSSTQGDVSSGQMLTDLTNAEELEDEMLESFRGNPEERPQIYGAQQHNLIVDARPTVNAFAMQAVGLGSENMDNYKFATKAYLGLDNIHVMREPLNKVVDALKESDVHPLGPNRDLLGPKWDG

SEQ ID NO: 27497 - protein, 86 aa, A.fumigatus
MSEMNRWYKVWKASKCLILLLPYTLFPSLFVTFLLPYLKGVLAEHLVQEVCGIFVPLFAFSFLIFPYIPFYLKDIPLRLDKILYRR

SEQ ID NO: 27498 - protein, 64 aa, A.fumigatus
FGSGRDWRLVMGYLLLNALRRGPSWRLKLIKVTDAHISEGFLEGRLMCTLYPDAGAHASHGTRL

SEQ ID NO: 27499 - protein, 75 aa, A.fumigatus
AEKATGPLGRLSPGPGPVGENRETGTSAYLIILEDLHSGSNRESQDEGCRRWRGLGTGILFGHVPTGLLLFLRIH

SEQ ID NO: 27500 - protein, 85 aa, A.fumigatus
HFNAYISGVPLTNTPLPLTPAPAPAHGPASFPPLSPPSYPPSSLAQSTYITITRSPLARNNTAMKKTYSNTKTDRLATKLPPPDN

SEQ ID NO: 27501 - protein, 145 aa, A.fumigatus
SADDLSSHGDWVKDINEVASTTVQFPIIADPERKVAFLYDMIDQRDLDNIAEKGIPFTIRAVFIIDPAKKIRLTMLYPASTGRNSAEVLRVIDALQAADKKGIATPIDWTVGEDVIVPPSVSTEDAKKKFGNVREVKPYLRYTKF

SEQ ID NO: 27502 - protein, 93 aa, A.fumigatus
FSTLLPYIHTYIHTYIHTYIHTYIHTYIHTSIHPWSTKDIGRWKKCSASGMHAIPSGFPNMVSTWYCRAPPMLLRQSSTDKSHRRYTLVSALN

SEQ ID NO: 27503 - protein, 73 aa, A.fumigatus
HIVRIVAPNFKAQTTHGEIDFHEFIGDSWTILFSHPADFTPVCTTELGAFAKLKGEFDKRGVKMIGLVGSPLS

SEQ ID NO: 27504 - protein, 66 aa, A.fumigatus
  UNSURE (9): Identity of amino acid sequences at the above locations are unknown.
IDADVFRCXTSPWREFSSDTSDGLSTNKATPAPENKHFTSPVGSQSTSKRSIISPKPTFLYCNCLM

SEQ ID NO: 27505 - protein, 286 aa, A.fumigatus
HKHTNCGTPMVRGIGNIGRIYSFELLLLDGAEKGPIVSTSKPSTLLCQYGRAEAVPMQGYFDISAAYNGNLIVVTDILDPMYRPASVGAHLELGVAQVGLDLSHIAKLLLSVLGRDGGRNNDIFANGPVDGGSNAFLVCCLQSVNHTQDLGGVTTSGSRVEHCQTDLLRGIDDENRTDGERNALLGDVVQVALIDHVVEEGDLALGIGNDGELNGGRCDLVDILDPVAVRAEIVRALYIINEYGTMIQLRGLPTRPIIFTPLLSNSPFSLAKAPSSVVHTGVKSAG

SEQ ID NO: 27506 - protein, 91 aa, A.fumigatus
VWYHDSTERTTHQTDHLHTPLVKFTLQLGKGTEFGRAYWGEVGGMREENGPAVSDELVEINLAVGGLSLEVRSYNTYDMLAECLQPKERRE

SEQ ID NO: 27507 - protein, 346 aa, A.fumigatus
VAHLPTVKGLGAPISFTPAAPASPTKGSPRRRKVGAGRKSVSFSPKKTQAKTTKRSVRWKDDEQDGALTEYQKTPQKPLTETIPEEPPSEEPQLPRASPIPRGIPVPSRNISPSGSSPIPPPSNEPTLHVQKNNRFKAGFLSKKAGSSPVGPPPTSTLPLSDNENSPLRDIENSSFLNRSSMDRPSRIAVRTSSGSYSSSPLPDSRDSWKASKDDAIKITSAMRRISGGQFGSAASTNSLRINRRRSPTSATYGSSPSENTMFTASQARRMVKSEKELDPKPRVLSPRTLPIMKSTSHRRTTFGGDIRPRDISLTSRDAIRLSTMAAPSIERPPETLYPSSGAGWR

SEQ ID NO: 27508 - protein, 306 aa, A.fumigatus
GLTFCVCRIALYFVCRASVFSSSVTTRIQISTMTRIRPDYDAIVIGAGFSGVRSLWELRRLGLTARCFDAGSDVGGTWWWNRYPGCRTDGEAWVYALKFLPELLEEWDFTERYPPQEEIQWYLSRVLDRYDLRKDIEFNTEVKSAHYSDHDSIWKITTASGKVATARYFLPATGITSIPKEPPFPGLQSFKGEVYQTSTWPAHEIEFENKRIGVIGTGSTGIQVITKLAPVAEQLIVFQRTPNYVIPAQNYPLDEKKREDIKKTFDATWDIAKRNLAGHAVKHSGRMVASAGGPEEIQRVFEDGWA

SEQ ID NO: 27509 - protein, 106 aa, A.fumigatus
GLSVATCDSPMMASLFGSNNDGSQLGTALLRISPLIISSASLMFSWSQDISLGAFLHPSLRHDAAHPSGKLLPRYLPAFMSPGIWGIGLTYPPAVFYHGAGRTRAW

SEQ ID NO: 27510 - protein, 144 aa, A.fumigatus
GTNTLPRPYSPTWAALMSRFPHSLVDNQPFHKILWHAGLVSSKSEGHRIVANKGAYVGSRPGDSGPMSDDLAFTPIETWLPEKTQEFIINGDLLLLKLGKWKFRMVRIVSDEEFKERGLTAPGWELEKSESESAAEKATETKSA

SEQ ID NO: 27511 - protein, 185 aa, A.fumigatus
PRTLETHRSDVHFWHAGCIGPMIVEGDHILGHESAGQVIAVAPDVTSLKPGDRVAIEPNIPCHACEPCLTGRYNGCLNVAFLSTPPVDGLLRRYVNHPAVWCHKIGDMSFEDGALLEPLSVSLAAIERSGLRLGDPCLITGAGPIGLITLLSAKAAGATPLVITDIDEGRLQFAKSLVPEVRTYK

SEQ ID NO: 27512 - protein, 91 aa, A.fumigatus
TSSHWFVQSIYHESDIMATATTTVLEKPNIGVYTNPKHDLWIAESTPTLEDVKSGNGLKPGEVTIEVRSTGICGYVLRIPCVRPFVSCRTE

SEQ ID NO: 27513 - protein, 187 aa, A.fumigatus
WLNLRTLAVLGAMTSLTTKGTRRFTTPLKLPLAWDGKPIPYWLYKLHGLGVEYPCEICGNFVYMGRRAFDKHFSEALHIFGLKCLGITSNTNLFREITRIEDAIKLWEKLEQDRKKERESRENVVQMEDAEGNVMPERIYLEYVSLFLTKPNDANLLQSSKAGYSVILLLSVPFLPCFGPFRVKAWS

SEQ ID NO: 27514 - protein, 313 aa, A.fumigatus
RGTFQPGPEDPNEPVENLERAYKRRQPGEGEPTGVEIDTMFSGEEAYGQFLDLTTLHEDYLNLPGVKRLTYIQYLDVFDSFVPPHLLIKRANKISDKYFKYVGELAGYLESFIKRTKPLQDLDKLFASFDEDFEKQWAANQVPGWTEENVENRTQAPKTQGSGEGIWCTDCEREFKNENVYKNHLTGKKHIRAAEARKAVGDSGAGAPPSVGGVTSVAHRLKERAVAEREHRVRSLAKVLDSERQATRINVERRQGMTERERQMELEALMAEFENAGGPGRNDQSDDEGDEKIYNPTQASLGMGRQAYSLLAV

SEQ ID NO: 27515 - protein, 127 aa, A.fumigatus
VYLSLPDSTFQRSWQANLTLSQNAAISNAPPTHSHPGPTRPSHPTPNHPARATTPVQGPVHHCQNDPTLHLPPRQMAVPQSRCRSLQEEPLLPNLGPPRPRPLDQIRSPRPPNRRPPARRRCSFSRQ

SEQ ID NO: 27516 - protein, 295 aa, A.fumigatus
RYHRTQLSLMHPRLIHTLVLLDPVIQRQTTQLEPRPLSKDQFIIAKTTQLSTYRRDKWPSRKAAAEAFKKNPFYQTWDPRVLDRWIKYGLRDLPTAVHPLDDGAASQGNDRPVTLTTTLHQEVFTFSRPNYDGPPGKNVPINRVTHPDLNPKHVGSFPFYRPEPSRIFAQLEHLRPSVLYIFAGKSDMCLPEMMADKMKNTGTGLGGSGGAAEGRVRDVYLKKYGHLLAQEAPSECGEAASRWLGKELERWRAEEQAFREQWSKKSKIEKATIDSRWKEHVPAPVRPKKDSEAKL

SEQ ID NO: 27517 - protein, 103 aa, A.fumigatus
PILPYAPQMASGGRASLGSFPRGPWLVVRLVYESSPRLFANFSCRHVMTGIGAYLYIIWGIWLRHCLNGRQEEYELWWPHFWNFPEIVPVSTDSGSRPAKKSI

SEQ ID NO: 27518 - protein, 200 aa, A.fumigatus
SYSTRLSNASPVTKKETCEIADYLLDPMQLVDELSMIYTTCLMCYASFSYSRPLGFRIVLAVALTSLAVFITLYYHYLQDPVFHQNAYALLTIVVVLRSMYTMEVTLRPSLRHSTEEDRLARQKKDLPVLSKERQHYENVRDVRTLKTMWFMVAYGLAMFLGGFFIWTLDNRFCHTLRRWRRAVGLPWGLFLEGHGWWYV

SEQ ID NO: 27519 - protein, 65 aa, A.fumigatus
ITCRLLHWNTSEFIQIIARFDSRGCVQGSLTNYVSGRLYDYNNYLVIFYKNICLNHSNPFGISWL

SEQ ID NO: 27520 - protein, 153 aa, A.fumigatus
LFNASTVIESRAATQLGENVKLLTYVSIFYLPLGYCAALWSINRDFNLVAFTITTALLALGTYALVLNLNDIVFLIRKTYRKLRSPILEAMKNDSHEQWAELGSAFSEFMPERHGDQPSEWAILLYAVLMATEKLKFWKRGHSNPIDDGLERK

SEQ ID NO: 27521 - protein, 155 aa, A.fumigatus
  UNSURE (151): Identity of amino acid sequences at the above locations are unknown.
LDHSPPIFPTTGFWPQQHPYIAIFTMTAEHSPLSLSTVLVTGGSGGLASKILELFSQRGCKRLHSIDIRQPSHLLHGVTYHLGDLTDVDAMRQIFHEVKPDVVIHTASPRFDTPNHIMYKVNVEGTKNLVQIAQESGAHSFVYTSSASVIXDGKD

SEQ ID NO: 27522 - protein, 63 aa, A.fumigatus
GLTKSVAPNLRAHASLLSLTSTAMILPALFLTAPWMTERPTQPAPKTATFEPSSTLAVTTAAP

SEQ ID NO: 27523 - protein, 105 aa, A.fumigatus
SPGFTEVTPSPTDSTIPAPSCPRMTGKAPSGSFPDSVYASGGRLAVVTVSEASSQPRDTNLCGRHRCAEPGCGLRAPWGVQPQHPQSREARQRPMQRQPAVLSMI

SEQ ID NO: 27524 - protein, 87 aa, A.fumigatus
GCTPQGARSPHPGSAHRCLPHRLVSLGWEEASETVTTANRPPDAYTLSGKDPEGAFPVILGHEGAGIVESVGEGVTSVKPGDYVIAL

SEQ ID NO: 27525 - protein, 150 aa, A.fumigatus
STPECRECKFCKSGKTNLCGKIRATQGKGVMPDGTSRFKARGKDLLHFMGTSTFSQYTVVADISVVAVTPKIPTDRSCLLGCGITTGYGAAVVTAKVEEGSNVAVFGAGCVGLSVIQGAVKNKAGKIIAVDVNDSKEAWARKFGATDFVN

SEQ ID NO: 27526 - protein, 191 aa, A.fumigatus
  UNSURE (178): Identity of amino acid sequences at the above locations are unknown.
KIVVETCAHILSSVLVIGARNSGKTSFLNFLRKSLTMPPHKHPIRSPEEVEAYERHSPANEGFTSHYLETEIDGERVGLTLWDSQGLEKNIVDIQLRGVTGFLESKFEETLREETKVIRSPGFRDTHIHCTFLLLDPVRLDENIAAAERAAQGTSKAADTPVIGGLDEFLDIQVLRTXLGENHCCSCHQPS

SEQ ID NO: 27527 - protein, 448 aa, A.fumigatus
SHPAGSYRIQIFWKGDPGVVDNFIIRFQNEDVMRKWYKEIDTQRAIQAEQRSARNTGTSETEFMYMKGIANMPNPYQQEYDAEEQSTKEAAFFSEFPMSRNASSTSLRTRSATGGSGSSGPPLSSGRQICFPRDPSLSVHTQFTPGSMSPAERNMNSYFSPVAETPSTRSSSQSTGYSYGRQGTPSNNWNEEPNRYTAPALSRGVSRDGTNFFNNAPNGRGTRPSLPPLAGQTNANGMAQRMRSASSPDIHHHNPESRRYMGAHTMQTVDNVPVPPIPAHMASMKAPVNRSQNNSPTGINLPIRNGHSQQASTHFHEPQYSESRATGPASDQPTSPLSREPDEDPLMPTQLKAKVNFDDNYVTLVIASNIMFRSLTDRVDAKLARFTNRSIGNKSVRLRYRDEDGDFVTIDSDEAVQLAFMEWREQHRDMLAKGQVGEIQLYCQVVEN

SEQ ID NO: 27528 - protein, 303 aa, A.fumigatus
TNCSSNSEARATTSIAIMVHAHAHRDHHAALLERSLEERDPKNEAVTIVYVTAAPTFDGPIGGYVTGVDPAETATRPNQGVGAPLGHTRPTTTEEVTTTAQPKPKTTKETKPTITEAEPTTTQRTTKATKAITTDNTEDIITTPTTFSTATSSSTSSLTIPGLDTTTTTTTHGSSSLEKSASPSASPVAAGSSSGLTGGAKAGIAIGVILGLGLIAGFIFFVMRKRKQGQQMAEAEAIKEKSHEADNMLPPGPPPKPQPMTPAEPPQLNVRPVTQFAPDLTPMGTLGAGGAGGLHQTAGKSYV

SEQ ID NO: 27529 - protein, 238 aa, A.fumigatus
ASNSLNNGPLKSTFGANVARRRWSSIYMISDTYENAKFSSTTGGKSPIALGKPSTMSWNLSTDTSTEATSRPPLASQQSNSLPSTPYQHTRNLSFHSRTPSPPHGNTSPRSTHSESIHFPPSLRKPFAGCKYETAMAFFRRRMPYTIGADLLPEEKEGLKERLEAEEEERLTKDMLEVYDRLLPSAESDDRRRQLVRKLEKLFNDQWPGHDIKVHVFGSSGNKLCSSDSDGEWSWCRA

SEQ ID NO: 27530 - protein, 128 aa, A.fumigatus
CCAHFASTLVYLTEAPALGKISTVTANTVSIRSSRIPSSITPARTVGIYLQLVTPITPGSGADCRMQSPRKTLREQESLVLHYVDLLVEKLRAECAAARSTVDMMKWYNYTTFDIFVDIAHDGAKQTR

SEQ ID NO: 27531 - protein, 119 aa, A.fumigatus
VHLTTNCLTGQRPAEQATSRIAGGSSAWAGYLQYLVIYLQPLRKSPGPKLVACSNICYIWWTFSGEIHAKLKELHDQYGDVVRISPPLWCTLPKPRRLERYLRSPQTRCQFVHQGSRVL

SEQ ID NO: 27532 - protein, 63 aa, A.fumigatus
PGRKHRRREARLAKAAAVAPRPVDKLRPVVRCPTVKYNRRVRVGRGFTLAELKVNSSSLFVPQ

SEQ ID NO: 27533 - protein, 145 aa, A.fumigatus
EAGIPKKLARTVGIAVDHRRVNYSKESLVANVARLKDYKARLILFPRKSGQFKKLDSSADEVNAAKAAFAAEGKTEGYATKLGATFPVKNISAAEAVTEVKRDELPKGEEAAYRRLREARSEARYKGIREKRAKAKAEEESAAKK

SEQ ID NO: 27534 - protein, 68 aa, A.fumigatus
CKPNFSLLLSPDAGHTIVHENITYDFHILPSGLVSPSCVNLIGAGTVVHVPSFFKELASLEEKGLKDA

SEQ ID NO: 27535 - protein, 60 aa, A.fumigatus
KVGWIYLYNFSKYKVYTYFPITAIILNSLLYLLLSFLYRHYILKFFNKSSTFSLTENKIS

SEQ ID NO: 27536 - protein, 147 aa, A.fumigatus
  UNSURE (116): Identity of amino acid sequences at the above locations are unknown.
LLHTALYLYARHESSTHSTTAYCTDCLPYPMSVDPKIRHPEEGRAENIRTNKQSFRYAVDLTFRGPVVRSNNPGSGLSGDEFLGGMREKIFRFAVGGTPYQCLVWGDWDLGLIRLXTPLLTKPIWSFGLAFSEFSSPLNPDIGSGLY

SEQ ID NO: 27537 - protein, 66 aa, A.fumigatus
RHIGSTSRQRVQQVSESWKEGQNVAWMASVAQFADLKDLYVRSGTSSNTFSNNDTRSSETILLKFQ

SEQ ID NO: 27538 - protein, 559 aa, A.fumigatus
KAIYTSPIKALSNQKFRDFRTEFDDVGILTGDVQINPEASCLIMTTEILRSMLYRGADLIRDVEFVIFDEVHYVNDLERGVVWEEVIIMLPEHVTLILLSATVPNTYEFASWVGRTKKKDIYVISTAKRPVPLEHYLWAGKDKYKIVDSNKRFLETGWKEADNVISGRDKIKAQKAAEAQAQSQAQRGGQQGRGRGQPTGRGAPRGNAQRGGAPRGRGQPANRGTGNIARTGRGGGRTTAAQDKTIWVQLVGHLRKENLLPGCIFVFSKKRCEENADSLSNQDFCNASEKSLIHMFIEKSLTRLKPEDRILPQILRLRELLSRGIAVHHGGLLPIMKEIVEILFAKSLVKILFATETFAMGLNLPTRTVVFSGFRKHDGRGFRDLLPGEYTQMAGRAGRRGLDTVGYVIIVSAGRDEAPPAGALRKMILGDPTKLRSQFRLTYNMILNLLRVEALKIEEMIKRSFSENATQALLPEHEKQVQLSEASLAKIKREPCDICDIDLVACHDAAIEYEKLTSELHVGLLASPVGKRLFMPKRLVVYRKVSRTVDVIAFCSQIY

SEQ ID NO: 27539 - protein, 62 aa, A.fumigatus
VPGSHTPLRKGPFTGSHLLTQSTSSANYLTSCKSIHQRSRHVSSFIKLDVTSLFQLCSVTKQ

SEQ ID NO: 27540 - protein, 81 aa, A.fumigatus
  UNSURE (46): Identity of amino acid sequences at the above locations are unknown.
VSFSFTAALVQEEAAQIRELVFKCIISYLYNNSSKQDECTEGSWDXIGWFELKIRLLFIDPNHAIHFRTTAASPNPSICNS

SEQ ID NO: 27541 - protein, 251 aa, A.fumigatus
SIATSRNDDLVFLGNFLSTFSDWSMTGYFSAIQKQLAPVLIRKDAQIEVAQLLVEQVTQSCLDHKVDGILNVSEFESKAYSLRTFLEDTAFMGEIERLDLNGFVSLQENSGLSPPLTATMSRQSSQRKENGKSSILKLAPPHLRIRRGKDYLEVLPPAISFWETFGLEPAYGSKDIYAYCIHPQTAAEAANDFLERLGLLYSSCNLGQHTRASRSTGFDRGMCSWNIGAPGEFNYHYIMQSLKSICDKLGM

SEQ ID NO: 27542 - protein, 62 aa, A.fumigatus
FATNPPLVTALLKSPPTRDSVVVYIINPFSHAAALADICSAFYDLFQKYIDEVGNQHAGQAK

SEQ ID NO: 27543 - protein, 236 aa, A.fumigatus
  UNSURE (226): Identity of amino acid sequences at the above locations are unknown.
PIIPPAHQHTPLRASSLIMASVESRIIAITGGASGIGAATCRLLAERGAAVLCVCDISPKNFDDLKISIKKINPSTKVHCATVDVTSSVEVRQWIEGIISDFGDLHGAVNAAGIAQGAGMRNTPTIAEEVDEEWTRIMNTNLNGVFYCTREEVRAMKGLPATDRSIVNVGSIASVSHMPDVYAYGTSKGTCAYFTTCVAADACPLGIRINNVSPGGSSPSPSSAWXAVIWITILSC

SEQ ID NO: 27544 - protein, 200 aa, A.fumigatus
LRLAKYSVGSQYQHLLMFYSVYAPNLGPWPNDKRDNVHWVCGICPGGENLEISMNYQQGAKCTVRIAAETITPAAGTDKDPFNLTAEKKMIEDLKALQPNLNFTWFNHFQREVLVPEEVALNNDEIISKVPFKNQRLHGLDLSEGAFMLKSYFMPAIRSAITGVENTQIMFESIRKLNLKNANFISALRSSPRGWEKKLH

SEQ ID NO: 27545 - protein, 249 aa, A.fumigatus
ARFDQWAEASMEKDDDLIAELKAPEDLVFADGLQDQTATFNLSLRAVDPVDVCVENLSLQVDTTRPIWKTSPSQLWNRLCGKTMDTHTHKTVLDSVNAFMPSGSLTAIIGSSGSGKTSLLNIMAGRMSLTKAKVSGATTFNGVAGIEGIRSAYVMQEDVLIPTLTVRETLRYAADLRLPSPATQEERHQVVEQVVLELGLKECADTRIGTNTHNGCSGREKMRTSIGVQMLANPSVSILRIPEGKEQEP

SEQ ID NO: 27546 - protein, 76 aa, A.fumigatus
RQGEGETDDERVKALLAQLDQTLQGYERVLSKQKYLAGDEVTFADLSHLPYGVFVEQFGFADLIAKYPRSKSTGRT

SEQ ID NO: 27547 - protein, 165 aa, A.fumigatus
RAVLPARGEDLGASYAQRDLIARNEYHNLSAARTILFIGDGSFQMTVQELSTIIHHKLDVIVFLINNDGYTIERCIHGRNQAYNDVARWRYLKAPELFGADQEGEYASRTWEIRTWADCDAVLKDEQLVNGKGLRMVEVFMDKFDAPDVLMNLLNAQIARDNAKK

SEQ ID NO: 27548 - protein, 95 aa, A.fumigatus
SGPSPPLRKPCVLVDPECDIAVGTMAQLLLQQGKVSQALKYFERAAELARTEAEIVNAISYAEATRTQLEVQERYPQLAARLQSMGAGLGGPPGL

SEQ ID NO: 27549 - protein, 144 aa, A.fumigatus
TLAMDTLQRVVIDPLQPVLRPISSALPQPVHDVIISLIGSPCHSALLLDLDVTKDAACTSLAISKALGIAIVGASAIVKVPQILKLIRSRSSAGVSFVSYALETASLLITLSYGVRNQFPFSTYGESALIASYTDGAGRITRCK

SEQ ID NO: 27550 - protein, 333 aa, A.fumigatus
  UNSURE (210),(213): Identity of amino acid sequences at the above locations are unknown.
FQYPSVHVPSAMIYLRSSLLRSGLAQDSARLCSQCFSRLSPSRRPVAVRSFFSSSRLRAGIADHESTPSTVQKTYFSANRTADGLLASLSAVNSSPRSIADNALSQGAASSESITSQSTSQELPHRRRKRLKEEAAKNNAAETELPPDASSQLSTLSSALPATSLRRKLAAFLALTKPRLSFLIVLTTTSAYGMYPISSLLTLDPSMTPXPTXLTSTLTFLYLTTGTFLSSCSANTLNMLLEPKYDALMSRTRNRPLVRGLLSRRAAVLFAIATAAAGLGLLYIGTNPTTTALSASNICLYAFVYTPLKRISVINTWVGAVVVVTTGLDGTAL

SEQ ID NO: 27551 - protein, 205 aa, A.fumigatus
KLIQLVFSRLNQSIANNEHPLNVDAWDGYLANKNRTLQTLYDNQIDNNIMIAGDSHANWVSDVAWIDNKPYDPKTGAGAIGVEFAGTALTSPSPYGQNITIADANEASKALVTDNEELQWSELYYRGYFELHITPQEVEARFFGLPNIKERNGEEISLANFTVKSGANHLERNSHGVVGGGAVANGWLKNGQVVPTNQTNNTYGQ

SEQ ID NO: 27552 - protein, 264 aa, A.fumigatus
CPSLADALALARSPATAGLVVTMPYKNSIIPHLDEPDDLVTMIGACNNVYYRTNAADRRLCGTNTDWRGIKGCLLEKEGQGQRPSATSPGCALVVGAGGASRAAVYALAVHLHCPTIYILNRDEGEVDALLADTQRLPVTLSITHVKSIEQARALASPYYVVGTVPDDEPKTESERAVAGILESFLAREEKGVLLEMCFKPRRTRMIRLAERLGWPCVEGTHVIMYQIEEQWRLWAGEESVVNLDLKGAWDVLLKAAEESTAIN

SEQ ID NO: 27553 - protein, 67 aa, A.fumigatus
  UNSURE (65): Identity of amino acid sequences at the above locations are unknown.
SAQGSANSLKAGLVTGKPLGLLPNFIRTNMLSDACEWENFASIFHADANVYTTWVFTTRRQGAAXSV

SEQ ID NO: 27554 - protein, 64 aa, A.fumigatus
DQIVWAVVANGARGPIAFGKRVYIGHFGFFVYWHCYWCEGSLENIYYEGHPAKDIAESARLPLQ

SEQ ID NO: 27555 - protein, 209 aa, A.fumigatus
  UNSURE (158): Identity of amino acid sequences at the above locations are unknown.
LEQLNTHRLIQPLRYPLSPESYIPVMAPAPKNFYIFGSGISFSISPAIYQAGFSHYHLPHTYQIRESESIDDVAHLIADNTFGGASVTMPHKLHAHRFCDIQTETARLIGAINTLIVTETGDQRLITGDNTDWSGLYALITEYTSRTQHPLQTGLVIXAGGASRAGLFALHKARVRGIYLVNRKLAAAEKVRDHFSALFQAIAVPPLDN

SEQ ID NO: 27556 - protein, 412 aa, A.fumigatus
RLGPWERGQGSLQGAKTGPKTIMELHVEILLKIFVKFQDPRVRRRAQIDCSSPHRGCEEDIACQTARETIRQIRMVCRLFNDLASPLLCPILRVDLDQESLNGAVELCKRPRIAGGVHAIQVGLQYRPEELVSDCPRFKDYCKQQLDRVADRCDWLGGYELDDETDCLEDKREFREAKRNYQKICRSWDAYFSTDESDENDDVAEAEADEHMEILIRAYNEYCKKHEEQLQLITSGAFVTALAACISQLPNTVTLGFTDEMEPLYDWDNPTIVLGDTSLLPGMMSAALRWEKIDNLRHGNDPVLTRDARFTPARILFDLPVAIHKAGIKLRNLDLGPFPCRGSFSLLCPDTVSNPTDPAVWSALRAACSSLWRVNFGMNQNHHRPHIRHEHLRPDEKFYVDQTSAQYFSVEI

SEQ ID NO: 27557 - protein, 79 aa, A.fumigatus
  UNSURE (1),(2),(4),(5),(6),(7),(8),(9),(10),(11),(12),(13),(14),(15),(16),(17),(18),(19),(20),(21),(22),(23),(24),(25),(26),(27),(28),(38),(39),(78): Identity of amino acid sequences at the above locations are unknown.
XXAXXXXXXXXXXXXXXXXXXXXXXXXXRLNKDKILPXXKKNTRAALKHQEKTRRFCDIKKEKKQTIIFFFYISTNKXK

SEQ ID NO: 27558 - protein, 73 aa, A.fumigatus
VELSSNFSSVHTNNYGFSSRKACGRYGRSGSKRWLRLCKLNKVPLSTITFRATLQATALYTSSRCGEAETIML

SEQ ID NO: 27559 - protein, 73 aa, A.fumigatus
DIRDEPAITRGTDRPDPIYFNVSKVSAQYPTSWRSVHMTKDRGTHQRGYANGDQLLIQGLNTVGLALVTYIAY

SEQ ID NO: 27560 - protein, 123 aa, A.fumigatus
  UNSURE (84),(105): Identity of amino acid sequences at the above locations are unknown.
CIGTDSCIWHLVRISYLCLRIGADVIAPLAAAQIYSFSPASDIVYRVVAPESTASSNSGPIYFQIRAPTSYQWVTLGQGCQLRXFNSSYVRRLFQQRNPFSWFGXGRSVKIKPRGAKRFYKDG

SEQ ID NO: 27561 - protein, 380 aa, A.fumigatus
SLESLDGFIGRSTGKSAMLCACPTYFRESESNSTFCKHVRRYSTEIKRQLPQECNAQKYHTSSQHSLEVRTFLVNMVGFDMCGLTPAPVTPFTQDGAVDYEAIQRLGSWLGSIDGVKGLVVLGHAGEGTFLTAEEQVSVIKAFVKSVDGKVPIIAGITGEGTEVAALEAKRAKEAGAAAGLLYPSHGWLRFGYQRGAPQHRYRRVYEVSGLPLILFQYPDNTKATYDLQTMLDIAAQPGCFAMKNGVRNMRRWDTEIPIIRAQRPDLQILSCHDEYLLHTAFDVDGFLVGYGNIAPEPLIELIKAGKAKDYKKAREIHDRLLPVTKSVYHRGSHMEGTVALKHGLVARGILEHATVRSPLLPLEPGAEQENMLLSMLFTQ

SEQ ID NO: 27562 - protein, 96 aa, A.fumigatus
KVSWFLDTLARAHFLPPRSKSQSSKRSSNRLMAKSQLLLASRVKAPKLPPSRPSEQKKLELLLGCSTRLTAGCASDTNVVPLNIGTVVCMKSLACL

SEQ ID NO: 27563 - protein, 136 aa, A.fumigatus
IRPDFPDFTVPSRRKRLSTPRKWTVSWPRLDHPHKLWKHTVSSLGRVTQLTGLGPIQQGYLTAYTTRLVTLVVCRGFIPARGDIAIRQPAPGEKLTSHQQPTISNHCLRHRLFPRANGPGLLQGCRRTWSVVSYIK

SEQ ID NO: 27564 - protein, 136 aa, A.fumigatus
IHRSVMSLPQRPGKVSPRREETQAFRDTSRRRRRDIESGDNETLSSPHRHHHRRHSQSSRKTRDMDEERLEPGGHRKSQVRPERSRIDENHPNYHYRQKSQNMPVYPSTTGNEPLIESDELNRDSSPEYRAHKQGR

SEQ ID NO: 27565 - protein, 325 aa, A.fumigatus
SLLLERGKTPLPHGSASQGRKVDVASSRPAKTFRAKDWECPRCQFHCVGRNFTCPRCNTPKPNLDAPAPESPRQIKQGQNALKILRLAQSLRSEYTNAGRRPLGDLIPEAGGSRNTALDNYLVEIGRKAESLPASTELETQSLAEQPLSNARDEVTESGGADRQASEAERTSSKPEADPWTWDQSALEKLQQTYEAEAQSGQKPKRWDGRKERGDDVDYEEFDPEDDRRRRRQERKRQKKEKTRQKELEAAAPSPLYLPEFISVSNLADVIGVRPAQFVRRMEEMGFEDVSYSHILDAETAGLIASEYNFEPIVFTTGLEGSAVV

SEQ ID NO: 27566 - protein, 297 aa, A.fumigatus
  UNSURE (294): Identity of amino acid sequences at the above locations are unknown.
YGQYHRGSATLQLHHSGYATASTVEVFEWLMIRGTVVALFTVGGIFGSLSCIYLGDRLGRRKVVFLASGVTIVGAVLMATAFDFAQFIVARLVLGLGTGAYLATVPVWQSEISKASKRGAHVVTDGIFIGIGVSLSLWIDFGFYFITGKSVSWRFPLAFQIVLLLTVMVFIVIFPESPRWLVKKGRVQEAREILAALADVEPDSESVSADIRDIELSLSICGNGSFKSMLTMGEQRLFNRTLLAAGGQMFQQMCGINLISMYATTIFEQYLGMSAINARILGAFLTAVIEGSAXPPT

SEQ ID NO: 27567 - protein, 93 aa, A.fumigatus
DTCSACIYFTTEMAPYFGLRGSTLSQAIICLVVCPAFVTYGYNLSVAGGLLTLESFVKTFPQIDTVNTTGAQQHYNSTIQGMPLHPLLKYSSG

SEQ ID NO: 27568 - protein, 166 aa, A.fumigatus
IIRRLILDIIGTNTYLIGRGHQRILIDTGEGKPSWANHLKSVLAKENATVHKALLTHWHHDHVNGVPDLLKICPQATVYKHRPDEGQLDIEDGQVFSVEGATLKAYHTPGHTVDHMMFVLEEEDAIITGDSESYSPLCGCSTWSPLRLTFFFTLSFRRARSRDSSI

SEQ ID NO: 27569 - protein, 106 aa, A.fumigatus
HACPSSPVVKISLGLSCTSQVLNALLVDLWPKRSAAATAANNLFRCELGAGASAAIAPMTNAMGHGWAYTTLALICVLSTGCLWWTMFFGIQCRQKRAQREQARRS

SEQ ID NO: 27570 - protein, 93 aa, A.fumigatus
KHSPQLMVKGVTTRSPFLKFRTAGPVSTTSPVNSWPIMKPVLEGWWPRKTWSSLRLSRYDGIFQAEKRGLTCRIVPCYRTLMNASVGIWICGY

SEQ ID NO: 27571 - protein, 312 aa, A.fumigatus
RERRSELHVFRGHQPSSTGFIMGHEFTGEVVETGPAVRNFRKGDRVVTPFTISCGECFYCARGCSSRCAKGKLFGSAVLDGGQAEYVRVPLADGTLVAAPAAVDEKKLVLMADIFPTGYFAARNAFRGWDEEDVRGSTVVLFGCGPVGLCALISALEYQPAALIAVDSVPDRLERARSLGAEAWNFQTDAQGLRERVLELTEGRGADVAIEVVGHSSALRMAFELLRPWGRISSVGVHNGEIPWTGNEAYGKNLQIQMGRCPVRSIFRDALELLLKKQDSLECVCNFLLMARLTMSRFMAADIRPLSQAIAA

SEQ ID NO: 27572 - protein, 219 aa, A.fumigatus
TQEMGVELGGPGVDHSHPGYPHRPMNPVLATPLFVLSGVFTVLFLCRVVIRFQHRRRLREILQTEDQCKFSRTSVIFAWIKKHVLYAPLVSKRHSREFQLLNRLHMGSIPLRLEATLVLGYITTNLLFLFVLVDWWTDYQEKMYQLKYAAGHLAVMNSPVLVLSAGRNNPLIPLLGIPFDTFNFLHRWVGRVMIAGALIHMGCVIGAQAMQGGWFSRLK

SEQ ID NO: 27573 - protein, 113 aa, A.fumigatus
ALIAFVVIFFQSVSPIRHAFYEAFLHFHIFLAIMAFVGLWYHLRGLAQQRVLLATLILWGLDVSYLPLISSWSSIKVRTAHASLQRMHFSSAFSGRIAGNTVLPATGEWWPGN

SEQ ID NO: 27574 - protein, 171 aa, A.fumigatus
RQKLIAARYSTNGYVIRKGSIRLFKLPSSAGVAICDGRRPSSCCWPSQLVINFCTRSRVSASRSSCCRSTVIRSRTKSAGFVVLGHSYPKDRKYGSIFSPSPAYTVYPPRASSRTLEKCWNRSDRDWWMVMIRVRPSAASASRTSIIDVAVNASRPEVGSSNSKTLGSVRI

SEQ ID NO: 27575 - protein, 86 aa, A.fumigatus
IQDANEIGMLQNIAIYPNERDVFYREEADHCYSAETFILQYTTLEVPFEAISSIIFGVLAAYADNLERSPKMFLISAFNWFCIISF

SEQ ID NO: 27576 - protein, 587 aa, A.fumigatus
  UNSURE (1),(2),(7): Identity of amino acid sequences at the above locations are unknown.
XXTILTXYIAVTFAAVSIGVASSFPGASIVGNLSFTLQSFACGYFVQSNQIPVYVRWLKWVAYTFYIFGALCANEFIGPDGPPEGQFYDCPYSTDPSNPACTQYTGRYIMENLGFPSNWIWRPIVILVAFVIGHYLLAGLLLQYNRFAIDIAQARKTDVDLSAGKEKFAERRSEEARPVAISLDKYALEIRKRQVSRRGSRTLSILKPITAEFQPGKLNVIMGPSGSGKTSLLNSIARRLRGSLGTQYRLQGNMLYNGAVPSESVIRSVTSFVTQDDDALMPSLTVRESLRFAAGLRLPQWMSREEKNHRAEEILLKMGLKECADNLIGSELIKGISGGDKRRITIAIQILTDPKVLLLDEPTSGLDAFTATSIIEVLEALAAEGRTLIMTIHQSRSDLFQHFSRVLLLARGGYTVYAGEGEKMLPYFRSLGYECPKTTNPADFVLDLITVDLQQEDREALTRERVQKLITSWDGQQQDEGRRPSQIATPAELGSLKRRMLPFRITYPLVLYRAAINFWRQPPLVMARSLQVVGIAIIMALFFAPLKNDYAAVQSRMGFIQEFAALYFVGEFSSIIIQRVRSKMLMR

SEQ ID NO: 27577 - protein, 60 aa, A.fumigatus
KDHAYQIIEKQYILPVLHSWMTFYYVNDYIVIMCCNKSSAEERMELVCIPAKHTSLGYLT

SEQ ID NO: 27578 - protein, 106 aa, A.fumigatus
MALPADPSSPVVKTASQLAKLNLDDVVDDMNEVSLQGWAELLEKKGITRPGPISPFLEKDVIKDQDMSIDGTLFEKTTGWKPTRERFDAEGVRAMVDSYKRMGWWP

SEQ ID NO: 27579 - protein, 67 aa, A.fumigatus
SNFRLLLFLSSTSGSTTVSTGMFLISSAYPSAYFITFLTSESAASSSSAHDPDEHVDLGVHNITYAL

SEQ ID NO: 27580 - protein, 116 aa, A.fumigatus
  UNSURE (10),(43),(45),(60),(97): Identity of amino acid sequences at the above locations are unknown.
AWSSMVSMRXSSFVIAASSFSTLGALALNFDFACLIFSHEIIXHXLGPLEAVFELAGLIXLLPFGGQASHSSSQNFFLNLLALVLQVGRLDGSSPHXILMASANLEELCGPSSFFE

SEQ ID NO: 27581 - protein, 62 aa, A.fumigatus
  UNSURE (28),(53): Identity of amino acid sequences at the above locations are unknown.
EKIRQAKSKLRARAPSVEKLEAAITKLXQRIETMELQAQDKEDTKEVALGTPXIVSHPPSTP

SEQ ID NO: 27582 - protein, 433 aa, A.fumigatus
LMRLLQPRREDRIPGMPARRTTILCSATLKMSVQKLGEISLKDAVHIKADPEDEDEKARRSKAEESAYRVPAQLKQSYAVVAAKLRLVTLTAFFKRTFMRKGSVMKAIIFVSCADSVDFHFEVFTRKQVKEDGGEPSDTDKSEEKPPSSPHGTIAPATAFSNPSNPVTLFRLHGSLPQNVRTSTLGAFAKNKEASVLICTDVASRGLDLPNVDLVVEYDPAFSAEDHLHRIGRTARVGRDGRALIFLQPGCEENYVEVLKRGYRDGGKALTRADANEILKRGFGGNVESGNKDWETKATDWQCEVERWALENPEYLEMARRAFQSHIRAYATHIAAERSMFNIKELHLGHLAKAFALRDRPSKINVPGLRQGKEETKKDFKAERNSAAGKKRKAGGADLADDIPSANNTATAAQKMRAKMKEHMAGANEFNLA

SEQ ID NO: 27583 - protein, 241 aa, A.fumigatus
RARVRHPRGEGRDIQLNVRGNKTLDDSFKDYIQVETLEGENKYDAGSPYGLQDAKKGVIFESFPPVLHLHLKRFEYDINRDAMMKINDRHAFPMEFDATPYLSDAADKSEPWIYQLHGVLVHSGDLNAGHYYAFLKPTKDGHWFKFDDDRVTRATDKEVLEENYGGEYELSNGAAGVRQPHTRGLSTKRSMNAYMLVYIRKTRLDDVLLPITKDDIPSHIGKPYAFSSSASRCLTLNQRSV

SEQ ID NO: 27584 - protein, 117 aa, A.fumigatus
GHSCSFLRQQLFEVLVPRDGTFADLLAGLQKKANLEDDVVREMRIFEAHSGKIYKEYQEDAKIAGINEYVTLYAERIPEEELQMQAGERTINAFNFDREPSRPHGIPFKFVMKPVCI

SEQ ID NO: 27585 - protein, 416 aa, A.fumigatus
  UNSURE (99),(102),(203): Identity of amino acid sequences at the above locations are unknown.
ALCILFLREQMSDIESEKRLVEERAELLRRKKEREEAHLYINVGVLSDESYTSHHGFDLTSADLPAGDPALPKQYRILRAKKVGEFVEQLAEERGLNAXQIXLWVMVNRQNKTTRPDQAIKDPEMTVEEAYSRFGTKGNRFKVWMEVGQPSADGTISWADSSTSVLVFLKNFDVPSQILSGVGTVYVRKNQKVAELAPTILEXMNWPAGTEFMLFEEIKHNMIDVMKPKQTFQQSEIQDGDIITFQRTVKESDLPSTALYTEARQYYDYLLNRINITFAPIKATDGDEFTLTLSRKMTYDQFSKKVGEHLNVESTHLRFAPVLASTGKPKQFIKRNPNQANQTLYHILSGQVSGYGYSMHRQDALYYEVLETSLSDYESKTTLKVTLLTEGIVKEVSSPYHRALGSFMLIFTSATV

SEQ ID NO: 27586 - protein, 75 aa, A.fumigatus
FQSYSTRNLLIHSLPIPIAFVFPTPYPPVWSCSFSSSPISYLPSDVSFLLLFLFIIDSNSPEHLNRPSAITYIPT

SEQ ID NO: 27587 - protein, 95 aa, A.fumigatus
CPAAAAKTLDKPLKDIRASITEKTVDIFSGYRKVFSGSHPPGQLVLPENLKEFSMYMLSMIKSRAFKGEVYYGCNNGFTANRASRWSGIVRPADS

SEQ ID NO: 27588 - protein, 235 aa, A.fumigatus
  UNSURE (211): Identity of amino acid sequences at the above locations are unknown.
SSRGRSKVRYTTVATMDSPLTGQVGGQESSDRRIHDIRMLRSIGCTELSLYLYPRIIPIHNMQPEDGFPNEQGQLQVPPALRASYSKIEEGGAYLVDNGQMILLWLHSQVSPNLLEDLFGPGQTSLQALNPQLSSLPVLETHLNAQVRNLLQYLSTIRGSKAVAIQLARQGLDGAEYEFARLLLEDRNNEAQSYVDWLVHIHRQINLELAXHRKREDTAGEGTLSSLAGLRAPYW

SEQ ID NO: 27589 - protein, 81 aa, A.fumigatus
NGGSSRKRCREGSEGSEGSEGSEGQKNKGSFTSLPFFDLQELETWILSLVSGNKVIGSCDSDWGSGVGFARQWIQDRGVSI

SEQ ID NO: 27590 - protein, 88 aa, A.fumigatus
GAKLKDQAGFRVTLALFAYMYIVVVVYIAIRLSDFSARSVLVGPQRPESVKAARVKENDLNFRERRITIDMDRHRASRHKFQVIKIRC

SEQ ID NO: 27591 - protein, 310 aa, A.fumigatus
VGVDFQLHRADPSSPVVKTENTAEIMFESFNCAGLYIAVQAVLALAASWTSSKVTDRSLTGTVIDSGDGVTHVIPVAEGYVIGSSIKSIPIAGRDITYFVQSLLRDRGEPDSSLKTAERVKEEYCYVCPDIVKEFARYDREPDRFLKHTVTSPNGRSVTIDVGYERFLAPEIFFNPEIYSSDFLTPLPQVVDGVIQSSPIDVRRGLYKNIVLSGGSTLYKDFGRRLQRDIRHLVDARIRASEARSGGAKSGGLDVAVVTHKRQRHGPWFGGSLLGQTPEFRSYCHTKAEYDEIGPSIVRRFALLGGPGST

SEQ ID NO: 27592 - protein, 319 aa, A.fumigatus
DYFGHARLCPEYLLPDFTHYILHLFPETFPLCSCLAMDSPSDTPSKSKQKLCKQACDNCRRRKIKCSRELPCDKCSRLLLSCSYSDVLRRKGPKFRTLYPLAPIHPLISRSRDTLHYGPRQHTLDKDFLPEAGGYPLGASPTSPPFSLGDVQFNSQDFLDSLTRLAPPELVSSPDSTNSISDPGTGQCSPFSRRLTSPVLLAHVNVYFKYIFPIMPVVRKEGIQADCHQLERLSSRRYAFLASLCAATHIQLKFDGAMGPPAFNTEAQSMMSGEELLAEAVRARKECDPVDEISIESLLTSFFLFACYGNLDKQEQAWS

SEQ ID NO: 27593 - protein, 78 aa, A.fumigatus
IHRRCRVLLSLINGRRAFFSILQTQYFILSFVDTIITSVIQFSLVCLIVCSQRSELHIRCNNFFSPSIAILEPSNHHL

SEQ ID NO: 27594 - protein, 490 aa, A.fumigatus
GNGQAAPGSQMESWRERGFVPDSDSEVDFDSQELKVVIGRFEDGDGGTEEVVAPNVKLTALAADDETNEGELDDAGDDGINKAQNEVLGLKDAEERTSAIDKAEEDSATTVDSRKKTSQSDSGSVQGNQKDPASQSARATAKVPNSSPSSGGVTAMNPSAPSTPRTQPHAAIWDIPSSPDELQFDLQPSRRLVTYFSKKKDPETQKNSPTIDEAETQLVNENDNISPLSSPLSSLHSISLGEDDESLRDRPEGHKETATTETQAPQNREEPLPPFESSDRILQEMSQPMRRSLRQRNPIQLHPYLLEDAKYRSLMKARGLKPVRVPLHQAVHETADESQIKDFEPPSSSPVEDFQFPPSSPIIDHPLPDRHIHKESSHRRGRVDPQFQDHLANRPDARPSKRRRVSRPRNTDRRSLIHAPQPKVVIGQSPARPEHESIFNIPSPPRSGSISSTQTSQHAEGFRFPLGFTPPTLTTPVTEPRVNARQCYKL

SEQ ID NO: 27595 - protein, 322 aa, A.fumigatus
  UNSURE (233): Identity of amino acid sequences at the above locations are unknown.
SHQDTAHRTVLCTNAQLSIYHHPIKNPASILVHGFHLLIMSNMNPLCTLGMTRRVTRSAAAREAALFAAKAQDVKPQLTDSNGPDVSPKTGKSTPGRKRKLPIEHPEKLSKSSKTSKPKGSLPSLNVNDDLPHNLGSVSQPLESINVEPKLNKQDPGIGEEEDLDNLASDLQKTVDKATEGLPQQIKISKKKNPYGLTPGATPFPEWARPTPEECEEVNRLLSSAHGEVIPPXKIPEPSLTVTGCGEVPSVLDALIRTLLSGATTGRNSALAFGGLVQRFGILEEGIGKGSVNWDAVRQAPLKDVFEAIKRGGLSEMHEPER

SEQ ID NO: 27596 - protein, 111 aa, A.fumigatus
THCVGFSGPVVEDRLFGPSGEDRGEGRKIKAVDRAKEAVTHGFANEEDYQIAANGVKLDQHGKIVPAKYPGESEVLQAGFNRCNKPMTHEDEPPKVKDRMDISIHNIADHE

SEQ ID NO: 27597 - protein, 161 aa, A.fumigatus
VATPQVEEPRDEKARLRHVEQTFIPSRPPDDSEPGPSAGHLAMPTAPVLPEDDHINGYHHLPSPVENCLPHTLGSAESVQTVVASSSVAEPNGSTAPPGEDKQELERRRLMMEASAPEDMDAHTDNSAMDGPSAPVFHDDHDEQLVGGAAHGDESLPRYQR

SEQ ID NO: 27598 - protein, 106 aa, A.fumigatus
LFTSDNPNKPIGRQIDNYCHLNLGYLHPTAIGVRSKRAGLAPSLSGHATTLIFIASHQPFALVFSFSYLIFSAVSSSVNNPFQCFSIASNHGLQERVLCDLPDRLS

SEQ ID NO: 27599 - protein, 151 aa, A.fumigatus
AATRRHLSSSPLTSHSPSSSPFPTSSFLPCPLPSIILFSASPSQATMAFRNGSFATFLIVCRKPPPIHLLEHFLFRTTILTGLPKTAVSFFLGIIFSLFPYDYPILWSTGPTPPAHYDYLEAHLRFLHASPPLIPRILHIVIFLGLAGLVS

SEQ ID NO: 27600 - protein, 328 aa, A.fumigatus
PTSHRYKAASLPASFSGLKAAKTKSGDIRFVAYGQSYPNGTAYNEELATAPLSSARIYDSIYVRHWDYWLSTTFNAVFSGTLKKGHGKNGYSLDGELKNLVSPVKNAESPYPPFGGASDYDLSPDGKWVAFKSKAPELPKANFTTSYIYLVPHDASETARPINGPDSPGTPKGIKGDSSSPVFSPNGDKLAYFQMRDETYESDRRVLYVYSLGSKKTIPSVAGDWDRSPDSVKWTPDGKTLIVGSEDLGRTRLFSLPANAKDDYKPKNFTDGGSVSAYYFLPDSSLLVTGSALWTNWNVYTAKPEKGVIIEDCVCQRDRSRAQGTWSF

SEQ ID NO: 27601 - protein, 71 aa, A.fumigatus
  UNSURE (17),(25): Identity of amino acid sequences at the above locations are unknown.
RTISGPLSTNGAISRPXASTMLALXTQDCGDQDSVQDSPVFLCFSAHTDQAKLSEAHSWRGEWAPYERPWM

SEQ ID NO: 27602 - protein, 109 aa, A.fumigatus
KVAVFSTSQYSFETHKRTSWWSLLDLKTGQTKVLTNDSSVSEIVWLSDDSILYVNSTNADIPGGVELWVTQASSFAKGYIRLPVTSFRRLSNRPRIDTRQPLCRPPSQV

SEQ ID NO: 27603 - protein, 334 aa, A.fumigatus
GHCLSIRTQHQILLKSRHHIDETVSTMLDKRGGPYPPHNAALGGLPSVIPDIPICAVFLALYIGFAATNMATLQINRRRSHKFLMSGMLFGFCMARITTLVLRIAWANRQHNVRLAVAANIFVNAGVLLVYIINLLLAQRILRAKQPRIGWNPVLRVAYKVLYALVAAALIMVITATVVSVYTLDRHTQAQCRDVQLAAITLLLVITCLPILHLLVAFLFPRSEQEETFGEGSMASKAITVILSSALCILIGGFKAGANWSTPRPVTNPAWFHSKTAFYVFNFVLEILILCVLALGRIDKRFHIPNGSTKPGDYTRLGLQLDKGKGMERAPASR

SEQ ID NO: 27604 - protein, 80 aa, A.fumigatus
ARANRRATALPVPWPAPAMIAIGFTIVNIGVCVPWGLGLQPQTTTYQLSSLTTVDIIAGMRCPEDAALAWDTSMEIPRER

SEQ ID NO: 27605 - protein, 66 aa, A.fumigatus
QIPQLYFEQAEELAPLLNLKLAVKRTSAGPVPMAGFPFFQLDRFLKILVQDLNKYVAISEKFANAR

SEQ ID NO: 27606 - protein, 194 aa, A.fumigatus
ISTWLSAKSLPMPAEDKSRGGLLFDRRVARIITPGTLIDEKFMDPSENNFLLAVYIDVAALKAQLEQQEGNLSAQQHILSSASQHVGLSWLDLSTGDFFTQSTTTQMLPSAIARIGAREILVDHKLQDLIGQELQLLVGHDHRLMTFFAYPSKILPIAQWSSVLEAQVADQDSDAFTPEEVAAGYSLLEYIRVQ

SEQ ID NO: 27607 - protein, 186 aa, A.fumigatus
CPKTKKKPGRPTDIERGAIRESEDVLAREQRKRRGQQQLRGQGILSAADALIEGLKYRPRTPATRATYDLILTMTASHLGDVPHEVVRSAADAVLELLKDEDMKDFDKKKEIDDLLGSSMSPKEFNELVNLGKKITDYDAQDEDEEMEGGMDGQEEAELDERQGVAVVFDEEDEDDERMGTVTEVR

SEQ ID NO: 27608 - protein, 176 aa, A.fumigatus
PNIIMEYRTQAGEKEAPDRDQLCCCSVNPLLWLVCRIASLMLLLIRYSGYDQGMMGGVNNAKDYIDLMGFGYTEMKDGQPTPVVTNSLLQGGIVSVYYLGTLCGCLLGGWIGDSIGRIKTIASGAVWAIFGAALQCSAQNHNWMICGKASFLPSTDRFAVTDQTQPALSTGLAPVF

SEQ ID NO: 27609 - protein, 65 aa, A.fumigatus
PNSARFINGIGTGILNAIVPVWATETAEHTSRGQFIAIEFTLNIFGVVLAYWLSTRPGAGRLPRC

SEQ ID NO: 27610 - protein, 437 aa, A.fumigatus
  UNSURE (181),(202),(434),(435): Identity of amino acid sequences at the above locations are unknown.
NNITEVGLFCVFGVKMGSKKSQSKPPPSAALDYKPANKLRRQMLHVKRKRAKDSERRAERFGRKKEEAKNPKLKEERLKRNIPLTLDRKRVWDEADSDVEDALGLSVDVERIKRQKKEEEDELNRPLDDKDSGSDESEDDVDSMLATSDEEEDGDEKAKKDDTRGRKKSSLPSATERATSXSQSTRSTNLNLAPEALAAKFXTLFPSEPHPTPKILITTSLNSTLHNEARSLTDLFPNSVYIRRTAHRYSHKFSIREIAAFASNRNYTSVVVLQEDQKRPSGLTIVHLPQGPTFHFTISRWIEGKKLPGHGNATEHRPELILNNFRTPLGLLTAHLFRSMFPPQPDLEGRQVVTIHNQRDYLFLRRHRYVFREKRETEKSVVGTDGKEIKGVEGIRAGLQELGPAINFKLRRVDKGIRLHHGAGRSAAKVQSIXXEG

SEQ ID NO: 27611 - protein, 164 aa, A.fumigatus
  UNSURE (8),(29): Identity of amino acid sequences at the above locations are unknown.
GSEGNNVXNLAASASGARLRFVLRVDWLXEVARSVADGREDFLRPRVSSFLAFSSPSSSSSLVASMLSTSSSDSSEPESLSSKGLLSSSSSSFFCRLMRSTSTLRPRASSTSLSASSQTRFRSRVSGIFRLRRSSFNFGFLASSFFLPNRSARRSESLARLRLT

SEQ ID NO: 27612 - protein, 204 aa, A.fumigatus
EENQGKGEIFDFSNSRSFHLLRTSSPCLSLPSFLRFVGSGGRLTWWMTQLPFLRLSLPRQIPLCSPARSFFHTTAALQAVQASKKNQLTMATVNTKTGKVVDRTVLDSMLRRRLFYTPSFDIYGGVSGLYDYGPPGTALLNNIVDLWRKHFVLEEDMLEVDCTMLTPHEVLKTSGHVDKFADWMCKDPKTGESLHHAGGRIHAK

SEQ ID NO: 27613 - protein, 127 aa, A.fumigatus
  UNSURE (75): Identity of amino acid sequences at the above locations are unknown.
PGRSARSATSPRSGTRTISPSAAKQTSTSNSATPPRMESTSSPCSTPPNSANSCTIKRNSPSPIPSTSLMKHTPXHAFPLRLLIAIVVLLDCHSLFQIALGACTWGINYHVRPFALTTVILCCSITC

SEQ ID NO: 27614 - protein, 273 aa, A.fumigatus
  UNSURE (218): Identity of amino acid sequences at the above locations are unknown.
TIGSDICYIRDALPSSGPWLGLVNMYRNVSRWTACFGCSYDPWLIAVCRQRWGFWLLYTQLSSPFLGLHGCFSLLVCSPPQILPTPAADIQKGWINVGGRQLYVINVIDNVLVALFAIMGDGLAPFRAIDTYHMIFIAHYTFLTWKIRKKRDLPALRDKNDLPERREADVDVELGDSPKDGEHEFSVLNPTQQRKLMHHQEKFAKSHTFYKPHETYTXPRLPTTPPHRHRCPPRLPLPLSDRPRRLHVGHQLPRAPLRPHNCHPLLLHHLLKS

SEQ ID NO: 27615 - protein, 348 aa, A.fumigatus
RMYRTETGQLMTSFRPPEDKGWDWVRPSEQVKKYLVFEERSPGIYELIVLDGWPSKVLSNRPDGSYATKDLFLKHPTMEAYKYYARLDDTIVLVNGEKVNPLDMEGRVRQHDAVSEAVVFGAGKACIGLLVIRAPGTEVISDEELNEAIWPAVTRANQTMPAFGQLSKSMVRILPADTQYPRTDKGTVIRQAFYRTFSKLIEEAYEAENASTGALTLSEAELKDFLREQLHRLLPLKNGHVVTDDADFFTLGMDSLQATQLRSVLLKTLDTKGQKLGLNVAFEHPTINALARYLNGLGSGVSDGPVPVEEQMSALISKYSQFEPHRPIPNGLKGRYVVSLSFSSISVI

SEQ ID NO: 27616 - protein, 161 aa, A.fumigatus
TEDVDTNLVPHLDSEAESKHVAWIIHSSGSTGLPKPIFQTQSAVIKNYAGNMNMTGFITLPLYHNHGLSCLFRAVHSCKSLRLYNAELPLTKQYLLDIMRSHEFEIFYGVPYALKLLAESSEGIAVLAKLKAVMFGGSACPDSLGDLLVENGVNLISHYGT

SEQ ID NO: 27617 - protein, 66 aa, A.fumigatus
TGAHKAVHLLDVVEGGDFRGDMASKGSSGARDNLESVNYMTDMDENDKLTTYLPFSPLGIGLCGSN

SEQ ID NO: 27618 - protein, 111 aa, A.fumigatus
KLAKCRHCLVRPCNGGPDGFIEFLVRYNLGARRTNNQQSDTSLSSSKDNGFGDGIMLPDSTLHVQRIDFFAIDEDNRVVQSSVVLVCFHSGMLEEEILCSIRTIWSVRQNL

SEQ ID NO: 27619 - protein, 93 aa, A.fumigatus
QTSFIVFRSDYGSPFFVLRHVHPMRRTRIWASDLQRVIDTAACFASGLFSLNQEKNDKATLFTQKEWGHFTYARDAIHYYRAGPGNPYAGAMG

SEQ ID NO: 27620 - protein, 212 aa, A.fumigatus
SSWRPVEPVDERRKGPTGPLRRSKKSRRYVIDSSLVDHLLTVSPAFRDQDFAHLPIEKALEFGGYFGRHHIHQTSGAPRGYPEIHLVHRGADDRSGAEFLATRTNTVTWHSDVTFEKQPPGTTFLYLLDGPTSGGDTLFADMVQAYKRLSPEFRKRLHGLKAVHSGIEQINASLNRGGIARREGITSEHPIVRTHPVSWPNFSRLVIVIDIV

SEQ ID NO: 27621 - protein, 77 aa, A.fumigatus
TTDTIRDPPLTPFEHYDHGKDADPSFPDLLPPGKVQVDNLTPTIGSEVRGVQLSQLTKEGKDQLALYVAQRKVVGTL

SEQ ID NO: 27622 - protein, 88 aa, A.fumigatus
LISFRLLERKPCLSIHNVSILFTKDRVSSNWAVTRYIVGYKKEESDMLLKFLYDHIALSQDLQTRVRWLPGTVVVWDVSILILRSGKY

SEQ ID NO: 27623 - protein, 136 aa, A.fumigatus
NLDIQRSLETNRRTNLIMPCRNNNNNTPGPWGSQCACLCLDSTGQRDFIEGGAFMESDDEEGLAWQHVEDISILTPEEQDFSLGATGRNRENGFKNRCISESASAKECGSKKGIFGFCAKSKCKGKGKTKGLAGKN

SEQ ID NO: 27624 - protein, 68 aa, A.fumigatus
FEKSAYSSLDASNCRVDAEKDPRLEADTGYKGNQSGFCLKWQGMDGCFVTEQGLVEQSREMAGFLTSL

SEQ ID NO: 27625 - protein, 198 aa, A.fumigatus
PLLSDKTTVHALPFQAKAALVSLIASIGFKPRVLLGINTAVGSVQGGVGAFLELPKVSVNVTQLRNVNEKCESVSNGEGKLTSMLDNIVGDFTNIVPTVDINLGALANFEVDVPRVFTETAAVQTVLASTSYPLPTACLQFDSESGEYSSPTPTPTPTSVSSAVGKAATAEAKKSRAGSVGINRRFVFLSVIVSLCVF

SEQ ID NO: 27626 - protein, 159 aa, A.fumigatus
KEENAAFCIFQPFSLPLFRLINTSWTMATANASITDSPRKSLILNAFVEMCTHSISPCLTILTYHRQRPPVSRAVATPRRRIVPVQRRRPLDRAGTVVGIRQVPWHLHRRRPRWLRRVQRGSKTCSGDCFRNRNGPVNEPASLWFPAKCTLQQKIILLW

SEQ ID NO: 27627 - protein, 97 aa, A.fumigatus
HTTGSGHQSPGLWRHPEDESYRFNDVDHWIELAQLLESAKFHGIFIADVLGGYDVYKGARKLAPAIVSGTAMAPSMSPLACGFRRNAPCNKKLFCFG

SEQ ID NO: 27628 - protein, 110 aa, A.fumigatus
SPITRGSTQMLIPNPAAGELENLIDEFSEGKIQFAFVKVTDPNSGLPKNVLIGWCGEGVSKRTKGYFTSHLSAVTKFLSVGAPLSSLDERNILILGYSRTTMFRSLHALR

SEQ ID NO: 27629 - protein, 284 aa, A.fumigatus
YSDIRLLQNYHVQITARSEVDLTPEGIIQKVGDASGAKYTPERASPVTALPKTFPVTSKPAFTPTRTVAVGSKTCSNVSTRVVPRTSGDEDDWGPDAPPVTRTELEKVQSAYKPTKVDIEAIKSQNLPRTSYYRELPVTENNDVVKGGYQPIGKVDIAAIRKQAREAGELKEDRPEPVRGAYEPVGKVDIAAIRSKAQKQPESSVDQSISSNPVGSRNERVEPSDFSKLADQPERLTTLPKPKVAKKIGISSTFTGTKAPLPGGFVSSPVPPTTQVGIAKPTFW

SEQ ID NO: 27630 - protein, 67 aa, A.fumigatus
CPKSACLGPGTTTYIHGFVGVIHSSTHYFIMMYQHASNWCFAMFERSLSLHSVFVSADPALGKVSYH

SEQ ID NO: 27631 - protein, 66 aa, A.fumigatus
WSASTIPYLHHPQAIRVDDWMRTEMETPRAGNEQGLVIQRIWSTDGVLVATCIQEVSQSSLSYLSN

SEQ ID NO: 27632 - protein, 107 aa, A.fumigatus
LQTTLADCPLELPQNVHHHTLQHKQVRDLIGDPEPPTSSTPYSRTPELRVTHKLAERKRRSEMKDCFEALRMRLPQSQNNKSSKWETLTRGTDFITASSIAFTLTFL

SEQ ID NO: 27633 - protein, 107 aa, A.fumigatus
HLLFSAPVDSRKPDDDEEGAVNPGSNLFVTGIHPRLTESDISRLFEKYGDVESCSIMVDPHTKESRGFGFVKMVTAEQADAAKEGLQGEVIEGRTLSIEKARRSRPS

SEQ ID NO: 27634 - protein, 191 aa, A.fumigatus
LCSCWGYGRCLPSRILGYGEGQPFPCGPRRLCSCDATGDSNRFDWRSAHTLPEILQYVNALKPLVACINPSIDRFYGFTENAREVEMDMREMVDKVKKGEPLYGTSQVSSYLQGVAARNSRYSQLFIHVLPWFNIVNHDQVSLFVFHCCPQNFEHSSQFANVRQHGVDTAKYYQQAERELEAERLTTAGSH

SEQ ID NO: 27635 - protein, 106 aa, A.fumigatus
SLTLHCSSLTLIRMSLPFAQALNCGSRYSHQHRHLRRVFGYARPSDYAVAGGMAAASPLAFWAMERVSPSHVGRGGFAPVMRLATAIGLIGGLHILYQRSCSTSTH

SEQ ID NO: 27636 - protein, 503 aa, A.fumigatus
  UNSURE (28): Identity of amino acid sequences at the above locations are unknown.
TEQAALSSSPLQIASWNPSLCPSISLEXYLSILKQVSHLLGTNPVSTVQHKKHCFLRSTSSSLAVVSETYLSSKVAHVPAIHTHTEYRSGGRLSLCLHGETHRHNHSAVRHPQNTQHRRKHDVRRHGVDLRRDLPAPRFAVSDQCLSSFRSVVRLTYLSTNSSIRSISNSSSGPVDLGDDRILPPLPRAEPLPRGPFNPFTSNIFAPSPPSPHDTIPAKSSWPVSEHIVTPPSPANSADSSWPDSLTPRKAFDWSQELSPADLLSLIAPKNISRKPPLQQLCGRKRKGSMISADVDDQREKHRIAEGNRRKNLSQLHRELDSRIHDFFLERAGWNPAKSLPESKEHIVQGAIFLIDFMLLIIVHLIRQENEMPRQLSEKLQPQIRCMQLQQLVSNLQQQQQTAQQQIKVLKQENQLLEERNQALEFQLKSYEHMFRSPKSEQTSPRPLALVPEAKTQNVLPGLRVLCDGIAAPSAAPEPLHPGSSHGQSFGRLHHGGRRIRAK

SEQ ID NO: 27637 - protein, 310 aa, A.fumigatus
RGSGPLRGEDIGDEEDDDDSDDDDDDDDDDNSLSRFIVDDEDDSSSVRKSKTKKGKKAKKTKKSLAELKKEASKNIKSKQKYLRRLEKTWVTSAKIEKTLEILQEIQDREDSEKTIIFSQFTALLDLLEVPIVRRGWGYRRYDGSMRPGDRNAAVLEFTDNPDCKIMLVSLKAGNAGLNLVAASQVIIFDPFWNPYVEDQAIDRAHRIGQMRQVHIHRILVQKTVEDRILELQEKKREIIDGALDEKAQKKVSRLGTQELAYLFVRESIPSSLNKRLTEFSHRAFGNGSLSFDMRGMGLHHGAGRIRQGQ

SEQ ID NO: 27638 - protein, 412 aa, A.fumigatus
  UNSURE (258): Identity of amino acid sequences at the above locations are unknown.
QLLRLSSISTGVHQTNHHNGGTGATNIRPAPTSVNVETGCTALGHLRQPTQLPQPLSLFSNISSLAFEDVIPNTNTYSVSQSTDGSDSSSWRDTKFRAYEVHQQTSKSNADQVELSQGVPYGSSRGVTTTGGTRAQGHNIPITRSKGIPDSSLPSDRRFVLQIPATSTMQGTEHMNVELGAHSPSAAGLGQASILPSPSSRKQPSSTQRVGLTAGVLGGLSMTFTPDPSLVGQSGVKSIINLSLVKTGSGSLQITTPXDNAYFFLKDRVVASESTAIVGTLSAEYSVNIATDADKPVQTDFLVPQGHITTPLLQSLQRLTTAHSQQLHITVTTSTHRSYSGSISSSASDQLDKGMSGRAIGVMVGAVAGGTCGFLGIFLIAVRHRKRKRRRIWISNQFWEDPNRSYISFGST

SEQ ID NO: 27639 - protein, 158 aa, A.fumigatus
  UNSURE (5): Identity of amino acid sequences at the above locations are unknown.
VFDLXGLRASLTAFIDQIDIGHGQSGKNFYYKTKHFVGPLQQLALQEKVSGDVELFYPDGPWPAPGGEELDVRAWGFGDFEHGLIKGLDISILKILDILDLYGPFSGVMGFSTGAAVAAIIASILERHERIQMFIRGHIHEGKLVQVFRDFGKLTDAI

SEQ ID NO: 27640 - protein, 106 aa, A.fumigatus
IAHPPLQFVVCFSGFRLGNLQYGSLYSPKLETPSLHLIGVLDAMIAGHLTEDFSAQFMSPKIQRFFGAHYVPKTDRTNQAVGKFILYWCRQSLSRSRTYLLPWNSI

SEQ ID NO: 27641 - protein, 198 aa, A.fumigatus
RSGAAPSGAIPSGAIPTGAVPSGAPNGFGGFGQGGHGGPGGPGEEGSGPSPTGAVPSGAIPSGAAPSGAVGGFDGFGQASENSGNAQFQSSGTSPFGASHSGSASGHQGGRHGGDHRGHHGNGSGAIPSDAAPSGAAPSGAAGGFPGFGQGGEGSGPSPTGAVPSGAAGFGGQGHGQGQGSFPTGVAPSGVPSAQPTA

SEQ ID NO: 27642 - protein, 129 aa, A.fumigatus
EDLFTAFGAFQSYYQSDLLHTSSPSRIAWVGTVNAFFLISTGVIAGPLFDRGYLHHLMIAGCFLTTFGLMMLSLSTQYYQVFLSQGVCCGLGSGLIYVPALSLVSTRFTTRRGIAVGLVTSGASVGMLH

SEQ ID NO: 27643 - protein, 266 aa, A.fumigatus
ADENHSTPGGVLFPIIFIRLQPRIGFPWTVRSLGFIQLACSCIAVPLLMVTTKTRRSPPRKLIHWHAMKEWSFNAYGIANFLMFMAYFIPLFYVPAFASTALRSSTDLSFYMVSILNAGSAFGRIGSSLLTYRLGASSILLASVVASAVLLFGWIGIHSVASFVVFCVLFGIFSGVLISANPLVIAHPVVSPTPSVIGTRMGMQWFATSLGVLIGAPIAGVIEGHGGDNGFLGLQIFSGAGMAAGAAFLLVPLMAVWRHDNIQNKA

SEQ ID NO: 27644 - protein, 134 aa, A.fumigatus
HGIWDADSPRPRLSSLLFAFLPALAAAHRWRLEEAPSGKKWMQPPRDSSFANPSCSDMWSAEERGKAMGVYTLGPLLGPVIGPIAGGFIAQYSTWRWVLWATSAAAVGIQVVGLIWLRECHPATSSPRGRRYAY

SEQ ID NO: 27645 - protein, 186 aa, A.fumigatus
ESVDVSPPKMDDKTPFASCEGITPSPQKEDLEAAKETIPTKPSNTGPDLVTWSGPNDTENPQNWPNSLKWKNTWAISLFVFISPVSSSMIAPAMQDLGKSLGMNTEIEVYLSMAIFILAYAIGPIFFGPASELYGRVRLLQVSNAWYLAWNLGCGFAKTKAQLFAFRFLAGIGGSAPLAIGGGAIR

SEQ ID NO: 27646 - protein, 84 aa, A.fumigatus
  UNSURE (37): Identity of amino acid sequences at the above locations are unknown.
ICQASRISLTILNLIKSSHCLWRTKALCHHGESFRVXKGAFTFIDIAFCSFLTKPYVSRIPCNTTVQMASQVDGKYAWIVVATV

SEQ ID NO: 27647 - protein, 303 aa, A.fumigatus
ISLSSITPQPFCVSGSLQKLAVMAPFQGSVSVTYITTATAIINIDGVRFLTDPVFCPAGSEYVYDGWAKANWKEWGFQNRPPTSVLRSFDGPALQLHDIPPIDAILLSHEDHVDNLDPFGRQLLDGRRVYTTPDGAHNLQPRPGVVGLKPWQTVSAQIGGKDFRITGTPCKHFPGGEVTGFIVECESFGVDETGLPNVVYFSGDTVWIDELVEIKNKWHVSVAVLNLGNALFEYPRGMLQITFDGKQAAHFMRATGADIMVPIHFESWEHFTEHREDLQKVFDKEGIAENVCWLVPGVEKRVI

SEQ ID NO: 27648 - protein, 60 aa, A.fumigatus
SHQIKPCPRTTTAIGKNLHAPLSEHHIHHISQLLSSNLPLAEIQFRSSRLSNPAPLSLSS

SEQ ID NO: 27649 - protein, 192 aa, A.fumigatus
LTSPPPRRSSTLMGCGSSQTPFSVLLARNMSTMVGPRPTGRNGASKTVHRPLSCAASMVLPSSCTTSPRSMPSFSATKTMLTISTPLVASSSMVAVSTPPPMVRTISSHALVSSASSPGRLSQPRSVARTSGLLVRPASTSPAARSQASLWNVSPSASMRPAFPTSSISPATRCGSMSWWKSRTSGMYLWRF

SEQ ID NO: 27650 - protein, 122 aa, A.fumigatus
TQAWVDMYHKLDPKEHPSSIMTAFDSHGKQVGWTLMLSPSSPVLQQNWAFPPLCGPKTGLIGCVGVDEEYRKAGVGLALLCHAIEDMKQRGVEGVFVDWVSLEGWYEQLGFKIWRSYRTGQM

SEQ ID NO: 27651 - protein, 184 aa, A.fumigatus
SSTVVAQAGASNTEALFASWGFGLVNFLFAFPAVFTIDTFGRRTLLLFTFPQMAWTLLAAAFCFYIPEESKAHLACIALFVFLFAAFYSPGEGPVPFTYSAEVFPLSHRGKCAFCILHLLWDSSANYCHRGWNVLGGRYLPWLGCSFVHHVPTHASCDDPHWRLLFLCVSACPISSLCFSDVWA

SEQ ID NO: 27652 - protein, 174 aa, A.fumigatus
  UNSURE (5): Identity of amino acid sequences at the above locations are unknown.
TLSRXNHRRLSLKRVPAIPKPFLPLGASVWSTSFSLSPQCSPSTLLDVAPFFFSLSLRWLGLCSQLPSAFIFRRNPKLIWHVSHSSCSCLRHSTLRAKDPFHSLILQRFSLSPIVVSVHFAFCIFCGTRQLITVTEVGMSWAVATCLGWAAVLSITFPRMLAVMTPTGAFCFYA

SEQ ID NO: 27653 - protein, 95 aa, A.fumigatus
PMCSGLNVTALVMIFLWVPETKQRTLEELDYIFAVPTTKHMHYQCFKVLPWWIQRYIFRRDVKLEPLYKLDLTAHDEKVASREGGGQVISPNTEM

SEQ ID NO: 27654 - protein, 85 aa, A.fumigatus
FRLQAGLHLAGSIAAPDLEPELLVPSLKTDPIHKDSFDSTLLHVLDRVAEESKSDSCLTIFFIDSNAADQPGLGATEGWEGPVLL

SEQ ID NO: 27655 - protein, 82 aa, A.fumigatus
KTMVSVILCVFLLSYVYGEGKSNYFKGSILVLTYLVVVIGFYLAGYSNVDTMGVDRFDTLALGPIRSENFHTIGQPTRGMAF

SEQ ID NO: 27656 - protein, 230 aa, A.fumigatus
AFPTRAIFKCRSRNKTKYFTDNFERNIGKEIGSGTGSPQGFHTWVPHVIFMGNFWGNRSPIADPNMKGSIIGMANDKTVDGLAIYYYATLEFIALQTRQIVETMNKAGHSITSIFMSGSQCQNDVLVRLIASACDMPVLIPRYIHAAVCHGAAMLGAKAASADAEGKTEDLWEIMDRMSKPGKKVVPTEDKNEKALLNVKYKVFLEQCYKQLEYRKLVDETVSSWKTGDT

SEQ ID NO: 27657 - protein, 70 aa, A.fumigatus
AIGASKSFKLLRAYHRKPFIYIYDSNGVEEYPPSRSSIQYVNPQNKLSPQLTIPPLGTYETTTMLSNTPG

SEQ ID NO: 27658 - protein, 65 aa, A.fumigatus
LPVPGSSQRFIDKSRSLTADCVAYDLEDSVTPHKKAEARSLVRRALDLPGSIWHPRTRRSHQLGR

SEQ ID NO: 27659 - protein, 227 aa, A.fumigatus
LHTRKRKPARWCGERLTCLAPSGIRERAVRINSVDSGLALADLTEVVSETSPSPKVNNPANETKQLQSPNLSTIVIPKVDSASDLTFVTDVVSHTLSQQARSQDAASRPRLSLLALVESAKSLTYLTQICAATPLLQGLIFAAEDFALDLSLTRTPSLTEFLFARSAIVSAARAANLPSTIDLVCTAYKSTKSDGSPPAALEEECRGGKQLGFHGSLQPGGQEPRSA

SEQ ID NO: 27660 - protein, 138 aa, A.fumigatus
VSQLLERLSVTPSHSFSSANTVHSVLVFILTLLLLSADFYYLKNIAGRRLVGLRWWNEVNTATGDSHWVFESSDPATRTISATDKRFFWLSLYVTLALWIGLAVLAIVRLSSVIWLSLVGESSYADIDIDCCIAKVER

SEQ ID NO: 27661 - protein, 515 aa, A.fumigatus
DEDPRERMFYNALIKFRNEQLENYQGQPLEYSASDYHHISRLPASSANRRKHARVQGGSRRQGQNSTTTTTATTTSNSSSKQPQSKSRALKSSTTEKSYDPFRSPRHIIATPEVQCAQVTIHRNGPEANTKEMSEAVPDLDDDMKEEEVEDIDCLPSSPFSIVPNKKSKASFTRSFQSRASHSSARRVMNTTPTPRSASYKRNVLFLHHQNRSQASMSARPRKARANASSISRQESDCSIKSDEDGVLSSDRCGSPLLPVQPLVVRGAGITIKNCPQVKRVCDADIIWRDEARKVSHELSQICEEAFNGGSLSTGCTTSIGSETPATSLSMVSAGDSQNQITGSNIKSNQPSNRARDSPNTYTATELTETRRKLIQHSTQDGTESVPGYLSAVINHLDRLIAQDRIKERGKRDKSKENGNSTYDSLQRSSIDTGNLPIISEERSNSLAESEMRNGQDVTRHNSDSASSIQTKRQSGDGKATIRMVPQSSQQCLEEIKPLNIRKKRQASNESPQPR

SEQ ID NO: 27662 - protein, 391 aa, A.fumigatus
GRGLIVNVDVSNSCFWARTSFMGAAMAILDCRDHQHLMHLLKPVADGHGGVTESTGFYEVHRRLRKLGVQPHYKGCPCLGVDFIVKGLLNANARQYTIEIKDKATGKTQKMSVEAYFKRKYNLTLNYWELPMVEMTKKGVVYPMEVLTIHGLHRYPWKLNEYQTSAMIKYAASRPADRLNSIHKSKAMLDHAKDPVLNTFGLAIDNNMIRTKARLLPSPDIQFGGNQRLSPGTNGRWDLRGKRFYQPNKRPLEAWGVGFFPGKRNAINQTQVQQFCDLLVKTYAGHGGMIKNRPHILELREDIGEAIKRLYNTTGQRFQKDPQLLLIIVPDKNSFTYTRIKKSCDCRWGVPSQVLQSGHCVKLNPQYASNVLMKVNAQLGWHQLLGCTQSY

SEQ ID NO: 27663 - protein, 142 aa, A.fumigatus
IACPSSPVVKTKLEGGLRHLRIQNADEVAKYSVPVETVARPNHNQTGKEIEVLMNAYPITKFPTRNVYQYDVSISWYRTKAITGAAPFNKPKVQIGNGVEKNAVIKKVWNCNARKAALKQIVFDGQKLAWYVLTPTCPLSNH

SEQ ID NO: 27664 - protein, 84 aa, A.fumigatus
LRSRTRPSSYPIELSISLSFNESGYAHPTNDILGFVHKVADASKHSELWMKFSWVFYKADVTALVGKLEGREKDLNLVLTFIAA

SEQ ID NO: 27665 - protein, 141 aa, A.fumigatus
FISANMKKQLFHLAGDVRPVVLAAKVLKVLLEESTHLNDTVGHALDLAQPLLVELRVIHDGRGDASTVNGRVGVEGTDEDLDLRIDSLLLLSGFADERESTNTFAVETLVVQHGQSLKCFHEVEQPELTMFLAKLWHRAML

SEQ ID NO: 27666 - protein, 163 aa, A.fumigatus
TLRQGGSQHCPVPEFRQEHGKLGLLNLMETFQGLTMLNHQGLYGERVGAFSLVCESAEEKKRVDSQIKILIRPFYSNPPVHGARIASTIMNDPELNQQWLGEVKGMADRIIEMRALLKKNLEDLGSKHDGSHIPSQVKKLFFHVCRNESMLIYDRLACLPTLA

SEQ ID NO: 27667 - protein, 232 aa, A.fumigatus
SERVGDDKGKPYVLPSVRAAEDKVVASRLDKEYAGITGIPSFTKAAAELAYGSDSAVIKEDRLVITQTISGTGALRIGGAFLQRFYPHAKKIYLPTPSWANHAAVFKDSGLDVASYRYYNKDTIGLDFEGLIADIKAAPNNSIILLHACAHNPTGVDPTQDQWRQISDVMKEKGHFAFFDMAYQGFASGNADRDAFAPRHFVKEGHNIALCQSFAKNMVSSGCSTSWKHFRD

SEQ ID NO: 27668 - protein, 536 aa, A.fumigatus
  UNSURE (133),(151): Identity of amino acid sequences at the above locations are unknown.
YQPPNLCSSCKPSCSVMSESQSRPVSLTRYRPALYLLTGVAAAYALVYIHNNILFPSSPQTPLRRRRAVRRRRTGPDESDVSNTPSYRAIAHLEQLERQNGVYGTFRIETEDGPRVESGLLPSFLATRDQLMXEVGVPQAHAKRMREMMEXTFLESFLALDFPSAHTIEEGSAERNYLIEQLQRRGISRTGIERALARFNEDDNYGEELRRRRQNGERVTLSTSTFPEESVPLQNLDGGETVVDDQSVFSWREGNNESSPAPEGQNLLNLLYHIAEDQSRRDGYIHRQVTCNSCGAMPIQGIRYRCANCIDYDLCETCEAMQVHIKTHLFYKVRIPAPFLGNPRQSQPVWYPGKPAMMPRSLPRALAKRLMMETNFENTELDALWDQFRCLASYEWPDDPNKLCMAIDRKTFDRCFVPHTSIRPPPPCLIYDRMFAFYDTNNDGLIGFEEFLKGLASLNNKSNDERLRRVFRGYDLDGDGYVERKDFLRVFRAYYALSRELTRDMIAGMEDDFLEGGARDVVLVFTTGLEGAAQRR

SEQ ID NO: 27669 - protein, 117 aa, A.fumigatus
APYKTWQRIYDYDFTTNLTDAQAKHIIGATAPLWSEQVDDVTVSSKFWPRAAALAELVWSGNRDANGKKRTTLMTQRILNFREYLLANGIQAGNLVPKYCLQHPHACDLYYDQSAVA

SEQ ID NO: 27670 - protein, 62 aa, A.fumigatus
YAGHRQALAQWSSRLCKQVGAGATLSTLKLPKIIIKMLKTCLENSMEAQQDLHESCQLISTF

SEQ ID NO: 27671 - protein, 115 aa, A.fumigatus
DFTGGRMCAVQGLEGAAGSAGEAGASPAAGGHGGCIEDGGGVTTIEDLVESLDGRLEEAVYLVGAGKLKEGAKNLGRAKGRSDGWERRGVQVVDEDSDSEKCVGEVQNTRSRGRG

SEQ ID NO: 27672 - protein, 409 aa, A.fumigatus
NIPKPNFLGCQGWSSRCGFPDGRLIEKPMHSAASPPGLRFPNGGVINGHFVVSGTYLTSSKQEYALWALDLKTLTWGRIDAGGSVFGHGSWNRGVLWARRNTFVVLGHRKRSLVEDYNHRRINFSHVCMVELEAFGLYNNPCRTAPTSGYISHSAPSVPASLQHKLTQLTSGGRPFSPASDELGKLAQSLPEIADMELQAAGGERIPVNSRILSRRWGPYFIQLLRESSDTGVSDTATLRGAIPMYPSRNSSITITPSIGQNSSYSSASTLVSNHSNPSKSLLSNLEIPFAHTLPPTSRPRVLYLPHTFLTIRVLVYYLYTSSLPPVGSSLCTPQILCSLLQLARPYQVDGLLEATVERLHQILDGRNAAAVFNAAAMAAGGGRGTGFTSGPGGTLEALNGAHAAASEI

SEQ ID NO: 27673 - protein, 67 aa, A.fumigatus
GSNRPYVSSFRYSPCHNCPSGEYAHAVSHFTDYTFMLWTGHMKRDAAWSLKIYIAPQLIAYPLLLLD

SEQ ID NO: 27674 - protein, 206 aa, A.fumigatus
LPAFLPSYPSLPTVKTHIFEIFSYLFHSLYTQPECLANSSSVVTSRCMSSDSMPRNPPRSFTIPACNCTATDIVDAMIGTVSLTPSSPSLRTSTKASSTPPSRSSSPPPLSTSSSPAKLPTPRLALLPRMSSTSPTVLSPVKLALSSSRMLRLTGSLSDTASVVSSLRRLTRYVTSRDLLCQIENVRLTCLFSSLLARPRLPLMVA

SEQ ID NO: 27675 - protein, 74 aa, A.fumigatus
  UNSURE (19),(23),(61),(73): Identity of amino acid sequences at the above locations are unknown.
QHNAGPSAPARSLPPSRPXEVHXAIRKWLSDDVSAEASENVRIIYGGSVREKNWRELRKPXRCGRFSWLAVAXL

SEQ ID NO: 27676 - protein, 111 aa, A.fumigatus
HCRRNDRNGVTDTIISIVKNLNEGQLDPSVEVVISPSALYLLLARQAADPKIGVAAQNVFDKPNGAFTGEISVEQLKDAKIDWVIIGHSERRVILKETDEVRYLPGSALPD

SEQ ID NO: 27677 - protein, 237 aa, A.fumigatus
CEWYVGIENEDLAHWGSVSLPGGVFPSTQCQTGHLSGNTDTTFVQQANSVLIALALLSEQITLGNDHIIEVEHAGAASPDTQLLLLLGNGESRGILLDHKGCDSLVALAGIQVRKDDEHPSLHGVGNPHLGSIQLVPIRRLFRLGLQGERIGSGRRLRETKRTDGVRSELRQPRLLERGVGPLVEGRIDERVVHIHQDTNAGVDAGQFLDGNNSGGEVHTGSAVFLGDLDTHQPLVF

SEQ ID NO: 27678 - protein, 217 aa, A.fumigatus
EDQGLMGIEIPEEYGGAGMNFTSAIVAIEELARVDPSVSVLVDVHNTLVNTAFNKWADAALKKTWLPKLATDTVGSFCLSEPASGSDAFALQTKAEKTADGYKLNGSKMWITNSMEAGVFIVFANLDPSKGYKGITAFVVEKDTPGFSIAKKEKKLGIRASSTCVLNFDDVVIPKGNLLGEEGQGYKYAIGLLNEGRIGIAAQMTGLALGAWENAAR

SEQ ID NO: 27679 - protein, 175 aa, A.fumigatus
VRYWLAERRSYRYCRSDDRSGIGCLGKRRQVSSHSPSEQDPHFLSQRTTHINGSYVWNDRRQFGQLIGTFQGMQHQLAQAYVEIAAARALVYNAARKKEAGQDFVQDAAMAKLYASQVAGRVASSAVEWMGGMGFVREGIAEKMFRDSKIGAIYEGTSNIQLQTIAKLLQKQYTK

SEQ ID NO: 27680 - protein, 91 aa, A.fumigatus
LTLIAGTVTDESLQDAVPTDYHGISFDEWLDLFLQYALVVSGQGEPDEAYDSLAAAADASIWYHSKPCTRLIHVCWFSKLPLAPLSRSMVY

SEQ ID NO: 27681 - protein, 184 aa, A.fumigatus
NSCCGRSRPWTFPFRMAPMTPDPAKQSASQSTESARRSPPATSQAKPFPLINWTSPCLCYMATSYIPATVSTQLSTTFSVHTISTTRTLLSYSPLPSATSTTRSNASPTTVTTSSCRASHSCTNTVAFASEREASSRNGRRWSLTLLAYGIYSASRISLSKDTSVSWRLGSRSRPNLRIRSLSR

SEQ ID NO: 27682 - protein, 245 aa, A.fumigatus
PSPPCGRRHYTPIQQTTEYADISYFMAMGDCFMQLGNIEEAENCYLTVADYDTRNIESRAQLAKLYESIGMTEQALKYVNEAVLLGRQETRTHRRRKDTRLEQLALEFRTETDPELPGLRIAVPPERAEGLAPTLTTTSVNATRRKVQEAEEERTELVQFLYGKLLDIHPRVKEGNAEAIEDWLDIADALLREFRSNKVFYPFQRNIVFLGYSREAQRKAGKYKNRTLMDEMQEMASRLQESLGM

SEQ ID NO: 27683 - protein, 268 aa, A.fumigatus
VAPCTFVSLDGILTRTACALKAQDEETLANEARWFIKEYQFVTDTYRLFSMLSRLCGDPHRSLFHSSPNMKFMLRQIKAMDFSIPDGPNDSRPSKAVRESIYRERATLTTRDESGEAIPADQLDVALLVLYGHILYSGNSFYPALNYFFRAYDLDDQNPAVLLSIALCYIHHSLKRQSDNRHYLIMQGLSFMHEYRRVRERKGSLLQERQEMEFNFARVWHLLGLAHLAIEGYQRVLALGEQIQTESQNKIPQPLTTNADPADSSDGL

SEQ ID NO: 27684 - protein, 87 aa, A.fumigatus
  UNSURE (23): Identity of amino acid sequences at the above locations are unknown.
KSFNEYSKSLTGFIASIQKILNXNHEPQSTNNSPHDISAQGLISTPILNEDGDPIWKVLVFDNMGRDVISSVLRVNDLRAWGVTIHL

SEQ ID NO: 27685 - protein, 175 aa, A.fumigatus
CTSCKRPSSLGCHYSSVGSSWCKEHRIAANHLSSRNLNFTRYPIPDVPVVYLVEPTPANIQAITNDLSRGLYSPAYVNFLSSIPRPLLEDFASQIASTGTAEHVAQVYDQYLNFIVAEPDLFSLGLGNDAYWKINSAKTSDEELDGIVDKIVSGLFSVSVTMGMFQTSPRSRISR

SEQ ID NO: 27686 - protein, 496 aa, A.fumigatus
TGAIPIIRCPKGGAAELIATKLDRKLRDHILNSKDNLFSGNKKTAAGVPSSRPVLIIVNRNVDLVPMLSHSWTYQSLVQDVLQMRLNRITVETPIDETNPAKGVTKKVYDLNSNDFFWKRNAGAPFPQVAEDIDAELTRYKEDANEITKKTGASSIEDLQNDTSASAQHLKAAITLLPELRERKAILDMHMNIATALLKGIKDRQLDNFFELEENITKQSKTQIMELINDPAKGSNPTDKLRLFLIWFLSTESDLSRADLSQFEEALRRAGVEDISPLTYVRQVRELTRMTMMTTAAPQQQSSDLFRGFSSLSNRLTDRITSGALGANFDSLISGVKNFLPANKDLTLTKITESIMDPSSASSSAIAKTENYLYFDPRSANARGAIPPASAARNPQAPGALGGVERGTSATFGQRRQAFNEAIVFTVGGGSMDEYGNLQDWVRQTSGQPGDGSGAGIRAGVGAMGGARRRVVYGSTELMNANEFLTESLSKLGRES

SEQ ID NO: 27687 - protein, 60 aa, A.fumigatus
NQPDKSLAPTSSVFLVEFSNAELEDLSPSTKSSYVLGWSAKSCLTERWGCRRIISVFARR

SEQ ID NO: 27688 - protein, 513 aa, A.fumigatus
PVASQNLTSPMLQNCDHSSMPGSTAVATDNLEPTSIPTSSVAQDNRRQPDKDIPPSHDNAVDTLPNLSSQITDTLTPLPERNRLTSAHTPSHRRANTEIIRRQPHLSVKQLFADQPKTYEDLVDGDRSSSSALENSTRKTLEVGARLLSGWFQGKSEPVNLTMVPQSAHQDALGLAPSGAFLNRASKRASSPLKQVTSTNPFNFFAFKRQGEGRPQLPEPADDEILNMDITAALFPPESLDLDGQEAFSALRTNADNLLRRLQAAYKERTFALHEALADKNEKQEELEETRTRVGHLKVQLDGMAEKVLQQEKAMKAMAEELEQERQLRRREDDARRRSVMLVRSSDEESLSDVGAELQTPKRSLKRASNGTYTSDSGFDSGDESLAESIFSRRDGLESPTSTIPPSPNISQIALSVPTSTPIQPSAKELKPAQAPPVRQSTYDRVLKGLASTGITSSWMGHTSTSKCNICHGIPASEAWGVLGVIKEENRGLKLRLSELELVVDDCLSLVGS

SEQ ID NO: 27689 - protein, 99 aa, A.fumigatus
IADTKTQFEASQQWHLYERFRLRLWRRKSRRKYLLSPGWPRIPDVNDPTVAEHISNCSICPYVDPYTAERKRVETGSGATGASVYVRSRAEGTCLYGYH

SEQ ID NO: 27690 - protein, 65 aa, A.fumigatus
ALYSLYRALCLWQRDILKALKEIGLQRINTDLYLYIDNKTIILVFVDNILFLYYYKSKKYADNLI

SEQ ID NO: 27691 - protein, 333 aa, A.fumigatus
ARYLPHCADPSSPVGEDIDPAALNMSTKRKRGCDEEDHDPSKCSPQPLKTSRMAVTVVTSNMASPMPSSTLKAPLQKPKSTPALKPAGRSPRGKSCKAFARRSAIGKSRPEPTGRKSISRPFSIATVLGNAQPKSQTAPKTPASWSFEIHVDSEQEEMTNMMQHSTCVLDISDDEGKAEFSSRGKENIPPSELEIDLSRTRERETSVLRKTEMADEPRSPLGELNAADYYGEDCHAFSYAVIYDEDETASEIKTPLPPLPRNPTHPSRTKLSSVSSISSILAATQPVKATASTKSEAEIEIWESESTADDSEKAIESNPSDELSSSTAKSINV

SEQ ID NO: 27692 - protein, 148 aa, A.fumigatus
  UNSURE (82),(138): Identity of amino acid sequences at the above locations are unknown.
ASSLSACSSASSSPSPSLSSSSPTSSLHCTRFPRATSAATPPAEGVAFERTLAPAASSCPFQDALIDARISVASCISREDVXSGSSVKSASEPSGATWSGKRRTRANSRSSATRPSSMLCTLARMNVLALPNVPLPKXPVDGEFAGVL

SEQ ID NO: 27693 - protein, 210 aa, A.fumigatus
  UNSURE (5),(8),(29),(86): Identity of amino acid sequences at the above locations are unknown.
PVPGXPSXSPDPPTPRVLQRTPANSPSTXCFGSGTFGKARTFMRAKVQSMLDGRVADEREFARVLRFPDHVAPDGSLADFTLDPEXTSSREMQLATDIRASIKASWKGQLDAAGASVRSNATPSAGGVAADVARGKRVQWSEDVGEEEESEGEGEEEALEQAERLEAQVAAAAEAVEAAAMAADEDEANDLDQEESDVGDDMDVDEPAKP

SEQ ID NO: 27694 - protein, 337 aa, A.fumigatus
MRIEWPLPAPREDTIIGAKDGLGVECLKGSGLIAGATSRAYEDIFTITLVTCRSVGIGAYLVRLGQRAIQVEGQPIILTGAPAINKLLGREVYTSNLQLGGTQIMYKNGVSHMTATDDFEGVQKIVEWMSFVPDKKGAPIPILPWSDDWDRDVAYYPPSKQAYDVRWLIAGKKDEEGFLPGLFDAGSFEEALGGWARTVVVGRARLGGIPMGVIAVETRSVENVTPADPANPDSMEVISQEAGGVWYPNSAFKTAQALRDFNNGEQLPVMILANWRGFSGGQRDMYNEVLKYGSYIVDALVKYEQPIFVYIPPFGELRGGSWVSHLLFLCHVQVFKY

SEQ ID NO: 27695 - protein, 118 aa, A.fumigatus
VVIDPTINPDQMEMYADEEARGGVLEPEGIVNIKYRREKQLDTMARLDATYGELRRALEDPSLSKEQLSEIKAKMAAREEQLLPVYLQIALQFADLHDRAGRLVPKATSLQSAAEINV

SEQ ID NO: 27696 - protein, 63 aa, A.fumigatus
AMSTTPRPKQLDISVTGEFETWFSDKDQLFYQFQQSYSTFNGSTDYHNTPDFTCYRLWINPGL

SEQ ID NO: 27697 - protein, 206 aa, A.fumigatus
DALPEGKMEDAVMHLKMLVSSKVLGKDTLDTTDSIAVDGSKELTCDIFDQLRPTEWLDEWTLYLAMKISDRPPYVRFDTSILLEYQPDKIKKNRKIEKVTNESSDCELVEVRKTTPLAEWAKKIAEDQQSVQEKLVYFRPINYRNHFTLLEINTREGVIRHYDSLAVGGIKKTVISRLVKKEFGSFGFRYEEAVSIRKTSVSVATN

SEQ ID NO: 27698 - protein, 74 aa, A.fumigatus
YPNRGSVQPRGEDLLQELTNLRRSSDIDCTITRVRFNPKFGTNSFTAVVDGVVQSKRTKRGFIHFESEANGSLR

SEQ ID NO: 27699 - protein, 203 aa, A.fumigatus
  UNSURE (203): Identity of amino acid sequences at the above locations are unknown.
SIDHPNPISMALPQLLSPKPFLTECGMETSLVYKDKVHLPCFSSLPLVDSDSSRKLISHYYDSYISIAAANGTGIVLDTRTWRGATPWAQPMGLSADKLLELNRAAVRLAKEARNRAVGGENNIPVVISGTMGPLRDAYVDTSELITLEDAREGYREQVEVLADAGVDMLAIMTVTNLNEAIAVVELAKEVRLPVVVSFSIEX

SEQ ID NO: 27700 - protein, 79 aa, A.fumigatus
QISRLIIYEGYREVYLTLMSPGTGYVEYLERTEPATTANPEEFVYMDTFGPWHIDNQVQLRSLCLALLAFLSAAEEVAS

SEQ ID NO: 27701 - protein, 155 aa, A.fumigatus
  UNSURE (14): Identity of amino acid sequences at the above locations are unknown.
PSPNPSQQSNGHQXSILNDTTTGNRTSFANSTTAIASFRFVTVMIANMSTPASASTSTCSLYPSRASSSVINSLVSTYASRRGPIVPLITTGILFSPPTALFLASLASRTAARLSSRSLSAERPMGCAQGVAPRQVRVSKTIPVPLAAAMEMYES

SEQ ID NO: 27702 - protein, 100 aa, A.fumigatus
VRLYMTADPSSPDGEDSGPLFSPVSRASWGEELSSWGKQLTDRCVYVIDFTAQMKNLIDNGIVECYSPLVDVKGSYTAQFEHTILLHSGGKEFISRGDDY

SEQ ID NO: 27703 - protein, 184 aa, A.fumigatus
  UNSURE (2),(5): Identity of amino acid sequences at the above locations are unknown.
WXTEXRVVSFQPRGEDRTAHQDLGQPAVVEERRYDRTGQEQLMLASGTETLPGGVRRITDLDDETGATTYDAGTQYGIPTGSANEREESSHGDEWWSSSVGRSSYDIGPPLPGARTYNAYTGAYEEQRADYDADGVPRYRDRGRGRGQGQSGYSAEQRASREFETDQGTRLKRETDVDMSDVLM

SEQ ID NO: 27704 - protein, 316 aa, A.fumigatus
CLCHPVCRVPADDQSIGIMRPGTYVLLITSPFNALLNYLFCYTFKMGLLGAPLATGISYWLSFALLVLYARFIAGSECWGGWSREAFNNLGTFARLAFLGVIHVGTEWWAFEIVALAAGRLGTIPLAAQSVIMTADQVLNTIPFGVGVAASARVGNLLGARDAGGAARAANTAAWLSMVLGGVVLAVLMGTRDDFARIFNDDEGVVRLTAEVLPYVALFQIADGLNGSCGGSLRGMGRQHVGAMVNLVSYYCGALPLGIWLAFHGWGLKGLWVGQCIALYIVGALEWLIVAFSNWEMEVEKAFRRMDVHERLETGL

SEQ ID NO: 27705 - protein, 141 aa, A.fumigatus
GVGHTLCVDFSSLLVNTFSLMFAMITAWMIALGGTTALDTLASSSFTGSSNNHDLGILLQRGFFVLGLFYIPVAILWACSEHVFVFLGQDQVLSRESARFLTCLIPGGLGYIYFEVMNKYLQAQGNVFAILSVEFPLTISR

SEQ ID NO: 27706 - protein, 80 aa, A.fumigatus
PRPFNRRKVGKGDTRTMGTTNNATIFFTVILMLCMLDKILDEVTAHGILVTRVSFGSCLTVPVPPVATMLCHRTYAKDES

SEQ ID NO: 27707 - protein, 77 aa, A.fumigatus
TNSNQEFLRRPTSPADWWPEPSTNVLGGRDLARATHGTWMGVTKEGKIAVLTNYRENTADEPSGVHSRGLIVNSWLT

SEQ ID NO: 27708 - protein, 81 aa, A.fumigatus
PQAANPTPMALCPCFEIVINLNIEWRNFESFCFSWPGIAYCVAVDYPSRVLVLPTSYSCAQQQLHLALTLHSSPSYHPSAG

SEQ ID NO: 27709 - protein, 65 aa, A.fumigatus
  UNSURE (50): Identity of amino acid sequences at the above locations are unknown.
SALIIYYPMGGNATTIFIPCWLGLRSQCASFEPCITIINIDLRFWERCPXHYLSYEDLFLKIYYA

SEQ ID NO: 27710 - protein, 111 aa, A.fumigatus
PLQKTKPEAEGTPLHGLLSLGLPRIPQRPSECHNHKKQSNWSHISLSVVFTVLFLSFPPRFLPNKLKFSQYYWLLLHTQINYFYIITIITVLIITNIIIFWTTTSLFATAD

SEQ ID NO: 27711 - protein, 76 aa, A.fumigatus
MVGCVTGPLAGLGPLTIPNSAAEAGTGWNWKFRCLSEFTLTDILPHPNNNDPALVSGLSPFSPPLSPPGGCPWGRQ

SEQ ID NO: 27712 - protein, 97 aa, A.fumigatus
WANIDTRKTLWAVAENFRYMTKFLRTAEEVQKLGRVKNFRVNFHALVSTDSKYFSKLYRLRSTSHDYLVRDLTREKPRGAKHPDTRVDSSWTAESMS

SEQ ID NO: 27713 - protein, 172 aa, A.fumigatus
SNEGETAWRQTPGYQGGFILDGGVHVVAALRLILGSNDPVATISAQSCLQQQHLPPLDTVNAVMKTKSGATGVLSLSFGSAFDDSVFEFDCEGGVVALNSDTLTIKGESNELAFDGRGVSREVAVFATTIASGGSVDKRQSPEEALADLEIMEKMLTSGERDGERQTVELQV

SEQ ID NO: 27714 - protein, 63 aa, A.fumigatus
TGTKRFFRHQSDRFKCVPESWRKPKGIDNRVRRRFKGNIPMPSVRSNSSDPAASDSIISTRQI

SEQ ID NO: 27715 - protein, 140 aa, A.fumigatus
LYSDPSPRGEHWNRRSTPFSAPARGNGHSHGHGHSATMTRMRKDEENKKDVHHPAPLHGIFVSGKKLGSNFFVLLFHHSYSTIYASTVTRPLGLVTLTPSALALAMISTRLREETAEAILSINQYLLFVDGTVNATYSAA

SEQ ID NO: 27716 - protein, 248 aa, A.fumigatus
TTGRRDERGPDVSVFVGPVIDIAYTIGLHRDGADDKLPPFDVEMRRRLWWHIVTLDVRIAEDSSTEPRTSLLSFSTKMPSNTHDICLDPDMGSTPVCQFGKTEMTFSLIRFTVTEFALRSLFGKQSWKVADCAPLDRQRRINELDQLKERLEVRYLSCCDETIPFDFVVAESTRLVLAKIGMYLRRPPLTEHNTAQPFEPTYWKECVDIRWACIFPSPVRERGKGGFGYFKPNFEWGGLAEFLWLALL

SEQ ID NO: 27717 - protein, 86 aa, A.fumigatus
DRCDMADLVEIVDCLRLSLAGSKETLSTSDSAQGGSKVTWLVAAMTPWFSFSSSCGSLTVRSINFRMNSSDSAENLHFFRMSGPYL

SEQ ID NO: 27718 - protein, 533 aa, A.fumigatus
  UNSURE (346),(347): Identity of amino acid sequences at the above locations are unknown.
RLIGPAQSHPLARMGASSQSASADTIEHVHPTRISHWRMVYDQGALTQEIIDYRFAGSGTEEDPYLVTWILNDPRNPLEFSATKKWTYTMVMAWATLAVSLVSSAYTGGMQQIMEQFEVGTEVATLGVSTFVLGFAIGPLLFAPMSELWGRQYLFLVSYCGLTIFNAASAGSPNIQALIVFRFLAGAFGSSPLTNAGGVIADLFSANQRGLAMSLFASAPFLGPVLGPIIGGFLGMTEGWKWVMGFLAIFSGALWIIAGLIVPETYAPVLLRRRAMKLSELTGKVYKSRIEAEQGKKTLGHSLKISLSRPWILLFREPIVLLLSEYMAIENGNYKKKKGAIPIEGXXQRGWNQGVSGLAFLGIMIGMMCAVAFSIYDNKRYIRAQEAHKGFAPPEARLPPCLVASVAIPIGLFWFAWTNYPSIHYLASISAGVPFGFGMVLAFLSLMNYLIDAYTIYAASVLAASAVLRSIFGAAFPLFVKYMYSSLGRSFFFLVLLFRRKLIGSRYSLGLVHSCLPGTGLCPLSIPLLQVRA

SEQ ID NO: 27719 - protein, 141 aa, A.fumigatus
SGPGIHWASSIPAFLALACVPFPFLFYKYGPDIRKKCKFSAESDEFMRKLMERTVKEPQEEEKENQGVMAATSQVTLEPPCAESEVDRVSLDPAKLSRRQSTISTKSAMSHRSQKLVTSQDVYDANPFDIDRVNTRDSFKD

SEQ ID NO: 27720 - protein, 185 aa, A.fumigatus
IGKRTANDRAQDRADTPDEASSPHVQRPLLYGSGGRQESHESDIHARARHATDGTANDQGVHVGRSAADGGSHFKDKDRQDVGPFCVELTKDFAPDQIRPRRADQESDTDPWELFDRVEMAHNDGLHVGHNGVVEGEEELRAVNGQHDKEPFPPGDLSRRGLGILWHRVPSSLCFRIRVRRDRLF

SEQ ID NO: 27721 - protein, 229 aa, A.fumigatus
ILSPMSDTMAADNQPAAGLASKDSNRSPTERELSEKAISTDSDPEAQRGGDSVPEDPKSPPREITGWKWFLVVLSIYSSQFLFALDNTIVANVQPVIVGHFNSVEKLPWISVAFLIGAAGTNLIWGKVFGQFNAKWTYILSVFVFEVGSAVCGAAPNMNALIIGRAICGVSGSGMYVGLMTLLAATTTIQERPLYVGGGGFIWGVGTVLGPIIGGAFTDSSAGRRWAFL

SEQ ID NO: 27722 - protein, 189 aa, A.fumigatus
NRLLQMIRSQQAQLQQLQQQQQQQQSGAAVEDSTPPSERSAGVPIIPPLPAAGSGRTSTQFPSSLSSHRASRPSSQTASPSLRPLPSASLHGTSVDSSRGPEGLDLVASTSETSSRRGSRDEVAFYQAEASMLNRENQMLRQRIRELGLSAVFPPSVICAKSRHLFVSYVCSELKIQTLTKQKNDKLVG

SEQ ID NO: 27723 - protein, 326 aa, A.fumigatus
  UNSURE (235),(252): Identity of amino acid sequences at the above locations are unknown.
LQHKIQSQSTTEDKHFDPLAGILLSELLKLTVCLLCIAHTAEEPQPLLATLKTNHEEATLPALLYTAASFAQSIGASSLPLLQYLALSQTKLILTPLLATFLLNQRFTLQHWTSTLAMTAGIILAQTGANAAAETQPRTAANPNIHAHPLLPGILAMLLSGSCVALGSLSIERSLKRAANNNTTTTAKGSAFFIRNAQFAAHSLLFALLSFLWKEKCRIDGSRFLEGLNRLVWVXVVLQASGGFLVAWCVRXTSSVTKNYAQGMGFAIAAAGPLVVESKDVDGKVSDLLQRGVFGECIADAEVGSFLSGLCLYWGRSLGRPSQGRV

SEQ ID NO: 27724 - protein, 277 aa, A.fumigatus
  UNSURE (231),(248): Identity of amino acid sequences at the above locations are unknown.
NPVPVHNRGQALRSTGRHPPLRTPQTDRLPPLHRPHSRRAPTPPRNPQDKPRRSHPPSPPLHRRILRPKHRRLLPPPPPIPRPLPDQTHPHPTPRNLPPQPTIHPPALDVHPGYDSGDHSRPDRRQRRSRNAAPHRSQPQHPRASPPPRHPRHAALWVLRRTGKPLHRTIAQARREQQHHYDREGERVLHPQRTIRRAQSPLCTPLVPLERKVPNRRITLLGRPQSPGLGXCGAPGVRWVPGGVVCEXDEFCDEELCAGDGVCDCGCGAVGCRVEGC

SEQ ID NO: 27725 - protein, 169 aa, A.fumigatus
LWYPQDNFTEGVYIDYRAFEANNITPRYEFGFGLTYSNFSYSALEVELVPGANIDYLPPGSAIAEGGLPSLWDVVATVNCTVANTGAVEAAEVAQLYVGIPGAPAKQLRGFNKQSIKPHKKKHFTFDLTRRDLSTWDVEKQTWGLQSGSYPIYVGKSVRDIQLTGTLQI

SEQ ID NO: 27726 - protein, 127 aa, A.fumigatus
SGTRRTTSPRACTSTTARSRRTTSLRGMSLALVSRTATSHTPRWKLSSSPAQTSTICPPARPLPRAVSPLYGTSWQPSTAPWPILARWRRPRSPSCMLVFLAPPPSNSEGSTSSPSSRTRRSTLPLT

SEQ ID NO: 27727 - protein, 291 aa, A.fumigatus
DSSICKTIEKRTLTTCSDSISTIAKPSTSQVPAPRVGSASTTLDKKIYLFSGRGGLAMSPIDEAGAVWEFTPQTSSWRLITPTSEIHPPPRSYHCMTSDGIDTLYLHAGCPETGRLSDLWAFRLSTREWTPLAAAPDPPRGGTSIAFADGALYRMNGFDGKMEQGGSVDVYSPGENVWSSYGFVADGVSGPEARSVSALLPVRTGEKVALVTLFGERDPSALGHQGAGKMLDDVWVFDVQERSWRRVDAQGEAPCARGWFAADVLGENAIVVQGGLDESNRRLGDVWILSF

SEQ ID NO: 27728 - protein, 82 aa, A.fumigatus
QPAQTQYQPSPNRQHRRSPPRAWDPRPPPSTRRSTSSPAAAGSPCPPSTKPGQSGNLPPRPHPGDSSRPPRKSTLHHAATTA

SEQ ID NO: 27729 - protein, 281 aa, A.fumigatus
SKAPIKVFFTGPGVITSATPTGDMSVDSVRTAILPLYNQFGIFNNIELRVLRRSNPGPNGRGGGGEVQLVFGHQVRLPKTLHLMNPGRVKKVRGVAYSVGVSASNNARMIDVARGILNPLVPDTYIFSDVSSAPLVPDRNNPSAKKKIGLGFGLSLVAESSTGCLYSADVASPPAGGQAPEDIGKQCAYQLLETISKGGCVAPAAASTMLGLMTMGSEDVGRLQFGREVIADESIIQLARDLAKFGAPGWGLRDATGENEQGDVIVSVVGRGIGNVGRKVA

SEQ ID NO: 27730 - protein, 90 aa, A.fumigatus
ESTLILVRVCRPSNSRLTTSFTITVDLYGTNPIIYGKRLNYLFSADPAVFRLLVASSLFPACSLDTSQLPTVFFAQIYEVLCALSRFHLQ

SEQ ID NO: 27731 - protein, 66 aa, A.fumigatus
VWIFILSYACRLLTSVSTESPNGGEQNKRGSYYGGKYALQTSPLKTICNRSDCHFVMQYANNRCCM

SEQ ID NO: 27732 - protein, 104 aa, A.fumigatus
AISGCGPRTVDSGLSKSYAAQRPIWADYQYVLTACAIGCNFPLTVFVIKADPDLSNPTRPRFERPLETIRSFEAAIEGTYSSRPVSWARTGEFGSLFCHMHADC

SEQ ID NO: 27733 - protein, 404 aa, A.fumigatus
IARRSEDRSQAAWTLTAVAVRLAKALGLHRERDETFFNQQMRRRLWLTISLMDLQASFSQASEPLISTEEATSTFFLPKHINDSDLDPTMTHEIPDREGLCDTTFALVTYHIQLAGRALNFGTTASPQHKASQQQHAQRFEENALRLLHFCDPESSPYAWFTWHGTQCLVSGARLSALRPLQLPQPSNGSSQPPSSPSPRPQEHNHELLRLALNVLEKAHLMHTDPRGEGFRWYVTMPWHALAVAINECSLSPDVVRIQSAWPTIEACYQLLRRKGVAGQEEAIQRPLEKLICQARDKASPLLQLARSSPTFSLGSSTGTSAAPTPRSRASSTPSDTLSDLSWPTAFSHAPSQLGMELAPVGPVQPFAKLDLDSLLSQFDIQGQPLLAGQIPRLHHGAGRIHAK

SEQ ID NO: 27734 - protein, 73 aa, A.fumigatus
PFVMPRQAMTLASPSRTSTSCSSMNTGFDTIANTSLRTKHCWQNYVDYHKCINAKGEDFRPCRQVIISIAGVK

SEQ ID NO: 27735 - protein, 222 aa, A.fumigatus
STFQPRAEDKSRFTSSSSPPGLPTLVGIACASGFIGGFAGDPADVLNVRMQHDAALPPAQRRNYKHALHGLIQMTRTEGAASLFRGVWPNSTRAVLMTASQLASYDTFKRLCLEKLGMSDNLVTHFTASLMAGFVATTVCSPVDVIKTRVMTASPAQTQGHTLLGLLRDIYRKEGFAWAFRGWVPSFIRLGPHTIATFIFLEEHKKLYRVLKGISGDNTINV

SEQ ID NO: 27736 - protein, 270 aa, A.fumigatus
  UNSURE (254): Identity of amino acid sequences at the above locations are unknown.
VIISRHPSPCLTLQVLLAQGFCIGIGGGIAYIPAMVVISSNFTTKRPIAIGCAAIGSSVGSVVFPIMFRQLQPRIGFPWTVRSIGFINLILGLLSILILCRKPGKKSRARSMIEWRAFSDLPFMLFSISLTCVMLAYYIPLFYVPSYARTRLHTTRSLSFYLVAIINGASAFGRVVPYLLSAYIAPIAILCLAIAGCALAHVHLESRERIFPASSSGAGNWGFLTGWLLPAPPEHRPSTLCSDPNNLGPPWDYXGNQFLGILVGDAIPGA

SEQ ID NO: 27737 - protein, 158 aa, A.fumigatus
  UNSURE (141): Identity of amino acid sequences at the above locations are unknown.
SNGAPSATSPSCSSRSPSPASCWHTTSRSSTSPRTRAPGSTPPAASPSTWSPSSTAPPPSAASSPTSSARTSRRSPSSVWPSPGAHSPMFTWNPGNESFRLHRLGPVTGGSLPGGCYRPHRNIGLQPCVRTQITWDPLGIXWGISSLESWWGTPFQGR

SEQ ID NO: 27738 - protein, 64 aa, A.fumigatus
PAHKAIIGANNNSFNCSCQLPRYQEPDIHVTGVAVLDLNNLIFTWSLSPPCYDGGTFHWFTLCA

SEQ ID NO: 27739 - protein, 149 aa, A.fumigatus
VVDLHFCKTTLSYTPRFPCHSLRTLSCLKKVNNAMLRFLRSAMTSLTTPRVPIPVNGVDYRGKVVLAPMVRSGELPSRLLALKYGADLVWGPETVDRSLIGATRRVNPRNGCIEYIRFPSNGGRPDKPAQESILYRIDPVREKGKLCSS

SEQ ID NO: 27740 - protein, 79 aa, A.fumigatus
GKHAIHHPLQFKDPSIWQGMSLRIMCLKHDLFTRDKWMSIVEPMKSNSIFLRAQIFWELWAKTNINPPLDGHVFSATRT

SEQ ID NO: 27741 - protein, 101 aa, A.fumigatus
DLPYKRHLVPKSRQVVLQVGSTVGLGLSCFGLSKLSSLVYSTNEGPGERTGIYCVLFESLCVPGMVSLSEGGLSHDCEYDIAQPCATQKMLITHVDLVFLT

SEQ ID NO: 27742 - protein, 143 aa, A.fumigatus
QCSLSEEGQRSPPRGPAADRRREPSRDRLGSRPRYRSRDRDDYRRRPSRSPPPRRGRPAYRDRDREGYRSPGCSRSRSYSRSRSPRRSRQPYHEKESREVMMDGLPVDMAEEDVGKLLPPLKFHFWSFRTTLHVTNTSLMARG

SEQ ID NO: 27743 - protein, 64 aa, A.fumigatus
  UNSURE (52): Identity of amino acid sequences at the above locations are unknown.
CSSSISSFCCCSYTILSPTIMMQILPEVTTLSFPADWIFRAVIRMDGACTVXRRASRKSVNRKR

SEQ ID NO: 27744 - protein, 62 aa, A.fumigatus
LRQGIYLAGTILMNQPWGADGYSTLDTTLLDQHFGNIDTWRNAITEIHKRGMYVIFDNTIAT

SEQ ID NO: 27745 - protein, 224 aa, A.fumigatus
VSPNPILCVRTDANTSLGDLIGFEGYLNTTTPFSVKEHKALWKTDRRYVDFDIGNDYNSTCDYPRFWYEDGLPLPSEQADQLVGCYNSDFDQYGDIEAFGVFPDWQRQLAKFASVQDRLREWIPSVRERLIRHSCIIIASLDIDGFRYDKATQATVDALGEMSMAYRECARAVGKNNFFISGEITGGDYFGSIYLGRGRQQNQWLPDPSQGPKMTNESSAQYFV

SEQ ID NO: 27746 - protein, 161 aa, A.fumigatus
YPLPSVHGSTPTYSYPPHCSEAANRNPLPTMKWGWTGALLAWFATTTSCWPYDESLVGYNLNENKEAKSPVEYWGEWPDHKGKYFPSPENWRFPFYTLFLDRFVNGDPENDNINGTQFEHDISSNQMRHGGDVAGLVATLDYLQGMGIKVGFPDLTDLWPQ

SEQ ID NO: 27747 - protein, 208 aa, A.fumigatus
AICYLPMSFPHTNFIQTTDTLFADQEAWFSSLRWWTRTTMDSRSDINPDWVRRTLRLLVEANPRNDDLAEYALAVELACNSKEARKYAKSLLKKRSSNLRLYNAYALIECRSGNPTGAEHVWATTLSMSKTFSDHDRVDCALLWQSWTWESLNAQNLAQASHLLLSIPQNSVDLKAVPGAFSETMFSATSLLKAQNVSSIHLFYCTTS

SEQ ID NO: 27748 - protein, 441 aa, A.fumigatus
  UNSURE (9): Identity of amino acid sequences at the above locations are unknown.
FISQATWRXVSDTDSSDGGLRVDPDEEIRSRNAELLRTVDRNPRDIEAWILLIEHQELLLRGSERDSRALTAAERKSLADIKLSLYEKALKKVGDSPFKDVLLLGLLEEGAKLWDTKELSSQWQAVLKANSQFISLWVKYLDFRQTEFLDFTYEKCFNTYLECLKLNKLGPGEPGNGHVQVYLFLRLTCFIREAGFTEHAAGLWQGILETVFFRPEDLSLAKDEETLSAFIEFWESEVARIGELGAKGWRSGENALMEPKAFAPQFKVNTRAIFASWTACERERISNAQIPGRSLDEADEDDPYRVVIASDFREVLPLVWDMDLADALIDSFMYYCQLPPLKSPENLESTSRWAGDNFLRNEFISNTGTTMDDFLQNQTNSAEPSAISPCLFLIQILSKPRIRCLQTKRPGFHLYGGGREPRWTHDPISTPIGFGGLSGYW

SEQ ID NO: 27749 - protein, 141 aa, A.fumigatus
  UNSURE (37),(49),(67),(85): Identity of amino acid sequences at the above locations are unknown.
ISRRSPRSGWSTPWPTMVSPQVLYPWSRGDRLTVPGXDVNIYASSSKDXWPLVGNHENTEIGQFISXYLDLDVENITKHLQSSSXWSFAGGDVERPYAWLGDPLGADVRTEGFDTYHGEFRKRSMDVDGMEKRECGCGGMH

SEQ ID NO: 27750 - protein, 450 aa, A.fumigatus
FEGKKNFCWESQKKLEKSMQAARLAASECESLVQKHTDDINKKTAETAKLEEEMKAEEEELSTIREGLKGKTQGLSEQIAAKQKSLEPWDERINKKLSAIAVAQSELDILRERSNAGAVQLEEAQSKVTSIEETLATKQTDLEERKAQKATLEEEVASLKRDLKKFTSRETEVRAHVSSARQKAEEARASLASTQNRGSVLAGLMRLKESGRIDGFHGRLGNLGTIDEKYDVAISTACPALDNMVVDTVEVGQQCIDYLRKNNLGRANFILLDRLPRRDMSPIFTPESVPRLFDLVKPKDPKFAPAFYSVMQNTLVAKDLEQANRIAYGARRWRVVTLDGQLIDVSGTMSGGGTRVARGGMSSKQVAEVSREQVSKLESDLEEMERKFQNFQNKQKHVEAAIREKSEEIPRVETKIQKIMIEIESANRRSSRCSAESQGYLHAGAGKYRS

SEQ ID NO: 27751 - protein, 482 aa, A.fumigatus
FPLQRPLQPRGEDMLHRAIPQKIAGIMNLCASNHKHLEPDDPALVEEHKLLLSKFMEPSSRGTKEIERVSCNNFETVFHSQTSMSSASNTINDEFSAVTNPGVTSGGRKDCNAKVALGLPTSARKRSTSNLSSMDKQTFSSSASSVERDSSSPGPSSTRSLAPRTRRSTRSRNKQINYYPVISLSESDSGEGPSGSRDTKTVNTSSQARNRQSHKPSNQSSKRLHHLNSNTDPLSDAEIRIIYSSRGVQIRKLSFTSLDHLKDLKHAPFCPEHNPAKYARRYRESMIVSSEILHVDFDSHEMTAMLGLLSLHGCQYSPTTEISISDQVIAVLSSHDVHRDFAKKISLLRELAKYISNEAVIDTSTWLWEVLTSKVRNKNQQSVRHCLTQLLTLKGMAGDGALSSSPAVIKQQLQIFLSCLPHASILYRRQPADIGAFIQAARNGHLSSSPSIIQAARVTDSNSGSSVFGPIRALITPPGWPK

SEQ ID NO: 27752 - protein, 272 aa, A.fumigatus
SLDRSQSKMNSTFDPWTQNITLTQSDGTTVVSSLALADDYLHYMIRLGINYGAQLGACAVLFLVLLLLTRPEKRVSSVFVLNVSALLANIIRLGCQLSYFSTGFARMYALLAGDFSRVSRGAYAGQVMASVFFTIVLICVEASLVLQVQVVCSNLLRQYRILLLGASTLAALVPIGVRLTYSVMNCMVIMHAGTMDHLDWLESATNIVTTVSICFFCAVFVVKLGLAIKMRKRLGVKKFGPMRVIFIMGCQTMTIPGKARRRPHHPMKEESY

SEQ ID NO: 27753 - protein, 139 aa, A.fumigatus
  UNSURE (96),(109),(110),(111),(112),(125): Identity of amino acid sequences at the above locations are unknown.
LPVLRIWIHPTNRPPRPNPTFVGTRINPAEAGDHCRTAIAYTGVKKRTDQRAIIEIRAAKQVASTLLALSTSSGIIGSDVNFDSKRKKTANENKLXIKGVIVTIESGDXXXXSSPNTKIVWKKWXIPNPWWLKPNYSYK

SEQ ID NO: 27754 - protein, 276 aa, A.fumigatus
STQSEKRTGDLLSSSDLDDGALVCSFFHASVCNGGPTMVARLGRVDPRSNERRVRPWRPVGRMDPYSQDRQLLRVGVVAIDLKSPKTNLTCYSSTLIVFLLFALTHFILAILSTPSSATVAYVVSTFFNGLFIGASMNYALSHMLHLTNMNVHYIVTSLLGMFRGSAGSFGSAIGGGFFQRELKKALEKGFSKHGLSGTDELVRKLLGSPALVTNLSGLEKEVAIQSYEQAVKVLILGGCVLALVATMLQACTGWRAPHEVEKDVHGDLEDRLDRE

SEQ ID NO: 27755 - protein, 121 aa, A.fumigatus
  UNSURE (2),(16): Identity of amino acid sequences at the above locations are unknown.
SXASPDSIVTITPLIXSLFSFAVFFLLESKFTSEPIIPLEVLKARSVLATCLAALISMMARWSVLFFTPVYAMAVRQWSPASAGLILVPTNVGFGLGGLLVGWIHIRKTGSYYVWVSLQLI

SEQ ID NO: 27756 - protein, 583 aa, A.fumigatus
  UNSURE (581): Identity of amino acid sequences at the above locations are unknown.
KLTCSPRGKVGIWRELWRNKAVAPEVADVLIWRLAALDSCHWPEGGIPVEMRRQLNGKYRVFMDEDLLDSLLFQYLGLKWSVTFKNAFKAFFRTRAWQSPRQQISKEERERRRYFLGSTGRGGCVNDYRRQMYETQYFMTQLPSSVEAGVPEYGDEANSDNITDGEKRKNHLETKHALLHLLITESIIHTTLYGQFTAICSDFKWFGSSLSHATVLAVLEYFGVPQNWLHFFTVFLEAPLKFTQDGENAAVQVRRRGAPISHTLSDCFSETVLFCMDYAVNQSTEGAYLYRLHDDFWFWGREQTCVKAWGAMTKFAKVMGLEFNEEKTGTVRLTKPNPRQGSPVPAESEHSSSLPTGDIRWGFLKLDPQEGRFIIDQSRVDGHIAELGHQLAACKSIFAWVQAWNSYFARFFTNNFGKPAMCFGRGHIDMAISTLSRIERTLFPDGVTSHLRQMIADRFGVRDLPDGFFYFPVDLGGLQLLNPYIPLLGMREDIKQTPQRRLQKAFLEDEDAWDAAKERFEKDGPCSAAQIDFGDDDSPATFMSLDEFMRYPESSSQALLQAYKESSPRGWKDPRQRNSIXNR

SEQ ID NO: 27757 - protein, 64 aa, A.fumigatus
RRISTGIPPSGQWQLSSAARRHINTSATSGATALLRHNSLQIPTFPLGEQVNFQLTNLETHSKV

SEQ ID NO: 27758 - protein, 66 aa, A.fumigatus
SPQSLHTVGGSALYIHSWFSNGSPKGKSKAAKVWKKILWKKLLSIQLLLAPAYGRLGAKYCWRRRM

SEQ ID NO: 27759 - protein, 90 aa, A.fumigatus
FSMKCFIAVKEFRSMVRISLYLPTAKSSIWLNVREPCSYRIDRANLTHNAPGIGVFPGVLEPYLTFTTYDVASSTLLRGGRRQGRAGVGC

SEQ ID NO: 27760 - protein, 154 aa, A.fumigatus
QWTGWDLKKMMTTARFADIDVSSYTTGYDYRFEPYPEDYYEPHPHDCSVVTFRGHRVLKTLIRCHFSPSSSTNSRYVYTGSEDGKVYVYNLDATLAGTIDVGRATLNSRPRDPDMFTTAYEIRSRSGEMLWRTCVRDASWHPSAPVLSGKIILF

SEQ ID NO: 27761 - protein, 117 aa, A.fumigatus
SIAHGNMASIIVLPTELLGRIISFLDRSSLKAIRQTSRRLSQIATPQLFATLRLFPDEKSYEAVDRITDHATLKKMVKKVYVNTCEDDYVSPYLFLANRGAPHTNRLRTTMTRRKSN

SEQ ID NO: 27762 - protein, 145 aa, A.fumigatus
PNADQSRKRGILESDLLLSTFADVYLKDMTPEQLQEYDRFLDENDWDIYYWATQDPPSATDSPAEDTVTETWKRTGAKSGEWKQTVGAYKAAYRPVPSRWADSEVLRLLRQHVRDKSAVGFHAAKNKKTGGCGLGRMPDIQVFDK

SEQ ID NO: 27763 - protein, 306 aa, A.fumigatus
GDRPQVGVTKRNGVRLANELRRGCRLQPYRPWAIHISHYYRSFHQSATMFKVGDDFDKIQASRPDFKRDAPVTFSKPPNPNWKQGDGANDGGESLKKSHVEIDPYEEGRPVSSNYKLLISGIVPRPIALISTRSKDGKTTNLAPFSYAQVINHDPPLFTVGFVGSLEKAKDSLRNMVESGECVINIISEHFVEAANATAINAPYGVSEWEVSGLHQAPCSVVQAARVKESMFSIEGKLVETKEFQSRTTGKKTGTLAIIEGVRFWVRDDAINEDKSIIDLKVLKPISRLGGISYGRTVITTPLKIT

SEQ ID NO: 27764 - protein, 63 aa, A.fumigatus
  UNSURE (48): Identity of amino acid sequences at the above locations are unknown.
VSHVAIYNRTRAPLSRGKYAYLINAHYYVADTTTNKKVLLADQVVYCXCVAISFNGLESPLSG

SEQ ID NO: 27765 - protein, 212 aa, A.fumigatus
  UNSURE (37),(76): Identity of amino acid sequences at the above locations are unknown.
PPRQGVPASAPFPIPSPLRNNFPLPFVQSRPFTYTSXYASDPPPQLAQFQQAQQSQQQPGLHSQSQHHSPYLPHNXTAPPQLQQQQHVPPPLPGNPQQPQQYLPPNPGPPMQPPQQQQQLNYNVAPMNAGSTSMEDPESVSFEERASKAIDDFEAVLLEDYEDKNHIKEVLKSARARALGHATESSFPGGEPKDEAVILDALRTLIGGLRDQ

SEQ ID NO: 27766 - protein, 80 aa, A.fumigatus
  UNSURE (30): Identity of amino acid sequences at the above locations are unknown.
LSFSRLSSRSNNQGCTRSRNITHRTFHTTXPHRHNFNNSSMCHLHFRATLSNHSSISHRTQDHRCSLRSSNSSSITMLRP

SEQ ID NO: 27767 - protein, 189 aa, A.fumigatus
YTHSADPSGPVVKTTSAMNTVLDPVTTYGLTAVPSSCTTLFNGNIPSSPPPFVPTTQTPIPSTPLATRIDNYARENLSEQTYHHSLRVYHFGLAIKRHAFPTWSFTDETYFLACLLHDLGTTDKNTRKTRLSFEFYGGLLALEVLQSSAEHPANHFGVRCSHRDRRAEGAGRRVSSRLSSGTRICARKE

SEQ ID NO: 27768 - protein, 79 aa, A.fumigatus
TSPSVVLITWVDNTGANEHLVNPQTIKDVCENYPRKQWSSCFAGVIRKENGLKPWAHSTTLGEEFPAKIMGNKLMAPYE

SEQ ID NO: 27769 - protein, 132 aa, A.fumigatus
GLLEYAHKLNRPIPNGVPSDEQTNILVMQSQTMRDLEELTLAFDGLERFGLCWKKIDKCVSIYVLNRNGLLTDVAFRSKRRRDSGAVKDLRDELQDTLDEISMHVDAVLDEWLTAPADGKLCLARHGRWKTY

SEQ ID NO: 27770 - protein, 120 aa, A.fumigatus
TFFGIEAEEAELEEIRVTYIPELFLDYHNALYFSAHVLTSEILVQCMNLAMQVSENEYLTRSFVSSRRMAELVDALALSSKAMVQTRAKPGKRLLGGESLGIWTVEVPEDEEQEFLRQAK

SEQ ID NO: 27771 - protein, 66 aa, A.fumigatus
SIGKTRTEAFHMPSHVDLRTVYMYGVDVRDNSNWCLDYKFAHGKSWIAESKSLKSMGTSILPNVLL

SEQ ID NO: 27772 - protein, 153 aa, A.fumigatus
YHSKIFNLHAIHLRFVLLYDDMMQLMTMHTRALLLCPVLFATLSCILASATAILRHMHTASFTNSTCAFSSFHSRSVFFWHFFFVSLVIWTINRDLVVLLVKEPGYSDHAGKAVIGFDLRLVPELASFSQQGNKAQAPSCMCSASSGFLLSYL

SEQ ID NO: 27773 - protein, 183 aa, A.fumigatus
  UNSURE (23),(24),(62),(77): Identity of amino acid sequences at the above locations are unknown.
SRSALRTAEFQMRRQMIDEMLAXXELKKMLRDSFANYVVQTAMDFADPETRARIVDAIRPIXPSIRQTPHGRRIAGXMMASEGSGRGSAATSGQVTPNEMNSAQLPGPLQGPQKPFLYQHNSFPAPTVGPQFGSQNFMPASGSGSVSNTTSGGASDNSSGIYAPAAQQPNGNIGAQSQLYAYF

SEQ ID NO: 27774 - protein, 93 aa, A.fumigatus
LISCTSGKVAAMAPKVEISIPTTTTSHTSPPYTIYNITLRLPLRSFTISKRYSDFVAFHTSLLNQTNAPPPAPLPFSQTAVEGPHMVIPKQPG

SEQ ID NO: 27775 - protein, 280 aa, A.fumigatus
  UNSURE (236): Identity of amino acid sequences at the above locations are unknown.
QTSTEKLYLSGFSSDGDVDKIGCDDLRQTGYLDIERSILLHDNISQIALSVSSHPMIQEILDQTAHGVKIFEPHDLIESRLSQFAGSGVWLSQLNVYIVASRVVYTAPGTSWPTISFLRGRVFDKNWRHLENYTIDWYGKTTTFPLLFEIPTVWWKDGSFFGPEDPRIVLEEGVQGAEPIIVFNMILNATGYPRVMWIFKPFSRIISYLRIRGEERKPTEKNWAPFFYSYRADSEXKPSEHLYFVYSFNPLQVLKCKSDTGSCDWFYRATSSPDFSSLPH

SEQ ID NO: 27776 - protein, 67 aa, A.fumigatus
  UNSURE (27),(29),(30),(42): Identity of amino acid sequences at the above locations are unknown.
HWELRLVLQGNIKPGLFVTATLGPSWXNXXGDEFRAVALAAXSGLPILSGNSPNTRPVLPIRVFLSP

SEQ ID NO: 27777 - protein, 89 aa, A.fumigatus
SLRRSPARVEKMCDEACLQDLSNNPYFLVYPASKPQMKRLQFRSSSDSISVLIASLRLEFAALSTAHDMISFSITDHRDFCNGVLWSPP

SEQ ID NO: 27778 - protein, 194 aa, A.fumigatus
LLLRNSDLTINMVTPTSKPNSSFSKVYLTKNNYAGRSLHPNAKRPGKGVEESAKEESTQVVESFEVDGDKQIVDNEDITAEPASSPVSSLEDHENEILPGFEYFDSAVGERRRPQRGRKDLRGSESPTLRRKRNADEMAHTAQADAEKEDYVFGWSQSQKKRKQGYAGKTSDGSLWKAQGSTTAPSQSKSSPSS

SEQ ID NO: 27779 - protein, 350 aa, A.fumigatus
TLEIFSQILSLVNHGNSLLKADFVKGVNGVIGNANTLLTADFVKETRGLIEAVAPILTPELFKQIGTLLINANTLLTSDFVKEVKQLINAVGPLLSPDLFKQISGLLNNANDLLTPDFVKETRSLVGGIAPVLTPGVLAEVGALLSNANDLLTPTFVNETQGLIGAVAPNITPQLFKEIGSLLNNANSLLSTDGLHEIQSLLNNANDLLTPDFVKETKDLIGDVSPVITPELLGQVGGLLNNANKLLTTKFVEETQHLIDSVGPALTPALFTNVTYVLGNATQLLTPKFVNETRDLIDGVSPVITPDLLVEVGGLLNNANDLLTRKFVNETQVLVEDASEVCSLTLKSTN

SEQ ID NO: 27780 - protein, 73 aa, A.fumigatus
GTYLRCILDQDLCLINELPGEQIIGIVEETADLYKQVGCDDRGDTVNQVSRLVDELGRQQLGGVAQNVGDIGE

SEQ ID NO: 27781 - protein, 104 aa, A.fumigatus
RESVSRRMIHGAESTRSRCLLQDEAAISTRISSELAYYYFDIIMTQSISSLGMNLGFPLGYGLIIKTSTHSTCMAWYITVLNMKIIKHEARDYLPYMSKKRKLQ

SEQ ID NO: 27782 - protein, 94 aa, A.fumigatus
EDLSSNWCSTAQLFDPETMSPPTSEKPGSVQNIEDVGQRALDNIDYDEEYSYEEQRKIIHRIDRRLVTMTGLAYCISLMDRTNLSMAAVAGYGP

SEQ ID NO: 27783 - protein, 217 aa, A.fumigatus
ALQSNSLPHPGPRPEDLGLRNDFPVSPRASTTTTTTDRRSCTTTVTYAIAYFLPIILQQGMGYSVGASQCLVAPPFVFAGIVMFSSAWVGDKYRVRGVLVAVNSILCLIGLPILGFHSNNAVRYFGVFLATAGANANIPAIMAYQANNVRGQWTRALSSATLVGFGGIGGILSSLVFRSQDAPGYRPGMWTTIGCVSLSFLLFFTSAAVLTEVDAIF

SEQ ID NO: 27784 - protein, 73 aa, A.fumigatus
ITGVIGVLTLLLLVDFPDRAHKSWRFLSEKECAFVVRRINRDRSDADDEPFSLIRFLTPALDPKIWGFAMIFL

SEQ ID NO: 27785 - protein, 72 aa, A.fumigatus
SYVSLFRSRDISLTIRQGMGFTKDWKQMTVCRALLGLLEAGYFPGCVYLLSSWYVRCQCPFLAPDGRFCVLT

SEQ ID NO: 27786 - protein, 141 aa, A.fumigatus
PPCADPSGPVVTTRMTDALRAVTRLAIQEARAREIRQELVKSEKLKRHFEENPEELKQLRHDGELRAARIQPHLKHIPDYLMPSKGRKGISSEDVGFVGFRKSGDNRIRKAREKNRGKGKGRKPSGVRKVDPLKTFNRGRK

SEQ ID NO: 27787 - protein, 318 aa, A.fumigatus
LHPRSVLCDLHITMAPLSSRIFPVAIGALALTPLTSAWTLTWRNSTAGATIINENKAENCTRIWHQKGLPFAWDPEGKWCMHFYKDAACTQIAGYACDGKVWRQDASRDLPAFDVFPMPPESVSVIFPSTSSTATTPTSTAVTTTASQSPSAASAAASTAPTTSPTPSPSPASSSSTLSGGAIAGIVIGAIAAVGLIAALFFFFGRRNRKPAQPAEPDPRSTTPPTPQFPPGSPLGLVSTNDTAAAPAPAYIVPNKRELAEAEMSQAYAHGYGHPRAYAGAKFVELPGNGAEAELSNSRQVHEMDGTSDIKRPIYEAA

SEQ ID NO: 27788 - protein, 152 aa, A.fumigatus
PPQHPSPRQPPPQPHRPRPPHPQPRPPPPPRPPPPSPGAPSLESSSAPSPPSVSSPPSSSSSEDATASQPSPRSPTRGRPPRQPRNSRRVRHSASSRRTIPRRPPRQLTSSRTSGNSPRRRCPRRMRMGTGIHGRTPAPSSSSYPATGRRRN

SEQ ID NO: 27789 - protein, 134 aa, A.fumigatus
LDELGAGVRPWMPVPMRIRLGHLRLGEFPLVRDDVSWRGGRRGIVRRDEAEWRTRRELRGWRGGRPRVGLRGLGWLAVASSEEEEEGGDETDGGDGADDDSSDGAPGEGGGGRGGGGGRGWGCGGRGRCGCGGG

SEQ ID NO: 27790 - protein, 106 aa, A.fumigatus
RLPIAMTIRASNTYEERALGLYPSNEDELDENNGINYVTTHMRNQLSFDLWYIFIGIFCICATEARRIMDPSEPVGFQPCFGFRARTTDFLQGFSVFAIFFEVVSA

SEQ ID NO: 27791 - protein, 98 aa, A.fumigatus
VQYLVLSFRGCLTRCSGNVGLSLGYPNVTTSFCGQFSVFSKIVICAMMIRGRHRGLPVQLDRAILLPGERIAGDDGLDESFAARQSQTLNSFRRYHTK

SEQ ID NO: 27792 - protein, 69 aa, A.fumigatus
EGNASKSVGFEHERLYITLPVSTAGAYDRSKAYTRDITNINPILIQTTRLEMPFLDYTSITLTILYGSV

SEQ ID NO: 27793 - protein, 73 aa, A.fumigatus
KKGLDRPPAQGNQGDPILANQWRVKDILLGHRRHRLAGYCCHPRASASLGTGAATLGTDTTNWQWPSWARARS

SEQ ID NO: 27794 - protein, 727 aa, A.fumigatus
  UNSURE (678),(690),(705): Identity of amino acid sequences at the above locations are unknown.
PWATPRAAELPFYTKEKKSWQVENLPKMVDAGIIIECMSPWSARTKFPRKTSGKLRMVHNFMPINAATIKMNYPLRRIEPVIANLSKKRWKVFFKVDAANGYWAVPLAIEHSFKTGFNSILGQFCYLRMGQGLTGAPGTYSKLKDLAMGAIPEPSSEAALTSLPGVGFEYFMDDDAAATENMNNMVSFLHQHYFPRLAWAGLTLNPAKSVFFTDEIEILGHQCTHNGLRPSITKLEALRAWPEPTNEEELMRFIYLLPFLKVYIPGRADYTAILKKALKYTGKGKTKRLESFKWGEEQRKVFQILKRYLLEVKLSGGDPKLQYHLSTDASNGGLGGVLFQMTEHPVGTKSSRKTHPYEVPVMYLSFALSDPETHYTTTEKEVLAVLRGLEETRWLILGSPYPVIVYTDHTAVKSVTGEHSEATGRLARWHYRLQEYQVDYVHVPGKLQVVADGLSRIPYWKSTTPGTEEDGFPLLSFANMEDCQPQPSITPKETHEELYLPYLQDTWYKQTVEELLKGRIDKRFSLINVEGEYLLAYHEANGKWSQCVLQSQLQGVLCLLHDVHGHFAARISLGRAIGRYYWPCRYQTLVEYCRSCPQCQVVGLKPPKGDPRAVISLEPLQLFAMDYIGPITPTSRMGARYILVGADYFSKYVFAHTATAATTQVSVHFLKHDVGKHXSITAIPCTPNNXKALYRRRDHPLLEKXWGVRHVTGPCTSPVVWRFYRTE

SEQ ID NO: 27795 - protein, 483 aa, A.fumigatus
SGNPYAANYITLPYSRGLGKSTPKKRPRFPSLTWGSIAVHPYFLCYFTLSLKSLFSFPLVERNMSDIKPKSPSIPQWQQPAAATTNTGNSTSTPSPSSDETPRSELIEQAKKFLQDDSIRDAPIDRKIAFLESKGLRSEEIDSLLAISRETDSSTNLAEGSKSTPDSTTSSTSNESQSPKEPSALSPISSASSPTTPAAPTATKNSTPRDVPPIITYPEFLMQQSKPPPLVTLRSILYTLYGAAGLGASLYGASEYFVKPMLATLTSARVELAQTANANLQKLNEKLEQNVSRIPPHLSAKDTKQTEPADSEDDEQDSVTSDPTELFHRDVATQTSQDLDVSTLPHKAGYHPADEATPDPTATVNTHIKRLENITSHLREVASSEKESGALDDSMRTRLNELHHYLDGLLYGRSSYSSVTAYGVYSTPGLETTSGPSVGISKGREDAMASFRADIRGVKGALLSARNFPASRGRIGSGILSGR

SEQ ID NO: 27796 - protein, 94 aa, A.fumigatus
EQASTAQANTLSNQCSPPSPAPVSNSPKPPTPTCRSSTRNSNRTSLGSRPISPQRTQNKPSPPTPKMMSRTPSPRTQLSSSTGMSQPRPPRIWM

SEQ ID NO: 27797 - protein, 117 aa, A.fumigatus
YCLFSFNRSGLQMLPSTVLHDYYAILGIPQSADPASIKSAYKRLALVKHPDRRRNEPKATAEFQLVSLTPSFSSLLEACVVTDAVILSSTLRMSSSEMSIDVENMTEYMNQQYVTKK

SEQ ID NO: 27798 - protein, 67 aa, A.fumigatus
LKFGSFQPLVVKTQCRSVQGIKGGKRRVELHYQVAPRFKEQEGLIVTYHFTAPLPLFYLKFYTKADN

SEQ ID NO: 27799 - protein, 87 aa, A.fumigatus
GAALGRVAPFSAFQPGNFCLLVLSKNPSLLNVAKGRVFNSTISPSGKLKPLPKSFQPGSPLPLTKKVQIPFLLNPFKNFPFPPSNFS

SEQ ID NO: 27800 - protein, 350 aa, A.fumigatus
KEQRAPTLHLIERHKNLLSEREALAASSQDASRLMARGNKGERRDPGKLLREEKMRKRIAKELPKVEADLRKELERWEEEYGRPFLVHGERYLDELTPVIAKPPPRSKTPSAPPSANSKAGFGRPQPPSRPASVMRGPPPPRSATRTPTGNGQTKYNTIGPSRAGAKSPSKIPARVPLSNMPYGNNSAGHRAAPGSYSSSTMGKVPAPRAPPPRMRALTIDSKEDRGPYSMDPPRCASAMSNAFVRPVSPEDVYDDRNQRSFMSSSVFSQRSTGFSQCSQSSASSISSVPNFPRPNPYLQHAPPPPAPRQVSNSSTVDTANTGSENWETFDDGSESEADVFTPGLEGNAC

SEQ ID NO: 27801 - protein, 176 aa, A.fumigatus
LKEVQTRLRAEILSTNTTTPTSEVVNALPYLTAVVYELLRLYPPVSQLINRVTVRPAMLGNEIPIPAGTFVGWNAYGVHVNPAIWGPDANEFKPERWGRTVGEMHARFRRETVRGTYIPFNAHSRKCLGQGFVLLQMKILLFEVLRRIEWTVDPGYRLKMTPVSYFLESGRKSTDA

SEQ ID NO: 27802 - protein, 274 aa, A.fumigatus
GVKMLHLPSFVSNRYIKTMRDYAAEIVAKRRAAPTEKKDMLHAIMHGTDPQTGKALTESQYLDEIINLFIGSATAANLVSFALYYLMKNPHEIARAREEIDAVVGGPTAQLEHEHLARLPYCEAILRESLRLSATAPGFNIEPIPDLEQPVLLAGGEYQVPNKQPLIALLAAVNRDPEVFEDPDAFKPERMVGEKYDRLPSGVKKGFGNGKRECFGKRYAWEWSFMIFVTIMKDVDFVLADKNYKTEVGGVNYNGAFSTKPLGLFALTGPRQSV

SEQ ID NO: 27803 - protein, 424 aa, A.fumigatus
GLHSRVPVVVDLGFSPRKIDTYRSVLEMFLRLVPDAVTCSLSCPDEIIQWLNTTKGSIKTIATWHQSTPLGIDVSQTAHIPVEKAIQSGFDCIRITGESFSIEDNLACVALRQRLIQNSTIPVIAYNTGLSGRASICLNPTLSPVVPSSMNATGVTLSDAQKALTSCFLTTKMRFTLVGQALEHTLSPAMHVAAYAACGLPHSYEAVQAATLSEIRTLLEDGSRSGVAISIPYKTAVLPLLDEISPDARNINAVNTVVLKRHRHDGQVVTTRKGYNTDYIGVRNCIHQHLSPANAIRDGTTVLIIGAGGMARAAIYACYKMGVRQFCIYNRTLENARKLAEYFHRWIHQSGTNLEFEVIESIETQWHTRFRLPTIVISCLPGQQVGCGEMVDVRISERWLQSTTGGVFLEVWLFLVFWAFVGFG

SEQ ID NO: 27804 - protein, 64 aa, A.fumigatus
RVYTRLKSSKTFPSTLTTTYLFVGTHSLQTWVFVLTVCSGGPKHERNGHTRGHCSFDTIDPVTR

SEQ ID NO: 27805 - protein, 99 aa, A.fumigatus
PPSIDMSLHTSYHADSDADDEYERSVITSPHLATDSEASPSDSEFPSAEHTPRTFANPEEDPRSPKTIITEWTAEECANWLAALGLRQYCATFLGTLAA

SEQ ID NO: 27806 - protein, 113 aa, A.fumigatus
SSLLLTVKEPKSRCRIGVNRSLALTYIQRKELRRALTPFPFHRSLGCITCKAKRLKCDESKPTCLQCRKRNVECGGYKKDFKWRPFEETNVISRISSIQARKSKCTGLQGLHL

SEQ ID NO: 27807 - protein, 393 aa, A.fumigatus
NLSGDPARSGKERRASHSVQAGKDRQPWPVSPRSPTPTASSLDSNDAALIHTLQSGISPSTDSPLALTQENLTSWNSGIARFLDFSNAEDELLTPLFTNSSPPEQSPQLSDIVPSALDIHTSPMRRPLGMASQNTLRPGNLSFAALLEEDNDKIEEIARQSDKPIDPWLVGVSDGGAPSETSNTPAMLTKEPNFDIASPEMLALQFDRFTCGILSVKDGLNENPWRTLIWPLAGETPALYHAIFSMTAFHSSKDNPGLRMHGVDHMRRSITYMVQDIQNMRTDAALATSLALAFADTWDQNTRNCIQHVRGAKALVLQVLKSKARDANDIERIRFLYNTWLYMDAIARLTSRDDDGDQDMNFSIFQLPRDAVHEIDPLMGCATTLFPLINQVA

SEQ ID NO: 27808 - protein, 82 aa, A.fumigatus
IIKMKYSGTWHGLPASKLYGEVKDVGLLTLPIGIVVTEALAPGSHTIMPGIVCAIPCDHKVCVKLYGSLCTPYSKVARHLPT

SEQ ID NO: 27809 - protein, 116 aa, A.fumigatus
HSSHDKAHRTLITRKLKGLEDIISFTSVHWHLGENGMVSELRALENEANVFCWKGWRFATADEEVAGENVTPDPLHPDFTHLRAIYFSNDPDYTGRFTVPVLFDKKTQRIVSNEVC

SEQ ID NO: 27810 - protein, 195 aa, A.fumigatus
TFKQSSEIIRMFYYEFDDLLPEKYRNVDLYPPALRSEIDATNDWTYNDVNNGVYKSGFATTQEAYEKAVTTLFASLDRIEAHLSKDANSPYFFGSSITEVDIRLFTTIIRFDPVYVQHFKCNIRDIRSGYPAIHRWVRRLYWDVPAFRETTNFEHIKKHYTKSHKQINQFAITPVGPVPDILPKDEQVRAVAAQQ

SEQ ID NO: 27811 - protein, 88 aa, A.fumigatus
  UNSURE (2),(3),(4),(5),(7),(12): Identity of amino acid sequences at the above locations are unknown.
LXXXXLXSYTTXAGKITDWVDPKDKSGEFKRQQSVFRNFISREPGAQFPPEKDRYHLYVSYACPWGARSLEDSFDCSNSRHIRLTLFS

SEQ ID NO: 27812 - protein, 249 aa, A.fumigatus
  UNSURE (9): Identity of amino acid sequences at the above locations are unknown.
TILYNQFFXSSDRHTKDPSVGCRLLTPQTTSRRQARRKMPLRNILHKKDKINDSGSQYPPDGPSNAVPEIKFIRSDTISHEVIDPSSFGGDVSEHKGDHGQSDLLEPSRPSSSTHRRSLNIFSRSRSPSESSEPASPSRPRGEHRLSQLLHRDRGSRSASSSSVNIPSDLPQISDDKVDEQEREAQWEKRATILAQQSPLFGSPAASLRSSPNRLETNSAGGARSRSSSHSQINDPEGDVSLCAWLKAI

SEQ ID NO: 27813 - protein, 141 aa, A.fumigatus
YGGFTKVYLFSLFLKCLTLNRSPRHGWGCPQDPDKAVTYLSYAAANSASIESQALQAGMKKGGAAKGELVLAIFELGNCYRNGWGVKKDPVAARQYFETAANLGDTDAMNEVAWCYLEGFGGKKDKVRYYLTPNCPSGRAR

SEQ ID NO: 27814 - protein, 195 aa, A.fumigatus
  UNSURE (167),(188): Identity of amino acid sequences at the above locations are unknown.
TLVWEEHGTSSSTSSLRVRRKPYLLMRCSSASSSSSSSSEESSSMSKPPSSSSSSSFSSSSSSSPSSSVATSEPSSLTTAASPCSMESPSSTPDLPLVGLVRRSLALEVRESPFKEVPKVTRCTSWIGSSSTLPSISSCNLSCGNALSELSSISVRSPPKARFTKAXLTPVTVSIKMPRPTLKNQNLXAESPVKR

SEQ ID NO: 27815 - protein, 309 aa, A.fumigatus
  UNSURE (8),(28): Identity of amino acid sequences at the above locations are unknown.
LLTGLSAXRFWFFRVGRGILMETVTGVXYAFVNRAFGGLRTEIEDNSDSAFPQERLQEDIDGSVEEEPIQDVHLVTLGTSLNGDSRTSNARERRTSPTNGRSGVEDGDSIEHGDAAVVSEDGSDVATEDEGEDEEEDENEEEDEDEGGFDMELDSSDEEEDEDEAEEHLINRYGFRRTRREDVELDVPCSSHTKVYRGHCNIKTVKDVNYFGLNDEYVVSGSDSGHIFIWDRKTTNLVNILEADSEVVNVVQGMSILTTYTTLAHTCFLRTPVRTDHRRFWDRQHHQDLLTRSPCTGQCTPWYQHPRPR

SEQ ID NO: 27816 - protein, 115 aa, A.fumigatus
GHPYEPTIAASGIDNTIKIFSPDRHAQDNARRGINILDPDNPANTLGSNVASIGGLKSCKRIHDSYRIMSQNDVDRQGGMSEAYITVSHGLLRSWDFILPSYSDSGIFRGVCWLG

SEQ ID NO: 27817 - protein, 73 aa, A.fumigatus
PTSLSSFNSTYYGKDYRAGAALLRARRPYLFKNALTGLGLVAFTISVCMCSTGTPPSSCFRDESTARSMVRSY

SEQ ID NO: 27818 - protein, 92 aa, A.fumigatus
RPRYKMSYYNFNSLFPSGQAVDRVRGSKLPTEGPQLSTLEEAFTSENWIIRIYKVKDLDNLGRDHNQAVAFDKGLKKKRSTKRKGPRVLRTE

SEQ ID NO: 27819 - protein, 67 aa, A.fumigatus
TSSGRGSSQHPYKELSGRPNSASADGHPRKAPILVISVIYYYFYSISVITIVFVFFKTSYPIQLNAK

SEQ ID NO: 27820 - protein, 391 aa, A.fumigatus
HYLPVVYPCEYDTGRPKPAPSGRYVLRFYFNGCFRKVVIDDRLPSSKTSRSLYVVDRNNPNFLWPALVEKAYLKLRGGYDFPGSNSGTDLWVLTGWIPEQVFLHHEDVTSDQIWRRLFRSFQYGDVLLTIGTGKLTEKEEEELGLVSEHDYAVLDMKEFNGRRQMLVKNPWAGVHTASGRTENSLESHAPHDRSSLSPGTFWMDCEMVFQNFENLYLNWNPSLFKYRQDIHFTWDLTAGKGVPGCFVKNPQFAVTSETGGTVWLLLGKHFKTRDRLDYSSSEDSQAGFISIYVFNADGKRVCLSDGALHRGPYVDSPNTLMRLEMLPRTTYTAVVSEESLPALSQNFTLSALSISPVHIAPSQNQYTCGNKVQGFWMPSTAGGNAESARYP

SEQ ID NO: 27821 - protein, 102 aa, A.fumigatus
NKIEERIAPKAQAWDDLCHTRRDKLQGDSATFMSEFDTIHQQSEWFTLSRPRSDREVVAQRLATTEQSVKTSCTRSVFSGTDIINVSPPACANSSEGRFQPS

SEQ ID NO: 27822 - protein, 88 aa, A.fumigatus
  UNSURE (1),(40): Identity of amino acid sequences at the above locations are unknown.
XDIMVLFVDYDHDAFPRAHEGTYQAYLQPDKPALSKLKAXDSDLPTHHENDHSMHDHAKNDGSHKIVNRNGFSAALNCYPYALLIDSF

SEQ ID NO: 27823 - protein, 314 aa, A.fumigatus
PRGMVDAQRKQSHIQRVEGIPFARLAKADFGQFIQTSLSSTQSDQERLIWQLANILFNDEIEDDISAGVPPQLRSKCLQRIKKDRLSRLWESIVRERHAHDLDKIESSEERAVHLLCSHRVEEACKVLIAGQNLHLATLVSQIGRDATTRSDMARQIEMWRQHNVYSEMTEPIRALYELLAGNSLRSEGKSGGALEDRASTFSFTERFELDWFQAFGLRLWYGIADDEPIEKAVLKFAKELSSGDESAFPYPASHLEGDVMSRAASDTLGRESPLWVLLKVYSGTTAAAKSSDLPAIELPAALLPESVTGDKLS

SEQ ID NO: 27824 - protein, 224 aa, A.fumigatus
RNTVGSEPTSTYTTDDSFVGSVAGVEDDTFDFKKRKMVPGAFGNQVMETIGDKDEDESFLGDGSTGSTTEQDGDDVTESQQSGDSDVEFDEGEEMDMAGTFPNLDHTVEHDDANSLDSYLDNTHPSLRPWETPSKARLNLSGDWAEQLQRTISPRKQNRDALREIQANAFTDRPLHDDTPKKSVTDYRQKGFATSIDLMNSLFHQPRKPQGQSPLKAQPKCFEV

SEQ ID NO: 27825 - protein, 61 aa, A.fumigatus
IYALDNRLLFSPAGITYRHNFYKDYKPLVYCIVELPSIPGRDIYISTIVLVDIITLYLFNM

SEQ ID NO: 27826 - protein, 109 aa, A.fumigatus
YQTTDANSSAKVFKEKVQEGSGPVIVDCSATWCGPCKGISPVFQRLSTSEEFKNAKFYEIDVDELSEVAAELGVRAMPTFMFFKDGQKVNEVVGANPPALEAAIKAHVA

SEQ ID NO: 27827 - protein, 139 aa, A.fumigatus
  UNSURE (133): Identity of amino acid sequences at the above locations are unknown.
DYELAAAGAADTLSWAAGAGAAAEGASTAGCVEPSFSKLRMGYNPQRSFISRSSSLPLLSVVYFFSPVKTALAPAMNHATCCSSDSEMRPAAMRTMVAGMKIPAVAMVRTHMFKGNILRVANGVALMGTKALXGNSIRV

SEQ ID NO: 27828 - protein, 62 aa, A.fumigatus
  UNSURE (7): Identity of amino acid sequences at the above locations are unknown.
FTRIEFXVKAFVPIRATPFATRKIFPLNICVRTIATAGIFMPATIVRIAAGRISLSDEQQVA

SEQ ID NO: 27829 - protein, 60 aa, A.fumigatus
TTDSNGRDEDREMKERWGLYPMRSFEKEGSTQPAVEAPSAAAPAPAAHDSVSAAPAAASS

SEQ ID NO: 27830 - protein, 132 aa, A.fumigatus
  UNSURE (97): Identity of amino acid sequences at the above locations are unknown.
VPMFLGTETGILKMVYSQLCHLHLGDFGLGSSNLWSSSGCRRTSYCGLVLVSGLMHGHVHRQFGSGAGLCVSYRRRNVLRYKARCSNDQVPIFSWVXGWCNLLGQTAGVSSVAYTVSQMLLACASMNSEYFY

SEQ ID NO: 27831 - protein, 120 aa, A.fumigatus
  UNSURE (92): Identity of amino acid sequences at the above locations are unknown.
ELKREFSKWSTVSYAISILGILGSVPATFGAPLAAGGPATAVWCWFLGSCMAMCIGSSVAELVSAYPTAGGMYFVTKHVVPMTRCPSFPGCXAGAISWGRLRAFPAWLTQSARCCLRAPV

SEQ ID NO: 27832 - protein, 387 aa, A.fumigatus
SSMADPSTYYSVAQGPAPPEDPSDPNRMAHQVTPPSHPPAGYGPGAVPPQPGAPYGAAAPNQWPPYGSPFPLQQQPQQPPQLASPPPFGYNAGPQAGMVAPTEPGLGGLTHQMGGLGISGEGGARTHKKKHRHAHHDIGGASATAPAQQPFAGMAQGGVQPTSQFLNTGLTDSSRPISPGAGVAQPAGVGFGAGASSGAGSVATQGKIDPEQIPSIPRSRDLPAQYYFNHVYPTMERHLPPPAAIPFVAHDQGNSSPKYARLTLNNIPSTADFLSSTGLPLGMILQPLARLDPGEQPIPVLDFGDAGPPRCRRCRAYINPFMTFRSGGNKFVCNMCTFPNDVPPEYFAPLDPSGARVDRMQRPELMMGTVEFLVPSSPRGWKEPRHV

SEQ ID NO: 27833 - protein, 115 aa, A.fumigatus
SVIVPSLLSVPRYPRYEAAWQIHQRITLSPRDLRLLKTPPIPIGWPTKLPLRLILLPAMALERFLLNQELPTGQQLRINGPLTARHFLYSNNRSNPRNWPPLLRSATMQARRPGW

SEQ ID NO: 27834 - protein, 131 aa, A.fumigatus
WVHLPAALVAVVPKDKLKINGPIKSFAKNGSSGKAVHRMFCSECGSPIAHDPDAAPEIIAIKAGTLDIEIKKNLKPVRALRRRAIGLNMLTTYVPGRIRKSGPLASFLSARSIWPSLSSTCPSRWDEKTNL

SEQ ID NO: 27835 - protein, 173 aa, A.fumigatus
QSEPYRRTTSPLPLMLVGLSACLAYVPESIPASTKPDLYQSNSNVLDRAIIRTVAAYAVVFGLVNCHRRGIPFAQPSRHTSYLENLFHLAGLVDQTTGRPDPTKLSCFQRFAMLNADHGMALSVFSALVTASSLTDPISCLITATGAAFGPLHFGATESANLVFTTGLQGVHL

SEQ ID NO: 27836 - protein, 191 aa, A.fumigatus
AGMAAGAPVQGHAGGKKKRAYAGEAFEIGSGANAALGGQLPAGGSYGAYPPQPQAAGYQQPVYGADPSQMNAAAPGYTAPVTPGIAQMTQQFGAMGVTDPHLMPPQPPQAAVAPQAPRPVPLNQLYPTDLLTQPFNVAELDYPPPPIVLPPGVCHSHGPVQEVKLLTASFSRQAFTHPLQRIALRNMFGRP

SEQ ID NO: 27837 - protein, 341 aa, A.fumigatus
  UNSURE (338),(340): Identity of amino acid sequences at the above locations are unknown.
TSVYPSPTANCPPKYVRSTLNAVPTTHSLLKKSKLPFALVIQPYASLRDAEEPIPVIPDQVISRCRRCRSYINPFVTFLDHGHRWRCNMCNLTNDVPQAFDWDAALQKPADRSLRPDLNHAVVEFVAPQEYMVRPPQPLVYLFLIDVSYASVTNGLLATSARCIKESLDRIPNADRRTRLGFIAVDSSLHYFSIPRDGSENSDPRMLVISDLDEPFLPIPGDLLVTLSECRENIETFLDKLQEMFQNTQNNGCAMGSALRAGYKLIAPVGGKMTVLSSSLPNVGHGSLTMREDKKVLGTSKESILLQTANSFYKSFAVECSKAQIVFTTGGLRNRPRXTXT

SEQ ID NO: 27838 - protein, 188 aa, A.fumigatus
SIDSIIANLGKLSGGGNVNLGWIIGRPIVASVAMAVLTPLLTKYVFARIFRRYIEHAFAQFDHVSNIILMVLVLCAFIAIAAYAGTSVLFGAFLAGTFLTYIPSKHPSGPFVVMSREEGEREAHKSPTFVHTFEVYLLDVQSYLMEPLFFASIGFAIPFVQLWTGTRIWRGVVFSLLMVAAKVCTSQP

SEQ ID NO: 27839 - protein, 333 aa, A.fumigatus
LSNIADHAIDPRFYCCLSRMFLDGLRLRFAGSLFNLVSLALLFSRGCDGRLCNMLSNRFSNRLINGLRLSSGLSGRLSDRLSDRFSDRLSDRLSDGLSDRLGNRLINGLGLSGGLSSSRLSGGLIGGLSGRLSDRLSNRLSNRLSNRLSNRLSNRLGNRLSNRLSNMLINRLSNRLSNRLGNRLSGRLSDGLSNRLSNRLSNRLSNRLSNRLSNRLSSRLSDGLSNRLSNRLSNRLSNRLSNRLSNRLSNRLGNRLINGLINGLINGLINGLINGLINGLGLSGGLSGRLSDGLSNGFLLFFNRCHIGNFILSRYLNAGFRLSTYSRLTGLRL

SEQ ID NO: 27840 - protein, 274 aa, A.fumigatus
ASLCFSVAGAMVGSATCSATGSAIGSSTGSGSAAGSAAGSVTGSVTGSVTGSVTGSVTGSVTGSATGSSTGSGSAAGSAAAGSAAGSSAGSAAGSATDSATGSVTGSATGSATGSATGSATGSATGSATCSSTGSATGSATGSATGSAAGLVTGSATGSATGSATGSATGSATGSATGSAAGLVTGSATGSATGSATGSATGSATGSATGSATGSATGSSTGSSTGSSTGSSTGSSTGSSTGSGSAAGSAAGLVTGSATASCCSSIAATSATSS

SEQ ID NO: 27841 - protein, 68 aa, A.fumigatus
RAQQQAQQQAQQQAQQQAQQQAQQQAQQQARQQAHQRAHQRAHQRAHQRAHQRAHQRARAQRRAQRQA

SEQ ID NO: 27842 - protein, 585 aa, A.fumigatus
EATETVMEPEAVAPVAEEPVKTAIAQEDNIEKKFAEETVSKDVTVEEPSVAEKVVPSEPATEEPVSEPQTSEATVRAEPEASIQVPAQDEVADVAAIEEQQEAVAEPVTKPAAEPAAEPEPVDEPVDEPVDEPVDEPVDEPVDEPVAEPVAEPVAEPVAEPVAEPVAEPVAEPVAEPVTKPAAEPVAEPVAEPVAEPVAEPVAEPVAEPVTKPAAEPVAEPVAEPVAEPVDEHVAEPVAEPVAEPVAEPVAEPVAEPVTEPVAESVAEPAAEPADEPAAEPAAAEPAAEPEPVDEPVAEPVTEPVTEPVTEPVTEPVTEPVTEPAAEPAAEPEPVDEPIAEPVAEHVAEPTIAPATEKQSEAHEVEETTSKAKPEAVKEHSTETAVEPGVNGVVSNIGELDQPPIGGKEAAKVESEPVASKEPKAEEPAPTSNGDSSVEKDVDSSSQPAPPVQDAIPEPTVEPTKDTEEKDSIVPPELVGAGAAAAIAAGAVVAGVVSKSHKEPEVVATLKDDVNIKEQSRPNDDKQEISRLVPAPQIAESSTSKEMPTPEPESDPALVALAGDREALVFTTGAAKSRAKRLAAI

SEQ ID NO: 27843 - protein, 331 aa, A.fumigatus
FLRSPRRRSLFQSRRPVRRLYVLSRKPAFRYLLKMKLPMWQRLKNSRKPLLSPSLSLPLSPPLSPSPLMSPLMSPLMSPLMSPLMSPLMSLLPSLLLSLLLSLLLSLLLSLLLSLLLSLLLSPSLSLLLSLLLSLLLSLLLSLLLSLLLSLLLSPSLSLPLSLLPSLLLSLLLSLLMSMLLSLLLSLLPSLLLSLLLSLLLSLLLSLLLSLSLSLPLSPPMSPPLSLLLLSPPLSPSPLMSLLPSLSLSPSLSLSLSLSLNLSLSLSLSLPLSPLLSLSPLMSLLLNLLLSMLQSRPSHPRLKSKARLTRLKRLPAKRSLRPSRNILLRQQ

SEQ ID NO: 27844 - protein, 261 aa, A.fumigatus
VLASYNRRYCAPRCLCLDERALDSSQSAVLKSPSVVTSHQSASVLVPSYSESHLKNVEWSNLLVQVGQNLVQARGVSPVAHQVGDDAKCAHEGDASLLHATVGIGRQFVVKGTTSLGVGETSYPSSMSERAKKAVPISLVSFYLDAGRKTKLTNFSDNTADNQLFLASGLDGRAELGIVPGVDLALAMNNGHIGVQIHDFLDRQSIGTRVGGSGHDDRQVKQVAQGGVGKHVVAEVVGVEIAVQLGETDMVVDDENSLVGN

SEQ ID NO: 27845 - protein, 147 aa, A.fumigatus
LSKPGTNWTKRMRYSFIPILVVQPLIPNQAVLIIDYHVGLAQLDRDFNTNDFRNNMLAHAALGNLFDLSVVMTTSSDAGPNGLTIKEVVDLNPNVTIVHRQGEVNAWDNAEFRAAIQATGKKQLIVSGIVTEVCKLRLTSSVEVERD

SEQ ID NO: 27846 - protein, 76 aa, A.fumigatus
RDRHRLLGPLAHRRRIRGLANTEASGTFDDKLAADANRRMEKAGVTLMGTFGVVTDLMRDWRNTPGLDQVLPYLDK

SEQ ID NO: 27847 - protein, 62 aa, A.fumigatus
RQTGGRCQPSHGEGWRHPHGHIWRRHRPDARLEKHPWPGPGSALPGQVSCSIRHFSNGTHCN

SEQ ID NO: 27848 - protein, 147 aa, A.fumigatus
QLEHRTPIHRLEADARTLRDDCSRGHALRVPDCAEDTAPVCVAAVEGGLDERGPSDGGRDETGGLVVRGVLDADGDELGGAFAVADDELRERLRERGEDFLHGGVVVRGGGTDGGTAGGAVGKDGDRVVCACVAVVFTTGVEGQRWS

SEQ ID NO: 27849 - protein, 211 aa, A.fumigatus
RPPLSFHPRGEDDGDTSTNDTVAILANGAAGGAPISSPASDDYTAMQEILTSFAQSLSQLVVRDGEGATKFVTVRVQNSPDYESARLIASTIARSPLVKTALYGRDANWGRILCAIGYTQGVAPGTVVPERTSVSFKPVDGSPVLKLLVNGEPEQVDEERASVILQEEDLEIVVDLGGGEKGEQGLGGEEAVYWFCDFSHEYVTINGDYRT

SEQ ID NO: 27850 - protein, 104 aa, A.fumigatus
  UNSURE (87),(93),(94): Identity of amino acid sequences at the above locations are unknown.
QNYNNDWQWIYSRHGKEDTSTAAKGAEQVGGDGEGTNAGTTKGGSSRNDSLKLLIHALFAVAGHLQDPVLQLLGDIARGRARDLNPXLGEKAXXTSMKVMYTAV

SEQ ID NO: 27851 - protein, 148 aa, A.fumigatus
LDHRCPSTPVVKTTATQAQTTRSPSLPTAPPAVPPSVPPPRTTTPPCRKSSPRSRSRSRSSSSATAKAPPSSSPSASRTPRTTSPPVSSRPPSLGPRSSRPPSTAATQTGAVSSAQSGTRRAWPREQSSLSVRASASSLWMGVLCSSC

SEQ ID NO: 27852 - protein, 74 aa, A.fumigatus
IHQYINAPRAILSRCTCPLLGLSCKYFNLVYFLSNVHLAIIDLFCFYKTFQVTCIQCILHSAYRLDNLLLTNFG

SEQ ID NO: 27853 - protein, 66 aa, A.fumigatus
VCVQCLFTRADYSWVGNWTSVFLASATSGMEISNIYVRKFDSNFMICTWRIQLGPQFCSRTETLKH

SEQ ID NO: 27854 - protein, 170 aa, A.fumigatus
SSPVSASYKEAKIMSVDADEETPLAGTSPPNPSQIPSIALNAISNPDEPYVVDPSSLTTYEKRLYDFLCSQEWTDTQFSCFITQIKPMKEALSRYFYSHGWNTVQVQCLHERCEMEFPEHFPAPRGNAEQQDTQMQLRLVEEMNRRRAMGERMYPSIGTMDGGIVEEGRA

SEQ ID NO: 27855 - protein, 89 aa, A.fumigatus
YRISMSLSNPTIDDYPGPDLGTNSDASEESSCKHYSYVCTKESKSISIEESLKNSIPNGILSISSVVPGHITYVKGGLAKYPYVAETPN

SEQ ID NO: 27856 - protein, 227 aa, A.fumigatus
PDDEDPGYQAFLDHPAFERGDFPESKDEPCAFAVDVGPVVTTCNGCGATFPLRNRLHTHLSECPRTQEPIPVTPTTNDPTAVCIIESTHKPTGLVGICSWHCATAKIRINSTSEYHEICLNIGCSSTIGNTEFIEALPSVTITELTDGITVSGIGSCHRSNCSAMLTLWFPGLMNDGGSVNAFAKITIRCHLVDGLKPKLLIGTDVICSEGFMLNFEHGITIISSCS

SEQ ID NO: 27857 - protein, 144 aa, A.fumigatus
LTFLIITQAKLHRITCVVVYAKQRSLLLVYSVSKLAVRLKTDLPANHDFIFDPLDGSTLNGATIYAHMVDHEFSFIEVRNETPTPIMVTRHARIGTISDANFVTAYQVSEDAIPLAKPLESKLLEFESTKLSYPSSRYREHVKH

SEQ ID NO: 27858 - protein, 92 aa, A.fumigatus
LTEVLMSFNVWGDDGSTARIPEEEWMEVPLKEGWENRLPKPYVYRVSPKDHECIDRMFDPLREAGKLSPATGHTPSAYLVFVVWKTVTDQNS

SEQ ID NO: 27859 - protein, 133 aa, A.fumigatus
KILDHGTNRWSATTRSTVGLAVKNAMLGPESVSNQYLFIESFNVSQRDVLAALEDVTGTRWDVTYHDAEEEKRLALEKLAKGNYSGIPALMRYITCVKGYGGNYMDSEESANKLLSLPAESLHAVLAGLTRHE

SEQ ID NO: 27860 - protein, 75 aa, A.fumigatus
QNSKAQLDNRDLTFDGKCVGESLLYEGFYTWAETARGMDWAGVDNEQSTLCIGGDPTYGASSVMLFNFESPTDIE

SEQ ID NO: 27861 - protein, 335 aa, A.fumigatus
  UNSURE (13): Identity of amino acid sequences at the above locations are unknown.
AGPLGEDQFRHGXWYGTMLADYTTDSTRPILFFRIGVVSEIATFLAGAISAQIMALNPWIPTLIGCGIVAVGLTCAFFLPETLNHCAKKKATIHRDEPVSCMGGLIVGEESFYCSPKVLLKSSRHCLILGKIRRFLNHDIFIFDHRLMLLLFAFAVYGLAQGSSGFLAQYMSTRFNWTLAQANLLKSFHTAATLPVFLFLLPYLSTHVLNYLSLRGRDLYLARMSITCLAVGSLSVGLAPNIVFLVPSLCLHAAGGGFPLVARSLATALVESDKTARLNSTIEILHSMGSVLGSLCFTKVFTLGLKLRGVWIGLVWIMSSLLFALVGIPLTVLRV

SEQ ID NO: 27862 - protein, 365 aa, A.fumigatus
TPPPSPSQSSQGRQGIKIERYTTMGFFRSHSKKTMSPVHSLIEECNRLMDENMWHEAGEKLSHAVKQLEESQGLYHEETLFMKTNLAYALRRRGEYQEAERMDQQAYAVRLQVSGPDNVETAKSLNNLALDLKGLGRFDEALDLEERALETFLKINGEGSRETQTSMNNLANSFHRHGRLQDAARLHERALALQTNTLGREHFETIITMDLLGVDYRELGQLDRALHYQSEALELSKANLGEAHATTIRCSANLATTYQRLDTEDGEAKALALLEQALTLSRRTFGENSSDTVPVMNNLAAAYAREGRFADAVPLLQSAYAWNQRTLGPDHPQTRASEGNLNYVMEKMGLTRATRLHHEAGRTRL

SEQ ID NO: 27863 - protein, 268 aa, A.fumigatus
  UNSURE (110): Identity of amino acid sequences at the above locations are unknown.
TDIPHGKSIPLVGLCGGDKEDPLQLKCLAPLFQAPFWEAELTGRCVVYVGAYFFLPFMSSGFALGQTIVTILVCRALLALLGCVATILVAAPFDDMYTPNKRAVPMPTFXYIAIFGTVGAPIYAGFIDETLGWRWISRKCSTIPPSKAIHILATKPALLGFGLWFSLAWFLTSSSSPSSPSPSRKKTPGARALPVGSTLYRPLQRHNLRLRAQLPPDQQIPLHRHRLRPRTNTRGTPLRRTARLYLAAYRTVLSTASRSSRSYIGFRR

SEQ ID NO: 27864 - protein, 223 aa, A.fumigatus
APPYTPASSTKPSVGAGSRGNAPQFLRPRQSTYSPPNPPSSALVCGLVSPGSSPPLPLRHPHHLPGKKRLERGRCRSVVPYIALCRGTTFGFALNFPQISKYRFIVTDSAREPTPEARLYGALLGSIWQPIGLFYLQLHVVQGATLDFAGDCLGPQYRGHFLYLESCYSFTSDCYRENSSSAIAGQGFMRNTLGALSPLFASQFFSIIWAVGIRGCWRLWRRC

SEQ ID NO: 27865 - protein, 420 aa, A.fumigatus
  UNSURE (49): Identity of amino acid sequences at the above locations are unknown.
GNLSHCGRCSLRQSTIGLLAARRPQERDLYVEWTLIVPARCSHLLPHLXYLMRPIVVALRADSDFVGQGLRTLELCVDNLTADYLDPIMAPIMDELMTALWDHLRPHPYNHFHAHTTMRILGKLGGRNRKFLNHPPELTFEQFSDDSPSFDIKLIGPSEKRPFPSSIGVDLAIRKLMEVPKTAAAKASDGYYKQQAFRMLSSQLKLYIGHENVPEDLAALLRLHANDLFEGKTTAMTDILDKSERSSSIAKKLAQEGTLKQLLKACIFATTLPDIEQSATAFVADVCKHFAVVEVGRALALARHNRKPFDVHSGEGPVYLDSRILAEAIVESLSSDNLRVRDGAEAAMQVMKDAAGIIFGAPERVAKLPFFQHLGRVFCHSCHSEEWFTKAGGSLGIRLFATKLDLGDSVFTTGLEGAEP

SEQ ID NO: 27866 - protein, 550 aa, A.fumigatus
  UNSURE (5),(486): Identity of amino acid sequences at the above locations are unknown.
QNTSXWYEPILPAEQMFLLSCRKLLRDFIISLSSHLSRKRPADAFLEFLTNSSSMVIVLLNELSAAFQHVEGRLTPEDAVKRYLDLHPESSLANILSEQQQRMKLKMVADDILSSFLEPGVYACSVLRDFLREILAGVVLESAISNLSRSETINGWIIHLLREGESELLNAIDAGVEGAKEQVVAVEGANEENKPTAVPSSESDMEGKPAGHSDTYGILPTTKVIEVPIYPPGGTTVQTQDLQPQTARLCSPEDMLSSDAQSTMLPHHSPVGIQDKEATIHTPKVKDAAEIQNDYDSTKIESTEHYPPVQPTDPCMAPPASRLPDFQSKKSPATTLHHASVSVEELSEASEKALIRSKPTSSYLIQIEPAATRRTGWMIFRNYADFESLHGTLGTIARLNKIQDFTESHPVLPPWKGQTKGALVRNLERYLKDALHYEALADCERMKRFLEKDERLDPGASDAPAKSGFPFATSVALENMGKGMLXVLTNAPKGVAEGGKAVIGGVTGVFGGANGKKTSFNSKGYQGNHGRSLSTRSTSQMNYGSAVSDG

SEQ ID NO: 27867 - protein, 135 aa, A.fumigatus
PLALSVRSFISAFGGSSRKENAGQHHRTASASITLGDPPSRFETPSPDTPSPIEGSPSQLTTKAERRISRPASTVFSHNPPLTELSEDTPPELQPIFTYLNNHANKLYHEGYFLKLNDLDTRMCFASSVCRTSTT

SEQ ID NO: 27868 - protein, 91 aa, A.fumigatus
VSGSHPSNPRCQRKTLPQTGSMAPSILSTESSIIVIGAGTWGCSTALHLARRGYKDVTVLDPHPVPSPIAAGNDINKIMEHSELKGTTGVI

SEQ ID NO: 27869 - protein, 67 aa, A.fumigatus
DEGIGRARRIDNPLLLVHRQDNETRENLLIVLSAMLSSIGSCYLIVVWSFLVSTTYRIFPSHEGNAK

SEQ ID NO: 27870 - protein, 89 aa, A.fumigatus
ELTWVSFEEHSNMTLYNVSCAKFYYTSTDYSISRIGFKGVKVGVFLWHAILLIRAVASLTLNLGAPKTAQRETIDLIRIALLFIGSIAK

SEQ ID NO: 27871 - protein, 558 aa, A.fumigatus
HGPSFSQFASYYLQRTYFFDVHPPFGKLLFAFMGWLIGYDGHFLFDNIGDSYIDNKVPYVALRAMPATLGALTIPVVFLIMWESGYSLPACVLAAGLVLFDNAHVGEDRLILLDASLVLSMALSILCYVRFYKLRHEPFGRKWWKWLLLTGVSLSCVISTKYVGVFTFVTIGAAVLVDLWNLLDINRPSGALSMAHWTKHFAARAFALIIVPFFFYLFWFQVHFAILTRSGPGDDFMTPEFQETLSDNLMSAQSIGIQYYDTITIRHKDTKVFLHSHWEKYPLRYDDGRISSQGQQVTGYPFNDTNNHWQILPSVPYPETDRQGHSVKNGDIVQLRHVGTDTILLTHDVASPYYPTNQEFTTVSHELANGERHNDTLFEIKIENGKPQQEFRSLSSHFKLIHVPTRVAMWTHTTPLPEWAFKQAEINGNKNILQTSNLWFVDTIESLEENSPRAIKKERQVKHLPFWRKYLELQRAMFFHNNALTSSHPYASEPFQWPFLLRGVSFWTKNDTREQIYFLGNPIGWWIASSLLAVFVGVIGADQLSLRRGVDALEESKH

SEQ ID NO: 27872 - protein, 101 aa, A.fumigatus
SVFSQFLWSLHINPLAETTRQQDVNIYLPSSLKTETLKTAHAKFFEEKYKGGFRNARNRLQDYASWLQGQAGFGNLDQATKDEVAKLASNPEAHCTEIWPL

SEQ ID NO: 27873 - protein, 78 aa, A.fumigatus
RTSSSCVLLLYFYFIFFYLFLALLAVLINNSSFIGCNSSDTFESVFLTSNYSMKGTNNGRILVDHLSVEPEHLSFTFL

SEQ ID NO: 27874 - protein, 163 aa, A.fumigatus
GLYRREMKETTRSHSISDSDKIPAAIPSLWETTMGFPHDLERLGCCNCKLAADRFQRCIFLSVSFSSSFLILILFFFYFLFFYFIFYFFILFYFFFFFSFFLLPPLFVSLVFVPWLVLGFGAPCQTDGSGPLDFPKRILRKKHPHTSLSVCPNVMWDHCHDRI

SEQ ID NO: 27875 - protein, 91 aa, A.fumigatus
  UNSURE (78),(81): Identity of amino acid sequences at the above locations are unknown.
DIISGDEVLSDNFKIKEVDGVLYECELRKYLKRKNKDIQLEGANPSAEEGDDDAGRDGEEVMVHDIEDQFRLVWLKNXEGXEPSKDAFQNT

SEQ ID NO: 27876 - protein, 87 aa, A.fumigatus
VAPLFSVPKSLTVDVVAWNWGAKTGLFYAGTNLLCNVWCWFRLPETKDRTFGEIDLLFHHHVHARKFKHTKVDRKLLLVYSGSSILT

SEQ ID NO: 27877 - protein, 105 aa, A.fumigatus
RHMSGLSFMFACMVIIGGLGFAEGNKGAQLAIGILLVICTLCNMITVGPVCYPIVAETPSGRLRYKTIVIGRFVYNLTGIFSNSLTPRMIAASCELHHSLVYRNR

SEQ ID NO: 27878 - protein, 78 aa, A.fumigatus
  UNSURE (17),(20),(31),(38): Identity of amino acid sequences at the above locations are unknown.
LNPTTNTSFHLIYFVHXKRXKSAITCILITXKPCANRXCLFAHRVILSLDEDPLFSPTATIISPQTQVFPTRRNGFAN

SEQ ID NO: 27879 - protein, 190 aa, A.fumigatus
LTRELHDLELWNGPKCGIHGCENQRNKCLVGGYPHNHLHSGFNFALQFVRPFSFPVSFLFFFFFFFFYGRTTSKIPLKFILFLHVEVSVMVPFFSSLSPCVSPMFKSRVMPFMGGRFSGLALHSNSSLSRQLELSDNTSSHFDTYGFNSMIRYNTYFPTRVLSAFTKAVHHKFITTVEPNKHPFERLQFS

SEQ ID NO: 27880 - protein, 178 aa, A.fumigatus
  UNSURE (17),(23),(30),(32),(50): Identity of amino acid sequences at the above locations are unknown.
LTTPFIPNELDGVPAVXGTSFNXIHFLSNXFXPYFLVTSKSILEQLNAPXGVIPSLDELKDGWKPVALKGGHKIGKAKYLFSRIDPKKADEWRELFGGSQADRQKKEDEAAKAAAKKAANKASKLKKKEKKAAQAAGTSVEASAKGGAEVIDTTTEGKNDEAVEKVVDGMAQVTIPTS

SEQ ID NO: 27881 - protein, 60 aa, A.fumigatus
VLRRHQMFSVCTEESLPWRLPAATVLEMIYKIAVCRVVSTCPIVTPYYPVKEDIVSLTIW

SEQ ID NO: 27882 - protein, 134 aa, A.fumigatus
FAYTASKTFVSYTAFPPSPALVVCLIIPGTCCTGNLNHFYCLSSVCLIVGVHSFFTTYRASHDRRKQKRKGLTVRMSLFGNVGATSTTAGQTNTTGDISKDVPLSSPPEDGISDLRFSLASEHLAVPSWEQKVR

SEQ ID NO: 27883 - protein, 103 aa, A.fumigatus
  UNSURE (63),(79),(93),(94),(99): Identity of amino acid sequences at the above locations are unknown.
NYFCAQFQTESARSALSSFTCTLCNKSYSRHPEYEAHISSYDHQHRKRLQDLKQLSRDPNAAXKARKAERKANAKAGLXVIGDDSRIRNRGAXXWGRGXKIGK

SEQ ID NO: 27884 - protein, 497 aa, A.fumigatus
GQKIPSDDAFRLRHNGICEVCGIEGDDGLRGPLVFCQGCTSAYHQACLGPRSNRDHLVTKVADEQFVLQCRRCIGVSHAKDPISPHQGCCMKCNNQGKMSKPLRERLTPKQEQQIRQDNGGKDPITPVGMTTVNNVDNVLFRCTACHRAFHFEHLPPISDMTDDPATARFEEYSYTWKCHDCSSVPAEIGAVVAWRPADPQNHVAGYTADGVNEADKEYLIKWKGHSYHHTSWMPGSWVWGIVSPSMRRAFFRSEKNFQPHMTIEEAIPEDFLRVDIVFQVCYSEEVEERSLESDLQRIHKVTRAYMKFKGLPYEEAEWDSPPDPSQTERWNDFKAAYDDWVKRDYIYMPEPKALQKHLAHIREQNFESQIVRDTQPETMTGGQLMDYQKDGVNWLYYMWFKQQNAILADEMGLGKTIQVIGFFATLSPYHKCWPFLVVVPKSNLFQIGARKSSHGVPPTRVRHFFTVHHSPGKFGPWITNLFPPWLEPRFFRMSGC

SEQ ID NO: 27885 - protein, 69 aa, A.fumigatus
DFWHISFTMGKKRRGPTLEELLARPWCYYCERDFDDLKILISHQKAKHFKCDRCSRRLNTAGGESVQHM

SEQ ID NO: 27886 - protein, 199 aa, A.fumigatus
  UNSURE (45),(95): Identity of amino acid sequences at the above locations are unknown.
SDVKPCDRYSQSHGHVTAGAGDFAPEHESEYVQHDNTGYGAFRSXYTYTTNTSFGSLAGEHSQLTNDITGSPQQNGSGRMTPRTGGGPPPQWASXYASPRPTAASSLYNIVSDTRGSSNGAGSEKYTVASNTAPTYSMGGSLGSGKRGREDDDMGRPDSQGDYESKRRRTNETTVGGPVGGVLLGLQPMKAGGAMPRRR

SEQ ID NO: 27887 - protein, 76 aa, A.fumigatus
KTATPADIDHEYMEIVASSQESKPSSPIEFVKILIGKGGRPGSNLGRRAWLCVWLQIMASWTGITVSLCVPQEVLG

SEQ ID NO: 27888 - protein, 267 aa, A.fumigatus
KLTMITGCYRVFSRASQPSRVQRGDSKRSRRRTEHDRYCRHDHQCADCRSTRPEKVSDARVHGPVCCRACGKSPPWPSNLLRAGLIKSSLQAGGVYEGSLQNPSKAAQYAPAAVAMLFLFNLGYAATWGTVAFLVPTEIFPSDLRAQGNGFGITGWAIGVGMTTLVNPIMFGSLKSRSYFLLSGLNLLWIPIVYLLYPETCNRSLESIDALFSTPSPFYWDMERAYKLHSDVLAERAARKLTDEDATKADGHESAHEEFHGATTVGV

SEQ ID NO: 27889 - protein, 76 aa, A.fumigatus
SQAVTAYSPVLLSQAGYSEVTQNGLAGGLNTIGIVGTIISAQIVDRLGRRKCLMLGSMVLFAVELVVSLRHGRPTF

SEQ ID NO: 27890 - protein, 60 aa, A.fumigatus
FIRANTTSPQRRTQYDLSWRSPSQPDIDHPRRRNCRINSCLACRQRKLKCNRQQPCANCA

SEQ ID NO: 27891 - protein, 62 aa, A.fumigatus
DTEVTKSTKPGSGSPEEDVDDMLVASLELTLLGIQDAAYDHEEDDDSDDDLYDLGFRFGKCA

SEQ ID NO: 27892 - protein, 212 aa, A.fumigatus
PMLDFPFPMYGSYDALGLDGFSCMDRYTRFGAYGYSGTDSQLQGARPLPPVDWKKVNWRTLQEECFERNSDRYESAQQSLSMHSLPLTSVSHETLPRYSRLDQSLPQFKPRSAVILRAWHDMPWTENMKHYVRSLVMELSLHTGSEYQVFILTHVKDNNIPIYAVNGDDNAQRLKEKYMPKEFHDMTILFNDHTLESWYPAIEEHRYVLATP

SEQ ID NO: 27893 - protein, 66 aa, A.fumigatus
DAASRSGDALMGPCFGFSDSQRTSTSIEDYGNGSCVQKRARSLFKRCTRNTGGQTAIGASTYCFAE

SEQ ID NO: 27894 - protein, 101 aa, A.fumigatus
LANSSPSSIRSSKQYLNDLFKTSSSPVVASAPSSSSSSSPTATTTLALPSRGIVAHLSKLVDGHQCRLPQQRHIQLTLESPVWTMEMNKQKTRRCVSYSRP

SEQ ID NO: 27895 - protein, 373 aa, A.fumigatus
  UNSURE (251): Identity of amino acid sequences at the above locations are unknown.
RVSSYRPSFLFHFISVPRCRTTRPRSTPACSVIPMDDLHQHITPRGHGINTTYVYEYSRGLGGVNVPRDVIITRIIYWSVIIGALAVFCGRIAQISHAYLRHVTSLTASQRQQMFWSVEESRLWANIKKHLLYAPLGRKRHNREIQLSSAINVGTLPSRFHSILILLYVASQVAYCCFLDYAVNEKAALVAELRGRSGTLAVLNMVPLFILAGRNNPLIPLLHISFDTYNLLHRWLGRIVVLESVVHTAAXAVNACDEEDFSRMLVRLTGDPFFTWGFVGTVAMVFLCPPIPLARSACFLRDLPTSASACRAPGPPSASMFTLDLDKLPPDPLGPGHWRFLAVRTISAAVPLAVPQLFTQKGLNQTGRRSVAR

SEQ ID NO: 27896 - protein, 182 aa, A.fumigatus
PLQGDLPLAEACPHQPWRSRLRLHPERLPLDVAPLLNRLGRTKQLRDSFSRARQRNESHDAVTPGKAEPSALGRVHEGHSTHLRLSHRRRPPRHDPQALQQSPRRPAADPLHHGLHRGPLLLPRVQHGQLRHGRPLLCWRRHHTPHALRARPHHPRLRGPRRNPADLPHLVRPQHRTPHLGP

SEQ ID NO: 27897 - protein, 344 aa, A.fumigatus
  UNSURE (11): Identity of amino acid sequences at the above locations are unknown.
YSRAWSTQRLXQSMPAMKKTSLACWYDSPVTPSSPGGLLEPLRWSSCALQSPSPDPHAFYETFLHLHQLAALLALPRRLCSPWTWTSFPQIPLALAIGAFWLFERSARLFRLLYLNFSLKKGSTKLVVEALPGDPCKVTFHLPKHVRINPGGHVYAYIPSVSLWMSHPFSIAWVEPNSCVTPSAAPDNVMSPMTPSLLEKQNPLHLDEYMRGTQPTSVSLIVGARQGMTRKLYNKALAAPQQTLYTTGYIEGPYSSHASNMGSYGTVVLFSAGAGITHHMLFVRDLIIRASEGRVATQQIYLIWSVRNTEHLTWVRDWMDQILRLPGVFTTGLEGSDGGASNQA

SEQ ID NO: 27898 - protein, 170 aa, A.fumigatus
HPAPPEPSAHSYSTFSPLPYLLFPAPLRPPLPTPPPPGPTIMTYYPSFTALSFPSLPSSTPPSSLIYELRTDYHPISLTSLPILYSRPYLVRSHFATFSHYPLFLLPTAPYRRYVQCHHCIVPPSLALRPVSLFPTLLTLLTIACYLSLHAMHASLLYRSLAILHVSIFR

SEQ ID NO: 27899 - protein, 191 aa, A.fumigatus
RRPIQFQALARKILDTVLPPIGGFKTVGAPAPAPARPIGEKKAPPPIKVTGPPKPNPSNARAASPVVARALEILAAEVGLSEAEMTDSLNFADYGVDSLLSLTVTGRYREELNLDLESSVFMDYPTIKDFKAYLAEKGFCDSSSPEPSSEPESKFSFNSDASSEASSGLTTPGITSPVKHEAPKGGQSSRR

SEQ ID NO: 27900 - protein, 254 aa, A.fumigatus
GRGPSSPVAKRHLITEYKPEYQGLGLDVCDMTVPKPLIAKSGDQFFRVSAVMSWAEQKASVQVWSVNGDGKKMAEHAHCTVKLFNCAERETEWKRNSYLIKRSVSLLQDKAQTGEAHRMQRGMVYKLFAALVDYDENFKAIQEVILDSNEHEATARVKFQAPPGNFHRNPFWIDSFGHLSGFIMNASDATDSKNQVFVNHGWDSMRCLKKFSGDATYQTYVKMQPWKDSIWAGDVYVFEGDDIIAVYGGVKVCL

SEQ ID NO: 27901 - protein, 228 aa, A.fumigatus
APHPPTGQPAVFQPRGEDGRPSSAHSAQGPSLPSPIQNRPSMSPTQGNHDVGPLAGFPPTGPSDGSAPWTPFGPHRAALWPDVGNNSSLSSIHSGRPSFSAETPSGSRSSPPQSSHGVPFSGISPTKQSPRPMTSGSLSGAPILPPIQKLEPSPKLMGRSSPDAPIPPPVKSMTPEQEERRQRENALMFQSQPHSLSNGQYSAMSSPSLNRIPPLGPSALSRNNEPQS

SEQ ID NO: 27902 - protein, 609 aa, A.fumigatus
  UNSURE (20),(503): Identity of amino acid sequences at the above locations are unknown.
RLETTVSATMEAHRGRQHHXCDPCRKGKRACDAPARRDRHADAGSRRVLAESNLNIPCSNCRKYNRECTFNWLVENRAAARAGRKQKSRNVSNLPRADDVSSSRSGTDLLDDLRYSSSWLSNSPGNGVSSNGSTEDQPGTWSMPSNAVSIPLRSKESELDPFSVMLWNANTAHVPPSNAETAGSAEDTCSSLDYYQQSLSSSGPHSLDETLDLLQQFDDSSPGLSSSYYSSPPGFVIPEGSDGLPTFPADSLYPSGNKDSLFVLSDNISDSYARSMMTQNLIRIYHDSMENALSCWLTEQNCPYNTAVPYTSPSGLASKAQAAWAPNWTNRICTRVCRLDRAYASVRGRNLSAAEEKMASRALHTAIMAFASQWAQKMPRSNGFSLTSPVAQHERVIRENLWNQARRALENAAGIPSFRVAFANIIFSIGQRPLNVDEDMELHELLENDSAPLFMEAAVRQLFSIRYKLTRLERQKPKSRSSPEQSKIDLASMDMPSPQTDAXYADPEHQETVNLLFWLVVMFDTLQAAMYQRPLAISDEDSQITSVSPAVSNAKPDSSVDLDGWNITYSRALKEKQDLWGDFFLHKRAARQGANPPVFNRRGSQGYRA

SEQ ID NO: 27903 - protein, 191 aa, A.fumigatus
HRILSAYTMTAWRMRCPAGSRSKTVPTTRQSRTPHRAGSPVRHKRHGPRTGRTGSVLGSVGSIERMHPSVGETSAPQKRKWHRERSTPPSWRSPRSGRRRCPEAMAFLLPRPSRSTSVSSGRICGTRRGVLWRMQRVSLRSGLRLRTSSSPSDSVRSMSMRTWSCMSCWRMTARRCSWRRRCDSCFQSDIN

SEQ ID NO: 27904 - protein, 168 aa, A.fumigatus
DEYPLVHSGSENQPLHTAIDVQTKIMATIRRLQQTLSHLRPPKAPQLLSIVEGPTQPELLDITLGELLTLQSLQYGDYECLVFPWTGARWTYTDLKDEADRVARGLLAMGIQKGDRIGIMAGNCEQYISVFFAAARVGAILVVLNNTYTPSELYYALGHTGMYYLQHS

SEQ ID NO: 27905 - protein, 116 aa, A.fumigatus
  UNSURE (65),(70): Identity of amino acid sequences at the above locations are unknown.
SADCRLLFLTPRIGRHSLEEVLAKLGPRPKEQGTSSALEEIIILRGQYSGFSTYEHVIQRGLPLXSHALXDREAELHSTDVCNLQFTSGSTGNPKAAMLTHQYASRATGMKAANSA

SEQ ID NO: 27906 - protein, 184 aa, A.fumigatus
FNVEIEDTDILREQLRIWRTCDAIENRPPPLIIETYLETKGLTNNQSLVILDENGKRWDVLEALTASGQASPVRPPHSNSDDVILERWRVELGSASSKPPSDLGSILPTVYKKSIVLFRSLFTYSKFLPAWKFAKRNGRLRSNPALQIRYRILDGRTASDRRQVDHLTVPSSPQRRDPLWLDPP

SEQ ID NO: 27907 - protein, 309 aa, A.fumigatus
IVRGYNPLTPPNLLQHEIAMTEKSRQTVLEARREAVAIVHGTDTDKQRLLVVIGPCSIHDPDMALEYCDWLLKMKEKYNDELLIVMRAYLEKPRTTVGWKGIINDPDIDNSFKINKGLRTSRQLFVDLTNKGMPIASEMLDTISPQFLADCLSVGAVGARTTESQVHRELASGLSFPVGFKNGTDGSLDVAVDAIGSVKHPHHFLSVTKPGVVSIVGTVGNPDCFVILRGGKRGPNYDAQSIAEAKAKLTSKGLPPRLMVDCSHGNSQKNHKNQPKVAAVLAEQIAAGETAIMGVMIESNINEGKPQFT

SEQ ID NO: 27908 - protein, 147 aa, A.fumigatus
DPPCPQEEPFGYLNGQLVNWSSCLTLCELRLTLINIAFDHDTHDSGLSRGNLLGQNGSNLGLIFVVLLRVSMAAVDHETRRQTFRGQLSLGFGDALSVVVGAPLSTAKDDETVGIAHGANNGDHTRLCNGKEVMRVLDGSNGVHGNV

SEQ ID NO: 27909 - protein, 226 aa, A.fumigatus
RAIRTILETDGKRKTGGQFTVDLRLGCPRPNRTDRETIGKELRRNCIQHLTGDRHALVGQIDKKLTRGAQTLVDLEAVVDIGIVDDTLPSNCCAGLLEIRAHHNQQFVIVFLLHFQKPIAVFERHVGVVNRAWPDNNQQTLLVGICAMDNRNSLSTSFQYRLPGLLCHGDFMLEEVRRCEGVISSNYSFARKLVNEGRGDRGKKGHTPRIFEVVTVPYIRVFDKEL

SEQ ID NO: 27910 - protein, 194 aa, A.fumigatus
GYAVFKDNIRIPLRPFLGCIGLAPATDEDLSTVPPTNAGGNLDCRDLTVGSTLYLPVQTDGALFSCGDGHAAQGHGEVCGTAIETSIKATLRFELCKDMPWVTSPQYETPPSLLTTRMPVFGQYATTGVGQTLHEASKTAVRNIIQWMVATKGLTHCEAYMIASVAGDLQIIEAVNMPNYVVAMTIPLEIFGPS

SEQ ID NO: 27911 - protein, 156 aa, A.fumigatus
SACNTKQRQYIFLDHMDSTLEGLNSAQKAAVTSPASVLQVLAPPGSGKTKTLTARVAYLLSHYGYQPQDVICCTFTIKASREMRERLASLVGNEVQSRLILGTFHSICRRYLVSYGYLIGLRKGFGIADSSDSLAIIKVGSTCWHHGFLYTLVICY

SEQ ID NO: 27912 - protein, 165 aa, A.fumigatus
YLQRIVKRLRCSIQPNTARARISHQKAHGVSPDEPAVKYSTGSKSAEHHEFVQIYRAYESYLETSNLFEYDDFLLRCADLLRRHPQCVSNVQAVLVDEFQDTNHIQYELMNLFAVRNRRITVVGDPDQSIYGFRSAEIKNLGRMQQHYKDTSVILLHHRGSKHPR

SEQ ID NO: 27913 - protein, 135 aa, A.fumigatus
LPASTILPARKTKMQSASLIVLNRCATAMVLLFPSLAASLSAACTILSLSVSSALVASSSSRIFGSRIRARAIATRWRCPPESFVPRGPTSLFKPSGNEMTKSKMLASLQACSICASVASLDSTRPIATFSRMLP

SEQ ID NO: 27914 - protein, 346 aa, A.fumigatus
ESREGEYVYKLASPQSLIQRLAPAHLVVAPSCLQQLGMTARLHNPPSPKDKDAVRVLDRTQPMRNRNGTPLPIVGSLAQRRLHNPLALRIQRTRCFVQQQDLWIAYQSPCDCDPLALSTRELRAARTNLAVQAVRQRDDEIKDVGVFAGLFDLCFGGVPRFDQAHRDVFTDAPLIQDRLLLNECQAATVILWAEVVDWPVVDRDIAGRWVIKAGEQVDHCGLAAAGRTNKGHEFARWDADIDAGYDVGARARWVGKVEGVAIDGNGARVLRSVRRRLVRKAIVDSGDPLAQPEDVVCRPGRFGDASRVLEDRSCILASDYDGSEDHEELLVGVLARRDELAPVPEA

SEQ ID NO: 27915 - protein, 529 aa, A.fumigatus
QVIIPGEDILPQGVGSKLTMPQKVGRRYRRELFRNTRKQEIAVFDLEHNATGAISSRLLIHASNLNELLGINSGLILIYIVTVISVSVLGIAYGWKLGLVCVFGALPPLLLSGYFRIRLEYKLEEDTSARFASSAAIAAEAISAIRTVASLTLENKLLQIYRERLTAVAEQSVKALTFTMFWYALTQSINFLAMALGFWYGGKLISTGEYTNEQFFVVFTAVVVGGENAAAIFQYTTSITKATGSTNYIFWLRQRVPAIDNCFSDEPPSDGSQDPGPVTVDCHALDFAYPSRPRSNVISGIDVSIPPGKFVAFVGPSGCGKSTMINLLARFYDPTSGYIAVNDRPIHDLSPQDHRRRLALVQQEPVLYQGSIRENVAMGLVESRDATEAQIEQACKDANIFDFVISLPDGLNSEVGPRGTKLSGGQRQRVAIARALIRDPKILLLDEATSALDTESERIVQAALSEAANDGKRSTIAVAHRLSTIKDADCIFVFRAGRIVEAGSHAELLETRGSYYEMCRGQALDKALG

SEQ ID NO: 27916 - protein, 471 aa, A.fumigatus
  UNSURE (469): Identity of amino acid sequences at the above locations are unknown.
LGGLRRLLQEAPGRSYDDGMYHPGDNRLSGVANPSNGIDHPETKPIAAADATLDGHGWSESGMLRGATTDTLPNPVVAAVKPAALPSEAALDLHQGHFDHPVQPITTITTSTNASPSTTSATTFYKSTIRTTLHTVSMPTATRASLTKSASHATSTSTSAPAARGGGGTAPGTQAGIVISAMSLVIILIVIIFWWLNRKKRALMKSLRGEESPPPTEKPNPAYRFASNLYTSSTSTLVNVTEIFKASREKKSPSVNDGSSSIYSTDQIQSNQTWRTLFTRAAAKVRAFRGRKQPPDRRSRYSHGYIFAQEFQHVPPLPPPRLQKIVAGLYANGSSTIKTVIASFRAHPPPPKDSASSSTWSSTSSRTPCSRAYESYPQADQFQPPCDISDSLDLVKVRSVSSGTVAMSNPAEISVDAQAGRISGESRPHQEAAWESSSPSLSQHISAPSQRQSPPVFTRGLQRADQLKXPP

SEQ ID NO: 27917 - protein, 393 aa, A.fumigatus
IGETGADRVEEPSAEENGDAKASVGAENDTAGAVEKGEGAEDKDSSKPTKLILKTKEPDPSRPVPSIEGTGDGVQPPVRRRGPGRPPKDGIMSKRERAELAREQKLAAKREANGGVTPPPLNRPKAGKTTTTTTSTVGTATATPSLPGEGESPGSKPEKRKYTKRKKPDGTLMDYPLPSTEGGPFPMEQRPEEFIKAPPVKKRKPSRSPSPNYPPESAYTPEDLAKPPYNYAVLIFDALTEAGTPMTLKQIYRALKLKYPYFRFKCETEGWTSSVRHNLNGNSHLFMHAERDGKGWSWQLRPGASVEKEKKRRPSPPPPSQPPSVPASAPQYMPPLNPSYGNPQNGQSTLANQHFQFPTMPPNTYAPPTPAPTSSAAAPPSAPPRHLDPYPPP

SEQ ID NO: 27918 - protein, 389 aa, A.fumigatus
DFIHLNSRVALLTVIEMELKKIHVGTVSYANDAMEEVASFVRQAFAGNTLTTPSAAFGAQAGLGAAPRTRREIGSRVRDIVLALALCHNVTPTTDEEDGVKVTNYQASSPDEIAIVKYTEEVGLKLSYRDRQSIVLETTETGSVVVRVRILEIFPFTSDSKRMGIIVQFETANSILESSNEDAEIWFYQKGADTVMSSIVAANDWLDEETANMAREGLRTLVIGRKRLSLQHFQEFSAKYKQASLALQGRDVGMAKVVSEHLERDLELLGVTGVEDRLQRDVKPSLELLRNAGVKIWMLTGDKVETARRVAISAKLVARGQYIHTVAKVKDPSAAQEALDFLRNKTDCCLLIDGESLLLMPGSVPVGIHICGPSSYRAVVALSKLFQLK

SEQ ID NO: 27919 - protein, 123 aa, A.fumigatus
GLLEYEINNLTKILCALTLTLSIILVALEGFQPNNDKEWYIAIMIYLILFSTIIPMSLRVNLDMAKSVYSRFIQRDKDIPGTVVRTSTIPEDLGRIEYLLSDKTGTLTQNGKISYILTVELRY

SEQ ID NO: 27920 - protein, 220 aa, A.fumigatus
VARDDNNLSKGYGFVSFADFESSDAAIANMNGQYLMNKQVSVQYAYKKDGKGERHGDQAERMLAAQARKHNVRPPTQPLPPQFTNPGTPMAAAGVANGDGTQALNAAPPELATGRGIPPPNLGFQNIPSPQPNRQLPPTAPLANPPPGLPARPPPSQAGYGGPQTFLPSGFNSAGQQPPFPQQAAPPPGFAPPGFGPPSGTANPPPLPPGFQQPGYGGGR

SEQ ID NO: 27921 - protein, 132 aa, A.fumigatus
LCREQDKEATVYIGNLDERVTDSLVWELMLQAGRIVNVHLPKDRVTQSHQGYGFVEFISEEDAEYASRIMNGIRLYGKPIRVNKASADKQKAVEIGAELFVGNLDPLVTEQVLYDTFSRFGTLVNIPKVRRQ

SEQ ID NO: 27922 - protein, 75 aa, A.fumigatus
SKMSAQNSGRQSPPPETQSGAQQQDPPSAGKTQSELRGDPQHSQRESNETKEWKLESNPKHPLEDIEAAKYSKVH

SEQ ID NO: 27923 - protein, 103 aa, A.fumigatus
PCCFPSYSESIDHTPRPHPASPSGILPDSFAAYRSKAQQHGPLGRASFTQGSIGRLPGAALGPVQPKQGEFFDRAELPARFHRLPWTEAEIEAIETGGASLYA

SEQ ID NO: 27924 - protein, 70 aa, A.fumigatus
ISIHRHAKCPVECLCFVSRVQSSVFVPRALIRSYLSVDLGLSTPISITSFNYTLQAKTVTLRFCSMRSTA

SEQ ID NO: 27925 - protein, 69 aa, A.fumigatus
  UNSURE (52): Identity of amino acid sequences at the above locations are unknown.
YHKAEGLAAKFVFLFFFFLRNFFPLFDIDISIVGLSEFYLPMYYIDSTLRIXASVPCASAIRIFLMFLY

SEQ ID NO: 27926 - protein, 79 aa, A.fumigatus
AAFLTQKCSLPTRTIKFEIWDTAGQERFASLAPMYYRNAQAALVVYDVTKPSSLTKAKHWVAELQRQAQPWNRDCTCWQ

SEQ ID NO: 27927 - protein, 62 aa, A.fumigatus
SLVLPQIFTPFISMDDVEEIIYSLVKYQIHARLLVSFQSTFLHIQETKPMGVVYAWPAFLKR

SEQ ID NO: 27928 - protein, 544 aa, A.fumigatus
MALEHDPNSARRKRRKTEDVNQRTRDLSTEGEPHQGDNSLLLDQPLATLNTPSGEIQFAANAGASNATLPPVVSDVASSESSSGSNSASDLHNPDRGVLDDANQALQSRSPPQKIMKLTANGKLLSSPVAKQSDDTPQKKRRSKRTKAGSQGLEQGKKKLVVLKYASEPDKNQNIGQLIDKIICGQTRYIPSRATVPPLPVAQKPQPPKPTHPFFLKPALRKPDPSAETVPPSNLSQGIPSTTSVPETKPSFTRSTSRPVLFSSFRPRPKFPEPIDPVWPPRGLGHVRGIPGGSDRQDKNLCYPLNIDQKKAKMPAVRVLDEENILRTWTNLNKDVPTALRLPQRHTASGRDLQQAILPELSNSTFADGTNLIVSHPAISRVFLSIPQSLTAFDRGEYDMSLWTQKYAPESAAQVLQMSKEAMMLRDWLKYHTVSAVDTGKPAKDIEKVNEKGDVKKRKKKPKKADQLDGFIVNSSDDDYEMSEVTASDDDELAGGVTVSSKKTVIRSGDSDGVWRSGTGNHRTSNVIFLSVVFTTGLEGQAFN

SEQ ID NO: 27929 - protein, 134 aa, A.fumigatus
FPTASANRWCCCGDSGKTECVNITMTMAAEVDLNHSAGELTTEELERIVTILQNPTQYKIPTWFLNRQRDIVDGKDSQVLSNGLDSKLREDLERLKKIRSHRGLRHYWGLRVRGQHTKTTGRRGRTVGVSKKKG

SEQ ID NO: 27930 - protein, 94 aa, A.fumigatus
CFFSIPTALVSGEKTNFQYILRLLNTNVDGKQKIMYALTQIKGVGRRYSNLVCKKADVDLSKRYVQSTFDFLQHLQIAGVVVETAGRLNASISL

SEQ ID NO: 27931 - protein, 123 aa, A.fumigatus
  UNSURE (7): Identity of amino acid sequences at the above locations are unknown.
SRAGGFXKRAPVDTSSPVVKTKNPISGHPVGYKFIPLATQLLLADPNSVQAKRAQFAQHHVWVTKHRDGELYAGGRYTLQSQQEVDGVADAVKRGESVVDTDVVVWSTFGITHNPRVEDWPVM

SEQ ID NO: 27932 - protein, 497 aa, A.fumigatus
RLIGGKIIDHRLERSRITSVPTGERSFHVLYYLLAGTSPAEKAHLGFDKAVHVSTSSGAIGHKRWRYLGHPTQLKVGVNDVEGFQHFKTALRKLEFPRSEIAEICQILATILHIGQLEFASGQATTTHAEESGGYSHEGGETVTIVKNKDVLSIIAAFLGLSVEDLENSFGYRTKTIHRERVTVMLDPKGARQNADELARTIYSLLVAYVIEAVNQRICAAEDSVANTISIVDFPGFAQACATGSTLDQLFNNAATELLYNFCLQSFFDRKADELEREEVSVPATSYFDNTDAVRGLLKHGNGLLSILDDQTRRGRTDNQLLESLRRRFENKNPTIIVEGSKRTSLISQNARSAFTVKHFAGEIDYSVNGLIEENGEFISGDLMRLMKSTKSDFVRELFGQAALQTVTHPKEKTAIMQAQVSSKPLRMPSMARRKTSPSSRLAFDAGDADEVESQAESIAKDSSSGRRKSAMLTSGIQGAALSFFRHQPGPGNKSNA

SEQ ID NO: 27933 - protein, 207 aa, A.fumigatus
  UNSURE (136),(179),(192): Identity of amino acid sequences at the above locations are unknown.
QRVIPQPFNNVLVSNSSFPSSSSTSTASAFLFPRFKYIPSISINVSEEQNAPTNLATFVQAFLLPAQLNPMQDSLPESKRAELTRKSELESSFPGAVDIQYSPVVLICGHGGRDMRCGVMAPVLEKEFSRVLSARXFSPAGADGNPTDSPEHAKIGLISHVGGHKYAGNVIVYIPPGMXAGGSPHPLAGKGXWYGRVEPKHVQGHYG

SEQ ID NO: 27934 - protein, 72 aa, A.fumigatus
  UNSURE (11),(39),(52): Identity of amino acid sequences at the above locations are unknown.
YITIPINPTPXMFEYTSSTHYSLIHNAPGHAWVQPVHTXYPYPPADEGIRLXSFREECTQSHFQHICDHRHD

SEQ ID NO: 27935 - protein, 66 aa, A.fumigatus
LVASILAALSSAYSLTTSRKQYTRVQYSVSVMRSYRMYDVVLGGLWIESIKNFICAVGSSKRVANS

SEQ ID NO: 27936 - protein, 334 aa, A.fumigatus
VSQKKMSSLRGVARSAPRGIQAIGLWRQSESVAANFTTAKSRFQISISNRRLLRSAPARKIQTVAAENSSSRDSSNPALSFPCLDALDAKSALLSARSIESGPEPSYTTGQHENFHCEEPLLLDWGGVLPEFDIAYETWGQLNADKSNAILLHTGLSASSHAHSTEANPKPGWWEKFIGSGKPLNTDKYFVICTNVIGGCYGSTGPSSIDPSDGKRYATRFPILTLDDMVRAQFRLLDSLGIQKLYASVGSSMGGMQSLAAGVLFPERIGKIVSISGCARSHPYSIAMRHTQRQVLMMDPSRHGVLYRYSFPPPPAFVNIQSSPAGAGKDHAMQ

SEQ ID NO: 27937 - protein, 154 aa, A.fumigatus
GHRSRGRMASLITTMFVPFRPFIPSPSPSSSSTSPSAPPSHPLSALTPSISCSTIHTFRGPLSEPPSYLSPAVRALKQNLCGLTPPSNARTRAPFKPRSAAKGTSSYQLRQFAEATLGSGSLRKAVKLPEGEDLNEWLAVNGKSTGGIVAGPRV

SEQ ID NO: 27938 - protein, 145 aa, A.fumigatus
CDVMMLRDLWFAVATAFTLVQADRGPYFQSSRFEDGDLGQWPTETYRSSALMGPILNYVESNPQCKDGQYTLIAPRGMAVRNPGPMIIDQDGHLVWTKHYGQTYNVNVYRYKGQDYLTFWVGNDGIVGHGDGTYYMVSPVSVSTW

SEQ ID NO: 27939 - protein, 173 aa, A.fumigatus
LDSAYEEAFTIRGANGLPADLHEFQITGHETALFTVYDVVPADLRSAGGPEKGWIWDGTFQEVDIETGQLLFQWRASEHFNLTDSYRGREGAGDSEDHPWDFFHINSVDKDAKGNFLVSSRYMSCLTYIDGRTGNIIWRLGGKHNDFHELFCRARHKLNLQQQARFSRTTVRA

SEQ ID NO: 27940 - protein, 215 aa, A.fumigatus
VTITNNHNSLASISSWISIISLSTSIFLARSSRKMASSTPPIPTQTWTKDAYFISTDSSLIPLETLNDWFASDDIYWTNSLPLDILKQLVENSMCFGLYYTPDQPDKADAEPEFIGIARFVTDYTTFVYITDVYVLSCHQGKGLGSWLVECMGEVIDAMPYLRRSMLFTMDWARSVPFYKKILGMSVQESKNGEGMAILMKKGNGYPKYDYEKGV

SEQ ID NO: 27941 - protein, 63 aa, A.fumigatus
RSDGTTGNEGPSGANMLNCRPKTVKTIRDLYSMSGFFGCPRSSNVITLPDFITLAQNAVEPPS

SEQ ID NO: 27942 - protein, 372 aa, A.fumigatus
EYHSEMLQLLKLPPQQDRDAVMILHMGGVFGDKEATLDRFRENYKALSQDIKNRLVLENDDVSWSVHDLLPICEELNIPLVLDFHHHNIVFDSSKVREGTLDIMDLFDRIKATWTRKNITQKMHYSEPVPSAITNRQRRKHSDRVSTLPPCDPTMDLMIEAKDKEQAVFELMRRFKLPGHDLFNDVLPYTRTDENRPFKPPRKTKKNGGFVDLEAQVPLAPTVPEEEVGMGGPERRVYWPPGMEEWLRPKKIIRVKARQSPAKSNVSKRNAKGNEDSSQIQDEDADEENEGPATPKPKNSRPPKRTGSVKKQTSRKRKASPTPPSTPSVSDIEGLDLAKPPILSGTETANTRCSRRATTAKKVNYAESDSAC

SEQ ID NO: 27943 - protein, 239 aa, A.fumigatus
LDYCPGGEIFSYLRRARRFNETTSRFYAAEITLTIEYLHDVEGIVYRDLKPENILLDADGHIKLVDFGFAKQINDRETYTLCGTPEYLAPEVIHNSGHGLAVDWWALGILIYEFLVGQPPFWDQNPMRIYEQIVEGRLRFPPNMSPAAQNIISCLCKTNPSERLGHISGGSARVKAHPFFEDINWDDLFHRRMKGPIIPRVDHPADTGNFEDYPDVDVKGQAIYTDDMKKKYEALFSDF

SEQ ID NO: 27944 - protein, 63 aa, A.fumigatus
VKLQLQAEQLSFPATTVEPSKAKQAIPDSFRLEAMTILPAGTNDTWDLQGGGRKINEAAPGWK

SEQ ID NO: 27945 - protein, 170 aa, A.fumigatus
  UNSURE (141),(154): Identity of amino acid sequences at the above locations are unknown.
SNSATSSSPILRVRFSPFHFLAIPTDPPQPPAPKNPSGPPSNSTSPSSAAASHSSNPSCKASSAKSKAVSRKATRSLRPGPNFPFPRPGQTMTGSSRSMIRMGHWRRRHRKRFMWRLRRARIARMWSCRGSRCIPVSGRMXMGGPMLGVPVPYXIRSGGNNICILLSLYI

SEQ ID NO: 27946 - protein, 93 aa, A.fumigatus
LLPISFPHISVLSIAIMAYKQNTYWKNVLTIVPIVGAGVATITYLLRLYSRRLTAAGFFLEDLLMGIGLIISYCATAFVVESECVWPTARNQN

SEQ ID NO: 27947 - protein, 212 aa, A.fumigatus
DLGAGSVKSVWDASAHPCHFHPGAASFIFLPPPCKSHVSFVPAGRIVMASSLKLSGIACLALLGSTVVAGKDSCSACSCSLTHFNATVGGRVQPLTPFSLPCFSSYNGRPVARDDAACAAIQAKYTDPWLRTNSPNGYMNNQDEMWSSDPSDQCLLDSSDPTDPLAFVNATCRQGNMPSHYLEVHSAKDVIEAFRYSNVFTTGLEGSAADAF

SEQ ID NO: 27948 - protein, 380 aa, A.fumigatus
LLAQVAARTHDHSRKVWTMLSVALRIAQALSLHMTDPPFPVTPFEREMRRRLWHVIGWLDLEASLNRGSESMMRSAWIQTHSLTNINDDDFGCDSEDPLPAAQRGPTEATLLILFAHGQCALRALDLSHFAEPGITDIQERQQTVDHFRRTTKELLAGCDPENVPFHWFSIQIQEQISAVLQLIALRPLQRSPTFVPAELPAPQILALAADILERRQRIFNDPRGQPWRWFGLLFFPWHALVVAMTEVCVCTDRLVMDRYWPTVERSYDLFQKQAVGTHYDWLSASMDSLMNNARAARQKVVDSDAPGLQAPDSHLYMDMASLERPLLPESLPPVPDAALAPEGLTLLPDQEISAWAQYGEFTDRFDELHAIFNSGLTWR

SEQ ID NO: 27949 - protein, 128 aa, A.fumigatus
ILGLMPLGTSMDYESADSRSKGCWDPVPVLKPFYEKWTSAVPTPDFLVDDVWCGMVGGIGFGASASEELSVFWTKTLKEVYRGDEGRKKVRMAVICLLSRDGLLLRLGDIKCPVYWLQVSSNPLVGRG

SEQ ID NO: 27950 - protein, 277 aa, A.fumigatus
DVVRPSAGENQTSRIPSAGYRRPPACHWRCCVHPRLTGIWSRKGSYPLYVCRLVWDGTGNGVTWRGAEPRSCPWRGGVGDRSLIYMTSYIGTLLTPVVVGLKKPHIRKQQEKEKKKKKKKYMAATKTIQVPHLGGITAGYALSNDRYDPAKPTCVLINSMCTTVSLYRDQFSDAALTDAMNLLAIEPLGHGSTSCPSEHFTYWDSAWMALQVMDQLGIDKAFALGTSQGGWIVTRMALLAPDRVGAPASVNYLSCEGVPWQTKKLLTDVYCSSRSSG

SEQ ID NO: 27951 - protein, 105 aa, A.fumigatus
SRQMVGRRLRHDLIVSTGYVWFKSQQTIVLNPRLVEGFFLGIELMRQGGVFDSSCLRNAARDLVGVALGYLASRTAASSFVVFGHGSYFEKYPALDLILSKSSSF

SEQ ID NO: 27952 - protein, 215 aa, A.fumigatus
PLIPALTGEECDSYQIMTLTNCTKVFPPSAHRIVHLVSSPLFPPERTPIANWINRVLFFLLYFNRLFATLLSYAIRAYTWHYYRAYVDIHALQISLLGGRIFWKGIRYHGVNETIFVHGGFITWHYWKRTVRHTDLSLLSSSNERTPAGSQRPDTQSSNLAGRDNGEGEQGGLKEADNFPCRITIQFYGLEWFIYNRTPAYDSMSSPRGWKGPRT

SEQ ID NO: 27953 - protein, 76 aa, A.fumigatus
VPSSANRVYALAASNHYIFGLSCASSFALPLQGFWNSLIYITVSWKAIGTWFRQVGARARRTSSITFRPFQHPLRR

SEQ ID NO: 27954 - protein, 110 aa, A.fumigatus
AMTTLSSGYQYSTQLSRHQQYVLSTIERVCSCVSVVASGVVIATFISSSAFGKPINRLIFYASWGNLLSNSATLIADSSLHGRTQGALCQFQGFMIQWSVNTRGNASFVY

SEQ ID NO: 27955 - protein, 84 aa, A.fumigatus
SWSVRFLPADSLWALAMASNVYLAIFKHYDTRRLGMLEWKYLLFCYGVPFIPAFVYLFLSSESRGKVYGESVVSLVAVVRKGRY

SEQ ID NO: 27956 - protein, 101 aa, A.fumigatus
RAEVDDPNEFRYIYNKLRIFPSAAINSTRDSLSSREYQYIQRRKSFQPPLMFVSYLLANADHNRRHLVSSQSDEKNRIQQMQPLPEIACSVLASSMTARVM

SEQ ID NO: 27957 - protein, 68 aa, A.fumigatus
LAVRRSVSHLRIVQALFLCVSICSLHKNRFLNVEAFFSTVGSFTLSDFHIAVTPIGRNNSFLYCYFRL

SEQ ID NO: 27958 - protein, 545 aa, A.fumigatus
DLHLHKETLGHIDDESSLSGESAVDNSSDRLSNSDCHGIEIKSRGDEVEARSEPEIAVQEAVVPSDRCNSNVEVGKGEGTHGREECLDIQESVLVQGTDAHAEEQGLHNAQVRDTSTDGKLQKQLNTEVQDIGQNESHLCDDIGRSLQLSEPRPNRGDQQLTTQADEVCPPLPSRADPETSSASRRTQRQSLEASKDLQTSATAETEDCKDGQSIKENTTSGSKEQNVQGPAEHTSLKTPPGIGVESEQQRPSPAPSKGKSGRKKEKPKLDTKNVKHLPERTSRVVQTYRTNEWAKHLCDAEIPEPEPIVLITKEGAESRVEEEAPAPVNVEELLQTPLTVQPPPTADLRVSTGKEHHSPTDCQQISTDYRLRTTSSTSPQRVGEAQPVDRPSEESSAIVLSSTSPFQSTVLYGIGHNASLGTSSPPIPTGQSQGELELSKPRWKGPPPLLAVREDMVRSRVSSTCLSLDPWASRKSPRQSSPSQSVTLGASAPNSPMTSFPESGDDVPLSRRRAILHQQKVQSPHTSMSVSGLHHEGRRRIRNK

SEQ ID NO: 27959 - protein, 135 aa, A.fumigatus
SCTSGPGHSQESPRIRTQASHCCRGIGHPVRYYRRRRRLRRGSEARRRSRPLPPGRPIVRPDGRRRHRRQPHRHCCGKHHGRHLRRHLLDLPERACARSPRARPRDPNTRNGRGLGQRAQVLHHRAGQVHSGAAG

SEQ ID NO: 27960 - protein, 234 aa, A.fumigatus
FRRDAVLPAPGRILCPPTYSADHAPVDPAILKKALGSALKRVIAAEALVTRYDTIVGDGDCGVGLKRGAEAVLSLLEDPSSGLTDDAVTAVNRIVTVVENTMDGTSGAIYSIFLNALAHGLRAQDQGTPTPATVEVWANALKYSITALGKYTPAQPGDRTLIDALVPFCNTLVAAKDVHAAAKAAQDGTEATKSMKASLGRSVYVGGEAEWVGKVPDPGAYGLSELLTGLAEAL

SEQ ID NO: 27961 - protein, 71 aa, A.fumigatus
PMTTTLNLLIGIEHDGKSASFASVKSKESNISYLASVYADCVPPVVTSEEIQGKSPNARADNRDKRTTALS

SEQ ID NO: 27962 - protein, 691 aa, A.fumigatus
LCAGPACSVSEDEVAHFSPDTPETAAAARGEVTNWQEGDANPFADGNSMDANTTDEKHTDEMMFQGESIQGAAAEYYQACAHELFSGRPYFECVNHVCSITPKDRIPVLLASSIAEPENNEKHLLIDVDDDVTQLAPVNPFESVSHSGARSISGTTAVDDQPASPLISNTGKKYLEEDTPKESRGHSPEPGPIEREPPVYAGDRPEKQASHLFFQPTNTISPAATNINIQPPGALPSASGAPQERIIPQYIVVPPQNYGGGGHPQPQTPDATSPGLQQATARSGSIPLTEIASGPAPACHAHRSASHTLPPRIDPAPITQEQMTHPWFERERIETRRRRLEREDAIGRKAGGLWRGRGCFSNKGCFGRPGREGRLRRRWYMAITTFFVLIVVVAVVLAVMLTRKGDGTPVQSQWLNLTGYPPMPTGIATIAGSEPQTQSSGCITPSTLWSCALPPEQQSDNKPYAPNQPSFRVEIRFRNGTYANSTTVASTSSHKTRDINGSFNPSPSPPSLKDQIFLGNTTDQNAIPYAGEDTPFFITILSTASLRSSRLSRRSNSSFPDIESLIPSPDLNSDGTAAAATLYPLPESQPVRLYNRGLDTEHYGFYTYFDRSIFLETLAPLNGSTTDNSAADANRGRSETDARVRCTWAQTRFLVQIWTQPIRARKNLLRSNPTAASAPITHPPCFPCYLT

SEQ ID NO: 27963 - protein, 190 aa, A.fumigatus
MDHSTHRHLHRVSKTRFFWAIRLTRTPSPTQARIPPSSSPSSRPPPSVHPDYPADPTAPFQTSSPSSHPPISTPMAQPQPLLSIHSLNPNPYAFITGAWTQNTTASTRTSIGLSSSRPLLLSTAAQQTTPLQTPTVGAVRLTPASVAHGPRLASSCRSGRSRFARARTSSAVIPPQHQPLLHTHHVFPVI

SEQ ID NO: 27964 - protein, 159 aa, A.fumigatus
AHPASPSPASAWWSSTRSAFPTRSRYSMFWAALVPMVGSVLLFSGVRDVQHVVGLIRGAATLGARLFLRPPLSRTLGWMIHTGHDFPELMTDRLRSWDSTLIVKREADKPSTRGLLEYEDTTFGRASPFTAFVRRTAARTNQPSKTLHIHHLHPPGPRQ

SEQ ID NO: 27965 - protein, 282 aa, A.fumigatus
NGKQTSRQLGGYWSMRILRLDVRVPLQPLSGEQQQELTNPAKHFIYTTSILPVHDNDLRNTPLLSAKAYHYLETPQDMQTRLSALLSLRNEAGEPDRPFIVWEPAPYVCKPENLQPCLSAAQHVDVLSPNHLELAALFGESPAKAHDKATIEALARRVLDSGVGIDGKGTVVVRAGENGSVVVSRDLPPTWLPPFYPAGADGRQHSKVVDPTGAGNAFLGAYVVGYLQTQNAVEAACYGTVGGSFALEQVGMPELVSGEDGELWNGADAFERLREYRKVVGL

SEQ ID NO: 27966 - protein, 184 aa, A.fumigatus
YLGWLAEPHTAAAIAARTTRNANATASKLRLRAQPPFYTHATSQKRPHHSTTPHPHRRPAPASPPAPAQTTPQQSHSKPPPPHFASGDTQPHTPPETHSRPPSDQQPWNAASRQLQPDRTAAATWEADREIPRHSRSRLRGRRQCLSHLSRRRCLGLFAPRPRSWPCRELLLGIRRRGRRVRGG

SEQ ID NO: 27967 - protein, 103 aa, A.fumigatus
ALTWLFDSFGGGMSYTITLSEKAPEEGVQPVSSTLSDYDADLSSSGYPESPDLEDREKYAGILADTKKTDKAAPGLGFIVWTAINVASTVAIVCTWPPRQIPT

SEQ ID NO: 27968 - protein, 67 aa, A.fumigatus
RVQSGLFASLVNLSQFFIIHLAGPISGTVVGQLKTCIIVGLGWAFSTHPISFQSIVGIMLALAGMSL

SEQ ID NO: 27969 - protein, 168 aa, A.fumigatus
  UNSURE (126): Identity of amino acid sequences at the above locations are unknown.
FLGGLIEDSYSVTRVIDGVPYFLSITDTAGQEEYRGLFALSNLRSDAFLLVYDITNASSLSALDYFMDLIDIEAEQRAEDNARLLKELGDSVRGVEVGMPPPVKIIAGNKCDLKDNRAISAREGLXYARKHGCGFMDTSARDMVNIEETFARKYLVLWHYQCWRVETA

SEQ ID NO: 27970 - protein, 87 aa, A.fumigatus
GFDAQPCTSSVSVSWDISIKCLGQNTGANMVHTTPTTLLVLTGLAATATAYKHTWRDHMKCAVSIACLHVDLSKEASFSNISPVRLL

SEQ ID NO: 27971 - protein, 265 aa, A.fumigatus
  UNSURE (124),(125): Identity of amino acid sequences at the above locations are unknown.
AQSQRPGARGRTRQGSPPLPPRSLSTAHSSPTPPPPLGEDSDFEDGEEHGVRVITEFLTHTSCDCSSSTVAAASSRMSSWPAYVHQSAVPVSSLSAGHTRVHQTLVPVSSSSSHMLVHQTAIPXXFSSSRPANLDQVMAPVASSSSAHAPHSAIPVATSSSARAHVYQTAVPASSSSTHMHLHGSAIPQPASSSARAHVPQTVVPGASVSSQPAHLHQAAVPSPSSSSVSASSTVVRSHAGVYAPASLYVSVPVLLHRRDWKETR

SEQ ID NO: 27972 - protein, 226 aa, A.fumigatus
HLTRQAAVAQDADYPTCTSPSKFYCFCAQPFEPSKISSAAKDVCEGFGIRTFKVLFFTSRQRMKTDAMKQRSLYTGSSATTVALGVMTMCMIGTMATTVTATMPSLTTMTKTMATTMTGTDMDIASPIPTASATPTCVLPLRKVRPGLQTQISTVPTSRSKRAYAPGLSPSASSVAVNRALVTNAPSALGGGQRLRGRRGARGQGHHGVPHAYILRLFVVDCSGCK

SEQ ID NO: 27973 - protein, 72 aa, A.fumigatus
FAFLSGVECLTFASATYCPPTYTARMYMHMYSCSNGMIRRSVWQVLKLGYVAEDGMQTTICYANPCTDTCRE

SEQ ID NO: 27974 - protein, 373 aa, A.fumigatus
SMLNAIRDLDTTRSFDIMSSRTILKSTYPWTKSPLLASAPMLNIAGPQLAVSVSSAGGLGFLAAGFDVSSLDHNLEVTARLMKQSGGMAQQVYEETGMLPIGVGFINWGADLKVSLAAIQKYMPCAVWLFGPRDQPDDLVPWVKEVRGVTSGRTKIWVQVGAVDEAIVVAEVLQPDALVVQGSDAGGHGLAHSASVLTLIPEVQDALRERDLTHIAIIAAGGIVDGRGLAAALALGAVGATMGTRFLASAEANIAHGYQKEILRASDGGLNTIRSTVYDRVRGIGGWPNRYDGRGIINQTYLDAVQQGMSDEENKSLYEEELKKGDAGWGPKGRLTTYAGTGVGLVREILPASRIVEDTLCEAGDAIRGIPLD

SEQ ID NO: 27975 - protein, 72 aa, A.fumigatus
PWQGSSDHYKNPSSLLQIISSDNLRAWQKPYFDREHNLAMYPSTSLAVWAYALLLLASPSPADATSNSERFE

SEQ ID NO: 27976 - protein, 225 aa, A.fumigatus
SVADHLSARIKVHRFCAFLDVPVFRKRHCDLQSECCGVESAQSAIPSPPEDIPLPSIMKSDLPDLTFPFSSHTSSKICLQSALNIVTVVDNLPYPNPDHTIPLTLPPYLSHASRVEIPRVMPTFACCLMQASYAMLMLYLKARAKHAHSPEDSGSVKGLSLTEFLNELQQNLRLVSKILANYAIAAEALQGMKGEFLFFDTAMLFADRVRGDIVLGFLGGLIGSV

SEQ ID NO: 27977 - protein, 90 aa, A.fumigatus
RVPLRDTRGRPSILKVPRLPSYRRQRCPCHTPGSQRAWGYPGWHDMNGMPTMNVVQYPMDTADPAQQAAFGAPPAHMGHSGQGPVVDLMS

SEQ ID NO: 27978 - protein, 184 aa, A.fumigatus
TTDLLTEPRIEGSTNFAAAPTLDPSVPWDEYTTISDPQILSAMAAGKHQMMNVPPNAWSPGPNNMVAMPPNPAMAATPTVPSQSQPISPVQTYAMQPDGSVWPVAQPTRSMTFPAQPEMASYPNPSQFSQQMHTDLKRRMTSPAQGYPGTPINPQSPPPAELQTTTVSMSYPGQPAGMGLPRMA

SEQ ID NO: 27979 - protein, 65 aa, A.fumigatus
PFAAPLNDPVVPSLKSQYQKNFGYEQKKSELSGMHGVPTGYYSKSKISFFVKISVFRVRLVKQPS

SEQ ID NO: 27980 - protein, 91 aa, A.fumigatus
  UNSURE (81),(84): Identity of amino acid sequences at the above locations are unknown.
KDPGKGGDHTKQRDPCFRGRNHEMGWGDPGGSRRRGQGPAGKGGGLGKAGCSSPADTLECLRGLDYTDFLNAPNAVPGILXYHXVPLSYLL

SEQ ID NO: 27981 - protein, 229 aa, A.fumigatus
PNGKAITASPDILVKTGKYAAVPIIIGDQEDEGTLFALFQSNITTTKQVVDYLAKYYFFGATRDQLEELVATYPDVTTDGSPFRTGIFNNWYPQFKRLAALLGDLTFTLTRRAYLKYVTELHPSLPCWSYLSSYDYGTPIMGTFHGSDILQVFYGILPNYASRAFHTYYFSFVYDLDPNSRRGSLMEWPRWNDDQQLMQVFNNRGALLADDFRNDTYNFILENVDSFHI

SEQ ID NO: 27982 - protein, 101 aa, A.fumigatus
TMRVPDVIALAGLLAVSGATSSGQETLLMPRKQATQPNVLFIMSDDQDLELNSPAFTPYIQKHIRDKGVEFTNHFVTTSLCCPSRVSLWTGRQAHDTNVSI

SEQ ID NO: 27983 - protein, 233 aa, A.fumigatus
SPTSREIAELTGVPSEMADVESNVADESFAQSETQDEQPSHSTVSATVGIRRQANGTIGSVYSGNKIRHLKKEDGMPLWRKDIQYQFLKLVFEDKTPVFTRWSDGKKGLDFADIYIDAMARSSKTSKILKDKLQSDKQAAINMAMVCLLVNFGRMNTTLNCMVLPFFLSLHSALFAISFLSKSSLKLVPLDLETDLETNSVFPEMRAQLRTYHSIPSLQAHQEPNAYKPLPDA

SEQ ID NO: 27984 - protein, 94 aa, A.fumigatus
RKKVFRAVNTLCMKYYNQSQSSRALEMIVQAYWIECYEARIAVIRLENPHLSSTEARVTALKEACAVLSWKEKDLRNRMYLSPPFSFSKPSLTG

SEQ ID NO: 27985 - protein, 364 aa, A.fumigatus
VREKFGYYTHLLLGVFANQGIIGLSKAQFEPIAYASQEAWLFRDSIKDHIVFGTAYDQKRYERVIRDCALEKDLAAFKDGDLKEVGEGGRSLSGGQRQRVSLARAMYTNANVVILDDILSGLDPSTFEWVVTKCISRSEQQNRTMIMVTNSQRILQMADLVIQMENGRIAQIKKNLSTESTQDVPDKDYVGHLFHDTPEIPEVVSATPESTGGRDEMSPVSAEAPNEGADFQRVSSLRYGKSSSIVHFQVLTPPGFKYIRSFGSRPFVTLAVISTVGAQALEIGLPAWLSMWSAISVRNEGEGRDGFYLGFYAGISSPSDRVRRQMLTARAGLGSAQIAILAVSLLLPYSGWLGAPIRGQAYGN

SEQ ID NO: 27986 - protein, 100 aa, A.fumigatus
FANYTHMYGHFLTHLQYFREPQMKPNEPDEPGSADYNERLWRRGRNEKIITETQPLKGKAGSSRWDNSLALLTNTSQPLKMCFHQFEDHLAVADDRDTIA

SEQ ID NO: 27987 - protein, 420 aa, A.fumigatus
WFRMIFVRNILQGTEMCAFFGGFLRFCSEHSGLMWEIPLLRQWSVLCISMLWSDFPEAKWMGFRCGAPPGLWELNFDPVPEVRAAMLHAATTFLGIPDWTDQVAQIEESLALAVLPMASDGSVLVRKELLVFFSTFVKRYQNKFLVAAYEEFQDEKQTFLLRLEHDGSRGFTMEDVQNGTANSRNKSQKLSQNTAFGTIWKQLLILSVDPHPDIAQDASTIIDYIHLTLLASPMASLTDKARKEIMELTSRLSQKLQVRERAESKKAAPPPAPPSQTAAPKQEGYLSLSIKRTASVAASLKNLAFGGPPQNEQQSSQNVTSPTKSRTPVTPRGRAPPEWTRPPEVNDQVASAAAYHQAPIPPSRGFEPRDPSLAPMIPLLSRFLDWSTEVSPSLSPFDSRTTPTCMDIFLPIFSISVSPR

SEQ ID NO: 27988 - protein, 126 aa, A.fumigatus
CLDANFLYLVRIWDWQRHKRLNRFSNGNPPGSRINEVRYINEDDQALLMTGSSDGVLKVFRNYESPKEVEIVTAFRALPELIPSNRNAGLVFDWQQGQGKALVAGDVKLIRVWNAATEVCTNVCSS

SEQ ID NO: 27989 - protein, 67 aa, A.fumigatus
LHIVKSSVSQNKAFHPFYMFQIASLVLWSLDEYYYYAVCIFLISVFSICATIFETRTVCGGRLLTTD

SEQ ID NO: 27990 - protein, 97 aa, A.fumigatus
SMGEASEADESIISSRRSKRLYYSRPSAEDPLFPRRPSSAFCTGERTIDSRLTQKVYIVSEDLTIVIAGFSTSSTGLALYSLLCVITLGFAYILLRW

SEQ ID NO: 27991 - protein, 191 aa, A.fumigatus
PRWRVRLIGKPTPLRLCQWVAVEVGFPRLSPCKVFAEYVQDQWNQFNVCEVLSIPYGRALSTVFAESESCTQDEDNDPTVSYLRYIDYRCLRFFYHPFEDKFSLISGWKDPLWTNIKRMRVGLDADDHDSRAQIFGANVIDIQQKSVFQLLIDEVRAMLLITYREVQCLTKQGVSPVLHVPNCESCPMVTG

SEQ ID NO: 27992 - protein, 93 aa, A.fumigatus
LSSMQTMKRLREISLFECDTRVLRNGFCKYSSVCIRNWNAKLISGLAGRTVPSRELVPGDVFEFSDPSLNQVPCDCILLSGDCIVNESMLTGL

SEQ ID NO: 27993 - protein, 93 aa, A.fumigatus
NALFCETLDFTICNQKHGSYFIDQKLKNGLLLYINDIRSENLRTAIVIIRVQPDPHSFDIRPQWIFPATDQAKFVLERVVEEAETTIINVSQV

SEQ ID NO: 27994 - protein, 75 aa, A.fumigatus
FKDGSENSKTSPGTNSREGTVLPASPEINFAFQFLMQTDEYLQKPFLSTRVSHSKSEISLNLFIVCIELSYLASP

SEQ ID NO: 27995 - protein, 101 aa, A.fumigatus
KPGRFLSAVASQALANRTTSYTHNLRTIRTQLQGARLAMGSTVEYSTIRQATSTDLSTQNFGLPSRTITQLDPSLNARIGIVISHYKNSSSPRGWKDQRSQ

SEQ ID NO: 27996 - protein, 435 aa, A.fumigatus
FSLDRLSHGIIPLGRKFLRNGGRGSEIWANVYFLEPQEGNRFLNSLISFGKRQVNQRPHLGIGFNYQTPVSQRSGAGMRIRNRFCGMSQWKKHSRDKSRQRKVASLNELDNIQRIPKWPGSKRSPVRPAFPRFPPPYRSPTPPGLPSFGSPEAISYSTQFFVRSLVREGHIQQRPPPATGPPTSNGGGVASYGESLRRFFGFSSPAPPRPTGQSIPVARAGDGTAVLGRFPYRHSAHGTSLVRPLDDHPFHRRALPAADCETVEEESDSNRPNEYSTRLVKYTNLAQVEASVPTPRPAEENRRFDSSSVTPAIPKQTVTGRSRNTGSATVSLAKNPIHRQTSISQTLHGRTSLSGNEPQQQSSDRIGEPRLSVEMTGTVPGSADTLLQFLKARALPLCCCLPGFGEQDDIIYAQSSNDTYTTARSSPGNGIDSRV

SEQ ID NO: 27997 - protein, 210 aa, A.fumigatus
DPAISAVSSSSTTASLHRIMNRPQSPSYVGPTSAEFGLTTRQRQPEDFDSGDDLVSTAVQSPAPALGGDISSEDPLGCLGSAEALRLVDVYENTVGLMYPCVDLASVRVYIAEYFRDKDGMEPISPPTLDQEWFFARDIEVLKILLATALLAETHGRSEKAALLADSVEDRFATRLKVPEVDMKELLILTLLVFPSFLRDVSFFEWLLMR

SEQ ID NO: 27998 - protein, 343 aa, A.fumigatus
  UNSURE (144): Identity of amino acid sequences at the above locations are unknown.
SIFHSYRDDEVISWRLIGMAVRGAMQLGLHCQETWQKTGGVFPGELQCEYASRLFWCIYVLDRKWSFGTGLPFAIQDSDMDTNVPEPGTSTPYLTCMIKYARLSTKIWGLVVGWRNRSRAATADYCSYLDFQVQQWIQSIPPEXRFNPARSPMLSERAGCSATVTATPQPHSQYHTQTDSMMMLQVLFAVQANQLRILVYRQNILCSESIEADVSGASTAVETAKSTVHMLDSFSRVSPLYFQRPEPFNYFLISALAALFLAVLHAPARFSQVCRPEFYTAVDMVRRSSTRARTSRRLQKIIKSLKTIWMNLGTQRPREPVQKNGPNHRTPRGLDDTGAPRRF

SEQ ID NO: 27999 - protein, 262 aa, A.fumigatus
VQELYIDPSRASRRRNGKPASCEPCRKDKVRCDHGHPACSRCLRRGSTSQCFYHPAPLTRATRRSRGFIVGQHASTTSPAELRGSPEALSSSGSRSDHLLSAGYLGPTSFVSVLGEGDGANELVTAADESSAASSVPAWWAKRASEVVGHLVVFPALKQLILEFYGVSQAAVIAAPFILNALSQMQDTYHAYLLDQGEAEIPALVETVLDNTGQKFNAPPTVGRTALPQALHKVHGLRFGRYLAVVLCSWQGQTKSIPDWGG

SEQ ID NO: 28000 - protein, 92 aa, A.fumigatus
RQAIALMDPEHCTLDTCPIQNAYIHYQPTIAGNSVYLALFGIFLFTQLIQSMFFRMWGFAGAMAAGLVLEVAGYTGRILQHGNPFSFDYFLL

SEQ ID NO: 28001 - protein, 156 aa, A.fumigatus
IIIIYHGEEISRLKPRNYAIFFVSCDVIALILQSAGGALTSAAEDADGRQMGLNVMIAGLVFQVAALTLFIALASEFAICLRRRHLKGEYQVSHSASLRKDDYAAIRRKKTWTLFLFLTPPALCLTNEANNGSPCSCDYHGLYSVHFLSGGAERRL

SEQ ID NO: 28002 - protein, 148 aa, A.fumigatus
NLHFQPSSPSYIAYYFILIIDFWSAATLPSSLVHKSYGSSAALAHFIRLVSQLLSASQNELHIFSTTIHYHKIQMRLMSGIVKRLPQHPPQPEMSPELTRACLVGGNAISAFLSWRLQATTSCDVTLVWKSGFESVSQYGVSFKYASS

SEQ ID NO: 28003 - protein, 222 aa, A.fumigatus
PLSGNRDSNQYLSMEYHSSTLPLDSSSFLSKPFFLIAAKHTGRKHMAMNASSPVMVRSLIMAYVSLAVNLLTYAFRFVVVRAPEEAASRENAYDYVILCVKALPDVYDLASVIESVVTPQHTCILVNTTNTLGVESQLEQRFPTNVVLSLVSGVEISQTGASEFEHLDSSDIWVGATSNNSSIPASIQNDMASALAMTLSSGQVNCRVSENIRQEQFERMIG

SEQ ID NO: 28004 - protein, 87 aa, A.fumigatus
LYRVLGTKANLISMLTGVPHEKLQVFHHWASYAMFVLASIHTFPFIIVHIDKGDMVTLWKREVTYWTGVAALIPQAYLTFMSLPAIR

SEQ ID NO: 28005 - protein, 179 aa, A.fumigatus
PPIPSPSPPSPTTQLPCPSTTNSSSTSNPAEGSPPDSPASPRSAPAPSKPSSSKVPTAASLHPQAKTSRASTWFLSSRVAQAAASRWELWTPCLPHPRTHPPQHQLYRPSSQRATSQWQSGMLKKSKAASQRPMSLPEAGTFPPRFSLPVNRNSSIGRQMTRVNSPPQNLSPAACRRSA

SEQ ID NO: 28006 - protein, 201 aa, A.fumigatus
TAKLTWQGLLHRRGRPLPLQSLRSIYPHHPPPRPPQSHPRRPPLWLGPHQNPNLHNLVPRPTRLPPLFERLPARPALSNRPSLHHHLHRPRRSFPVQAQRTRLLHPTPRRDHRPTRQPRRAAPRHRANRPPRRSLRRPRCIRRQRPRALRLGSCHLGWLRQRLLAGNCGRRACLILALILLNTSSTDHLRNAQPVNGRVVC

SEQ ID NO: 28007 - protein, 321 aa, A.fumigatus
RGRDYFIAGGALYLFSLCAAYIRTTLLHGRHKATLDVLPCGLVRIKIPTFITWSPGQHVFLRFLNASQLGLHSLTAHPFTITSIAHDAASLSKHNELVFYIQPRGGITARLASLAAQRPGTEQTVLLEGPYGGLAASAGKDLARFDLVLVISGGSGSGFSLGIVDAVLASSSHSSSSTPALQTIFATRNQSMAEWYVEEIESRISTSNVSTRGGDVSASVFVTRQQEQQHRQTDDESKLPSTKPLARSMSQIGITHGPRPDLPAFIAGCTSPSSARGKRLGIFVCGPASMLHDVRNAAARAQRDVLENGPEEVYLHLEPFS

SEQ ID NO: 28008 - protein, 70 aa, A.fumigatus
HQLYKSISNQKKSTPPTPTQRQTPTSCQRANINYEADKRLINPSLIRTFTTPPTPYAGTIFPILAKQLAT

SEQ ID NO: 28009 - protein, 529 aa, A.fumigatus
KRRRSMRTKNDDNGEDGASRDDRNRSRQLSVVPGSMMPKDQLAGVYRELQAIRQQQQIISNTINKLRREHEQLYAQAANFQEQHNRHENSINAILTFLATVYNRSLQGQDGPQNLANSFAGVISQDQGNVVDVGDDFPLSALGAANLNSPNAQRSMKKQPLLLKAPPTTDRQNGRATTLSPAGSTYNRSQSRSHSRQPSVTQAGHVEEVFETSPTQKDATNSQNRSIPQSDIMSVIQNTNARNGIPTTFAEFPNVLSSLETSGGNSPLTPNQRADMLRLMANESHTDPNIPVPSDNALITPTPPPMPHNYNGRLASTRAEIDNLMKMQAEQDRSVQNLTNLLQPLSPTGTIPGLAGGENGSVPPPALDLDQIFNNDYFTDIGDLEHNKSNMDLGDTTSSVPAPAPADAPVTTGAEDVKDGSDLFDFDQIPPEGDLFDTSTAAQQQSPTFFNGYDGAGYPGGSGTNGHTPIGHKNPNGDSGRIVETLTDSESTSPSTNVDEVPQYSGPAGLNESHGGKGNGGGAKRRRKA

SEQ ID NO: 28010 - protein, 356 aa, A.fumigatus
IKAYTGGDTSAIVDASADLISTINDGTSTVAAQPALSQVDALNLVNPILALTNKVKTTIDDLISKKSLIVEAGAGPTTYSQLLDQYTASSNLATTLSGKVPEALKQVAEELSSGITSAIQKGIDAYKDVSTPPTTTTSSTSTPPTTSPTTTPTETSTPCETTTTTTETSTPCETTTTTTPPPETSTPCETTTTTTETSTPCETTTTPTETSTPCETTTTPTETSTPCETTTTPTETSTPCETTTTPTETSTPCETTTTTTPPPETSTPCETTTTPTETSTPCETTTTPTETSTPCETTTTPPETSTPCETTTTTTPPTETTTTPTTPPAETTTTTNVPVPPVTSTTTATETTPCHE

SEQ ID NO: 28011 - protein, 212 aa, A.fumigatus
ALPRPLLLRRLPRLLRLRLLPLLPRPPLRARLLPLLPRPLPPVRLLLRLLLLLRPPLRARLLPLLPRPLPPVRLLLPLPRPLLRVRLPPLLPRPLLRVRPLPLLPRPLLHARLPPLLPKPLPPVRLLLRLLLLLRPPLRARPLPLLPRPLPPVRLLLPLPRPLLRVRLLLLLLKPPLHVRLPPLLHLLRKPPPHPLHLLLKLPLPPMSLFPQ

SEQ ID NO: 28012 - protein, 230 aa, A.fumigatus
SWHGVVSVAVVVEVTGGTGTLVVVVVSAGGVVGVVVVSVGGVVVVVVSHGVEVSGGVVVVSHGVEVSVGVVVVSQGVEVSVGVVVVSHGVEVSGGGVVVVVVSQGVEVSVGVVVVSHGVEVSVGVVVVSHGVEVSVGVVVVSHGVEVSVGVVVVSQGVEVSVVVVVVSHGVEVSGGGVVVVVVSQGVEVSVVVVVVSHGVEVSVGVVVGEVVGGVEVDEVVVVGGVLTSL

SEQ ID NO: 28013 - protein, 356 aa, A.fumigatus
LMAWGGLGSGGSGGHWGNRDIGGSGSFSRRCSGCGGGFRRRCSSGGSLTWSGGFRRSSSSLTRSRGLGRGSSSLTGGRGLGRSGSGLARSGGLRRRSSRSSSLTGGRGFGRSGGSLAWSRGLGRSGSGLTRSRGLGRSGGSLTRSRGLGRGSSSLTGGRGLGSSGSSLARSGGLRRRSSRSSSLTGGRGLGSSGSSLARSGGLGRSGSRRSRRRRGSRRSSSGRGSAHILISIDTLLDGRGDSRGQLFSDLLESLRHLARQGRSQVRGGRVLVQQLAIGGRTRAGLDDQTLLGDEVVDGGLDLVGQGQDGIHQIQSVHLAQSWLGRHGGCAIVDGGDEVCRSIHDSGRIASSVGLD

SEQ ID NO: 28014 - protein, 61 aa, A.fumigatus
  UNSURE (32),(58): Identity of amino acid sequences at the above locations are unknown.
CRLSRYNTFILRDNSNLGHLDVVAMSTTNIQXYTQTINMRQSSQQTNVYTLFLSTPKXSNL

SEQ ID NO: 28015 - protein, 64 aa, A.fumigatus
LERFDRHQPSDKLTNRPPYTQHGQEISGSKRQEFQEKSAINRQITANTEAQAGEQSTDTRFEVY

SEQ ID NO: 28016 - protein, 135 aa, A.fumigatus
  UNSURE (12),(43): Identity of amino acid sequences at the above locations are unknown.
GTGFRPRTRTMXCSRTSPIVPIVASPDLTTIMPFFNPFRKHDXTTFHGVVIPLSSAPSHARPESPALEKKGSPKEKPDDSSLDKAPSQENGSAASIPERSHLTIESLRAEIESDVAASGHDTAYDRMFLCVVCDY

SEQ ID NO: 28017 - protein, 159 aa, A.fumigatus
PSLFVGPLVWPPLVVPHGLGMSIRYFLSAVGAGACALIYLKSSVCALFACLGLGVGGNLPVDGALFLEFLPFASGNLLTMLSVWWPVGQLIARLVPIEPFELCEFKSSNNSLVLLHGASSPVIAAPMTCPPAKQSVTESPAAERTTTWAGDTSCSLWAP

SEQ ID NO: 28018 - protein, 103 aa, A.fumigatus
NLDTNQNQGVALTLTPVASEFGISSTRVRFTTCALFVGLCLGASFWGVASDIVGRRPAFNLTLFICGAFGLAAAGGPTWIGYVHSIFPVRSWGRSLRANIPQI

SEQ ID NO: 28019 - protein, 123 aa, A.fumigatus
QLASLIAWGLIPSYSCADDLPSCKAVGDGVACCGKDNNMGWRYFVLTMGSLTIVMFICRFFLFHLYESPKFLLARGRQDEAVAAVHGIAYKNKTKTWLTVDILNEIGGYPEENAPQTLSTKEI

SEQ ID NO: 28020 - protein, 341 aa, A.fumigatus
  UNSURE (7): Identity of amino acid sequences at the above locations are unknown.
PRRTYAXAHAYHINSISVNSDGETFISSDDLRINLWNLNIQDQSFNIVDIKPANMEELTEVITAAEFHPISCNWFMYASSKGTIKLADMRQRALCDEHSKRMSCMLDMNSVKPPWLTYFPLVFEQEEDASSRSFFSEIISSISDVRFSHDGRYIVSRDYLTVKIWDVNMERQPVKTIPIHEHLRPRLCDTYENDSIFDKFEVVFSGDAENVMTGSYNNNFMIYPTDPSKETEIVLQADKSAFKAKKVGVPTPMNKNGKKNGSRAGSPAGPGSRMKKETDADQIDFNKKILHMSWHPYEDSIAIAATNNVSILALHFPSCYHSCDFAKVLIQSEQLFVFSAL

SEQ ID NO: 28021 - protein, 164 aa, A.fumigatus
TVLTKVPGRPGRTALGVSPITSYEIGPGAHGGTINSIVWNQDTNIFTTAAEDRKVRWWDLRSRHPVIEYAVEGTIGSCELNTLATRPNDPGILTVAAGKSVYLFDGVTPGRLLKKMDFRYEVASAAVNNDTGRLVTGSADDTWARVYDLRTEEELGTCIRNFYF

SEQ ID NO: 28022 - protein, 71 aa, A.fumigatus
AHRLLQLWNSFPAYSEPYSHETRSVFNTDYRSTHLGLATPMLATCPVYNQHITGTARTSTFCNAVLSRLSR

SEQ ID NO: 28023 - protein, 184 aa, A.fumigatus
GHSVSSLHHLLLTILVQEIRRKSTKESQDIKEELQRKQMMKEAAKKKQEKLEELEAKRRIKARIEADKEERRLRAEREKAERAGMAPPAQQAAPAPTTSGPVASKPAAAYTETRLRFQTPKGNIMKTMPVTTTLFEVAAALKQEDGIDVQSFVQNFPRKVYNAEFFGESLKDLGLIPSASLIVQ

SEQ ID NO: 28024 - protein, 64 aa, A.fumigatus
CTYVYLKYHGGGFSNSLPMVIVFRFLAGSSIPSIFLNPAIAFDVFIVIIIHGGRYMFGAKAPRG

SEQ ID NO: 28025 - protein, 69 aa, A.fumigatus
LAARANALYIYVYTYMFGHLGVTSLANNILHFPVSIPQSFQDPSFTEYICPTGRFRCYLSRMSAGNFTK

SEQ ID NO: 28026 - protein, 441 aa, A.fumigatus
  UNSURE (5),(35): Identity of amino acid sequences at the above locations are unknown.
IFIRXCLAERKSLTCIGSRTLRHDGSDVDLFLSTXVTQAFTLEAVDLFGIQGRLVPGLLQQYLGHFGKLRKLDLSRVSRTSGPEALISPETLFRWRLQELSLSGTAVNRETVDAIATYLASDQSRDLRILRLDQCGLTGQDVAIFLHSIAVVGAPRDLHLYVSENRLDLGCSYLFDAIAQNKTPSHLSMRMIDFKREEQFQDLVEALRINRTLKYLDISKASLPYDAGPETCRSLQLMFEENSTLESLDISGESAHLDVARFGIGLNLALTGLKKNKSLKVLKIEHQKLGFQGASTLASVLEENTCLREVYCENNDINLQSFTVLVNGLQRNRTILNLSSMDQDRVQSLDKFRREIENVKRDLSHAQSSTTSSIRRSIHAAIHVKNATVGNKLSKHSSAANPTRSMTSPSLSSASTTAVAASHVMDHDVEIILQSLNEKWD

SEQ ID NO: 28027 - protein, 232 aa, A.fumigatus
GVARLRRYLFGNYFVANGIDDGYDDAASDGRPTTAASLGTMLENLKLNGPEFSEEEPTLSQTSLQATPQSDEKADSPTPSTASTESKSSHLDIFKSLDADSGFRAELGDRPQTAGDVLTHGSAGLPREYSTSNAPSARLAVPVPAMPSITVKPNSVRSARSSSSMSTSAGTTMSSRSTYGTASSTLRGFLSKGVSKDRRGLDKLKPGPLCVSSDAPPQLDWTPPQLELRGFR

SEQ ID NO: 28028 - protein, 445 aa, A.fumigatus
  UNSURE (204),(236),(239): Identity of amino acid sequences at the above locations are unknown.
APWIFHGWCRRCPPETANKSLSLSLTPGATTDDEKIFKPYVSRSAGEIPQADDPNGPGLSEPRTISWGQSRKFNQPQSTAQVHPEPSILRASGAGDDLNGQFCDSVLETPDSEEDHGSPRALLSVDDWVVKAAEQGNGGLRNAVYAAAETGILTNKMWVGTLGMPTDLLKDATRASISETLEDEYESLTVFVRDSEFDGHYTHXCRSVLLAAFHYQMPEKPRHTEYDDYSWRQYVXVNXAFAYTIAARWRPGDSIWIHDYHLLLLPQMLRQRLPQAEIGFFMHAAFPSSEVFRCLNSRDALLNGLLGSDFVGFQTEEYCHHFLQTCSRLLSLEVTVGGVQLKDRFVRVKSIPMGIDANALDHLRQTNEVKDWIANISSRYSGKHLIVARDRLDVPGGIKQKLLAYELFLKKYPKWRENVSVHILYDLRVDVLIDTGCSHPDSVSI

SEQ ID NO: 28029 - protein, 272 aa, A.fumigatus
  UNSURE (220): Identity of amino acid sequences at the above locations are unknown.
TQVVLIQIASASEMPELESQISKIATRINSKYSTLTHQPLVLLSQDISYSQFLALMSVAEIFMVTSLREGMNLTSQDYIHCQDGKVTPQYHGSLILSEFTGSASIFHGHEFLVNPWDYREVADAINKALGMSPEQKQHNWEFLLKKKGASHSRSVVQFVYLSPCRSSQRAIVPRTQPCRDTLCTRTEGVIRERQPSDSSSLKAKEPSLLTAHRRCLKNFXAIQKTSSTSPATKARSRSNPNLQASPIEIDTSARTGASSGKMGQLNGKHSWT

SEQ ID NO: 28030 - protein, 107 aa, A.fumigatus
ARFEHLCKGQLFLASQSQLIVHFHEKVIQEADGNGTPFNYHIIIGREKRDYLHVWLALDLSVLFVCCDAALEVGIFESQQPHINEEAAISIFRKSSEEVAASDVDVQ

SEQ ID NO: 28031 - protein, 206 aa, A.fumigatus
RCVRLDYLLSHPSTLASSVPIVPITTLWTVLMDGFASIWPPSRTQVDGVSIGDAWVCSSMPQSPPAQPWESIVPFHKLTQWLCYSIMVPMAKLLNIHIAGSDLLTGLPEYRNGGLLIDMGLLALKDADLQRGIAAYKQNAQIKGQPNVEVVPLFAADDDVVVEWRAVTVGFLDDLLMEVNNQLGLRGEEQLTLAQMLEAGSWKVRT

SEQ ID NO: 28032 - protein, 78 aa, A.fumigatus
LPLQVYSFVPIPGAQQHKRPRRRYEEIERMYKCGWNGCEKAYGTLNHLNAHVTMQSHGAKRTPERMSLIYSSAFSLRS

SEQ ID NO: 28033 - protein, 123 aa, A.fumigatus
LILPFATEFKEIRKEWKARKKEEEAQRKAAEERERAAAAQAAQANQVDAPGPTDPAQAQPPAYAGGVRPQLPPIGYQPADGQVPGQYGGASGMVYQGNGQMAYPPNYPHSPYGQSGQVYQQRK

SEQ ID NO: 28034 - protein, 454 aa, A.fumigatus
CARLQNKPSLSSVLGWQAWWRRSFSTATAKGDTGWKCLKRYDYNLPDVVFEDGCVASNSNQQDQLSLDSASYTLEAATDELPHRVDIPMRAFDDNYHINLKRMYDFLGIDYVSPKFLYSLSRICPSSGKREPPYFIHSSSNHQVPPIRPRSRSRMDWIAETLYLTVCYFWFIVCCFVIGPKGKSVSCGDESFRRYLERIRLPQYFSRRYLLPLLSSMTTCSHAELLDFPAIDVVDYATRTYRQPHYTVVGGVHRVQARISDGLAIRLHSTVTAVEAAGTRCRITWIDSQNDKVSSAEYDHVIMAVTPDVVAAIFKPLEKPLRSIPTVKGDCIVHCDTSILPDGGLLCTEAKKALEPPEIMYMVSDNNSTESVHIHRSSVMVTNFPIEPINSNKIIHRARLTRVLRTVRSREVVNRIFSREPVPKHPLGERPIVAQWGWERVACWRMVLGWHGAS

SEQ ID NO: 28035 - protein, 69 aa, A.fumigatus
GLSVSQLRSLIIDPAVSYESKADTERNPMLVVKNCQVQATYTHLHSPFRLNCCRSSSANQCFDQCRSIR

SEQ ID NO: 28036 - protein, 76 aa, A.fumigatus
DAGGLTTTEYYQIFLSFSVLGGISSCCLFTPAITAVGHWFNVRRGLATGIACTAGGLGGVFFPLIILYLGPTIGFT

SEQ ID NO: 28037 - protein, 283 aa, A.fumigatus
LFATLNGLHIPTAGSTLGPFNTDSVDTLDVTVTVVDKFSRHDTVLAGVLAHVGLDLGVAVVDTVDTGPLRPWVITGTFWRRLRQQLEVNNRLGTMADRGTNAVVTSVTTTNDNNMLVLSRDVLSIRETRVEKRLGVAVQELHGKMYAVQLTTRDLQIAGNGGTSGDDDGVIALAQRVQGHLIVRANSSVGDEFDTLGGHKIDTALDDLLIKLHVGNTVHQQTANTVSTLVNSDAVPGTVKLICSGETSGSGSNNSDRLAGARLRWTRNHPAHLKATVDDGTLD

SEQ ID NO: 28038 - protein, 424 aa, A.fumigatus
  UNSURE (1): Identity of amino acid sequences at the above locations are unknown.
XSARCMDCGVPFCQSDTGCPISNIIPKWNELVFANQWQDALNRLLMTNNFPEFTGRVCPAPCEGACVLGINEDPVGIKSIECAIIDRGFEMGWMVPRPPKTRTGKTVAIIGSGPAGLAAADQLNRAGHSVTVYERADRIGGLLMYGIPNMKLDKKIVQRRVDLMAAEGIKFVTNTAVGPDNEVSLNSLRQSNDAVIIATGATVARDLKVPGRELDGVHFAMQFLHRNTKSLLDSGLSDGEYISAKDKHVVVIGGGDTGNDCIGTSVRHGAKSVVNFELLPQPPPERARDNPWPQWPRIYRVDYGHSEVKTHMGKDPREYCVMSTEFVDDGNGHVKGINTVRVEWTKSASGGWDMKTIEGSEQLFPADLVLLSMGFLGPEDRLLGNEIERDARKNVKTPPGHYSTSVSGVFAAGDCRRGQSLIVW

SEQ ID NO: 28039 - protein, 146 aa, A.fumigatus
RSLVVSWTAYILPCSSCTATPSLFSTRVSLMESTSLLRTSMLLSLVVVTLVTTALVPLSAMVPSLLLTSSCCLSLLQNVPVITHGRSGPVSTVSTTATPRSRPTWARTPASTVSCLLNLSTTVTVTSRVSTLSVLNGPRVLPAVGI

SEQ ID NO: 28040 - protein, 94 aa, A.fumigatus
AMATVSAPTPKLDRYIVIHVATTCDEHGVYVTKDSAEVIELGWILLDTKTCEEVGSTLVNRQHSAFFPLPSLRLTPLFPSKCLGHHHRCSSACR

SEQ ID NO: 28041 - protein, 253 aa, A.fumigatus
QCLTASLTTLTWEHVRSAGTFRDAINRFDAFAQEHLISKNLEFAFVTLDSWDLRVQLPREARDKAVVLPPYLQHSRTFDLRTEYQRWQTHHPESLPFGPSSLSNICAALEVEPVQSSAPIKHNLPFHLQALAPASPRRAMEEAITLARVLRGLIRKSQPPHEHPEILTRPMDARADVRAFLTERSKVLHLSGLPHDTTQSELESWFTQCGGRPIAFWTLRTPDEHKPTGTGFAVFSSHDEVCTLSLLPLFSTG

SEQ ID NO: 28042 - protein, 264 aa, A.fumigatus
YSYFLTFLLRHRKTGGSGVSAGGTIAVAVVVPVVSVALIILAALYFWRKWKAKKAAEEERRKEVEEYGFNPNNDPTLPPIMGAGAAYEPKEDTSGYRGWGTTSAGRKASTNLSSGAGPGLAISEAGSAPGYHHAATPSDGTIQFSEGQMQETEPIGVLGAAPTSSNNRTTDIHRGPSNASSAYSAANRSEASEESHMSGTHPAAAFYEDNPYYSDMQGQYGAYGDGPYVPNQPVIRDVQARRNTRIENPAVFPRQGNAGIAQNF

SEQ ID NO: 28043 - protein, 409 aa, A.fumigatus
SSFYDSPTVELTNRLVQYDEIPIPQHIKKPVLTMLRETKTTPSLMSQLNVQLGNMFGETVKLFCKKHNVPINSIDLIGSHGQTIWLLSMPEEGEIRSALCLGEGTVISGLTGITTVTDFRMAEQAVGRQGAPLVALIDGLLLHHPTEWRICQNIGGIANLCVIPPDSEGGVDAMVDWDCGPGNMFIDAAMRYFTNGEMEYDRDGEWGAQGTVNQAVVDNFLNNNKYCNQLPPKTTGRETFGDNEAQEIIDECLALGMSKYDTVATITRITAQNIIKQYRTFFPKFNVDINKIAAVYMCGGGAHNPNIINYLKEQLPSVAILKLDETGVPSDAKEAVSFAQQALEAILGRAALVPINSDTLTPNTISGKIAPGLRWREVMAMAVEFGKGRTRLPTVKEMVVDRPYTYGKP

SEQ ID NO: 28044 - protein, 116 aa, A.fumigatus
SMVSSFTTPPNGASARILAGSLTSASSHPTARVASTPWSTGTAAQATCSSTPRCATSPTVRWSMIAMASGERRGLSTRPSLTTSSTTTSTVINCLPRRPVVRPLATTRPRRSSMSA

SEQ ID NO: 28045 - protein, 122 aa, A.fumigatus
RLSRLLSGLLRVLFPCGPRSIYLDTNGLILDVEYKRTTLIEVVQSLGEYINDEDPILRGKAVSYLTAVIRALPPKYLSRQQIQVLTTFFCDRIEDGGAVTGLDTLQKLDRFNDTLAEEVAQA

SEQ ID NO: 28046 - protein, 85 aa, A.fumigatus
RLKTLFEAVYNYFPITFRPPPNDPYGITAQDLKDRLQDCISSTSLFAPYAVPALLDKMDSTSPNVKVCFFTTYMSPLARIGLRSP

SEQ ID NO: 28047 - protein, 486 aa, A.fumigatus
RKEFLLTLFSSQMRSGSQAPLGPGSQSTHLRRESSQSTHSDMSSHMGSGPGRGSYPHQGGRGRGYSQSGYQGQMPYSPGPSFRSPNQPRGGPNMGPQFHAPNQGRPLAPFPNSPHQRSPALATAHPATPQMNQVPMAHPQMPPQPYAAYGQHMAPQTVRHHPSVYKPPRRGPFPKRRQGSCRFSSSSSSSLPLAHTSPPPLHLPPPNLAPESGQFEHYLTLMKNPQAYPYDPNYAYYNPAYGMQQMQYMTPPSPQPRPGMPYNPQAPYMQNQYPVQPPPQTAPLSRTPSQVSNDRPGSSLGQGQPPAGAPAASHTHTTSRSSNSPAPPKPQFVIPPTKRSPIVIKDPGSGVVKTFEKAPASPARATPSPVKISTPTATPPPRTGSGADHNRTESRAKTDEEKKKELREAVRQKIEQDEAEQRRKEEEEAAAQKKKQEEEEEAARKKKEEEEQAAAQKKKQEEEEEAAKKKAADEEASSPPGWKISV

SEQ ID NO: 28048 - protein, 163 aa, A.fumigatus
RSCLRHVLSAILGLVSDIVFPRLINSEKERRPSSPRDGQPHYLTILLSRPFTSAQTITMADFLALPSFLVENSAAVALKDAYNSFSERRAALGLSNPGTVDNIAREVQKEVLLSNFMFSGLRADLTKVFGMSPLFRVSHAFSMGGSGNLPPYAFSAMYGTPKV

SEQ ID NO: 28049 - protein, 244 aa, A.fumigatus
  UNSURE (13),(69): Identity of amino acid sequences at the above locations are unknown.
ERAPRLPPSTAPXTSDTDHRPSLTPGKAKSTVKSTSPDISFPQSTIAAQRQSSPDWTHIPHSSGGALFXTPLPQPSLYPQSTPEFSRMTDSQRRSSVMAAPINLSLLDDDTTGEGVNLVDSARPGSSYANDVSHKSHDMGSSAPPTKMRKLSHSVSQAPSRSTSTSLPLLNTAGLQQPFASSLPFPNESADLLYEYFPLGLDDWQAPVDAVYRPHVVHHTNMPEMKFVAGRGRSKRYFAAEDVF

SEQ ID NO: 28050 - protein, 71 aa, A.fumigatus
NLLLEEGEASGILLQKMSFKNSLVWEFGRVSFHYSAEILCKNSIHDSYLDQPAIHYPERLCIRPPRPSPYP

SEQ ID NO: 28051 - protein, 106 aa, A.fumigatus
YCSIMAARQLRRLSLPTHLPLPIRPHVRHLGTAQTNCHRFDHETDILIVGSGAAGLTAALRSHFHRLSSLVIEKDAQIGGTSAYSGGGLWIPNNPLAVDAGIIDTP

SEQ ID NO: 28052 - protein, 396 aa, A.fumigatus
  UNSURE (250),(396): Identity of amino acid sequences at the above locations are unknown.
QAMTLLISVIDADTAEDTDVGRASSPPRKRAFLNHGPHMVSFLRDRGFAFRLSPGCPDYYPQAHGALPTGGRSIEPDVFDARLLGLGEKWTEAIRQRPGRSLPLFTYEASSVTRMGASWRDVGTVLRVLLRGIYLSRVRGQIPVTMGKSLVAQLLWLHMQLDQSPVLTDTALRQLIATPEGVILGARVATPDGERSIRARCGVLLCAGGFAHNQGLRERYGPVPANAEWTSAARGDNGDAIVAGVRVGAXTALMDEAWWGPTLRDPVRGMYYFALQERARPFGVIVDSSGKRFMNEAEPYTDAGHHQYAQKAVPAWFVFDWNHRKRYAVGSLMPRQQPPAQALDAGYIHRADTIAELARQIGVNEKGLEGTLAKFNEMADCGVDNEFARGESAFDX

SEQ ID NO: 28053 - protein, 183 aa, A.fumigatus
ARGKATRATTRVAAMTCKKRLRSSRDSDDHRDPKVSIPDAIRQRLKKKSKPTAKSFHHSLGGSNPVPCDYSRAVHEVRGRAILTVESSGQKPAYYFTFVPDVQPLLSQKPAAEISGKQGPYTSDENALLVRLKEREGMPWAEIAAHFPKRSTSSLQVHYSTKLRKKATTRAESYKDVDERHQT

SEQ ID NO: 28054 - protein, 275 aa, A.fumigatus
LDRLTDSSAEPPYPQYGAPQGFSQPPYPQPSGYGGFPLPQGHYNRPPPPAPSPGGYPPAPGPGYPHSPPPQPPYGAPSQHPYPPQGGPGYPPPAGGYPQPGPYGAPPVGGSGYPTPPPQQFQGPPAMPSLGYVPGQMAPGDFRREADLLRKAMKGFGTDEKMLIQVLSKLDPLQMAAVRSTYTNHHHRDLYKDVKSETSSYFRQGLLAIIDGPLLHDVQSLREAVQGLGTKEWLLNDVVLGRSNADLNAIKAAYEHTCQSSPGSESPSGKTTRAP

SEQ ID NO: 28055 - protein, 84 aa, A.fumigatus
LPAHHSQTSLVVFLMDSDFYLLYAQTNISQDFVKRQYKADSEIAPVWPWSTAGAWKERTVLPASHVLGDWGVDHRKQMTSCSSE

SEQ ID NO: 28056 - protein, 278 aa, A.fumigatus
SNRHPVGSFQPRGEDKESKLDTKKKTAGYNLLLNSLADLHSCNVIFFLEARKRGQDLYLWLARPPNGPTIKFHVTNLHTMGELNTGFSGNCLKGGRGIVVFDRSFDEQGPVMSSPGNEYRGLIREMLRGVFCVPKRGVKGMKPFIDRVIGVFGVDGKIWIRVYEIRESEGGAKKDEENSKPAPKGKNAEPEISLVEIGPRFVLTPIVILEGSFGGPVIYENKEYVSPNQVRSEIRLSKAARYAKRRDVQTNLISKRSTLGLAEGERKPGPLDNKSLFS

SEQ ID NO: 28057 - protein, 78 aa, A.fumigatus
LLINRGWTSWRDTPTPTFSVHHGGTFAIQLFAAVGYSFCITYDILQYACSISDRFLFCQPQRRGLHLTRYPYLRRRRR

SEQ ID NO: 28058 - protein, 505 aa, A.fumigatus
  UNSURE (114): Identity of amino acid sequences at the above locations are unknown.
IMASIFTYDPDPPRVSSPWSTSGSSTPQLTASGNRGLTIRTRSGTELDRADPDFLSDYGITKLEPEPQEGPTEYKLHLLLRPRRLYNSMTTGHVVGGSYHSRASLSTSGPTPSXYESNLRSAQVRSTQSRQQRLQQLTTQLLWRLQQSSPFHSSTTANLVLPVLPEATPHLGTPQKPARLIPGLEESQGALYEIGVADDGTLVGLTQDELDESLTNLQIMAASLGCKVEILRRVIVGKCEWAECPEDTSAEAADTGRVHTESLWVAEALVSPDLEFYGLISHRDEFGRQSPSHGTKTKSMREDNYSTTEQIRISITGPSAAGKSSLLGTLTSSILDNGRGASRLSLLKHRHEISSGITSSVAQELIGYATGESMQDPVEVINYASGNVAAWDDIHATAKDSRLAFVSDLPGSVRYLKSTLRGLISWAPHYVFLCIPANCDEEMVPERPVCGTSEQMTEINLALSHLDLCIKSGIPTVIVITKMDVASRAGLRRHLVFTKEQPGSA

SEQ ID NO: 28059 - protein, 62 aa, A.fumigatus
AVDDCWSVKSGRDASTQRIIPDPDKFPDGISGVADQIHDLGLKIGIYSSESLPMDRYRRPRR

SEQ ID NO: 28060 - protein, 137 aa, A.fumigatus
QLDSISQDHLAILSNKILLKFHQDPVIGRPAQPYKWGYNPDWTFDPAHPAEYWSGASSVLGGTLVLMLNSEDTTQRRTAVWKEVPELKDVLGRQGKRRIGFRVTDVWTGKDLGCVRDHYSVELESHDVAALVVGRAC

SEQ ID NO: 28061 - protein, 112 aa, A.fumigatus
VSGEAFSRDDDVFLSDHCSCSVNPRPREQCAHQTRQCGKLLVSSNICMSRSKTRQGKLPALGWNTWNAFGCDIDATKIMTAANEVVNLGLKDLGYEYINSELPHPASRMYVC

SEQ ID NO: 28062 - protein, 116 aa, A.fumigatus
SRQATRLTNPQSDLKYDNLRRPLQLDRHVHILVPDPGSKATNGTCPDNKNPAPAGYDWRTSLTAERYRRMRDALVSVDRTILYSLCEWGQANVNDWGNETGNSWRTTGDITRKIQP

SEQ ID NO: 28063 - protein, 71 aa, A.fumigatus
PIPPASWPRIAAIANENSFLMNHVDFWGYPDPDMLEVGNGNLTLAENRAHFALWAAMKSPLIIGTAVRLSL

SEQ ID NO: 28064 - protein, 136 aa, A.fumigatus
PYHSNPIPQSASRHVTSTSDERPTWQRKTTASATSSGSTNLPEGIVFKKASRTESSPQAFFPRAVHTTVGDTELAVIPCPPHSDAILRVNPHKAALEAQYAPCRGSATCAACDAMLTIRPGGDGFADASAVLEAAK

SEQ ID NO: 28065 - protein, 121 aa, A.fumigatus
  UNSURE (22): Identity of amino acid sequences at the above locations are unknown.
YWRHHQSSMPFHALGREMIRAXSSPQSDVFFPSILINTAGYVSLSDMEMTPPEETMQHLTTNIFGPMLCSQAFARLYFAASKTAEASANPSPPGRIVNIASQAAHVALPRHGAYCASKAAL

SEQ ID NO: 28066 - protein, 77 aa, A.fumigatus
GLTRSMASEWGGQGITANSVSPTVVWTALGKKAWGEDSVREAFLKTIPSGRFVLPEEVADAVVFLCQVGLSSEVEVT

SEQ ID NO: 28067 - protein, 169 aa, A.fumigatus
  UNSURE (68): Identity of amino acid sequences at the above locations are unknown.
QIAAKDYIERVAVAMTTMLIRSDTLDYPEVQHLLQHHFTELRSQGRPETSFALDLTAFLDPSITWYTXWEGDSLLACGALKQLSPIHGEIKSMRTAPGHLRKGVAKTILKHIVAEARERKYQSLSLETGTDGRFESARRLYLGMGFEVCGPFGDYKSSDDNMFLTLRLC

SEQ ID NO: 28068 - protein, 100 aa, A.fumigatus
ATQLWPPVVKATPAPFSSWQRTNPPTTSMARPSTTTRAMATSSPSTPPTAVWSRMSRTTNTRRTQASTAWSLTPQKPTSTRPICRPTRSGPIARTLRPAS

SEQ ID NO: 28069 - protein, 119 aa, A.fumigatus
DPIDLISVNMKHHLVIGTWTPPGRLYTVAFDDEALTLELVKKTEIPEDEPISWLTISVGIQPLPATFANVVQHDKKTLYGAAMKKWNSFAINSPTDIVHQVAHPLAGHRMLVSISARSG

SEQ ID NO: 28070 - protein, 214 aa, A.fumigatus
KSGTASPSTAQQTSSTRSPILLLVTVCSYPSLRGLADADLSYPALASSSESNTRAIFVLAAHKPPYNVYGAPFYNYAGYGNVFSVDPSDGRLVKNVQNYEYQENTGIHGMVFDPTETYLYSADLQANKIWTHRKDAQTGELTLVDCLEAPSPDDHPRWVDIHRSGKYLYALMEAGNRLAVYVIDEKRHVPVFTHITYPLLPAGKLFYHRRSVQD

SEQ ID NO: 28071 - protein, 166 aa, A.fumigatus
RQCRSGKKQYPRLKSIPPHTSLRMDSDIFVLHLNNTFKHSTRYTFQHIRKKITLHHAPPLRSLHPTPRRRPLHHRNLRPHRRPQTPPPTHSPRSLPATLPPRRRRLEQFPGRHPHAHNPPRCAPRALRLPRGGPQRRRVRVERARAARAEGRGDGRQTAGGARCQC

SEQ ID NO: 28072 - protein, 152 aa, A.fumigatus
NQFHRIHPYVWTRIYLYFISITHSSIQLDTHSNIFEKKSHCTMRLPYAPSTPPRDADPSTTEIYARIAARRHPRPLIPLDLSLLHSPPVADGWNSFLGAIRTRTILPGALLELSVCRVAVLNGAVYEWNAHAPLALKDGVTADKLRAVRDVN

SEQ ID NO: 28073 - protein, 564 aa, A.fumigatus
  UNSURE (511): Identity of amino acid sequences at the above locations are unknown.
NSQRRASSQSASAFSATLLFLHHFLWYLSIPVYNLTALDGLPRFLFTSSDLMFAVRSVFSLSFKSCLFTTHPRRLAHSQKAFFAHILPHRNAPSPIKAMQSPSRKPQTDAKRRKKGRADRTKNSGFDEVLQTDIDNLLRRHKPEAENDASTPSPALPELFTEIEVTVSDISSTGDGLALSENKDHVYVVPFTVPGDKVLVKVVRHHEPLSHSVTDFIKVLEPGPQRNDAAIGCGYFGKCSGCQLQMMSYEDQLAHKKRIVEKAYANFSGLIPELIPAVEDTFPSPLQYGYRTKLTPHFTAPGGHSAAKRRKSGEVPTEVPPIGFTYKNRRMDMDIEDCPLGTDIVRRGLRSERKRVAENLHKYTKKGATLLMRESTRRIPKDSAEAEAGAVQKEGDNPPESESGDVIRIERDNYIEEKRCVTDNNATSVEYIDDYIFTNKAGAFFQNNNSILSSFTEYIRQHAFPKGNEQDPKPIKYLLDAYSGSGLFTITLSPLFKSSLGVDVAADSIAXARENARANNLPNTGFARPDAATLFKNVPYPPDKLYSSWTQPVKDAPMISSGNC

SEQ ID NO: 28074 - protein, 75 aa, A.fumigatus
DCTLGWRGTTKNGGGKEVLRKRRTRIGWRLSAENFTIPSIVPILPSLTYSITRPIYSGNSATSPRSLLGSCIPSQ

SEQ ID NO: 28075 - protein, 70 aa, A.fumigatus
LRSISLHLLIVFRAEDKSVRYVAEENVEIITPDLFELPQTLVETAGKHFKRWDGCSHTFVSNIRDEYPDD

SEQ ID NO: 28076 - protein, 69 aa, A.fumigatus
CFVARLPSFLLFALLYHFILSFLFFFSSNFFYLFNFISLFFQISSPRNSDRSTFITIIDLQVQNVVERL

SEQ ID NO: 28077 - protein, 138 aa, A.fumigatus
ASKMRRGVLIFLIVNLLIISFLVRSVFTLLSLLVEDASADAIRHAELPSPNSSLIEQRPQIIPKIIHQTYKNETIPEVWREAQQSCKDLHPDYEYIVCASFPVNCCLVILTSPPALAMDQRKVPRIYQERISVVPRHI

SEQ ID NO: 28078 - protein, 70 aa, A.fumigatus
LWTNEKSREFIKNEYPWFLDTFDGYKYPIQRADTIRYFVLGLLGPDIYRTLMRNVVPSMLTKMDLGNLVP

SEQ ID NO: 28079 - protein, 231 aa, A.fumigatus
DDMAVLTQLTNNVRLYGTDCNQTEMVLHAIDKLEIKDMKIWLGVWIDSNETTSRRQIDQLYKIIDDAKDISIFNGAIVGNEALYRAGSDKTSAQTTLINYMQEVKDHFKKKNIDLPVATSDLGDNWDATLVQAADVVMANVHPFFGGIPVDQAAAWTWRFWQDHNVALTKGTNKKQIISEVGWPSGGGNDCGQGANCPNDTAGAVAGVDELNKFMEDWVCQALDNGTDYFW

SEQ ID NO: 28080 - protein, 77 aa, A.fumigatus
IMARIISGKDPKTTLSSQQASSTAANEFDRFEAFDEPWKIVYNTGKENWEDKWGLMDSARNLKPGLKIPDCGGKTAT

SEQ ID NO: 28081 - protein, 294 aa, A.fumigatus
GIVNGYLDTEKNLKGSVLPTLERLHKEIKNKSKELQSGASKSAKAVEKARGVTQKHIELLAQQVAAFDSTAGNKFDHAHDPYILRRGVNHRLNKQVIEENNNRQDIIAVQNNFQQFEAHVLQTIQAAMEQFNVFIGGQLDRQRGMYSDMLAAAQRIPPDYEWVNFITRNANVLVDPDSPPRSLSNISFPNQDHRATVPLIEGSLERKSRAMLKGYSTSYYVVTPARYLHEFKDNDDFRQDPSPELSLYLPDCVVGGVDGNKFTIKGKDVSRRQGRQRLPHYQRVFTTGLEGHAL

SEQ ID NO: 28082 - protein, 95 aa, A.fumigatus
PVVKTLCCTEQTTGLLLERLRAWKHMCGYLEDYVEVTAKVQKSQAKDYEKVLKVWRLFCLRWFRKGADTARVDCQRSPSGGAPFLSECRWSFGMV

SEQ ID NO: 28083 - protein, 156 aa, A.fumigatus
LLPRFPNLVKTRPEMAATYGSGSQRVRRLSSIDATRADLYGGPNVVVPPKHLMASSDAHDTAIEMAMAKQHLDEEVSSEEESPRAASPLTRSPHHLTTADEFALAFDIDGVLIRGGQAIPEAVDALKYINGQNPFGVKMYVSLPEKLSTQHRLLTP

SEQ ID NO: 28084 - protein, 230 aa, A.fumigatus
SSPYIFVTNGGGKTEEERCLDLSRQLELEVSPGQFICGHTPMREMAEKYHTVLVVGGEGEKCRIVAEGYGFKDVITPGDIIKTRQDTTPFRKLTEEEYNNSRVRDFSKTPIEAIFVFADSRDWAGDQQIILDVLMSKNGYLGTRSETFDEGPPIFFSHNDVVWSTSHEHVRIGMGALRTSLEALYNAVTGNELTTVAFGKPQLGTYEFATRLLRQWRKEYHGIDEPPSTV

SEQ ID NO: 28085 - protein, 114 aa, A.fumigatus
  UNSURE (101): Identity of amino acid sequences at the above locations are unknown.
PYSLSIFASPYLDSQLFFLIGSSCSNRLIQIYATSEERKQRNRQAQAAFRERRTEYIRQLETTIKRNEETLQTLQQNHRTAADECLMLRYKNSLLERILLXKGTATIFVSSGLY

SEQ ID NO: 28086 - protein, 132 aa, A.fumigatus
SSLTTLRPSSPVVKTIRRLAIPLDMTKRAELLYNSEPFELAHKWVEQTGDSYADPTRERNGGHFVSFVKSGGKLWELEGSRKGPLERGILADDEDVLSPRALDMGLKRILKLNADGGEKNLLFSCIALARRP

SEQ ID NO: 28087 - protein, 384 aa, A.fumigatus
LVVNDLILSEEQVISRYTASPISRVLSPKLRPQSVPAISICLLILLLIHTSSIYLILPGHSLGSSLLKNSTQWYLTVHLRSLVAVAIEGAPSLSVRGTNHLKGNMGSAMLSGLLDATRRTTDSNGSPSAKISRFIVSTKSAASAHRLGEEFQADKDRVDIRHSDNLLAMQEADIVLLACKPYLAEEVLGELGVREALAGKLVISIMAGKSPEDIEKYIYRDTPADDAESKAIIVRAMPNVAARLRQSMTIIEINNNLSHDIADTLTWIFEQIGKVKFLAADLFDIGTMLVGSSIAVLTVPLDGILDGCVAEGLRRADALEMAAQNLIGMAGLLREGVHPAILRESISSPRGCTIQGLLAVEKEGMRGACAQAMINGARHLKEIH

SEQ ID NO: 28088 - protein, 82 aa, A.fumigatus
IHCIPNFSGSFPEAETPIGSRNIYLPLDLVAHTYFVYLSNSSWALSGLVTTEKFNTMVSDRTLAFIGCGSYRRGPFTERPWN

SEQ ID NO: 28089 - protein, 356 aa, A.fumigatus
RLRHKLSEERVSICCLRIGQDIDNKSSPSELRQLLPHLPCTVHNQEQYLLPIIYYHYKKKSSDTGGSHIRTPTVKSIGSPISTPHSPRVTETTQKCPLTKVHTTFRTEIRTNPHRKHAKRHVFFSTVEHNTTDPSIPQQPTRRRRPDLSTFFSTLSQISPDEHRSRPHAVPVPRDVSAAFYTLAEALEVMRRESEGGGASAGSREGGNGDGDGDDLLSQMIQTLLREADTPPKEVEGVSEEFCDSRSLRCVMRASLERELTSGVVLDRVPRTSLKETQTCPICNNPFLEDEYPLVVRLPCHSTHLFDLECIRPWLRLRGTCPLDRTDFAKQEREKAEARRKKPVEDDEEEWDGMYG

SEQ ID NO: 28090 - protein, 116 aa, A.fumigatus
IGGRILKKLVALVLSSGVGKCPEVQYQIRRHGGVETILSGTNFDAHTPYIKEHAVMCLKFLLEGNRENQKLVEALEAREVVRDENGLLERSGFEAVIDKTGKLAIRLKEGQPSEKK

SEQ ID NO: 28091 - protein, 74 aa, A.fumigatus
RSNFLFSADNMSYSSMAVRYFTAPKPLGGVMEAPRSQPSVDARVNASNPTSVNGGSAPAQSRVFTTGLEGPALK

SEQ ID NO: 28092 - protein, 81 aa, A.fumigatus
WFQEGYLSRLFGSVDWRCSTSYVIPMKRVNDSPAATTSLYLFTNIIRFLLHLNRLNQLTRESNAETVYFRPIEKVDRPVHD

SEQ ID NO: 28093 - protein, 99 aa, A.fumigatus
QVPSQDLPPPPYDNKPPSNMKSSAPKYTPYSDTPHTSITIPPTFQRFELDPRDTIYPSSPSPALAKRVRRCCCGILIGFVVATVLFYVWLYLAFQNWRF

SEQ ID NO: 28094 - protein, 110 aa, A.fumigatus
RPGGIAVAVGIFNVPSFTLARAIGGIIAWWWSRKHTNTTTSNIPGETVADLPPGASRVPAAVAGKTAEQAAREADAASSSVVVLASGLILGEGIISIVNLLLASGNVPHL

SEQ ID NO: 28095 - protein, 274 aa, A.fumigatus
GRTSFHAAVKTFGPGGATGPPPPGPSNVHRVQMDFQPSMEDELELRAGQLVRLLHEYDDGWALCVRLDRSQQGVVPRSCLSARPVKPRARPPPGAGPGPGPRGPPRPPMMGPNGPWAPPPGPPGPAGPVGPMGPPPPGFYPHDPRPRSPSAPRPMSPAQHPHGGPPPPRPYPQHPMSPAQFPPTPRSFSPGPGGRPMPPRSMSPGPYGPPGLQRPEMPASQRKRSNSAGRVSGTYSSFTRITRTKPSSRPNDATSVQCPPSNSHPATAASTGSR

SEQ ID NO: 28096 - protein, 71 aa, A.fumigatus
IDSHGSLMEGFWFYSGFSPNGLLLSRLKRRPKIIKDVTQLVLSRRTRMCNFLEYKGMLLFPTDCLRTLQHQ

SEQ ID NO: 28097 - protein, 101 aa, A.fumigatus
LLSFSFLDTKVVYRRYASLFFIAGCASTDNELITLEIVHRYVEQMDKYYGNVCELDIIFNFQKAYFILDELLLAGEMQESSKKNVLRCISQQDSLEDIEVS

SEQ ID NO: 28098 - protein, 85 aa, A.fumigatus
FSLIPRIPCLHPPPQCVEVVSAMRLISLTPPSACLPASDPVYVREAAANHPSIAPIFISPTHYISNTIVIRWVLLASSDVNTSHV

SEQ ID NO: 28099 - protein, 278 aa, A.fumigatus
MADTLKTGEPSGWRIPKACQECRKRKIKCNGVNPCKTCRVRNTLCVYRDVIRQRKKKRHGPVDEGLASCESTRTELGTQQPSSPPPQPLGRRNKSASYTFHNSVSATHMTSPSCKVQLYYGPTSHFTLMHEIYRGLVSNQTTHPEEPQGEVEEAGAGLDMFSVRGIFFGTPAETHDPNKGIGTTVAPVMFMPYELARVFLQRFLSTLYHLVPFWSKELYERQLETLYLPSSGTGSDTCTNSILLMALAMGSLGTQRYRWGRIFWLNGSRRLVLPGNNW

SEQ ID NO: 28100 - protein, 208 aa, A.fumigatus
  UNSURE (7): Identity of amino acid sequences at the above locations are unknown.
RGSLARXGEDYRSGVKKESGLNPAEPGAKAHPGHVSNILHASVNEGDTIKVSHPFGDFFLSDAKAAHPVVLLSAGVGLTPMTSILNTLTSQAPERKVSFIHGARNARARAFKNHITSLEQKLPNLKSTFFTSHPTEEDKEGDDYQFRGRVDLSQLDSNRDLFLDDATTEYYVCGPDTFMTDMLNVLKSKGVSEDRVKLELFGTGGVPH

SEQ ID NO: 28101 - protein, 120 aa, A.fumigatus
IISTHELRLSDRFLSISRMFHIRDIIYSRILHEYSSAEYIFRYSNIKATNSIKIQNYKTTKLQYNYVKMSHLTYYNYDGVGKAKQAQFKYSQAVSVGDRIECAGQGTPLPSHSPPTHPHS

SEQ ID NO: 28102 - protein, 65 aa, A.fumigatus
DQTRQISTQPPLQASTGACQPFIFIEISKQILLYQICIIYNASCKTKDEGKKPRTLLGRSPRFKI

SEQ ID NO: 28103 - protein, 69 aa, A.fumigatus
EYLIKNHSSLRKHPSIPYKICFIMKISLALSALALLACPATAVDLDLTKDCGAPFSAWWNKCTQAASNC

SEQ ID NO: 28104 - protein, 174 aa, A.fumigatus
IQTMTIRIKWLRGIQLPRHTNTSISTSSTPSSSTSAASSAASSSTPTAASAISATAAPAPAPASTTTPTARTTVGTASSRSGLRPTSSTPSSETDRHRKVRIRDTGVLHRPSCILPRRIAPLRAPEHQFPFLGCPRRVSLLPHVLVGLNGEPVIRNPLRDEEVVVRAALQRVDI

SEQ ID NO: 28105 - protein, 134 aa, A.fumigatus
EAYNFPDIPTPAYQPPPLPPPPPPLPPPQPPPPLPLPPPLSPLPQPPPPPPPPPQLPQLAPQLAPQAAAVACVPQAPHPVVKLTDTGKFAFGIRVYSTAQVAYSPGGSLPSAPQNTSSRSWAVRGEYRFSRMSS

SEQ ID NO: 28106 - protein, 108 aa, A.fumigatus
SLHNACADLRPPMVEYGVISVAVTLAATPAPTLLILCMSTGTTGPDSTNPSIPINSSSPGTAPKHSAATRSNAGPAHSPNTSGPSPLTPGQSSPCTSPETNAPIPRPN

SEQ ID NO: 28107 - protein, 319 aa, A.fumigatus
RMRGSSASYGRIRSDIRRCHFGCYTGPDVIDSLHEYWYDWAGFHKPLYPHQFLFPWDCTEALRRYPVKCGTCTLSKHVWAFPFDSWSIIALHLSRDKCAYPASELSPNSPSDASWITNRLTLLTALDTLSAGATAMSQSLPFQSATQWFHLQLEPSTDRIKLGGINRAQSYIHALERRTHDDFFVAKWVSDDRLPIQTYEDMREKRYSPRTAQERELVFWGAEGSDPPGEYATWAVEYTRIPNANFPVSVSFTTGCGACGTQATAAACGANCGASCGSCGGGGGGGGGCGSGDSGGGSGSGGGGCGGGSGGGGGGSGGG

SEQ ID NO: 28108 - protein, 163 aa, A.fumigatus
GQSPVSISFLLAMQTTDAASISNRLMHSKFSSLNADNTGFSHGAYNSNLPVQGFADRNARRPNIPHINTSNPASTRSDGMANSGTAFDMNFTPLLPSQLLLGSPFQPGTPSAFASPQFANFGGFSQASASAHAQNHQTQLGSPTQAAPNAGLYSGMMATDGLA

SEQ ID NO: 28109 - protein, 67 aa, A.fumigatus
LFPLNATLKQSSELPYSILQTTSPTNSFRPTNYRSRRLTLTLLFSPPSLESLLRPRFVFPPHPLSTI

SEQ ID NO: 28110 - protein, 64 aa, A.fumigatus
STVSTLSYGLRYRTAAMPTVHLLDYVAGNVRSLVNAINKVGFDVEWIKSPADIQNADVRTLLCC

SEQ ID NO: 28111 - protein, 268 aa, A.fumigatus
KLMVPGVGHFGHCLSQLSEGGFLEPIRQHIELGKPFMGICVGLQALFEGSEEDPDTPGLGLIPQRMQKFNADTKSVPHIGWNSAMNTTSERQTFYGLNPNSKYYYVHSFAALYKAGVLENDGWSVATATYGEEEFIGAIARENIFATQFHPEKSGQAGLRTLRAFLNGDKFQPLGTEGLEARKREDGLTRRIIACLDVRTNDAGDLVVTKGDQYDVREKAGVGAGGQVRNLGKPVDMAKRYYEQGADEVTFLNITVFTTGVEGSALSD

SEQ ID NO: 28112 - protein, 380 aa, A.fumigatus
  UNSURE (122): Identity of amino acid sequences at the above locations are unknown.
CWCLPGRSVGANKDTESIVPARPFRILDAPYLRDDFYCTTLAYSPTSGVLAVGLAHRVYVWSEIFGVLYPPFADHHPSNFVNSLSFSSESGGKDILAVGRRSGLVTLWSAPEAEPRYEISHXNSITSVAFRQTVTRRFSERFHNVEVNTEDLAVGDELGNIWYYSVEWPSEEIREQFGWNGAITLLARISAHTQRICGITWSPDGAYLATGGNDNACLIFELRDLVPWLQLNCATKPCKSAQTCQSISVQCQNAFSSLSASTSKRLFRRRDFLNLLPSWSHFRLGSSQTSLIKHTESIALGTERTVIIPPNRQKHILAHAAAVKAIAFAPWQPSLLATGGGSNDRAIHFWHAPSGACLASINVYAQVSSPQGADGSAQCT

SEQ ID NO: 28113 - protein, 107 aa, A.fumigatus
QMRNRLTTANSFNGSNCRVRLIDWKPAPLETGRADGLESISLEVLDSFRIGDRVLNDCQPCEEIVLGNPGKDGVIARTMTIPDKWRSWERPKRYAWSRHQLWIFGRS

SEQ ID NO: 28114 - protein, 96 aa, A.fumigatus
LLFPGQIERVMVENLYRHKTVQVNWNTQPVRLHVAPVTKDEPEAHPLTITVQNKETLGQETIRAKYVVGADGAHSWLRKYLNIGFSGDVTDSTWGE

SEQ ID NO: 28115 - protein, 190 aa, A.fumigatus
QQKTSRAVASARHELGPRARVCLISRWSTIPTRCRSKLTTDSPVTAGSAFLFSPGDISQALAFGRFSRLGDWLTSHLPPSSGLEIITIHGARRADVELMDLHPAFRPWSDEEGWNYWTVYADDDSYHKGHGHVYERCGISKEDGVLVLLRPDGYISLIASFDETHELIDFFDGLQSGPRTVPQPERRANL

SEQ ID NO: 28116 - protein, 171 aa, A.fumigatus
  UNSURE (10),(164): Identity of amino acid sequences at the above locations are unknown.
SLMKAGVWLXVMNLVPKTDFPDIRKVFVVHPRAGTVMGVPREDKLVRLYISMDGGNRHTSIDAKSITAENLLQAARAILAPYRLDAARIPWWSAYCVGQRVADEFARHNRIFLAGDAVHTHSPKAGQGMNTSIQDGYNIRWKLRYCLEQKGKPGPALHIPNRAXAHRAGAH

SEQ ID NO: 28117 - protein, 467 aa, A.fumigatus
RQTVRVFSMRKQLLRQLLLIPFATVAAVALGSLIVVTFALEVFISEVYVGPLKGYLEFLPTVLFSLSLPTITSKLTDIATQLTEYENYRTQDQYDLAQTAKTFVMNFITAFLPTLLTAFVYVPFGAKIIPYLDVFHVRGLHSSISTEFQVDTSRFQQEVIYLSVTGQVVSFGEEVILPYVKKVIWRKWRDYRLQKTQAGRPRRHSKMTDLLLIDSPSEAAFLTRIRNEAEADEYNVHEDTLEMCVQYGYLALFGVAWPLVPLLFLINNWLELRGDFFKLTLECQRPPPIRADSIGPSLQGLEFLTWLGTLSTASIVYLYRDGMKEVHMSSLLLVLFIAQQVYLAVRFAVRTGLQKLGSGTLRREAAKRYAVRKSYLEKFCARRTHGNGKPRVRFNDHVDVYSSSTDSSPTEALETKSATLHQETAYASERRGGILGGTALDGGGGGCEVDQSVEWRGEEARVAYSCT

SEQ ID NO: 28118 - protein, 86 aa, A.fumigatus
WGTNISYWLSNSLDVGYQNQSTAWVMGGKNIRFNGHGYGTLNGNGQVWYDFVKSVSNYPRRPHALTVARASNSVFQGLRFLQSQMW

SEQ ID NO: 28119 - protein, 109 aa, A.fumigatus
GGSHESYARQSCQPIVVDIMYLANILPWVLLPLAVIADATTGQSHRRTCVVKAGGSESVDDTPAILNAFRRCGKEGRIVFQNTTYHVNSVMNTSGLHNCDIDLYGTLLV

SEQ ID NO: 28120 - protein, 129 aa, A.fumigatus
KDNTDGADTIYSSHITFNNWTVVNGDDSISTKANSTDILITNSVFYRGLGIAIGSIGQYKDVFETIERVRAENITYYGTLHSLYFKTWTGEQVNYPPNGGGGGLGCNCPLPIPLFLNIRPPPSDVCYLR

SEQ ID NO: 28121 - protein, 215 aa, A.fumigatus
RPFISGRYGRRGRGSASLLPLEDCVSDVYRFAARMQTDSNNLRTSVEIIGYIGRIDSHGKTGQLGPYIIQSVFILLGPVLFAASVYMVLGRLIRSIQAEKHSVIRVNWLTKIFVASDVLSFLIQGSGAGLMANGSRADMGNNIVIAGLVLQVLMFGLFMVTSFEFERRMHRAPGGHVLDADVPWKTHLHVLDAVSALILIRSVFRVIEYAEGHDG

SEQ ID NO: 28122 - protein, 254 aa, A.fumigatus
YLILQWILLAFRSWQPSRRPLFRLTERTFSFCLIKASYTSKMRFLGSIALVLSSISVASANVRSRSYDTHEFFALHLDDSASPSHVAQLLGARHEGQIGELANHHTFSIPRERSSDLDALLERARAARKIRRRARDDATSQEQHNDALGGILWSQKLAPKKRLVKRVPPPERLARTFATGKEDPVAAQSQKRIASTLGITDPIFNGQWHLFNTVQLGHDLNVTGVWMEGITGKGVTTAVVDDGLDMYCNDLKPN

SEQ ID NO: 28123 - protein, 121 aa, A.fumigatus
THCIKRDGLSTLVGTGGSMLSGGQKQRIAIARAFLRKPKILLLDEATSALDSQSEAIVQEAMDAIRKDRTTIMVAHRLSTVQNADVICVLQDGKLLEIGTHEQLLGKRGKYWEMVSMQSLH

SEQ ID NO: 28124 - protein, 292 aa, A.fumigatus
RPKAPNEPVPFIPEKDLEVYRRYRDPAFEVQVGIHELLGHGTGKLLQETAPGKYNFDVSNPPVSPITNKPVTTWYKPGQTWSSVFGAIASSYEECRAECVAMVLSCDFEILKIFGFGDGQVDLNNEAGDVLFVAYLQMARAGLVALEFWDPKTQKWGQAHMQARYSILRTFLDAGDDFVRLVYTKEDLSDLEIHLDRSKILTHGRPAVERYLQQLHIYKSTADIDAGKKLYSDITFVDEWWGTKVRDIVLKNKIPRKIFVQGNTILNGDEVTLKEYEPTLEGMIQSFVERNV

SEQ ID NO: 28125 - protein, 77 aa, A.fumigatus
GQEMAVYPSAQTQVADWIGAGNQPWMDSDCQSEKNEEKNVARESRLQGQPRYFEEGHPLWHWLEQRFQTQCSCELVR

SEQ ID NO: 28126 - protein, 695 aa, A.fumigatus
AEIISERKSTGSSDASFGDDRSIPAQSDKTLRPTNVESYDGCDKERAPSGDRRPRIRTEKSPSRSAVDGNDEDLPPLRGRKLRDRVKDAQIRMASPSLEQFREEIGWPPAEEEFRRYSGVSTSSTIEAMIIDAPRPANRKLRHTGKRQSLRSTSSPVTKSARTSLVSNPDSQHRLVHKDARITEQVRKSIASETSVPASATADGPPRNIEVVPVVVIPERRSSLRSSHSDSRNPSKAGSRRRSSQRPESARKDRPPSLDLTRQRKRTFSDSIVTATPASRPRGRSLGRRVILLRSSSLSAPTSRDSSRRPSFASERLPNQDLLMDREMDKIPIEQLEPRLDNQTSNAGRWDATDAPKTQSIWIGIEDMTHLRPPSILFTPASVASSSPGLIEIKEAKTVAFFPHNNESLLLVDQPVRAALDHPASQPDDCQRQRDSRTPENLLPQDSSHVHSPLRNPRPPPNPPVPNVIPPTPEDEADRQLRVSDERDESNGINLRRFGSLRRRVVRPRSDSFDRFVRSLSVASAKNRKAGRDIDSRLHPFWRPRRFWDDSPESEEPPQQAARTESDHIISNSLGMPQPRVVFDGPSLARRSPFQGTNPRRHPKRSSALIGSTMLSPEALRSQTSLHRRRMLSLSWWRLRLQLGPVRNFRRRLRRSLQQWEEAKREARREKLKQKIGEAVLVGSSMQARDLLNRP

SEQ ID NO: 28127 - protein, 61 aa, A.fumigatus
IAMSSFSLIDFDGMHSHDMNDVYDLLVCLLVPCLLCRRSVLTTLADIYDFPYEHDDLTPTR

SEQ ID NO: 28128 - protein, 580 aa, A.fumigatus
  UNSURE (570),(577): Identity of amino acid sequences at the above locations are unknown.
RLTARSTGTPKGVKISHETYTSSAIPRANAVGYTEDSRVLDFASYAFDVSIDSMLLTLGNGGCLCIPSDEDRLNDINGVIRRMKVNYAGLTPSVARILDADVISSLSGLGLGGEAVSARDVNLWGQDTRIIIGYGPCECTIGCTVNSSAATGRDYISIGPGNGAVIWIVDPNDHDSLVPLGAVGELLVEGPIVGQGYLNDPEKTAAAFIEDPSWLVAGHEGYPGRRGRLYKTGDLGRYDPDGSGGIVFVGRKDTQVKLRGQRVELGEIESQLRARLPSETTVIAEVIVPQGSGGQPTLVAFVAAQTTKGHDHTGLEAAELPDELRRALSEADAELAKVLPRYMVPTAYIPVNHIPTLISGKTDRKRLRQFGATVDLRQLDQDATNTAARELSDLERRLRQAWSQTLKLQAGSIRLQDNFFALGGDSLTAMKLVSVCRSQGLDLSVTSMFSNPTLSAMASVVRICDVDVQRTVPAFSMITSDMNSACVEAAEPCGVGPADIEDIYPCTPTQESLFTFSLKSVKPYVAQRVLCIPSHIDLNAWRKAWEDVVAALPIVRTRVAQLPEPGLQCXNRARWKXPIL

SEQ ID NO: 28129 - protein, 95 aa, A.fumigatus
RVFNERCCSFLRIIQVALPYYGTFYQQLSYRAERHERIMVVRIDYPDYCPITRANGDIVSSRCRATIHCASNRAFAGPVADNNPGVLTPEIDISR

SEQ ID NO: 28130 - protein, 65 aa, A.fumigatus
HSADILPRSGKHISYKQMSHAIQHAYNLAPSLADQLTSSAYQLDQGRGWIDLQDLSALNVSYQDA

SEQ ID NO: 28131 - protein, 295 aa, A.fumigatus
NILKTVAERKRVLDTKSKTACFYHPMKLKHQKKQYKYPCCGKRHGCASLPAHVYAPVPGFILENWQSYQLTPSPMPGLRPPRRVVALDCEMVEVKGGDSEVAQVCAVDTLTGEVIVDIYVVPSKTVTDWRTPWSGVSQRLLEEMKEAGKTVNGWEEARKALWAHIDADTILVGQSLQHDLDVMRMVHLNIIDTAILSREAVAKNCKQNWGLKRLCKQMLDRDIQQSRGGHDCLEDTMATREVVLWCVRHPGKIQEWAVSQREWKKKADAHGKLKRKESDKAQVKQPQKSVSQVPP

SEQ ID NO: 28132 - protein, 206 aa, A.fumigatus
AALLLGESPYSTGENLGKPEGQYYDAAPVSPVETDPFTEGKDLAPRQPATTAADSQAPYASQYYPQQGSNIYGGRPASANDDRSYDPSVASSEQGDEEYSSYRHAQGRPIEYPPAMSEDSEEYEHEPHEENYASSSLPASSAPLYTPTTVDYSGSGWGVGVGWESMTPRHRHPTRLSDVLEEDEPRTTPSRASRASRASQASRSVQ

SEQ ID NO: 28133 - protein, 288 aa, A.fumigatus
KAGTQNGATRTAQGPVPVNHHPPSGVRTPTDIMRQRRDREARKKAEQEAMAREQEEAEHRHQEEQAKQAQQTQPYAAGVAGEKPGQRGAAPRTTAAPGMTTNTSGMARRADSQIPRQPVPPTQQVPGAQQPATAKAAAPPSTFAKPQGQAPSASQSDPVQNQQQPRRVGFPHAFERWETLSSHWEGLTSYWIRKLEQNNEALERDPLSQQMARQVTDLSAAGANLFHAVVELQRLRASSERKFQRWFFDTRAEQERTKELQAELENQLKNDAGRPRRNRRLSTKGRDR

SEQ ID NO: 28134 - protein, 113 aa, A.fumigatus
STKMQPFIVLFTWLMGTAYAAPAFFDNIYDYSDELAEFYSKVSKYIDDSKDVLTATTTCDPSKISLPAFASGLPSPGNQKPLYVAVGRGTQVSNNCTSRSHIRRMANVADPTQ

SEQ ID NO: 28135 - protein, 115 aa, A.fumigatus
GVKQVKRTDLDARFLFLAPPSLEELEKRLRGRATETEESLTVWLSSTFLHFPNSPDCPAGILTLRQKRLAQAKNELEYAAQPGSHDKIVVNDDLEKAYKELRDWIVDGGNFGARQ

SEQ ID NO: 28136 - protein, 76 aa, A.fumigatus
LFTKHFRSCLHWVLVAILYDDPRSLWYIKLAMNITNSAGVLCAEYNGYSASTENHHWTFEVYSTQYSLWFVMHEDM

SEQ ID NO: 28137 - protein, 76 aa, A.fumigatus
  UNSURE (18),(62): Identity of amino acid sequences at the above locations are unknown.
RPRSPPGTETVSGTGIGXALGATELSPLLTVTILLATIPDVLSENAKMAANENKTAPEMKCXPRLRAREGSPYARA

SEQ ID NO: 28138 - protein, 148 aa, A.fumigatus
CSATPTTPHEDARTRTISKSRSRSRAKSPSRPTSRSRSPGPSDVDGRRSVRRALPTVDKDADDRERRRDAPKKSPPEDKFDEHSAAEDDRRSRSPSVDSKRSSHRRDREREDRNARRSHRPHRRSRSRSRSRSCNGDSHDVDRLPRIL

SEQ ID NO: 28139 - protein, 164 aa, A.fumigatus
  UNSURE (24): Identity of amino acid sequences at the above locations are unknown.
YVGNGGEKNSHCQQGTEFGRAESXSDTCPAHGLGPRWRSRSLSRSRYRSRSRSRLRSRSLSLSRSRSRSLSRSWSRSRRLESRSRSRSRSLSRSRSSSRRLERSFREIDALLSEREAGSYRIRGRRSTSCESPLQLRLRLRLRLRRWGRCDRRAFLSSRSLSRR

SEQ ID NO: 28140 - protein, 60 aa, A.fumigatus
MLCSPSGRQAPIESAGDDRHHVNLRCSSDSGFGCDSGDGVDATDVHFCPPVLYPAGETIV

SEQ ID NO: 28141 - protein, 234 aa, A.fumigatus
EELTVHHYRFHGEETYDPASPLTDAPTFVVDPIDGTVNFVHGFPYACISLGFAIDRKPVVGVVYNPFNNTLYSAIRGEGAYLNRNTKLPLNARSLEPLNGLENALIGVEWGSERAGNNWVTKVRTFEKLGKTNGDGGAMVRSMRSMGSAALNLCAVACGNLDLYWEGGCWAWDVCAGWVILTEAGGTIVDGNPGNWEATVDGRKYLAVRGSPNQAGQKELIEEFWGHIQGHLEY

SEQ ID NO: 28142 - protein, 332 aa, A.fumigatus
LLEPFIMRNQIGVTATHESELEAKKDEAHIEEVVLANLTEEDVFRISREALDLRSWTGFRLFLIIFVQGCNQAGYGIDWAVISGINALPAWHTYFGFGTSGGTYGLLNALMSIGIVCGAPFLSLADIIGRRGINFLGNFIVIVGAVLQGCAVNLSMFMAARFLLGFGSALLSSSQYVGEVAPTHLRGLIVGIFGACFQIGSLGMNGAMIGLTKIEGNWSWRLPLLLEAVFPAIVCATIYLLTPESPRYYIMRGRRDAAKQMVARYHTTSGDINEPIVEIVVSQIEASLEHDRTGFNQFWDYRVFFTKMARFRLLVLFVYSIFQQWNGGGIIT

SEQ ID NO: 28143 - protein, 96 aa, A.fumigatus
IFTGLATMILFQFAATITSWQFDVTGNTAAAALTILWIYLYQTFSAMLIATMHNLYPVEVLSLPLRAKGMGLYGLIQGGAGAVQTYGISGLHHRAS

SEQ ID NO: 28144 - protein, 160 aa, A.fumigatus
FRSFSPRSKLLFSRSGARAEWDVVGRKADIDDAVVVDAVLSLDQDDLNEKLIGIKKVTGGGLQESLFVNGVAFKKTFSYAGFEQQPKSFKNPKIVCLNVELELKSEKDNAEVRVEQVSEYQAIVDAEWQIIYNKLEAIYKTGAKVVLSKLPIGDLATQYV

SEQ ID NO: 28145 - protein, 246 aa, A.fumigatus
FGHAVRLKFTLYVVDGTLTNVYAVYRYFADRDIFCAGRVSADDMDRVCQATGAATQSTCSDIHDRHLGTCGSFEERQIGGERYNIFSDCPGAKTCTLVLRGGAEQFIAEVERSLHDAIMIVKRALRHTTIVAGGGACEMAVSHYLHDFAQHDPSKQQAVIRAFAKALEVIPRQLCDNAGFDATDILNRLRVEHRKENTWAGVDFDNEGVRDNMAAFVWEPSLVKVNAIQAAVEVFTTGVAGAALEY

SEQ ID NO: 28146 - protein, 190 aa, A.fumigatus
  UNSURE (112),(114): Identity of amino acid sequences at the above locations are unknown.
ELRVLAALEELRINGLDHVDGAVDAIVELLKGFLVVFHRHDVGAGEAGDGVLGCVADALHLEAQREHVWVETGLGELGEGDVVFFGVFFGLFEHESQGVQALEVGGDGVGVXRXGHFDCVLSGRPSEVRIEFVISVPVVLSFAIEMLGFRLIYTSSDCPANGSSSEPRRRYGSNVLNPSGGTSNGISSAT

SEQ ID NO: 28147 - protein, 179 aa, A.fumigatus
  UNSURE (12),(14): Identity of amino acid sequences at the above locations are unknown.
RSSTQDAVKMTXSXYTYTVPTYLKGLDTLTFMLKKAEEYAKENNIPLSEFAEARLYPDMLPLSFQVQCVSNTSKNSVARLSGTDIVPMEDNEKTFEEFYDRINRTIDVIKAVDPKLFEGREHTEFSVKLGSYESTFTGESYVNRFGLPNFFFHLNIAYAILRSKGVPLGKFDYLKYFNS

SEQ ID NO: 28148 - protein, 96 aa, A.fumigatus
ISVPSALVCTPPDRARTRNPRFLFNAVLSKIGLDGRCSGNAYSSSPYWSHGLMAWFLTCVMQPMGKLVVGQNKSMHEAIRKRALRKAEREKGKKST

SEQ ID NO: 28149 - protein, 78 aa, A.fumigatus
YGKTGRRPANQVWIGCTKRDVYSGAYSNRSFRYSSLLIVLISLRSLCPPTLDLNSHAVTNISCRGQGTYGLKANQCPP

SEQ ID NO: 28150 - protein, 220 aa, A.fumigatus
SIESEYVVTGHAFFNVTAYTIIGEGYIPMTARLSLLDQSGSESPWAEERPEAATPSPAWQNTRTDSQNMSSMPHVVRGNGSTSPFQTSYIGNEPGYSSQYLQQADHGSLAPGSGIETPYVTDSTMTTPSSHELIEVDEPSHAGAEPTTQLLSRNTSAAPAPPLPQPPNADANQAPPLPLRNAALSESDEQQQNEQRSETYTIRHVNWDRPHRGNCQSLPS

SEQ ID NO: 28151 - protein, 99 aa, A.fumigatus
AVCENQPIYPVLTSCPLYYSIYCLEKNKPSAAWNFINSASHMIQALGLQHNVPAGTEQPGVKAQNRSLFWTIYITEKMLSLRLGCSSTFRDQDITLARP

SEQ ID NO: 28152 - protein, 135 aa, A.fumigatus
QLSIFATPPDKMLGYLPLFASLASAATLYATHYSGAVYTLSLTHRNGKYNLSLASDMTTCGGMPSWLTLDRDTTTSTLYCSDETGDATTNGTLTSYAVGKDGSLTQLAKVVDVGGGVHSVVYEGEGGAKYIAIAH

SEQ ID NO: 28153 - protein, 279 aa, A.fumigatus
  UNSURE (23),(27): Identity of amino acid sequences at the above locations are unknown.
QQRSSGSAVSTFALPLESGDEPXQILXYQTPPGPLPQQDSSHPHQIILDPTGSFILVPDLGTDQVRVYAIDKQSGQLNTCPSLNYTPGSGPRHGLFWSSHHSHRDGLRIQKTAALTAPHTILYTVSELSRHFHAFAVSYLPSGCLGFRETQDFVPYPGGEITEGASLAELQQAGSNLYASIRSDHAFSGNDSLATLNRSQNGTVTFQELTSSYGLVPRTFVINRAGTLVAIGDQSSSNVAIVSRDSASGKLGDLVANLQVGEPGKPGTSTGLSSVIWAE

SEQ ID NO: 28154 - protein, 459 aa, A.fumigatus
  UNSURE (455),(456),(457): Identity of amino acid sequences at the above locations are unknown.
SQGAGVSGVGSLQRLLTQGQLHSAKLLAGWTSCTGGRALREKKKEEKLREEIEQDLVVSCATPAVFSGPSSLGNSTGLLPEAALRETLSGFGLHNMTPDDAWDFLKAKLLVIFDGEDVRIAIEDLNKLVLIHIQRCVQKHTPTAIVDDLRELLETGCASLNHTLNGVPDEKLVPHLVQIWLLVFGTILPFIQAVFLPLDLEFRGAGSVMNLREAKDFWNSVPTGKDFENELEVRHLVLVAFRDMVILKRYEGLKATFSRLSLDSINVGSSALSITTKSSNNSGRPATAASLDAGFGSYNSQSSTLLNTAGSYSSDSMSNRSRAASNTSSNPDQLIFQSFSSPNQRATVIHRASHTADTSQLITETVGRMLQCLSVLASVQTGDEAQEKIETLSKALKHNWLGRGRTGRDRRGFVGAKVRPSITTHTTSDDSMNDPRNSDLGWSSPRGWEVPKSQXXXFN

SEQ ID NO: 28155 - protein, 211 aa, A.fumigatus
SPGGGGGGGGGGGGGGGGGAGRGGVAGGGGGGGGGGAESKGFPTGKELRVIPFQQGEGGLSRVRRGVNQGLVRGVGRGGGGGGGGGDGGVEWDASVNPGSTRGQPCGGGGGMGGRGGSGEAGGWGGGGGGGEGRDGAGERAWVGRRGAVGGRVIPGRGGVGGRVAPASPNAGSTTFSKTVGGLDLLHGWSGASRKKERGEAEGGNRARLSG

SEQ ID NO: 28156 - protein, 124 aa, A.fumigatus
PCVRRRWSDPTPDTPAPWDHPASNCSTPTHPRPLPRTIPPLPPAPPPPPTPSLPASPPPPHPSPPPAWLSPCTSRIHRCVPLHPPIPPTPPPPPPPPHPPYQSLINPPSNPGKPPLALLERYYP

SEQ ID NO: 28157 - protein, 142 aa, A.fumigatus
PLSLALFPPSASPLSFFLEAPDHPCKRSNPPTVLLNVVDPALGDAGATRPPTPPRPGITRPPTAPRRPTHARSPAPSLPSPPPPPPPQPPASPLPPLPPIPPPPPHGCPLVLPGFTDASHSTPPSPPPPPPPPPRPTPLTNP

SEQ ID NO: 28158 - protein, 67 aa, A.fumigatus
VRPRSGFGVLRLDTYFVLGRVSGIAGGGRLRVLRALWGKVDNLEGRPDAMDNAAVRDTGHIRVNERR

SEQ ID NO: 28159 - protein, 210 aa, A.fumigatus
YKAQFMLQTLADQLKESAGQGTRDIAGAAPWTGTESLHDATLRMLDSSKKPMRVPYKIPHPAPVDMRISPKPSKSPGLRIADAKERSATYTMSQRPGISEDEREALRREMSERFTAGARPMPMTLQGLSSLANERIEDAIARGQFNNIKRGKGVNVQSDHNANSAFIDTTEYFMNKIIQKQEIVPPWIEKQQEFTREVGLTPRRLEGHAY

SEQ ID NO: 28160 - protein, 80 aa, A.fumigatus
RMWAKVFLSYATCMSVTQLLIQILYAGITEVQIIQWYVEEGAHIEEWKPLCQYQSDKAVDDVSKFFSIPLSTYLTIYQSR

SEQ ID NO: 28161 - protein, 62 aa, A.fumigatus
DIMGLEKQTLRMGNGKDHPQPGDPVELNYTGYLYDESNPDHHKGKEYVTAVTNTHRQRRKAS

SEQ ID NO: 28162 - protein, 76 aa, A.fumigatus
EFLARGGRFVLSDDSHGLDQVGFNFHGVLAFMEKAGISTLHYLELGDEPAVDERFPRTQIRSIHVSELKKMSFWQV

SEQ ID NO: 28163 - protein, 247 aa, A.fumigatus
SLVKVLGGGSASQEGLSLFLVGFIIDQELVQGATGGNHGEHGHLAVSEDLKQSGTIALDQPLQLLLHLRRLSAALSSDTHRPSHGHKVRVLLVGMRVPVLVKQVLPLCHHALLFVVQKEDLDADVELSSRGKFSKSHVERSVTIDINDEAIGACDLGADSSGKAVSHGTETTRGNHGAGMAPTEVLGSPHVMLTDTGSDDGAVFDGGSEIAEFLNQGLGLDGALRALLLVQRKGEAGFPVIDLSTPL

SEQ ID NO: 28164 - protein, 61 aa, A.fumigatus
  UNSURE (1): Identity of amino acid sequences at the above locations are unknown.
XRKRVTFQPRGEDSMLGMHGSAYANMAMQEADLIIAVGARFDDRVTGNLSKFAPQAKYGCI

SEQ ID NO: 28165 - protein, 310 aa, A.fumigatus
PVTSPSLLLRPSMAASEKRGGIVHCEIMPKNINKVVQANEAVEGDCAHNIRLLLHHVNPVSETSQWCAQINDWKARFPFSLYEKQSPEGPIKPQALIEKLSDLTAPIKDRTIITTGVGQHHMWAAQHFRWRHPRTMITSGGLGTMGYGLPAAIGAKVARPDCLVIDIDGDASFNMTLTELTTAAQFNIGVKVLLLNNEEQGMVTQWQNLFYEDRYSHTHQKNPDFVPMARSMGVAAERCTKPSEVEEKLKWLIESDGPALLEVFTDRKVPVLPMVPAGSALHEFLVYDEANEKERKALLRSRTAPEYLHK

SEQ ID NO: 28166 - protein, 143 aa, A.fumigatus
PFMSRVISRSNTVIIHHPSSLAMDKLQLTLHALQHQSIHFLKLYAQHPWLYTAACLTAYLTLTLSLRFQRLRSIQAKYHKYSTRASFASMTDHDAWAIQKRILQLEFPFTALKALQFALFRVLPPKAFPACSPRAPDPAIVGG

SEQ ID NO: 28167 - protein, 413 aa, A.fumigatus
RMKMCVRKSYPCDTLFVLSGVSIRLARKMGLHRDGSLLGLSPFDAEMRRRLWWHLVHVDFLLADVLGTRPSMDISCADTKTPLNVHDADLHPDMTDLPPERHGITNISLCLIRYQIMVSLHDFSTSSPADMRWEVLLGPNVPPAKKDHIISQIEDHLEQKYLRYCDPANPLHTFVSIITRFSICKMKLVAHNPRQFACSPPKDLQAERDIVFANATKLLEYVALVQGGHCGLEKYTRQIGTSALWNAMLYMLIEIRHRGTGPEVDRSWQLIGVVFSCPRIFGRTPPQVDTVLRKWTLEVWDHYVATSKIEGLPEPLTPEYINEIRRWIRSRSDLSRNETRAAERDPVAEPSFRCAQVTYEGHERLPGFPELLTLTSLMTFCLSRWTRMNGSSGSSWSQGGPLLSARIHALEKD

SEQ ID NO: 28168 - protein, 89 aa, A.fumigatus
FGQYAAVMGIRKDLKLVGNDFSNAATWFFIAYLIAEAPLGTFHASDDVCILLISATFSSNSSAKDSSSQMARSKCLSLGGCCGGRCGHP

SEQ ID NO: 28169 - protein, 438 aa, A.fumigatus
SQRLPSVRFMHPTMFASYSSPRRSPVILLQKTPPAKWLGANVFLWGVAAAAGAGTRDYPTLLVARIFLGIFEATVGPSLMLLSSQYYTKSEAAPRFTLWYVGLGVAQILGGLISFGFQHVKNPSFQGWRVMFLVLGLITSITGALTFFFLPDTPMKAKWLTDREKVALLNHVSVNQTGVWSSDFNIKQIWEAVCDIQLWFITIITMLVCMLACPIGPANFPITDTSIAQISVSSGVVTSYSATLIAGFGFSGPHAALLNMPSGIVSIFFTLLVGFGIRRVSHRWAWLIASTLPGILGGGLLSFLPKHNKAGVLIGIYLVNAIVATLPILYQWTAANCAGHTKRAFASALVAGSFSVGNIIGPQTFQARDAPEYRPAKIAVLATQAAAAVLSFVLFLYYVWENKRRDRAAQGQQEDQAPDDTKWAGLTDRQNKAFRYVY

SEQ ID NO: 28170 - protein, 192 aa, A.fumigatus
QQQEWQTASIPLHNIGARQTGGGNDFTRDRMGRYIYLRRNDSQSNIHPKPVVGWKVCPYTESISVRSTRCPMTPSQLIREEAVWRFSLPRVLSTPTTMLETTEPIAHASELDKPSIVVTNTEVDSEDNTSSVLGRYIPQKCLQNARLAAVNSCVNEIFEARFRERPDAPAVCAWDGSYTYRELNDRSSALAH

SEQ ID NO: 28171 - protein, 125 aa, A.fumigatus
RTLEPVPIPGNIDTTTYGFTPLCLAAKNGHPAGVRLLLEEGANLILPDKNGTTPLMHALAEGHSEVVYLLLEAGAQKESTPLEVAVENNKKSAIRNHLAHGANYDLLARESSLSWTINNRDQEAV

SEQ ID NO: 28172 - protein, 72 aa, A.fumigatus
LICPCSCSVTTRRPHGTLSPAQHMQAPEANVAFESMTWIVSMETYARMSPSTIYFYLQLQRCFTGNQERKLH

SEQ ID NO: 28173 - protein, 135 aa, A.fumigatus
LTATLCRFISLVAAACMVLYGYDASVYNSVQGSKNWVKFFNDPDENMIGAVNTAYTVGAIFGGFFLGGPIADYLGRKIGMGVGCVLVIASTFMQTWSPRGNIGCFLAGRLIIGIGQGIALSEYPLPMECILSCTN

SEQ ID NO: 28174 - protein, 133 aa, A.fumigatus
LTSYTLSWRGSFQSSWRIVRVTRLCIESEKRMVEKYTPGAQSQSLVLVSQALDCRRVLVVLYTTQMLKDNTLPRGPKRQIYSLREGSRRDGARGDRNEQEPAHYIRPWDTHAHGRILVNTRKKAPGNSPISID

SEQ ID NO: 28175 - protein, 159 aa, A.fumigatus
WILTRSPGARHNLAHSYSLPVTIQELGSLGTGPEEHVDNPLATTLSLPMNYGPSFTGLETLRMNIAALYGSESEAVISPSNIITTPGASLANFIVFFALVGPGDHVIVQNPTYPQLYSLPSGLGAEVSLWQASESNHWQLDLDELERLIQPNTKMIVLK

SEQ ID NO: 28176 - protein, 214 aa, A.fumigatus
HSVSVSNPQNPTGAIITKSALGKIVDLARRHSITIFSDEIYRALFHSIPSTDPEYPPSVLAFGYEKTVVTCSLSKTFSLAGIRVGWIASHSSSIIDLCLNARSYTVITVSQIDEQVAAMALEPVRLRELTKRNLGLATHNIEIVQSFIDRHAAVCEWVRPAAGPVGFVKFSRNGVPVDDLELCVLLLEKKGVLLVPGQKCFGEEFKGYGLHRGT

SEQ ID NO: 28177 - protein, 138 aa, A.fumigatus
PVSYDIKPIIIENRRWDPLTGVTSAAVGTGTDLLKSTTNMFYKPYKELARNKTDVAPDGAERHPVVTAGAMAGQFAKSFGQFMGSYAKGVIVDIPHAAAESFRQVPRLYGEQPKDYGAVQDWNSGATVGGKNFVDGMM

SEQ ID NO: 28178 - protein, 143 aa, A.fumigatus
NILISIDVCGFFFRQPPSYQPPPDLEQFLASGPPPVYIGFGSIVVDSPQRLSNTVLQAVAASGVRAIVSRGWSKLAGDGNPNIYFIGDCPHEWLFQHVSAVVHHGGAGTTACGLANGKPTVVVPFFGEWVCIPPYTGQELISM

SEQ ID NO: 28179 - protein, 255 aa, A.fumigatus
MCVASSSGNPRRTNRRQISSNSLLQAHRLCISALEASLWTARNACPIQCCRQWLRLVFVPSCHEVGANWLETGIQTSTSSATVPTNGCSSTFQQSSTTEVLGLPPVDWPTGNQQSSYLSLESGFAFLRILGKSSLVCSQQFWGNMIARAGAGPSPIPHATLSIRNLAEAIRFCLKPQTVAAAREIAAKMQFESGVTAAVQSFHRHLPLEQMRCQVFPDQVSVWKYARHKREIRLSRKAVQILIDHLKIDPKNLRW

SEQ ID NO: 28180 - protein, 281 aa, A.fumigatus
SERGVYIVANTLRQTQGIVVTFRHWRVIFWLLTALTGFAVLLIIIFLPETIPYKSKAELAGHSHPKRIKMLWQRISPLRAIIIPLSHPNIFITGLAAGALVWNQYSLLTPIRYVLNPRFHLSSPIRAGLFYLAPGCGYLAGTFVGGRWADYTVKKYIKKRNGQRVSEDRLRSCLPYICIVTPGCLLVYGWTLDREVGGIAVPVVAMFLQGVAQMFCFPSLQSYCLDVMQPHGRSAEVVASSYVFRYVFAAIGTGVVLPATQSLGVGWFNTISALFLVFAGV

SEQ ID NO: 28181 - protein, 62 aa, A.fumigatus
PSRCPIFHRLGFHTHNHPQWEFYFYNVVFGLFQAPYYAVRSTTSPSPFETRLTCPTPREMHT

SEQ ID NO: 28182 - protein, 77 aa, A.fumigatus
GRILVAPVVKTSCIAMLGENEKPDVTYADVGGLDMQKQEIREAVELPLTHFDLYKQIGESESSRAMSSAVCLRYSRY

SEQ ID NO: 28183 - protein, 258 aa, A.fumigatus
RISTFTNRLVSRSHRGQCLVRFAYATQGIDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQTSNVKVIMATNRADTLDPALLRPGRLDRKIEFPSLRDRRERRLIFTTIASKMSLSPEVDLDSLIVRNEPLSGAVIAAIMQEAGLRAVRKNRYNIIQSDLEDAYAAQVKTGQEADRYALPCIPIY

SEQ ID NO: 28184 - protein, 109 aa, A.fumigatus
PSLGDLGGSFAPRGEDSAGENPVNLLPHLQLFGMDSDCNKRGAKICVTTTNLIKKTPRYSPEESSDHRHPSFAIPDLSAKNSSKIVIEVLVEALTSDREINHFRQIHIL

SEQ ID NO: 28185 - protein, 194 aa, A.fumigatus
LNRLLRAARDAENAQSHEYVSLVEAVRLEHVQVVEIQIKSEPLRTQLISEINGECERVLKVLEAAQTLGEISARCVDKVISTGEKLSCRLMAAFLQDRGVDSQYVDLAEVIDFPIGSQGLDQDFYNNLATVLGRKIRDCEGRVPVVTGFFGTVPGGLLDQVGRGYTDLCAALVAVGVHAKELQVWKEVDGIFTR

SEQ ID NO: 28186 - protein, 97 aa, A.fumigatus
KLLRRCSAFATPAKLFKKVSLLPAPITGPLSYMLNSCICKAACSCHTRPSSMGDQVQSDSSPYTLSMTNGSSNWVVQKFGGTSVGKFALNIIDHVVL

SEQ ID NO: 28187 - protein, 158 aa, A.fumigatus
YFWVKSILYAMAILHNENRPRGLRVPSLSAFKSKKAIDHEPAPAATPVSTAPSAAAPAPPAPVAPPQYPVRTDSAPIRPARPQNDKELPPNPLPGFSSHIGIPRAGGYPPSPSEMNRQLRGTTIMHLLPEPATNHQSRSRLNRPLPARAQYRQMQATH

SEQ ID NO: 28188 - protein, 221 aa, A.fumigatus
RHPDLVINIPTISNRHFLIFSENKNGDSVAIVEDLSSNGTFVNDAIIGRNKYRELEDGDEITILDEARFVFRYPRTRDTNGFRQQYRVLQQLGKGHFATVYLCVERATGTQYAVKVFERRPGDSQKSQNESLQQEIGLLMGVNHPNLLCLKDTFDEADGVYLVLELAPEGELFNLIVSRQKFSEEETRHIFVQLFEGLKYLVRSLFIGLQSTLPVPAEKKT

SEQ ID NO: 28189 - protein, 99 aa, A.fumigatus
DPCSLDCNLRYQSQRKRRLELIQTQHDRGIVHRDIKPENILVADKKLTVKLGDFGLAKIIGEDSFTTTLYVLPLFLQIAFFLLPWLILLFTDVGHQVVS

SEQ ID NO: 28190 - protein, 60 aa, A.fumigatus
MSLQRSYRSPVVEDTPRLWTSGHCGVVLYICLCGFPPFSDELYTRENPFTLAQQIIMGPI

SEQ ID NO: 28191 - protein, 192 aa, A.fumigatus
LNSQFIIIITIDSVFVLIACVDSTLICVHYCFSLPFFIPADFLTLCYLRSWHCSTRTPPASASFLSSNLSRSYHPIIVHLPSQSIHYQAFHSHPFSSSSVTFSHFSQSHKIMATTLTDQKRPQLQPVCQNCGTSTTPLWRRDELGSVLCNACGLFLKLHGRPRPISLKTDVIKSRNRVKTAGQGPKRKVSLG

SEQ ID NO: 28192 - protein, 252 aa, A.fumigatus
GLLDSNIALFQSSSAVDANGLPTSRSEDGTPPLGSQGYRRASRKASPGHSDRSNSPVSRTDTPGVSALQQQQQHQHQHTSNIAPQHMFDSVTLADHTLNQPNGLPSLQLHQPSPTSTSSAAVDRHADAPQTYEGLLAANASLKTRVSELELINGLFRGRVAELEQSDATARRSEMIVRDSEARLRRSLEEAQRREEELKRRVSDLERQLADQANSNNSANNDSPGEPLSKKIRLSDMVEQSSASPTKSPKSI

SEQ ID NO: 28193 - protein, 67 aa, A.fumigatus
LPLKVTHTPFELFFSTLRFFERPAKTCFRISDDHLGPACGRVALFELRNAAPKKPVDEFQFAHARLQ

SEQ ID NO: 28194 - protein, 132 aa, A.fumigatus
PSPSSTPAAVLEPSASHPQAAPLPSRAASSPSESTTNSTTQICTPACTWTPSDASRTCSHPPSSHADAPQSASGTPSRRGRRSPPAPCGLAACWSCSRSATDPALLWFLSRSLRRRSRCGIPPPPYPSTPVP

SEQ ID NO: 28195 - protein, 174 aa, A.fumigatus
CLANRLQNRLRDIRTSPLSTSSSVRRWSTVRSRINILYDHPLLLYASANGHQMWWHADNSTYGWLLQGFATSDNITGPYTFVDATAPLGNWSQDFGLFTDYKDGRSYALYSNGDSKYGRDVYLTAYNKNVSALEEVVYRFPKFDLEAPTIIQTEKSYWLFTPGAGRNRACVRKQ

SEQ ID NO: 28196 - protein, 140 aa, A.fumigatus
ISCMIILSYYMRLLTDTRCGGMQIIPLTAGYCKDLQLPTTSLGRILLLMPRHRWATGRRILDSSPTTRMAAPMRSTRTATASTDATSTLPRTTRTSARWRRSSTDSQSLTWRRRPLSRRRRVTGSSPREPEGTAHALGSN

SEQ ID NO: 28197 - protein, 66 aa, A.fumigatus
VVKTGSLVSDYDVDHECMCKANTACNSIYYMSAYMLLEITVTARLRDDLRNLEFSKDKNCFFAFNA

SEQ ID NO: 28198 - protein, 254 aa, A.fumigatus
FIDVNNSIHRTKTTPHPINPPARDKVEMGWLWRSSPSKEEPQQISSVPSFSDNAAPQPSPAAEAPGTMPSSSQSRPLSRKEQADAEFNQLLESLKADVSRTKSPQQSSNVSETPLSPSSPSPSGPPQPPSSIAPESLYPDSMSCRSAFDYAFFCQSFGGQFVNVYRYGELRSCSEHWDNFWLCMKARGMADEERKKVIRDHYRKKAIKYKTGPSSEDVWDLRREPVQHAFQGDFEALEREMKAEEEASRNAGGI

SEQ ID NO: 28199 - protein, 525 aa, A.fumigatus
APTPSRFFQPGLNTAVTGRGIVARHKEYAFYRPSAVSIARVVMDFPAIFCMVVPFTIIMYIMTGLDVTASKFFIYFLFVYTSTFSITSLYRMFAALSPTIDDAVRFSGIALNILVIFVGYVIPKQGLIYGSIWFGWLFYVNPIAYSYEAVLTNEFSDRIMDCAPSQLVPQGPGVDPRYQGCALPGSELGRRGVSGSRYLEESFQFTRSHLWRNFGVVIAFTVLYLIVTVLAAEFLSFVGGGGGALVFKRSKRAKKLATQTTQGNDEEKVQDVGDKAALSRGEAMSASNGESFKRISSSDRIFTWSNVEYTVPYGNGTRKLLNGVNGYAKPGVMIALMGASGAGKTTLLNTLAQRQKMGVVTGDFLVDGRPLGADFQRGTGFCEQMDLHDNTSTIREALEFSALLRQDRNVSKQEKLDYVDQIIDLLELNDIQDAIIGSLNVEQKKRVTIGVELAAKPSLLLFLDEPTSGLDSQAAFSIVRFLKKLSLAGQAILCTIHQPSSMLIQQFDTILALNPHSATEWKDRV

SEQ ID NO: 28200 - protein, 64 aa, A.fumigatus
RRGQTSIVAVVRIWVFSFGVFCIMGGLYYLLQGSTGFDNLMNGKSFSRSVKQRSLEDFGKLTIS

SEQ ID NO: 28201 - protein, 258 aa, A.fumigatus
  UNSURE (36): Identity of amino acid sequences at the above locations are unknown.
ERSTDASSKRRRSIQSKPLTNSAAPAEDVEQDDRAXEPSGPTYRNRDPFDAFLEPFYYNKSLTDPINTAKDKWNLLPAFLKVKGLVKQHIDSYNYFIEVQLKKIVESSSTIRSDIDHTFYIKFTDIYVGSPCRADEPQDVTPDATPSDVSPHECRLRDTTYAAPILVNFEYIRGRQRVTRKGVSIGRMPIMLRSSKCVLANKTPSEMTVLNECPLDPGGYFIVNGTEKVILVQEQLSKNRIIVETDPKKEIVQASVTR

SEQ ID NO: 28202 - protein, 112 aa, A.fumigatus
DSLSSSRGCEDVEYRAKYYEYTIRAMLQAVGVSTEKLRFVLGSSYQKSPEYVMDVYKLCSLVSEHDAKKAGAEVVKQSNNSPLSGLLYPILQVLDEQHLDCDVQFGGALPRL

SEQ ID NO: 28203 - protein, 126 aa, A.fumigatus
ARRPGASRLPRYQADARRLQERYCMYRSNLQRKGLSGPVLTSLQLTPQLLKPAVAEALVELMAPIITAFEASKEWQEITLKAYPPPEKKKKEKKQKDKGNRYPGAKTAETAELPLREIGVQEPTAD

SEQ ID NO: 28204 - protein, 100 aa, A.fumigatus
SPVESKIDLLEAADTVRKKIRKAQAAPKEVENNGVLSFAEFVLLPASALKTGRPEFRVSRERDGLEPLVYHDIKQMQEDYKNDIVCTGAICSARGYLARY

SEQ ID NO: 28205 - protein, 238 aa, A.fumigatus
KNWRSFFRPRGEDERGWVVYSNWGSREGKGGQVFGVNAGGGDFPGAMPRPDEDESLLQDVQGGNRWAALTFCWSALERQVRIEGLVEPLSREESELYWNTRERGSQIGAWASWQSKVLWSAEPETLVDRRRKSVAAAAHVQGSTPTSGCPEIPADIDETDIDDGRALLEKRVQEMEARFAGVEKIPLPPFWGGVRLVPESVEFWQGRRSRLHDRFRYVRVKESDDDSSFQWQIQRLSP

SEQ ID NO: 28206 - protein, 86 aa, A.fumigatus
RRSMKMATSVAAGSGTENSGGFNTFGNAKVGNLDTALVIHQNVGTLDITVDDVSAMEVGKTFQYLTYKILDQRLLEGVVLFEHRSN

SEQ ID NO: 28207 - protein, 287 aa, A.fumigatus
FWTPKNWMEDSLIGGGSSVRFFLAIQPITGELMAFKQVEILSGTKGTEFDKRKNSMVTALKHEIELLQGLHHPNIVQYLGTSADDQYLNIFLEYVPGGSIATMLKQYNTFQEPLIKNFVRQILEGLSYLHSRDIIHRDIKGANILVDNKGGIKISDFGISKRVEASTVLGARASGNGGGHLHRPSLQGSVYWMAPEVVRQTAHTKKADIWSLGCLVVEMFIGAHPFPDCSQLQAIFAIGSNSARPPAPEHASKEAMAFLDMTFQVDYEKRPSADELLQSPFLSAPLA

SEQ ID NO: 28208 - protein, 87 aa, A.fumigatus
YGSFQRPPFFDLHPITLRRPSFPWFFIIIVASLLSFNNPFLLLILNNFPFIVLYFPRIVICLPFFTPPLSLLGIIYRGLGHPLLVVD

SEQ ID NO: 28209 - protein, 74 aa, A.fumigatus
SIIGDPASLVLIGSYLSFNFRMFHLQFKFGLLIFVWVIFAVMNTKYVRSTEYCVQRKLPQPPLYQPLLLLSNAP

SEQ ID NO: 28210 - protein, 487 aa, A.fumigatus
RGSGTSREYRDGRYYEERKPADAAFFEDDYRYTEEPRPMSRKYDEFERRRPRTKPTEEKKKSKAVPLDHLRTGKDTARESVKSTHTSRAKYRTKERRREAYEKLERAGPYYDSEDDYSDASTSSASSIYVKVKVKRPSESRRSRDSTSRKTKSTDSSRRSERARYDDDDDYSDEWDSKHEKLHTTAQDYILRSKAAPVESDRRRRSSRSPVRHHGYECAEPEPSTSRRPVRSSRSSRKDVRPAASRNGSYEHLESQSRSYETKRPSMPTAATSPSIKVSSSTVRPSLQSSRSASSAQSQSRSRREPPSRVEQVLLNMVRSSVKPRGVERYDSGYSSPGTPEMASGDSPTKTSTRYKIKEQDATVVEPVMPPAPTSSSRHTRAYSPPRAERPSTSTRSAPKPVRSSTTYAYPSEPSSRHESTRPSASRQSSSRLFGEVEYSAQFKEKDIKYVREIRPEHIVYTRDAYPRQHYDEYRQPPAPRRQSTYA

SEQ ID NO: 28211 - protein, 89 aa, A.fumigatus
SSSRVSHIRPLGKAWRQATMKVPPFSHLRFDLTLPKATEGRNHSFQKVYWDIGNPQGDTLSVEARVVMNLVVTIATVFTRGLQGAALLL

SEQ ID NO: 28212 - protein, 68 aa, A.fumigatus
LISGPRTSLAPLQSIPYALAAGHGQHPHSLTGLGTTTSHCQELNTTRRIKGVVMTTEVIVNRTLSFGV

SEQ ID NO: 28213 - protein, 87 aa, A.fumigatus
TAILELVAWLGTFINGYLADATGRRVTVVIAVVVFCVGVIVQACTKNPEYIYAGRFVTGLGVGNLSMIVPLYNAELVCSKDRYEDHA

SEQ ID NO: 28214 - protein, 106 aa, A.fumigatus
IGYGTNYIGGTGEGQSIAAWEIPVCIQILPALVLAAGMLLFMPQSPRHLMNQGREEECLQTLARLRDTSVDDISVRIEFLEIKALRMFEDEVARKIFTRGLEGSTI

SEQ ID NO: 28215 - protein, 110 aa, A.fumigatus
ITSKLWNTHHEPEHVEGALDQTLRDLQVDYINLYLIHWPVSFRYSTTTNQPVDAETGLVDVIDVPLKDTWAAMEKLVDKGKVRSIGVSNFTRQRIEELMTTYVFRNFVAR

SEQ ID NO: 28216 - protein, 81 aa, A.fumigatus
LQVRRARIPPAVNQIEAHPYLQQRDLLEWSKQQVCLCLHAAKHGVYIADGVGNRHHRLLASREQYLQHPSVSIRQPHNAPS

SEQ ID NO: 28217 - protein, 63 aa, A.fumigatus
RPRAVDDPTVIQVAKELGKTPAQVLISWAIQRGTSVVPKSVTAERIKSNLEGKCGPDSMKVHH

SEQ ID NO: 28218 - protein, 114 aa, A.fumigatus
NKGRVSQPCGVEQCQSSPTKVKKPVGTALKAEYGHIDAAAVYGNEKEVGEGIKLSGVPREEIFVWGPSQFLLTALTAIARSPVNYGTHTTNPNTSRGRSIKHSAISKSTISIST

SEQ ID NO: 28219 - protein, 339 aa, A.fumigatus
RKEFVKNSPAFQVHKGVFDVCKTIAEITIYTASRSLQGKEVRSKFDSTFAELYHNLDMGFAPINFMLPWAPLPHNRKRDAAQRKLTETYMEIIKARRQAGSKKDSEDMVWNLMSCVYKNGTPVPDEEIAHMMIALLMAGQHSSSSTASWIVLRLATRPDIMEELYQEQIRVLGSDLPPLTYDNLQKLDLHAKVIKETLRLHAPIHSIIRAVKNPMAVDGTSYVIPTSHNVLSSPGVTARSEEHFPNPLEWNPHRWDENIAASAEDDEKVDYGYGLVSKGTNSPYLPFGAGRHRCIGEQFAYLQLGTITAVLVRLFRFRNLPGVDGIPDTDYSVSYPCPI

SEQ ID NO: 28220 - protein, 72 aa, A.fumigatus
LVLFTLCSQALRYIIRNTTLPQRVRAQAQLQLSQMHAYTRPTQIKNRCVAGGIARSVIRDFRIARVSDFIAC

SEQ ID NO: 28221 - protein, 160 aa, A.fumigatus
WRALKLKTYLESGRYDSFSNITRNSLRHALAEHGEKPEKDVIDEILRAYDSLSTFPDVPSALGQLAHRPEITAVVFSNGTQDTVTNSVHHSPDLSPHRAVFKEIITVDEVRQFKPAPAVYAHLAQTIGKLPSSQMADLWLVSGNPFDVIALGVVVCTPSG

SEQ ID NO: 28222 - protein, 159 aa, A.fumigatus
VFRSKKQQSSPLVNLPTEILVQIFSYINLHDTIALSTSCKYLLSILSFAAFPGDFLFKKLPDLAPIKLILFLLGLLWPREMNGRPKKGLRYCNACRRIYPEKRQYWEEKLSMKISRDFLNRDCPKCYLGHKRTYMCLCHAAFIKRWEQICAEHIGWFGN

SEQ ID NO: 28223 - protein, 522 aa, A.fumigatus
QCVSFQPRGEDSSWISINYLPLVNAPPLQLVILLGKDSDGTFDAVPERQQREGNGLETAIRKFRTAAYLWQAFTAEQMFRNNFGRRCFRFEEEWQTGTLSRRDATDGLMRNEAKVHVIRTDKTVAELRALDIAQQHGPATRKDELFNIAKEAVKNYFRPKEGQKQYVSVLLLDSHWDKTSKTITGHAALGSSGDNIKMAIFGSHCLQSYPSCLEEVVEAFSDCTRTNTDFVANDCGEAGSSWEAANIGIGAHLHEVGHLFGCPHQESGIMLRDYVRLNRSFTTREPFSTRTKTQGLKLCLPQDECGWHRLDALRFRFHPCFRLPSDAPVSSDDSVQVWPVENGKILFTAPSGIAFIELYAEGEDVCHNFIEYLNSESSSNGLPKQVIVTESELRQRLFGNEKENKKNVKLAVFSGALGSYTVESIASLKSKLSLVKLPKGQSGYKSGKLGFSQMDGSQPEQLLLDCAFVSTKLLTSIKIYHGLALDGLEFCYEDSTSQLFGKRGGKPGGDEFVLGRHNHSPV

SEQ ID NO: 28224 - protein, 119 aa, A.fumigatus
PRSRSIMDWPSTDSNSVTKTLLASSSGSEGESPVVMSLYLVGTTIPQCDNQSLTLSSDTRRGEILLGFYVRAGAWIDGIEILTSLGRRSGIFGNARGGSGYLLHLFPSSNFRKTRASWV

SEQ ID NO: 28225 - protein, 68 aa, A.fumigatus
NILLLPLLWSEIVLHGFLRNIEQFIFPSGRTMLLSDIKRTEFCYCLIGTDNMNLGLIPHQAIGRITTA

SEQ ID NO: 28226 - protein, 503 aa, A.fumigatus
AAWRFIMNGPFIPTKNPSQPKGSGPSLLACLLCRHKHLKCDGVTPVCGRCAATGAECQYTPSRRGYKGPSKKRRANPSSPERTPSDQSSSFDFQSVALLDTPQDWSVPDGLSYIFPNGFASSGSNGSILNNDKALVSDSAPVSNGCPLTPDSVNSVAGDGYLIDIYYTYFHPSHPILPPLRILYRSHVPPFLEHVIKFIGSHFTPAANSEVYRPSVMSSAMEQESSVEKLQALLLLAVVLHSRNERAEAGQCLATAVDLAFELGLHRQDFAISMGRGDPIREESLRRTWWELFIVEGMLTALGVQRTFRTSLVPLEVGLPCEERIFQDGLAAPPPPTIAQFDDHIFADEERDFSSYTYRIEAVRILGRVVAIQEMLEGQEDHVEAVDARINSFFHHLPESKAELLRPDGSVDEMMFQAKMIANGASVYLNFPRSDLLSSPAVAAEVICGHHGPCSIPAFTHNDHAMKALKAAKDISQLASIRLPVVKHTPVFTTGRRRIRDMR

SEQ ID NO: 28227 - protein, 92 aa, A.fumigatus
AGTEGTLDTQGSQHAFYYEQLPPSASQTFFPYRITSAHGNGEILTMKSEFESQIDGGSEALPGFCPLVSRMQHNSQQQQRLQLLHGAFLLHR

SEQ ID NO: 28228 - protein, 154 aa, A.fumigatus
RRAPSAALKFFRTLVSLQDTFYQALMTHNNTFGLILDIVYETMPRDNLLNSACLELFEFIKRENIKPIVLHIVEKYREKIKDITYVDTFQNLILRYEQMQGYGAEADSTLFSQEEEARKLQANGQRWQGVKEMDAAEEEYFNTSDDEDEVRCAQ

SEQ ID NO: 28229 - protein, 73 aa, A.fumigatus
QGSCLKFNKCGELAQAHAIETQLNFSQEWTGHERTQGTGLGIFIIRVEQLLDALSWTSTGVVHIITLISLANV

SEQ ID NO: 28230 - protein, 72 aa, A.fumigatus
PTRCYRIFRSLSKLRATISVNSHPLVTEQVGCHHPMSDSQSSPYTCQKKVKLSKCMPTHYGIASYATTAEIV

SEQ ID NO: 28231 - protein, 120 aa, A.fumigatus
SLTICSIIFIRDSYARISGLFTLTLGQKVKGSFKSSSLVALKRSRDQQTGHGRILSAISGNDITGTGISSWQAATKYIATGCRSRRQKYTFLRVIYFPIFRKRSFLRSDVFISEISQTEQ

SEQ ID NO: 28232 - protein, 80 aa, A.fumigatus
SHSWMDLQSSANTCFEQIFYTAQTALAYSVGRVAHGLANNSLTDAQRAALSPDDPEYRAAYVDLLVQGTEVDERAHTSTG

SEQ ID NO: 28233 - protein, 88 aa, A.fumigatus
QSHSPDACQAAVSDPIIWASFASNVSTDIYLILIPIPMLWKSRLKLIKKIAATVVFGAGLFVLVCAILKSVFVLVVSRDVTFATSAGS

SEQ ID NO: 28234 - protein, 269 aa, A.fumigatus
  UNSURE (120): Identity of amino acid sequences at the above locations are unknown.
RVPWFRVAAVEACRWATRCIPRAPYVTSLSWVSHYGCKYVVHGDDITSDSNGEDCYRFVKAAGRFRVVKRTPGISTTDLVGRMLLCTKGHFIKSVKDTLAGVEGSDNQEERKQFGVELMXRIRDYATDESGLRPGPQVWTWTGSRPAKVSDTVEEAGTFETLVNGKAIKPGQRVVYVDGGFDLFSSGHIEFLRQVLELEELEGRQRGWYDSEQVEKRLHEFGEDYSPAYVVAGIHDDDVINHWKGFNYPIMNIFERGLCVLQCRVCPFS

SEQ ID NO: 28235 - protein, 61 aa, A.fumigatus
IPCQGITGVLLANRSTPLYLWKVERFSQTETPTQIYTTGFFPSKKKGYYTYPDAARDPPTR

SEQ ID NO: 28236 - protein, 114 aa, A.fumigatus
RFSQYIHAVIFSAPFSPSQPYLEAMPFGVPDVVYHGPTTFIPLTYDPYTAPKRMGIFRQINDHPFQHVNAGEIVDRILRSREAYEERQRAKLQKAIIEEQVKSEEKSLAGELGA

SEQ ID NO: 28237 - protein, 85 aa, A.fumigatus
  UNSURE (6),(9): Identity of amino acid sequences at the above locations are unknown.
TAFQLXHAXHARFLSEQTRSAIDKAIASAPVVLFMKGTPETPQCGFSRASIQILGLQGVDPKKFVAFNVLEDPELRQGTYSNPFF

SEQ ID NO: 28238 - protein, 159 aa, A.fumigatus
RAQCGSFQPRGEDLADLRVVEEDAVLGVFCRRWGVPLIDGGTVRLQAIVGLGRALDLILTGRGVGAREALDMGLVSRVVARGKAVEEAMVLARDLMRFPERCMNVDRGSCYYSAYAAGSMEDALRREFEMGSKVLATESVRGATRFRDGEGRHGRFEKL

SEQ ID NO: 28239 - protein, 73 aa, A.fumigatus
ISLQISANSSDTDAIWNQQRLMLDLSHRSTAGPNANTASMAGASLVEIFKHYASIIMTMIDESETSWTLIVSC

SEQ ID NO: 28240 - protein, 162 aa, A.fumigatus
ELLQLLKAPMSPLPIPKPRRPPHTLRRQHLGPHLKLPPQRILHRSRGIRTIIAAPPVNIHTPLRKPHQVPRQHHRLLHRLPPRNDPTHQPHVQRLARPDPPPSENQIQSSSQPHNRLQPYRPAVDERDTPPPTEDTEDGILLDDAQVSQVFTTGLEGTALCP

SEQ ID NO: 28241 - protein, 69 aa, A.fumigatus
TSPLYCRMGIDATTVLEDKNSYNFSKRPCRPSPSLNLVAPRTLSVANTLDPISNSLRSASSIDPAAYAL

SEQ ID NO: 28242 - protein, 270 aa, A.fumigatus
SSTMAPKLNITHIGTATAVLEIDGVNMLTDPFFSPAGSSWPVTETITLQVSDDPALRLDQLPVIDAVLLSHEDHVDNLDELGRRLLDGRRVFTTVDGAKNLSPRPGVHGLKPWEKIDTVIAGKKFQIIATPTQHIAGDECTGFIITNEEFGRGRDGLPNAIWFTGDTVYIDELKKVGEQYHVLAAIMNLGNAYGPVDKTDPSKGACQITMDGKSGARLLRDVKADVLVPMHYESWGHFTQFGKELRRDFEEEGILDKVCWLTPGKPVSVL

SEQ ID NO: 28243 - protein, 98 aa, A.fumigatus
FQNFCLLLEKKAVINIPVPTVGFLFFLFHFETEFHSCHPGWSAVVQSQLTATSASQVQVILLPQTLPSSWDYRHPPPCPANFCIFSRDGVSPSWPGWS

SEQ ID NO: 28244 - protein, 69 aa, A.fumigatus
FSCLRLSRVAGITGTRHHARLIFVFLVEMGFHHLGQAGLELLTSGDPPASASQSAGITVVSHRAGWVFL

SEQ ID NO: 28245 - protein, 72 aa, A.fumigatus
IIIIAIFKTGSFSVTQAGMQWGNLSSLQPLPTWFKRFSCLSLPIAGITGPRHHTWLIFFFFCIFSRDEVSPC

SEQ ID NO: 28246 - protein, 110 aa, A.fumigatus [sequence omitted]

SEQ ID NO: 28247 - protein, 84 aa, A.fumigatus
NPISTKNTKISRAWWRVPVIPATRESLRQENHLNLGGGGCSELRLHHCTPAWVTRVKLRLKMKKKEKKTHCRYRDVDYSFFFQQ

SEQ ID NO: 28248 - protein, 438 aa, A.fumigatus
VKTSGIDVKAIHKAAYGYPEIEEAVVGLRTLYAGKKIIVGRDRLDSVRGVAQKLQAFEQFLERYPEWREKVVLIQVTSPTSVEEEKEDPENKIASQISNLVSTINGRFGSISFSPVKYYPQYLSQHEYFALLRVADVGLITTVRDGMNTTSLEYILCQHNTHGPLILSEFSGTAGTLSSAIHINPWDTTGVAEAINRALTMSPEEKKAQHVKLYKHVTTNTISTWSNHFVTRLLTNLSSFDQSVATPALDRAKLLKQYRKARKRLFMFDYDGTLTPIVKDPQAAIPSDRVLRTLKTLAADPRNAVWIISGRDQTFLDEWMGHIPELGLSAEHGCFIRQPRSDDWENLAESSDMGWQKEVMEVFQHFTERTQGSFIERKRVALTWHYRRADPEYGAFQARECRKMLEDTVAKRWEVEVMAGKANLEVRPTFVNKGFIAP

SEQ ID NO: 28249 - protein, 788 aa, A.fumigatus
FITATRNMSAFILRDIEIKAALVLQENSAAEVMTSLRAWQGSTKASERLYEFNVYSVTAENRWTEHCRGLVGGSDLSLDTEYEISSQVPKQASDLSVIDTSTFYEKLASIGLEYGPCFANLTHANQTGNLCFAEVTIPDTAAVMPMNFQYPHLIHPCTLDSIFHTVFVQTNVGDDPAIPVHIDQLSVSRSAEHSPGTKMHIETHIEKRTRKSIVASITVINSNDTIAMSIKGLRCKHLKNSDPKDMVNPTERLGYMLTWKADSDLLSKQDFSTVFTEDNHHTQESAKRQLLEGCAFSYIRKAIQDLEPANKEGLHPRRREQLDFFVDRTQNSRLVASSVTNNADIQALSASGPEGRLLTAVGEQLSTILKDSKFSNIDMDLSIWEQYWDTIRLSPVYEKLASYLELVGHKNPMISILEVEGTFGQASQDHLERLLGNNGHGPLCREYTITHEGQSIPEHFSPVVSKWKPLLKVKELNLNQSPEAQGFSKYQYDVVLAPLGLCTVPAKLQALRNIHALLKPQGHLIVVDPIAGHDNLTESVIFANSLGCWSEGRFGYTLEGWNLVLSAAGFSEAEDASIPREGRFMIITRPLHGQSIPKQSILIISEDDDNGIDLSALQDSLSPMSSDIEIADFTHAKPKGRVCIILSALSRHLMADPTPDELEVSKQIFLKASGVLWVTRGATISPVTPDGALATGFVRTSRSESGIERIVTLDLDGRKPLSSHRAAEIICKVVRERILTDGNGQSDTEYAERNGVLLIPRVAENQAFNRCPAALFFTTAAGPIRAMH

SEQ ID NO: 28250 - protein, 101 aa, A.fumigatus
DFASNPWRGGVSNRVTGVDLQPYFRIFNPLFQSDRFDPDGEYIRKWVPELRDIQGAAIHEPNARGGGAIAAKNGYPRPMLNHSQSRDLALHRYKRASESGR

SEQ ID NO: 28251 - protein, 183 aa, A.fumigatus
TSHRTPFVPRYHLRQTPGADIFDPPLTPCPLSFFLDRPYPRSRYSTQCRPEMDLAQPGDAPPTSTNTAGTLEDSSSTAKRRWRRNRIACDSCHSRRVRCDRAFPCSRCLRSEIRCEFTRERRKRGRIARSKQTATVPNGGSMEKLPKAPNVQPPVPAAVPADAAPTPLPNHASPTTSFQHRSP

SEQ ID NO: 28252 - protein, 210 aa, A.fumigatus
  UNSURE (96),(100): Identity of amino acid sequences at the above locations are unknown.
LAATLASSLLSSAIFFLSLNSAPTVSIFFLLSWLGPTSLLSVYLSLEFISVMSKATIAAIAAASAATGAGITALLYSSSSFRPQQQQQQQQQQQLXPPHXPSQPAAISPPATIPPPSLAKTAASKPSGGSPVDPAGIYQYGFPGPIADTITSLPLTGAYDRRTRNPAWVAEHITPYSLSLKNADRKHSAFVEDASIPAIVLHRRGWKDTR

SEQ ID NO: 28253 - protein, 144 aa, A.fumigatus
VNGITFINYENLHQQLLRETIGLHTCDSRSSKAAIQAEYPEYIIEDGFAEEDPLYDPKLRESDTARDARLRDLLQNIFTHDKNTFISLTAHSGAITSILQVTGHRKFALATGAVIPVLVKVERVAGPLPKMHIDPPTTAPVCKN

SEQ ID NO: 28254 - protein, 143 aa, A.fumigatus
  UNSURE (46),(50),(85),(117): Identity of amino acid sequences at the above locations are unknown.
QGDRVIQPSGAQRMIPTTFDYVSCGETCPSPTDIVDTDQLPSNFGXIPRXYDSDAEFDPDGRRTQWERFEYQINKLNEESGPDTXYRLLFLGRHGEGYHNVAERRYGREAWDVSISXNALYPRLLIWAQLTVTVLLVPSRRRR

SEQ ID NO: 28255 - protein, 94 aa, A.fumigatus
LLQCYWSLLDGDDNGTWVDARLTPVGIAQAETAHRAWETQIESKIPSPQSYYVSPLNRCLATANITFRGLKMPHTEPFRPVVKEVSQRYHLHQL

SEQ ID NO: 28256 - protein, 205 aa, A.fumigatus
IKITSRCSNAALPMDPSSLQSSAGPRARQTPRPYRHSHSSPTADQTSTPSHSAHPVAPDLPPATSPTADPPSHGAGRTLDPAPTKTHRPSWGPAQHGPRHARPTGPAVLGSSTARNSWIVCAARIRCTAAAPANRCSGRALKLRSRQRGLYRKADRSSGRFRSSRSWTYRGPIGGERMGPTRRSHRSDPALRGIATSGGLQGATV

SEQ ID NO: 28257 - protein, 376 aa, A.fumigatus
PVVKTVQRLLPVSATKNHAHIKMKLSLLLLLSAVYTATGTAATTTTATAATHVIYSYPGVSPPASLLSLIAAGKVGGLILFGENIDDNLPATIATIQKTYASSPDYNGTPLLIMTDQEGGKVRRLPGGPTLSAKQVGLSSDPAATAGETGTEAATTLAQYGVNANLAPVLGVYRSAGDFLDEYGRSYGNSSELVASCAEAFIRNQQARKVIATAKHFPGLGAAGADANTDLVPVQIDLGLEELRRVDEAPYRAAIAAGVEMVMASWAVYPALDAKPAGLSEKWIRGELRQRHGFQGVTITDAIEAGALRAYGDDAARGVRAAQAGMDLLLASARNVTQGEAIVDALTAALEHGELDTEEFAAATARIMALRRTLHV

SEQ ID NO: 28258 - protein, 144 aa, A.fumigatus
IGTRSRSRVDVAMLPCQWIHQVCNLPRAPEHAKLHDRIDTHIRRPRRIKHPRRPIQRIPSPRTCLLPHPPQPIHHRMVQEERWILHRRKHIAHRGAQRNMDRGMRAQPAPRCSGPAPRETPGSSAPPGSAARRRRRRTGAADER

SEQ ID NO: 28259 - protein, 226 aa, A.fumigatus
WIHWQGSIATSTRDLDLVPIYGYTCNVRLNAMIRAVAAANSSVSSSPCSSAAVSASTIASPCVTFLADARSRSIPACAARTPLAASSPYARNAPASIASVMVTPWNPCRCRSSPRIHFSLSPAGFASNAGYTAHDAITISTPAAIAARYGASSTRRNSSSPRSICTGTRSVFASAPAAPSPGKCFAVAITFRACWLRMKASAHEATSSELFPYDRPYSSRKSPAER

SEQ ID NO: 28260 - protein, 157 aa, A.fumigatus
TARSICRPFDTTRAVSSAALTLVRCTGSPAPPPCSGSWRRRRSRSFSRCWTRAPRGRLGAHAAVHVALGPTMGDVFSSVQDPAFFLHHAMVDRLWGMWQEAGPGRRDALNGTAWMFDPPWATNVSVDTVVEFGVLGGPRKIADLMDPLAGQHCYIYS

SEQ ID NO: 28261 - protein, 499 aa, A.fumigatus
  UNSURE (486): Identity of amino acid sequences at the above locations are unknown.
NRSTGDILVTNDGATILKSIAFDNAAAKVLVNISKVQDDEVGDGTTSVTVLAAELLREAEKLVNRKIHPQTIIEGYRIASKAALEALEKAAVDRSKDMEAFRKDLHAIARTTLSSKVLAQDREHFAALACDAVLRLKGSTDLSHIQIIKKAGGKLSDSYLDEGFILDKKIGVNQPKRLENAKILVANTAMDTDKVKIFGARVKVESTGKLAELEKAEREKMRAKVERIKSHGINCFVNRQLIYNWPEQLFTEAGIMSIEHADFDGIERLALVTGGEIASTFDHPEQVKLGHCDVIEEVIIGEDTLIKFSGVAAGQACTIVLRGATEQLLDEAERSLHDALAVLSQTVKDPRVTLGGGCAEMVMSKAVEQAAQNTTGKKQLAVDAFSYALRQLPTILADNAGLDSSDLVTRLRQAINNGMTSSGLDLLTPGGGIADMRELGVVESYKLKRAVVSSASEAAEVSMVVDLLLHKRLANYVRLQLLLRVXNIIRAAPRKRERM

SEQ ID NO: 28262 - protein, 154 aa, A.fumigatus
  UNSURE (24),(28),(34),(40),(45),(72),(77): Identity of amino acid sequences at the above locations are unknown.
GGSGRKPWSLAQIRGIFGDVPPLXGILXQGFETXFPPLEXLPFFXAGRYFLTIYYPSWFVISQINFLKDKMXTTSRXLRPIPTQIFADDVVEEKGENAGLSAFVGPIAVGDLVKSTLGPKGMDKILQSANVGWFSGNAGVCWKTSLPELTLGLK

SEQ ID NO: 28263 - protein, 321 aa, A.fumigatus
QGPFLFQVETSQQLKERTSACESRLLPLAPNAGQETTTTTTTVDDKEKKSIASEVLQELDQIAKEVSELQKYSRINFTGFLKAAKKHDRKRGARYRVRPLLQVRLSQLPFNSEDYSPLVHRISVMYSFVRQILSEGAVESKDASEPRSGQDAYSSYKFWVHEDNILEVKTYILRRLPVLIYNPKSSRDFESLPEDPTITSLYFDNPQFDLYNQKVAKAPEAGSIRLRWTGDLKDTPAIFLEKKIVTSDDYSKEVKVQLKKKHVQEFLEGKYTFEKQLHRMEGLNNGESAEAETLKKDVEELQSFIPETYSLQGSKNARDFF

SEQ ID NO: 28264 - protein, 361 aa, A.fumigatus
APYFSTRLPFHPGPSPVEFRRLLRKSLKDIQALNDVKGAYRTKYNLFDSITLPLADFLKGEGVDFRFNVDVTDLLLYPESDPTTVSEIKLIKEGDECLITLDPEDICIVDPGYSRSGADFGTDTAPPPFLTSNWEDLMMKEWKLWQKLSDKCPKFGNPSNFLSRALESGVETFTTTLWGPQFMNLYEKLTHDQPRTDALLSLTESKWSITLSIPHQPILPGQPPDAHIVCGYALSPWNEGDFVKKPMFACSGKEIFTEVLSHLGFPVQSILDAATTIPCGLPLGTAPFLTRGNRDRPHVIPPYTTNIACVGQFAELPEDTTLSMEYSVRSAQMAVYQLMDLQKEPAKLKKNILLELFDLLI

SEQ ID NO: 28265 - protein, 378 aa, A.fumigatus
PVIEPTNLLKGAGPRSGFLRIDKVLVTIAAMETKGNPKDSMKSTWRTASRDTWSLGHWLIHILNAYPLELDKEVPVHSKDEPIPFMPQWSLNLWVIFYSSLPLLFHQAYAWYTERNLGPLATFNLYMFAFNAIVIYQVHILRRLGHIYGFLDGDKHERDGIPDVGVGKVVASVYKTTGSRLALSVYFSYQTSQLPAQMNWYWLPVEVGLYGIVLDFWFYWYHRLMHDVSFLWKYHRTHHLTKHPNPLLTAYADHEQEFGDMVGVPMMTYFTLRLLGLPMGFYEWWICHEYVVFAEVFGHSGLRLHLTVPSPLSWLMQWLDAEIVIEDHDLHHRKGWRKSHNYGKQTRLWDRIFGTCHERIESAPENVDYVNTARMPLF

SEQ ID NO: 28266 - protein, 197 aa, A.fumigatus
PSNQVTKYTMDSVKNKVYAVTGVAGIGLAVAQQLHARGARLSLADIDANALTSAFAKLGSDSETVLTTVVDVGSSTSVDAWIEATVQKFGRLDGAANMAGTIGRKHGVGKLVEQDDEEWDFLLRVNLTGTMYCLRAEVRSIAATAGEGSIVNAASIQGVRGFALHAAYSTTKHGVVGLTKSVAKEVGPAIRVNAIAP

SEQ ID NO: 28267 - protein, 211 aa, A.fumigatus
RLLLHSFYLPRPSLLYIKMKLSIAATLGFLGCALALPAPAARETDLPFPFPAGGSGTGPGSLPFPIPSGAPSGFPFPIPSGLPHGFPTDFPFPIPSGLPTGFPFPIPSGFPTGSGSGGFPGFPGLGGSGDYEKREEAHHSRPKPSGVFPGWPWAMAMARSPTGGFPGWPKPTGTPSFPPGGSPTGGFPGFPSIIPTAYAQRNSFRLPPSRG

SEQ ID NO: 28268 - protein, 73 aa, A.fumigatus
LSSGMLLTSCSGSIQTPLLDKARDIQGTLNAMPTIIPRIGTADEVAQSVLFLLSDASSYTTGLVLNVDGGWDP

SEQ ID NO: 28269 - protein, 536 aa, A.fumigatus
  UNSURE (516): Identity of amino acid sequences at the above locations are unknown.
LQTTLAPCELSTHCIIKLSRMSEQTKKTPQRVRKFLPNVIESSSRSSRNRQSTPSVQASSMELEFQSGKPAGTLIADTRPVPPGDLTSSQRQQDDSWTLNDIKEVSDNRAFGLPQRQPIREEVLHNSVDTKTNGDRLSYPVSSSATEKVVLQMRSCPRKFAPQLVETNKRSFRRKETSHTLSGAPVQGYDNVSRTQSGTSTCANSNAFSATIESKFSYSSLQQRQESRSHSFRVPDLPAIPSSCSDASEGSDTPSFSASPSISSNVSAHHSKAENGCKTGRDGHMAEYFLSLAGQSVESQLKEQALAAFPNEQVYEPVDHFAIDKDEDECSEEDSKNGHLHVSRRESSADLPWELEHMRRHKEDAEMRDRAMAGTKGRRLSSAIFNPRQFYSGIDNDCWRGKYEPDLSRHLARPPMLGDDLVFPQSLSPEATICESGSVRDCATDSRHRVRNDFGLWCTKPGHVQDDATTGLWKGTCCNYKHTQQSKRSLPCVTDNSRHSNNNECQSKVCSDEQDXEQSTSNSYHLGLDVRELSRH

SEQ ID NO: 28270 - protein, 115 aa, A.fumigatus
GGSRTMVWRDFGVKLRRDFTMVRASAPPKHIKTMEKETAVNPADRVIGALKDRKLPINRHEIESALIDIDNKNVESIQWLEEHLRPDTLLSQEELTLYVSHSSPRWIPFLSISKR

SEQ ID NO: 28271 - protein, 60 aa, A.fumigatus
RAPPESRIILRDSRGSYSCLQDGNRQSVFRKAFFKARDIEYEEAFYSVAIHPYRSRKAHG

SEQ ID NO: 28272 - protein, 64 aa, A.fumigatus
RRVAYFTHSVRKYGVEGGSKVLLFGALPPPVLALLRSGYSTASQESQLRLIGFELGVIDALAQV

SEQ ID NO: 28273 - protein, 440 aa, A.fumigatus
QQRGSLISGNNLVSNNASVLDLLVVDNAHAAPCISPATPVKMPTTTSASDKSRQTSAGKGFFGRKLHKEKPVDDRYEGYGGSENLAPPGNATGSRSSRHSKRSSVQSVDYSHDFDPSGISMTAGVITSIPYESLTTDTRSPIPVDYLSRAETSPRKEPSPNHLAKGGGDFHQYPAWNPTGLRENNAFSHPTGPRPPPHASNVSMVGSTAGDKSARHQQWARPGSSATNAGFSHNSSSTVDSSSTSRMSFDQTSIHSSLSSNTRGSSYISSDGSARTLTTSHSGDRGTLFPSSGNSNRFSTAQAAWQAAQLATHSAAPVLNPEQYLTRPRDDRVVDQLFLDLMQKRGWQNLPEQAKRQKLAYPASKKWTLVHQDRLTDLQGEQKRRQNARQTHGHDGPAGILERADEEGSPEWYVKKVMDDSITSKQLASLSVSLRTQPIK

SEQ ID NO: 28274 - protein, 166 aa, A.fumigatus
DDSWVRAFVEAQGQIALTNVLSKINRRKASGPVPAPPTGDRDLDREYDIVKCLKALMNNKYGADDAIGHQQVIIALVSSLLSPRLNTRKLVSEVLTFLCHWAEGEGHQKVLQAMDHVKNQHGETGRFDAWMRIVEVTIDGRGKMGSLVGASDEYRSGSYPSGAEIR

SEQ ID NO: 28275 - protein, 182 aa, A.fumigatus
GIQAVSFDVDYLNANLAYADSIIVEEVVVPLALKYLARAGKLSALTMPTASFLVIFPRADKSSYADTVTLTVTETVCDFSSTTLSKPSTTIWIPPIPTMVTTASMPTSQTSVSTSESSTTSSVEQTASRRTSSTSSSDASAPVPSSSEPPFAPPLSDSATGQGKIHFASLVWTLVMTSFMNV

SEQ ID NO: 28276 - protein, 68 aa, A.fumigatus
ATKDSPISFPAYITSPHGTSKLVNQYESVLAITTNFGVAAVILYFRKLINNYNKSVAHAYRLHFIWQV

SEQ ID NO: 28277 - protein, 110 aa, A.fumigatus
LSRQVGWYASAFFLTIASFQSTWGKGYKYFPLKTTFLGAISTFEIGSLICAVAQNSTTLIVGRAVAGMGAAGIASGAYTIIAFLAPPRQRPAFTGLLGFHHGGRSTALSN

SEQ ID NO: 28278 - protein, 75 aa, A.fumigatus
ILIISLFVKSGPAENILFLGDYKHAFIHCKELNYYKIIKAKASGQYITRLSNSKEARGKSLIMGELLQLCLELSY

SEQ ID NO: 28279 - protein, 141 aa, A.fumigatus
LLQWIARLSINSTFGASVLEPAVTDVMADFCVGRTQATLCITLYTLGLATGPLVLAPISEAYGRRWVYIPAISFVLAFSAGAAAAKSFAILLTCRFFSGFFCSVGIAVGGGTVADIWPRGKQRATASLSSTRGWNEPFVGV

SEQ ID NO: 28280 - protein, 388 aa, A.fumigatus
  UNSURE (358): Identity of amino acid sequences at the above locations are unknown.
RREEDLAADRCSQSLSSLFKNLPELLKNRQSSVKPVNLKRPAPAAVSRHAANVKNQQSAPEITPPQRASTFPVQLLSRQSKAEASNTPKSLDDSHNFGSGKMYQSPVNTQVSTPKWTPSTPEAPTDTTTTTPEPFIADQARPSTTASPMPGMHSREPSSGQFSAQQLANAGNLPDLMPIMFPSDDPFAYPTQPMSTLEDDHFRVDGLGLQSANQFAFDPSSQGLPSSASNDSAIGAASTPTFDNFGTFPLFNNGTSAGINATLPYRVAPQKQQAMSQARLQSPGSHSSTPGSGTEAVNSPDLVSIPNQNFMWQGYNFQPQAIPPESSGPQQAPTTTESQGFSMGTNENNYMGVGIDLXFLPLDDIFGDPCRPNTLANDDWIQWMNVGN

SEQ ID NO: 28281 - protein, 111 aa, A.fumigatus
  UNSURE (1): Identity of amino acid sequences at the above locations are unknown.
XTSQARSLVDDTFIIIDDGITPECPLDPTYRIHFLSRTPLVIYIEGFLTTPEADHLVDIRYLFAFDPQVHTTPSLTFTEKRRKIHPQHNLQRHHRARRPLHAALRACPARP

SEQ ID NO: 28282 - protein, 209 aa, A.fumigatus
HLPKSVGKYTPSIIYNGITERVDPSTRLSERALLDRDHTVRCIEDRARAFQGWRPHLYIERMWAQRYNASGHYRHHYDWAGSVARGGDRASTFMVYLDDNCTGGGTNFPRLRMPVDRRWCRFLECHGDEETLEVGDGAKDTAPRKETARARGTGEGITFKPIKGNAIFWENLRPDGTGYPETWHAALPVTSGTKVGLNIWSWYQPPRRG

SEQ ID NO: 28283 - protein, 158 aa, A.fumigatus
STTASPSASTPPRGSPSVPCSTVTTPSGVSRTARAPSRGGVHTCTSSVCGPSATTPPATTGTTTTGRAPSRAAATAPARSWFIWMITVPVGARISRACACRSIGGGVGFWSVMEMKRRWRWEMGPRTQRREKKRRGPEGRGKASRSSLSREMQFSGRI

SEQ ID NO: 28284 - protein, 578 aa, A.fumigatus
  UNSURE (27),(32),(44),(71): Identity of amino acid sequences at the above locations are unknown.
QEQCSTHLFPWSDSTTCSLELWLRGIXWGQDXWERPPPEGNGGXNFSSWTNDEVGWLHTGSNDGSYARVNXYVDAQGTGPEAHSIIARKVAAEGTVLLKNVDRTLPLSRNASSPSGGILRVGIYGDDAGPALGPNACPDRGCNQGTLATGWGSGTVEFPYLVSPIEALESAWSTEIESTAYLRNAVMPADAVDKDLCLVFVNADSGEGYISAGGIHGDRNDLFLQKGGDTLVRTVSSNCGGGQGKTVVVIHAVGPVVMESWIDLPGVHAVLLANLPGQESGNALVDVLFGEVDASGRLPYTIGKSLEDYGPGAQVLYEPNAPVPQVDFLDALYIDYRHFDRHNITPRFEFGFGLSYTTFELLDLSISPLQQKSRSVPPRPTDAVAPPVYDISLPDPASALFPAGFQPVFKYIYPYLSNLDGTAPHNYSFYPKGYNETQRPSPAGGGAGGHPALYEEMVSVKLQVSNTGDRKGQEVVQVYVSFPPDVTEEGDWVEVDSDADKTGEKPRERVKIEFPERVLRNFTKIELEPSERREVQMTLSRKDLSYWSTREQNWVMPEGKFQIWVGRSSRDLPLMGEY

SEQ ID NO: 28285 - protein, 265 aa, A.fumigatus
LSCLLDLLKLASFVQQSMLSSRRNHPIPQDFELAFKRHHLHVDDLLPHLKPLPNIEPVPTLLPSPPPEEVAWLDLPFLGSELSGESDRVRSAYIPKHFPQFPSKHTYRHTPVFTQREQDPRKIRERATEEGRHGEEALRKLARASFKDNQLGWAGREKRLWGRRMESLDSMFEKTVKGIAKKMHKDVTAPGTVAAMDIDSGVAVDPELKATRPKLPFSLELPPVINCERGLWRRTAAPSNRKAEEKPAGTKDPTSVSRVESWMST

SEQ ID NO: 28286 - protein, 67 aa, A.fumigatus
QLPRPRPPSAMSPPATDAGCARTAATSDSPGVSPVRKPVSVVSGMILSLNERSRAVMSIFSKRALLT

SEQ ID NO: 28287 - protein, 495 aa, A.fumigatus
FVSKFSANYPLVPLDLRQTSILETWLSHLGTPSPRLAFPVMLNTSPASPTSLGRKRPHPPAEPSLTQSQPAAQTQQQTAGDGTAKPPPPAVTTSSTSSTFRNVSACNRCRLRKNRCDQRLPRCQSCEKAGVRCVGYDPITKREIPRSYVYFLEARVAYLEKTLRDHQIEFKEAVAFDEEEAIKVEAGYDQDRPQMAGSEASAGAETLSTTVVESDRLTRQKADKAAQVPRSGRNPESEQDAENSRDYEKEDNWRIHNLVSNIGMVSVQGTSDPRYLGSTSGISFARVVFAAVKSSVAGNVGERGPMRPSERLPHSATGTAGSGSTMRDSFFGLQTRPTMKCAAFPDRELAEKLVNLYFEHANPQMPILHREDFMELLDRTYSVEEKDRSPRSLYTLNIVFAIGAGIIFEDKTSSDDEDNTLSNSSRSTSSSTAKMPRLSTRQYQPEEYHASAIIHLESFLGASSSNERFGALDELQAVLLLASFALLRPVAPGLW

SEQ ID NO: 28288 - protein, 105 aa, A.fumigatus
QRRRRINRQKQHKVSARSQTTDGAYTNIYRTGLMFYELNTWDLLGGSPWKRSDNQPFEGTFEGTVNKFAQITRLIDPDAKFTEQAFISDAGTASVASFNRTSRWC

SEQ ID NO: 28289 - protein, 74 aa, A.fumigatus
QEGEKKKTNLILLRLEQIALASYVNPLADPVAWDRMIAYPSNKVSVLVANVLNGPDTTVNEDWAKVIDRAHASG

SEQ ID NO: 28290 - protein, 61 aa, A.fumigatus
HSLQGVMTALLQEIISVYPLLNPSQLTAAASNRVCNALALLQCVASHNETRTLFLNGIFPL

SEQ ID NO: 28291 - protein, 138 aa, A.fumigatus
ETALLMSTLLSLAHIPLFLYPFLNTTSKSRPFEYLRLTSLGVIGALVKNDSSDVINFLLTTEIIPLCLRIMETGSELSKTVAIFIVQKILLDDIGLAYICATYERFYAVGTVLSNMVTQLVEQQTVRLLKHVVRCFLR

SEQ ID NO: 28292 - protein, 62 aa, A.fumigatus
YRIRLSDNSRAREALRQCLPEPLRDATFSSVLRDDAATKRCLAQLLINLSDNVSDGASGVTM

SEQ ID NO: 28293 - protein, 113 aa, A.fumigatus
RLQASLAIVSDILALFLHFQYIGFITATAVLDILVIILCAIGVGTISTGDFVSYLGLYYYDYPSVLAQAEIVVFALNLLVAYVCQSSRWGYMRLMRLLKVGEIPFDYFMLCFV

SEQ ID NO: 28294 - protein, 84 aa, A.fumigatus
KTKGTMVMFSAMASNFYRAQDAPRYILGHSLELGFAVVGIIAVVILRFSYQRINKKRDQMDVSGYDNAQLARMGDRSPLFRYML

SEQ ID NO: 28295 - protein, 90 aa, A.fumigatus
LLGQLSMSSLPERHWQQRFPTFQQVLLRKNIAALDNLLQQRLQDPGLITFEIDQLAKPDDIAAHQHFQLGGVLDPLFPFPRRDLDVETAP

SEQ ID NO: 28296 - protein, 348 aa, A.fumigatus
VVLVITKVFPDEFHLHTLDLLLSAISRLNPHVDLKKIVIGLMDRLSAYAARETESTTDPEIRKQNEEEAVTKFLENLKIAEENKTQEAPTGTAHENGVEHLSTEPSKEPSKDTDKPEAETPKGEQESNANGENDAKPGVPADVKLYAIFYDQVVNLIKTRGLPIQDTMALLVSLVNLALNTYPDRLEYVDQVLDFATRETAEYADHADLHAAPTQQNLLHLLLAPLRSYVSIFTALALPHYLPLLTSQSYPTRRSVAGEIVRSLLKNRTLITTAENLDRVLGALRVLIKEGLQQAVGYPGSQRRGGETDETIEEQGWLARLVHLIQAPENDVQLKVRFLGRNRDQIHR

SEQ ID NO: 28297 - protein, 81 aa, A.fumigatus
GCGFNIKVPSREREKRIQDPPELEMLVGSNIVRLSQLVDLERYKSGILQALLEQVVQCRDVLAQEYLLEGRESLLPVSFGE

SEQ ID NO: 28298 - protein, 197 aa, A.fumigatus
LLQATRKAYADGNERIRYTTPAIITASIRLARKLKSREHYDDNWQSQSSALYRFMHQCVNTLYQRANPGCADLALRLFVMCGEVADQTGFEEFSYEFFAQAFTIYEDSISDSRAQFQAVCIIAGALHGTRGFSKENYDTLITKAALHGSKLLKKPDQCRAVYLASHLWWVVENPQRGEEDPKNVCPLCSLCFHDHCS

SEQ ID NO: 28299 - protein, 211 aa, A.fumigatus
HNLVRICVCGDEGTGKSSLITSLVKGVFVTNKIQPVLPQITIPPTIGTPENVTTTTVVDTSALPQERSNLAREIRKSNVILLVYSDHYSYERVALFWLPYFRSLGVNVPVVLCANKSDLAADHTEAQVIEEEMLPVMAEFKEIDSCIRTSAREHRNVNEAFFLCQKAVTHPIAPLFDSKESALKPAAVAALQRIFYLSDKDRDGYLSDKEI

SEQ ID NO: 28300 - protein, 69 aa, A.fumigatus
TIEAGVKRSALPNCLTGLAPEDPTLIPFSLWPFSHCISNFYECIDASSDISKYGNSQVNPKKLLQTVNP

SEQ ID NO: 28301 - protein, 64 aa, A.fumigatus
IHPIDVAIILLDPGPSSTSDFSHASISSGAASDSGQAQMTLINFLRWFMQLIYYEYNVSRTLGS

SEQ ID NO: 28302 - protein, 259 aa, A.fumigatus
TPFSFHPTITMYHRSAFGLVLASILLLNPVAGKPPLGQTPQMGWNSWNTFKSQINSSVIENTVQLFEHLGLKDVGYEYILLDEGWSDYSRTADGYLQPNLTSFPNGIKPLIDDIHAKGLKIGLYGDSGILTCGFRPGSWSYEERDAQTLARWGVDYWKYDNCGGFQAMTEPPQVRFGIMQKALELSGRQIFYSVCEWGYQFPWHWGGSTFYPPSATSGKWLKKRRDRPFLSHVGRHHRQIHQRDRQRRIRPQGLEGPQI

SEQ ID NO: 28303 - protein, 198 aa, A.fumigatus
  UNSURE (69): Identity of amino acid sequences at the above locations are unknown.
AFLVYRLSRGSSWFLFQYISTRYKWTFAEANLLISFKPALTIPLFLFILPALSRHLLRSMHTSKKDLQXARVSIICLCLGTLGIGLSPSIATLVPSLLVQTAGSGFLYLIRSLITTMVKQEETARLFTIIEVLQAVGNVIASLSITTVFQLGLELGGPWIGLAWMMTSTAFALVGAAVWCFRLPPIVEGKNEAEVAEV

SEQ ID NO: 28304 - protein, 476 aa, A.fumigatus
GLMHCFGLLVLVSGWWFRYSHSTRMSNSLHDELESFVFLCLHLLIIALLLTRLHPSFVSLNKHFLQVSCSAFPVDSAPLLTTGLSFPSHPSVFEQTTMARTIQSELTPSAHEIGKGLPLTTRYTLADRKQSKAPTRPERTPDELEAGEALILLSRGYGDPPAGPRQNMQTQNDLGSYQMRNNRGVPSNAYPRARQNTVLAQADGRMQIPQNVPQQPASAAMPAMQTGPYWNGNPAAAQRVALTGQEALQAYLIRQQILAGVAPQDIIMMRGPPQHGRPAVPPLVRITNQGVYAPVIPPATFNGVFHPFPMLPVQQNKPNVPAPTAAPGVPYPAVAPGISPQTAREPQCHCPPNGRMMPQEAGKFQAQRPLNRDHSNAAAMAGLDTNLGAQNRVVLPAVMQPNGQQPQGPYFLPARTIAERNVNMPANNMIARHNGIFEKNAGSQRPSYKTPRIKTESPEPEEVLANQVDHTSIRKT

SEQ ID NO: 28305 - protein, 61 aa, A.fumigatus
FAMGPQRFKRQFIVAILLAASIIWLMRSFEHEDADVARTMPLLQKYIHPPSGKGGGKTQTH

SEQ ID NO: 28306 - protein, 105 aa, A.fumigatus
FTEKDMRADCSVDWHTSGGESLGMSLMGYQSLLDRAWPSCHVPDSAQANEKDIGIPEPSRQLVFEEFINSPREYKHDGLPPAPHIYPVPYVGTEEASILKAAKRS

SEQ ID NO: 28307 - protein, 67 aa, A.fumigatus
SFASHCRQYETQAACRHFNCAEPYSSFIIAQVSWSFPPHTKLAGSSKPRREAFLEYSSAIIQLHQFV

SEQ ID NO: 28308 - protein, 603 aa, A.fumigatus
AGSQEGLYCGFLLAERCGDLVEIVKSKSSPDPLSLGVGSKTDTQTHWFSESGRIDLFVFLGPTPQEISKTYGELTGYTQLPQQFAIAYHQCRWNYVTDEDVKEVDRKFDKYQIPYDVIWLDIEYTDDRKYFTWDPLSFPDPKGMEEQLDDSERKLVVIIDPHIKNKEGYSISEELKGKDLAIKNKGGETYDGWCWPGSSHWVDCFNPEAIKWWTSLFKYDKFKGTQPNVFIWNDMNEPSVFNGPETTMPKDNIHYGNWEHRDVHNVNGLTFINATYNALLERKKGVVRRPFVLTRSFYAGAQRVSAMWTGDNQATWEHLAASLPMVLNNGIAGFPFAGADVGGFFQNPSKELLTRWYQAGIWYPFFRAHAHIDTRRREPYLIAEPFRSIISQAIRLRYQLLPAWYTAFHEASVNGMPIVRPQYYVHPADEQGFAIDDQLYLGSTGLLTKPVVVEGATTTDIYIADDEKYYDYYDFTVYQGAGRRHTVPSPIEKVPLLMQGGHIIPRKDRARRSSGLMRWDPYTLVIVLDKNGKAEGTLYVDDGESFNYQQGAYIHRRFKFEKSTLLSEDIGTKGSKTAEYLKSMTNVRAQKVFFTRSKDRVKL

SEQ ID NO: 28309 - protein, 221 aa, A.fumigatus
LNASRIFAPRGEDQDFDLCDDCRLLIFLFRNPCIQRGSSALAIGCPRSSEEEAIYRLFALPQVSCRLRVAAAYLLSSGNWLADRRGRRLSQHSVTRPFSTTCRYSHYHANFVPSQLTISGAMWIRRSFGNDPLYHTVVQAYIDTLLQKGFNFECFIEGGRSRTGKLLSPKFGILNFIVDSLLSGRVEDTIICPVSTQYDKVIETEYGTPERMVPCHILLTH

SEQ ID NO: 28310 - protein, 132 aa, A.fumigatus
DRSHSYHRYVYRDYKGHIGTDSLQLFRGEFIFPPEGLTTNLEKTLRGLEKDEVITVSRDSSGKPLFVELSDAERQRGRENYDFYCFLIWPFIEAAWLGAVSLMGLTPPLDGPKDVWIDQKKAQDSAQIVSVF

SEQ ID NO: 28311 - protein, 90 aa, A.fumigatus
SFCSGIHVSSEEVLRLRSVAQEAAKKKQSIVFLPCHKSHVDYVSLQLICYRLGIGLPIVVAGDYLNIPLLGPFLQHAGTVIITPILYHHS

SEQ ID NO: 28312 - protein, 255 aa, A.fumigatus
QGHRDRVWHPRTYGSLSHSSDTLIRSYISELLGQPKRKENLADLLSSSSVLSLKLGRVDVRFHEPWSLREFITQQLSRLPNQIDAKSGQKLSYAERGRILRTLGYRVLSDINNVSVMMPTALVGTVLLTLRGRGVGKGELVRRVEWLCQRVRAKGGRVAHFYRSPTELVVDRALEVLGPKLVGEVTGLAEPTFYAIDRFQLSFYRNMTIHLFITEALVSAAMYTRVKQGGGPAHQRISFEDLLRQVSFLSQVCLS

SEQ ID NO: 28313 - protein, 615 aa, A.fumigatus
RQDYTSSHGADAAQSLGSEELWEAAESAWQKLPRAGKSNVAASRSASELHRQYQRHVLHICRGLWAKFDVPSMLQGVGILFAAIVLLVFYARGITAARTELTGSLLSSVGVGSVLGAVTGACLSYSRMLSARAVESSALLAAVGSIVGASWAIFGKSGRIVLPLPNSLWGWLAILFTVSQSMGFASNSYTIWEDEILLFFLSTFGVVAGASSMRQKSTADRVLGVYHSILFVILGRIASFSRLCREEHMPFCRSTYYASTTSSTSAPWQLVIPFLVTLTLPAVVRSFYAGSKSYEGAATLWIGFAFRFGLFVTSIFWTLEAADDSEWGLLSKETLKTIRVFFAQVVLALAFAAGTTAFVYTKPCVSISVSQGGAESEGREPARKTVTILGFGNVYGTRAFLLVVNFCLAIILMQKPMGQGAIGLLLWQIFSLLEILDTNGLVMGNSAIGPVVLGLLGSFHFFKTGHQATLTSIQWETAFIPLSSVQYPWSPILVILNTFGAQILTAIAVPLTVLWKRPLQLHDSSSSTTSSTPATRILSDVAQAAATYILYFATINLATTMWAGHLRRHLMLYRIFCPRFMMGAAVLGVVDIVLILFSVTSVRFSILSVAEIFGW

SEQ ID NO: 28314 - protein, 248 aa, A.fumigatus
YQHNIHNTKNSRPHHESRAEDPVEHEVAAQVASPHRGCEVDRCKVKNICRGRLRHIGQNPGGRRARCSGRAAIVQLEGSFPQHRERNSNCSEDLRAERVEDDQNRRPRILNRRQRDERSFPLDTGEGGLVSGLEEVERPKKTQDHRPDGRVAHDKPIRVKDLQEREDLPQQQADRPLTHRFLHENDGQAEINDEKESPCAINIPESQDSHRLSGRFSTLGFSAALADAYADARFGVNECGGSSGECKG

SEQ ID NO: 28315 - protein, 548 aa, A.fumigatus
  UNSURE (179),(229): Identity of amino acid sequences at the above locations are unknown.
PMAGTYTFLPGDLNASLKSRNRPYTGLRLPSSSPAKKRASSFYPEHGPEIVDETNPDPFYLEHSLGRSGAWGRSRGDIRDVRFCEETNQYFRLSPVNHSQKEPTFPKSVRGESKRTPRPSQPDRSTLTVVGFEHQYSIPPQVAVPRWEKHPPHESQGSFSSEQIDATPDLTPSSSFSSXYSSPIYPDSGLQGSEYPVLPVQLPAQRTQSRSSERFHQASAKQPVSLRPXSSNRPSTPARNTEITSSAETLRMPRTEDQDLSVRRGKPLPSLPINPRHGSGVPSKRSTNSGRRPSIEPSMISPPSLINPVTLEPHTTHFDQAMFIPANDCPSPVPSRGPPSPTTTSEAPVSSRSQRPSTSASEAPFEHSVWEPDSDSESLGPKSLSKKPMDTLKKVRSRVHLRVAKSAPKLQNSTASAPTDPPLEKFPTMPDHPPRDPFPEPVKSMAPLTLSSREVFRPSPLQTLRLVNPSTTSLARPRTPRSRRNSSQARGQDRDQPRNYDFDRSAAPAIKAKSQRKQRSNPLATPAVMEGKSVALPPARIPSNWPSS

SEQ ID NO: 28316 - protein, 465 aa, A.fumigatus
LPKSVTAEVVAENAQVQAIIEPRLKMLTDIANGFLTTIISSVDEAPYGIRWICKQIRSLSRRKYPDAQDQTICTLIGGFFFLRFINPAIVTPRSYMLIESVPTEKPRRTLTLIAKMLQNLANKPSYAKEPYMAKLQPFIQQNKERVNKFLLDLCEVQDFYESLEMDNYVALSKRDLELQITLNEMYATHALLEKHSLALAQDQHSHLNELLQELGSAPPLVPRKENRTITVPLFSRWETALDDLTAALDITQEEVFFMEAKSTFVQILRSLPPNSAIARRPLRLDRIAEAVATLKNDAVMVRKGIRTMELLSQLQEMGVIDRSDDFSLLRDEVEQELVHLGSLKEKVLEETKKLEEVFATIRDHNAYLVGQLETYKSYLHNVRSQSEGKQRKQQKHQELGPYKFTHQQLEKEGVIRKSNVPENRRANIYFMFKSPLPGTFVISLHYKGKCGLQPSICCDLLSCGG

SEQ ID NO: 28317 - protein, 248 aa, A.fumigatus
  UNSURE (96),(185): Identity of amino acid sequences at the above locations are unknown.
NSCVFKSPQKRRIGSLHMTPVDKGVLPQYNPGQFVSVRCYVPSIGSYHLGHNSLSDIPNGGHFGISVKRESARDSRPAGRISNVLHESLPVGAELXVSMPFGDFVLDLNATTPAVLISGGVGLTPMMSMLKSIVSQQGQSRRVVFIHAARNGRVHAMKTDLNRIVAENPTVSRIVFYENATEDDXQGVDYDYTGRVDLTQIKDKAVLPDADYYICGPQPFMKAQSQSLEALGVAPDRIHMEVFGAPRD

SEQ ID NO: 28318 - protein, 65 aa, A.fumigatus
QLIVPDIVPANVDSDDVHGCNIMPTSDEEIVNMLLLTSLRKSPEDGYGTPRMTGKHIPDQGGVAE

SEQ ID NO: 28319 - protein, 74 aa, A.fumigatus
SNLEAHQKIPCTPYLDYTHCISTSIKLTVASQNGHPSTSAPCCSNTPKLVIPDIKIFNSALGRQLNPPPISTSS

SEQ ID NO: 28320 - protein, 196 aa, A.fumigatus
LNPIGSISKVDLKKFIAWARDSFDLPILHDFLTATPTAELEPITATYVQSDEADMGVTYAELGTFGYLRKVAKLGPWSMYEKLLHVWGNEYSPREIYEKTRHFFYHYAINRHKMTVLTPSYHAEQYSPEDNRHDLRQFLCQLLSSTDGLLARVNADLCLLDPPFTWAYKKMEESVKYWESKGWTAGKAQKKSVKAD

SEQ ID NO: 28321 - protein, 128 aa, A.fumigatus
SSRIFHTSFMGTQNSSKETRERAKALSTEIGSYHIDFNFDTVVTAITNLFTVITNFQPRFKVHGGTGAENAALQNVQARLRMVLSYLFASLLPTVRQRPGGGGLLVLASSNVDGKIFSRLHLLRVQAH

SEQ ID NO: 28322 - protein, 65 aa, A.fumigatus
AHFDVFNALTLHDNPLFLEQLKFGAGDGQLHFYLYNYRTAPVPGGVNEKNLPDEKRMGGVGIVML

SEQ ID NO: 28323 - protein, 337 aa, A.fumigatus
AAGAVGFVDVSLRRGRQCHVPVQIFAVVPTLVGAQRGRGICFSPAWEGVDYLSADNFDRRALMSPGWKKEWHVGVRATKSRKLVASICGVPTEINVRNQKLKVVEINFLCIHKKLRSKRLTPVLIKEITRRCYLNGIYQAIYTAGVVLPTPVSSCRYYHRPLDWLKLYEVGFSPLPAGSTKARQITKNHLPSTTSTPGLRPMEPKDIDTVHDLLQRYLSRFALNQAFTREEVDHWLVHKPETVKEQVIWAYVVEDPETHKITDFFSFYNLESTVIQNPKHDNVRAAYLYYYATETAFTNNMKALKERLLMLMNDALILAKKVTTGIHCHFPGVDLRS

SEQ ID NO: 28324 - protein, 235 aa, A.fumigatus
WSPAKRLPPSVYILRLRRGAVAENLPEIHYLSRLRFSTTSLLALHTLEVMSNSKDRKGKAPEGQSSEKKDGAVNITPQMAESLLENNPALRNETAGMDKDKAAEAMRKMNIAELLTGLSVSGKNQKDMASYKFWQTQPVPRFDETSTDTGGPIKIIDPEKVSKEPDALLEGFEWATLDLTNETELQELWDLLTYHYVEDDNAMFRFRYSQSFLHWWVHNAAEGSVSHRLGRVWII

SEQ ID NO: 28325 - protein, 149 aa, A.fumigatus
SFQPRGEDTSFLSLVEADKTDRMEEVKAALKDHLKIENPSDAECQAVKVLVHAIGKRAARLSAVPLAAILISTGKLETDDMVDIGVDGSLVEFYPNFEGYIREALREVPEVGAAGEKKVRIGISKDGSGVGAALIALVASRNETGSGPK

SEQ ID NO: 28326 - protein, 61 aa, A.fumigatus
SRKVTCFSESSPRDKAHHMMVLEVKLDKDPTLRPLYCESVSVIVEYLCLVNPGRAYGYCTW

SEQ ID NO: 28327 - protein, 448 aa, A.fumigatus
RYVVLIPVKCVKADISGRITTNGTSVVVTGASTVDIFFDTQTSYRYPDETERDSAVKKQLDAAVKLNYPAVKQAATSDYQSLSGRVKLDLGSSGSAGNQPTDIRLTNYKTNPNGDPELVTLMFNFGRHSLIASSREGSSSGLPANLQGIWNQDYSPAWGGKYTVDVNLEMNYWHAQVTNLADTFEPVIDLMDKVLPHGQDVARKMYHCDTGYILHHNTDLWGDAAPVDNGTKWTMWPMGSAWLSMNLMDQYRFTQDKTLLRERIWPLLKSAADFYYCYLFEFEGYYTSGPSISPENAFRIPEDMTLAGKSTGIDLAPTMDNLLLHELFLAVIETCKALDITGEDLANAQKYISRIRQPQIGSYGQILEWRREYQETELGHRHMSPILGLYPGSQMTPLVNQTLANAAKVLLDHRITSGSGSTGWSRAWTMSLYARLFDGNSVWAPRTV

SEQ ID NO: 28328 - protein, 211 aa, A.fumigatus
AAQRQVEEALPNRPSRTVLVDLMGGADVPATNPAANGSQNTADVLADILGGDSGISSPAPQAAHAPAQSVNTSAIMDLFGSNGATPSPRPAEPASASVDILGGLGSAPSPAPSPSAAAVHTAYNKNDLTLTLQVQRAGHGNAQIQARFRNVSDFSQFSHVGLQAAVPKSQRLQLSAINKSELSAGDEGVQMLKIAAISGVSLSAFYKSTPG

SEQ ID NO: 28329 - protein, 120 aa, A.fumigatus
MYGMYHFHSRSSHSGATSPHESSVYLQLSHTRTLSSLHHLNTQLDNLPVTLTMAQTIRIPIRTEKAPLPPPFLSQGIKVGNMIYCSGQVGVDPTTGKMVEGPIQARTVLSLSPSSTILQR

SEQ ID NO: 28330 - protein, 71 aa, A.fumigatus
NDGTKATQKQILHNLSAVLEAGGSSLQDVVKVNIFLADMGDFAAVNEVYQAAFGEPKPGSFLLSVLLCVLR

SEQ ID NO: 28331 - protein, 363 aa, A.fumigatus
SFSSSETSVLLIVFVTFQRVWQVQLVAPMPILPTSIEGFSPHVDSNPGRAIEGGQWKPQSAPRTHARHGMSFLSWMAPFLPAWLTQRTNSDTNPNTNSNEKQRQRTRPTAYLDGLRGFAALVVYWGHHELWAHEGAGVGKAFELAYGYDNKYYFACLPGVRTIFAGGHFAVSVFFVLSGYVLSMKPLGCIQDGDYAELGKNLSSAVFRRWFRLYIPVICTTFGYLTFLHLFKIRTIPEFQGIYRSELWSWYAEFKNFTFVLGTGGEPWFTYNFHVWSIPVEYRGSLVVYTAALAFARFRRNARLIGEVALVGYLLYIADGAHFAMFVAGMLLRDLDLLAMRNDLPGFFRRLEPFKSVMMTGLF

SEQ ID NO: 28332 - protein, 438 aa, A.fumigatus
RAWRRTRRPQAFSSKQMGNRDTKATNTNGRIQLDLLQLVQRDYHLRSYTLNSVSYEFLKEQKEDVHHTMITELFNGTPDSRRRLAVYCLKDAYLPQRLMDKLMCLVNYTEMARVTGVPFNFLLSRGQQVKFLSQLFRKALEQQLVIPNIKSTDEQDYEGATVIEPIRGYYGVPIATLDFASLYPSIIQAHNLCYTTLLNKNIVEKLKLKKDEDYIVTPNGDMFCTTKVRKGLLSQILEELLAARKRAKKELAVETDPFKKAVLNGRQLALKVSANSVYGLTGATVGKLPCLPIASSTTSYGRQMIEKTKQEVEARYTIANGYSHDAKVIYGDTDSVMVKFGVTELEEAMKLGQEAADYVSSKFPKPIKLEFEKVYFPYLLINKKRYAGLYWTNPKKFDKMDTKGIETVRRDNCLLVQNVIETVLHKILIERDIDGAQE

SEQ ID NO: 28333 - protein, 119 aa, A.fumigatus
AFPFHPVVKTVIQIANVVTRYGESKPFIRNVFVLDTCSLIVNTQILEFDKEEKMLMAWRDFLEKVDPDVIIGYNIANFDFPYLLDRAKHLKCTGFPYWTRLKGMASHATSTSFFQQADG

SEQ ID NO: 28334 - protein, 369 aa, A.fumigatus
AGWMGKGKNRDSEQEQHVSRPLSSLKDPSAFGPPPKHIAVHGPGAVPNQTTPDRRGLGAPLSQEEIQHAQARQQEQNRAEEAEPPKPAGPPLPYRVNTTGINTDNLPPPPARRLHSPASSVSSAGSRPVPSVPPPVPPRMNSTTQSHPATPPPAYSPSETASEGFLNQSAVTRLSNAGVSVPSLGIGHNRSSPSNTPGGVAGPASVNELQARFSQMRTSLSQSPSQAPSPPVRGSTTQPELSTASPHSNLHERHNDKLQAGKERVQDLNDKYKITQRFNNFVDEKRSANTSISSQQFRLPPTPPHPDRSQPSPDSVELDALNRRKAPPPPPPKKAAMRSTPVNAPSSTSPVPPPLPLSTKPARAEVRYN

SEQ ID NO: 28335 - protein, 436 aa, A.fumigatus
SPADRVDDNCYSDAATNYPNVNYEPSTSPRPRYEIMSSALARVGRPILFQICEWGIDFPALWAPALGNSWRIGNDIIPAWRSIFRTLNQAVANTDFAGPGQWADLDMLYVGNGVFSLPEEQTHFSLWAILKSPLTIGAALKDDDTSISQASLEVLKQKDVIGFNQDALGVSASLKRRWSDEGYEVWSGPLSGNRTVVAVINWRNESRDLTLDLPDVGLQYAQVARNIWGKTVVRDVRTSYTAGVAGHGTILLELQGTLPSGLYPAKIFAKSTGQRSTFESIYAATTSANYELAITFSRPSTETVTITTSSGQTVSISGKSGRIALTAGSNTITIQHKTPIESIQITPPTGTYYANTVFNVTGSAKHTTCGSGCSPVGSKIGYLSPTSNAYTSISTTTAGSKYLAIDYINNEVAFSSSWGWGSNSRSSPRGWKGPRL

SEQ ID NO: 28336 - protein, 148 aa, A.fumigatus
LARWNSYNYYSCSPNEAIIRSNAKALVDLGLAELGYRYVTTDCGWSVADRLPNGTLTWNETLFPSGFPAMGEYLHELGLLFGVYGDSGTKLCGSPPDQVGSLCKSPSSMILTLANVPDHEEQDAKTFAEWGADSLKCMSVCPLKMKPR

SEQ ID NO: 28337 - protein, 172 aa, A.fumigatus
ATAKHFFDDPNHLVQTALHSLTLTNPSLAFDSKHKVIFRRPDASRKPKVAIISGGGSGHEPAFAGYVGHGLMDASVAGSIFASPSAEQIRHAAMNCVDNEKGVLIIPMNYTGDVLNFGMAAEKSRAAGIKTEFFAINDDAGVGRKKGGKVGRRGIGGGILILKIVGALAETG

SEQ ID NO: 28338 - protein, 238 aa, A.fumigatus
  UNSURE (228): Identity of amino acid sequences at the above locations are unknown.
TVLCRASLEDVYRVAQLANANLASVGSSLEHVHIPGRGVPEDVIPDGEVEVGMGIHNEPGSHRMKFSLPEVIKTMLLQILDHNDPDRAFLTYQPGDQFVLLINNLGGVSTLELSGITDEVYRQLTKDFHIKPVRIIQGTFLTSLNGLGFSVSLLKLADTGLGPGKSMLELLDAPAEAVGWSAPIRTSTWEAHQSDAPVQVKSTKLAEDQPTNINRKFKIVPHHAAKRXRFGEPPEKEV

SEQ ID NO: 28339 - protein, 67 aa, A.fumigatus
SGQKSGDIQIADYSPRFEDAAGPTERLPLFALNNLSATVSRGMSSNPTMSGRISPSIDANPGRGWTW

SEQ ID NO: 28340 - protein, 153 aa, A.fumigatus
RPCGKKKQSARLTTSRAQLQSVQMQVNEAFSMRKIQGSLKKSTGIMKDVNTLVRLPELTGTMRQLATELVRAGIIEEMVDDAIPNNELYEDEEDEAEAEVDKVLQEILQGKLSQAGEVKAEEPAEGEPAIEDQMEDQEAALEQMRGRLEALKS

SEQ ID NO: 28341 - protein, 119 aa, A.fumigatus
TSHSPIRTTHSSSTTMSTKLDKSLDEILVNRRQNARRRTRRPAASKPGSAAVPVGGVKKNAKAAKPVAKGAQGGHPVATESKIMVSGLVSFHLRSELVMCGYANSLKPSDVNEANIKVC

SEQ ID NO: 28342 - protein, 349 aa, A.fumigatus
QGRAPRAWTRLASSYKQNGTISALGSYYRLTPCTVLLQCGGTITGFAEYTNDQLTYLLCTLYSDCTNYTMSTPSTPRTARSASESGTPILTPGRKIRAILAAFDSDSESDNANNKQRTIQKPVETMNDVESEDDDDDDIVKPKGRLAARMQAHDQTSASPPVTERTAFDRVSKFLRAEREQSKEGEQARLESASASEDEDDLPKAGPRRRRNVRKTPEPGENNTSASSSRARSFSPLFMSSPAPQRNEALSDDEANDDDEEDLKADPRVRALIMQKRKEREEKERLEAEKQTARLAQRDQFSSEIASVEDIDEEEAGRKLTQQRPAARKASQKSFGKEMEPAKRQRIRR

SEQ ID NO: 28343 - protein, 159 aa, A.fumigatus
WHLQLELAELMGPKLAFSTQPSKPRKEKSDYERLAELNLRGQKLNTESVRRAQLEERKASRKAAAAVARGEAQANPFMRVRTLAKTHYDANGNSLIPDSLSSRGGTPATGSETPSKPSTPKPAVTTQKKQSKGGIGSIRHRNMDDENIAALDLELDIEI

SEQ ID NO: 28344 - protein, 497 aa, A.fumigatus
  UNSURE (407),(414),(421),(424),(427),(463),(473): Identity of amino acid sequences at the above locations are unknown.
RQEERPAKVGKRLAVFSGQISPNDFPGPMTKRRKHSNSGRLPSDLTMTKLENGQSSVGGSNSGVLGNDTSFNAARGFASPAERPFVTPSAMSGQFANRPPTPNSGDNNPFFNPSATQTSLDTFIQQQLMSAPNSAQPSRPGTPGNSARHGFQDQSINISLGSSTSTPAWPPLTNAGNRLPSVIHKVVPAEGSITGGTEVTLLGSGFYPGMEVVFGDTLATTTTFWGDKCLNCLTPPALQPGMVAVVFKHEHPTFGQMQPAQPLMPKQQQFFRYVDDRELQMYRLALGILGQKLGNQADAFQTAQQIMGSDPKAVFNLQKDFSAGSGGHQRQVPGLESQGELSDLDSKMLTYLEFIDLDDNPRPPKYNSRCATGQTLLHFASSLGLTRFVAGLLARGANPEVQDNIGXTPMHLAXLHGHAHXVNXLRXAGADVNARSIRGFTPADLTTTLPTHQAALDPCSHNXFRTVGSVTSXRRRPYSSCSLNSLWKSPPDSGINE

SEQ ID NO: 28345 - protein, 61 aa, A.fumigatus
  UNSURE (18),(21),(24),(31),(38): Identity of amino acid sequences at the above locations are unknown.
VGRSETPDAASVNVGTSXTQXVHXMRMTMQXGQVHGRXSDIVLYLRVRSSGEQSGNETSQA

SEQ ID NO: 28346 - protein, 501 aa, A.fumigatus
TQHQNPDGVVVSFSQPPETDNNYFTTSRRSFNRHNISEQTKTLGDKACWPLNNYNMPRNVKKNPRDVTKLSGKPLAETIEPSPVLKTLQEGWVTSPDLIEGDLSFTLEVIQNMTVFLLANPNLNSSHLFRADILYDSLGVLSAPHAMEQSRYQGSGGRNQDTQKEDYVEPLPARSVPGFELKRTFVRRLIPRNRNLDRPLEQTCHFYEADELPPTSNSTNIAQSEQCESKAESPRQRFLVIYLPHVSSKEEMPWYHPLLRSLAFLYEFTPNAFPHSSEENKGTGIMSVHFLPYEEEPIQNRLERTLLALLSTHIRLARQTRLDEKPERGNYNPPKDNVIPKHLVQDTYARLKLKYAADLCQNWVEDTEPTKHVLEDSPITAFLIQLWKNMYGIVPPNERTPTQWNREVPLKFPRVPEFPCGTGVRSSSPLGRVTCWGIKALLQNTELFPLSLRKKIREEFSFRTLCKLLPNRKRLGVKPPGLFLETFPLLIWEKTNLGLLW

SEQ ID NO: 28347 - protein, 508 aa, A.fumigatus
  UNSURE (254): Identity of amino acid sequences at the above locations are unknown.
PRLAGGLIAHNDGFALLTNEALPSGTSNAPPSNTPVPVLYRYTNGQQTWKTWLGGPGVHEADGLSASPDLNGDLAYSESAKMYGAYFVVTDYTGWAQGHFGDSIQYVSDNGTLVTIPGASSSWGCSHNTGIAFEAADEPPFASICAEDQGAIWLNTKTQGMSNDGVKISNENTTNGASGEPMGGMSGSYSALARFADTARYIFAWVSRGAMDVTENSWMGAGYTHVNNRTNGRNVAIALFSDKYTKVGAQATSXVGAEDGDSQVTWITSGSNDCSNAHAATFGADSALITWEEISNPTCDYIAMGCRGQFAGSFFQQVDSSGKKVGEALTSTDTYVAGDMVTMADGRVCWPYVSMTWDLSQPVGFSSSTTKKMSFACISLGGASSSSSSSSAASSASSASSASNVVTPQPEASSSASATATPEAGASSESAAVPSGASSASSDSTVDTETNYASEPAAQDASVPAPTDTQPAVEAETPTPAPTASSGRKGSHGHGHLKYKHPTSCRAK

SEQ ID NO: 28348 - protein, 174 aa, A.fumigatus
PTKPCLPEPAMRPRPTPPFQSSTATPTASRRGRPGWVAPECTRLTACQLLPTSTAIWPTPKAPRCTAPILSSLTTRAGPRATSATVFSTCRTTEPSSRSPAPAAPGAAVTTPALRSRPRTNHPLPASAPRTKAPSGSTPRRRECPTTGSRSPMRTPPTEPRVSPWAVCPAATVL

SEQ ID NO: 28349 - protein, 76 aa, A.fumigatus
  UNSURE (3): Identity of amino acid sequences at the above locations are unknown.
SAXPFIPAVGHDHVDPAVLLGFMSKYTSSSADWARYMRNDPSKNYTRNLVADISGRANLVCHLCHSRYLPNLEVRD

SEQ ID NO: 28350 - protein, 131 aa, A.fumigatus
LLLVWNPEKGSPIHDHANAHCIMKILDGELNESVYYTPTAEDQDSPLKIKTNTTYQPNEVAYISDQIGLHRVVNPAKDRLAVSLHCTFMIMAFWRVWTNEQRLVYTPPNAADFGYNIYDPITGKSSHVFQA

SEQ ID NO: 28351 - protein, 62 aa, A.fumigatus
  UNSURE (38): Identity of amino acid sequences at the above locations are unknown.
QLTPTDGGWMPSALIGQAQRFNNVPPKAKNGKIFLPVXENRLPKIYHGTRPFALQHFVSISR

SEQ ID NO: 28352 - protein, 416 aa, A.fumigatus
TDQLLAGSHPLLHQPPVILHPIRTQHPPEDTTLPHTAHPQIIQQQIHIRNRIKHKVRVPLPKPAGIPPLAKLGMQRRLPHQIHLLALFVQLLGIYICVVVVLVDRPQRTRTPLRRAQHGTPSKERSDPQRLHLRQQRRVDRHGNPHKRQGAFPRQRARHHEAGQAEGMRDGGGGIRRERGVVLGRGGLVAQPREPTEDFFVGGGEEIRWDGVCGPGEAAVGLQAGREEVEVGGGFPAGGADEGVGGEVRAGGEVDGSLGETGDVGDVDAHGAGADQLEEVRWVVEDAEAGGDPEGADPGLELGGLRVGVVAVQLDDVVGEDAPKRVDDLAPEPGAVQEAADARVAVGGAPDAGAEEGQEARGDQLLEPLLQRGDVRRRHPDGPVTVLADDPVDLRARRGGRVDGVRLRPQGLEEPA

SEQ ID NO: 28353 - protein, 108 aa, A.fumigatus
SAFPSIPRVEELCPPYGLEQNWSDGPFETAVRTWYWGREKVGPFSVVWFDMLPAGHGTEVVSGYVAVGMEVVVSVRPWKDGWQLHIRQCVRMCRMGFRVFIGLGWRWM

SEQ ID NO: 28354 - protein, 170 aa, A.fumigatus
TATTPTRRPPSSSPGSAPSGSPPASASSTTQRTSSSWSAPAPCASTSPTSPVSPREPSTSPPARTSPPTPSSAPPAGKPPPTSTSSRPAWRPTAASPGPQTPSQRISSPPPTKKSSVGSRGCATSPPRPRTTPRSRRMPPPPSRIPSAWPASWCRARWRGNAPWRLWGLP

SEQ ID NO: 28355 - protein, 364 aa, A.fumigatus
ARVLPAPVVEDGRRLRGRHGGRAGRLGHPPERSRARLDGAAVRHPAEEVAREAGHHAPPDLLQPLHLGRRRRLPAHPPLPARHRARAQDRRRVLAHPRQRRRPAEPLRRPPGDRQAQALDQPLLDRLRPQHPQLPNGLLRAGPLRRRARPRRQHHPSRPGNRPPLLRHGPPLRRPHLLHRLESHPQPRLPPARLGDRLRLPLGRRPHPSGSPRRRRRRNPPSVPAAAQPARPAQGLRPARAGCPRHRRASLPPGPLHGAVLVGEGTLPGVYGDCHDDQHDVAGAGAGAVDRCVLWRESRVAHDGAVSSCAAGGRRERRPRRCRCREAGRKARANGSGVGDGAAYPVWQVAVSRRVWEAEPGLCV

SEQ ID NO: 28356 - protein, 412 aa, A.fumigatus
RGFFQPLWSKTDAVYAAATAGAQVDWVIRQNGHGPVWMAPPYVTPLKKWLEKLVTTRLLTFFSPCIWGAADGYPRIRRFLHGTGLGRKIVDAFWRILANDVVQLNRYDAHPETAKLKPWISPFWIASGLSILNYPTDFFELVRSGAVRVHVANITRLAQGTVHLSSGTDLPSDALICSTGWKATPNLDFLPPGLETDCGFPWAADPIPADLLAAADEEILRRFPRLRNQPAPPKDYAPLAPDAPATVAHPFRLARFMVPCSLARERSLAFMGIAMTINTTLLAQVQALWIAAFFGGSPVLRTTERCPRALRAVDENDDHADVDAEKLDEKREQMDLVWETALHTQFGKWRYPGGFGKRNPDFVFDAIPYVDLLLNDLGVSSVRKSGIFGRVLSPYGMEDYRGLVEEWMAARQ

SEQ ID NO: 28357 - protein, 62 aa, A.fumigatus
  UNSURE (28),(29): Identity of amino acid sequences at the above locations are unknown.
LRRYSTSSPHLSHLGNYVVLYEYINARXXPSSYLTLFHIAVNNYCDDSSLLMIITGADCTDC

SEQ ID NO: 28358 - protein, 411 aa, A.fumigatus
  UNSURE (406): Identity of amino acid sequences at the above locations are unknown.
PMRHPPFPLVYQLKTKSYTACTNHLTYNNLKTATIRTASDADDDAGSNSDIDRHGVDVDDARAHFLGATVDARDVNFSDSIALKRKSYRSKSRRRRRGPDGVEDVGDASDTEEESFERKLARLRREVEELKDEMASRKAKSESTEEPAQAVDDGVLELSRALDNLHGSSQNASGSHSAAAVLSRKLVSTSSQGIPGESKGADQPIATEDAVTLSSAGVLAHAAAFDGRLALIEAAMGISSSSNPFVSDGISEPALQPVLPALDHLTSRLSTLTNMLAGPTPASAVPTTGSAPPSTTFTTTHLEALSSRVRRLTADADALASARIRAVDAAKAAQKARIATSTIEQASDMSVSSGSGTEIEQAAAQRDEQATKIQALYANLPQYPVPFILSLTSVVEPLTFPPWPSXPGGAH

SEQ ID NO: 28359 - protein, 190 aa, A.fumigatus
  UNSURE (187): Identity of amino acid sequences at the above locations are unknown.
VTDKAESPSVYCRDLIAILPSGCAIPYRVAHMAPFTFLVGILSLCICCIVLGAAAEPSYAVVEQLRNVPDGWIKHDAAPASELIRFRLAMNQERTAEFERRVIDMSTPGHSSYGQHMKRDDVREFLRPPEEVSDKVLSWLRSENVPAGSIESHGNWVTFTVPVSQAERMLRTRFLRLPPRWRQVSTXSSE

SEQ ID NO: 28360 - protein, 90 aa, A.fumigatus
KAYAPTRHRYTALSLTASNVCLKRPSSDDGVLSSRLSKSFKFSTLMSLIMRRKKSSHPTRQANAGSSPGKAQTDNRASAVILLVQILANK

SEQ ID NO: 28361 - protein, 68 aa, A.fumigatus
YAGFNQAKKHLHFINAMRYVRASMVICIPFLTLYILQVRTDAVIAAVYISRSCGVISRLSGPPRLPSP

SEQ ID NO: 28362 - protein, 396 aa, A.fumigatus
SQDLQPILKQGTENKRTVDLTQPHITRNMNKNDSVIIIGAGAFGLSTALRLAQDGYTSITVLDRCMPPVPDGSSNDISRVIRFDYGDPVYAQIAKEAYDQWKTPQYSEAFHQTPCLWVSQEGTLEQPVQPRAAEYSRKTRQVLTEMGQEWHAVPSVEEAKRRFPALSGKLATPGFDGFYNTNAGWADAGLAVQRLASRCVAAGVSFITGPNGHVVELEYGRDGVVDAVRTINGNRITGDRFIVATGAWTASLIPSWNSMMATGQIVGWLRLTPEEMVRLKDLPIYFNFSTGFFCFPVHEATGYLKVAVHGFGYTSPHPKAVSAPPSSAVSARANFIPADGMKRLLAGLRDILPELAERGFEKVGLCWYNDTPTGDFIFDYHPEHKNLFIATGGSGQ

SEQ ID NO: 28363 - protein, 201 aa, A.fumigatus
SSSNLRHESSRSFLALTMGAGRSRRPQVCAGYILELGQVHGKILLQVRCAFSGLIRIDVLTEIRWPVIVGIIIGAVILISVIACVINCLCCGIQCCTGCCRCCSCCCPSPRNKAPRPKYLDDPGYHQPPPMPANDGYRAPPGPPVYRGAQVARFESTTSPAPAKVNEDALPAMPTWNDAVTRRVEDNSPQDTMEMEPLNPA

SEQ ID NO: 28364 - protein, 173 aa, A.fumigatus
QDYQRVQSPRRFNSPGQMDVPPVRTQTSSPGYFHASSPYDDERLYGHDSSGTYNQSTTSPYDRAYHDYSPQNFSQPMTRNAAPYSSQTQYSNMPTALSPSAEVPRHLPYRQPSPGMSSMPPPSYRGMSPNPPTSPPPPFSATNPVPLEVSDPGRPPSILQSGRKPAPNSYRNV

SEQ ID NO: 28365 - protein, 155 aa, A.fumigatus
DANFHKRQELTISLADIIDSKTQEIRAEDGEVYSKMQDLADELPESSPRFILLSYPLTLVGGICAGGSDAPPLKSCSKNVRVLETNFFSSHQGSGRLTVPYVLLYYLPENCNPSMRMTYAGAVELMRNTAEVNRVIEVQDEDDILSIESKLQGSD

SEQ ID NO: 28366 - protein, 83 aa, A.fumigatus
CQQLQTIDTNSAFFAKYCFSLGIQLKRVEVIADDEDEIIEAVRRMSNNYDFVVTSGGIGPTSVHALTYTSLTTPSCYIASVQS

SEQ ID NO: 28367 - protein, 65 aa, A.fumigatus
LIWRYRPLSSFFIKSPSTTARLDNSLIYPFLSILLRYLYRASSSSYNIVNKGLYSSNFLLSSYIL

SEQ ID NO: 28368 - protein, 176 aa, A.fumigatus
RLSDIVKVRLQTTSEYKSALDCATRIFKNEGPLAFYKGTLTPLIGIGACVRLRFDSLDICLQELIFCRSAYNSVRSMKPEDGWRSSTRRNMPIRPSPMVSTIWLEVSRVSPTPPSRDPLSMSASACRRNLTARPACTAVRSTASGNSFLREACCAVSTEARMSRISEKPRPTVPGF

SEQ ID NO: 28369 - protein, 228 aa, A.fumigatus
HLLARTHILQVSVQFGAFHEARRRLEELNKKKYADPTLSYGQYYLAGSFAGLTNSALSGPIEHVRIRLQTQPHGEARLYSGPLDCIRKLISQGGVLRGLYRGQNVTYLREAQAYGTWFLTFEYLMNQDAKRNNIKREEISSIKVATYGGLAGEVLWLSSYPFDVVKSKMQCDGFGAQQQYKSMTDCFKKTFATEGFGGFWKGLGPTLLRAMPVSAGTFAVYVPLTSLI

SEQ ID NO: 28370 - protein, 60 aa, A.fumigatus
LLKEESLVVGMPIYYVSTATAMVNNSTERSVKCLPLFSYQPFSLRCVPRGRPIGYAQSTG

SEQ ID NO: 28371 - protein, 156 aa, A.fumigatus
FQVNAVWASLGASAGISILLALLFSLFRPRHTLVYAPKVKHADRRHTPPPVGKGFFAWMRPVLRTREPELVECIGLDATVFLRFTKMCRNIFIILSIIGCGVMIPVNLTQSNGSGISSLSAFATMTPLYVTTEAIWSQVICAWAFDIFTTRLEGTT

SEQ ID NO: 28372 - protein, 215 aa, A.fumigatus
HMTSSCTNDWRLSLVNINITGGGFPGTNTFAVSFSFQSQIILYPVSVKASMDTWQRNIRMMHQVGEFLDLDSTKSDMVAEFIALIQAVREGLMQIDDNFQIPDAHINTLFLTKLKSRPQWKEWATTMLRDPRITAANSTEHVTFQELASLAIEQEKAIQQGDAKGRNASDNAASVAATSNVEANPRALTQDEINAFVVKQMNRLHHGAGRIDGGA

SEQ ID NO: 28373 - protein, 73 aa, A.fumigatus
FNTCTYWLLLSLYFVPNPYLVGVYLIFFIICNPLCLVPSFSAPTECDFPGCGHRPSDPPGQNRQGTRNPTMEL

SEQ ID NO: 28374 - protein, 83 aa, A.fumigatus
TNFSYKLISRLASSKFAKSKTKTWHESDNSIEEEHLTRSCYLSASEGKKEPYNPDCLLSALNSIQYSKLFELNHHRKMPSSKL

SEQ ID NO: 28375 - protein, 361 aa, A.fumigatus
  UNSURE (49),(62): Identity of amino acid sequences at the above locations are unknown.
MYLRGEGVEQNFNHALTWFTRGLVIGDSLCQHEIGLMYLHGYGVPQDAXKAASYFKSAADQXYPASETRLGVLFLDQGDVATATRYFELAARWGSMEAFYYLAELSNNGIGRQRHCGMAASYYKMVAERAEAIHSSFAESNAAYERGDKEAALIPAMMAAEQGYESAQANVAFLLDEQRSLLSLDTMLPGIKKSRPSLLRNAALALIYWTRSAKQANIDSLIKMGDYYLSGTGIEADPEKASICYHTAAEAHYSAQAYWNLGWMHENGVAVEQDFHMAKRYYDLALEANAGAYLPVKLSLIKLRIRSYWNKITNGKVNSIREEEGKGTQEDFFRLRLFNMLTGHRRTKASSDIQRVDCGVY

SEQ ID NO: 28376 - protein, 159 aa, A.fumigatus
LHRRRTSYQILLSQRFRREERALQSRLSALRSELDTVQQALRIESSSKDAELEALILKWKTVSQEAAEEVFEGARERVSRMGGMKAWRERMQSDSARREQEEMNLWYGNAEAEGPEINEEELEQRKAELLDEVEMPRKEQEVVSEREIAEDEVCLNGFL

SEQ ID NO: 28377 - protein, 60 aa, A.fumigatus
IKEPYTSGGSVSTAISGITLSSIPILNPSILKKQPLPMHDKRGDCQSALWKASQYRDQRH

SEQ ID NO: 28378 - protein, 154 aa, A.fumigatus
GVSILSSSQRNPFKHTSSSAISLSLTTSCSFRGISTSSRSSAFRCSSSSSLISGPSASALPYHKFISSCSRLALSLCIRSLQAFIPPIRETRSRAPSKTSSAASWLTVFHLRIRASSSASFDDDSIRRACCTVSSSERRADSLDCRALSSLLKR

SEQ ID NO: 28379 - protein, 212 aa, A.fumigatus
ILVNAGSQSYKKIISSGDLEQSTINRLSHTMTTLPESKMSTTRYTMWYWYDQSCAFKTEDPNFSLNQLSKLVNAVQKEVNDETLVLPSQGPARPRQMEVAVFFPTSDADQGRFSRETGTELINRKARELKLPCSDFVSQSVENVRSFTRQEIERVFSFAKLPPNLIKEASEKIPSGQSHSGIYMTRRDLNRLTWLTGKSLAKEMEAKLRGPP

SEQ ID NO: 28380 - protein, 456 aa, A.fumigatus
TAPWRFSVTLFSMSWSWRCLDSELLLSRLRSNLLSLFPPYLNDPLRRGHRTDSTRHTRHKRSKSALALAILHRDKSKDNDDLTGRESGSLESGASSPINSTSSFSLLSHKNSIPRKSPQEAKSPPMDSEASLEPPGSNNSAENVEKMPTQAQSAIGSMTLEQSVRTFRLFEILRSGDTNAISKAIKETREPQGAGALTGTTILHLAIQCAEPQVVEFILSLGDDLDINARDRDGNTPLHLAAQLGRGPLVRELLNRPSVNDSIVNYRGQTALDVARNPEIFQQLQLARSLFIDSKTQEIQSLVYQGDYDNLERVLEEPRVEGILDVNSLDLVTDPTTAQSGGTLLHEGARKKDTRLIQILLMHGADPFRRDKKGRLPQDVTKDDKTRAIVKKSPAAVIAQRGIQEKAILGSNPAQGVSGRTGAGEAPLVGKDAREMRGYLKKWTNYTSGYKLRWLS

SEQ ID NO: 28381 - protein, 87 aa, A.fumigatus
QCTENTKKKIFTLHTSKMSLADDVDLDEFINQKDDLSGADIRAICTEAGLMALRERRMRVQMDDFRAARERIMKTKQDGGPVEGLYL

SEQ ID NO: 28382 - protein, 233 aa, A.fumigatus
  UNSURE (39): Identity of amino acid sequences at the above locations are unknown.
WIRRFKESREFVGFGLGSTRKLYEEVGIKPPKGVILYVXPGTGKTWFAKAVANQTSATFLRIVGSELIQNILGDGLRLVRQIFQVAAEHAPSIVFIDEIDAIGTKRYDFTSGGEREIQRTMLELLNQLDGFDDRGDVKVIMATNKIETLDPALIRPGRIDRKILFENPDREYPAKQLAVVSLTDNAQKIPRRRSSPFTRPRCPLRMTLTSMNSSTRKTISLVLISELFAQKPV

SEQ ID NO: 28383 - protein, 204 aa, A.fumigatus
LALNKHFARSLSITMDGFDEEAFKKFFPSSFGKQEKKLDVNAQIDRTKRSKLSTEPDGDKEEVTDNKPAVEDGEAEDETRGHDRKADSEDDSDDDDSEEEEDEFPVSHELLIKTHERAVTTMTVDPAGARLITGSTDCTLKLHDFASMTPTTIRAFKSVDPSAKKQSAAQETHPVHYVAFNPLSPSHVMVVSATPQPRILDRDG

SEQ ID NO: 28384 - protein, 158 aa, A.fumigatus
  UNSURE (156): Identity of amino acid sequences at the above locations are unknown.
RSSSWYFLCIVSQGNHSELLSRVLTVWVFEENLSVNTTRTDQGRIQSLNLVCGHNNLYITTVVETIQLVKKLQHSTLDFSFTTRCKVVALGTDGINFIDEDNRGRMLSSDLENLSHQPKTISQNILDQLTSDDSKESGAGLVCNSLGKPSFTGTWXHV

SEQ ID NO: 28385 - protein, 185 aa, A.fumigatus
RKAVLLNLRSHKTPIDEIPTLQIQALHRTAILLSLHDPFPCGTEIIHLHPHTALSQRHQTGFCANSSDISTREIVFLVDEFIEVNVIRKGHLGRVKGEDLLLGIFCALSVKETTASCLAGYSRSGFSKRIFRSIRPGRIKAGSRVSILFVAIITFTSPRSSKPSSWLRSSNIVRWISRSPPDVKS

SEQ ID NO: 28386 - protein, 168 aa, A.fumigatus
  UNSURE (131): Identity of amino acid sequences at the above locations are unknown.
SRRSRHQNRTPQGRRLCPQLRQPRQRPLFTLCLDQPIQGKSGARRQECPRPPHTHATALPHRRLSPEPRPGSKRPTRPFIRRLIRKASISDRLQHLWLWAGWALPRQESVRSPHSKRGGSPLRHGDGHRAXKSWYLDCGYLRGQLRILKYPCCLVRAGKRPRAPWTQH

SEQ ID NO: 28387 - protein, 275 aa, A.fumigatus
  UNSURE (163): Identity of amino acid sequences at the above locations are unknown.
RTATKESPLSGITVVSLEQAIAAPFCTRQLADLGARVIKIERPKVGDFARNYDSRVNGLSSHFVWTNRSKESLALDVKNARDHRILMRLLSRTDVLVQNLAPGASARLGLSFADLSEKHPSLIVCNISGYGPDGPYRDKKAYDLLIQSEAGLLSVTGTATEPXKVGISIADICAGSYAYSNILAALFERERDPERRGRNIDISMLESMVEWMGFPMYYTYGDQPGPTPAGAAHAAIYPFGPFETGKGTVMLGIQNEREWAKFCEMVLEKPEMIDG

SEQ ID NO: 28388 - protein, 118 aa, A.fumigatus
STDERFCNNSLRVKNRDALRETICKVFAAYSAEGVLRRLDEAGIANAIVNDMQGVWNHPQLRARQRWTQIQTPAGAVPALFPPGTGPDGFEAQMGAVPEIGQHNEAILAELGIDTDIE

SEQ ID NO: 28389 - protein, 405 aa, A.fumigatus
EPVQAPIIGRKRKTKKAPTSNADASNTSADNAPEPTKVSQPGPQEAAERVEPKTEETKKNKQEKPPKPHIEEKQPVSENKPAEPWRSKNTLEQLIKDSEQSGVSIKDLFLERTSPLQVLLAQLHKAGQLDLNNHPLFNPSNLSQRFDMKCTSDDYELLKQPIELTEEHRKALLRGEPVRLHSSSSQLKDRCLITPRGCVLHHLTPEEEDRYLALEKSMEWTTESFQEYPAALITEPDVTNRGGGLDALFATPENFNICWVDETTTNLSSAAHAGSPPAADASVSSTASAPPNVLSTMEADSTRSHNWAIASTAELANATAASVRSFAAATAKHMLGAAGVVMGTIPDLDDVVGMTDEELRSFALKSQKDLEGSRKELDAIDKKLAALFKRNKKLAQQALATTVEV

SEQ ID NO: 28390 - protein, 99 aa, A.fumigatus
  UNSURE (6): Identity of amino acid sequences at the above locations are unknown.
EDWKRXDNPIIRLRKWLENEGLWNEDMEQETRDQLRKAVLKEFGDAEREKKPPIRAAFEDVYDELTEEAQEQMKELKRILETYPEEYDLRQYEDGIKGL

SEQ ID NO: 28391 - protein, 506 aa, A.fumigatus
  UNSURE (496),(498): Identity of amino acid sequences at the above locations are unknown.
GVYADRHLVVKPRWPLLFNSFHSLTQWASAIRLSLFEHTSLYEAYTGSIIAGKGKNLNNIRSILERNRFKQEDWARVRFGAGTPWRRCWFVISPPNEKEYQKAQKSLKKSAYDRAPKLATGDIKFYDTRKTKKAKPIATITDAYAAYAIYPQSKALIDQSTLVKIEGTVTIHSNPESTSEGFVFVMPEVHPAISGFEMMVRFLIPTFDTFNLYGRPTRLIAATNHVKSIMFAFTSQRRYGYLDVLDVASLMQMPGSHSWTEAEWRKQLKDATAQRMAAAGSRTSSISSRKPRYRASLPNRYSNAPAGGPRNNHLLPESRPEYNQSADAILNESQKEDIASSYHSRGYSDTTGTEPMQQRVQARVMEGSPSSSDQDLMPVERQQAGTASVSDRSSEEGDWKQQVDPPATAVGENLRPQSPPDPVAMPPAFMHAPGETPSNRPLPSPDLRKANNRMSDGTLTQLAAAGKLNLSNLALPSTTEHRVQGLHHGAGRIDGXSXEIHTGFQS

SEQ ID NO: 28392 - protein, 77 aa, A.fumigatus
FHSWALIITLGPIYFLNEDLAQSSSPYYSLLPFCSFLLVLSPGRVGYIFNRHDLLLLFCLYASLTSVILLKTLGPFN

SEQ ID NO: 28393 - protein, 60 aa, A.fumigatus
LSVLSNSYQPGGSSGFTKDKDPLSDPDACLRDAALMQRLGVRFTGSLSRFFWYVTYAKVG

SEQ ID NO: 28394 - protein, 66 aa, A.fumigatus
VLQNSGPNTNGCQFFITTTATPFLNGKHVVFGQVVDGMDIVRMIENTRTIRDKPSQDVIITQCGEM

SEQ ID NO: 28395 - protein, 77 aa, A.fumigatus
HSVAIGVPLGRIKMELFADVTPRTAENFRRFCTGESKNSQGKPQGYKNSKFHRVVRLQPFVSAQKADPKPLSRSKIL

SEQ ID NO: 28396 - protein, 62 aa, A.fumigatus
VNPGIVELWTVLSATELWAKYKWLPVLHNNYSDPLLEWEACRVWAGSGWHGYRADDRKYTHD

SEQ ID NO: 28397 - protein, 461 aa, A.fumigatus
EPKEGSKGQKKSATGTVKLDFHDMGKLEKMKNVPKTEDSAKFGKGDITAEIKAIYHGKNFHSSTAQIPDGEQIGIILDRTNFYAEQGGQENDTGRIIIDGRAELEVGDVQLYAGYVLHTGFMKYGSFSIGDAVLCEYDELRRWPIRNNHTGTHILNFALRRVLGDSVEQKGSLVAAEKLRFDFSHKSAVTEKELEKIEEISTEYIRQNCDVYSQEVPLATARRISGVRAVFGETYPDPVRVVSVGVEVEEILKNVEDPRWLEVSIEFCGGTHVQKTGDIKDLIILEENGIAKGIRRIIAVTGEDAHEVQRVAKEFEKRLDRLDAMALGPQKEQEAKQIQVELNQLSISAVQKSRFRERFASINKQVIDGQKAQQKLETKKALEAIISYFESPTNEGKTCLVTRLPISANPKAVSESLNYVKSKLQDKTVYVLAADLEQGRVAHGCYVSKVSLPSFFTYGLG

SEQ ID NO: 28398 - protein, 149 aa, A.fumigatus
NKLYLTIGRVRANHLYGYPSYFRIGKKHGLRPEHPHISPHCVMITSWLGLSLIVRVFSIIRTISMPSTTCPNTTCFPFKKGVAVVVMKNWQPFVFGPEFCSTQHRPQLNNTRVNLRPCLRHLRGRASRQSSHLQIWECHIWYKNLFHPR

SEQ ID NO: 28399 - protein, 384 aa, A.fumigatus
DACAECRQAAVAGCGGMGEMVPAGRGRGVIGDAGDLAAAAVELLNRADCMFVASTHGAEDMDTNFRGGPPGFVRLMSNGPSGSVLVYPEYSGNRLYQTLGNFQMTPLAGYFFPDFDTGNALYVTGTPEILIGKDAADLLPRSNLAVKLTVTSARFVEKSLAFRGIAGPPSPYTPTVRYLATERVNQVAQFSDDVSVTATMVAKTILTPSIARFRFRISDPSKIGAWAPGQYATFSFQEELDLGYCHMLDDDPLSLNDDYVRTFTISSYPGHGLPADEFEITVRKHGNVTSHLFRTNERAGLEVPLKGFGGGFRLDDQEGDCTIPVIIGGIGITPVIAQLPGISVSRLHLLWTISMADVGLVFDTFQRFPQLPGSTTLFLTGPKP

SEQ ID NO: 28400 - protein, 134 aa, A.fumigatus
KLPRVWYNLLPEYSGYTKTEPLGPLLISRTKPGGPPRKLVSMSSAPWVEATNMQSARLSNSTAAAARSPASPITPRPRPAGTISPIPPHPATAACRHSAHASHRAIDMIEILPRHPWMNRDRCAIPLSLWPWQS

SEQ ID NO: 28401 - protein, 560 aa, A.fumigatus
YLYISLTELSEIGCFGAFSRERIAIGIDKQISDFNDPLLWPAQGSAAEPDADLCSTFTEEYIDILPPNWNVLSLSLSADCTEFIISRLRKDHSPFLLRLPLKRGNAEDDEDQFTFEDGRREMQEIIRLANETAHAAKLQKDRHSKKEWWRNREALNQRLQNLLQNIENVWFGGFRGIFSPMAHEGAALSRFATSFQNILDKHLPSRQKGGRSATPRLSLHRNVLELFVGVNDLEGQEDPEETLMDLLYFVVDILQFQGERNAYDEIDFDMMVVETLDAVRGYHEAARRLREGQRPQHTVLVLDKALHLFPWESLPCLEGLPVCRVPSLECLRERILQSESVIKLNGSEMGFAIDRGNGTYILNPTGDLQTTQATFEADLGRLATWTGITKREPTEEEFKDYLESKSLFLYFGHGSGAQYIRGRTIKRLDRCAVTFLMGCSSGTLTEAGEYEPYGTPMNYLHAGCPALVATLWDVTDKDIDRFAKSTFEKWGLIEDQNTNGEQATLPSKGRSRSAKMSSNTESSDPVMLDEAVSKSRSACVLKYLNGAAPVIYGIPSVFLE

SEQ ID NO: 28402 - protein, 63 aa, A.fumigatus
  UNSURE (34): Identity of amino acid sequences at the above locations are unknown.
YANHPLVTQHNNVIFNKTALSSFELHLTELQNVXNKVSNKRIEWSCSACVLSHDELREGNHPL

SEQ ID NO: 28403 - protein, 241 aa, A.fumigatus
VFQKEAFTFHAGVAVIGSRRQIQKFTMGTYTKIFLQFNETFWPSNTQYFLYADPKLRGWYPIWQSLSTPGFLPGSNILFVTVTNEFSYHVENQSDEETKAEVMAVLRKMFPDKDVPEPTAFMYPRWSTEPWSYGSYSNWPASTGLEEHQNLRANTGRLWFAGEHTSPSYFGFLHGAYFEGLDAGRQIAALLQGRCVYYNSTMERLCGPRRHFETLHGITPLADYSAVNGWISNSFYDYNDE

SEQ ID NO: 28404 - protein, 113 aa, A.fumigatus
PLNLSQRTRPKASCNHSSGHRLHSAMTEYDYIIVGAGIGGLVLANRLSADASVNVLLIEAGANRMGDPRIDTPGFLGMLYGNPDFDWDYMSVPQVSPLFHCSIYGNNATMLIV

SEQ ID NO: 28405 - protein, 474 aa, A.fumigatus
PHVNNRQIAQPRGRVVGGSSALNFSVVLYPPASDFEAWKALGNQGWGAEDMAPYLRKFHTFSPPSKSTADLLGVDSYMKASSQGCDGPVPVSLPDVYGPFNEAWDKTFEKLGWRTDADPIAGRKLGAFTPPLTVDAKTGKRGYAAAYYSPEVAARPNLRLLAETMVERVLLTRQDGDVLATGVLVKDKDGAREIHAKKEVIICAGSLNTPQILELSGIGNAGLLQKHDIPVVIDNPGVGENLQDHCISCISFEIADGQVSGDILRDPNVVQALVKLYEETRGGPLAGMPISVAYLPFVDGRGVVPRPEVEELLAKYLDSAALPPNLQAQYAHLRKAILDNDTPSSEYLFLPAQLHMKPGATSLPDVLAKPLPENYISIMILHNHPFSRGSVHISSPKAEDKPIYDPNFLSHPLDLEILARHTQFLETIAATEPFKSLLKERRIPENARDLGDLERANELVVFHPGGRDMPAMEG

SEQ ID NO: 28406 - protein, 103 aa, A.fumigatus
DKMVALYDAFGFPIVRDQLIANTVLVALATLAVLLRFISRHIRKSKIWWDDGCCVGSMLHTYGMLAMHYHYARVGMRKHVTEIPPENLVAMLKMLFVYQVLYY

SEQ ID NO: 28407 - protein, 190 aa, A.fumigatus
QPCISNAGEFQDLRRIQAAGADNDFFLCVNLSRAILVLDQHAGGQHVSVLPGQQHPLDHGLCQQAQVWPCGHLGGVVGRCIPPLPCLCVNGQRRGERTQFASGDGIRVRPPTKLLKRLIPRFVERPIYVRQGNRHRAVTPLAAGFHVAIDAEKVGRGLAGRGERVKLPQVRRHILCAPALVSQRLPCLEV

SEQ ID NO: 28408 - protein, 68 aa, A.fumigatus
NRRALNALDGELANCHLVLLVKAKTIENAEECLFFSFRKEVEITTVLYHIVHNVYFTFNTSDPLNLIS

SEQ ID NO: 28409 - protein, 299 aa, A.fumigatus
HSAGCEQQHWICSGGRHKTTLIEIAGMDSNTDPYSEPPCPLQQLRTPAPISPSTLDPTEPGSCHREPISSTHKTTHSPYEVWGCDSNSTNGLVSPTTRPSEPDLFNGLSTLIPGLRRLDYGARAATNAERKITFLDGCRLYPKAMAWSAVVSSTLIMEGFDTLLLFTFFSLPAFKRYYGVPSKNGDYEIPARWQFGLSTAIEVGEIAGLLLNGLLADRVGYRITISAAIVLLFFCILLPFFAVNLQMLLAGQILCGIPWGVFQTLTINYAAEVMPVALRAYLLSSINMCWVVGQLLATG

SEQ ID NO: 28410 - protein, 65 aa, A.fumigatus
  UNSURE (17),(25),(40),(42): Identity of amino acid sequences at the above locations are unknown.
HPERPIIRERGMTIAPXRFMPSSIXILGVRQADERFTVKXTXNISSQFESFGMKNENEAYESVAS

SEQ ID NO: 28411 - protein, 350 aa, A.fumigatus
GIAFHLHRSILVYQRKFVTASWQLSSLYAGFLIFLNRPIQPHLLTSTAQPHLPHCERPDATLSPMTPTEQQEQEQPSPTSTTIMPASPSRTGTLLANLSSVTSRISTAALNANRPATKPIRLIAVSKLKPAADILALHNPPTNHLHFGENYLQELLEKSKLLPPSIRWHFIGGLQSNKCVTLARDVRGLWAVESVDSEKKASLLDRGWGERSEEVRGVALEDRLRVFVQVNTSGEENKAGVDPVAGAVPLARFIREKCPRLKLQGVMTIGAIARSKATTPETENEDFVCLRETRDRIVRELGLQGDDAELELSMGMSEDFEGAIKLGSDEVRVGTTIFGERPPKSEAKVV

SEQ ID NO: 28412 - protein, 222 aa, A.fumigatus
RRVFPARGEDSRKSSPFSPHIIYTTFASDLGGRSPKIVVPTRTSSLPSLIAPSKSSLMPILSSSSASSPCSPSSLTMRSRVSRKHTKSSFSVSGVVALDRAIAPIVITPCSFNRGHFSRMNRASGTAPATGSTPALFSSPEVFTCTNTRSRSSSATPRTSSDRSPHPLSSSEAFFSLSTDSTAQSPRTSRASVTHLFDCSPPMKCQRILGGRSLDFSRSSWR

SEQ ID NO: 28413 - protein, 127 aa, A.fumigatus
SACAVFRLLGEDEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 28414 - protein, 60 aa, A.fumigatus
SSILYPEEFQGRPNIDWQKWAGLMEGRRLRLLVMFADAPRLVDLSIRHRTLAIQRHRFSA

SEQ ID NO: 28415 - protein, 192 aa, A.fumigatus
SIYSDAATGVLIPYLQPAYDIGLLKVSMVYLINFAGWLVASFANIHVCSRLGSGGTLVVGATIQCFGYVLMFWKPPYPLFMTAFFFTGMGVAFQDAQANVFTVTVRNAHRWLGILHAVYGVGTIIAPLIANTIASRTPYWHYYYLAMFILGVINVVLLAWTFRRGLFKPNVSNAKDANAELIFPRGANPPKL

SEQ ID NO: 28416 - protein, 95 aa, A.fumigatus
AAWTKPRGMRSDLSRILSTCATSAYIIGIFILKRFKPVHYSTLRLKNASLFFSSSTRGTCTQIMSMIAQDYNANPKQGLQEDIQLFPRTLSFSPR

SEQ ID NO: 28417 - protein, 110 aa, A.fumigatus
PSLVACFYIRFPRTNQNGDDYYRAVYLTERTVRDLMEKISMKQKIDPQRIVRVLHVKENGLKIMVDDDVVRELPDGPKMVVEISEASALDNAVANKFDHLNSAVEFKLSY

SEQ ID NO: 28418 - protein, 66 aa, A.fumigatus
TSSRAMIPCRNMIVSLILFDFIDLIHLDISSLHVHIFLTTSSTFLRTIYCTIFALGLLNVQSHISL

SEQ ID NO: 28419 - protein, 332 aa, A.fumigatus
ESASFDGFCVTWTANPATGVPECAISVRFNFLSTDFSHSKGVKGIPVRLCAKTEMIGPESADSREAEVCYCKVKLFRDHGAERKLSNDVAHVKKTIEKLRQQIAQAGIGAGSYGKRKRAGNPISLKNSDQRPAKISKHKRTWSMSSQDGDKLSVEDDLHAKLAMLQDMFSSTRPMSILGLRGDEQDDPDLYPVILPGDSFDQVKKEGSAKPGDPRLSIDASAYTLSPTSSNVSINSPCHPPQLQQQGHFYDSGYQGSMGNSRDNSRPSSEFSGEKMILKHPVKVQRISGGSNLPMGYIEAVDIDPTYRPPAERPQKPSKSSTRSYFEAKVLT

SEQ ID NO: 28420 - protein, 74 aa, A.fumigatus
TKGYSTIIINLTLLNSTKYIRSIILLKVWHTLALTYNLISIRKLIELGINTIFRKNSSIKLIYNSLIKAFAKII

SEQ ID NO: 28421 - protein, 95 aa, A.fumigatus
ITLAVDPSSPVVKTIDCDGANNSAGDCANDPSGQSMTAFMDTVKQYGISDLDANIHPYVVFGNSGSSPTFDPQQYGMEPLSVMAVVCNNQLVCCY

SEQ ID NO: 28422 - protein, 85 aa, A.fumigatus
FYGIWGDTNGGTSTGEASISLAKLCFPNDGITGDNGHGEEDVLYIGFMGQDAVPGASAAWTARDTKTFEESIKALGDRLVAKLSA

SEQ ID NO: 28423 - protein, 164 aa, A.fumigatus
  UNSURE (5),(13),(14),(16),(17),(18),(19),(25),(28),(29): Identity of amino acid sequences at the above locations are unknown.
GPPPXFLGARLWXXLXXXXTPRGKXPIXXNRAIVLASQNPQVQFHVVDDDPRLITAWNSDRLPVVEPGLDDLVYEDHAVASNIPKKQAGHQLETHQSDLRQPRIRKLRNITFSTNIHAGIAASEIIFLCLDPPLDHVGLPHPQPAQQSILIPSPAPTMRLPVST

SEQ ID NO: 28424 - protein, 318 aa, A.fumigatus
  UNSURE (5),(6),(13): Identity of amino acid sequences at the above locations are unknown.
YSSRXXHPIPPPXSSLQPEFLVPGSAIRDLLYPVRIIIGHIFSEDMSPEALTALKGLYSWIPEDRIVTMDAWSSELGKIAASAMLAQQTSSIQSLRAICESTNANITHIEQTVGTLSTTGYGSSESILLRDVGCLVYLAQELGLPEVAEYWRAVLRMDAYHTRRLAQHITESVPAGTERRDVAILGFASKWNTIEIGDRSATRLVQELTRTGVKVDIYDPHVSKEQIERALGLVSGHLDAVTVVEDLHAACSGCGAVVLHTDWDEFKEDRLDWEKVAGKMESPKALCDPHGMLDWQRMEKLGFKVLRPGVNCANKLQA

SEQ ID NO: 28425 - protein, 246 aa, A.fumigatus
PPYPFNLPPLLYAIPTDPFPRGAEAPRIPSPRHPARRRAPFRSQYNATTAPTPAASTKKKKLEKNDATPDDPSAESRPPAGHQIPFPPSTQLTWKVNVSGSPRITFVPWPAVQGSRAASEIAKAASSSSTSLSFGSRPSNSGIEYAVPATTYPGLACLLFRFLFLVLEADGILCTTTFMSVQMCRWLRCRVPCRAKVRGVYAGPPLSRGERSVFSLFLASGDEPACAEVVRGAVGTRQASGTSEWT

SEQ ID NO: 28426 - protein, 334 aa, A.fumigatus
NVSANSSLPVQITDNLGKLQYIPFPTCNETFLPLALRYGVTETVNCTISSLPDELYHLLEYYVHSDVPLACRVPTAPLTTSAQAGSSPDAKKSENTDLSPLDNGGPAYTPLTFALQGTLQRSHLHIWTDMNVVVHNIPSASKTKKRNRKSKHASPGYVVAGTAYSIPEFDGLLPKDKDVDEDDAALAISEAARDPWTAGHGTKVIRGEPLTFTFHVSWVEGGKGIWWPAGGLDSAEGSSGVASFFSSFFFFVLAAGVGAVVALYWERNGARRRAGWRGDGILGASAPRGKGSVGIAYSNGGKLNGYGGYSPSSTPSVVAAGGGGYGYGGYGKKD

SEQ ID NO: 28427 - protein, 271 aa, A.fumigatus
RRDRPHPRHANLRAEPQRPSSADISTKSVTPTVTPKLEAATPAPASARPTAPQKPGSAYPPVQASTIDVNANPVHPSTGKPILSTDMDSDFPTEDDKPWRRPGSDISDYFNYGFDEFTWASYVLKQQELRKEVQDQKKQLDDMQNFLTMGLPPIPGAPGPAAPPGSAPPALPGMPGMPDIAPDMMQGMLASMMSQGMDPSSMDPMSFMQHAQAMMGRPRWCWRRAAARPAWVRRPVAKFGIWRTRWRPASYGIWRLRTEKWFWRSGTKEKM

SEQ ID NO: 28428 - protein, 116 aa, A.fumigatus
LIHWDMLLSVISCLYQSVLRNIKNLAPLLDRVLVQRIKPEAKTASGIFLPESSVKEQNEAKVLAVGPGAVDRNGQRIPMSVAAGDKVLIPQVRTGRFGCFISGRIRCATDIGFFCR

SEQ ID NO: 28429 - protein, 169 aa, A.fumigatus
SITFSTNFRYLDQFDNEEGEEYEASNFGGFGDYMRRKKLKLQNLDAEIRSSSPDRPPIFRGVVAHVNGYTQPSLQDLHRLIVSHGGGFLQYLDGKTAATHIIASSLTLKKREEFKRYRIVKPAWVVESIKAGRLLPWDAFRVVDEGHAQKVLNFDNGRLLSQANVQQSG

SEQ ID NO: 28430 - protein, 96 aa, A.fumigatus
QFRVSMAAIDPDETPEFEDGQTRPRATLKLVRPPADMDIDESDDDYEEDSEEDSDDEEINGGPSDKEKARKLKEAAALKELEDEDEDDDSEGDDEN

SEQ ID NO: 28431 - protein, 66 aa, A.fumigatus
FGEFQTKLFPYPRIHIPLFPQASVIFGAKVFQRGQFFQRINIWLFGAQPTRWSSVPPPTARTCHPA

SEQ ID NO: 28432 - protein, 105 aa, A.fumigatus
  UNSURE (80),(105): Identity of amino acid sequences at the above locations are unknown.
LENSRPNCSHTPVYTFPCFPKLPLFLVPRFSKEANFFKESTFGCLGPNQRDGQVYPPQRQEHATLLDIRGDVVPKETHAXVVTFKTKRTIQFVDWCHNGIKIGIX

SEQ ID NO: 28433 - protein, 79 aa, A.fumigatus
TNGNYSCMLSNTTAIAEAWSALDHKFDLMYSKRAFVHWYVGEGMEEGEFSEAREDLAALERDYEEVAADSMDEEVEAEY

SEQ ID NO: 28434 - protein, 69 aa, A.fumigatus
VRIPLHFVIPSTPFPIHSPYSLTIYARGIIFTLVHSIPLYHLISHNSTSIREIWPKERGGALLLSYNHG

SEQ ID NO: 28435 - protein, 116 aa, A.fumigatus
TPEENDRPPDRTAISPSAVGLTECLNHLAQRHPNLNLTPEEKRVFYQLFQAADTTNLGVITGEVAVPFFEKTKLAPETLGLVSCVAWIVSSGACLADWSPTMCRYGRSQIRRTEGS

SEQ ID NO: 28436 - protein, 77 aa, A.fumigatus
  UNSURE (41): Identity of amino acid sequences at the above locations are unknown.
ILSLAGPLPKFEGVIIEPTSPTSRSAGATSPPPVSGPIRVXPLNPEDVNKFTALFEKSDVSRSGVISGMHPAKRGSM

SEQ ID NO: 28437 - protein, 164 aa, A.fumigatus
PGQARPCCVSFFPVFLFSPNKWSMKIVSELTATIAACCPTPRPSPRPGLLSTTSSTSCTPSVPSSTGTLVRVWRKVNSPRPVRTWLPSSVITRRSPPTRWMRKSRPSTRRTSSLGRIPKNGCRVWPSDLMQRLLLAVSVLLYWGQAFAKVIYHGPARLMLHANT

SEQ ID NO: 28438 - protein, 234 aa, A.fumigatus
  UNSURE (37),(130): Identity of amino acid sequences at the above locations are unknown.
LGRCLSLKASLLNLHLPPLAPLVRPAHHQLVGQFESXHSTRKTSINSQRYLRSLMCRGAGLSQACIPQNEEVCSFEANNACITGDIAKQIFERARLPNEIFGRIWNLADTKQRGALDATEFIIAMHLLTXYKSGAMRGIPQTLPPGLYEAAARRGPVRTSVGSRPALDVPPVPAIPRQFTGPQRTQSPLNRSQFGTPLTAQSTGGDWLITPAEKAQFDTIFGTIDTAKLGVIHW

SEQ ID NO: 28439 - protein, 256 aa, A.fumigatus
TPQTNVVLALSEEKVKGFARTQLSQPTGLDSSYFEQYPCPPFKIIILDEADSMTQDAQSALRRTMEQYSRITRFCLVCNYVTRIIEPLASRCSKFRFKPLDNSAAAERLAHIARLENLKLDEGVIDKLISCSEGDLRRAITYMQSAARLVGAGRPTSQKDGDEDSEMTDASSEPVTMQMIEEIAGVVPESVIDRLIQAMQPKKLGSSYEAISTVVTDIVADGWSAGQLVLQVSSVLIPFTRGFVQLRDSVLVVKEC

SEQ ID NO: 28440 - protein, 82 aa, A.fumigatus
ALFLFPLHEASFNCEIPSLWSKSADNPQLYRRIVYNDAIPDIQKNKIVTAFSEMDKRLVDGADEHLSILDLALRISGILGGS

SEQ ID NO: 28441 - protein, 80 aa, A.fumigatus
WSPQVQERPRPSLAVGKIDIGSALYRSRILELNASDERGIGIVRRKSQGIRPHTTQPTHRTRLVIFRTIPLPTVQDHHPG

SEQ ID NO: 28442 - protein, 62 aa, A.fumigatus
TIRRYSCGLSALFDHKDGISQLNEASCKGNKNRAYLQDKLTRTPPICNNIRDDGRDSLVGRP

SEQ ID NO: 28443 - protein, 300 aa, A.fumigatus
  UNSURE (203),(272): Identity of amino acid sequences at the above locations are unknown.
LNRHSLAAASSSSSSHSSHPKVVFTSARYKMSTPTVIVFGPTGRVGSVAALSAQKHNAKVILAMRDTTKSIPGLTSEQETTGNFERVQVDLTSPESIHAAVTKTGAKHAFIYLAFGTADAMRASIEALKGAGIELVVFLSTISISLHGAADAVPPSDFIAFTHAQVEANLRDVFGDDYVAVRPAFFASNSLWWKSGVLAGEVXQAYPEARFDFLAPEDIGSVAGKFLVKRLPTGGDGSQLKYLELVGPEQMLITDAFGLIGKIVRKEIHIPXIYNHDARQDMTKGQGVPGAGFEQNIWLP

SEQ ID NO: 28444 - protein, 202 aa, A.fumigatus
GQDIYGTMYLVLSTFSSLWTRVYNESTGIGGLNYISLGLGFWLGSQLCAPLNDRIYRRLKARNNNIGRPEFRVPLLVVGAFLTPVGLFIYGWTAQFRRHWIAPNIGACLFGAGNIIAFQCIQTYMVDTYTRFAASALAAVAFLRCICGFAFPLFAPYMYNALHYGWGNSLLAFVSIGLGIPAPIFLWKYGEILRKRSPYAAG

SEQ ID NO: 28445 - protein, 88 aa, A.fumigatus
QSSGPRTGHGMYSQRTESTSNPPLPRSVIHDRLPNVGNFAIETKAFTDEYPHDPLLNRRMQSDLAPFPSPPPSPTPKLPGQNSSQTQA

SEQ ID NO: 28446 - protein, 673 aa, A.fumigatus
HHRRSFQPRGEDESTQSLVKYSGSSSAGYSTDSLPAPTAENEQHNPYLNNSAQARLQVSDQAVSSSCGLDHAETNNVGSGQASSCLSKRPDETPLSFSGEGSSGSRTTTEQSKTPQKKSKGFKWSFFQRHGNVQKEKKPTREPLVSPNTPRLHATVSPALVSRPVAHYALVDADSDPLEDIINHVEESPPTEIEDLDSRVEIPAALNIRKPTQSILLPSPPKLQGEFCRDRPASPKVYFNKDPSLSNSEASTSSGRPRRLASVGRIPEVIPRRDRQHKPALQSFSRPFSMADSPSIIAPATVNLLPELQTSSQPTVTAQSNEAPRRPLGLGFDLTCPFGDPEVATALNFISGPYSKDEFLTFSPRKDSGVSTSSGSEASATITAVVPMPGSDPTEDEVWAEYDDLIEHVLSPEAPVRSLSGEPTEDEKLEMATVASKALQAEIDSNVSKHSPVPLVDTPTVALTPSTPRPSDSSFHLRRSAIASALHTSITPSSQPSFSDIIASYCYHQDEKQTGDEKIDDNSASLAPVEQQAAFLSSSSLDLSETFETCRQRNTILFDIAERDREGPTAQTNIRSGSLMTSRWLSFGRVLFSPAHNHVKNGEQERILVIDGLGNDDWSFYCALTYPNAEIYCINDGPTKTTLKHPAAWQPPTNHHTSSPRGWKDRDGRCYRR

SEQ ID NO: 28447 - protein, 297 aa, A.fumigatus
RRSSPPRPKQEAKKPEPPKEPEQDLFDFGEEEPVTAASTSTAAGKKPASSNGLDILESKPIDDDDEFDEFQSATPAPQPAANQFTIPAPASTVSTTSSTQFAAPRPVSGVQGPNLNGLVGFTSMTPTPTSSTVASPTLSQNSMVPPSQQAKPSQPKPTGFQAATPNYFTSVTTATTQQPTATTPGHRPGMPSTSSFTSARGTSSVGGKPAASKSSGDAFGSLWSTASASAGIQKSSANASKGPNLASMAKEKASAGIWGAPASSSSFTPTSPSPSVSSSTQQQGTKTGSSGLDDLLG

SEQ ID NO: 28448 - protein, 96 aa, A.fumigatus
IPVRNASTAARSQPIYYSRTRVHSQYDLEYPVCRSPARLWCARAESEWVGRIYINDPDSDIEHGCVSHTFSELYGAAIAAGKALTAQTDGLPSRHS

SEQ ID NO: 28449 - protein, 69 aa, A.fumigatus
RGNSRGAAHEMTGGTGGEYCVNMQSELSTYLLCKYVLGGETAGRSHGPYVPLLANVKTTMWYYVEDVRP

SEQ ID NO: 28450 - protein, 225 aa, A.fumigatus
  UNSURE (129),(131),(153),(189),(190),(193),(194),(197),(203),(213),(214): Identity of amino acid sequences at the above locations are unknown.
RQCISLKDPCKSEIFVRWPRMSGSAMHDWCSNACFASLRGRGGNCFWSIILLAGNPCIPASDGLGNAQELLCPRNFMWPFRTFSIEPDPFCRAGPPPPPPAPYLLPTNGLVSVICLPPPAARTPPMSPXTXLATPPPLSLVCAQNRKPFSASXQERPPPIDCPPPSLLSRPDLFRDSPTGKEPLLLHGXXTKXXFLXKQIHKXVEQRGGIGEXXLHYGAFPTSPP

SEQ ID NO: 28451 - protein, 70 aa, A.fumigatus
  UNSURE (9),(10),(20),(26),(29),(30),(33),(34),(70): Identity of amino acid sequences at the above locations are unknown.
SGERSIMQXXFPDTPPLFNXLMNLFXQKXXFRXXPMQQEWFLSRWTVPEKIGAGEQGGRGAVDGGGSFLX

SEQ ID NO: 28452 - protein, 200 aa, A.fumigatus
  UNSURE (4),(6),(7),(10),(11),(48),(70),(71): Identity of amino acid sequences at the above locations are unknown.
ICFXRXXFFXXPPCNKSGSFPVGLSLKRSGRESKEGGGQSMGGGRSCXEALNGFRFWAQTSDSGGGVARXXRGDMGGVRAAGGGRQITETRPLVGSKYGAGGGGGGPALQKGSGSILNVLKGHIKFLGHSSSCAFPRPSDAGMHGLPASSMILQKQFPPLPLKDAKHALLHQSCIALPDILGQRTKISDLQGSFRLMHCL

SEQ ID NO: 28453 - protein, 61 aa, A.fumigatus
  UNSURE (42): Identity of amino acid sequences at the above locations are unknown.
GDVPLNFRNPIFIHPHPPPAGFGPFEPRENYPMAPPVSKEPXTGRNENKPGFSQTFFIPSL

SEQ ID NO: 28454 - protein, 66 aa, A.fumigatus
TATGHYFKGRFVNTELKQRLMTQSLIVLDCSVRTLYTAVLNQSEERKTRFAFILRFGIDCKCTVTA

SEQ ID NO: 28455 - protein, 306 aa, A.fumigatus
  UNSURE (235),(287): Identity of amino acid sequences at the above locations are unknown.
IAAQDNGAKDISTSVSSGFLAISIVLPQHLTMTIVDWQEKAQLKQSEAASKIPPEWRLSLDILTAISNESNVLDIPTKCGILSARELDITEHYDATDLLQRLASKELSAVEVTTAFCKRAAIAQQLTFCLTETFFDQALARARQLDDHLTATGQTVGPLHGLPISLKDCFNVAGVPTSLGFVSYLDRPAPTTNSSLVDILLAAGAVLYVKTNVPQTMMTADSHNNVFGRVLNPYXRNLTAGGSSGGEGALIALHGSVLGIGTDNAGSIRIPALCWRDDPLSSLLVRXWHTGGQTAGGRSRDGRNYG

SEQ ID NO: 28456 - protein, 63 aa, A.fumigatus
QQYPGGGGFVPGIVFNPSAKGLAYARTDIGGAYRLNSDDTWTPLQDSVGNSNWYVTCSVSEID

SEQ ID NO: 28457 - protein, 86 aa, A.fumigatus
RFRHDWGVDALATDPIDTSRLYLAVGMYTNEWDPNAGSIMRSTDQGNTWSETKLPFKVGGNMPGRGMGEVGNSPFPCIACFSAKTM

SEQ ID NO: 28458 - protein, 61 aa, A.fumigatus
ISFVDSWEDSGHLYIQTEFCEEGSLDVFLAQVGLKARLDDFRIWKILLELSLVCHPIYVSC

SEQ ID NO: 28459 - protein, 94 aa, A.fumigatus
ARANLQQGLKHIHDSGFIHLDLKPANILITFEGVLKIADFGMAARWPAEDGIEGEGDREYIGPEILMGRFDKPADIFSLGLIMFEIAGNVELPR

SEQ ID NO: 28460 - protein, 166 aa, A.fumigatus
CSKLRAMWNFPDNGLSWQKLRNGDMSDVPSLTWSSETSIFRDASGNPISEEPSFEELCASDLGDDDFGEDSFLDSRLRQAVLLARSGELVNPPSFMIDASHEQALDKIVRWMISPDPSDRPTADRVLQTHGVQFVERRRRAGATVYEGNWGPADEILAEDAEMIDV

SEQ ID NO: 28461 - protein, 104 aa, A.fumigatus
EARKIIFEAASQLTRRSAGLPALATGILLSKPGGPLFRQVMDELHEISHLPAEQDLVKQKVELPQVHATNCLKDIFTNTKLGPFTESYIMPALTLSAEQLGSPM

SEQ ID NO: 28462 - protein, 201 aa, A.fumigatus
  UNSURE (148): Identity of amino acid sequences at the above locations are unknown.
SKSSLTEEHISKLTFPSPLHGYESDISKQRAPYTSRTTIIKLLTMTLPIPPNIMFSFNSLRGHGLTIGITACCGVSFMLFGYDQGVFGGILSNPTFQKQFDHPNTTMQGQIVSIYVLGCVAGAFLSMYTGDRLGRQRSVLLASAFLTXGGILQSVAFTLPHLIVGRIVAGLGVGMNTTTVPMWQSETCLHHGAGRIRGGAL

SEQ ID NO: 28463 - protein, 67 aa, A.fumigatus
EWLTIQRLAKMCCMRKESKGNNAIIFAKLQEFDSEMRAMAIKYKYLFLPLLCTLVCCINKALKPLNS

SEQ ID NO: 28464 - protein, 128 aa, A.fumigatus
TLFCRHEDRSFPPIRFGKATPRRGLALEKHGEIRGSYRVSVTKAPPHRSALRVSHSETTNHTESTIFQFDYLKLFKPPNMPKSSKNNESYLLKACEAAQAQKKPNISKITREYGIPYIILYNYVKKGR

SEQ ID NO: 28465 - protein, 191 aa, A.fumigatus
VPNDFSLPLNNNLCSLPKGNGIFMESWFNESEALPPDTTIATSPNGWISDELAVQWLQSFINATNERTKKGEKQILIFDGHGSHLTVKFLQLCEDNGVIPFRFLPHTTHLCQPLDGKPFLSYKQYFYYMNNKLSYWAGKPVGKLEFLYMIRPVQEKAFNQRIIREAFKDRGIWPVNSKIANNLGVPLCLFH

SEQ ID NO: 28466 - protein, 134 aa, A.fumigatus
HPRGSFQPRGEDVLARAANEEAVWLMPDFGYWAWDNPDNAIGPFDQVVARIQRADIPWEAKKQQLVWRGKPSFAPKLRRALIEATRDQPWGDVKQVSWPDRTNVLSMEDHCQYMFIAHVEGRSSRFIFLRLDDS

SEQ ID NO: 28467 - protein, 158 aa, A.fumigatus
HYSLTDPIFKITILGHDIVFITSAKLLEEICDEKRFRKCVTGPIVEIREAVHDSLFTAYHDEESWGIAHRIMASLMTPEAVIDAFAGMRETATDLVKKWTAGPRQRINVSNDMDRLNHAANMLCFFDQRIHCLEGPEPSVLQAIGGCVFYRRRRRPSA

SEQ ID NO: 28468 - protein, 435 aa, A.fumigatus
GHTHSSTLRHGSLTQSEQLNCHSRPPSIASELTVSGNGGDLRQDIPNPCLWSRRDVREENQFFRTNAWCIDDVTLTNSSKALDTYRLRHDYNTVYFDMSRSSPVPSAALSSPSSSVKHQSQFTYRQLQLLRQGSTATPLRVIAHIDLDAFYAQCEMVRLGTPKEAPLAVRQWDSLIAINYPARSFGISRMMSASEAQKHCPEIVLQHVATFREGEGGKWAYRKDAFKNISTDKVCLDPYRAESRKILKVMKEELSRWHAGLVDSEHEPYSHYQVQPSSLEKASIDEVFIDLSSLVYALLLQRYPELRIEPQGDGRSTPLPRPPTTALEWNTEDCLIDLDENETEVDDPDWDDIAMLIGSEIVRSVRTAVWNKLSYTCSGGVARNKMMAKLGSACHKPNKQTIVRNRAIHNFLGSFKFTKIRMLGGKLGDQVATLF

SEQ ID NO: 28469 - protein, 64 aa, A.fumigatus
PPVNLLAVLYDHHGKGGIADITEAEKWTNVNVNFNIMCDYGTHNGISAITLPQPKRIPHRLNRQ

SEQ ID NO: 28470 - protein, 70 aa, A.fumigatus
DIISLISVRDVYTHTENLRGLGIFPHEIDLILAKSLLFVSTLDLDNIRFYLSTKKKPCQVLWRPWSAREF

SEQ ID NO: 28471 - protein, 218 aa, A.fumigatus
PESPHTGETQGVQTRLLPIQSVRYSLWLGQCYCADSIVSSVIAHDVKIDIDVRPFFSLGDVGDTALAMMVVKNCEEIDGGLPARLRMIMMINVLIDFVIGLVPFIGDVADAVYKCNTRNAVILEKHLREKGAKVLKAQSRTPEGIIDTSLPEEFDRYDQSASDEPPRYESQAQTGPARPEPARHPKRDRSQKGWFGKSSDRAGDLEAGVADNSQSRVQ

SEQ ID NO: 28472 - protein, 190 aa, A.fumigatus
  UNSURE (190): Identity of amino acid sequences at the above locations are unknown.
LTCKAGILAALLACKTEELNDGASHDYFPWIAETVLGLCRLCIANNGHLPTTIPPRQSTRRASPLVQICHGSPAILLLLGCARRNRYLVSNFWQPEWDKAIFLATERVWEEGLLSKGGSLCHGIAGNAWPLLLLHDSCEYDDELVETAKRNYGERAKNTTVEQPQPALTGDYFLSRALALLLHASSPRGX

SEQ ID NO: 28473 - protein, 146 aa, A.fumigatus
CISIACSMSFLHLHPRATELFAITSGRVLSEMIPETGVLDSEGHQRVIRAELGPGMLTVFPAGSFHTQVNPDCEPANFTAAFTSDEFAVGIVAAQTFSFSDDVIAATFGETIAGEDIDKVRHAIPATMAIKVEECLTKCGKQKRQA

SEQ ID NO: 28474 - protein, 97 aa, A.fumigatus
PIQSCEQMTYIEHPTGSQVVQTAFAIIAVLSVDYPDVEPIHRGVRMIMSRQQRNGEWLQEGIEGIFNKSCAITYPNYKFIFPILALGKFGRKYPHLV

SEQ ID NO: 28475 - protein, 350 aa, A.fumigatus
RPTRAEDWVSKLIDMEDANSDYADLASVNGPLNMIVCYIRDGPDSYSVRRHRERMEEFLWVNKEGMLANGTNGVQCWDTAFLIQAVWSAGLAEDAQFKPMLVQALEFLDRQQIRENCQDQGVCYRHVRKGAWAFSNRDQGYGVSDCISEALKAVIVLQKEADGYPQLLEDQRIFDAVDTLLTYQNPSGGCASYEPTRGSEYLEMLNTAEVFGRIMVEYDYPECTSAVLTALVLFSKHWPDYRREEIQTFIQRGVDFIKRAQRPDGSWYGSWAVCFTYGTMFALECLRSAGETYENSEHVRRGCEFLLSKQREDGGWSESFQVSTEINKPLHYPYASIRYLKTNPFRAANK

SEQ ID NO: 28476 - protein, 61 aa, A.fumigatus
PSAPLVKIQFALGGNSKTLMFVMCSPLQAHLAETLTSLKFATKVHNTHIGTAKRQTRVRDV

SEQ ID NO: 28477 - protein, 489 aa, A.fumigatus
LKDSHHLAPISGTIDPTDKDPLTAAWRELHEETTLSPANLTLWRIGKPFTFSDLALNREWTVHPFAFKLKPASQGGQGEAAIKTEWEHESWEWHDPASIVDDEAFGGVPRLHETLRRVFPECEMDERAGETLARGLERLQQDHKSGAHELTGIALAIFREIIAQTHKIDEGWWRTVRMAAWHLIKNGRESMGAATLNALLSILVTLDDIVHQTTGAEQDQKRDRILSTIDSHIANGTANTTRLKDAFTSYVQTTFLATQPKRDRVGMLTLSASSTTRNIILDAFDSFDVPTLELRVLESRPVFEGANLGSSIYSRFQSQFGSTDKKLEIKIYTDAAAALAAQDIDVVLLGADRICSSKGVSNKTGSLPVVLSAKHVMPSAKILVISQLEKVVGDDGILEDKVEDNDPDEVFSAWRNERVEGSQVLEDSFRDSKTNKDNPATIQIKNIYFEWVPLTLVDAFVSDEGVLDEAAIQNKSQQLRKLARKYFDF

SEQ ID NO: 28478 - protein, 109 aa, A.fumigatus
RSGASANRSPSATSLSTANGPSTLSPSNSNPQARAAKARQPLKQNGSTKAGNGTIRPPSSTTRPSAACRVSTRRSAESSQSVRWTSARGRPSQGGWKGCSRTIRAGRTS

SEQ ID NO: 28479 - protein, 198 aa, A.fumigatus
  UNSURE (197): Identity of amino acid sequences at the above locations are unknown.
GYVHCQERVKFPFVPNLLHQLLYSLDCEEDRIAILQTLLLMTYWSDHVNNPQRDIWDWIGICNTQAHSIGLNRDPTTSDMDPRMKRLRVRLWWSLYCRDRLIAMGLRRPTQINEGTSSVPMLRLDDFDFEPFHPSVIEIFRCRQLEDVSHQKRLATMFIEKAKLCQSIGRVLFAQYATSQCQFGLHHGAGSIHGSQXP

SEQ ID NO: 28480 - protein, 242 aa, A.fumigatus
SPSSFFSSRSYPVHVYQITSFFCRCSHLQVASLRMVTTKRKLSSVDIDAELPNTKKSNLLGYDARTPWLFDSKPSSLGRRTAGNPAVQHSLPLANMVSTVQDLIDPDFDPLIAILDDEPRFLKPLPSRISSEDLEFLRFRGALSIPESGLRNELLRCYIQWVHSFMPVLNLQEFLRCVAENDPEGNISLLLFQAVMFVATAFVDFKHLQDAGYKTRKSARNAFYERLRVCTLSRKGQVPVRA

SEQ ID NO: 28481 - protein, 244 aa, A.fumigatus
HRPSPKTLFPKIGSSLVQVYSGDDHDYCEISHREFSGSPKEITVKSLSWAMGVRHPGFLLTSLWNPIDLTTGKPREHSSSTIQNHLCLLPDQLGIFIHYGALFGFTLAILLIRAIVLVLYFPRPTSPDPVLPLSEQDLHNSSPSVTSLPPFSSTSSSTLPSPRGLASRAVNAPPRPKPYHDAYPGLAEYEAEQNSKWRPSRDEYRRKPGAGRSALARIRRELIGSVQYVASVVLAWYFFLIWRW

SEQ ID NO: 28482 - protein, 262 aa, A.fumigatus
RPLTVRYTDQYMRRSFTSIQRSLGPDSVVFLGDLFDGGREWGTSSTTSPEKRYQQYKDSFWKQEYHRFVKIFSDQFHEGDGQSTEPRGRRMIASLPGNHDLGFGSGVQVPVRDRFQSFFGPGNRVDVIGNHTFVSIDTVSLSAMDQPDPRTGSSGTGAGDGEQPNERIWREAKDFLDEVPRHMAKAETEELLMLRNETQASKGRLFKHDAVQVLENAIVKEPQWEALGLPTILLTHVPLYRRPGYTVWASQRTLSTLIRWGA

SEQ ID NO: 28483 - protein, 68 aa, A.fumigatus
SISRLHSNAIVYRCREDEISLYEIITLNIIILCLNKGLLFYQGSRITTARLKRSTMPTRRWPHTAPNQ

SEQ ID NO: 28484 - protein, 158 aa, A.fumigatus
VVDRMQKDQDRNIDVFITGISSQLMSTFDSALHLDDQLTSDLSRELENGRLVRLMAKLNFVNERPEYEHDRQWSENGERYFLKIFRDYVFHQVDAQGDPVVDLGHVITCLNKLDAGTEEKITLISRDEQSCFIVSYKELKKALESSFQALMKPARRMH

SEQ ID NO: 28485 - protein, 248 aa, A.fumigatus
  UNSURE (40),(41),(60),(124): Identity of amino acid sequences at the above locations are unknown.
AHFPGISTGDATDLHTQGATNGIIHGINAILIPPPETLTXXTIVPSEFSTFTLGLYKTGXATALNKSSTPHHHGGTMFAPSNSAFKHLGLKINAFLFSPIGEKYLRALLQYHIVQNRTLYSDVXYTAQGEIKPFGVKGFTHLDLPTLLHGRKLAVDVARFGPFASLKINGFQRVAFADALAKDGTVHVVDRVLIPPRKVDDSAPDWTGNDDELTVEDLKSRLGDWLAEDEGVDEVEMMHDILAHGAEL

SEQ ID NO: 28486 - protein, 107 aa, A.fumigatus
  UNSURE (4): Identity of amino acid sequences at the above locations are unknown.
IPRXRFSLQPGGEDPPFPPHHPSFNKTIYELIKSSKYTTILAKIIDEDDELVQFLNSTDANHTFFAPTNEAFSKIPHHCPGRDHDHDGDDHHKHHKVPKEVIRAIFH

SEQ ID NO: 28487 - protein, 70 aa, A.fumigatus
HVAPGRYSAADVFHNHTVPTALKESALGHDLPQRLAVRVRWKGLTLNYYSHIVAADIVSSLPRDINRGRN

SEQ ID NO: 28488 - protein, 98 aa, A.fumigatus
VYYPGDWDGADSTGVILDYDLACKRSLEPLRQFDFVAPAAHTAGLSIGMMLASTGNPYVKALVDNLPLYNRRWLYLPYVTVMFSTGCHYASYGFPPTR

SEQ ID NO: 28489 - protein, 78 aa, A.fumigatus
WLEARELCVKHHASWSTFVWNEESANKLVREDFPHLYEMWKGYPYMIQRVDALRYMILHKHGGESITREIGMELTRQA

SEQ ID NO: 28490 - protein, 69 aa, A.fumigatus
SLGGPSSKSQRCEGLPTTSSSKDVFLRQPTLLIAGENAGSLWYKGNLDNKIGGATKKVIVPNAVQMGLL

SEQ ID NO: 28491 - protein, 124 aa, A.fumigatus
TTQGFSRKQSGTYILFNSAIPSHPPSCRPCRSTKDEFRLPACCTSLQRHPTLLAIVIVHPGGGVKEQTAGLHRRSSRKKALSPSPTMPLHQAESRGEPNLSVDPAARVSDVKGCRLPRAARMCS

SEQ ID NO: 28492 - protein, 328 aa, A.fumigatus
YSISLIMCLLSKISASLLLAMAAPSLSYPTGIQSYTNPLFPGWHSDPSCAYVAEQDTFFCVTSTFIAFPGLPLYASRDLQNWKLASNIFNRPSQIPDLRVTDGQQSGIYAPTLRYHEGQFYLIVSYLGPQTKGLLFTSSDPYDDAAWSDPLEFAVHGIDPDIFWDHDGTVYVTSAEDQMIKQYTLDLKTGAIGPVDYLWNGTGGIWPEGPHIYKRDGYYYLMIAEGGTELGHSETMARSRTRTGPWEPYPHNPLLSNKGTSEYFQTVGHADLFQDGNGNWWAVALSTRSGPAWQNYPMGRETVLAPAAWEKGDWPVIRYQPPDGRYTS

SEQ ID NO: 28493 - protein, 136 aa, A.fumigatus
  UNSURE (69): Identity of amino acid sequences at the above locations are unknown.
PWVSQGPGSLPFLRTGTKLAPSLKAKLGPKRNPRASSPTITSGFWLPWVSRMCSSRQRRRASCRVGSAXNRKISSKRMPGDRKSGNWRQAARDSYFKNRRIRWLPEGDGERGVPANLGGRRASGSFALDLRKQFDW

SEQ ID NO: 28494 - protein, 154 aa, A.fumigatus
  UNSURE (25): Identity of amino acid sequences at the above locations are unknown.
ESRAAWRQFPDFRSPGILFEDIFLXFADPTLHEALLRCLELHILETHGNQKPDVIVGLEARGFLFGPSLALRLGASFVPVRKKGKLPGPCETQGYEKEYGQDFFQMQADAIKPGQKVIVVDDIIATGEFDLFQENTLHHSLTWLQAALPTLPES

SEQ ID NO: 28495 - protein, 67 aa, A.fumigatus
FISGKYSSSFIDVVTGGSAYAAGELIRKMGGELMGFIFILELEFLNGRDKLPAPVYTLLSGQESKYQ

SEQ ID NO: 28496 - protein, 115 aa, A.fumigatus
RHTDKDLGVKIHATGDVRNGFEFEIKRSSNFRTNELPPTKRIPLQWVYGQYFDEKAMSNNGEHKIDNVPVCQFEASAHKIKAPGKSLNTTSDAVSPNYISHAASCSVSVSGNHIF

SEQ ID NO: 28497 - protein, 162 aa, A.fumigatus
LENCLQASLLREAARKGHAGVVQQLLAVAGVNPAAVDRHHSTPLIVADLQGHAEVVKLLLATGRVQLNTRDNKGMTPLMYAAKFQRNPVVEFLLSTGQVQVDFDLRKLSKGPRSLNQQNPTLDQSLVEVIDAYKRDNASPKSGLLLKGQKPMFLIVLCPPPP

SEQ ID NO: 28498 - protein, 62 aa, A.fumigatus
VKDIERTYHNTNIPYIDRVTPIDFQHHFRRSINIWLRIVISPLISTYGRAKITQHCSTKHLW

SEQ ID NO: 28499 - protein, 95 aa, A.fumigatus
AVLSDFGSAVRGDQRRNHDAQPNVYRSPEVMLKVDWSYPVDIWNVGVMVCPLDILYSPVGNNVYRCGICLRGSIFSMEMTQMAKGIQPGRTLRKL

SEQ ID NO: 28500 - protein, 199 aa, A.fumigatus
  UNSURE (199): Identity of amino acid sequences at the above locations are unknown.
VRLAKHTRMILAEINIYAEDGSFHGNGFFMHMPGAKKPFILTAAHNIISKNGDPSENIVMRVMGSKKRFPIHGSTVRICPAYEQNPTTAAEEADWALIFAPDELEQDPARAGIGPLGFALKLAYEERLDCEMRVTGVPVSSKKNSPNATTMGPVTTTGKCLNPIVLPAQLEYTAKTDKGLSGSPVWTMYHGVPTVLAIX

SEQ ID NO: 28501 - protein, 265 aa, A.fumigatus
VRRKGLLFIPAPTVAGADKYRNWTNWGTTWSSWTKYHGGNDTIEELPWQGTKGQRWEGKHVRVEYWSGLTGSSDYYQEGDVGWPHQVPRRFPHIHFNGPFNQFGYDGGLPNKLKLDTTTGHWKYHFTYEWPAQAQINVWGMNPDGRPDQSWVLGDIDGDHVLDRMPPSSLSATMINITDLPPSPHLAWIISINDGTMRYTLEPTGDQSTQMAMYILFWIVPLLTGAVCVYLFKKSFYQVKFNQVGVSQKRTLIPLGPSAEGHACP

SEQ ID NO: 28502 - protein, 548 aa, A.fumigatus
NPPVIKVRRWPCTFSSGLCPCSQVRCASTCSRNPSTRSSSTRSVSAKSGRSFPWALQRKVTRARNGEGEAMNPLMRLANKSGFLQSATDLTAASGGSKRRMVLIATMEYDIEDWAIKIKIGGLGVMAQLMGKTLGHQDLIWVVPCVGGVDYPVDRPAEPMIVTILGKPYEVQVQYHILQNITYVLLDAPVFRQQSKSEPYPPRMDDLDSAIYYSAWNQCIAQTIKRFPIDLYHINDYHGSLAPLYLLPQTIPACLSLHNAEFQGLWPMRTEKEKEEVCSVFNLDKEITRRYVQFGEVFNLLHAGASYLRVHQQGFGAVGVSKKYGKRSYARYPIFWGLKKVGNLPNPDPSDVGEWNKEKALAKSEDPPVDQEFEAGRAELKRQAQEWAGLEQNPDADLLVFVGRWSMQKGVDLIADVMPAVLEARPNVQLICVGPVIDLYGKFAALKLDRMMKVYPGRVFSRPQFTALPPYIFSGAEFALIPSRDEPFGLVAVEFGRKGALGIGARVCGLGQMPGWWYNVESMTTAHLLHQFKLAIEGALKSKPQGPC

SEQ ID NO: 28503 - protein, 131 aa, A.fumigatus
  UNSURE (21),(29): Identity of amino acid sequences at the above locations are unknown.
TNGFRVPQWIEDLEILQSTFXRIHNKGAXKSNISPVTSTRPMTPWGLGTMNPTFPGCWNPDPGGTHFCRDCFVNLKELSEIGHNNGETIIFLKQNNLWVGMDGKPLPGMAPKTALGVHTGPGILTGPGGGE

SEQ ID NO: 28504 - protein, 467 aa, A.fumigatus
CSCHVARKYRDEPRPRQGLLRGREFLMKDLYTFDYSVEEALKTYNLVKAAYKNLFDELKIPYLVAAADSGNMGGSLSHEFHFPSSKGEDTVISCSNCDHVYNDELADGKAHGIEEAQNAGSGQVSGFDTGATSTGDSPTVSVDLWMAISRDKKTLLRGWYPKFSMREANQEPVEREVNSHAVKSIATAAGVDIDLSVENPLEQWVSQVKSDRESSISGSSERPQVLDLYDAQVRVYKRPPLGDLLEKVNRTADEIDYSMLDRFPGTNQALNLVKVQDGDKCTKCAKGSLKTHTAVELGHTFHLGTRYSEVLQASVMVDRSLSGGSQSKDQLVPMQMGCHGIGVSRMISAVADSLSDSKGLNWPRAMAPYEVVVVPGKGLETEAEKVYDSLVSNHTSSVDAILDDRDKPMGWKLGDADLIGYPVIVVVGKGWKKAQTLEVQCRRLNNLREDVPLDQLPSFVQSLLERL

SEQ ID NO: 28505 - protein, 128 aa, A.fumigatus
ALASLAYAITGYIPYSALSNRRAVINGASTVNITSLSVPQLRALQTRLTSELEHLTTSHQKLRAAQSRFRDCVRSINDGVVGSEKKGTAGKDDILVPLTSSLYVRGKLADREKVLVDVGTGFYVEKVS

SEQ ID NO: 28506 - protein, 63 aa, A.fumigatus
EYEHKGGKCVSWTSKKFIPIHPSRDTITCCIVTIDESGSKNTKTRFPSNNQHMKSNMKTCQYC

SEQ ID NO: 28507 - protein, 203 aa, A.fumigatus
  UNSURE (38): Identity of amino acid sequences at the above locations are unknown.
KTVSSQMVAPFKTFPTFSPTSKLSTRPCGKSPNVPSCXMAADRGAFIDQSQSLNIHLKEPTMGKLTSMHFAGWKMGLKTGIYYLRTMAASAPIQFTVDQEQFKVADTNVARANAAYKKRAAGSVHTTYSAVPRTTSAPLNGHSEDGSPRALAADVTADSETGVNGSQEEDDERESGEREGDIYSQKVLQCSIENKEACLMCQG

SEQ ID NO: 28508 - protein, 319 aa, A.fumigatus
  UNSURE (310): Identity of amino acid sequences at the above locations are unknown.
KAQKLWYAILEAQTETGNPFMLYKDACNKKSNQKNLGTIRSSNLCTEIIEYSAPDEVAVCNLASLALPTFVDAARGEYDFGKLHEVVQVLVRNLNKIIDVNYYPVPEAKKSNMRHRPIALGVNGLADAFLALRLPFDSAEARQLNIQIFETIYHGALTASCELAKEFGPYETYEGSPVSQGILQYDMWDRTPTDLWDWDSLKAKIAQHGVRNSLLVAPMPTASTSQILGFNECFEPYTSNIYSRRVLAGEFQVVNPWLLKDLVDLGLWSDNMKNRIIADGGSVQNIPNILADIKALYKTVWEISQRTILXNGRRPWCFH

SEQ ID NO: 28509 - protein, 78 aa, A.fumigatus
  UNSURE (5),(8),(14),(17),(18),(19),(21),(22),(26),(28),(29),(34),(35),(38),(39),(40),(41),(42),(43),(44),(45),(46),(47),(48),(49),(50),(51),(59),(60): Identity of amino acid sequences at the above locations are unknown.
PPPPXPPXPPPPPXPPXXXPXXPPPXPXXKNEVXXQTXXXXXXXXXXXXXXKTLRTPKXXGRKKDLEKDGRQSDRETD

SEQ ID NO: 28510 - protein, 467 aa, A.fumigatus
LVLAKWHPNVSKLDQYTPARSWSALMEASMRQSGLHTYGSVRVIATLPLFEAQTILPRSVSNRSRPALITENVALHAFEVASTQDPSVWTMAKGWDLAAANAARVAERSAQHNVIVPAGRQVPPVPLAPEAPEPGHSPYPYVSRLKTDMHDRILKTIKTAEKSPSDIALKKKKQRALIQLRYDNRNSFLRKELADKQIKIDELNRSLARKAADSTADLQDLQPILDQIGSLKADIAKLSSEVHYEVLHHVPNMIDDARSALSTGSFDDAVLLWDRRLFEPLHIQPEELYPRETDMTMIYFEADANPPIMRLCNQVDEASRADLYRIYEAVSLIFGSRSAMPVSELLNALFPNRPINDLVRAIPSLATHAARTPKPNFDSLPKTVHGRPGEDPSKQLDPVFNFQENLDYDLSDVRIRCLSSITLWEIILEYQKENDTEVNVVQLNRLLGGTLTSFRAGEYGMEPKKLR

SEQ ID NO: 28511 - protein, 181 aa, A.fumigatus
TTMKTIFTNGRIFAPSSNDLNADNAFAESMVIEDDHIVNVGVQDKAPSGDYTIDLNRRIVVPGFIDGHVHILNFGLSLGKLDLMDCTCLEDIQAAIRSFAASHPTAPRLLCRAWIQSTTSGVALASMLDDLDPRPIHIESLDLHSVWLHSAALEEMGISSTRDPPGGTIHRDEKRKTIGAP

SEQ ID NO: 28512 - protein, 189 aa, A.fumigatus
MPFWPHPPAKPPSSRMPSASTKKTTDCCTSILTSETATSSQLETGNSSSPRSLPRQTTSTPSTTPSRSTGRTSSRSSSLACSTRTACTPPNKPPPSAPRSPAASTPRTTSTSSPCASTRKSTAPAILSCRATRSPWPTPSAPPPTPTATASTQRRPPCAPPSKAHRTTATKPPADGTSSTPPVFTTGLE

SEQ ID NO: 28513 - protein, 161 aa, A.fumigatus
LPRRQRHLSSRPETHHLPDHYRGKLRVRLLPHLHARRDVQARGQAHWHAQHVLPAPLRTSRPLRHRDRPRPRRPEPPAHLLLARRPGNRRPRQYCRAERRGPHGRPRRLPRQPLRQRLLRKEDPLAHRPPRRIGLLPRNLPRMGHHQPLPSSPRGWNDPFN

SEQ ID NO: 28514 - protein, 325 aa, A.fumigatus
VCLRLSEGVCHTNMADPLSADEITTAATLLRQRAHPTALKFNCITLHEPLKAELNAFLSGTGPRPARRAFSIILKTGTPEVSEAIVNLTAKKVESWKNVKNVMQTLTLDDLNIIEHIASKDCRIIEACREIGITDMYRVYYDAWAIGIDERWGFERRLQQALPYYRSSQHDNQYAHPLDFTVVADTETQEILSVDVRRVNGERTPVPLDEHNYLPQFIKDQYRPERLKAIEITQPEGVSFKMNGNEIEWAGLKMHIGFNYREGIVLSNVRIDDPYENRERKLFHRVSVVEMVVPYGCPKPPHHKKHAFDVGEYGSGFMTNSLKDG

SEQ ID NO: 28515 - protein, 203 aa, A.fumigatus
DCKGAIQYLDAVLATSTGEATVIENAICIHEEDNGLLYKHTDFRDGNVISARDRKLIISQIITAANYEYAFYHTFTLDGTYKLEVKLTGMLNTYCLHPSEQAAPFGTEIARGLDAQNHQHIFSLRVDPEIDGPGNTVVQSDAVPMADPVGSPANPYGNGFYAKKTPLRTALQGASDYCHETSRGWDIINPSRLHHGAGMIRSI

SEQ ID NO: 28516 - protein, 124 aa, A.fumigatus
RRASDYTMLPLPPAVTALSAPGKVLLTGGYLVLDRSYTGTVFALDARIHVIVQQLRRNHRREAASGSAHGRSDTPQAEGNVHGDKEDEGTIVVHSPQFVDAVWEYSIQRCEDGGGVLVKQRNDG

SEQ ID NO: 28517 - protein, 384 aa, A.fumigatus
SNNIIVSVNCPGADPSRPRNLFVETSLNFALTYISYVADSKDFGSLSITILADNDYYSETAFSKASGLRSSSRFVDFGVRLQEAHKTGLGSSAALVTALVSSLVIHRTMQPDDLGPGRDKLHNLAQAAHCAAQGKVGSGFDVAAAIYGSCLYRRFSPSILESVGDAGSPGFEERLFRIVEDADPQHPWDTECLDFGMKLPRGMQMVLCDVECGSQTPSMVRKVLEWRKQNQKEADMLWGALQSNNERLRLELRRLAQSPDEHTLSDFENVRTYIQRSRNHIRSMTQKSDVPIEPRVQTELLDALSELEGVIGGVVPGAGGYDAIVLLIQDNPDVITRLKAFFETWESKAEDDFGGKIGKVRLLGVRHGSEGVKNEMLEQYAGWV

SEQ ID NO: 28518 - protein, 64 aa, A.fumigatus
TPPSDPSSPVVKTAKELPRLTDEEIEAKAAEYGILDDNEKTEERVMEGDPAATAEFSSFQPTQL

SEQ ID NO: 28519 - protein, 108 aa, A.fumigatus
KSGWYRRCPCQRAAQTPEVMEKNTRVDLLSRLMEGKDSNGNKLGREELTAEALTQLIAGSDTTSNTTCAILYWCMSTPGVIPKLQKVLDEAIPDDVDVPTHAMVKDIP

SEQ ID NO: 28520 - protein, 203 aa, A.fumigatus
YLLNVYLLPYSDFYDAFVSIRRGLFNTRDRAEHTRKRKTVSHTFSMKSIGQFEQYIHQNVELFVQQWTKLAKLNGNPRSGYATIDALNWFNYLAFDIIGDLAFGAPFGMLEKGKDIAEMRKTPDSEPTYVQAVEVLNRRGEVSATLGCLPRLIPYAKYLPDRFFKDGVQAVENLAGIAVARVNERLKPRKSWRKTPVSIFCLA

SEQ ID NO: 28521 - protein, 254 aa, A.fumigatus
PSSSLVRTPPPTPPAPSSTGACQLPASSPSSRRFSTRLFPTTSMFPHTPWSKIFHSMSLCPVRSSPFSPLANNPYSLQWVIWETMRIHSTSAMGLPREIPPGNPPVTISGHTFYPGDVVSVPSYTIHRSKEIWGPDAEKFVPERWDPARLTARQKAAFIPFSTGPRACVGRNVAEMELLVMTGTIFRLFEFEMQQDGPMETREGFLRKPLGLIVGMKRRAVHAFCLNTYQVPICWVGGIQGFDFGGIIRCGGPD

SEQ ID NO: 28522 - protein, 289 aa, A.fumigatus
LRCERLLTRNPPTSRLWRSSTAVVRSLLLSAVSRGLSPMPSISPTASSRMAFKPLKIWLVSPLPVSTSGSNPGSHGEKHPCRSSVSPDGRQGQQWQQARPRGTHCRGLDPAHRWFGHHLQHHLRHPLLVHVNSRRHPQAPEGSRRGYSRRRRCSHTRHGQRYSIVCPYVLFAPPPFRHLLTTLTACSGSSGKLCASTAPPPWVFRARYPPATPQSPSPVTPFTPATWSPSPATPSTAPRKSGAPTPKNLSPNDGTPPALPRAKRPLSFPSPLVRAPASAAMSLRWNYSS

SEQ ID NO: 28523 - protein, 92 aa, A.fumigatus
VNQDGVGPLTADIDPSSGGTNAKAFVSAKVIQNIPGVAGFSTSSTMDYEVKVQVPNGMKCTGTVGAAKNVCILRVRNTAISGPFGGSAAFTM

SEQ ID NO: 28524 - protein, 113 aa, A.fumigatus
CSACPSSPVGVRLAIIRGQKMGGIKASPLGRTMGAGPVYAATVINKFMGAATDKRGRASPSERRMRLPSHCSINWANMFSCRQLINDAASVITNAGGTILNGMDSLGGPRRAD

SEQ ID NO: 28525 - protein, 398 aa, A.fumigatus
LCKDPHYQKIYSLSRRNPGGGNAKIQHATLDLRGSAEDMARNLKDISAEYVFFCAYLAHDDPAELSRVNGLMLSNFIQALEITGAIRTVKRFVLTCGLKQYGVHLGNCKQPLIEDDPLLEGNQGGTTWPPNFYYEQQRILKEAAARGKWEWIVTLPQDVLGYARGNFMNEATALGLYCAVSKALPGSELPFPGCKANYFAFNCWTSANLHAKFCLWAATAPNAGNNIFNVMDGDTESFQNLWPRLAARFGCKIPNPMFPHGGTPDTQGFREYEATTVRMPNRHPLAVHADRIGVSADDTPTLFLQVDPEKWAKRKDVNEAWAKLRDKYNLDQCGWDTATWDFLTFALGRDWSCVATMSKARRLGWNGYADTWEELEDTFRVLETEGILPPVDKLRGDF

SEQ ID NO: 28526 - protein, 364 aa, A.fumigatus
YSRRQIPAEFLYIFLSIDRNLDIHAQHSNGGGRFKYLSGWQQDRRKMDFSSKVLPVAALGVVLVVLTPRVIKWASTYKSSLLQALRLQKETSSEIVSLRIYPIKSCRGIELPRTTLRLHGLDLDRQWMFVDAKTHEFLTIRQLTQMTLINTALSDDGTSLLLSITGSDEKVQIPARPDAAWLAAHTTLAQVKVWDTLTDGYLYGDAVNAPFTRFLQRDVCLVYKGPTPRILQGNGDPRLLGRQQSTNFPDVHPVQIASEASLAELNQRLRRKGAQPITVERFRPNIIVRGTVPWAEDSWKTVRIGSELDLDVVARCARCQVPNVDPETAEKHKREPWDTLMTYRRVDEGIKYKPLLWDAECAPE

SEQ ID NO: 28527 - protein, 142 aa, A.fumigatus
  UNSURE (85): Identity of amino acid sequences at the above locations are unknown.
ISSRSRTRFLKLTMFSLASFLSFFWPRASRRARNTLTSCSSICSISSSFMSASEPSDCSLKSWSARCVPSASASLASKAGISSSXSPSSDAASSSSLSSSSSSSSSSSSEFSASMTSTSLSSSSTSIISSSSSSSCCSNNSC

SEQ ID NO: 28528 - protein, 123 aa, A.fumigatus
TPQNHSPPAWPRPRPAVDVRRRKNPRVPHHPPTHPNDTHQHRPQRRRHLPPAEHHRIRREGSDPRPPRRRLASGPHHPRPGQGLGHADRRVPLRRRRQCPVHQVPAARCLSGLQGPHAAHPAG

SEQ ID NO: 28529 - protein, 153 aa, A.fumigatus
  UNSURE (13): Identity of amino acid sequences at the above locations are unknown.
QRRRRSRIRRRRXRRRNARLRSQARRSTGHAPRRPRLQRTVRGLRRRHERRRDGADRRAASQSVPRAPGRPGPEERQEGRQGEHGQLQEPRPRPAGDLRQEMPLEGSGPRPPSPPAASHPQVDRQAASQQGERRAPRVYQVVQGQCTSFAGLG

SEQ ID NO: 28530 - protein, 337 aa, A.fumigatus
  UNSURE (17),(20),(23),(109): Identity of amino acid sequences at the above locations are unknown.
GSQVLAVLVTRFTKNGXGFXWVXEVHSLREISFHGNQHIRFWRPGKAFVGQQELFEQQDDEEDEEMMDVDEDDSDVEVIDAENSDEDEEDDDDDDDNDDDEAASDEGEXEEEMPAFEAKLAEALGTHRADQDFNEQSEGSDADMNDDEMEQIDEQLVKVFRARRDALGQKKDKKDAKENMVNFKNRVLDLLEIYVKKCHSKVLALDLLLPLLRLTRKSTVKQLANKASGVLREYTKLCKGNALPSLDSAEPVWELLKSIHAEAMHSGPPAHASACSQASLLVVKVLVAHDKNALADVVGVYAATRKEQLLSKKCHVQPQFFSDWNNWCVSASKQMKN

SEQ ID NO: 28531 - protein, 83 aa, A.fumigatus
TRWGVGFGPRDCSDYQTGISVIPIERLTEADRKWMLTAEYGGTGGRPIESGMVVEEPDIEIGAGVSSKGKRISFLVLRINEMK

SEQ ID NO: 28532 - protein, 63 aa, A.fumigatus
KPQVNDIGKSDDMLRILKNLSVLSSELPNALEKIVDAKDAEEIDGGEKWVQGLFADAIKAYSQ

SEQ ID NO: 28533 - protein, 177 aa, A.fumigatus
ILPFHLTSLCPRPLSSTCILLTATLLSQLHPSLPKQHTWSTTTTKMVAIKSLFSALVATALISSTSALPVPNTVNDVVHSLDDTANKYTDLDNAIKAFDGHPAGYTTITEREATVEVSLHRAIDAAHATASLSVEDSKFVMQALAKPYPTFMGNLLADIVSKVSHLFALDNMHSGRD

SEQ ID NO: 28534 - protein, 312 aa, A.fumigatus
EDNNRCGMTPEHTTLSTGDPRMWTWNIRQVGVLDLTALVSRVLFETGFEKLGLVCHSQGTAQTFVALSKHHRPELGEKISVFCALAPAVYAGPLIERVYFRFMRVIPPDIFRTIFGIHAFIPIMITVHRFLHPRIYGALGYHVFAHLFGWSDVRWDRGLRDRMFQFAPVYISSETIRWWLGQGCFATQRCILATMEETLAEMEEDVRLQRDGDQPGSRTDTAWYGPQTPPFALWVAGSDALVDGRPLLQRLHSGREPHVQVVHSKVIEEYEHLDVLWAMDAVEQVGQEVRDVIYRTMPEAARKCCRVPKGVS

SEQ ID NO: 28535 - protein, 139 aa, A.fumigatus
VLPHLAAGTCPISLIYHCAFILTASEKCQQEKRKTVNGEDILFAMTSLGFENDAEALKIYLSKYREVRLCTTCYGCLSPHQRLVVWWVYYHMLSTPPDSVRPWRTPEYANEQRLQFWRAHGRIQHARWTTWCIGFRRLS

SEQ ID NO: 28536 - protein, 62 aa, A.fumigatus
TATCANIYRQVARIMKLALPENAKIAKEAKECMQECVNEFISFITSEGECYRIWLPVPVLFH

SEQ ID NO: 28537 - protein, 88 aa, A.fumigatus
VLLQTQSARGEHQNMPTSSGYNSGGPMGGSNTQGGRPGASASGGFPETTDSTNNIINPGLDPSEQDSSTYGYPPMVGQPHNGAGGDSY

SEQ ID NO: 28538 - protein, 189 aa, A.fumigatus
RSSCDISHPTQPFNHPLRMKDKIVEPTVAVSDNSLADETAPDEVLKHLKHIKEQHQWDPNLPDDVAEELDVALHTDDKGARVGVAHELMEDSPYVEVRSAVPNYDEGGHTNTIRAWTIGLVFATLGSALNMLFSMRQPYIVIPSYVIQVIAYPVGVAWYKVMPNKQFKFFGIDCNLNPGPFSKKEHALI

SEQ ID NO: 28539 - protein, 65 aa, A.fumigatus
PPASASRPTFLPLLFLFSSFADHLIAPLSIVYGTNLRWILLTTALLHYSLLLLSFYRPSPLKILL

SEQ ID NO: 28540 - protein, 75 aa, A.fumigatus
SWLNLRRKMASILCRAVAALLLLLQFSTVWSLPLDISLAGDAGSGRKSHWVDIWTTMPQLVEPYNLPPAPYVSRS

SEQ ID NO: 28541 - protein, 62 aa, A.fumigatus
  UNSURE (54): Identity of amino acid sequences at the above locations are unknown.
STSTSLKANKATPSTGHPGSKTTSWLSFGNYVGANNLNDPSVKNVNSWWGSTWXVYYRTSLC

SEQ ID NO: 28542 - protein, 172 aa, A.fumigatus
AHITAHQEPSVPDVFCQIPSKSYTMAAIFQSQKSALITGAASGIGFAIARVCRTKGMHLALLDVDTANLENARNELSALDPSLKTEIYTIDVGNRDAWKDIAKQIRSTFHDLDLIVLNAGKSYKAQSGLAGRLKPWADAEYWRKVIYLIRSCPAIADELDIRHQRLRPAERA

SEQ ID NO: 28543 - protein, 278 aa, A.fumigatus
RDPSSPVVNTEAIRLSLASEEERRNKAEKEARKEAKRREKENKKAEKAARKHGFYSNNASSSALDVPSDARLGRVASTSSSITGEDASPSKGKEVDRTSPAATAASSQSSTEIASESMTINPHPNVVELGSSAQSSMAQLSPRELPKPSHLRQVSSASSSFSSLVESTGEDHSGAYDGNASSTEPLFNFRSLAAVIGDEDKGDGTAEHVEDTSLKPSAEGSASSTAPVADEMPGQSTTPADPIAVKTVAEDRDCLMPKELETQSVEITSATRNAEATT

SEQ ID NO: 28544 - protein, 228 aa, A.fumigatus
TALSHHPRVKTTEFKKLKPAYKAVIKDITEKMGNGMADYCRKAALDDASVKTVEEYDLYCWYVAGLVGEGSTRLFVEAEFGNPALLKRTELYKSMGLFLQKTNIIRDVREDFDDGRQFWPKEIWSKHVTNFEDLFKPENREAALNCSSEMVLNALRHAEECLFYLAGLREQSVFNFCAIPQSMAIATLSLCFRNPAIFERNIKIKKGRGVPVDDGVDTESANSLRGLP

SEQ ID NO: 28545 - protein, 161 aa, A.fumigatus
DMRRSVSFTLLVCVNRASSTSAPSLSPWPLLPFPFASATRQFSNVTSRSRRGEACQLMMESTQNLRILYEAFRRYAREIHKKNTPKDPNFLEIGIACAKVGILHSSSFVPSINSRRSKNLSRPSSHRNQPKRPTGVSWAKSPKPNKRRPDWRLKPAKTSSL

SEQ ID NO: 28546 - protein, 144 aa, A.fumigatus
  UNSURE (34): Identity of amino acid sequences at the above locations are unknown.
WNRYAKFSRYTTWVFYGLLKTDDFQIRHEGKGVXVQDMDPLPNWNRGRAIVIGDAAHAMTPLQGQGANMAVEDADSLRLLRPGLSHAEIEAVLKQVDNVRRPRASKVLEDTRVMAKDISMEQRLANLDFTCGYNGVFEALKEIQ

SEQ ID NO: 28547 - protein, 184 aa, A.fumigatus
SIPDLTKRTDLCLCSATASMAGPTEPIRKRRRPALSCVECRRRKVKCDRNSPCGQCRAHKSTACTYAVAWATGPVRHESQRTQEPLLPEPADQGASEPQQPASSSPNPTIGESTGPGISLVLGGPVRCTPPDLDSTHTLPQKVSVSSSTIQAPPGPFHGILSKTRVFGHGHWMSSVPLVRRPAT

SEQ ID NO: 28548 - protein, 104 aa, A.fumigatus
  UNSURE (71): Identity of amino acid sequences at the above locations are unknown.
STWPANIVHLLKHRFDFRMGKTWTQQAETVSIFDCHVRPLTLQWGHRMGRIPDNDCASSIPVGKGVHILNXHTFTFVANLKIVSFQKPVKNPSGVPGEFCVSVP

SEQ ID NO: 28549 - protein, 106 aa, A.fumigatus
SRFVLFTSGITLFETAMAAPRLFRPAARLLSSRLSATPFRSTFQKSACAPSILRARGYATESGTKEVTVRDALNEALAEELESNPKTFILGEEVAQYNGAYGITFS

SEQ ID NO: 28550 - protein, 142 aa, A.fumigatus
HLVRLLYGQAFPMSEAAQKDDFVLPLGKAKIERPGKDLTIVSLSRCVGQSLNAATELKQKYGVEAEVINLRSVKPLDVETIIQSLKKTGRLMCVESGFPMFGVGSKILALPMEYGFDYSHCSCCLVLPALRFIHLTLLVLSR

SEQ ID NO: 28551 - protein, 73 aa, A.fumigatus
ALGRFARIIIICLCIVVCILLVSIALCIAVLSVRILSGFVPNEFARFTRSYRLVGVVVIVSSPRGWQWPLQPH

SEQ ID NO: 28552 - protein, 158 aa, A.fumigatus
YSHHRGGLLWFGCWRRPRWTAPYRESNVYLFLKRLERLMGASHLQCEFMTFNFAMQAIDQIINSAAKTHYMSGGIQPCNITFRGPNGFAAGVAAQHSQDYSAWYGSIPGLKVVAPWSAEDAKGLMKAAIRDPNPVVVLENEYVLPEPLDVAGLELTFG

SEQ ID NO: 28553 - protein, 103 aa, A.fumigatus
IAIYYYSFGRENELQLTGSFQSHLMVWNIALTRMKYLAYWALLYSSSPGLAIQPSAPDAIPAPIRDLQWGQLNFLHTTDTHGWLAGHLQEYGFAIYCAIVDAR

SEQ ID NO: 28554 - protein, 212 aa, A.fumigatus
CRSKRASYGADWGDYISFTTRMREKALAQGNDLLIIDTGDRVEGNGLYDASEPKGAYISDILRQQQIDLMSAGNHELYKQNTSETEFLTTVPNFRDSYLASNIDIVHPISGELVPLAPRFKKFTTEKQGIRIVAFGFLFDFSKNYNNTIVYTVEDTIKTTWFQEAIRDEEVDLFLVIGHVPVRSKEYNAVFEEIRNGLHHGAGRIHGWCYQE

SEQ ID NO: 28555 - protein, 60 aa, A.fumigatus
LPISSVSLTLMSRKYPLWHHGVHENMISVQPPTSPWARWIGSEHKHGQGTPSEMQHGTSQ

SEQ ID NO: 28556 - protein, 476 aa, A.fumigatus
WSNSFEARTAMRLAIEQAGSVFTGWIASCLSCLRPEGDVQSSHYQRATKSNGMYSFPDRIYHQQTLMSCNPGVEREMRICHTQPHLVPPMKLVVYDNLPSPGPPPRTSSFPPWITEGRSIASRASNRASMSFKRQSTTPLRISAPTDFRRVETFQSFASSPAEFQPLVLKIHTPGNRLSDLPTFDEFTSQEGRRRSLSWPAKAVVSPTDPSRIPRVRSHHHSSSSFQLARKPVGSGSRRSSLSNLEQLLDKQSPIASPGMPHFSARTSTATGLSEAMFLPTHSRLQEPSAGYGSMPQRQRIDITPPIAVPPKTPPKTPLQDRPLPPLPTGNSPSSTETPTSNPSSTPLSENDVQTQTPNTTPSRSGRVAQWLLQTSSKASPPVSWKLQAGRSRGGSASANAFRIRSRTLSGSTAVSSAPSTTTTTSLGPRTPTSRGTRDLNLNQLSEKDLEAFPSRGLHHGAGRSAALGSGAQWDP

SEQ ID NO: 28557 - protein, 193 aa, A.fumigatus
DQAPVDLPFRTWSSFWTSNLPSQALECLTSQPVPQPPPASARPCSYQHTPGCRNPRLAMGQCPNANASISPRPSRCPPRHLPKLPCRTGRYHLFLPVTPHRQRKRPHPIPHPPPSPRTTSKPKPQTPPRPAPAASRSGSSKQAAKPLPLSPGNSRPAGAEAAARAQTPSASAHAPSAAQRPSRPHRAQPPPQA

SEQ ID NO: 28558 - protein, 242 aa, A.fumigatus
NSSFGMGVEADSKLPDRSSSAQSKEDVDPETGSIQEGEGLDRLGYKQELHRNRSVLTLLFQTLAIAAIPYGEGSPLLNAIYGGGPLSIFVGWIMVCVLDECVALSLAELASRWPTSAGPYYWSFQISRSSKTVLSFINGWIWLVGNWTITLSVNFGFASLVSATVSMYHPGWAATDWQLLLIFYAICIGSFFICTFGEPLPSPGRHRVCHLHRTHHPHQSHCIVRQGRRRQTQRGLRFGPLQ

SEQ ID NO: 28559 - protein, 107 aa, A.fumigatus
VRSSSARLGNRYLPQVDIACATFTALTILISLIALSVKADAGRHSAAYALGHYNENLSGWGGFPFFIGLLPAAYTFSAIGMGLLNGRKIVPSPHSHLPRGHSTFCVP

SEQ ID NO: 28560 - protein, 95 aa, A.fumigatus
  UNSURE (78): Identity of amino acid sequences at the above locations are unknown.
PVANKKKSILHLTAFENSAAFRDYINATTAELDDPFAQDDATDFGLLALRDRPVADWGPSVEKVCIKSTSDFTEGCLXIGYGTFEHPTAALNPYP

SEQ ID NO: 28561 - protein, 76 aa, A.fumigatus
LQKEDLDCSGLHWTSPAHAFTTQKHVCLTLTFEKDSHIHFDAFANAHSLPQDIPVILNLWILPTILNTLTLLKLGL

SEQ ID NO: 28562 - protein, 63 aa, A.fumigatus
LIYTSLLVLIQISARYATNLMDPADYDKVLANPQEVKDRIIGSKIVIGLSSPRGWKDPRGFYN

SEQ ID NO: 28563 - protein, 303 aa, A.fumigatus
RMRNVQYTHLPSGGLCMIVFADFILHSDDGYRLTYGGLDYLALNAHQKQKCIYSVGNQIGVGKESDIIVVANSKGTQCILKIHRLGRISFRTVKTNRDYLRNRSTGSWMYMSRLAAMKEFAFMKALRENGFSVPEPIAQNRHTIVMSLIDAFPLRQISRVPKPALLYSELMGTIMELARFGLIHGDYNEFNILIKEEEDPNAKGKAPADADNDENIRLVPVIIDFPQMVSIDHPNAEMYFDRDVNCIKRYFQRKFHFLSDEPSPFFSDAKEQLFEESWESGWMSTYKAFGFSRQDGSRAKNLT

SEQ ID NO: 28564 - protein, 217 aa, A.fumigatus
TNNSAYTSIGSSLRGTSTAMPELAEVSRIVHFINQHLVGKTLTKVSAQNDDIVYGKVGTSASEFQKAMEGKKVVSAGQQGKYFWLIMNEPPHAVMHFGMAGWLKIRDADTYYYRVEKPEDKTWPPKYWKFLLETDGDPKTEAAFVDFRRLSRIRLVDCPGEEIRKHSPLKENGPDPVADKDIVTEEWLADKLKSRKVPIKALLLDQANISGIGNWMG

SEQ ID NO: 28565 - protein, 173 aa, A.fumigatus
QPFSDEILYHAKIHPEQYSNTLNDEQIKQLHSSIHYICTTSVDVLADSEKFPEHWLFKHRWGKGKKNKPSVLPNGEKIVFLTVGGRTSAVVPSVQRKTGPVARDIDDEDTNGPKTETKRKRVTAVTKEEDVNDDEKEPKSKKHGSRSGQSEDTVEIKEEPKQERRRRSTRLRN

SEQ ID NO: 28566 - protein, 586 aa, A.fumigatus
RPIWPIGAGKSPVPLKLDSTLKRADLEKIRSSRKDRAKEKPARPVRDDKMQVGTYPSSSHYAAAPVQRSPSRPRQRDSVYVRHVPGTCRDCDQGLYHASTPIEPRRMEHPYYVSQPPPSVYDYPPPPPSPQSRYPPSIIQDVHVSHSSRPSARSGRSNSYHSTARPSSFHGMMPGMGPMVYTPSPMSRYEAGPPLASPVYANSPSYAASHYAQQSPYYGAQEFPALPPTDHHQERSVSKTREKQPRARRPSLYGPPVVDHVPPTPPYDESEDDDDEEDDDDDSEDEQLLEPPPPPVRTRPRLPSQSSHNRDEDYYRMPPPPIKNNNTRPHVIQKRPDPPRKSATTTSLTSERRSSRSFDLSEMEDALPSYGYRRSSRETVVPERSQSLRGSRRSTSYHDSVRPARIAIEGARRQRTTVYDYNSGGDIEDKQREAEEYQASRSGKTVAVPLTADALRKAKTSQRAESDSGSQKSRSSRGSDARTQNGSSGEAKPEEDDNIVMTMNGVTMSFTQKSVGGKRISVRTGDTGAVELNIEGKRPKKYLTGGSDYTGSVSRRELEDARRPRGDRRSDKASHRSSRSTYSGRY

SEQ ID NO: 28567 - protein, 100 aa, A.fumigatus
ILLRSLALNVQLNRSRVASADADPLSPDRLLSETHSHTIHGHDNVIVFLRLGLAAATILSASITTSAATALLTSAVTFRTLRCFGFAQGIRGKWHRYGFT

SEQ ID NO: 28568 - protein, 76 aa, A.fumigatus
PQGENYQRYQRCYQLITLQCYLCPCNHRANGVTNPQYTGTFLFENDYSTVRMDEGEYDTDTFKKGASSWFQLSLPG

SEQ ID NO: 28569 - protein, 163 aa, A.fumigatus
ISNCGLIVIRKTMSPQENSRVEYLPLSRRATDGTEFGAKESFHISSTLEKLGFIPRIVLVITFLSLTAWILNFVHPSHISVHEANSGRKPLVHTLNGSYEGIHLDALKQDIFLGMPYAAPPLGPLRFRHPQPLTESWDGVRNASTYGPQCRLTPTGMDGIALP

SEQ ID NO: 28570 - protein, 384 aa, A.fumigatus
  UNSURE (190): Identity of amino acid sequences at the above locations are unknown.
HCPDGRGRIRHRYVQKGCVKLVSVIFTWLIMAESLQDVASVLLRAEVVIGRCYVLTYSPNHHYTISHMTPEEVLAIIEAWTMVYARYLSPDNPQRRSTTSISSHGPRFGDETTSDTANLRYMQIFDNNGEIVGCSNTHPHGQIWITSSMPDEVRLELIQMSEYRKDHCGRHLLEDYARLEVDRQERVVWXNDAFLAICPWWAVWPFEVLLLPKRHVRGLVDLNKTERLQFAEAILHVTRSYDTLFGMTFPYSMCLHPQPSGSPGDSQLTHSVSALHQAPLNATEAEVDSSYLHMHFSPPLLFPSVKKFFGGYELHGEPTREITPEAAAALLRHSGTQLPVCADNLKAAQHQFQVRSDGVLCRGGTSTWWERVLRTSRWVKLWFS

SEQ ID NO: 28571 - protein, 114 aa, A.fumigatus
LLMRPCLDIRTWFSNVEQHASEGVHKILIGNKCDWEEKRAVSTEQGQQLADELGIPFLEVSAKNNINIEKAFYSLASAIKKGMDTSKSEQVGSQGVNIDHHGSGTSGSTGGKCC

SEQ ID NO: 28572 - protein, 135 aa, A.fumigatus
  UNSURE (83): Identity of amino acid sequences at the above locations are unknown.
QCSEVLRGTSLRQLPRLQPRVHLRRVTRPAPARRPETHRRGTQLPPGHAQRSLPGDPHRGRASRTQAAGDHPQERNRRRDPRXHRRDAHPAGRGGPGRGLWPGGAEARGCAADDRCRGGGSQLPAEGHGHPLSVR

SEQ ID NO: 28573 - protein, 209 aa, A.fumigatus
RKSDRMHSVVHTGFLRPSLIAKVNVDRIGREDDGASLWTPYPSHRAARPAYLNQYFDESCNLCEIARDISRVLFADDQSHASTAYRRQTKDNLYERLRRWHNALPDVFDPGRRPPPHIILLRLRYFTLVINLFSCSSSTDDTSSLASNAPKTPESPPRQSPIGRYNAWEITQSAARGISSLTRLHRREYGMSRAHHFAMYAINLALFVF

SEQ ID NO: 28574 - protein, 377 aa, A.fumigatus
  UNSURE (176): Identity of amino acid sequences at the above locations are unknown.
RLTPCLDMNDPTSTPRQIVPGRVQTSPTSPTSDSPPQGSQASPTSSWKKRVSTACLACKKSKRKVGGRPLIFHFRSSGPNRSNLLDMDTDMADNAAKCSGVPPCDNCRAFNRVCIFDESLDQRRRVAQKRTAEELNYHRDMLNDLFRVIRTADEPHALKLLEIIRKNATAEEIRAXIDETLIRLDGEGRGAGCGQAVQKLEDVRRTIDVEGADPSFRRKVMDIHYLCDEAPWKVPAKPWTSVTEDEDLVSHLVSLYFTWDYPFHAFLDRDVFLAHMARGREDSDFCSPFLVNALLANACVRSLLFCPVFPAWRLVLYWGEVIADRDETALLRVLRGVCRAGRLGDQGRGLFVGSGEAEGGGLSKAQSGVPAGDVAVV

SEQ ID NO: 28575 - protein, 113 aa, A.fumigatus
ISLSSAKKKKKKKKKEKKRKEKKKEKKSRDNMRMKSLDLRSFLQLSAQAHPSAACPSKNKRHDGSGWFQPKRPVTALSSGRRGEVRNTKPERYEQRGPEETGRIDANRSSITY

SEQ ID NO: 28576 - protein, 85 aa, A.fumigatus
LYRMLRNVLSLTIDYVDNIPKSRAAGTVDTPGAIPSLFIHLLGPFISITIYTWDILLSGFCFYTFFCMPLVLFMKYDLPGIGARK

SEQ ID NO: 28577 - protein, 273 aa, A.fumigatus
  UNSURE (46): Identity of amino acid sequences at the above locations are unknown.
NCQMPLALRLALEPARLAMDLRTHLEGQHSANIQSTLTRRQGLLNXKNKAILPGGGVEFSSGHSFSISLDEVERLDELGKGNYGTVYKVRHSRPHMRKPGMGLRGIISRPAENSTPDSTSAAKPQDNLSGYIMAMKEIRLELDENKFAQIIMELDILHRCVSPFIIDFYGAFFQEGAVYMCVEYMDGGSIDKLYKDGVPENILRKVALSTVMGLKTLKDDHNIIHRDVKPTNILVNSRGQIKICDFGVSGNLVASIAKTNIGCQSYMAPERIA

SEQ ID NO: 28578 - protein, 108 aa, A.fumigatus
GGVHLSGATGGGTYSVQSDIWSLGLTIIECAIGRYPYPPETFNNIFSQLHVSLKPLSQLFRMVEHCLMPFQGYRAWGSANLTGGRIFGRGACICPCLLGQKSQQASFV

SEQ ID NO: 28579 - protein, 137 aa, A.fumigatus
CHFKAIVHGDPPTLPEEGYSEEAHAFVHACLDKNPSKRPSYSTLLRHPWLAPLMQPPTESNGTEATFADPSAGQPGGPDTSTATEDEEVAEWVKERIERRQRGHLQEAEKPALHAVALDAVPGSPLLDDPSSLPSLS

SEQ ID NO: 28580 - protein, 105 aa, A.fumigatus
IQTKFTSVHGQDPNKMPYDPRTSVTDQVHASVKSSLHNLCAPDASSSVEDAYIDTFLLHSPLSTMAETMEAWLTLESYVPHRIRNLGISNCTLPILKKLYARCDG

SEQ ID NO: 28581 - protein, 437 aa, A.fumigatus
  UNSURE (237): Identity of amino acid sequences at the above locations are unknown.
RLLTFRIILSAARGNTSLESAVSLTKTLRLDMQALGQRLANAAASEELLRKGAKSPRDRSRNDAEIKLIVRDIKRLLTRIEDAVPLMNLAITTSGARLSTNLPATVSPSRLLQASTFLTAGDTQYWMSPTQAIQIGPTFTLSIYMLFAGHVRPQDEEGIRETTWKEVIHKARVKLRRVPLDLTSITLAPTWRAKLPAEARIDEYQYQMLIIEDLDDGRVHSYDEDEPKPEPYEGIPXAGMREILPIHQISKIFYADTSKVLNINTEGEVNNPVLLLKRDINAIPPRRMLEREEADSFYVQEEQGEEETDEIQAQLDAQLNGTNAKDSLNQSYNEKSIPEHWRFPKDLDPEWIAFEVYNEDESSDTESEADAPDREHSIDPQMMAKLSLDAEDDRSKQTTPTSSHPAATTTVSNPLFNNIRTSFSIVLHRRGWKNTQS

SEQ ID NO: 28582 - protein, 195 aa, A.fumigatus
  UNSURE (24): Identity of amino acid sequences at the above locations are unknown.
VIWCKIKTPKKRPSLGQRCFCNLXYPSFSPSSLWLSFSRYPKMANQTPDSWEDELSKQTEGVNLNARGQYRPQAQAPSFHPGAASFQPGAPSFVPGQTYQQYGGGYPQYGQYGGYPAYDQQQQGFGQYGAYAQQPGGYNQIYNNQYGGYNQHQQQQYTQPPRQAAPVATQAPSAPAQPAQTAPNIHHGPGRNRNC

SEQ ID NO: 28583 - protein, 69 aa, A.fumigatus
NIFLPLRNPAILYPTTMASETKILPKKGERNILVTSALPYVNNVPHLGNIVGSVLSADVFARCVLYAAL

SEQ ID NO: 28584 - protein, 272 aa, A.fumigatus
DLSRYHKACGRQTLYICGTDEYGTATETKALEEKVTPEELCAKYNKIHQEVYEWFEIGFDHFGRTPTQQHTEISQAIFKRLYDNGYLTEKTAEQPFCEAHGSFLADRYVEGECPRCHYEDARGDQCDKCGHLLDPFDLIKPRCKLDGATPVRRSTKHIHLLLDKLQPEIENWVLPAMEKGNWPKNSRDITKAWLKEGLKDRGITRDLKWGVPVPLPGFENKVLYVWFEACIGYPSITANYTADWEKWWRNPEEVELYQFLGKDNVPFHSVIF

SEQ ID NO: 28585 - protein, 107 aa, A.fumigatus
TDICVLYSPGVISPTLWSIGTDLSNRVLTTLDKSLITSCTSLFALLASPLAGILADKLGRRRVILVADVLFTLGALVQAVTGQVWGMVLGRSVVGLAVGAASLVTPL

SEQ ID NO: 28586 - protein, 364 aa, A.fumigatus
LIIVFPRYISELAPSHARGRLVTILCLFITGGQVVAYIVGWLFSTITSGWRWIVGLGTLPAVLQFVIVVALPETPRWLVQAGLEAEALHVLSKVYQGQSDNHQIAKQVVRSIQLEVAEEQEEMDRIKPSVDATRIPWLRKVAQRAQDLFLVGGNRRALIIATMLQGLQQLCGFNSLMYFSATIFSMLAFSSPTLTSLSVAVTNFIFTLLAFALIDRIGRRRILLYSIPVMSASLIVCALAFGSMELPGFSSEPRSQTQADNGATDKSFLPIAVLLCLTVYTASYAFGLGNVPWQQSELFPLNVRSLGSALATATNWASNFIVGLTFLPMMDWLFSGLDMYALRRRLCGWMVWHLNHLPRNGPGP

SEQ ID NO: 28587 - protein, 156 aa, A.fumigatus
KQQTREFGGRLGTSSVPAEILCFMDNRPASEYAQSGSHFPYPPSATAHSELPAADQASAAATAQYTPQQEVRPTPQYTPQPEVRPASAAAANISSSNTPQSDYGLNQPPAARSPAYPDYLAPPPQYHHAPNTQAGGAAGMAQATSPSMTTLHDGHQ

SEQ ID NO: 28588 - protein, 61 aa, A.fumigatus
NLAAAEIGGYFKPLKYDFITKSSYSCAVDIIIAYSPEYGSYCCVGVPVKGVILYLLPALER

SEQ ID NO: 28589 - protein, 73 aa, A.fumigatus
MCFDFYFKSCSAQPATIPLKACINLKNLVEQEGRVLLIVLALKNKEILNIYKAVCIYNMPYTTLQQRLKGHTF

SEQ ID NO: 28590 - protein, 178 aa, A.fumigatus
PDIGFGTVFLAHKNTPHGQANFAIKINEHNTIAAVDDGSHVAEMMFFEEGGKVRYIPCEAMIMLLLTRSPRFPTLHSVYTEKDKVAIVMSACIDYDTLQLSNGMQETDQVWAIEGGHLRTRGKEPRLNELQACKVSTQLLEAIAYLRDMNITYGDVSYRNYLVGENLEVSKFQNFQFG

SEQ ID NO: 28591 - protein, 94 aa, A.fumigatus
FSAEQAAVADKSAEAATQSTETQPGSSTTTAPEAKTEAPAPEPTAAAPAVPETTTSATAPAETAPAAPAPAAEPTPAQPTAEKPAETAEPPKSG

SEQ ID NO: 28592 - protein, 105 aa, A.fumigatus
LSAPDALQQLKKGLKAIFSRKKKKAQNNQNEPAPAADKPVEQAATAPAAGAGAAAAAAAVPATEAKPAEPAPATEPKPGTLFLYILLDPVKLSKLILCRTSSRSR

SEQ ID NO: 28593 - protein, 77 aa, A.fumigatus
EHSDDTDHQASYIALIPDWERYKKNEGYIMRRKHGNDNDDDKKTINSTEGTFGYYAATARYCGNVKEQSNDRIRRDC

SEQ ID NO: 28594 - protein, 150 aa, A.fumigatus
  UNSURE (11): Identity of amino acid sequences at the above locations are unknown.
GGRKCPGYVLXFPSSHLGLILFAYFCFSQPGCYLPWRVIHLKRQHTKIPPASADPTAVATICITNPPTRDPKSRKKPGKKRRIQLRKRKKAAEEEKQREAEKRNRKNRERKIKRRQKARELKAAAAAAAASGPSQDVAEVEMKNSSDVSN

SEQ ID NO: 28595 - protein, 78 aa, A.fumigatus
KTLQMFVSAGGLNVLVEFLEDDYEDERDLVLIGVNGIWSVFELQVSPAHQTRFTQHLTLARDQHQRMIFAESCLAVRS

SEQ ID NO: 28596 - protein, 180 aa, A.fumigatus
RRWLPNELFCTVSVDTCLARSYLSDSKYLGVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNRGLPFYISLLSDPYWQVTALDAIFTW

SEQ ID NO: 28597 - protein, 138 aa, A.fumigatus
PRQASIHTYCAKQFVRQPSPSHDFQPERRRRRCWRCAPRQFRRVLPLRPILGLIRVKEGLGPNCETGFGKNHSLVLIPCKCQMLSEPSLMSWTYLQLKDAPNTIDAYKDQISFILIIVFQKFHKNIQPSGTNKHLKSL

SEQ ID NO: 28598 - protein, 244 aa, A.fumigatus
  UNSURE (240),(242): Identity of amino acid sequences at the above locations are unknown.
CQCLGHHIGLQSGDIGKVVYDVAKGYQVGRSRCGSMVIILATSCMAMLLTDNRYLFNPFTIAACLGRSTSAFTSTAILYALSNAVTGNSFNAMLALGCASYLSIYPALLFIPLVLLCYDRRAQVAKPSSGVAIFAIQHFGILLLGVGGLLSLSYLVVPDFQQFISATYGFQLLVPDLTPNIGLWWYFFIEIFDSFREFFLGVFWLHLTGYVGGLTVRLRKQPLFVLTSSSPRGWKEPRHXKXAP

SEQ ID NO: 28599 - protein, 101 aa, A.fumigatus
LQLGSVNMAPTRSSASWLSSALAVCAILCLAVPANALYFYMDGRQTKCFYEDLPKDTLVVGTRWSFYYSQLVANYHIFFRMNRKLQNRSHQPTVQHVLGRP

SEQ ID NO: 28600 - protein, 156 aa, A.fumigatus
TGNFKTEVINQQSNTYSVDPNLKMLITVDETFDNDHRVVSKRDGHAGRFTFSAADAGQHRICLTPDTNAAVGGWLSGAPAGAVRVNLDIAIGETSKIETEDKDKMKDIVQKVKDLNGRLQDIRREQVFQRVCCSFPTVLHCLELGRMAVADLPTFV

SEQ ID NO: 28601 - protein, 198 aa, A.fumigatus
CASNSPTPLHISVDKHLDVLFSSISSTDSKMSASPPSSPLERPPSTEKGATDSLSELPVDNQGESKTRERDIHEEEQSTQNKVDGNDTSQSKTQDAGEKVTRPQNDKENTKEEDASAPPLPDEPLPPPLPNEAPPDGDDGWEPVWDATAQAYYFYNRFTGVSQWENPRVPDAPIASAPALAPVPLSDPAEGVKATTRS

SEQ ID NO: 28602 - protein, 183 aa, A.fumigatus
WLGARLGCNRSSVLLLQPLHRRFAMGEPTGAGCTNSVSTSIGTGASQRPRGRCKGHNPVVGGYNAAIHGDYDPTAPYAQQYEEPTLGGAAADPSSSYEAVGAFNRFTGRWQPATLTPENYNDENKSRRQLNAFFDVDAAANAHDGRSLRAERSARKLTKKELKMFKEKRREKKEEKRRAWLRD

SEQ ID NO: 28603 - protein, 114 aa, A.fumigatus
FRARFYVLTDHGALLLRMSDHSRVSIGTAFVAGILLAVGFSELLYPELKNRIRGTRSQPTKVLQDGSADSLTVRSGPPAIVDGIEGCIGNTPLLRIKSLSDATGCEILGKAEVW

SEQ ID NO: 28604 - protein, 80 aa, A.fumigatus
QCCQLWVYSCWYLVCYLANHYDTGFAAVKTAMKLGPGHRIVTILSDSGSRHLSRFWAKAGDVGGAVDTKLEDVLNAKDDE

SEQ ID NO: 28605 - protein, 265 aa, A.fumigatus
NLTPGIPYTRARQVRPEFHWLVLPEQRATSLTCEYRLVRLHEVFIPQLTLISCMPSDQAIEKSNLLLKLGAIVDRVPPAPIVEKDNFVNRARALAQAQTLSPSGGRGFFADQFENEANWRAHYNGTGPEIYAQCNGKLDAFVAGAGTGGTISGVALFLKPRIPNLSVVLADPQGSGLYNRVRFGVMFDIKEREGTRRRRQVDTIVEGIGINRVTANFEAGKELVDDAVRVTDAQALAMARWLVEKDGIFVGSSSAVNCGYILVGT

SEQ ID NO: 28606 - protein, 76 aa, A.fumigatus
YSHARAGDEFAGNADSAFLSTRNAPAFAFLGSNQLVFNVVDSKLLFHFKYTLFFIGSAHVPRQSQQCAGQDSFMHR

SEQ ID NO: 28607 - protein, 70 aa, A.fumigatus
LSEVRLVLSRSQSERKTLLIDLRVQISHDAFEIYSSALPNCSPLIKRINYIGAQQLLPVRATPPALLRAR

SEQ ID NO: 28608 - protein, 535 aa, A.fumigatus
VMMRLRSTVRLSLTALLSLSASTISARSNYSQSELLPPLFSVLDDRPPECPPCFNCQLDAFQCAQFAPCNKFNGKCVCPPGFGGDDCSEPVCGSLADGVNRAPRKGGSCDCKEGWSGINCYVCQTNHACNAMMPEGEEGVCYKQGVTVKENYQMCDVTNRKILDQLQGRKPQVTFSCEADDHTCNFQFWVDQKESFYCALDTCDWNLETGYNQNKTTYNCKNINCKCIPGRMLCGEEGSIDIGEFLAQEIKGPASFRTVTTEGGSPEDGSKFQEPAMDDLIKSVFGDPSIFLNCDAGECLYHTDVPGYVRPIKQINTPLIAGVIAGCALFVVAVILGVWYLSRRSYHGRIYLPLSDDSDDEAARLLADHKPAALYWDNVSYYLNGKEILSGIQGAAHPGEITAIMGASGAGKTTFLDILARKNKRGTVQGDFYINGEKLSDHDFKSMVGFVDQEDTMLPTLTVHETILTSALLRLPRDMSRADKEQRVFEVEKQLGIHHIKDQLIGSEEGKGRGISGGEKRRVGIACELVTSPSM

SEQ ID NO: 28609 - protein, 365 aa, A.fumigatus
HRTLTEVNSIVIQFEDFKNPFPALERYRDAYTCFNDDIQGTGAVILGGVINAVKRSGLPCKEHRAVFLGAGSAGVGVAKQIVAFFMREGMTEDEARSCFYLVDTKGLVTADRGDKLADHKVYFARTDNNGQQFKTLDEVVDHVKPTILMGLSTLGGVFTPEILRKMADWNTHPIIFPLSNPSANSECDFESAITHTDGRALFASGSPFQPFSFKNSSGESRTYYPGQGNNMYVFPGIGLGTILSKAVKVTDEMIYASGAALSQALTAEEIDLGLLYPDLTRIRQVSIVVARKVIRAAQDAGVDRETSLRNMDDESLDAWIKARMYDPHSEVHALEREVGALLSNLGPASPALNGYVEDQSKDAKL

SEQ ID NO: 28610 - protein, 152 aa, A.fumigatus
DLTLTAFICLGMYLSWEDRGNLAAVIANWPQPNVEITCITDGSRILGLGDLGINGMGIPIGKLALYTACAGIRPEATLPLTLDLGTSNKALREDPLYMGTRRDKISPEEEREFMDELMAALTERWPGYVAPPPHLFPMTPDANGGQQYRHSV

SEQ ID NO: 28611 - protein, 140 aa, A.fumigatus
MTILLTSVSVRCHRKEMGRWSHIPRPALGQSRHQLIHEFPFLLGGDFVTACPHVQRIFPESLVACPQIQSQGQGGLGTDPRTCSIQREFTNRNAHSVNAKISQSENSGPIGDARDFNVWLRPVGDDSGQIAAVLPAQIHA

SEQ ID NO: 28612 - protein, 523 aa, A.fumigatus
QFGKTHSRNPFLAPVSPSSIGSTGAPAQSSGHEAGTNYNFEAPDLTNGNLIPPEVPLSQGDWAGQWPTMGTLDAMPVQLPSEPQDAFHSPLAKVNQLRNNLQLWDSLVLQALPELDYSQLVDLRSFVKAIFCRLDTSIQERLDLGASNIPSPRDRYLCKLCSQGNRKVYGTRGTFRRHVSLTHQAEQKYYCPACSFSTPRRDKFRGHLQVKHGSFALTLLNKGCLDSLARPCPPPKTCGLCPKQVNTWKRYFECIVKHCRLPGGSSPYTSASQSRRGSGNTGGDGTDFDGQQGFDPSGIDGSGFPSSSSAEGNNMDGGDYDFNNISQQFSFHATSLSQRNTQDSIVADTVDEAQQSPPLAINAHARTGPNSVPNKDGPEHLSSVHSPTSLQGYHRTLNSTLKECSSASTKRKTSLDSFKQLSAARNAPHSTDSSGRSRIPNARSSPTDETPRKNRCPDLGKSCQIKCRICSHTMQSCTLCTASNGAERKCHLCAGKARQRSNKSRPWHHETYPDYAYIPGKSL

SEQ ID NO: 28613 - protein, 77 aa, A.fumigatus
TSVETFVIMNRLNNGHIIDDFNHEQDDIYTGPNAIWRFIHYTDPPTQTLGGHLAPAPTTNMAFVSQPPTSVFLGISK

SEQ ID NO: 28614 - protein, 133 aa, A.fumigatus
SSTPASTPDPTADASVAPAAASATTTAAATATTTTAAATNSINGHRLGPSDLQSAASAKDTCTITSRPRSWHLFIVNSAVVATKFTTTTSPSSSTTTDTFASSTGSWGAHSVSSGSSISSRPGDIRFTASPCS

SEQ ID NO: 28615 - protein, 277 aa, A.fumigatus
QLPPAIKVNACYRGQIKPRMDHPSSQGMMPGLHCNSVTPGSVQPDYWNNLDSLYSGRDPPHQHPHLTQQQMHQSHQQQHRQQQQQQQQQQQQQPQQQTQSMGIGWDHPIFSQQHPQRTHVPSHQDQDHGIYSSSTPQSWQQNSLQQHLHHHQQQQILSPAPQGLGVPTQYHQVHRYPPGQVTFDSRPLPAANNPSYQTYSFPQNFYSSQHMSLPDAFPQSNPPQASRSQTSQQNHYQTVAHQTPIASYSLPTGYFEGNSVSTQMTHHLKDVSLTYSR

SEQ ID NO: 28616 - protein, 114 aa, A.fumigatus
PNSRCISRTSSSIGNNNSSSNSNNNNSRSNKLNQWASAGTIRSSVSSIRKGHMYHHIKTKIMASIHRQLRSRGNKIHYNNISIIINNNRYFRQLHRVLGCPLSIIRFIDILQAR

SEQ ID NO: 28617 - protein, 62 aa, A.fumigatus
VHISHYLGEVLRNGPDPILPSFTAFAVRWRKYQGMSLDHRCESDTTELMAGFIPFYIYEEID

SEQ ID NO: 28618 - protein, 147 aa, A.fumigatus
NSRAEVRGRPTSLLLQIYDVESSFLTGRYQVHRLVAPRDQKYQSNFVEFKRSTKIVYRRYAGLFFCVCVDATDNELAYLEAIHFFVEVLDQFFGNVCELDLVFNFYKVREVYAGGLCSRTLRAAGDVIRLSDNHGANRGMCVGICDS

SEQ ID NO: 28619 - protein, 172 aa, A.fumigatus
KTDPDIVARLPDLQFIEQYDPEDTDSATAVSQPYAYVAAKVITLSEPGAKAPGLSWNPEDLAKDSPLEPSEMEALTQLRDKYAAGERIGWWIVYNGDPDRAFPRYEEDDSYDEYDYDDDDDDEYTESNGDSVRNSTAPETPPSPVVSLALRTSLILVTDYIDGLAHLRLDSP

SEQ ID NO: 28620 - protein, 427 aa, A.fumigatus
SLCVQLFTDNPILTIVEQLAIQQQIELLQQQQQQIAATHQQYVNMGLLQPQQLGQVSAFSPSLQGGASMGGVSPQINAFQFPQLAQQQLGVPMNTPTQHSHRRNQSALPGLPMGPPPAPSSGASGYTDYNAQQGNPQQKENNNHGRNRGPPGGGHQRRHSLALPEAKKAAELAQQKRTASGFQFPAPGAGGSSENLSGSEDKPTSTTPQPPQGLGLHRAGNLRAGAHGRSQSVAVGNSRGSLSGRGMGGFQFPQSSDIGGQSENQRRGSQPGHARTPSRNFDGNWRQPNNQNQAQDQQKSFGQQGGSTFQPGHRARASNQSIGSIGSFQYPAQPQLIQLPQGQVVMAPPQLFGAGQQLSPLQLAQLQALQQQSGQLNGQGLGGLQASQHAPPQLSAQQQQQQQQQQQRKTLFIPYLPQANLPASPRG

SEQ ID NO: 28621 - protein, 242 aa, A.fumigatus
FDVPSAPLPLHFQTVTPQTEKLELPSISQVHTRGPVDIPWYNHHAAERPLLSGDKLPALSLPTASQPIVSGQSYRASYEESAPGSTTSSARTSLSSGTAPTISEVRTPPSVDLVAGGHGRLSLESSASQDYTVAHNQVSDSYYPNPTPRGSMNQTHPYMDFTPSNLSIGATRTPPHAGERQGAKGPLSANILKQTTCSWQPSPPSYCPGQLLYFAIMALSLTGGWPPSPENGLNPPGIQQSE

SEQ ID NO: 28622 - protein, 89 aa, A.fumigatus
  UNSURE (26),(38),(41),(62),(80): Identity of amino acid sequences at the above locations are unknown.
GLSLLLNLPSKQVHTSHTPVNHAAVXYIGQHPSRGTPXISXGCSPSIKSYLGNNSGAPPRVXPQPPKIPCATLCLGKGTXGEFSCVYPG

SEQ ID NO: 28623 - protein, 109 aa, A.fumigatus
SPQRLSYLFTMTILKQTLDNAEIQESAIVTMTAGNKSGASMLENAFGSQGAQVMLPEPAWSKVRTYCRDAFSEFFGTMILILFGDGVVAQVTLSKGEKGDYQSISWGWG

SEQ ID NO: 28624 - protein, 244 aa, A.fumigatus
SSSSLEMAWLPRSHLAKEKRVTINQSPGAGGEYISWFCCSILWHLLTGLLFRIGVMLGVYASGISGAHINPAVTFANCVFRKFPWRKFPVYAIAQILGAMCGAAIVYGNYRSAIDQFEGGAHIRTVPGYSPTATAGIFCTYPAEFMTRTGQFFSEFIASSILMFLIFALKDDGNIGAGPLTPLALFFVIFGIGACFGWETGYAINLARDFGPRLVSYMIGYGPEVWKAGNYYFWVCLALFEYDD

SEQ ID NO: 28625 - protein, 271 aa, A.fumigatus
FGIVTTLLMEMHTVVFPPGKPAPPPAAQPQAVAAPAPEKKKRVRRWHRRGFTGCLTCRRRHVRCDEASPSCKNCTRLGLDCDGTQGRMTFKVYGPSQGAQDLSPSPNNISTANAITVKNQQADIKHVKQEPRDEKDDLVDGIVISPTTVGDSAPVKYRFQDPLSPSGFMPSSLDLVEGRYYTHFIEQVSTLLLIYDNSNNVNPFRQYFPELAQSSPSVASAMQALGALHLANTSAGPKRNVHFQQAMGKYGEVVKTFRTSSPRGWKDPRRS

SEQ ID NO: 28626 - protein, 75 aa, A.fumigatus
VLLASYRQDSHLHLTEGGCLLEAKTLRPIIWVHLELGKELPCTEKVTWKDVTSIRKLTVPGQLLDGNNHRWTRQC

SEQ ID NO: 28627 - protein, 64 aa, A.fumigatus
GSIPRRYVLTLAFTIRKAHMVVAIMESGNAVGPPWNGTDWHQPMYDRIVNKAGYLNRSSRWSLC

SEQ ID NO: 28628 - protein, 62 aa, A.fumigatus
EIYGSFLIQIPFVFANPVQNITPLGTDPSRLELGNMAARMWTSFVTDLNPNGHGGTSGSRLD

SEQ ID NO: 28629 - protein, 267 aa, A.fumigatus
TRLGILIAPHDGVYADNSSCSTSSDTLQCLREVPYQSLYDIAYEGLEWFAAIDGSFIKEYPQISYTEGRLAKVPILLGSNTDEGTSFGTTGTNTDEECINQLICGFFCRPRQRLVLTMTASKRWVLTREEATRLLTYYPNDPALGCPYGWGNVTWPKLGLMYKRYESMAGDLTMVAPRRLLAQTMAKYTKQVYSYRWDVPALNTSSTIGVGHFAEVSHHHLHRRSMAHFSYRSLLSLRILCRTLHRWELIPPVSNWATWPLGCGRPS

SEQ ID NO: 28630 - protein, 128 aa, A.fumigatus
LTRTLRVVVKMHLKSSCPYWFLYCIMGPQDQTGAKRIRGKPVPSQPGSHGPTVMNVPPPSTGSREACDECRIRKVRCNKEYPKCSSCRKSNLACGFSNKGKRVNHTKKLSVFCVLLVDLDDSNLPVPG

SEQ ID NO: 28631 - protein, 98 aa, A.fumigatus
KHASFLAGKPCLLPSYDCGLPFPVAKSEHLPRDQRSAHISLARIQEDVYQRLYSAQTAHKGREYISRQTQQINRTLDDWEIQHKHILSPASTMTAQEA

SEQ ID NO: 28632 - protein, 466 aa, A.fumigatus
LIWMILISLCLDRVNDVEILGNRLGKIEEALIRCLSAVERSQTPSNATARQSSVIPSDDSSHPDPNDSAPTDGNTLTDASLETNAEACNDPTFPGSTPIASFYTEAQAACDRLRSVVPFASPDSQHSPASPDFIPDRTGSLQSRLQEVGELFEKFARESPVMSIPESDGLLPSLPPRALVETCLETYFACLSPFLPLYSRQSVMAAIDEQYGPRVNSPDPAWVISFNNILLQTLDARYSAATRAGSITHNLLEEELIKSLLLNYRRGYNNFERLLRPQLANVQALLSMVGRPFFMHGIFTVLPAQALIALKYFSLATFETVFAQACQLAKSIGLHQSSPDSENAEQKDLWWSLFIIDVSLPIVCVTFPCSRRNRSTHLSWPASLACFRRMTAGCRSQWPSRSISHGINVRHTSLWPGSKKTSTNVSTRRKPLTRAASTSVVKLSRSTEHWMTGKSSTNTSSLLQAP

SEQ ID NO: 28633 - protein, 64 aa, A.fumigatus
GRHLGDLYLIFNPSSRGIQNSILGILGDLLARGWFDPSSQFNRALGTVSGHEFLVYYTMGRVRS

SEQ ID NO: 28634 - protein, 66 aa, A.fumigatus
PYHPGLRLSQDLMDTIGDKLSKEPDLAKTGLEIDYIDPTQICRTPIPETASPTRYSSTLDATLMLH

SEQ ID NO: 28635 - protein, 360 aa, A.fumigatus
  UNSURE (92),(176): Identity of amino acid sequences at the above locations are unknown.
RRFKIFFSFDYVARGPWNQDDVTELLLRYKVNEAYYRNNGRPLASTFEGSENAEEWINIKASTDCFFIPDWSSLGAKAALEIGYGIVDGLFXWAAWPSGPQDMNTQVDLCYIKLLNESEGLVYMMPVSPWFYTNLPGYGKNWLWRGDDLWHDRWQEVLSVRPEFAEIISWNDYGEXHYIGPLHEGGYELFRTGKAPFNYAENMPHDGWRTLLPFIIGTYKRGHAKVKQESLVTWYRTTPGSACGTGGTSANTQSHAHIEFSPLEVVADRIFYSALLTEYATPEIFIGSTTQKGTWRNLPASGRGIYHGSAPFNGAKGDVEVTLWREGNRILTLKGKGISGSCYNGVQNWNAWVGSTQSPS

SEQ ID NO: 28636 - protein, 183 aa, A.fumigatus
HEFSNPLRKRPPDLFYDDNESRKYTTSSRIRNIQADMTHRALELLDLRSPSLILDVGCGSGLSGEILSQVPPQQGGPHTWVGMDISPSMLDVALQRDVEGDLLLADIGQGVPFRPGTFDAAISISAIQWLCNAETSDVSPEGRLRRFFEGLYSSLRRGGRAVCQFYPKNAAQRGFQQPAEIQQ

SEQ ID NO: 28637 - protein, 79 aa, A.fumigatus
LWALSALPPPVKTSINWHVFGMVAVSTTEFGTMKGFQAYVCLFEIIRGSSMRCSWSCDRCQWKYAELPVPMIPYLAWTL

SEQ ID NO: 28638 - protein, 67 aa, A.fumigatus
TVLCELLDALLQYDPAQRLSAKQACMHHYFRNSSSSSSYFNRTQGGANQSLDREHITASLMLVTNCE

SEQ ID NO: 28639 - protein, 111 aa, A.fumigatus
DLLVRSFLLVRVGQIEFDTLFYNPHGTPDGEIWPGFITFSDYKPTFPKWRRSPAPLIPGFRQCCASFWMPCFNMIQLRGYLQSRPACTITSAIAAHPHPISTVLRAVLTNL

SEQ ID NO: 28640 - protein, 69 aa, A.fumigatus
IKYLTFSRDIICTTRSPNPMPYVAVFGSLSYRPAIRGSRLSMGSWGQATLHISIGIGHNSNYTAWRIRG

SEQ ID NO: 28641 - protein, 70 aa, A.fumigatus
IRSLTRIALENGARSLEMMDWVIEEVTFKAETFLKKEMVIVLDGDVVKSNIAIKDIACPPGGCGAFGEYC

SEQ ID NO: 28642 - protein, 67 aa, A.fumigatus
LSFPFRRGQGLGGEDDPFSVINNGRAGTKGEFLDLFTTYSLDYQYLPCEINFKDTTEGCRIASSYNN

SEQ ID NO: 28643 - protein, 131 aa, A.fumigatus
VMIPQVVLRRLEMQRVLFIILEARQDGEERTKNCSVAFVLVQWWSYAKRLACTGAHLIPGMFHCMVFSGYVFHIHMFLQACALLSSKLVLRSGMIMSAWCQVSTQTPFKGHIRFYSINNNAEVLHASLKTV

SEQ ID NO: 28644 - protein, 150 aa, A.fumigatus
SHLSQSTTHRSIMAENALPSPKRYITENDDEGNSFFSNTLSESLPVVNDLGGALARLGYTTNRPPVVLTNGNDVKLYETSLKELPPLVTPGGGANVWYIDTPPDSESPVHRTVSLDFVFQIAGEIELILSSGETRIFKPGDLTIQRSTLH

SEQ ID NO: 28645 - protein, 240 aa, A.fumigatus
ANPESPISETGSASSTFAPEDRVVLGYTRNNAGGLKDAIDFLISRLVAHGLDATTVKGAIPRPKSDSFEESLPFFDSKLLQHAPAPIVTDSPTRPSFPDETSERGSIFERLRKPGSISSFSSFIGRKNHSASPGSFFKHASSNASKASLVSMESRDSGYRNPWNDSGVNLPEDDLPVLGSSHSHSNSTNGWPARFDTKFPFGTAPGDMTPKHDPRASFDSGRPSTSNSTSGYPAPIGPPR

SEQ ID NO: 28646 - protein, 61 aa, A.fumigatus
KKLNYHVFFRACEDKFVILGQSESGMCLKEQASGIAWVCINDDINVLSQISCKTHLRVDKA

SEQ ID NO: 28647 - protein, 594 aa, A.fumigatus
  UNSURE (13): Identity of amino acid sequences at the above locations are unknown.
RGSSGPCGRRLAXNIMKKMALQTLPLLETQNNASSYGMSESLFTSLKDIFESVVGSQSRIGIIRPQQFLEVLRRDHEMFRTAMHQDAHEFLNLLLNEVVANVEAEASKQPPIEKSLPAPETADSVDQSSSTGSKTPNTTRWVHELFEGLLTSETQCLTCEKVSQRDEVFLDLSVDLEQHSSVTSCLRKFSAEEMLCERNKFHCDNCGGLQEAEKRMKIKRLPRILALHLKRFKYTEDLQRLQKLFHRVVYPYHLRLFNTTDDAEDPDRLYELYAVVVHIGGGPYHGHYVAIIKTEDRGWLLFDDEMVEPVDKNYVKNFFGDKPGLACAYVLFYQETTLEAVLKEQEQENMDSNLAATDANDTILKQNGFPQSPLAHVHSASQIPSHEDNLRPNGLRRAPTAPQLSTHHEHGDPESAPFSPLSPLSPLSQTPPVPPVPERVTTVATPPKNDALAKKERAREEKERKAAEKEREKAEKLRRKEQEARMKENQRREEAELKAALEMSKASKAEEDRRLSHENGKEKQGGSLSRLKRGSKSLSHRLGKDKETRSVSSDLPPVPIPEHSTLSQTGPTSEQQQQQQQQQQHLHPGLEGQR

SEQ ID NO: 28648 - protein, 67 aa, A.fumigatus
AFVNCIQKGKITDTLQRRVPESLYPVAFDIWGHSHTIWHVFVTFSIGAHVMGLLHGLEYSYSQAECR

SEQ ID NO: 28649 - protein, 202 aa, A.fumigatus
QLLPGTKNSKMVFNGLLRFRIIRSKQVKEIALGGGHDQSQPVEKQTLLTIKQLPPWYDPNPFILSGYRPETRSYYRCFASWLYCHNETGNIYSHLIPGILLLSSQGILYEYIRTKHENLSNFDWSIVSLQLVTASICLLTSTTYHTLLNHSAAVAHRWLQLDYIGIIALILGNFISGLHFGFYCNPQLKHFYWSLVSTLLVV

SEQ ID NO: 28650 - protein, 94 aa, A.fumigatus
YGCLQILAFSSATAVALLSPQFRGLEWRSFRLASFVCTGLSAFAPIGHACMLWGVPYLWKIGVKYYLLEGVCLIIGCYFWEVGFRQLYPEGEDY

SEQ ID NO: 28651 - protein, 166 aa, A.fumigatus
ESSKSARPTTGSVKTSSTEARFSRSTVTPARYVHTYRSPPAKVNFLQNLVEWTYVGELLSRQSSGDLGPNRVVERPKVLYNEATRKYVMWMHIDDSSYKEAKTGVATSSSVCGKYTYLYVWLFDCASAVHNLTRWLAGRFSLWGSSRAIWVCSRMMTGPRIYSRRM

SEQ ID NO: 28652 - protein, 85 aa, A.fumigatus
PRLAVYIPMVNDLQDGTALSCIIVEGSLAEYGFIMLLISRLVAALALAGTAIASLQIVSSQSPDVGYIANMTGLDSRRDMDCEWY

SEQ ID NO: 28653 - protein, 187 aa, A.fumigatus
SQYTMAHTHASSKKRRREPVTIDTKLVEIYEDLANEKDEIRLKAAQALVSQFTPDKKPTDEQMRKALQRLFRGLCSSRKAARIGFSIALTEILAQIFAAQREESEITIPAVVGIWEAQSNASGSETGQVKLGLNSACLKTALLTVVSGTKRSPLWPAVWSGSSCQVVYSVQGRGAPGRVDQAFGFGV

SEQ ID NO: 28654 - protein, 133 aa, A.fumigatus
QLSQEQRDHHFGRLFGAEALVKSSILFKGAVPPAEWTKLLDLVFDLAKKKPWIREDCGWIIYRCVFDLASQKAGAKYVEIALERLCANDLARTPEGVSIWLAAQEAYPIAEFPGQVWEHDDPLDSPGEEPSWA

SEQ ID NO: 28655 - protein, 215 aa, A.fumigatus
DVTNSADKTGIELAYVIMGSIGNNIDAIQRDLDEVVDATKAYKTSDNDYSARYDLMVKATRLLQTIRGPVDMLFANFENVHTLPCALDTRETLTKIDGQHGCPPHPARSRRLPRYAHGRTKHLRQRHIREDWNGQGADWYISSVTPRNPQNEKKRPADATVRLMRALTPLGPFRETGEEEYAHTPFSEIYMVPQMNAIFKVLYVCYPLDLTWDRS

SEQ ID NO: 28656 - protein, 150 aa, A.fumigatus
RDSPTDARPHPPRSLPRNRRGGIRPHPVLRNLHGAADERHLQGAVRLLPARSHLGSILMFDRVDEYCPPMLRNHEFLARNNWKNTMTLTDNPYTHVHNCTGQTMFDYISQFPERLSRLNDAMMAQESGLVLHGVYPFTQEAGGLWPATTE

SEQ ID NO: 28657 - protein, 62 aa, A.fumigatus
  UNSURE (60): Identity of amino acid sequences at the above locations are unknown.
CRGTDRDRHRRLSSYATVKGQMIVMRLKEKQNKTVRVPQDTMISVNLTALSGIVAGGLIXTS

SEQ ID NO: 28658 - protein, 76 aa, A.fumigatus
ATLRSAAREKRGKGRLPLTAARENDQITVMTSYRKTRGEMLGPTAATNTLNQIKPDVNIAQAKPRSRMLTAQNTSV

SEQ ID NO: 28659 - protein, 84 aa, A.fumigatus
HWQGSYNPPAEAWTELNVDAEAELADMVHQIGEKRIEMSLILGLLKAAVFSGKYPSEYKTVDNELLGLGIMGEEELEAMFGGEM

SEQ ID NO: 28660 - protein, 305 aa, A.fumigatus
  UNSURE (46): Identity of amino acid sequences at the above locations are unknown.
WRQSGAQNIRRCAWGVPDVKSTESCHSLAEYCQTKSCGRPYKQGTXGIGIYSNALENFISTEYEIIAQIFTGDQRGLALQTTFRSALAEYSKTLRELNEYIKANLMTDCFLAFEIIEIVTAMSYRVDSRTGELKSLFIEALRPVRETAKSSLSELLEETKRKAASIPVLPPDGGSVPLVNEVMSSLTTLTGYSGPLASILTSLGDGNWRSTANASGTAPLDVSPDSSALLSHFILDMIEALMSSLEARGRALHRSKAVQGLFLSNVLCIVDRAIRQSPELARHLGTPDSIARIDTFREAGHVHFS

SEQ ID NO: 28661 - protein, 107 aa, A.fumigatus
TSRAGARPASGGIVDSSAIVKSLSSKDKDAIKDKFKAFNASFDELVNRHKALYMEREVRGVLAREVQAVLEPLYARFWDRYHEIDKGRGKYVKYDKGSLSAQLAALA

SEQ ID NO: 28662 - protein, 318 aa, A.fumigatus
  UNSURE (288): Identity of amino acid sequences at the above locations are unknown.
TVCYLYRMAGCAKILVIGAGELGNQVLHALAQHPNRGGATIAVLLRPSSIASTHPDKVKELEELRNLNVQLIPGDIAKDSEEQLSDIFGEYGTIIGCTGFAAGSGTQLKLTRAVLAAQVPRYVPWQFGVDYDIIGRGSAQDLFDEQLDVRDLLRSQNRTKWAIISTGMFTSFLFEPWFGVVDFKGDTVTALGSLDTKVTVTAPEDIGRITAEAVLGSRADSVFGDKPIYVAGDTLTYEQLGQLVERITGRKFTRHVRTVEAARADLARDPGNTLFKYQIVFGEGRGVXWDLSETWNCQVGIRALTAEEWARRNLQNIM

SEQ ID NO: 28663 - protein, 456 aa, A.fumigatus
SCCFRHQFHLVPFLPLRLLPKLPRPIRQYRPLRLRSEIARRYEERLKARPTIVERSSFIALFVSPFTLSHLKSPHEAPTYPALPASAVLTRMLIPLRYRRRITLISAVLGLFLIYHFISIRPNLPRPLSTVRSNLQQQRQQPKQKPDTHSDCPLLPGIEDVLVIMKTGVTEALDKVPVHFETTLRCIPNYVIFSDFEEEIAGVRIHDALRNMDPEVKRTVPDFDLYNRLQKLGRKGLGTQDFADEANSAIGKPNNPGWKLDKWKFLPMVQETLRHKNDAKWYVFMEADTYFAWPTLLEWLSNYDPQKPLYIGTETQIADVIFAHGGSGFIISRPALQLAADEYAARRVELDMFTDEHWAGDCVLGKVLLDAGVPLTYSWPILQNSNIRELDPFTAGFYRQPWCFPTVAFHHLSSQDIRNLWEFEQRRRKVRSSSALQCSKHTCEQLINGFSSPPNT

SEQ ID NO: 28664 - protein, 158 aa, A.fumigatus
NAQFPTLTSTIDCRSSAERVWERRTSPTRPTQPLGNRTTQAGNWTSGNSSPWFRRHYATRMTQSGTSSWKPIPTSPGPRCWNGCQTTTPRSRSISAPKPRSRTSSSRTADPASSSPDLPCSSQRTSTQPAESSSTCSPTSTGPATASSERSCWMPGSH

SEQ ID NO: 28665 - protein, 63 aa, A.fumigatus
DRVKGETKSAMKDERSTIVGLAFSLSSYLLAISDLSLSGRYCRIGRGSLGRRRRGRKGTRWNW

SEQ ID NO: 28666 - protein, 119 aa, A.fumigatus
LILAEYDDDTTIIPRSTSVIARRLPASRPGKGGAARYVSGKMPVSARGAPRNDATMSTRAISNTSSTVSNSVLELNNAQTEEEKINALFNLQASQWKEQQQEMAKYAYTCYMWMYWMYC

SEQ ID NO: 28667 - protein, 173 aa, A.fumigatus
LHSQTHLLDAQFNTMSSSVHFKFKSQKEPSRVTFDGTGISVFELKREIINQSRLGDGSDFELSIYNEDTGEGKLCGFVLITFLRAGVSRKKPENSEKGKPESVIVDLFLQSMMMIPQSFPVPLLLSLGGCLPLGLAKAALLVMYLGKCPLALAVRLVMMLQCRPELYQILAAQ

SEQ ID NO: 28668 - protein, 134 aa, A.fumigatus
PITPLPMDATMPPMSAPPTSCPALDNMFIRACPDALCSGGVSDSIMYLRGAPMTVMSPRAMSTSASMKRGVVDERRAMMVHPTIRIRLPEIITTLEPTLSSRTPTMGAERAMVVTKGRRLKLAMDSDSERARRA

SEQ ID NO: 28669 - protein, 133 aa, A.fumigatus
LGMNTIAAWDRPLPAEIAVAMRTSRLASRSTCTTGSGAALSTLQSMGVSAAAQMRSTTTMGLIKLPVRSVVSIWFIPTAREAHNDGKKRVPLASKSPSSVLAVTGNIKKSPDNYRGRIWDVDEEEPLPTIGEV

SEQ ID NO: 28670 - protein, 284 aa, A.fumigatus
LSGDFFMLPVTAKTEDGDFDARGTLFLPSLWASLAVGINQIDTTDLTGSLMSPIVVVLLIWAAALTPILWRVERAAPDPVVQVDLLASREVRIATAISAGNGLSQAAIVFIPSYALLALSLSESMASFSLLPFVTTMALSAPIVGVLLDRVGSRVVMISGSLILMVGCTIMALLSSTTPLFILAEVLMALGLITVIGAPLRYIMLSETPPEHRASGQALINILSSAGQLVGGALIGGIVASMGSGVMGYRFSFLFLVAVAFTLFLLSTGLKGRKEQLETMKRHI

SEQ ID NO: 28671 - protein, 484 aa, A.fumigatus
  UNSURE (445): Identity of amino acid sequences at the above locations are unknown.
FGNLGSEGAAKPKKAQDNLKTNTFCVPDDDDEVIEIVDEAPINPESTGSYVPEDPDTSSDSEHHQSAGNSTPVTSPLNKDVSVESVENKSSAPFSELQSHVARSQQSPVDLEEENNEHRLVTPRMTPPSVEDTYEGSYTGIADDMGDIDYAPDHEPAPTGYSRGDSTTGSDGWEESEEQDESDDDLMPHSSLSVDTDEFGREADAMASNNPSTSVIYESLVAVDNGARSEEEERSQPTQNDAPCSKAVTSGERVCLQTAAPNLNNWKSTARENSTESSPLKFGWSSIPRPVRVSNLVSRSSGRSLDHSLACFHNTTSSTSGDKCWPNFGHHRINPLPQRESNGNAISQNHRTPDAPYSDGPFVNSHTHTAFDESDKGNTVHSAASTNISQSSREQHPNEESVETWDDSSRVELQSKNHSVSSMAGSGVTRDSNTRHSMADIGDTXEWTATSGFKLSRKRKVPDMELDAEELVQALRATSRCNCQ

SEQ ID NO: 28672 - protein, 244 aa, A.fumigatus
LTAGTKGLLHLEVAFENGLCKIRPTWHSENMLPFTVTRYARTLIDTVRLCISNCDAAIQDCLRPTAYDLDEIWRWNHNLPPTYNFCMHEIISDQAQKFPDKEAIASWDGSLTYRQIDQYSSFVARSLIGMGVGLHDVLPVCFEKSRWTIVAVLAVMKAGATFVLMDPTLPLARLQNMAQQVGAKMMVSSRGQYNLATEIIPNANVLVVEENTFSSLSAEQNGEPLPTVVFTTGLEGSEAGAIPR

SEQ ID NO: 28673 - protein, 538 aa, A.fumigatus
NLEAACGLLQHVLGWKSLLAGITTLALLMLLNHACMARYTLAGKNLMACRDRKIIALTEALRGIRQIKFSAAEDRWEEQLNQLRDAELLAQATSFRWNVTCFSLWVLAPILLSVASLSVYTISHGELTASVAFTAISALTSIENALSTLPELITNATDALISMKRIANFLDAPERNSSTVLLSPSIRFDNATVAWPDSTQTSDVSPGTRFVLRNLTVHFPEHGLSLVCGRTGSGKSLLLSAILGECEILEGIVKRPSIRSMYKRPGPGEDWIIDSATAYVAQTPWVEAATIRQNILFGMPFNGERYKKVLFACALVRDLQMLEGGDLTEVGPNGVNLSGGQKARISLARALYSRAGIIIMDDIFSAVDVHTAQHLYEHALTGELATRRTRILVTHHVRLCLPRVDYVAYLDSGNLIFAASLTQMRHSSVLEELLRSQFDVDNTAAVYEIPEASASQDRLACFNERCQSCPADLRLAQHPIVSKRPRNFIEEESLEKGAIPLSVFRRYIQKCGGLRAWVVLALCFATYTGLALGKVSFP

SEQ ID NO: 28674 - protein, 339 aa, A.fumigatus
  UNSURE (45),(50): Identity of amino acid sequences at the above locations are unknown.
GPRRIQRRGRRSYRHERIAPRRSEPILQVRKLLVDRKWLTNQVQXESMLXCCGTYGFRPSASRIPNGGGRSCSTPGMKFILSCAGPLALDMDAVEVFLKTVIDARPGLYDSSVIDGPWRQATVKHPLRIGVVPPDYSFPLHPPVKRTLAKAVKLLKAQGHHIIELSAEECKVMEINEVAWNIFTLDSGAMEHLQAAGEPPVPALLNVQRQVEILRQAGKTYLPDFSHLDRLGRLAALNTKRADLRETWRKMWISHDLDICLAPSAQNTAVPHDMFGLAPYTTFLNCLDVSCLFCRLKISSNDAQYPSCIIPFGRVNEMDARETFELAPGQAGPSCKYFC

SEQ ID NO: 28675 - protein, 121 aa, A.fumigatus
RQTRPLSQACRIIQMDSQNSISGWQHKVAQKQQECLQKIPAEWKIPESLLSSLQLPLAENRNDLIQGDAVRKAGILTERELQITEQYTVSGLLSALADGRLTSLEVTLAFSKRAAVAQQLV

SEQ ID NO: 28676 - protein, 107 aa, A.fumigatus
VNCLTETMFPEAQERAKYLDELKVQGKSAGPLHGLPISIKDLFHVKGTHASIGMISFLDEKSTDNSPLIDILLSLGAVIYVKTNIPQTMMVRLRTSLGCMITNHFLP

SEQ ID NO: 28677 - protein, 485 aa, A.fumigatus
NFILVSLLHRHLLVMPLTILSQAQLRSLLLSLNRDEVSSLQQSLAQALLDYSTGSQEQGCAATYQPLRTAITRQNGCTTLFMPASTGRTIGMKMISLQDGGAAGCAVEGAFEIPEGTKTASRSRSAGPRRSMTSLSSEMSDLSISSQEEGSSSSSSSRSLRSDTVNRQSVGSSSSSGISKTLGAWPGAGTRDTSPQGTVTLLDADSMPFGLINAHELTPFRTALATMMIFNKRKRVRTVVVFGAGKQAYWHIRLALTLRAADIKRVVIVNRSFERAAMLLKDIYSTENSSWRGDVKFSAVSTDFGEYDRIIQDAIHKSDAIFCCTPSIEPLFPAELLTSREGRQKGRFISAIGSYRPHMAELHPDILRDEVNAHHSGRHFHKHIKRSGVVVVDSLEAALKEAGELIQAGIKPNQVVELGELLMVRDASRKDNNQDVEDTKSLREWVERGNVIYKSVGMGLMDLVTGGDLIQMARTRNLGTSVEDF

SEQ ID NO: 28678 - protein, 194 aa, A.fumigatus
KIRPSCRLLKTHLDALALNFAASLKDLKPLKSAFAVAEANGFQLFLSFDYVGAGPFDKATVITIINEFKSSSAYYTYKGKPFVSTFEGPGNAADWKDIKAETGCFFIPSWSSLGAKEALKLGTPDGLFSWAAWPWDNQDMDTYVDASYLDYLGQAGGKEYMMPVSPWFYTNLPGYEKNCLWRGNVSRRAKQTEK

SEQ ID NO: 28679 - protein, 254 aa, A.fumigatus
  UNSURE (221): Identity of amino acid sequences at the above locations are unknown.
SIEYLGDDLWRDRWEEVMVVQPDFVQIISWNDYGESHYIGPLYNIDKYEAFSVGEAPVNYAHGMPHDGWRLFLPYYIDIYKNGKASITKEGVVGWYRPNPSSECNDGGTAAITASQLQYEFRPAEVVQDKIFYSALLTSMATVTVTVGGVSIPATWQDIPDGGVGVYHGSVGYGTFYGDVKISISRARSTIAKFSSAAITTSCTDGYANWNAVVGSAKGPXISAVSPKLAIDKSGCIEGTTPSNFEGLCKFNCQ

SEQ ID NO: 28680 - protein, 295 aa, A.fumigatus
  UNSURE (12): Identity of amino acid sequences at the above locations are unknown.
WYCPNGTCVCYXNGAPRVKPKPTGMKGYPIAVEASSYIVLCSFARQYGYCPHAACAPVEVPLSEPTVSRFLPSACTAGTGQGDLAGLCSYACTCTGTGALHQPPAANSTFTAFYQGDGDDAGLCKFACQHGYCPDACASTEGEVPSCDEDDDDSPDCALEDTPDLCDLSLHFSSWEALQAATDIPELCMPMYAMQVLMDTLNTALRNYTDVNNGYDEKFGYYVKYLRGMVPEVINKVIADNGKYVQCSQAINGGWSKPRSCFIPLVSDSWTVKYTFVDEQGFYDELQSKYGIQRD

SEQ ID NO: 28681 - protein, 142 aa, A.fumigatus
LSNRSQHTLWRLDQMHIYRRQSLPSQQKLLNILHRQPFKTHMRVNRTAGIMPTSSSLAHVSPAGDAHTAPLHEHPTQQPTSALHQEPAIAPPRQPMIPARYRRTAPRARTSPASPHRSASSPQTALRPPRNPPTPAIRPTRP

SEQ ID NO: 28682 - protein, 109 aa, A.fumigatus
LRRCLPPLVKTDSSHLLQPLDISCFGPLKHAYGGLVEQKMRLGYNYINKFNFLKAYPAAHLEVFTPLNIQNGFAAAGIHPLKLERVLEKLNIHISTPTPPLSRASTNSS

SEQ ID NO: 28683 - protein, 144 aa, A.fumigatus
LTTPHTLQQLHKQASSVKKLLKQQSQSPLTPSKLAIQQLIKGCKMAIHNTALLAKENHDLRAANEKEKQKRKQSRHQMTPNEGLSIQEARDLIQARNEQGNEVEGSSIDSAPLPLEPPKRAPPRCLNYFIIGHTRVRCPTRNTS

SEQ ID NO: 28684 - protein, 66 aa, A.fumigatus
GEFRTRLLVFGFFWIGTLPRKICIFASGYVTLTTSVTPDPTIVVWDSLRIGQHYYVTIQKGMLVQQ

SEQ ID NO: 28685 - protein, 139 aa, A.fumigatus
PSSLQTHSSTPTSPAELWRSRSESILETALETCIIVSMAPAENIHIPRGSRPEPGPLYSDFFQQQVAKQRNNNYHSTSLRNMVATSVNHTALHPGGVQYVFPYLPCCLVNPLQCLCHSASVSISSSCLSSSHHTFTQTK

SEQ ID NO: 28686 - protein, 106 aa, A.fumigatus
  UNSURE (15),(47): Identity of amino acid sequences at the above locations are unknown.
TRIGWISPQARIPLXNNGTTKGRIWRKETPRPSGTHSGQGAPQTCKXYPISSTLKGRIDSGTMASDTSSRLSEHVTHNDASGLPTFTWPRTRYRLGSPNDSDPNSP

SEQ ID NO: 28687 - protein, 203 aa, A.fumigatus
  UNSURE (33): Identity of amino acid sequences at the above locations are unknown.
GTTEPPREGFGGKRPPDPVERTQGRGHHRHARXTQYLPHLKDESIPEQWPVTQAPAFPSTSRTMMPPVSPPLPGHEPVTDSGVPMTAIRIPLEDVERPPSPPAKAFLSQPGTSAELPSAAEPSSAPAPNAEPTTLRVLVAEDDPVNSKIVEKRLSKLGHAVILTGNGEECAAAFRRDSTKVDVVLMDIQVINFISSVMYSRPC

SEQ ID NO: 28688 - protein, 72 aa, A.fumigatus
  UNSURE (6),(23),(24),(26): Identity of amino acid sequences at the above locations are unknown.
IGTLHXEKLAPFKEQSEKKKGAXXCXIPNIPHLKFNHLLAEITFFSTPISLPLAWAPPPNACYGFLPAPTGA

SEQ ID NO: 28689 - protein, 175 aa, A.fumigatus
PALSIVYSGDINPVRKICYIGLANNLSSGIASRPKDEKVTWTLDKYNRTPGTLFTGLRVLADRATQIPDLPDSGVRQVVVRITSRQSTSKVTIPTKRGAESAVAAEPTPAKQQDCTEYIVIQKLRWTGEEQEWRIWGHATPTTVEDLDSPFFAPGLTLSERMDAMKDMMTGKKMM

SEQ ID NO: 28690 - protein, 102 aa, A.fumigatus
  UNSURE (98): Identity of amino acid sequences at the above locations are unknown.
FVLFSVIKGVWTVRPRYELYHIKIALLVIHVITGHISKLDCQYIQGRNTYHVLKVNYETGVVSHQKDSQSNVKRRNMYIGGYVKTMGNMIGESRTTIXMCNL

SEQ ID NO: 28691 - protein, 115 aa, A.fumigatus
  UNSURE (28),(56),(91): Identity of amino acid sequences at the above locations are unknown.
ICKKPIRHLIRHSETPDKWKHIAEIDMXVKVATGCSQHSHASAVPCCSLTPSGVCXPLLIDRPTSSDGKDERPLDPFQYDCPEQDGTLLSXENMIDSRSKLTWLAVFASSAVGPK

SEQ ID NO: 28692 - protein, 637 aa, A.fumigatus
  UNSURE (410): Identity of amino acid sequences at the above locations are unknown.
TDDNTSFVEMTEEKAVPGKLEVALFLAASKGYDTIVKLLLSTPGVRLDFKDEDGRNAVSLAAEGGHESVLQILLETGQVDVNAVDTKTGQSPLCWAVKNGHAGVVSKLLAVENIDPNIPDANGETPLYAAVKSENGGIIDQLLARADLNANTPDAAGQTPLYWAVKNGNEAVAGALLGRAEVDPNAAGADGQTPLYLAVRNGHEGIMNRLLARGETNPDIPDANGQTPLYWAVEQGNLPFVVQLLKVNADPDVKDNQGRTPLLWAAEKGHEEVVRLLIGSRRVNVNAADAVGRTPLWWAARNGHLPVVRLLVRNGADREAQPSPDDEKVAHGTPLYQAGRKYHTDIVKYLIKKGADIDCPCGESGLPLLLALVVHDRTKRGMKMLNALLEKGANVNARDTKGRTTLHILXKDGDMDLTALFLQRGAQVNAAAKDGTTPLHLAVIHEHEEIVEMLLANGGDPEAADHTGDTPLHLAVFAGHRRLVGLLLEKDCDINVTNHCGETPLHKAVERGHRKMVEFLLRNGAELEMQDDYKRTPLHRAVKAKNHVMRLLVNKGANIHATDMYGQTALHIAAEAGLRDDVDFLLGHGAEAEAKDHKGRIPLDLAVKAGEVEVEELLQEMSLVVVDASSGSEESGG

SEQ ID NO: 28693 - protein, 67 aa, A.fumigatus
HDVASKQADFPSIMSQRALVLQEIGHRLVEVDRPIPQPGPGELLIKLTSVGCRPHLLLLPCTAQTND

SEQ ID NO: 28694 - protein, 181 aa, A.fumigatus
VILLLPSFSLPLAAACQSAVRLVHFRLVLAFLFPVARQSSPRPLRRCLLHNTTSNPHFFAHTVFNFSHPRDKSLKSKNYVLILLRHPKPAAHVARLYGLLPRPTTQRTSPRSHPLPHLLILPFFFYMQKFMRDGCPNCDNVLGLRGNNDAIQECTSQVFEGLITLRDPSTSWVARWQRLEG

SEQ ID NO: 28695 - protein, 62 aa, A.fumigatus
EESTAIASMSKSSNADGGSPTSIAFSNSNRRTSFSHSASFSFASRLLGSFFTTALKSLRASR

SEQ ID NO: 28696 - protein, 104 aa, A.fumigatus
SLPAQTPRLLPIPLLFSHPWKSPSCPSTDSIAPFASVDYYALQMAASDLEAATALKVQGNKAFAEHEWPTAVEFYTQAIDKYDREPSFFSNRAQVCLGRSGRLH

SEQ ID NO: 28697 - protein, 104 aa, A.fumigatus
YSGAQAYIKLEAYGFAIADATKALELDPSYVKVGRMCIFPRHLLRKYWLTALLGILEKSSCEHRHIELPRSPQRLQGCREKGAQQPRCETKAGRVREACAAVRV

SEQ ID NO: 28698 - protein, 139 aa, A.fumigatus
AYWRRALANTAILNYREALKDFKAVVKKEPNNRDAKLKLAECEKLVRRLEFEKAIEVGEPPSAFEDLDIDAIAVDSSYDGVRLEKEMTQEFIDDMIERFKNGKKIHRKYAFQIIKAVKDIVYADLHHGGRRIRAKRIQR

SEQ ID NO: 28699 - protein, 156 aa, A.fumigatus
LAFSDRFPRVRACLFDMDGLLIDSEDKYTEITNAILQEFGKPLLPWEIKAQLQGRPQPEVSPPQHPQSVQSLRLKGLVPTLLRSVLIFYGKGKQDLPPLGSTSHQPRGIRREAGRPASQVLPPVAATTGSQNSPVQASLDPEDGPTCLHSPGDIIA

SEQ ID NO: 28700 - protein, 237 aa, A.fumigatus
YSTVKASKIFHHWAQLPISPEEYGAKQAALQAKYFPQSQPLPGVRTLLSKLLSTQKTDQPVYIALATSSHSKNFKLKTDHLQDLFSAFPESQRVLGDDPRIGKGRGKPLPDIYLLALETINEGLRQRGEPEIRPEECLVFEDAVPGVEAGRRAGMRVIWCPHPGLLGAYKGREAEVLAGLTGEHKEEEKSVPEKEAEELAAWRIKGAGNPGEIDDGWGELVSTLEDFSYEKYGIRPA

SEQ ID NO: 28701 - protein, 216 aa, A.fumigatus
ENLTKSKQKPTNCSRLAAMIRLFPAMTGPLPSCPNYLDYEVAVLRSNMAACYLKLEDWKAAVDSATTCLDRLENIIPLSQQNQDEDLPKQNSQLSKQTDAVIEISGENEEAEKEELKRLEKMDEKKNDVMRIRAKALMRRARAKSQLGGWGNLQAAEEDYKVLTGMENLPIDDKRVVQRALRELPARINHAREKETAEMMSKLKDVSRQLFRTDPG

SEQ ID NO: 28702 - protein, 77 aa, A.fumigatus
VCCLNTQRLFLRLMLPSSRSRVATGVTFKQAKGELAKLGWDPRTQTKGDKLYWLNGSTYQKLDEQSWASIESGRAKL

SEQ ID NO: 28703 - protein, 167 aa, A.fumigatus
HCIATTLGITGSRYSVRYCRLENRSEKKTDEGVDFAPTAFQNLLYQAAGDQGTLPFAGRQRSINSIVLLSNGISFAIQVVVFLVIGSFADFGTWRPNILIVLSVIAYAIGFGWLGVHTQERWHIAVGLYIVGLIAYQTTLTFWTAAFPGLARNTAEMKDRADAVCGR

SEQ ID NO: 28704 - protein, 147 aa, A.fumigatus
PCAVLSPPCGGHASDANAYPTLSQPPVPRAPTPANHVTSLPPLKVLSGEYSHPSQPNAQSPHHDLGSGKRLLWETNHTLSKRSHEETFGSDERPLHNGMRPDMDQYPSMGRKQPDYGRLPFYTDSRDEMAYKRANGRMVMKILPALP

SEQ ID NO: 28705 - protein, 187 aa, A.fumigatus
TCNRPDLPPVKPSAIAMGTIFTHTASLGILAPVFGDTYHRAQAANSKEEFIKSKEAAGAAAAWGSSLVGSAVQTYGVAALINATGTLSYKGAAYLGSLIFMASSAPSVSIPILSHQILHDMLTLHYVSSLSAKSSPKSDPSILLLLVLSAGCLRQLGLVCSLPGGVLAQILSIRSDSWLMVREIMIL

SEQ ID NO: 28706 - protein, 182 aa, A.fumigatus
AGVTDCREKNIHSRIALTLTKLILGRRGVQVTRSWRQTIGAQNALDAPLVLLKYGSEATLFSLLFNLNQLLLSCLPGLQNVVLGRRPATYCKKANSVCLVDYAKSGVISPDVALPVRVVGNVCCWDSNGVIIRLRRESTRSRKSILRVKWDSSRAIGIDGKKTAKTFPYPRRLDGVFLIIKT

SEQ ID NO: 28707 - protein, 65 aa, A.fumigatus
ILIHKIIISLTINQESLLIERICASTPPGKEQTKPNCLKHPADSTNSNSIEGSLFGEDLADKLET

SEQ ID NO: 28708 - protein, 237 aa, A.fumigatus
WSTFSLLSFDDQKYTVQSTGIWERLRRLLAIDPNRSTGVPLNSQYRLPTPGALPPQSYDDPVTVPAADIADNPYWKRDVRRNYPRLSIVNQADAVGLLTVGSRAAPKDDVLQTGQAGEQQLVEVKQQGEERGLAAIFEKDKRGIQGVLGADGLPPTPCNLNASAAKYQLGQGQGYPAVYVFLSAICYPSLHFNLGILAGRSSKYSLTAHLKLNCYLLSVLGRKSSISEKCSNVEWVR

SEQ ID NO: 28709 - protein, 63 aa, A.fumigatus
PPNLAPQASSPEQPMESSPLTQYLGAQCPPINHCLAFMTLMLERAALLLESFVPSHGTCLARK

SEQ ID NO: 28710 - protein, 360 aa, A.fumigatus
RWQECRNLPELCSVDMTIADSYARSSIFFISTYFSDYIIVPLSSKAQVIEALERRGFQFEITTEAFINHNQSQYSGYSSPVSSRSASSLGSPPATPPPSSLDELQGRTFASLRKNHIVPSVDRSLRLVQCAAHHPYSSDASSISILRTALTTALVVDRPRFLSLTLTAADPAASLLLEQRLLPRFLNDGTSSAESTDETSLLLGSKEDVLVPITLDLRKLPLEATGIVCGVASRLADATHGAWDESTEASTVALSHSFNGISSFESSLNRYFSSSVDSGGPVRPPAQNPTHRTPNGDLSTPSTHHLQPDLDTSLEAVEISFLSTARAGTILVGEHELHRAMDALEAESHEPDLPAGVLEV

SEQ ID NO: 28711 - protein, 113 aa, A.fumigatus
ESFPTHTPTSMPSTTIIRQLAISLALCNSALGQVVNGADYNKPNGGPPASFFAAASTMPVAALQAAAAKATKVPSLATYPVSQDKGAAKSTIHTDWASFRFSPRELAGSALKY

SEQ ID NO: 28712 - protein, 113 aa, A.fumigatus
FVSNSEHMVLPLWRSLHSVNLMLPKEERRAMLLRIFNDEPQLLNITQQGTPQSSTPVVETNEEDVSGMAPTEAEENALKQENLAIGEDQQEQVDTRETWTKAGDEDDRFNTTV

SEQ ID NO: 28713 - protein, 135 aa, A.fumigatus
KWNMETNTTSRIEETTPRKRIHFSITLPSSASGYSATMPLFNQFLRFTDKLVASAHFRPEVMRKIKHVREEEIKKLRRAAEEEKAEERRLAAEKIKKEERERLLRGMTAEEQRKFLERESQKGQRRSMKKYTKRA

SEQ ID NO: 28714 - protein, 267 aa, A.fumigatus
DTQGATAVPYTKWYRVWERTSPKDFIQEAMVMPLILLIVVFHLWGTRKNRRRAREWAQAHAPALQSEFAVVGFDGVHKFTGAVDSAPAELISPESTLKEKSAQEFISYATGRQNVAFVDMSIKLPNRYNPIVYWSDYALSFFFDSWQAPAETFEAIAYTFDGREKDLVPVPANDTSSLKVNNSAYDGFIWAVVHKNHMRKFRLDRYDASMTFTKDNAKLPSWVTVMTESAEITDTLLTPELIQAIEKAGDSFRYFIVTDQPVDKPLK

SEQ ID NO: 28715 - protein, 413 aa, A.fumigatus
  UNSURE (389),(401): Identity of amino acid sequences at the above locations are unknown.
MGCFLVREVSWLVRNEAAFVYLDSHISNPLFHRPELSTFSPQQVIRCRSFSFIGIGSGKLESSSQKAFYSHAIAVLQMRGCLQLARWLSAAPKGTAASLTRAPFVLANAPRYFTSSASRAGSRSTATKPLSDLEKRISAIPIERYRNFCIVAHVDHGKSTLSDRLLELTGTIEPGSNKQVLDKLDVERERGITVKAQTCSMIYNHNGEDYLLHLVDTPGHVDFRAEVSRSYASCGGALLLVDASQGIQAQTVANFYLAFAQGLELIPVINKVDLPSAEPERALEQMKNSFELDTENAVMVSAKTGLNVEKLLPTVIEKIPAYGHFPVDSHELLPLLTLSSPIGDCKKPLRMLLVDSWYDSYKGVICLVRIFDGEIRAGQQVVSFASSPXKEPRIREKSPSXAPPNPPTKEKEN

SEQ ID NO: 28716 - protein, 88 aa, A.fumigatus
SNPVTADDHVKAYIKKIMSQLNKWMLGGKISKLVVVITDKETGEHVERWQFDVWQPPEWMRAEAHQNLLSPGPDIWKACQEPNFSEIC

SEQ ID NO: 28717 - protein, 104 aa, A.fumigatus
YNLVLCNRDTENQSSTAVEKTEKEIQEEIQAIFRQITASVTFLPVLDGDCTFNVLVYADADSDVPVEWGDSDAKEIKNAEKVQLRSFSTNNHRVETLVSYRLAE

SEQ ID NO: 28718 - protein, 66 aa, A.fumigatus
LMVSTTIFMTSRLPLNNCYNGLVRGSDQFADKKTPGFSPPADDSPYVLAPIATIYLSASQARILNL

SEQ ID NO: 28719 - protein, 275 aa, A.fumigatus
STEYKMRSFLFGGLVALSSTLGAFAANYNSSAYSDSASGIDFQRWCDANTGFCFGLALPETVGTDFVGQLVVPLDSSKGWGGVSLGGSMTSTLLIAAWPNGNSVVSSLRKTTNYANPDVYSGGASLTEIPDGTSVNRTHLTYTFLCSGCILGQPATFDATDETYFLGWALSKTSPTTPASASSALTYHAAGFGSFEMLLGQAKSSKYSTWAAMAKSTGGSPSSTPSASASVTPSPSRSPVPSVTPTVSNSTYDYIVVGGGAPGIFTTRRQGRVTL

SEQ ID NO: 28720 - protein, 176 aa, A.fumigatus
TTRNGRCLATRDLGKAMIPLILDRFTIHGPNGEHACYVTATARASLSALKDGSWVRLFELDVARTLAAQLVLAVDYVHAQGFVHGDLHLGNILLKVPPSFDRLSPEQLYEEYGAPELEPVIHLDGNPLPPGVPSHGIAPIWLREASEKIMLAEARILLSDCGESSTRGWKDPRGRY

SEQ ID NO: 28721 - protein, 292 aa, A.fumigatus
FASRISCSTRSWGTPVGNTILLGVDDFFPGSEPGVPLPLGLVCGVDLGIGVEVVITTSSPSAKDTERRCADFSAGESLRKAECNCFTRSRAGVCFDGVASFSTNDARRIVDALLEKRGVPIDVVASWDNGTITCGLLGGLFVIPRPRPAFADSGFSETLGRRPIPENDGALSCLRTNGLLTGGSDSDWLGLFSLSDDPGLLASNRGSLFGCSSSKLFFLLRCRTAGNPPLDELSLLPFTTGSSVSSASASAGTLSNAATSLSFIATSPSLSKSLNCSSTSSSSSSSSDSRPC

SEQ ID NO: 28722 - protein, 552 aa, A.fumigatus
TGSVHLQLPWTIASVAGTCRSPPVEQEEIPMSPPRWGESPVHENDSQDPKGVVVAATPQHKRMESQELGESPSPERQWAPTPKTQTSPAKRGSVSKHVPATRSISQFVAEPDFPTSNRTERERIGSESPLSPRQAPSRPEREVDEEEEVETDISQQGRESDEEEEEEEVEEQFNDLDNDGDVAMNDSDVAALDKVPAEAEAEETDEPVVNGSKESSSKGGLPAVRQRKRKKSLEEEQPNKEPRLEARSPGSSDKENNPSQSLSEPPVSSPLVRRHERAPSFSGIGRRPSVSEKPESAKAGLGLGITKSPPSKPQVMVPLSQEATTSIGTPLFSSKASTIRRASLVENDATPSKQTPALDRVKQLHSALRKDSPAEKSAQRRSVSFAEGEDVVITTSTPIPKSTPQTNPKGKGTPGSEPGKKSSTPSKMVFPTGVPQERVEQLMREANQKFAKHHKDKEEVEEMIKVAKEQNKDPAFVRNLEELLAKLDRVQKLEKRNRSSERDRLERARADLRAKREEIAKMEADMGISSQDKQQKADSAKSSPRGWKFPRC

SEQ ID NO: 28723 - protein, 103 aa, A.fumigatus
RTMEHSSPLAAMQPPSVMFGHCFRSDAPTSYPTFGPRSGLGPNSFNFKELSMNKASGDYFGMNPVRGSSPTASLAADLSQNFHIDQRLADALRCLSCFLCHAL

SEQ ID NO: 28724 - protein, 68 aa, A.fumigatus
EKPTQGDFLGKGQLLLQTILPGIYYNGKMKYGQTPQTPCNSVFDSLFFFLNCVSCSNSRPHKSWETPF

SEQ ID NO: 28725 - protein, 144 aa, A.fumigatus
SWISRFSSLAMNIMNIHQSLCMAGRLPVFTSRLCSGKRLLCYTAQKSSKSDAKTGSCMIYPSNNRLSLLKFLEVQSPSEDPSKVRDNNQESKPKVTRSVAQADEELRERLEQMSGEGGASGIEYEDGKPTAMKRSVRNNMFRYI

SEQ ID NO: 28726 - protein, 74 aa, A.fumigatus
TVEFNAFYKENIIIYLYIPPYTSYLLQSLDISVFSPLKHAYRKLVKGIIVIGNNYINKEDFLHLYPPVYKKVFN

SEQ ID NO: 28727 - protein, 88 aa, A.fumigatus
WEPLVRASFVTTPQVTPTALSLSEMPMQVGTKQRVSILRQACLACDHHRCMISRKFDIIEARKHLQENGDNSKDDDGSLLSIELWVGF

SEQ ID NO: 28728 - protein, 132 aa, A.fumigatus
  UNSURE (90): Identity of amino acid sequences at the above locations are unknown.
RVRRNRHAGIPRESVAFSDQDIPGNGKSRRENTGNYRKSIRHTGLRVQQLANNVEQNKELEASEERKRKAKQLEMQRKEAARSGRSMAPXAPSYPVYTPPSRPAAPETYDTYEAEKKKSFAKYALISYVPYL

SEQ ID NO: 28729 - protein, 285 aa, A.fumigatus
  UNSURE (276): Identity of amino acid sequences at the above locations are unknown.
EAVANQARFFRRLPTRGKGMQLGKKSKTTDIYEKVRGDLGPEVDESSPLVTPQVPTPAAERVPSARASLSADREPVHITIAETISAKLTREGALKSFEVKGDLQLRITDPSFTKIKLDLLANPTHGAQFRTHPNVDKAVFTSSSAIQLKDLTKRFPANNSIGVLRWRVASSGSENADILPITFTVWVNKGSDSTTVTIEYELTGSDTLRDVVVSIPFGATEPTVSSFDAVYEVSGDSLDWNIGTVDETNASGSFEFESAGDGDEYEFFPMNVRFSXVSPSVEVNV

SEQ ID NO: 28730 - protein, 234 aa, A.fumigatus
  UNSURE (200): Identity of amino acid sequences at the above locations are unknown.
VVLAASICTRGGKAVLSRQFREIARSRIEALLASFPKLADSGTQHTTVEQDNVRFVYQPLDELYIVLITNRQSNILQDIDSLHLFAQVTTSICKSLDEREIVRNAFELLSAFDEIVTLGYRENLSLSQIKTFLEMESHEERIQEIIERVYDTLAFGYNSLLIMLNRTKSLKPARSAKERRSSWRCSERRQLAVAGLWHPXPHPILYTLLHHVLLLPKHTILMRRRRRSHLRSMP

SEQ ID NO: 28731 - protein, 65 aa, A.fumigatus
HTPDTYAMATASSLAFTNMEVPGLDDTMEMASPYQGHVDDFDIDLDVMEDQACLHLRGWTDPRLS

SEQ ID NO: 28732 - protein, 133 aa, A.fumigatus
SHHPWRQASAMPIIVVAVSARSVLLFSFTFLASRSLLPSYDSISYINITMSTEMEVDVPQEEVPQGQSGGGGSDPRTQAGAVAVRSIEGWIIIATNIHEEASDEYVTDLFAEYGEINNFSLNLDRRTGYVKVS

SEQ ID NO: 28733 - protein, 73 aa, A.fumigatus
  UNSURE (34): Identity of amino acid sequences at the above locations are unknown.
PWSTPPSPPTTQSHSPTPASAPPGYPTSRTSTAXVYPTPHTETPRGVVLHPSRSWSPTSPEACRDSRRRTPGR

SEQ ID NO: 28734 - protein, 176 aa, A.fumigatus
PPVTVLWSSAHAKTWQIVILCIVFFGFVWAGFLFVLSHLSKKHSWILPVFACGLGAPRWAQIWWGVSGIGYYMPWVAGGLTGGALASRSIWLWLGVLDAIQGLGFGMILLQTLIRMHMCFTLIVCQVLGSIATICARAFAPNNVGPGPISPDPTYGASAVANAWFWIALIFQLLIW

SEQ ID NO: 28735 - protein, 176 aa, A.fumigatus
  UNSURE (11),(17): Identity of amino acid sequences at the above locations are unknown.
VGLLMFFGLPXYYRQSXGKVPSFYRSVFRRKIVIWNFAVVIIQNFFLSAPYGRNWNCKSPSSVHVNEDPNPLLQSSGVRPTQKHGRSSFSALSSSVSSGPASSSSSATSPRNTAGSCPCSPAVSVPPAGPRSGGVSRASGTTCPGSPAGSRVAPWRLAASGCGWAFSTQSRAWVSV

SEQ ID NO: 28736 - protein, 198 aa, A.fumigatus
  UNSURE (165): Identity of amino acid sequences at the above locations are unknown.
RPSWRNINTQCKLLQIVNIQLFHWAYITQSSTQHTMASDNDDTIYLYNPSLGASILFTILYILPLIYQSYMTLVYPRKAHTPRANYFIPMVIGAALEVAGYAVRCASVRKPADIALYAVSSTIIVIAPVFVCASLYMLLGKLETSSDSGAKQPPAAFLCGGSGKXLPWMFVTLDILAVLTQGSGSGIASSEDWEGSTK

SEQ ID NO: 28737 - protein, 456 aa, A.fumigatus
YPILFSIALFIPGGIPDIAHLLTMIIPATFKPSLTRIRSKRRSKGIKNGDTHSICPACLYHLSIIQGRTTIPSTLLLHHVQLDTPSESNCLINGETLKECPVWETSPLPCLPILLSPTRFGTFGGRFAPESHMDALQELTLAFDRFSSDYSFWKEFVTFPGIRPSPLRFAENLTRIAGGANIWLKREDLNQHGSHNIRSIVGQALLARRLGKAEVVMECGSARHGIVCAATCARLSMECTILMGSRDATDQKDSVDMIRKLGATVLTADMGASSGRGTLRAAVNEALRYSVAHLSTAYHIMSGPIGPHPLPTITRTFQSILGEEIKTQFGGASGDRLPDALVSPVGPGSAAVGMFYPFIEHPSVKLLGVEAADAAPLSHDEIGVLHGCRTYLLQDEHGQILDSSSISPDLDFPSVGPELAHWKETARVEYVTATDTEALRGLDILRSQEGIVPGAM

SEQ ID NO: 28738 - protein, 527 aa, A.fumigatus
  UNSURE (518): Identity of amino acid sequences at the above locations are unknown.
QSADVAFKLHLRASSNPEVRVDLLVELPTTYPKTYPNLSLGNSENISHRARLKIQDIIRNKPKELLGSEMIYELAVSIQDVLEDVAQAQAQDKDLPSLEEERMVQEAAANQRAELERQEELRKQEAATAEEERALQQLLEDKLRERTKARLSRRKSRSSGTGLSGSIDAVDQFPDAITFDPPLIINDTNEQPLAFSAVFGKTLLQSSPGKQTFTVRPVVSGSRSHAPLIVLKELSLDGNGTAPICYRERMRASEDKLEALKRLRHPNLVDFIGFKISRPLDSIDAQDSTWRVYLLLEYANKGSLSEFLDIVGSVSVEIIRAWMIQLLEALEFYHRSGFVHGDIHCGRILLFRNPQGGTIVKLQGSIEDALPDTENSKRSLTISKSPFWMPPELTQESTPPTMKIDVWDMGIVFLQMAFGKDVLQRYTSANALMGTLGLSAPLQDLLHEFFRPDPKKRPTAFQLQPFEFFRVDTPLIARTSTSNSVSLPRRPRLDSTGGLPAFSRYNQDFDEAGRVGKXCPQAEVPYG

SEQ ID NO: 28739 - protein, 92 aa, A.fumigatus
IWVQTLNTAHRPGMPHKQKKNPSNVHKNGSPRAERKQSTSNTIPLAQPGLATTNYREIHQNEAEALRSIYGDDFEEIEHRPSAWQVRAVFSD

SEQ ID NO: 28740 - protein, 569 aa, A.fumigatus
TEEEKIAPGTEEGRKREGASPAEEGEGEGKEGAARKGGKLLTRPRKEAKERMKFGLKQMLAAGVGKVAGLEEPGIEKKKPVYDNRKRKGLKKQEEDLEAAAARARAQREAEEERRRKEEEEKKAKAEAEAAAAAAAAGDEESEVDDWEKAAEAEEEVKDSWDAPSEDEGEKPATNGVAKPAAAPQQKAEVHESESEDDSEDDSESESEDEEKSAAQKAIAQRKAEAAERRKKQHEEALAARSKDNLRSPICCILGHVDTGKTKLLDKIRQTNVQEGEAGGITQQIGATYFPVDALRQKTAVVNKDGKFEFKIPGLLVIDTPGHESFSNLRSRGSSLCNIAILVVDIMHGLEPQTLESMRLLRERKTPFIVALNKIDRLYGWKKIDNNGFQDSLAMQSKGVQNEFRTRLEHTKLLFAEQGFNAELYYENKSMARNVSLVPTSAHTGEGIPDMLKLLTTLTQERMTNSLMYLSEVECTVLEVKVIEGLGTTIDVVLSNGILREGDRIVLCGLNGPIATNIRALLTPAPLKELRLKSQYVHNKEVKAALGVKIAANDLEHAIAGFAVDGCWD

SEQ ID NO: 28741 - protein, 144 aa, A.fumigatus
RTAGMLLLRTRERNQPQTAWPSPQLRPNRRPRCTSPNPRMTQRTIRNPSQKMRRSLPRRRLSLKERPKLPSGGRNSMRKHWPLVRRTICVLLFAVSLATSIRVKPSYWTRFDRPTCKRAKLVVSPSRLVLHTSPWTLCARRPLW

SEQ ID NO: 28742 - protein, 123 aa, A.fumigatus
RICLRQNQITRIDFPSEIAPTLLELDLYDNLISHVKGLDEFRDLTSLDLSFNKIKHIKNISHLVNLTDLYFVQNRISKIEGLEGLTKLRNLELGANRIRVGVFQADLKKDWAECSRKSRILTL

SEQ ID NO: 28743 - protein, 495 aa, A.fumigatus
GIADPASLRGEDREGKGQLLSLDGLVDVVTRERPAEAGDGASKHTLHGLLGDRDGVLGLLDSHGSGTRDITNNDGRAHATRSVTLHPGVGGEDVTGETLTEVLHHVVTLRFTVDEDIEVKLFLDFDNLGNLLLDELLVLLSGDLTLGELVTLDTDLLGLREGTDGGGGEERKVDGLALLGKTDWEGRLAVVHLLGDSSLALLDLGVVGASRRGTSLNGLGVGLELVADSSRALGDGLGDYNNLVRLLDSEAEPLPDLGIEVLLALKGVGDMEKRAGGRDNNSVLAKLLDSVLNLLDGSLEVGLPDVATINNTSREDLHGAKSGNNSIELLRVADKVHVDTMKVVQSRENINVVDNVTEVGGKDNARSLVTESTNLLIDRLEGSLGLGREIENENRLVNLNVLDAGSLQLSKEVNVDGNQVVDLVNRVNFLTTVGLGEGQEGDGTQDDGTSNDASLLGLEELSNGLGVRSELEDLVLLEGRLDVVVVRVEPLDHFL

SEQ ID NO: 28744 - protein, 556 aa, A.fumigatus
VVPERYSKYNLDPLDEYFAMGRGLQKPASEGQPAIDVPSLVWCSVPSTKRAQKVPILIRYLQEMVKWFDSNYHYVKPTLQENQVFKLASNPKPVAQFLEAKEAGIITRPVILGPVSFLTLAKADRGQKIDPIDKINDLVPVYVDLLAQLKAAGVEDVQIDEPVLVFDLPAKSKAAFKPVYEKIGALGDKAPRIVLATYFGDIVHNIDVLPALHNLHGIHVDLVRNPEQLDAVIAALGPMQVLSAGVVDGRNIWKTNFKAAIEKVEHAIQKLGKDRVIVSTSSSLLHVPHTLESEKNLDPEVREWFSFAVEKTHEVVVIAKAVTEGPAAVRDQLEANAKSVQARASSARTNDPKVKERQAAVTEEMHNRKSPFPVRLAEQSKSINLPLFPTTTIGSFPQTKEIRIQRNKFTKGEITAEEYEKFIEQEIAEVVKIQEELDLDVLVHGEPERNDMVQYFGERLTGYVFTTHAWVQSYGSRCVRPPIIVGDISRPAPMTVKESKNAVSISKKPMKGMLTGPITCLRWSFPRDDVHQSVQAQQLALALPVFTTEAGRIRDA

SEQ ID NO: 28745 - protein, 176 aa, A.fumigatus
SPRPSPRALLLSATSSRPTPSPFRLVPRLLAPTTPRSRSARLLSPRRCTTASLPSQSVLPSRASPSTFLSSPPPPSVPSLRPRRSVSSVTSSPRVRSPLRSTRSSSSRRLPRLSKSRKSLTSMSSSTVNLSVTTWCSTSVSVSPVTSSPPTPGCRVTDLVACALPSLLVISRVPLP

SEQ ID NO: 28746 - protein, 84 aa, A.fumigatus
HGLCSAVLGFPRMGKLRDLKKATEAYWGGKISRDELLSEGKRLRAEHWKIQKDAGVDIIPSNDFAFYDQVLDHIQLFGVSCPDC

SEQ ID NO: 28747 - protein, 117 aa, A.fumigatus
YQRCSRRCSNGPYTQGEGLLGLLVLLCPYSELFAPGSCELLQFDPVQLLPYFFLDLLDLLFWIDGLLVCEFQYQSSTQEMRILERVHGIFRFASAYEVSKTETTSRPVKLLRNPHRA

SEQ ID NO: 28748 - protein, 146 aa, A.fumigatus
EAMDAAEERRREDTAKKIAARRTKIIIKNLPFQATKKDVRSLFGAYGQLRSVRVPKKFDRSARGFGFADFVSAREAENAMDALKNTHLLGRRLVLEFANEEAVDPEQEIEQIEKKVGEQLDRVKLQKLTGTGRKKFTVGAQEDEEA

SEQ ID NO: 28749 - protein, 190 aa, A.fumigatus
SLLGDCCVLSQAVSISRASSHPSLWNLSFFPKSPLCWCPPPMATDWQPECIAPQHQSGLENIGHHTDRALQNTSGNVQSYSDAILHGGMSGRDDHLQHLAYKYSHAPVHPQPMQTATTLHPHHILNARVQAKKLRRVQSLGPNHAGARRGRSYLKSQKYLEYRARPRRDTGKDGEPVWSDELEDAFQQGN

SEQ ID NO: 28750 - protein, 189 aa, A.fumigatus
ITLSAGPFAHVVKPVDIIDRGLVSLTVASEAFNRFVTHMAPQMPFVVFPAGTTMSDVRKSKPALLHAIIAVSIGAIQPDAQLALLEDFYKTVADRIVVRGEKSFDLVQALLVSCNWYTPPDHFEKLKFYQLTHMAVTLAMDLGMNRKLLVRNKPLPMFKDMVMKKPPSMNLDSPETRRTWLGCYFMAVQ

SEQ ID NO: 28751 - protein, 153 aa, A.fumigatus
  UNSURE (90): Identity of amino acid sequences at the above locations are unknown.
HLKQGQTPLHLLSEVANSRSATAHPSSHHQPSYASQSSAEPITQTPSSDLTAQTVPSSTATDSDPWTQYPSVSLSSATTQAQQQAQSRQXYSPFNSNYQDMSSYPDGGIMMMSPMNQGFFVPELGIQVGFDSGNMFALEHLLTDGLLNLSLPR

SEQ ID NO: 28752 - protein, 125 aa, A.fumigatus
YEFHNNDNLQIDNHLNEAQTPTRRGKPHTKSCANLTDNKVTSRRCSKVPDVSDRCQLVCTEYCYIRPVPMPCNRKQHMYAVLAFMTTGVLNCWQGERVMTANSEVHPGVDVDPYSGQSNGMLADG

SEQ ID NO: 28753 - protein, 165 aa, A.fumigatus
IHADLQPLVKTRGSVENIWPNKIEYSISTPTKAVIFGTSIRVDFKLIPLLKGLKIGQIVSQLIESHDLTLNPEDPDSVRNTYKNTRTIVNDEHELDEEGNLEIIDEAAEGYQFSRFLDLPKTLTRCLQDTDTRGIKIRHKLKFRVQLLNPDGHISEVCTPPLRNV

SEQ ID NO: 28754 - protein, 287 aa, A.fumigatus
HSQLRATLPVSIFISPNLAIDDNNNLVDQTPQSAQRAVNDLAQQAPPLYGEHQFDQLYSEVDPSGYRTPGPGSGPGTPFGTLSRNLSAENLASMNALTNTDISASALHSRLSNLHASRFSNPSPSDADGHTDVEYRRLGVSTDSFGPSCGSNSQSPASPELSRRPSDEGYHDHDYIPSGMATPFHPQFAEVESLSRVPSYSTAVRSSVGPCDSELPDYQAVVAEDTAMPTLQSPQQAHIRSVGRGVSTGHTGIDVHHLRSGFFNSRTSAHHDDDDRILRLVQARAQV

SEQ ID NO: 28755 - protein, 69 aa, A.fumigatus
SNTNAHIARGIGSQTPQSSIDALVQPESGKAQTLIAYSTATICIQFGNYLSHLSHRPYQLFLQLISKTR

SEQ ID NO: 28756 - protein, 80 aa, A.fumigatus
ESPRFRNDGTNGLGYLIPYEKMHVWFRWIFYLNPGAYAFEAFMANEFVGKSLQCVQPDYIPYGSGYSGSESPNRGVLKSR

SEQ ID NO: 28757 - protein, 503 aa, A.fumigatus
LVSYWSSVGPDQGVPRFCACFPTTANPSTKSSAKPDTAVWTHVVARRFRQQIMFNNEDDVHFPTLTVNRTMKFALRNKVPRERPDGQGSKEFVQEQRDNILSALGIRHTTKTLVGNEFIRGVSGGERKRVSLAEVIAGQSPIQVWDNPTRGLDSKTAVEFARLLRREADMNQKTMVATMYQAGNGIYNEFDQVLVLADGRVTYYGPRQLAKSYFEDMGFVCPKGANVADFLTSVTVLTERIVRPGMEDKVPSTAEEFEARYRQSDIHQKAMEGFDPPEKLTHEVDELTAAVASEKRKRHLPRSPSVYTTSLWEQIQACTIRQFQIMAGDRLSLVIKVVSAILQALVCGSLFYNLKDDSSSIFLRPGALFFPVLYFLLESMSETTASFMGRPILSRQKRFGFYRPTAFCIANAITDIPVVLVQVSCFCIILYFMAALQMDAGRFFTYWIIVIANTLCFMQMFRAVGALCKRFGNASKITGLLSTIFFVYGGKNRLAFVMTALTA

SEQ ID NO: 28758 - protein, 176 aa, A.fumigatus
RRLWPARNASGICLAAQVCTLRVCGSRYRRAPSASSRSWLGIDCLSSLRWYQLSCRPWYAEVYSTTSKTTARPSSCAPAPSSSQFSTSFSSPCPKRRPRSWAGPFSRARSGSDSTGQRHSASPTPSPISPWCWCRSLASASSYTSWRRYRWTPVDSSPIGSSSSPTLSVSCRCSAR

SEQ ID NO: 28759 - protein, 255 aa, A.fumigatus
RLHNSRHSSLHHQTNIYKLRDAMAIEQHTSGWDNFVAKHGNVEFVWLQFMSYRSLVYTRMFPIQRFKAMVQKGKFITIPEVALLLGPGDVIAEGCFASGKFWLRPDFETVYCQPGSNGTRAVIMCDFVDDDGTHSLQCARSRLRYLEETLLSELKCSALVGFEIEVMFMQAEKINGAVRFSMANYEHSWSSMTADDESMLEMLETIARTLAMADVPLEQFHAEAAPGQWEFVLPPARPIQAADIFTTGLEGAALA

SEQ ID NO: 28760 - protein, 74 aa, A.fumigatus
PQCANRKRIQELSPRSSTNEFRKFIRKLLKDLGLTKKPLIGRFFIHYVPCRQRNSSDMERMDKKSRHAGMKDMR

SEQ ID NO: 28761 - protein, 382 aa, A.fumigatus
SLWVTLHLNEQTDAKSLLGMYSTSPATGSFDWQPGVLTKAAREGRWILIEDIDRAPSEVIGLILPIIEKGELTIASRKERIKCAEGFKIIATMKSTYNIAGEEIAPNANLLGSRLWQRVQIDSLSIEEIREVIIRKFPLLEPRVPVIMDVYQRVCSSFHGSLAIKSSQGRTPGLRDLIKLCTRLHMRLQRLGVKTGYEATPEVVEDEIFLDVVDVFLRYIPEKALADSLALVVAEALQISPQRAQFCLHERTPAYSDHGNSVTLGREICRKNKVPSGSASKLAAASSRFASTRAALKLMEQVAAAVQMAEPVLLVGETGIGKTTVVQQLANLMRQKLTVVNLSQQSESTDLLGGFKPVNIRTMAVPMLDEFNTLFELTLRHG

SEQ ID NO: 28762 - protein, 203 aa, A.fumigatus
EACAGCYTCRLRRKKCDESHPACKNCTNLCVRCEYKRPDWWASAEQRRVQKERIKARIRQTKVLEKQNNLQGGCAPVSLSVHRLCLNLLTPDFIDRHLPPRVTVGYDFSQPVLVDPYQAYDSYTSQFSASNLMSTANANDRPEAAFATENKNILNGVPTPGFYGMPQPHEALFNSPGYEWPQILASITPPHYVQPQCSAPKLT

SEQ ID NO: 28763 - protein, 77 aa, A.fumigatus
PTYPAFPASNNLSSKHLICIVIAIIRVPTRLPCAPCFTGTFAVAESVLDKPFSSDPSIDGMPLYLHNWSNYFPRSKM

SEQ ID NO: 28764 - protein, 85 aa, A.fumigatus
LGEYQAGMCFVDLVPDAFNSAYAFSPLSHRLTLNLRQLCQGTGFMTDCLRGEWKRLSSPIYRQQQISWDKWTCMLLSRMDLCRRR

SEQ ID NO: 28765 - protein, 61 aa, A.fumigatus
EKRDVLVRMRVYKGSGILLFQYPFQEIQYLTSVKNLPLLSSISRHQYVDQRHPHCDSPSVF

SEQ ID NO: 28766 - protein, 87 aa, A.fumigatus
RREAHGYGTSISNAGYTQPAINALEPQFAELADSMADLEANFMHLQLMHESLTRFSESFASFLYGLNMNAFCVDFPEVCSIISLLLN

SEQ ID NO: 28767 - protein, 63 aa, A.fumigatus
LYILKLSLPEFQDFFDSSNTLSIFLIFLYNIRGTASSRAVTFGIMASITSASVFTSRAGKTSA

SEQ ID NO: 28768 - protein, 137 aa, A.fumigatus
WLDAGEVAAKLNELGIPPTAYGTRWYLTLFNYSIPFPAQLRVWDVFMLLGDAEEPPGKGTNQSEPPVTSAFGRGLDVLHATSAALIDGMREIILESDFENAMKVLTIWVPIQDVELFMRVAKAEWKVHRRKKGGMKA

SEQ ID NO: 28769 - protein, 247 aa, A.fumigatus
RLKQRRIRRLQEEEKTRQESLRLEQRKIEQSMLRDSLQSGVPPQMIPLIFAGITGGSLPQSAIELIQQYASQNPGTHSNAPPPPSRPSAPLHQQQQSTLDILPPPPTLSQRHPSLAIPADIRRDSRGHPSTTYATLPPHQQPIPGPALSQPLTTHGRSPTIQSLGRPPLPSGAGKATASSLSRINGDTPSQHVPLTLSDSKYATGSSLPPSQPVGVKQEQTPRHSPPSLYFSPMGSTGPAPPSKEPT

SEQ ID NO: 28770 - protein, 104 aa, A.fumigatus
SGRTSSRETGRFWYNLARRDIKGSRYEWGPQGPRYQGAVEGSCTYFPDLDGDGRADMHSIWDSINNTAQTWYNQCAIKDHTGDDGPITDPNLPVSPASIDVVPH

SEQ ID NO: 28771 - protein, 436 aa, A.fumigatus
CKRNKQAYQRSINQSINSDELLSRGSEILNLLIRSFPSISSTKMPPTLCFNCKEARAVIIRPKNRHKLCRACFLEVFETEVHETITSSSLFYPGERVAIGASGGKDSTVLASVLKTLNERYNYGLELCLLSIDEGIKGYRDDSLETVKRNAVQYDMPLEIVGYSELYGWTMDQVVEQVGKKGNCTYCGVFRRQALDRGAARLGIKHVVTGHNADDVAETVMMNLLRGDLPRLSRGTSIVTDSAASDIKRSKPLKYAYEKEIVLYAHHKKLDYFSTECIYSPEAFRGSARTLIKDLEKIRPSSILDIVKSGEDMAALVPFEVSSSGKKCGGTNVATATAEDDESAGGCGNQNGRSSGGEITEMEKKLAEDDAAQLRETEIKLPVAPRRKSGKVNNPRAIKNPPMGQLRALRIHLKPEDLQSVYAPGRVEQEPAQERD

SEQ ID NO: 28772 - protein, 71 aa, A.fumigatus
  UNSURE (51): Identity of amino acid sequences at the above locations are unknown.
ITRERSRIHQWGNCERCGYISSQKICKACMLLDGLNKNRPKNAIEVAVGIXEEESSSTLMRQMERVQLNTG

SEQ ID NO: 28773 - protein, 396 aa, A.fumigatus
RQIIFVIDRSGSMMDKIDTLKSALRVFLKSLPVGVCFNICSFGSRHSFLWKQSLFYTAESLQEALSFVDGVRANMGGTEMQEAVEATVRSRMKDKELEVLILTDGQIWNQQTLFGFIRETAADNGARFFSLGIGNGASHSLVEGIARAGNGFSQMVVNYEELDRKVVRMLKGALTPHIFDYKLEIEHDDPVEEFEVVLPERPRAMPVDEAEMKQQPISLFDADYKEDEQKTDEEALPVLTPPQTLQAPYKIPPLYPFIRTTAYLLGSANMQNPKALIFRATSKQGPLVLRIPINDIGTGETIHQLAVRRAMIELEEGHGWLAAATSNGNSFDNLHPTSKERIIARECEKLGTQFQVTGKRCSFIALEKDSTSDQEKETDIGLLHGGGRISGSGYTI

SEQ ID NO: 28774 - protein, 424 aa, A.fumigatus
TTPAIDSLSTMELFRLLLSHPVSSAVALGAVYLLWVVLDRLYLSPIAGFPGPKLAALTHLYEFYWDTICCGQFTFQIGRLHEKYGKRNPLTCRLRSECTPSSSIDHFLAFILVRYDISTVHLYSCHTGPIVRISPTELHINDPDYYEVLYSRDSPRNKYEYYQKTLNAPLALLNTIDHHLHRQLRAQLNPFFSSTRIRRQEPAIKALVNKLCRRLDELKNTGQPLNIEHALTCYTTDVITDYSMGDGYHYLDAPDFIPQWHGTLNGTAKTMVFIRPVAWALPLLLALPEAVTAWLNPGMELFFDFQRRCRKMIKRIVAAHNEKGNQGVQNEGFVNIFDDILRSNLPAKNKSETRLAQEMQVLVSAGAETTAKAITYILFYLLNDPETMAKLKAELETVGEDPALVQLEQLPYLVSHLATWPRPG

SEQ ID NO: 28775 - protein, 157 aa, A.fumigatus
DLLRVYMRCTLVTHVMFIRHSDTLKSAAKMVAAPMMEFYNKNQTEGIPGKLTDTWYVAGAMFMILIQYWYASSDDTYNTVVSHDLMFQSGENYDFFSKNYSHWLVGRQICPHILSMLTSFRVMTIRCSGDLPPSLLQRLGSQRSQTNPPGPPWRGQS

SEQ ID NO: 28776 - protein, 64 aa, A.fumigatus
YLVLVTAILKYKPVTALINETNAMIGSTRLLDLPRYQTARLTVTLQDEKKVDQPLCLPQKENKC

SEQ ID NO: 28777 - protein, 420 aa, A.fumigatus
GRRRSASLTPPSSSGWMPPALKGRRYSSLPLRADGLHAETQKSFLDSYVDEPEEAIVNSRLKSDHRIYLDEQTDDGPQHHDEIKNLVLNFLRAIRRQHTMKLTVFRNFATDIVGRMFVGDLGDDRAAPIGTRSNHIDRCRFTTSLDHIMFKSPVAKLKRKRNKGLRWISCAGTYSRWNDASIVDVLPETGRKTILQAETREYDGPYDSLIVNGADCMAAAFVSMFRHLFKCPTAMFQLQDEVDNAFRNLTISDVLHQETELHALPFLDAVMKESMRLAMKFDYRRAVPAGGLAVLGHYVPERTVAQFHSEALRNNRTTFGEDVSDFRPQRWLQADLDQWQRTRMEEALLFLRPNIPNSAEARAAWLELKRAAALIIWKFDVSTVGSPAEVKLIYFSCILSTMRKCSSKMLSLQSKNTRSW

SEQ ID NO: 28778 - protein, 828 aa, A.fumigatus
  UNSURE (12),(66): Identity of amino acid sequences at the above locations are unknown.
LGTWLPQGGLPXYGKGRPVDSQKSVSFLNRYTFSWAYRTLSIAAQNQRLNIDDLPVTGDEVRAQTXSSSFYAVSAASAQWRRWLKLYRAEITYQVILQLVANAVNFLPQFLLLTIFRIIEDRDAGASNQLQVWLAAIGLGLSMVVTSWSISLRDFVADMKLSLPINEQLLAVISKKAMSLKDVVISADDSENEDAASDKDDDDADDDAPPRTKHSVLNLLGVDVERVSEFVAYSHLLLDCVLELSIAIVFLVYLMGWKPIAAGCAIPVLLIPFYYHLTNRYSEQEQALMDRRDDKSSNLTVMMRGIRQIKFSALETQWYDKILGLREKELRNQYTVFQLDVFLTAIWTLGPLCISCLSFATHIYLNGSIAVSVAFTALSLFENLQSVLSMFPEMFTELLDARVSLRRIEGFLDLEEHEDKRVRGDAMSFRDATIAWPSAGSEDATGQFQLTGLNLDLPPRELTVISGRSGVGKSLLLQALIGEADIVKGTAIVPHSSATNRPAGEENWIVDGLVAYVSQDPWIENATIRDAILFGLPFNPERYDKVIHACALSHDLQSFPDGDRTDIGANGINLSGGQKWRLALARALYSRASILVLDDIFSAVDSNVGRHLYDHALTGSLAKERTRVLATHHVRLCLGGAAYLVRLENGRVVQAGHPSSLLQDETPDQRLDDSTSDPSDSTPTTLKPVQRTNATPRSDGQPKKYYEEEKRERGVVRAEVYKAYMKASGGYSRWILVAVLCILTLILNLAAPYWVSIWTRAYNESPPRSILTQSGDHPDFRTGGLHLDHRLVYYSSIYFALAFASWILDIIRIQHDPRVYKQREGMRR

SEQ ID NO: 28779 - protein, 94 aa, A.fumigatus
PAPPITLSAGPGSRVSEHEPRYDRIMQDYDNIKRGHVEDSVNEDKSTAAKILQDIYAQVLNLPSNKVDPKRSFVSLGKWIIVRLMKKRGKEADW

SEQ ID NO: 28780 - protein, 225 aa, A.fumigatus
SDTLILGSDFVDTTKRVKDLRRKIKDNGRSYFARSLLQANNTEPSDFPVPLEIVFNYLGRLQQLERDDSLFKHYGEAFDEEKFRLAGDMGSDTPRFALLEISALVVNDKLQVSFTYNRQMQRESQIFQWISECRRVLEIDVLRFKDTVPEPTLSDFPLLPITYDGLKKLTSTTLPRAGVKTFSQVEDIYPCSSVQEGILLSQLRDPSAYMFHVCRLHAEAGRTRA

SEQ ID NO: 28781 - protein, 144 aa, A.fumigatus
LVNTGGDSITGMAVISRARKQGLNLTLHKILQSKSIVELIQAAEVETSSIQVEEKANKYFSLSPIQNLYFKSARTFKETGRFNQGMTVRVTRKVEPNVVKDALKAVASQHSMLRARFSRSANGKWQQRITNVRANQLTDVVLRS

SEQ ID NO: 28782 - protein, 235 aa, A.fumigatus
PITQDIESSVRVGIHSVMSSHEMLGKIANTQSSLDIENGPIIAADLFTVNGEQVLFLVANHLCVDMVSWRIILQDIQEVIEAGSLSSEKPFSFQSWCELQLENSRSEADKAKLPFAIEPPNLSYWGMESVPNHYGQIRMESFVVGEDTTSFILGDCHEMLRTETIDILLAAVAQSFRRVFTDRRMPTIYNEGHGRESWDSNLDLSRTVGWFTTLCPLQVDECSGKYLLENSRATR

SEQ ID NO: 28783 - protein, 274 aa, A.fumigatus
GVTANQVAGKYQAIFFYQLYRLEVDAHGFANSRMAPGCAQAGVVCDMEAFIREVCRVKKEPERDENGKIIKPPKGQKPKLVDVPDFDKVDWAHIGEGADLKVFSTEFDKSGFKGDFLNDKIFKGWEQPDTFKTVMSEAEDIGTKAIAKLHADGKTPADDRINKMIAALRAHADARRYDQAQKITKAFAEFMEKKGFTVAYTDPIERPPVPGYRKIDADKTISDNQGKQGFDKVEQEVKDYVSKFNTAGQSLSHVEAITKTQGMHDHLAEACKAA

SEQ ID NO: 28784 - protein, 187 aa, A.fumigatus
IRLQWLQKVFIPATTSRTTGRYQLLILDGHGSHLTPQFDQICTENDIIPICMPAYSSHLLQPLDISYFSPLKRAYSRLIEDKIQLSFNYIDKFDFLEAYPQAHTAIFSADNIKSGFSATGLIPLNPDQVLSQLNIQLRTPTPPGSRSTNSIPKTPYNLKQLKKQGNYTLRSYLGSVHTALLPLQRLC

SEQ ID NO: 28785 - protein, 147 aa, A.fumigatus
FYPKNTLQSQAAEEAGKLHFKKLLRERTYSPPTPTKAVLGQIIKGCEMAMNNAALLAKENYDLRAAHEKHLQKQKRSRRQIETAVGLSIQEGQEIIQRRDQAAEAIPTIPPEQVVDTEQRPQRAPPRCSDCHILGHRRLQCPQRKNN

SEQ ID NO: 28786 - protein, 445 aa, A.fumigatus
SARLRDPLAYRLRYLLPQLSHSEAGIRHAAIALGALHQHLHRVLSKGKCDPAASKITPQNEYFIIQQYNSAIRHLVAQLSSTTSHHVPHLTLISCCLFVSLEILSGHVGKALDHIEAGLKILQRWEHRTDGKLPSEAITRELAYFLLRWNTQLSTQGRKMIPLNLSQLDTAESGGNQESWSEISEAREALVLLSNRTMSFVEAVGTDRKTRGSPGQVRQQQALLQALAAWLRAFECLMKRCSRRLKKTDPRGPVLLRIQHRTNQILASVALSRDELIYDQLDEDFRAIVSYAEDLIELNASLDKDSVLSVFSLESGLVSSLGYTARKCRNPVLRRKAIRLLYRCPRKEGLWGVQQYAVIARIIVQAEEAAVAHLPLAQRIPEDRHRVYTVHIQNRNCSSCRLVLMYLPENGDGEWHCRVREVEFAAEVHAHDPNFFAESGINLEA

SEQ ID NO: 28787 - protein, 188 aa, A.fumigatus
RRGVFHFSGGLGLPSSRVGLATAIIGVIGLPLQIFVYPHVQSRLGTLSSFRTFLPFSPVAYTLMPFLVIIPRYPWLVWSAFTAVVGLQVISRTFALPAAIILVNNCVTDPSILGTVHGVAQSIASAARTLGPFIGGWGLGLGLKNNLVGGIWWALALEALVGWLLLWTIHEGKGIERRKDARRGTQES

SEQ ID NO: 28788 - protein, 62 aa, A.fumigatus
PPTTDEGAQCTRCTRYTLSDTMHRPKDRRISDTIIHKNDSSRKSKRPRNNLKSNHSREGRPD

SEQ ID NO: 28789 - protein, 101 aa, A.fumigatus
AAIVLLPYCPAGHMTLMHFLVLVCYFETLFFFLDNKAMEAYSFCALPLELIVMVADYLGPLDLLNLIQGLPHIAPLLNSWHIQAHDENGHTILHHIVEQRA

SEQ ID NO: 28790 - protein, 307 aa, A.fumigatus
YLIKPLAKWIPASSIADNEGWTPLFQAVRNSDESMTKALVYAGADVSAKDHTGKTALHLACYEDAVGIVQILLDHGANPSAADCNGRTPLHDAFGRNTVILQKLIKAGADLNPRRMPRGLAPLYLEAWLGREDAVRILLEAGADPSIQTETGETILQKAIEGSHTKVVQLLLDAGVDINVREFHHGVNAILTAAYWGADDCIRLLQRAGADVFSVDYRGCNALHRAALGGRLSTVKLLLKEGVDSSAEDNRGYTPQRYAVEGVYTHGGSSDIDWEELIRILEDVHTKSPFLRFLNWMRAKCCFTKKS

SEQ ID NO: 28791 - protein, 60 aa, A.fumigatus
SMGKHVLLRSISQWHHCDNYRLFLGHSNPLVKQRLDEPLAHQLDSGATSANTAWGHFLLL

SEQ ID NO: 28792 - protein, 112 aa, A.fumigatus
TNLWANTSYCVALVSGTTVTTTASSSATPTRSSSSGSTSPSPTSSTVAPPAPTQPGATSSCYEWYVAVPGDDCSKIDTQYGITFAQLRAWNPYLDSTCSNLWSDYAYCVKGA

SEQ ID NO: 28793 - protein, 188 aa, A.fumigatus
AISSRPVFAPAISNFHHNTTLLTLMIMGTVREKHKCIINGFSHLFTLFIKAHYIAPTDVLYPPHDADVGRLQRLGFEPEVIDLVQLLPAIRNEAVWSYNDEGIEMIPRAKLVNYLKQSETSNANDMLETLRWVDHTDKDAQGLFPPSILRLTFPAFYGVNVLYDVHDRKLFLCLNVYFIFHQPKKPKL

SEQ ID NO: 28794 - protein, 152 aa, A.fumigatus
ICELKSIGWSYSKIRAKHPEVPLSTIKSTVLNERKRVDNQSKPRSGRPRQVTEVQRDHLYDLSQSSPHLKMLDLLTEVYGAVKKRALQYLLRELGLRKWRQLHRPALTGEQALARLNWANQYQHFTLEDWARVKWSDECLVERGVGIRWTFC

SEQ ID NO: 28795 - protein, 180 aa, A.fumigatus
PRDQLREHDVCTRRTGKGVRQMFWAGFGEEIRTGLVPLYGDPEAPRGGVSGRVIRDLHQAQLPELTEPGDIFMQDNARVHTARIVREVLNSLQIEVMIWPPYSPDLNPVENLWSLMKEKIYMLYPELEDAPDTEDTRQLLILAAKEAWQAIDTSILQKLSRTMPNRVKAVIEANGWYTKY

SEQ ID NO: 28796 - protein, 105 aa, A.fumigatus
TDVCSIRYASPPVGQLRWQPPRPPVKNNSHIIPAVDPPPMCPQSGAAGTPAIYGFNSGPGDEDCLFLNVYAPPGASNLPVFVWIRELLLSSTWPACRCSSADSGD

SEQ ID NO: 28797 - protein, 157 aa, A.fumigatus
GNTFLSSSELYPALNPQSPKPPIFLTQGRQGIFDPCPCFPTPFLRLSDFSSSVSAQEGNPMKTDVCLLLAATLAPIVGGSSSGLIVHLDYSSYQGYHEASTGLNIWKGYAVTPQPAWNAANAKLTSAAFGMHRLLSGSCDGSLHGLQSRITVISSLP

SEQ ID NO: 28798 - protein, 250 aa, A.fumigatus
IVSQRCKTRKPQISLNNANNSISLVDEIANKIVTDEGLTPTPNVILGPFWSPNAPFRNLGDSIIQDPNPNGKVTFMHGVLTDMETGKPIAGAVLDIWQASANGQYDFQDPNQSENNLRGKFRSNEKGEFYWYCYHPTPYSLPTDGPAGVLLNLMDRSPMRPAHIHLMITHPDYATIINQIYPSDDPHLNIDSVFAVKDDLVVDFKPKTDDPKAELDLEYNVKMALKKHHPNPNSAPPVSSFERYNKGQKL

SEQ ID NO: 28799 - protein, 127 aa, A.fumigatus
NDYKSSDVSLSFLCQSSSVDNLLLPRNSSSRAISTHLHPHQYTMSPKRQFDPNFTPYVINSMGPKTPERARVVLGSLIKHIHDFAREVELTPAEWMLGVEFINSIGKISTPVRNECHRICDVIGLES

SEQ ID NO: 28800 - protein, 237 aa, A.fumigatus
INYSNAPSQLLALVVALEGRHRGRRVGIGVVLLQSHFNVVLEVELSLGVVGLGFEINDKVILDGEDRVDVEVWVVTGVDLVDDGGVVGVGDHEVNVGGPHGRAIHEIEKHTGRTVGGQRVRGRVVAVPVELALLVRSELAAEVVLTLVGVLEVILAVGGGLPDVKDRAGDGLAGLHVCQDTVHEGDLAVGVGVLDDAVAEIAEGSVGRPEGAKNDIGRGGQALVSDDLVGDLIDKTN

SEQ ID NO: 28801 - protein, 86 aa, A.fumigatus
NSSSAAGEHAGNQARFKTAVLESDSPLRLNGADTKMTDTAENPGARVRLLSIPKFKDTGELILVDSETLEVELVKFGTFAGKQENQ

SEQ ID NO: 28802 - protein, 133 aa, A.fumigatus
KVSPSRLGLLRKSTVRQKKRRGGGNKEKNARPHNNYNGLPRLRQNHPPAQSHPPTPPNLPARTPQKRIRRRSHRLAARLDTVHLRRARATERMHLLQSRGPAQRRAEPAARGGSARPHRHRDERERVPRDAGE

SEQ ID NO: 28803 - protein, 213 aa, A.fumigatus
IRASKSGLAPLPLRCKKYHHRDSVYSESRQSGRRKEGGGETKRKMPVPITIITGFLGSGKTTLLLNLIPQLPPTYRLALLKNEFGDVAIDSQLASTQSISGVRELLNGCICCNLVGQLSDALNQLREEVQPDRIVIETSGSAFPATLANEVKPLPRQHPGNFVLHGVISVIDVENGKGYEYTSYRENLQAMYPDQTFQNNGKAVPEQAFQTWA

SEQ ID NO: 28804 - protein, 136 aa, A.fumigatus
  UNSURE (120): Identity of amino acid sequences at the above locations are unknown.
ISPREDCDPYRAFLESKLGQFQPVIQSVQITMRENIYGFQGNQKSYYLKITVTEPKFISKVRSALENNAQSLNYKGLWNNPDGGILTFDNIQYLLKFMIDTDIAGMFWVEPKAGKYHWPXPPEIYQLARLKRFSII

SEQ ID NO: 28805 - protein, 246 aa, A.fumigatus
LRLYLHICRVKVSFHIVQADVKEIIQEDGSVNGVRTTSGLVKAEKVVIATGIWSEDLCDFGVPIPVIPVAHPYMYGEQCQPKPRKSPFVRWPEFHVYARDHGTAYGLGAYDHKPLYHKPNETAIGDWVDAFDATLERARSLIPAETNLTIKEKFNGIFSMTPDNLPLVGRISSIKGLYMATAVWVTHAAGSAKFLTKLIQGEEVDESLKKALDPNRFQGKEMQALKEESLAGYNSIYSTNENRRSR

SEQ ID NO: 28806 - protein, 193 aa, A.fumigatus
SATMPEAVAMPQKRVLGDATNNPRSILNTPGTVKKRKLDAGPSATVNSLSQNGLRKSFGSSQPQKSQFEEEVLEKLTQDINGLKDSNSEKDQQWERPPLGDFDETKDNICFQQIDAEEGTITGGKTAVRLFGVTEVDLSPHCQSVWFANGFNAGRAISFAPCHRVSALPLYRGAGEFHQGKIATPTVPFSRVN

SEQ ID NO: 28807 - protein, 63 aa, A.fumigatus
SQALDRSLTLPAGQVGKMLGERWKALSDSERRPYEEKAAADKKRYEDEKASYNVCGYTYCALK

SEQ ID NO: 28808 - protein, 133 aa, A.fumigatus
TSRISTPRTTMQRLFSDGDDDLVTADTLTTWYVHVPLSSGYAHDKVILFDAICSAIQAGRCEIYSSRNLENNISGFMIEVQARFSDLGTVRRAAYHIAQRHLDFHRMEMQSRTQTRLAEKCLASLSLEDARGK

SEQ ID NO: 28809 - protein, 154 aa, A.fumigatus
HQQYIASHQPSTNPLKPNYTEPSGATSKMGLLELIQHLRGEEPTGYTWYVHFPLHGDPLTQSEILHTAVQELRQKKITLWQSRGAAPDKGMLMKVIVADNKAAEVLKAAGTVLERRLQDAKLSLERILQKDNDKRADNYVTKLKSDLAALSMDG

SEQ ID NO: 28810 - protein, 675 aa, A.fumigatus
LTVKFLDQLSPDEIRATTQLIREISTGQYIKFNCLTLREPLKAEYLAFRQGKGPRPDRRAFAILIDRHSPGGVIEAVINLTSGVIEEWKRVEDVMPILTPTDLGFIERVARSDPRVIQACQDIGIYDMSQVYFDAWAIGIDERWGRDRKLQQGLPYYRHEPEDNQYAHPLDFIVIADTDTEEILSVDVRTVDGERTRPPLKQQNYLPTSLQHGYPYDTLKPIHITQPDGVSFQLHGNMLHWAGYKMHICFNYREGIVLSDISIYDPVEKRQRPLFYRISVAEMVVPYGCPEPPHHRKQAFDVGEYGMGLMTNSLRLGCDCKGVIQYLDGVISDQQGIPVVVKNAICIHEEDNGLLVKHTDFRDARSISARDRKLIISQIITAANYDYGFYHTFTLDGTYKLEVRLTGILNTYCLHPSETANPYGTEVARGVTAHNHQHIFSLRIDPEIDGVENEVRECDAVPFQYTDDSKANPYGNGFFCRQRAVEGASLASLGRSWDIVNPTKVNPVCKKPVGYKILNSQYPGLLAQEGSIVRQRAAFATKPLWVVPFKDFRLYPAGNYVCQSTGEAHQSGNETLEGWVSDAKHADIVCYVQFGLTHIPRTEDFPIMPAEPVSVTLRAANFFQSSPALPFLTLPQNRDTNSQLAGLGQSACVSHTVTVRQGSHDNPRLQKKLSL

SEQ ID NO: 28811 - protein, 104 aa, A.fumigatus
GRSKRQLPAPSRDGDDRDGTVRDNVLPAQNPEALRKATAEVRSAYNSEDEITFATTAERLPYMQACLTEGLRIYPSGPIAAPRRTPRGTVTWIAGHPVPGGGGG

SEQ ID NO: 28812 - protein, 177 aa, A.fumigatus
  UNSURE (152),(168): Identity of amino acid sequences at the above locations are unknown.
RIGFTEVTVCSILYQSWFSCFYCVCVVLSVTWSPPLFPGNMASNGCLTPSELNGQSNGHINGATNGYSNGHISGLTNGYTDGHVDDRHGHANGYTDGHIEDYTRHEDHRPSAPVAICGMGMRLPRGIRDEQSFYEFLINKGDARSSTRNDRXNVDAYYRPSWEARHKXSPTMVTFLK

SEQ ID NO: 28813 - protein, 130 aa, A.fumigatus
  UNSURE (35): Identity of amino acid sequences at the above locations are unknown.
RGLQAIRCQGGGGVSVGVHAWTASNSPLNFHRQAXFIPERWLSPSTMDPASPFQRDNRAASQPFSVGPRNCLGKAFALNEMRVILARMLWNFDMKLLPQSDGWERQRIFTLWDKGPLMVELNEVRSSLHN

SEQ ID NO: 28814 - protein, 202 aa, A.fumigatus
SAWDNTRLPFLRPLVYRLTPDVQRVYQHNARARELVGSIVKQREKDEATIPGCTKPNDAIEWIWDLVPNEDKKNHGYQGIAQLAIAAVSVPTTSQLLTNIVLNLIAYPEYVPILKEEIENVLASCDGQWTLDSMSKLEKLDSFMKESLRFDTPLTGHPPSLLQDLYRESPRTQWLTLTQLRFNARPCNASPSAMAQFCNLGL

SEQ ID NO: 28815 - protein, 118 aa, A.fumigatus
RVSEDTVADSDTATFQRKAVQRITLSDGTVLQPGTLALAPSNAIAFDPNIYPNPEQFDGRRFYKLRHQNNSKAKNIIYQFTAASKTQVRFGGERHACPGRWFAAHLIKMVVAGDSLQV

SEQ ID NO: 28816 - protein, 355 aa, A.fumigatus
HPAMRGSFGPCGEELFAEAGEAWVVMIARLPSEFRGLVEAVLECCARDWEHDAVSLTFVFWYELKQYVTLERYGDARVAFTDVFSKLVDIMVKHLEYPRPEEGETDLFGGDREQEEKFRHYRHSMGDVLKDCCAVIGVTECLSNANALIQQWVSKYASQASDQHVPHWQELEAPLFSLRAMGRMVDPEENTVLSQIIPLIVQIPNQEKVRFQAIMALARYTEWTAQHPETLEAQLNYVISGFQHNSPEVVQAAALAFKFLGTDCQKLLGGHIPQLHSFYESVIDKLKPASQEEVTEGVAAVVAVQPLDKIYETMKLFCDPIMARIMNLANNASDEQGQRAVAGMFNVHFFHLYWS

SEQ ID NO: 28817 - protein, 389 aa, A.fumigatus
RAFFSPILELTDSYTDHLQLITIFVQVVNPYVGPNEDNPAVKYCGEILPIMTTIVMNFTSSTPILERVCRCWRYMIISYRTAMIPLLPTLAQSIANGFETSREGCFLWATDAVVREFAEGAEFVDRSTSNAVFQFYEQQAVAFLRILNELHPENLPDGKLYSSCKTMLWYANSDAVIEDFYRLSSDAVRFYPKECISSSLAVPIFTAALSALTLQQIDPLIATLHYYHDLFSFAFEKPAVSEFTSSDGDSYTNPPEVREAVKQLILAQGQVLTQRILTGMMFTFPGDCFADASGVMMTLFDLVPQEAGAWVQSTLQMLPAGTMKPGEAERLLKGIADKVQTREIRKIRSLLQGGTGPQDSTVSIMTNSILQTLPTHIAVFTTGLEGSEL

SEQ ID NO: 28818 - protein, 60 aa, A.fumigatus
VEETFGEDPYLSGEMGYSYVKGLQSLNVSSMVKHFIGFSQPEQGINTAPVHGGERYLRTT

SEQ ID NO: 28819 - protein, 80 aa, A.fumigatus
EAADNLFRYDGIPAVSDYHTLTEILRGEWGYDYFVMSDAGGTDRLCSAFKLCRSNPIDMEAVTLQVLPAGNDVEMGGGSL

SEQ ID NO: 28820 - protein, 108 aa, A.fumigatus
RMQSNFQKIPELVKAGKLDIKTVDTAVSRVLRAKFEMGLFENPYPAAPKSQWNNLIHSKEAVKLARQLDNESIVLLENPYHTLPLKKKGDIAVIGPMAHGFMNVRATA

SEQ ID NO: 28821 - protein, 68 aa, A.fumigatus
DGPINAGSVSDSIPFGFQRSISLTKLIESATGDITNWMNSTSGAFNYTGLVENMKMKAGSFYGRQTGP

SEQ ID NO: 28822 - protein, 60 aa, A.fumigatus
SFCRTLTSTLQIKYWALGNEVWGPWQVAQMTKEEYAHKAYQWAKGENSFAATPKGTNQSI

SEQ ID NO: 28823 - protein, 84 aa, A.fumigatus
CLRHCNSRYSECRANLDLRHMGRCIYGGIYDPGNPLSDENGFRKDVLEALKELNIPVIRYPGGNFTATYHWIDGVCPKDQRPAR

SEQ ID NO: 28824 - protein, 318 aa, A.fumigatus
  UNSURE (51): Identity of amino acid sequences at the above locations are unknown.
EFIRCDSERDQPVNLIYFLALKLLDPSLKLILCGQDGTASWDYYTLKQCLXPAHSPLSTSTVPLIDMHSIHMYTCGSTHLPNVTAPLAAERAIEITSSLIDLAMIENGIPPDQPRPTICFDEWNVWDPLRAEGSKGAEESYTLSDALAVAIWLNVFVRKSKDVGMACIAQSVNVISPLMTTKDGIIKQTIWWPLYLFSKYMRGWTINAHVSCGAYEGETSPKWIRAVKDTPWLDVSATLGEDGYANVAVVNISDEKDMECKFEGASGDVTVFTVTGDSVSACNMKGKEEVGLTESTWDGKGAYKFPRHSLTLLRWKAE

SEQ ID NO: 28825 - protein, 310 aa, A.fumigatus
FHVQGYHNRNASKASLPQHLSQPPMPNHHQQPLVAPVAASIPRYCFDNDKYWYIIEAKMEDGRCWELSRYYHDFYDFQIALLTQFEEEAGNRGKPRTLPFMPGPVTHVTDAISNGRRQNLDEYIKKLLAMPPHISRCQLVRQLFAPRPGDFEIDPSAFGEDARYSGGSHHSSTQETSRTASRQSSQAQMSSHPDRASHQRNQPSVSHAADRPAPMNRQASSLTQVSTTSSGGAMKVKVFFQDDLIAIRVPSDISFQQLREKLLDRLKLNEEIVVQYKDEPSGAYMDLNNDSDLDTAMQRNSKLTLHVGLA

SEQ ID NO: 28826 - protein, 265 aa, A.fumigatus
NYPQFSDSYLYEPPFILSKVNEEVGHTVVHFLCTGNYETLRTAFEPGASKIGIEFRRSMLVYQAAKEYDLYDLETYAKKYIEVFGESMSIFDIMEAAREIYSKLPKDEIWLTGYIYKQLQIAFSLDRNIFQRVDLYDGVGKDPNFDKDVMRMVVNIYSEVLSRQVNETALEGSIAEEGAAEDCAAEDGAVEEGAVEDGVVEEGAVEEGAVEDGAVEDGAVEDGAVEDGAVEDGAVENGVADDSALKEAVNLGIPLQASGTALCFE

SEQ ID NO: 28827 - protein, 119 aa, A.fumigatus
GNTEVNSLFKGAVICNTILYSTILHSTILHSTILHSTILHSTILHSTLFHSTLFHHTIFHSTLFHSTVLRSTILRSALFSNAPLKGSLIDLSRQYLRVDVHNHSHHVFVKIRVFPNTVI

SEQ ID NO: 28828 - protein, 605 aa, A.fumigatus
LAHELILKRKLTARKRGALYQHIIRLCPTRAYNLTAHTTARLTTMTRTTSDLLDDRLSTLWQSACDDYAKETGIALTDGDFPKIHGPEDLSRHLDAERDHFEDFRMKKRPLLHAMQIILAPFEHWGDLLAGVASAAFPPASSIMGAMMLLVRGARRVSESFDMLMDLFHKLGHFALRLDSYKGVSLSEGMKTIIVQVLVNFLRVCAASQKLLRRGSLRARLTKWTKNVLVEDTSIRSLLDELEELTSQEHKMVSAHALDLTHQALRSTAELLERDDNRNERDRLDKVKKALDPVSASGRVFSSLNENRIPGSGSWIEDRIRSWWQSPDPLLWIHGGSGVGKSYLASKIISDLATADSSAPSTPPIVASFFFKNNDVDLRSFNKALRTLAWQVVVQRSRFAAHAEDFCLKEDPANSYVVWRKLLLDFFVKSPPDAGTCFVIDGIDEADPEEQEILFRLLESTYATEDQTGPSAPIRVVLLGRDSVRGILEEHSLGGIPEIEITNNQNQDDLHRYVSQKLQKTKLFRGYPDFLDEVVQDICGQAEGLWEWANLVIKSVLRCRSKEQIRRVVRTMPRGISAMLHAELQRLARELSASDAMSPELSDGE

SEQ ID NO: 28829 - protein, 84 aa, A.fumigatus
QAAVHKRLYWPTVTALPIPYSLNATPPSKVQSADDIGQPVSLSAASKPPSLVLQTLIFCHNDKANGDPKAPHESMTFRNMGEGD

SEQ ID NO: 28830 - protein, 273 aa, A.fumigatus
DDFEWVHPANTYGDDQLPQPPGRFKSREQAEKDRIFGYPPRLGERNLPRQTNLPFRLEDVDEEKAKVKAREAARLRGIPVDRTMSAADIEALIAQHDNAGQSEPAKEEKPASGSRKRRRTEPVNATPESTVGTKRRRQNPSAPSPAAAAAGATAEKSSLMVKFKFSNPEKAAAVAGFFGAMPSSPSKKRLLADVENEDEGSPPKRGKPSPETASPADQNQTPNGRPRRRAATALMADFQSHAEERARRAARKKAATPSKQGGGSAEGVPIKSA

SEQ ID NO: 28831 - protein, 93 aa, A.fumigatus
SCRSNLTNSRQLTICSANQRPEMHLSMLAVTLQNQNTRTHNSTDYPAVPNSTEHGTPTCVLECCDPQDKKDLNMTNTDASAAYLPDSMLVTLS

SEQ ID NO: 28832 - protein, 81 aa, A.fumigatus
THSCAAACTAQFFKDAAAARTCSKANDSPVAYAGKHRCGKYSTTLTMGADGIKSTDLSQASSDGFHVQRLLGWRPSVPFTL

SEQ ID NO: 28833 - protein, 321 aa, A.fumigatus
INTFGGFFVSSLQPVFDKRAQEVGSTLEWNFYNASHAFITALLPMLRQKLSTVLPSISGHPQLLSHLIHELMNFDNEIREAWNYLPDPYSKENWKGITWEVLTKEGWFDRWLQVEKDFALARYKEIIDATDSGEIDYEGVEFSATKPTKAAIRVNDLLETITELYRPLSSFGQKLRFLIDIQITIFDQFHERLHSALEAYLAMTSTIGRTVQGADGQASVEGVAGLERLCRVFGSSEYLEKKMEDWSNDVFFVELWSELQERVRQNKNSGRNVAAPMSVADVASRTSQMVANGHHSSGQASSDGALFDETASGLPSSQATF

SEQ ID NO: 28834 - protein, 77 aa, A.fumigatus
KTLVELRKNSSRASFQTSRSQSDIDNIAEVVNIAGKLRRSGSGKGMPHEDVTPKISLNGEEYLANDSTQRCYAQCAG

SEQ ID NO: 28835 - protein, 378 aa, A.fumigatus
IIVNDMGDVWNIKTTSSDSSSNQNRATSGAEHLQSTFTLTLGAITVNSSCREALVQQEVGKSIRHTLGLHEDESKTARAMGVEDIKKDGTLVVILDILDLLSNVLRGGANTTDGEEHVILQEVPGKHLNITRESGREHQSLALIDVRHVFTLYDAANLRLETHVQHTISLVENQVLDVNQRDAATLDQVNQTTRGSDQEITATLDLTELRANIGTTVDDTGANPRAVSELAGFVKDLRNELTSGGEDQGSRVRLALTTIAELAGGLSRHRGRACLEGLRENGKQETTSLSGTSLSTRHEIATVHHNGNGVLLDGSRGLIASELDVRNQVVIQRGVREGIDRLGNVVTGCFDGDIVVVGEVDTSALLGGIVGNTEKLTL

SEQ ID NO: 28836 - protein, 565 aa, A.fumigatus
PWRTSCRNAPRGGNWANANASDFSPRGPNVPNGNISWTPTETQRRPFNPHAYGHPGHGGSYGGSHGSAKGSGDGQWRDGKHIPGPANARLERELFGVPNDPTKQSTGINFANYDDIPVEASGHDVPEPVNAFTNPPLDDHLISNIKLARYQTPTPVQKYSIPIVMNGRDLMACAQTGSGKTGGFLFPILSQAFQTGPSPVPAQASGQFGYGRQRKAYPTSLILAPTRELVSQIFDEARKFAYRSWVRPCVVYGGADIGSQLRQIERGCDLLVATPGRLVDLIERGRISLVNIKYLVLDEADRMLDMGFEPQIRRIVEGEDMPNVNERQTLMFSATFPRDIQMLARDFLKDYVFLSVGRVGSTSENITQKVEYVEDHDKRSVLLDILHTHGTSGLTLIFVETKRMADALSDFLLNQRFPATAIHGDRTQRERERALEMFRSGRCPILVATAVAARGLDIPNVTHVINYDLPTDIDDYVHRIGRTGRAGNTGIATAFFNRGNRGVVRELIDLLKEAHQEVPSFLESIAREGSGYGGRGGRGGRGRGGNSTRDLRLHSRESNMPHPKN

SEQ ID NO: 28837 - protein, 417 aa, A.fumigatus
WRLSLSSREANKTRSIIYISPTAVCLIGRKIQYSSLMFKHLNMVTSENDLISAVLSIAFQIYLTCSLITWFSLREFTTSECPGSTNNFNVAIISASQQELTAVKALFDEDYGIVGDISGVHPLDTNAYVAGRIGNHKVILTQISKYGKVFAAKTSFWLSISFPQIRICLVVSTGAGVPCTKDGQEIRLGDVLVSEGIIEYDLGKLLPGGVFLRKTGPLYDFPPPTGHIARLLNSVRRRQARDMLKERMSQHLNYLQATISDLKATNYPSGEGNKLLPQLSLPCFPGSNSCVFNLEATNKNALFVAKCASLDSEPRVGAWAWLDIPAIEYFRPNIHLGWLASGDRIMRSAESRDQIATQEGVIGFEWAGVGAWRQLPTVVITGVGNYGDGYGTDPWPAYASASAASCAKAMLEVYNTL

SEQ ID NO: 28838 - protein, 67 aa, A.fumigatus
  UNSURE (9),(26),(28): Identity of amino acid sequences at the above locations are unknown.
LTSSAYYDXEHNDFSTSHKAFKRMMXTXAWEVLEVYSGPPVVIFKWRHWGYMKNDYVGYNKYGCVPG

SEQ ID NO: 28839 - protein, 103 aa, A.fumigatus
RMIMSGITSMAAFLDKERWILNQCSSRGEKVTVKAHGGLIDIQGIVIAKVNSSLQLEKIDVWFDPMDMFRQIAREEKIECENKEGVDAAGAAAGCPVMGHRSA

SEQ ID NO: 28840 - protein, 85 aa, A.fumigatus
  UNSURE (37): Identity of amino acid sequences at the above locations are unknown.
HPVRRSGLRQHRIVKVIGGICAFSFLLIEILFFAVWXPPFSAYWSVPPKSAQCSVYTNHVIITLVFNVATDVLIMAIPLPLLIRA

SEQ ID NO: 28841 - protein, 114 aa, A.fumigatus
VFLLPAQMAQRSRAHKSKQDCASLYWSSNLTTHLFTGILPDGHPNLVQTNRIYSDQLRQNVLVKQYFCDIDIAHLISYNEELAHKLTTEPADIIPLVSIVFRLAVADSNDRTPL

SEQ ID NO: 28842 - protein, 329 aa, A.fumigatus
FEAALQQCTQRIVYPSQRDIVLPSHQLLLHSSASHISIRDLNATNISHLVRIPGIVIGAFTISSKATVVHIRCKGCDHSENIRVEGGFSGLTLPRRCGRQKLPGEEPGEQCPLDPYVIAHEKCQFVDQQVLKLQEAPDQVPVGELPRHVLISADRYLANRVVPGSRCTVMGIFSIYSKGGKKDGAVAIRNPYLRAVGISTDLDHTAKGNAIFTEEEEQEFLELSRREDLYEALARSIAPSIWGNLDIKKAIVCLLMGGSKKILPDGMKLRGDINVLLLGDPGLARPHSLKLTEKVSLIVLHIPERFVNGWVDRISSQRPADTRNLYGKG

SEQ ID NO: 28843 - protein, 705 aa, A.fumigatus
  UNSURE (13): Identity of amino acid sequences at the above locations are unknown.
RALYEHDLSMSAXQRLRLKEKEEREIEENQHESLAQDSEDGLSSISMKRTASSSTASGPTANRRTSTAATSIDGESFPSGTGGSSENSKSGFIGAMASERGSFKSRRLYGQGLAQSAQNQQNTTLHRLESLSRQRAGTLESPPLTRAYSRSATNLRDRLQKLAIAEPTPESSRATSPPSSAVSPKLPSNESDPKEPKSQLTPGYGVPPLSPPVSENEDLGTLAAALQPEDLGKATAMGLFNKPQTAFDESQFTRRQLQMHQGRSTPPLRRAPSPPSRMTPQERIGRSRGLSNTSGSESVSSHYSEPHHAANHSTAPSIDASRAGPANGTFFSNPSSDASDDEGDEFNARDVAAAIDAVHPAFRPSTPPKPATPPEEPQSVLPEVRFSDLGHLKPIAEIEASEGTSVADDSTVLPEKPDSPTLGPSGLGLSGLIRTHLRRDSDRSSFHVPHSPVFPPKPNDEEVDGSVANGSDTANGSSQRASTDGNSSRDSQDNSKVPSWDDELKSKHRRQESTETQREREEFEMELAERRRRVQEKLRGFAESESRSASPISGYRTPDYPQQTKPGNAFAILKSKNPKHPFFSRQEPKNSRAVGLASASTPSLVPDDPWREEDEKIPFSFGKHSNTSSPQIAGEKSIRSRVAAFGRGSHEGSRESSRSRGASPHSSMRSQRDRSSSDASGRSKSRTRYRVFTTGLEGSAVAHGG

SEQ ID NO: 28844 - protein, 104 aa, A.fumigatus
  UNSURE (7): Identity of amino acid sequences at the above locations are unknown.
HYEFYYXIANQVPSFSSAGGLLFDYSNKPPPAASSDNPLSRPDNDHLEGADKDATLTKVVDRRWYERNKHIFPASLWREYEPGPEFEQKMRSTRRDAEGNTFFF

SEQ ID NO: 28845 - protein, 108 aa, A.fumigatus
ETHHIRMATQRYQHAALPINVPSKAPAPASLFPISRISGSPPDISDTSTTTGSRVSGFSYGSGALSGDYESSSASYSGIDVVEVLSDRMQDVFDPTPLDRGLAKQAQT

SEQ ID NO: 28846 - protein, 123 aa, A.fumigatus
VLWLSCAIANWYVSLIHPAACKSMSVSVSVANAESITQHYGIWGDTNGGVSTGEASISLADLCFPNEHLDGNHGHDPNDVLFIGFTSKDAVPGATAKWKAKNAKEFEDSIKSIGDKLVAGLKA

SEQ ID NO: 28847 - protein, 91 aa, A.fumigatus
PNQQAQDFLDIKAIALPDNQSGTMRLSEILTVALVTGATAYNLPNNLKQIYDKHKVYCTHLKVCIIASQLISLFAPSGKMFQGTGKRVHQW

SEQ ID NO: 28848 - protein, 148 aa, A.fumigatus
YLFLRRQGKCSKVLAKGFTNGDASQGKSFSYCGDIPGAIFISSSKGYTNMDIDCDGANNSAGKCANDPSGQGETAFKSDVKKFGISDLDANIHPYVVFGNEDHSPKFKPQSHGMQPLSVMAVVCNSQLVCLSHPSSSLQVDVCVRFRS

SEQ ID NO: 28849 - protein, 516 aa, A.fumigatus
LELGSASAVLKTIYEQKLGVVREVERDAVVLLQNQKVVSPLDPSALEIPMTVGTDNVVSWPSNQDAMRSYPLPNGEYLWTVESEFVFPGQFTLTSSKNLDRGDWSLEMGSKSQPEGHVLATPAMNIHVEWLCPNVYGAGPPYGGSPSEVIRATMLQGTAMKCDFGKLPTEGFSEKTVRSDTWVEVGPGDRVRFRNPADARKYNHKQIPTDQSFGYDINLFRVLSTRTEVKVQWQDLSVTTEAATSLHKFNGGDDEVWPGSLVVLSESLETIRKSCCRTESHRARKVGIVQAVDSGERVASVRWYKDPDIELLHKGNMLKPGSRLGELGDIVTQVSVYELSLFPGLGKALGDLVLLVPEKVHRSVFPPTPRDPPAVTGPSLYSFLFPMNFFEMTMYLESMKLALFKSEAFKNGITIDSSPLPSRYVIHHDKYNGQSPCDFLGRIVSVDIEGNITVRQVGRTSCRDICIPLDRILMVIDDDYDMPALPIPPLDMFGLPGFSPWMSNPFISNRTYEYEG

SEQ ID NO: 28850 - protein, 86 aa, A.fumigatus
REGRGEESIVIPFLNASDLKSASFMDSRYIVISKKFIGKRKLYKEGPVTAGGSRGVGGKTDRWTFSGTRSTRSPNAFPNPGNKLNS

SEQ ID NO: 28851 - protein, 195 aa, A.fumigatus
LDYDIAILNLSERGLTDDRLNHLLTIVPNRTLVLLEDVDAAFSNRRQTDTDGYRGANVTFSGLLNALDGVASAEERIIFLTTNHVERLDEALIRPGRVDMTVRLGEVTRYQVRCLWDRFYGDLDTTGFYRQAFLDRLQELGLIEDEKGFKADRSRSTSAAALQGLFLYNKGNMEGAVAMAEALTHTVHDSAEGDH

SEQ ID NO: 28852 - protein, 169 aa, A.fumigatus
KQAAFSINSCPADILYLVFQFLSSAELHALCLVNKTCGTIAEKFLYSKIQMTWLKADRPPPIIQLLRTLLSRPQLAAYITTVHLDSNFYDYWNFQFKIPNLPVSGAELDQPIAFIRGTGAPYSNLWIQELRQGSLDAFVALLLAQLSNVRYLYLANDFTRQSALVGMVL

SEQ ID NO: 28853 - protein, 84 aa, A.fumigatus
EQILRSFYFLLFSLNINIHYSGAVLNWNEADVKMWAEFSARVYHRISTIPTIHIISLILISIRANHVTDQNHLYHYGKDIVTEE

SEQ ID NO: 28854 - protein, 64 aa, A.fumigatus
FYNSSFGRLCGLEETVILTFVCWQQLMKYMSLDQRGHVQAEYVWIDAVGNCRCKTKVCNFSPSL

SEQ ID NO: 28855 - protein, 549 aa, A.fumigatus
  UNSURE (482),(537): Identity of amino acid sequences at the above locations are unknown.
DAILKLREEHKDDIGSVVQLVLSHSCIGAKNNLILAILAMYRPNQPGAGNVAKYFKPVLKKLTELESRPAAKVTLKAREVLIQCALPSMEERMSQMELILRSSVVESRYGETGWDHREPEFSVLKEVVDSKYTVFDVLTRFFVHPDPWVTLAALEVYIRRAYRAYTLKGIQYYPDGEVPLVSWDFTLGKLGQPEFGSVHSNQMSTPSTPTTESNPFRRLNSISDMSYLVNDSSNEPLRKGVIVPVQYLEDAEEQLPKALEALPRAGSKRKPGENGLIADLEGKRRPAPRIESDNELTGVCNVAVRDLEDLDDNQIVAQINTILAGLRDELLARRVRRVTFICGKDGSYPGYFTFRGPTYEEDESIRHSEPALAFQLELGRLSKFKIKPVFTENRNIHVYEAIGKGPENDNAVDKRYFVRAVVRPGRLRDDIPTAEYLISEADRLMNDILDALEIIGNNNSDLNHIFINFSPVFNLQPQDVEXGLAGFLERFGRRLWRLRVTGAEIRILCTDPATGMPYPLRVIITHTYGFIIQVELXFEKKSEKGKWLL

SEQ ID NO: 28856 - protein, 394 aa, A.fumigatus
  UNSURE (24): Identity of amino acid sequences at the above locations are unknown.
HKEENGAGFLPLPNGIGGTNHFFXQTVQFYPFQPGNSALYSAFVRNPPRLIPAAEYMYSTGVFHGCWSPAHQQPASQEATIEHNFDLLFSHYQKQIEQHRWYGFWDHGDVQHTYDPYRHAWRYDVGGFAWDNSELSTDLWLWLYFLHTRRADVFKMAEAMTRHTSEVDTYHTGRFKGFGTRHGVQHFSDSSKQLRISNVLYKRIYYYLTGDERIGDLISEQQDCQFALLTLDSHRKVQAHADIPDGFAMTNIGLDCGALAAAWLTAWERRTEGWEHCRDHLIKLLDGIARLKHGIGNNAILLNPTTGEIRECPPPTPEYAISHLSMLFGFPEIFAELLDYARDVDPATVDRFMAVWLSYCKAYNGGAEVQRRAVRFAFNCLTDRRRKSSVPQYN

SEQ ID NO: 28857 - protein, 82 aa, A.fumigatus
VKLLGHYENETYSQNFVHRYNGLKCRIRSALFVVEDSGQLLRTMIITLLEARGHDYSLVSTSASLILRVRTMRRRTPMQILV

SEQ ID NO: 28858 - protein, 453 aa, A.fumigatus
LQPIALWHGLGPPPFFFLATASHLVPSCPYKVLLPSGWCFSHGFTFRGCLNLPANLSIAYAGTPDSDPRCSLDAIRLATTMARSFDTAQTPLSGYFPGNMHFQDPNQIPAYSIFGASQYPDSVAFWHNLPPQPPQPGIPAAATPYSSPPPKQHHQPPLLQPVSDQKKHKRTRSGCFTCRSRRIKCDEARPVCERCRKGNRECVYPSPTATGTSSKAASRLGAKARAQRPPSQGSDSSGHVGPDEFHALEPILDEEEVDEGSVDSATLLSSSTTSLAARVKPGPATKQSMQSLRKRGTKLTAPDATPPNTEGSSPSTEASSRFESMSARSASVGLSNQESLGADSFSHLPEDLRSYLTFHQEYMTYRHYFMRPSSDQFVHHNIIKFALQYEPLLYAIVGLSAYHHSIHSGTGKLYTFLRYYDKALKLLRKSLASGEPHSEATLITVLALTTFEV

SEQ ID NO: 28859 - protein, 185 aa, A.fumigatus
LSSTPSSSFARFPFSTFPYSHPCLIVMAASRSFARSLPVLRAASPRTAVATVSSARIAASSAARSLSTSSGSSSSVLSSQRTSAAMSTTSSSFVATRRLHATAQQLAPATTSAATTATEYPTDHTPIANPIDTTNFIDNEFVSSKATTWIDLHDPATNNLVTRVPQSTDEELRAAVASAEKAFPG

SEQ ID NO: 28860 - protein, 204 aa, A.fumigatus
PTLEDQSSLRNLKAYRAAVKFLEFGGCQFVGPVSDKRARFGFEIWTMQNDILFDNMYIGHSIEDGEKLRKETFDLKHPVEVALEEASKPKLEEKAATPSVSFKEAPVTYVREKVEYFVGVAKQDPINAVKQVPEVAGGLGALLLTMILVIVGAVGASSPAPAAAAKKGKEAASAAKEKASEAVSSAADTAKGAATKRNTRSSAQ

SEQ ID NO: 28861 - protein, 385 aa, A.fumigatus
KTMGWNGRLSDDKEMGNLEADILPEIGRLEATSWIVNLEQQEGKVDQLARLIDKTIEECEELDGLLTLYSHELNVSFSPGILSLPPSNRMAQTLHEDVSYIETQSQGLQVQTANQKLLHNELQNLLKTLSISAVDLQPLRESSLSNPDGLRETEAALSTLYKAMLMIDPDIWQNKKRLGDAAGEQGSVGVYADTEIGQMRAIREKKEEYRAQSRMFLQRLRQFMAIAYKVAEQKRVDAAANGPKDPLKLDSEARAYFRQELWMYNALMLFAREVSGSEWHGLISLYEQQAKLPYQNEFRDNNLAWKRAGRKPSGEEQELLFTHQEKEKESEGITMAARKLTVRRGKTIRAAAGLRLTPGEKRHGRLDPCEVFAGTLQETLNMISE

SEQ ID NO: 28862 - protein, 82 aa, A.fumigatus
QNFIVHFFHLSSLSNTEFSDFVASGNPDERPLPDFSARHPHDPDRGMAIKVDQIMDELYSFWSTDMQNLVDWAIPPDPLYAT

SEQ ID NO: 28863 - protein, 102 aa, A.fumigatus
LHPRFIIRCLQKLHSPLNGLFNRFLDEQIRGIDDPNVYVNNRKGVISFIPVLPNFSAGVENFSLLPINEFFDFPVRVHDPYESITQPFWESLKFYSTGSPQS

SEQ ID NO: 28864 - protein, 183 aa, A.fumigatus
CSICTSFTRLEPGQQVTIGNAVRTARMYILDPDLQPVSDGQTGEVFLAGQQVMRGYVGDDAKTAYSVLPDPWHPGERMYRTGDYGYWNADRQIVYIGRLDRQVKIRGFRVELAAVEQKMYQEEPRLTQAAALVVNDTLVAFVMPLDVDVSRLEQRLRESLQPSWVPQVITALEEFPWDGQPQG

SEQ ID NO: 28865 - protein, 272 aa, A.fumigatus
ITCRPGENVDGRAGTLPYRELDQKSNAVASHIAKHFSRAQVIAIHADGTLNWVVGILGILKAGCAYCPLDPAYPIARRVAVYEQSGASALLIPNACSSSAALLPITDLRVFTIQETETSDTSRQPSLLANANEDALIVFTSGTTGRPKGVPISHRGLLALQSNPEATMFSRPGRRIAQFMSPAFDYCANEIFSALLHGGTLVLRDPSDPLAHLAKVDVSTITPSVLSVLNPDDYPNLDMVYATGEPVTPGLLARWGEGRAFYNAYGPAEVGP

SEQ ID NO: 28866 - protein, 174 aa, A.fumigatus
STLRLAVPRELLQRGNHLRHPAGLEGLAQSLLQTADIHVKRHDKGHQSIVDNESRRLGKPRLLLVHLLLDRRELDAEATDFDLPVQSSDVDNLSVRVPVAVVAGAIHPLTRMPGIRQHAVGRLGIVSHVASHHLLSGQEDLSGLAVRHGLEIRVQDVHARGANGVSDGDLLAGL

SEQ ID NO: 28867 - protein, 79 aa, A.fumigatus
LMTPSSAKCSMRCGGNYERLRKSRSIDRHRPRFDYIITAIISHRAIAEQLLSANTMHQGLFVICMQLYLGSDSIACIAT

SEQ ID NO: 28868 - protein, 186 aa, A.fumigatus
NQELPLNHFLDLAYNTPLWSSPDSTLTWLNHWATREFGTQVSSKVADIMDRYGMYAARRKYELIDSSTFSVINYNEADRVQEEWRALVNDAQNVYQELKDSARPAFFELVLQPCMAGQIVTNIHITVARNNLYAGQRRTSTNTLADQALKLFNDDHALTQRYHKLLDGKWNHIMDQTHLGYDYWYV

SEQ ID NO: 28869 - protein, 197 aa, A.fumigatus
WTRHILVMITGMSDSSLCIFDMVLTKGQQAAAHEDTLPPLAYTQVLEESLAGSMGVSVEASNASVPGDDVWHSLSSNSLTLPPMDPYGPSTRWMDIYSRGTHEFTFTVSPYDSWVKATPSSGKISVSGNNTDARIHLSVDWEKVPSGSHMALINVTISSDDYGNFGMPTVQLPVSKTSVPADFHGLCGVGWHGQHRS

SEQ ID NO: 28870 - protein, 197 aa, A.fumigatus
TSNQKNITQFFKEGAIRSKDWEVLWTLGMRGKHDTANPTNTKQTLGDIVNTQQQILSDVLNMTNISSIPQMWCLYKEVGQFYEEGLRAPDDVTLLWADDNWGNIQRLPLGNETARSGGAGVYYHFDYVGDPRDYKWINTISLQKTWEQMHLAYERQARQIWIVNIGDLKGVVSTESIAGLDCSKPNLKSGTSPEPLP

SEQ ID NO: 28871 - protein, 210 aa, A.fumigatus
STSPSHRMTTATLECQQSNFLSARRQSQQIFTGFVESDGTVSIEADHATRNTSSTDVSYAVIPRYGHTLSGVTLLPVTIETQQPPSSPRLEYDMYLFSNVSTVKATVYLGPSLNTDHSRPLKYAISINDADPQVVQFVPSTPLGSLPSNWETTVRNAVWTNTTSHAIQGGGRKNTLKLWAIEPGVVFQKIVVDLGGVRPSYLGPPESMIV

SEQ ID NO: 28872 - protein, 223 aa, A.fumigatus
  UNSURE (163): Identity of amino acid sequences at the above locations are unknown.
PRCLSGGRRRLGHRHGQADESVYCLPRGRLSRLCQRPPGQRPPRHQGPPATGRRPNHSRHRFRDHRNRHLRPRVEKSQDRHRPPQSQTHAGHLRPAQHPHHALGRPCLVRSGRPLPLARVLDRHPLQRAHPAPHQPHQPARLPGSQPEFPTFSRCKPLRSTVXYLAPRRPGPGRLRRPNPQMLLAPDFWPRSGFGKRPPSIYSHLHGLTPIFQPRTRGLQALP

SEQ ID NO: 28873 - protein, 179 aa, A.fumigatus
ISTWRSHSLSPSPHWAISGLPSSWPSSSSSSSSTTSSSSTRLSIAMTSIRVAPSAAKRALNLLRTVQYTHPPSCPCHSNPNHHHHLQSNHVRRLATPVDPSRQKEYAFEMAASSIRFGPGATREVGMDFANMKAKRVCIVTDQNVAKLDAMKQAVEGLSKEGIEFTVYDKVRVEPKDSS

SEQ ID NO: 28874 - protein, 256 aa, A.fumigatus
  UNSURE (195): Identity of amino acid sequences at the above locations are unknown.
VQHAPSLPVSRPVRTAKTPRRVKDAIAFAKPYNPDAFLAVGGGSVIDTAKLMNLYTVFPEADFLDFVNAPLGKGLPVTKALRPLVAVPTTAGTGSETTGTAIFDLVSKKAKTGIAHRNLKPTLGICDPLNTRTMPSAVHASSGLDVLCHSLESWTAIPYNERTPRPTNPINRPAYQGANPNFRHFLAASPCAAPXNTLPRAVPDPDDFEGPIPKCSWPRTSGRGRVSANARRPSIPICMDLPPFSNPEPGAYKHCR

SEQ ID NO: 28875 - protein, 204 aa, A.fumigatus
  UNSURE (143): Identity of amino acid sequences at the above locations are unknown.
ICILSSPRPTFSTLSTPPWAKASPSPRPSGHWSPSQPQQAPVPRPQEPPSSTSCRKKPRPASPTAISNPRWASATRSTPAPCPRPSMPRQVWTSSATRSSPGPPSLTTSAPRAPPTPSTGPPTREPTRISDIFSLQAPAQHRXIPCPAPSRTRTTSKAQSPNAPGPGLLAAVGFRQTPAVHLFPSAWTYPHFPTQNPGLTSIAG

SEQ ID NO: 28876 - protein, 218 aa, A.fumigatus
RSRKNRMGSTHCPLRLRHSIEPRQLPGRSARSYTREQRFQAIADVLKPGDYVVIEFGHNDGGSLRTDNGRTDCPGSGDETCTTTFNGVTETVFTFPKYLQDAAKMFQSKQAKVVISSQTPNNPWETGTFSYTPSRFVELAKLAAQRAGVDYVDHGAYVADMYKSLGKTTVDSFFPNDHTHTSSTGAEVVAQAFLKAVVCSGARLKEVLTTTNFPGKCL

SEQ ID NO: 28877 - protein, 122 aa, A.fumigatus
GTELSSTIRHSGIGPQTYKPRFRMKCFAFLSALALFPGTLSATIYMAGDSTMAKGGGGSGTDGKSQGKSPFARYIYNALVKTGWGLHIAPFVSGTVSNQGSCPAAVLARIPANNVSRPSQMS

SEQ ID NO: 28878 - protein, 65 aa, A.fumigatus
  UNSURE (4): Identity of amino acid sequences at the above locations are unknown.
AGPXYFYLARSFAPVVKNELVTKAAFSDGRTVYFPPRLYFDRRSLTDFLGHLCFNMYCGTNTFLS

SEQ ID NO: 28879 - protein, 224 aa, A.fumigatus
VITSFKLPVPVFESNPASPTMAKKVTCKQCDEKKPTCTNCRQHAVICDYATESTAPSRPSRGQYRFRQSKYEIQIDPSTPDTTSIQSSNPGPTPPPPLESISLADLHLFHHYVTAMASTLTDGQDPKHLWDVHVPQWGFVFPSILHLILALSALHLAHQHPALRAQYRNQADAHFTFGVRSVTTVLASLNEDNCQYIYISAVLICFVYFAHGPRTGEFLVFSET

SEQ ID NO: 28880 - protein, 258 aa, A.fumigatus
MSEQAELNKNGSQEGKDVRPPERAHLAQDTLADRQGSLGPLHEDRPRHIPSQISLRSQSQIASIPSNTGAPPTGGEADVAEELAWGPAHPCYPHLNPHVPIGSQEYLTTRIIRIRRDWMVKGDLAPTFSNLYPEILDPLLPEQEFRRVIATVNEELIKAFDPFSFRNLLDGALGLVTGWLWEDIGAAGIKSHLQQVEDWLDKWNREVGAKDGVHIWSLRRTAYLSLDIQIPDPKVGIVHSEGMSLPGTRPNSGVGLGF

SEQ ID NO: 28881 - protein, 66 aa, A.fumigatus
PTSPPTAPIYPESFSGRIPNFIPPFCQGAHSNALFPLFERPHIQNALRHSRLQPKRRESHLPRLSQ

SEQ ID NO: 28882 - protein, 169 aa, A.fumigatus
TDRLPHLRPPFILRASPAESPISSLPSARAPIPTPSFPFLRDPIFKMLSGILVFNQKGENLIFRAFRSDCRPRLADIFRIQVISNPQVRSPILTLGSTTFSHVKHENIYLVAVTKSNANAALVFEFLYRLVLLGKSYFGKFDEEAVKNNFVLIYELLDGEYSLKQGGLE

SEQ ID NO: 28883 - protein, 161 aa, A.fumigatus
RIIVLEILDFGYPQNTDPDTLKMYITTEGVKSAIVNNPTDSSRITMQATGALSWRRADVKVPQERSLRRRHRRREPAHVRHGHRAPRRRHRPDRHARLPLRHPGVQVRAERPPSPRQRQRRRCWPILVLARPLWQQSNPRGCRLRHAGRLPVPPVRETGPL

SEQ ID NO: 28884 - protein, 270 aa, A.fumigatus
KSSTLAIPKTPTRTRSRCTSQRRASSLPSSTTPRTRAGSQCKQQARSPGAVQTSKYRKNEAFVDVIEDVNLLMSATGTVLRADVTGQIVMRAYLSGTPECKFGLNDRLLLDSDSGGGAGPSSSSHAHFGSKATRAAAGSVTLEDCQFHQCVKLGRFDADRIISFVPPDGEFELMRYRATENVNLPFKVHPIVREVGTTKVEYSVAIKANYSSKLFATNVVIRIPTPLNTAKTTERTSQGRAKYEPEHNNIVWKIARLSRRQRVCASGLHH

SEQ ID NO: 28885 - protein, 91 aa, A.fumigatus
FDFHCSPISSSIMIGATRRWFRRNRKGLAIGAGIIGAGYLAGQYVLSKITEAREQMSSDRIAREKYVTFGFTLIFWPNEMDKTSIHSCARL

SEQ ID NO: 28886 - protein, 130 aa, A.fumigatus
LIDLSSLRRRFEQNQTDCTYTVLALLPTAAEGIVEALPVEELTKELQKKRAERLARLQAGEGTVSDLSSVSPSAADDDRRSLSSFQSDGFVRTSQVGESSFDGEGPARVKRNKTQLWNEVKITCTLPSLV

SEQ ID NO: 28887 - protein, 97 aa, A.fumigatus
NCSDGIANVATAAVTRSFTLIYTLSLLTIFTRIQLNLLGRRNYLSSVISLATPPANTSTIKLEDHDDDDLTQTLGNDFETNPRYLAFRWWLLPRGWE

SEQ ID NO: 28888 - protein, 173 aa, A.fumigatus
IGQLCKTEWQEGPRTHLRYSCALTAFRGYSQADSVVWHSQLPSWVSAISDKNTLTSVLKNHITTVMTRYKGQIYAWVFCPLSHTMPAPANSCKGRRQRDLQRGRLPPRQRLLPRAGRGLCADCLRDGALCGSLGEAVHQRLQVSLWFCREMYSVLDLTITVSTRLAMAKPRGW

SEQ ID NO: 28889 - protein, 132 aa, A.fumigatus
TTEPGPCGGSVLLLAVLCNYNTAVETLFQQTLQQTRIQSHSIILTMVVLSKLVSSILFVSLVSAGVIDERQAAGINQAFTSHGKKYFGTASDQALLQKSQNEAIVRKDFGQLTPENSMKWDATERRSLGHCG

SEQ ID NO: 28890 - protein, 76 aa, A.fumigatus
PGTRARSTPGYFALYPTQCQPQLIAAKDVVNEIFNEDGSLRDSVFSRVLGEDFVRIAFETARSVDPSAKLYINDYK

SEQ ID NO: 28891 - protein, 174 aa, A.fumigatus
LFLKALKPTLVRVLRPASKDKSPWFSCLRNADPPCTALTALASSGVSEVAITELDIAGASSQDYVNVCLLIANGRVIDTNRNRSSRHAWMSPNVWESTVWGGVGQGLLALPGPLRCWFDSNYHPKARIMPSLLLSDLGSGAYDLPLMWGGWMYLGCAAGLDTIRNHPWHKTGTL

SEQ ID NO: 28892 - protein, 78 aa, A.fumigatus
  UNSURE (18),(21): Identity of amino acid sequences at the above locations are unknown.
PCSMADLPFITNRGYTGXGGXPTKGHRAVQVPSPPTRNVNCPKPVLQSSGYRAAGMVNTGYFHMPVVQTKGHVTMQGL

SEQ ID NO: 28893 - protein, 108 aa, A.fumigatus
LQRTSSTRSSTRTAPSATASSPACWARTLCGLPSRRRALWIPRRSCTSTITSKLVVLSRDVLRPGSDHHSLDSASYGKTQGMVRYVKKWLAAGIPIDGIGEHRSRSCV

SEQ ID NO: 28894 - protein, 193 aa, A.fumigatus
INMAQPQAGYWTLPIIASYLSEVNPANNPYQERIDHLWSNILNHYFPLRDGFGTEREALVKPPRRFATNVAITNVRPLGMHKVVLVEAKTFPRNTDIGWFSVYPWADVESILQSFMKKAPDTFGNVQTMYGIVAVGDRVRFYTMNSQNNTGGILTPFPVGGPQPLLSVHTDAHSIHDILTAISLEIRTGWNTY

SEQ ID NO: 28895 - protein, 374 aa, A.fumigatus
EEGVLESCLTHVDGRSLLFVASLFEDQPVLVDISSPKPIKRILPSAPFRPPPSASEEVDPAMAAKQAAQDAKHSTCVTIFSAFGNHIIAGTSKGWINIIETQTCTTIHSTRLCYGVVILLRLASNGRDLLINSSDRVIRTIIMPDLSQLGIDLEPANIKLQVEHKFQDVVTRLSWKHVTFSSTGEFVTASTFMNPDIYVWERSHGSLVKILEGPREELGVVEWHPSRPMVVACGLESGCIYTWSIVTPQKWSALAPDFGEVEENVEYMEREDEFDIHPAEEIHQRRLDQEDEVPDVLTIEPLKSGADGEMEAFRMPVLLDISDSESEEDIVAVGPGTMRRRSPGAGREWMNSNGDGDKESGKPGAGRGQRGRRK

SEQ ID NO: 28896 - protein, 75 aa, A.fumigatus
RKCMEKFGDGPKTYGNTPYNPTISTFSVANSYDRAPFFVQYQIHAHAETSESSHENTGTKAYPVSCALESLTVGF

SEQ ID NO: 28897 - protein, 60 aa, A.fumigatus
TLLAERLFKKSTPKFRSLPRNPFGLKTGNPPLLQFSVKHPSQGSVFSTLLFPPGTISDIF

SEQ ID NO: 28898 - protein, 663 aa, A.fumigatus
YLRRRKFPDWVVGAPGCLRLQLCSNRSPKRVDIIFSCLSDQELSLIQDTALQDKSALRFFQMSECSKRLEQPLRYKLLTAHWCSISSVSGSDESPRCQQYNIQTHCNYHPRSCRPRGPDTMSRTEHSITNGHAVSSAQNGERPNAHLPIDVFNASSVAEIKAALSHLHDQEVAVTARLDALVASQKDFSRELGRLDLLRAHLGSQTSTTHAISHGMLSDAAATADRISSAVRQLDLEQSRVKATLEVVEQVSELKACVLGVAGSMGAPQDWETAASYLNRASKVPPEVVHGTFAAEMVPTAEVPDPPNVTVDNAGVSLCGLFVRELDKAVKENDGAKITRFFKIFPLIGRSEVGLDVYGRYVCQGVASRARANLNASTGGAQSKDGFLYANALTKLFEHIAQLIDGHGGLVERHYGPRKMTRVIERLQLEADLQGGIILDTWSDERHIDRKLTDIKSYAFTFLVQSFLPAQRSATPRSNSPATRDGLPAEDEGVDMKEIDGLLNEMAVMLSRWSLYCRFIAETCNVRYLTASTSLCMDVFGKLTLCKATEDESQKFTPPKFLQEASLSKKITDRLINPFNTMTTFFFRRSVEKAFQLDEQPSGLTLHPQKPLKADPPHITSAVDDIMYMVHQVLQQFLAPSQISVVTNVVPTLGRVLDRTSSE

SEQ ID NO: 28899 - protein, 183 aa, A.fumigatus
  UNSURE (177): Identity of amino acid sequences at the above locations are unknown.
WQVGAGISTSAGIPDFRSPDTGLYSNLAFLDLPEPEDVFDISYFRENPRPFYALARELAPGRYRPTIAHSFVKLLHDKGLLLKHFTQNIDCLERLAGVPGEKIVEAHGSFASQHCIDCKAAYPGPQMKEAIAKGEVPHCPHCNGFVKPDIVFFGEALPEGIPCKPKSAKNKQIYVLXMGDQSH

SEQ ID NO: 28900 - protein, 255 aa, A.fumigatus
CQVTGPGVPSLRTSSSPSAFPSLLDPSIWIETFLCIIMTMSKARGLARVSSMANFRTDATGSTVDNASPAPSPSLPAESLRPSTTTIAWTMMSLCLSVLLSALDLTIVTPAIPTIVGAFKTAAGYIWVGSAYTLAYAAITPVWGSVSDIWGRKPIMLIAVAVFLVGSLVCALARNMDALIAGRALQGLGGSGMGIMVNIVVSDMFSLRDRGLYLAITSLVWAVGSAIGPVLGGVFTTRLSWRWCFWINCEAFHLT

SEQ ID NO: 28901 - protein, 281 aa, A.fumigatus
  UNSURE (275),(277): Identity of amino acid sequences at the above locations are unknown.
AYSINRLVPVGAVSFLVLLFFMRVPSPRTPIAAGLKVIDWTGSLLIVGGALMVLLALEFGDVGYSLSSATVICLGSFGTAVMALFVVNEWKMARTPLSHFAVHLPDKIAPYVAFHVIIPGYGQAYYLPLYAQSVLTASALTSGLYLLPLIVSCSLAAAAAGILMQQTGKYLSVMYVAQGFLVLGSGLLISLEFEASITKLVIFQILVGFGVGMNIEAPILAAQAATSVLDTAAVTATMGFVRSLSTAISVVVGGVVFQNEMSSPRGGSINSCRYXNXPRAL

SEQ ID NO: 28902 - protein, 74 aa, A.fumigatus
VTSKTGAPSRRSMPVMLMAIAGLEKDITGPGMTPLRPSLLENMQVLLRLVLKVSAGILDAKAIEDSPNFSTEPA

SEQ ID NO: 28903 - protein, 368 aa, A.fumigatus
LSLIDPSSNRHLMIPFARNPHFVGRQKEIQEIEDSIYAPDGLKKLAITGLGGVGKTQIALELAYRMRDREPECSIFWIPCTSYEAVEQAYISIAQMVGLHTVEPGEMKERLQTYFSQTDEKWILIFDNADEMAMWVKGSPAAPSLKNIIPRSENGHVLFTSRNRQLALKLAASNVVSVPDVDQNIAKEIFRKLLIRKDLLQDDYVTSALLEQLAFLPLAISQAAACINQNDISLARYMSLLGEQEASTMELLGGEFEDDGRYAGIQNTVATTWLISFLQIQQVDEVAGDYLSFMACINPRDIPESILPPTTSTKRKVEALGLLKAYSFVNAQVNDSILSLHRLVHLATRNWLRNTDSSPRDDRPALMY

SEQ ID NO: 28904 - protein, 319 aa, A.fumigatus
IEYTYGMVVTTLAAVEDSNPDIYVRIDGDMDPIKPGDDVEPNLAAVPPKPITSKLRTAIKHLRARAGPWSRFRGMSMFLTYLFARGFLLSMMPFELDQFVFQFIFQMVVGVLLANLQLAWVHIVISEPSPKRFYQRIPGYQAWLKIAPVVAFEHAVAGLAFYVPLIVMNAYGLLEKLASAPDDGVPPAETVRQALTVVALPSLLSLIASIPARVVFIRVAASMLPEEDESIVPFDRSFGGKVAPAILGGSGKLSITDAWKTFDRAAARIRFLKVVGKVMALESGVFVFFSLALAGEIYMGAEALMKIIADMIARSGGSA

SEQ ID NO: 28905 - protein, 289 aa, A.fumigatus
  UNSURE (83): Identity of amino acid sequences at the above locations are unknown.
LYLSADASTPCGEDTTSHPDYIRFYNSLWLVANDVIIGIALGSYIIDNANWVAFQINSVLTGWTVKGLQRTISWLMDWPAGLXLNNELAAFLGDLFLWVIENWAGMHFLLLDLLFSFANFGAACIANLQPYLPHVIYVVGCSSFAGASMPIALFSDLVSILTVHIYSFYVASARIFNWQLTIIISLFHLFRGKKRNVLRHRIYSCDYDLDQLLLGTILFTVLFFLLPTVIVFYLTFASARMLIISLKAALDTCLAFLNHFPLFALMLRVKDSRRLPSMLVLLICLISSH

SEQ ID NO: 28906 - protein, 81 aa, A.fumigatus
LFTGRFVPPIHRRNLYSMQYSMLPAHRAGMAEVWSLLTQPRKTSSGSSGSSSMGGVTAANGLVRIPSGFGQGDVRRRGYRY

SEQ ID NO: 28907 - protein, 60 aa, A.fumigatus
NTLPDLTSSAGTNHIKAILYKSLGIDSRTILALAAVYGTVAFLTNCLTTKYLTDQWGRRK

SEQ ID NO: 28908 - protein, 73 aa, A.fumigatus
SNGASGRVAFHCQCSRSVPSTLPAGYMAMELRLSECAVTEAGPSAFANIHENYYYVFVACTAFFFVVAYFYFP

SEQ ID NO: 28909 - protein, 62 aa, A.fumigatus
ANPHLRHRMILTGLGGIILIEIYAAVMQREFQNTNNRVGKGFAILGIYMFVVIYCTSFLSLS

SEQ ID NO: 28910 - protein, 98 aa, A.fumigatus
GSLEPCYFEPVGSFQPRGEDVIMFAGLVTFMPNSPRHLIRKGKIEQARSEFVRIRRDLRSDDVHREFELMLAQIKYEKEREITSYREIFRLFRHRVLV

SEQ ID NO: 28911 - protein, 64 aa, A.fumigatus
CTASETKQKTLEEIAASFGDKVILPEDQGDQQGENDEDEDEDVKKVKPNSQQIEVAVAGRDGSV

SEQ ID NO: 28912 - protein, 67 aa, A.fumigatus
YVLTLVPRTHAPSSLVVGVLRKKTKYPPPKARPLPIRIAQLLLQTEKKGAKAISYFLLVQLPRSNGS

SEQ ID NO: 28913 - protein, 85 aa, A.fumigatus
QRHCKLASDTTLDNNLGWSLPQGVCAAADDEDGDEAASAVMTTMTTWPVETDYPSDYLSSWSLWAGLTPITTTTAAAATITISGL

SEQ ID NO: 28914 - protein, 87 aa, A.fumigatus
DLVYGTFFIENLTKLLWDYWSYLGTLGTFILDGSEVGIMGTYYCYLAGYGLLTILFYGVFTHGFTDPLQHSLFSRLSGASHRARTAS

SEQ ID NO: 28915 - protein, 72 aa, A.fumigatus
STGKWTIQNTDSLTLYAFAKYVQNALGNIYPHLPLAPPPPTSATILFKIGDLFTLYNKGTVNWPQTPPSTTT

SEQ ID NO: 28916 - protein, 121 aa, A.fumigatus
LTAFIDIVPIVMAGIIGIYGLVVSVLIANDLGQSVPLYTGFIQLGAGLAVGLAGMAAGYVPPSRTPSSNSVSNQLTLVSCSFAIGIVGDAGVRGTAQQPRLYVGMISILIFAEVLGEYHDM

SEQ ID NO: 28917 - protein, 131 aa, A.fumigatus
PFFGALGCTSAIVFTCFGAAYGTAKAGVGVCGMAVLRPDLIVKSMFTASYRFGRPDDVLTDGFHRYRSHCHGWYHWYLWTGRIRLDRKRLGSERSVVHRVHSVGCRPGRRSRRYGSWVCSTITNSLLKFCE

SEQ ID NO: 28918 - protein, 83 aa, A.fumigatus
YLSDIMAPMSIADLVAALPAEDTWGPATPSDNMLDGVPYAPFSKGDKLGRMADWTGDGNDRDRSGRQAYNRNYRGEPNRPARR

SEQ ID NO: 28919 - protein, 504 aa, A.fumigatus
DLLIGLRNVMMASPNSLSSAYTSGLRRQPSLRQMSTLSRSNSRHTSPALDYHTTSRNEGVSISRQYSAGDSSDDEVPEPKFSASVKALLDEDGLGSSPHLKYSSNERPSSTERAMSAATSQSRQSRTSSPLDRSTGSPAPRVVRIAPALANNNRHAREGSPLAQSESAGSSANYSSKELITPAPRPRSVRITGSRSHTRSPTSESPSQKRSADRSSVHEHSSAERSENGRTVNYEDDYAPRFSTASVLRSRHGDDVGMQSSLRVKRVGRLTGTFLNGPARRGVLRRQSEENHDPQSYSAERHRESSLDPNDDNAEYRYNAKTRTSSSPKVTWADPSPSQEAERPRAYDPASASSGEGPFSRSSSPRSSGSHSKSTPGSASEMSSKPSSAHEEPVFKVPPLPQLPATRDQENEPPPTFKRDKPHGLSLLSKPEKLSVVYGDDKKDNEETPAGHSPRKILATRSSNTPHRPAPHPPKMSMLETATATGGAATACPCLHAKAGRKRV

SEQ ID NO: 28920 - protein, 72 aa, A.fumigatus
MSDLPTVLPYQLDDDGLLYMTKHRLISEGITEEPWIYIPRPLAKDMFRLIHDKWNHQGIDKCLASLNGFTLY

SEQ ID NO: 28921 - protein, 78 aa, A.fumigatus
GRCILCQYIEHYPVCLQNKIRHYKLYRSLQPLQVPPALFKIITIDFIVGLPDDNGYDQLLVIINKFSKRVSLIPGKST

SEQ ID NO: 28922 - protein, 84 aa, A.fumigatus
KGYFTVLKARWLYSAAFHPQTNGQTERVIQVIKVMLRHSYTTAEQPDLFRWTIDLPSIISTINGSLNESTNATPHQLLFSINLC

SEQ ID NO: 28923 - protein, 182 aa, A.fumigatus
LDAEESIKYTSIRMKEIYDRNHKPIKFRVGDQVYVRLYRGYSLPTKQANYKLQLQNAGPFRVLERVGRLAYYIKLPSTWKIHPVLSVAHLEPAPATPDPFHHELPKPPAVIDAEVYPGEDDIYKVKRLLDKRTVQRGRKHTPYVEYLVRWKGYGPEDDQWVHKDDLQGSLKLIEAFEHNRPM

SEQ ID NO: 28924 - protein, 296 aa, A.fumigatus
  UNSURE (28),(91),(154): Identity of amino acid sequences at the above locations are unknown.
YPTNHFLYKGTLAVNRLDFKYHPVAMAXIFKSLALVSALFAAISSAAPVNLDKREVDVVWTTVTTVVWTTIDVTTTIYPTPQAPTPPVVEXTPTPTPSAAPEQAEPIETSTQPETTKSQPTQPSVGTFIPVAAAAAAAADSAAPIPEEPAPQPXTTAAPSTSTTTQAAPSAPPAANSGSTEKAASSGYSGPCSKGSPCVGQLTYYDTATSASAPSSCGLTNDGFSENVVALPVGIMTDADCGKTVTITYNGITKTATVVDKCMGCKPTDLDASRHLFGELADFSAGRIDGMSWYFN

SEQ ID NO: 28925 - protein, 131 aa, A.fumigatus
VALFSARLAPVLSKLSGPAAEVKSICLTMVSAGLDTVPGNLIMGIAYLASEAGQRIQQKAYEEILKVYPNGDAWEKCLVEEKVPYITALVKETLRFWTVIPICLPRESTKDIVYNGATIPAGTTFFMVSRY

SEQ ID NO: 28926 - protein, 64 aa, A.fumigatus
KTNREAEGFRVRRDKYLTFLLDMLKERIAKGTDKPCITGNILKDPEAKLNEGKWPCSRLDWRRC

SEQ ID NO: 28927 - protein, 72 aa, A.fumigatus
FRPRAESPHFPSAFVFRPPPRPLESLHHFYNIILFTTMDHTQTPLVPDSWPNARDEDARPRKRRLKYITKAW

SEQ ID NO: 28928 - protein, 68 aa, A.fumigatus
ASGYHGPPPTIRTNSPRSNECKRRKIKCNGQSPCQRCGRQQIECVYAGRTRPPDSSDQQYVHALIHSI

SEQ ID NO: 28929 - protein, 124 aa, A.fumigatus
NAYAADYDDEHFKMPDKFIPERYLDVSEGSGTPHYGYGAGSRMCAGSHLANRELYTAYIRLITAFTMHPARDPADQPILDAIECNAIPTALTTEPKPFKVGFKPRDASKLQQWIAESDERTKEL

SEQ ID NO: 28930 - protein, 120 aa, A.fumigatus
VEGSAYLLNFPFQPASTFDTEGAFSSPSPFFITYSDKLLDSTSPQPTIDATTLDLLSPHSTHASLIKHAFSPSGQKARPLRFDVNGRKGRRAICVLYGDGLRYEVLDMDAELADEDEESE

SEQ ID NO: 28931 - protein, 66 aa, A.fumigatus
SVDPCGEDHRQWLQAGAGVTSYSKPEREFAETCEKLESVAPFVIPQRDSLGLKSRVRRAHLRSQRC

SEQ ID NO: 28932 - protein, 167 aa, A.fumigatus
YKYLRIRRLLKGEDSGRHLKMKTLSSTAFISLLAFTTAAEAIFDNVTVFAPPSNWPSHRTSYGRTLLLDHTKTDPVLLSTWSFSPPDGTYLPIYRSTDGGQTWSDFSKVHFSNNGGYVGGSIWQPFLYELPRQVGQYPRGTILASGNAIPHDFSSTNIEVYASLDRG

SEQ ID NO: 28933 - protein, 234 aa, A.fumigatus
RFSWEFVSVVATGGPPNTTNGATPVWEPFISMYEDELTVYYSDQRDPLHGQKLAHQSTRDLVHWGPVVNDAAYANYTLRPGMTTVARIGNGKYLLSYELGNAPDVPYAVHYRIADNPLKFDEATPYLLQSRDGTIPSACPYTVWTPVGGPHGTIVMSDGTYSEVFINRDNGNPHAWIKVPTGKGVAYSRALTVMPDPSVILFFNGGLYGENNTTVTAGEWIVPRHQRSARQVAR

SEQ ID NO: 28934 - protein, 78 aa, A.fumigatus
APCPLKIPRGITNDNSSSAHALHAGWNSRNSNSVRTRTIAAALYNMSSQTSQIIGSNIYHDCECGQIPSMRALCSLAN

SEQ ID NO: 28935 - protein, 78 aa, A.fumigatus
ASTFVKIADAPRYIAGNRTLLIIICTNIVLYALTKLYYVMQNRRRDMKWQAMTEDQRVDYVATTQDQGNRRLDFRFAH

SEQ ID NO: 28936 - protein, 67 aa, A.fumigatus
  UNSURE (4): Identity of amino acid sequences at the above locations are unknown.
GPLXQGFCYTAASFADILAGFLAFGILHLRGVGGHAGWRWLFLIEVCTRPSPFVLMLIIYTNRGCSH

SEQ ID NO: 28937 - protein, 104 aa, A.fumigatus
DPSKGTMHNRQPLTLKLIWQSFKDYHIWPLYIIRLLFLIPSSEYNTRFDGLYLPPKSANANSNNIAILYLAVERFWIQHFPYHSAIHSMHVTQFRKQPQIFAEY

SEQ ID NO: 28938 - protein, 213 aa, A.fumigatus
LIRSNISPLIAEQYREEVPYIKTLKNGNRVIVDPAATISRIYLYFYMMINIGSILGQVSMVYAEKYVGFWLSYFLPTVMYLGCPIVLFFCRNKYHLVKPTGSVYTQAIRLWKLAMKGRWSLNPARMYVSPFAVVCWWHFTDPRSWKKNPKPFWDSVKPSALGRDRPQWMTFDDEWVDEVSRGLKACKVFLWYPLYCTLVSLTRQSRRSSPTLI

SEQ ID NO: 28939 - protein, 66 aa, A.fumigatus
RVGLAYNQMINNLTSQAATMRLGGVPNDIINNLNPLSLIIFIPIMDKLIYPGLRRMGHQVQPTQAH

SEQ ID NO: 28940 - protein, 147 aa, A.fumigatus
STGLFLLLIPLLLHSPVSVEQFRCICLCFFIFVAMNVSDPVEVAEVARARASAQDAQIDEKTDHKLSLTPSIEEVPPASKEAGVSSAAYEDDHSHLQRQFPSDDDFKHLRRIAGDIPWTAYTVAFVELCERFSYYGTTAVCMCSDLH

SEQ ID NO: 28941 - protein, 78 aa, A.fumigatus
PMVVNAFWSYVMPLAGAYMADQYWGRFRTIMFSIAAALLGHIILIVSALPPVIAHPNGAIACFSIGLLIMGVGTGGFK

SEQ ID NO: 28942 - protein, 103 aa, A.fumigatus
FGKGPNHAVTTACTTGAHSIGDAARFITCGDADVMLAGGAESCIHPLAIGGFARARSLATDFNDAPEKASRPFDADRKGFVVGEGAAMLVLEVGGFFGDINWC

SEQ ID NO: 28943 - protein, 61 aa, A.fumigatus
LLSSLPDFGVLVLRVMDLAWQDERKMARFAQYAMAASEEALEDACWKPTSFEEREATVRDC

SEQ ID NO: 28944 - protein, 81 aa, A.fumigatus
QCLVQGYRKVSPLFVPKLLINLGAGHLSMRYGFMVSYQPGSITELDADLGRAPIMPSRRPARPERIRLVMQLVLSRVVMRT

SEQ ID NO: 28945 - protein, 212 aa, A.fumigatus
HLQCDEIKPTCGNCALRGEPCDWPAETDSQGHCTPRPQTDSLRAKAPKDQSKRWAPHPDTASPRPLQFDIASDAAGGRSTLLPGELNMVDLQLYSQFMLHTSKHMTLNLRRQHIWQTVIPRFAMRSEALMHLLLALAGLDYAAAGTADEHLGLVSPDIQSQPSPAHGDHDHRHRHNDTLDATYLRIIIEHHQRGLEAFRTEVFTTGLEGSAH

SEQ ID NO: 28946 - protein, 178 aa, A.fumigatus
HQSQTEALMVLYLAGGHDEECFETASTAHLRPLTSITVLVVMQAVLLLAGIALLASFTPATLASQHVLGLEAASGVNNDMVITGVYKDEKIKHPMIIIHDINGKIVWNWSVSDVGETVPHELLTCIATHRAATEVKFAAKGSKVTAIIGSAALVINYPGKQVLSGICLHHPGLEGIAL

SEQ ID NO: 28947 - protein, 288 aa, A.fumigatus
FSSYLKVSNFASFHSLYSSTCAEYHLSALANGALLATAPVNRALPNAPDGYTPQGETCPSKRPSIRNATALSSAETSWLKARRNNTKDALKAFLSGVDLGSFNGSDYIANHSANASALPNIGIAVSGGGYRALMNGGGALQAFDNRTTNSTHSGQLGGILQSATYLSGLSGGSWLVGSIYMNNFSDVSSLQDNGSVWQFQDSIFSGPTQSTTWDIGTVEYYSQLLGAVDGKSNAGYEVSITDYWYVFCSPAPWREKGILTIHTGDVLSLTSSSTRPKVASVIPGRRLL

SEQ ID NO: 28948 - protein, 277 aa, A.fumigatus
FLGCIVAARQWFCVAVSGFYLQWSDSEHHMGYRHGGVLFSAVGCGGREIECRLRGLYHRLLVCFLFPCPLERERNTHYTHRGRSLSYQLINASEGGVGYTWSSIALSKDFQAGTMPMPLVIADGRAPGEILVPANTTVFEFNPWEFGSWDRSLSAFVSLEFLGSNFSKGTLATGEKCVRGFDNAGFIMGTSSSLFNQAFLQMNNTDAPSVVKDAISAILGKIGSENNDIAVYKPNPFYRYASQSKYTSSPSLTLVDGGEDLQNIPYSPRGQKIRASV

SEQ ID NO: 28949 - protein, 75 aa, A.fumigatus
RNCEISKIQNCRNLKLNNFKLPPLVDKFKVFFPPKPFPLDFKWVKTSDTLPSLLLFGPGPFEGTDRPLCHPRFNK

SEQ ID NO: 28950 - protein, 63 aa, A.fumigatus
  UNSURE (50): Identity of amino acid sequences at the above locations are unknown.
PADTLRIVSELKDRMVKIWDPRTGKCERTFTGHSGPVTCIGLGDSRFATXNEDCKVRMYSFQT

SEQ ID NO: 28951 - protein, 134 aa, A.fumigatus
TKQFSNAGTQLLSGYETATRPPRHHQLSPPYPPPPHLPPLPPPSSPLHPQRLPRLPRPRARRHSLNTNRLRSHLHPPPLHRPRSPLSPLHPAIPPPQARAAPLLFPHPGRAPPNRRRDSSPTDRRPSAPAKQCT

SEQ ID NO: 28952 - protein, 153 aa, A.fumigatus
LPSSTVRPREPELNNFQMQALNFSPDTRQLPVLLATTNSPLPILLLLTCLPSLLLAAHYIRKDYHAFLALGPGGTPSTPTGYARICILRLFTVRDPLSPPSTPPSLHPKHGQLPSSFPTRAGPRPTVAGIAPPQTDDPARQQNNVRDAVEPDP

SEQ ID NO: 28953 - protein, 90 aa, A.fumigatus
  UNSURE (52): Identity of amino acid sequences at the above locations are unknown.
VMLVNGLKGSRHFENKYIQFTGVRNSVVKTRSLLCGEQYFQNTQGIIFVVDXNDRDRIVETREDLQRMLNEDELRDALLLVFANKQDLPV

SEQ ID NO: 28954 - protein, 75 aa, A.fumigatus
WLGDQGRQRHLAYKRDLLLGGICMFSNGSSFLYAISFYFFFRPGVDSNKYSFVPLKNHFFICCSCPRELRLARRL

SEQ ID NO: 28955 - protein, 171 aa, A.fumigatus
TDGELLSKVSIGVCACRCRCWNLTKCSPQSGPKKSPILSKIPIPTHENIYTVPNILTFSRLVAAPLVGYFLVHDHHAAALSLFVYAGLTDLVDGYIARRYNLQTVVGTIIDPMADKLLMTIGVACLAVNGSIPGGSPRPSNDADLVVSSNIEQGDLPYFLGVTDWEQYGLP

SEQ ID NO: 28956 - protein, 92 aa, A.fumigatus
LGTVWLAVIILGRDVGLALSAIYYRWISLPPPKTMARYWDFSLPSAEVKPTGISKVNTALQLVLVGSAIALPVIPEAVLDAWNLQDGMTALQ

SEQ ID NO: 28957 - protein, 73 aa, A.fumigatus
VKGPLILTRLKGIKLGLQFRSKVLIAAFTRSVRDPFVHARNAGLLALAATIEFFNEEDCAGKILPRYLSLFAR

SEQ ID NO: 28958 - protein, 264 aa, A.fumigatus
LLALTEYPMLVRDQANKTLDLYLQRIRNFSSSMADTAITATASAETPKDAARIGTSNDKSWAGWAISSFTNKLATANGEIQPSTGTSKLAETEATRSVSVPRPTQSSHPTQLDLPKKELRAEAQPLGRSLSDQPVSTSITANGTDDVYEAWGAVDDDEEENGLKDDDPFSAPVVTSSPVPKSATVPFDDGGEPDFAGWLAAQSKAKAKKPLPKGLSKPAATTTGTRNSGHTNLSKPKTVVAPTKKIDTKPKDEGEDDGWGDAWD

SEQ ID NO: 28959 - protein, 81 aa, A.fumigatus
TAASGGCTFTNTIVDIFVILLLVCRRGNLSLIFQPRTWTLPTAWLGISLGLLMSHEGFWWEFAYAAGGMSNCPCSVLPVSG

SEQ ID NO: 28960 - protein, 61 aa, A.fumigatus
QLARQLKYPQPNQDRLIQRIAPNYLYISSRAEEHDAVCSTAQPPTVNTSQGNQHGWACHIP

SEQ ID NO: 28961 - protein, 86 aa, A.fumigatus
  UNSURE (76),(81),(84): Identity of amino acid sequences at the above locations are unknown.
SCLPIMSTRSRSRSSSYAVHDFMHYDLNTNILRHVFMNHAVLLDNNESPHVDDYQACHAFRSNTLYFWKLMGYGQXKKRTXHLXIP

SEQ ID NO: 28962 - protein, 129 aa, A.fumigatus
FSPEEFLATSVLRNPKAQEKLKLWLSAARSAYVLNFKFARRPKIWMLSGLYLLEDACTMVSRHSSSKISAGVSGSLVGALSSVPVGGFLNLGEGNSWEMTMELTEQHVWAAQYRLLDARFIKVDKRAPY

SEQ ID NO: 28963 - protein, 156 aa, A.fumigatus
GAYARVTGPGKILGTTGCKTLYPRITEVCAPYSLVQSSFNFLDSQEALQEHAYVSNVSNVIFHGRSRLTPGISLSGGDIIDLTLAWNKDSERIVVAKKGVRIILKEYVFWPIHGIHYASSSHDLVLKNSWQRLSCATPRRRRSSNYGCPPLGAPTS

SEQ ID NO: 28964 - protein, 74 aa, A.fumigatus
RATRGSFQPRGEDSCDPQLASLFSAFTAFNQAGSMLRDYSIRICVCTMEQAARKQRVQLSIQLSRQHGEPHDHA

SEQ ID NO: 28965 - protein, 701 aa, A.fumigatus
WGFSHAGCLIVKVVDHKSVSAQARKSTAPSTNGNNTPFSIHNYNEHITPSAYVPYPEQNQLTSEATVTKTDAATGSQSDENGKVEQTGDSDSSNKENESDALQKQTPAKPRVFTTVLHPTPRSLQAELTLLATTPDPRAAKQSATHSSTRPQPTSSSTAPQSPVVASNPPDRGHVAKRQKMLVEPQDLLECESKLTRALAPPLFLDPVNSLEAAQDLLKYLESPLHCAPPPSPKRRKRTVAELAADEALAAEEERFMLIMDERLEPATSGAAGGPKSAVDDTGGGAPFEPRFSRFKTLENIRMQHEEKAKREHEIKVKQEMAKRQQQEQERERRRLLEQRQAEEHAKEEARRQHLAAQQAQAQLAAQQQNRHVMTQANGVSQAPQSSPVVRNQTPLNASSPLVGNTMVTQAGVPMSMTSSAQGAGSPQRPPSALQHGHPNMMSHPMAPSRSQQGQSRHGTPQMTQGTPAMSHATPIMRNVTPTQRLSHGSPSQSTMAPTPVMSPGHDEHPADGRRYGSYAATTANDTAKAAVARATRTTRTRSVHTAAACSITSERTCSAKYPVAPAADDASSAAEPSGAATEAGESANVSSFTAAKPVDPDADGSAAAADARPTATGSTIPGPSGQPANDSSTTAADDDGGSCSGQCWTHAAEFPGRQYGAAVQPTLPTAPFASPAGDVYSVYGSIWAPNAISASYCTAV

SEQ ID NO: 28966 - protein, 253 aa, A.fumigatus
AQAMMNTPQMGGGMGLTPQQQQMILQRQQLLAQHGQLGPAQFTPQQLAQLQANAHAQQNIQSHQQQMMQAQQQNHQAQQQKLGNQQTYQASLLRNQWTQMQMAQQQQQTQGQQPQAQQSQVHQGSPQMTPQQQQQMMMAAAAQANAGHMPQNFQGVNMAQRYSQLYQQRLLRLRQEMSTRFMAQYGPPTQYPPHIAQQYSIGLERSAKAWVQEIIRREREAAQQQRASQVAAVQAQVMQQQQQQNMMHNAMGK

SEQ ID NO: 28967 - protein, 188 aa, A.fumigatus
ARDGQATATGTRKREASAVGAASSRGACQGGSSKATSGRATGPGTACCTAAESTCHDTGKRGQPGSPIVTSGSKSDTPQRLVTAGWQYDGHTSRCSHEHDIFCAGCRKPTATPVGLTARPSEYDEPSNGALEEPAGSESARHSSDDSGNTGHVSCNSDHAQRYTYSAPEPWQPKPVDHGSNTGNEPRP

SEQ ID NO: 28968 - protein, 315 aa, A.fumigatus
DAKPLAEPLWKQLTHTGAYWVFVSPKFAKVANKRQFPALTYVWNGVKYASYAQIISSSLQMLAHAATGAYQQINGTKAMGAVDTLNPAIAHTLLNPIAASSIDIKPTNQGVRFYYNTVSMVMPILQQFFFIMALNGLTAEFGVVLRTMSLRGSIVLRLTLSVLYTFIAALCMTGYIWGFREAWAVTGGQFALTWMAIWLVMHLNFLLIDAVTSVLPMKFMPFAILTWIIINVSSTIGPFDLSPGFYRLGYALPAYELYQLLLDIWTEGCNPPLYRELPILFAWWVVGFVAFLAGMRKRVLAARAGYVETRRTDKA

SEQ ID NO: 28969 - protein, 239 aa, A.fumigatus
MSRRPLWMMMAARDAPARRAARRTMDEASSRIAWTSTWLTFSTDNVSWMNLLEPSTSLASTNASPDRKGQSMPPGWNTLEISSAFMSNTSIRSSWTIASRRSSPRYKPDTLFSNICEPGSTDAASRASSNGVRGKTSILLSRQPHSVFITMISSSRALTPSRRTSASFSTYAALVPVPTMTAPSVETCWPELYARVKSVPTLSFARTVTTTGSPSSSMASCNITHGSRPTASGISQPLS

SEQ ID NO: 28970 - protein, 86 aa, A.fumigatus
STQMPAQLYLIDVFGSQAAASALGANNLLRYIFSTFLPLAGPSMYEALNYGWGNTLLGFLALAFVPGPLLFYRYGEHLRARTSVTL

SEQ ID NO: 28971 - protein, 359 aa, A.fumigatus
DKGWDIPDAVGRDPCVMLQEAIDELGLPVVVTVLANDSVGTLLTRAYSSGQQVSTLGAVIVGTGTNAAYVEKLADVRRLGVKAREDEIMVMNTEWGCLDNKMEVLPRTPFDDALDAASVDPGSQMFEKRVSGLYLGELLRLAIVQLLRIDVFDMKAEEISKVFQPGGIDCPFLSGLALVDANDVDGSSRFIQDTLSVENVSQVDVQAIRLLASSIVRRAARLAGASLAAIIIQSGRLDIQYQHSKQTASLPIGRTNRFEHTVTPRWRRLLSRLRLSSLPSRHLPRHTHLPTCLDEDIIDIGADGSLIEFYPDFEAEMRGAMRDVPEIGEAGEQRIRIGLAKDGSGVGAALMAQAACQSE

SEQ ID NO: 28972 - protein, 210 aa, A.fumigatus
VGGADGFVGIALAQAYANLTVFVQDSINLKKEADAKIPPALKSRVFFQPHSFFEPQSRLAGMADVLLLRHILHDWDDNDCLVILRHLAAVLQPGASIIVAEQVLGQSGTYDWQTERVMRALDMQVMTPFGSKERTFDDWETLFPGGRSDIASGRNGSACGKCGHTDGVEESCLIRFILRICLVTSMLFIPFRRKTVSLENSDLLSIPTSN

SEQ ID NO: 28973 - protein, 115 aa, A.fumigatus
  UNSURE (110): Identity of amino acid sequences at the above locations are unknown.
SVHSIHFTMKPQTAAFLLSLLGSTLAAPIQHADKGSDVKPTPTGRGAPGGFFTGFPSGVPSGLPSGFPGGPVPGGFGGDGPNGPIPSGPVPTGAAPSGFLSFGTGPAPFXTRRPK

SEQ ID NO: 28974 - protein, 230 aa, A.fumigatus
  UNSURE (104): Identity of amino acid sequences at the above locations are unknown.
STREAGFTKPQESDTAAYAKYDNDLFQTGRLVTCGLYVNIILKDYVRTILNINRTDSIWSLDPRSEMKDGLLGRAAAQATGNQVAAEFNLVYRWHSCISQRDQXWTEDMYQELFPGQDPSKISLQDFLRGLGRWEAKLPGEPRERPFAGLQRKADGSYDDNDLVKIFEESVEDCAGAFGALHVPTVFRSIEALGIQQARSWNLATLNEFRKYLNFAPYHQPRGRRTAHAL

SEQ ID NO: 28975 - protein, 238 aa, A.fumigatus
  UNSURE (58),(113),(121): Identity of amino acid sequences at the above locations are unknown.
ILAGQGLSPCLPRLYASSFSVSSRLALTNLIAAIPDHWANLYSCPNSSTNVFTCGYAXWATDVCSANLGQWLWVSGDVEVAKNGNTSPSASASASTVLDIVTTTSSGSGLSTXTPRGTITXEIVTTTESATATGSGTGTETSSPRPVNTSISARTLRAGTRGLEPGVPLLVVSGLLIFFMRMRRRAPAAPAPPVSEKVYPGAVYDPGAAEIATQRHNMVTELEGSGRNLPDRPELYGS

SEQ ID NO: 28976 - protein, 120 aa, A.fumigatus
INVFKEFPRHISHPRTSNAVSSSTMSLSAICLMLLVTLTPVTATCYWPNGDTDNNYTPCPNSKSCCLKGEACLSNGLCYGAKLNIAYRGACSDKSWPAKDCPHVCLDCTRLRSPFPAVWL

SEQ ID NO: 28977 - protein, 303 aa, A.fumigatus
NPFIMRRHGRAGGGTKAVTPVSDTVSLIHSFDSVTNPNRPARPSPLASSHIQALPLDLIDRLRSFPLFQSTPESFLVEVAQHLRPQLSAPNDYILTEGDEAKAIYWLVRGAVSATSRDGESIYADLEPGAFFGEIGVLMDRPRTATIIARTRCLLVVLSKEDFRNILPRFPEVEQAIRDEAQERLMILEKKKKETSTPSADLTSPVRRGSKRLRDSSSGDLSPIEREGTSLKAGNKKRKSPSPGVGVADASSSALANGSVNVRLLLKELPLFSSLPPDILHFLGLNAQPRSYPPFPDIIRPES

SEQ ID NO: 28978 - protein, 205 aa, A.fumigatus
  UNSURE (77),(98): Identity of amino acid sequences at the above locations are unknown.
SCFRIAGYKTTETSLSALFYRLLSTPGVLKKLQSELFRNFPSIDEITGKKLLSLPYLNGCVNESLRLTPPVAGKFAXRRSPGAIIERFYVPKGTKVFXETYTMQRSPQYWHAPDEYRPERWVERGEGSPYAQDVHEAFKPFSSGPRACLGREMALQTLRLTTALLVYRFHMKIVDEKRFVWEQDTDSRMIYSQYQIKAILQDRLT

SEQ ID NO: 28979 - protein, 182 aa, A.fumigatus
YCVNTGYAGCSVLSIIRKMREISQYQTPGHWLDMDMLEIGDGEMTLYQQQTHFAFWAALKSPLIIGADLSKLSDESVAVLKNKDIIAVNQDSLGQAVHYIESASKEGAWQVWAGPVNGGFVVLLLNEKSYPQALSVSFADLRLGLDGPVQVTELWSHKSLGKVDGYKGVLQPYQTLVFRLRF

SEQ ID NO: 28980 - protein, 89 aa, A.fumigatus
ATSLASTAPFLMSATSPGVDSTKYLKRRPGDFVHPGIWHTHEDLERIRTNVISKKDPWASAYEKFSADEYSQANSRLPRPRAGRYRARK

SEQ ID NO: 28981 - protein, 109 aa, A.fumigatus
  UNSURE (40): Identity of amino acid sequences at the above locations are unknown.
DRYSPELQQRIRDLAKYPMNKHEVCEVWTEILKFHFPISXIGKPGNNEYATQATPGNVFPFVQLSVRPQLSTFENHPVPCFPTAETSPETRHKDRPSPPVAKDRLNIAA

SEQ ID NO: 28982 - protein, 84 aa, A.fumigatus
TRQNMILALHSSHFDGCSPVFLCREQPSLGQLGQWLSFYAYLRTPGSGYAKTLREYHGWLATPPCQSSHGAVYDETVYSYKGSR

SEQ ID NO: 28983 - protein, 82 aa, A.fumigatus
PLCADFRLCGEDCNPIGNTGARALAKWLQQNQTLQRLSLQSVGLTDDGATALISSLRGHPALETLDISQSYSTQDLNARYVF

SEQ ID NO: 28984 - protein, 75 aa, A.fumigatus
IATPFQQLLPTFYQQDVAYHYGANKPSTCISHEPVDIQYPCRLRCLFGHPATNARMQGDMSMQSSQLSSDQINSS

SEQ ID NO: 28985 - protein, 249 aa, A.fumigatus
SCCASSRCWVPGMGSATVHDAAISYFLGLCSAYVYNMRRCRMYLAECRTMLHVYDLCRQSTMQSSYGPTSPISSSSATSQDRLSGPTERPVDMIEQELARRLFYVTLVGYRSIQQLGSADTPIYLAPETPTERYPPLPLEVDDEFIFSTHVEPQPTNRVSQLVGFNANVRVYNSYNALSAWEVAFGSGRIVDWQRQRSLLFECLQNSKTALANVPPELSLHPHRDDSADAAEDPWMRERRHIQYEIQKA

SEQ ID NO: 28986 - protein, 287 aa, A.fumigatus
SDLYRSDLISIRTARLIHRLKCDTSGPPCRSCASLDIPCTYDRPSRRRGPPNRHAEALKRLRLGTSPSAPTANSPSPSDFSPPTLPPISTVNQNLTSASNPSSVESICPFPTARLLVDDFFTYIHPLVPIPHEPSFRVAFERREDTTNPTFLALLAAMIGTLVASFPRRPKLHLKTEAEKAAFPHSLALVKRCHEVAVQARGVGYLGWGAPQSMMLPLATFWVSARLMSTTCGDVGCTLPSAVRCCMCTIFAASRRCSHPMGQQARYLRRRPHHRIDSVDPLSAQWT

SEQ ID NO: 28987 - protein, 475 aa, A.fumigatus
MVFFPLIRQKEAMRDKRRCRVLTILVPSRPQLCRSESQQSIAASDDYYSLSDRTTTSSSRSPSGESRLTVQRYATPNSHPVSSTSSPALSRTHLGANMAGSRSQHSIPEQSRNRNVPPSGPNQARFEHGRLIPVSGMSNESIRQVPNDRYADRSPTPGTDDLPYIRFAINQLTREDEQPSLSRQSSAASVDYPPQPLVWDAALGQFTRPSKPKGSSLRPPEERLHHDCLPDRSPQNSVDPEAFVAVDPPENNLLYPPLNFVPIVLRPWALALTILSCLLMIAAVVFCNVWSQRHQGIWDYNGLGGSRYFVVQFLPQILAAIITIWTFVIQAAVYRVIPFAIMATQTLQDQVIQKLPILSRNFLLPDWSYFRHGEPLVGFALLTIWISNLIMIPLLSCFFQAKWHLIHGEGQWRWNAVLAVGWTIVAVYALLALGLMTLLIRFMRTRSGLMWDPVSLADLIPVIQRVFTTGRKYAS

SEQ ID NO: 28988 - protein, 76 aa, A.fumigatus
PFSVLRPCGEDIPYVAMRLLPAVLGVLTVPLMFLTLKASGCRTITAVLGAGVVIFGKTDTDIFDQPMVADHLQKMV

SEQ ID NO: 28989 - protein, 284 aa, A.fumigatus
LLQRLWFKHFFARVFCLIIVPLGIYCGMFAIHFLCLVNPGDGDGFMSSEFQATLNSKGMQDVPADVVFGSRVSIRHLNTQGGYLHSHAHMYPTGSKQQQITLYPHKDENNVFILENQTQPLGPFGQVEGPYAWDNITTEYIQDGAVVRLYHAMTHRRLHSHDERPPVTDVDWQFEVSAYGYEGFPGDANDLFRVEIVKSKSDGEEAKKRLRTIESKFRLVHVMTGCVLFSHKVKLPEWGFDQQEVTCARGGTLPNSLWYIESNHHPMLPEDAEKVNYRNPGFFG

SEQ ID NO: 28990 - protein, 228 aa, A.fumigatus
PSAENGLITQSRLILLDSPLVFFTALTALAFTSFTNQQELGPSHAFRGPWWFWLAATGLSLGATLSVKWVGLFTVAWVGSLTVLQLWVLWGDAQNVTPVCLRYRLDLPHSTSKLIAPALMVQTFLCPGFLSHHRSPWHLLWNVRNSFPMLGQPGRRRWIHVLGISGHIKLQGNARCSCRCCFRFTCEHSSPKHSGWLPSLPCPYVSHRKQTTADHSLSSQRREQCLHS

SEQ ID NO: 28991 - protein, 170 aa, A.fumigatus
  UNSURE (167): Identity of amino acid sequences at the above locations are unknown.
AVSILHRSACLPSSIQVASCDCGCGHSCAITSLHSIMTFLIGTPLNWAITATAGSGFLLFGYDQGVMSGLLTGHAFTRVFPEIDTTKHGSGSASLQGTVVAIYEIGCFFGAIICMILGERLGRRKCIAIGSIVLSIGAALQASAYSIPQMITGRIIAGLGNGMNTSXIRE

SEQ ID NO: 28992 - protein, 96 aa, A.fumigatus
VKTTGQYLITGCKSNSSLLLPSFPRLTRYQYIMTDMTNQLLQAEPEVEKTWMAGALLGRLSTPVEFKAPAVFLLSEGSSFMTGADLRVDGGHCASA

SEQ ID NO: 28993 - protein, 189 aa, A.fumigatus
RLTLSQNSSSKVKEITTSPSQGNLGLNSLPFSSLPHWCALHSSLHRTDWSISKQYKPCRHPIYTSQISSRAFERVWQLQVSIMPSKGCHSNSLPEARGLKYDESDMALFHAKLSYHSTIEERMASKDTNLASISEHQARILKRWEMLKQVEKEMADKGKCLSPAEKKQLAQYEWRYKRLEELATKTTGG

SEQ ID NO: 28994 - protein, 82 aa, A.fumigatus
HMPQTFNSCQGLTLDHVMLDLTMPVFAHGQLYTSLSRVRRGADICILRNPCENDKPTLSLSRPTPSHMSRPSTESRRLPYIT

SEQ ID NO: 28995 - protein, 344 aa, A.fumigatus
  UNSURE (49): Identity of amino acid sequences at the above locations are unknown.
QVRNHIHLFGGDGPNVTIAGESAGAWSVLAHLRSDQPLFQRAIIQSAPXWTMILPEEAQLKFNKLLQWAGVPQGATADEKIAALRSVSAEQLIAWNDLLMSPIWDPKWFVGHGSPTSPLDSAEPFPNWVQGIVVGTMRDELSIFGLERFWQTKAMVKSSLNHSLSLPSDPDFSTEVLNEYGILEAGSDTEAVRGFIRVATDACFSRLPYNLARACDSPDSPYLYVYRFDQVDEERNSPLRGKAFHVLDNTYLCRYLAVAGPAAPRSCQATADAFSRMILCHTYGEAPWEPYNIRRLQNVFDGTDTRLEEVRLDDQCWRKFLTTEERVSIFGRLFAALMNNGPKH

SEQ ID NO: 28996 - protein, 67 aa, A.fumigatus
LFGELLPAGCVLMTFSGGIALGYNDTWPAPGEEYFIAVCRSTSATGGFVSRKHPTLICLLISEADRE

SEQ ID NO: 28997 - protein, 102 aa, A.fumigatus
LSTSRVPNPALQLINLLLNYSHLRTQWSSSSTDRPGRRARPACASPLIEKGVDAEVVNVDLAKGEHLAESYLEMQPFGKVPVLQDTETGVQVFGAFPARHRT

SEQ ID NO: 28998 - protein, 69 aa, A.fumigatus
FCLRSRRTVSRPRGKKKNELTSGRRGILQDSSKGFVLYYHYADTRIGKAVEDYQFGWNQLKWENDWPSV

SEQ ID NO: 28999 - protein, 222 aa, A.fumigatus
  UNSURE (222): Identity of amino acid sequences at the above locations are unknown.
WSLLQPRGYPEDCQDQCCLRRQEAPDRPEWHSQYPRRQQPDPCAKGYRWYSADGQSQSWWYVELFFCEIRVLIFQGPNADFGIKYNLCNGAPAPESVTNKIYETSKSLTSYKIAEIPDVDTSTIGTKTYGPLEVEIVHSTSDYLKMLKEIFDSDLIKEFLSTHKDFKVLFDGMHRVTGPLCVDNLVKELGLAPRQHHELGSQPLLQRRAPLTPTWSTPMSWX

SEQ ID NO: 29000 - protein, 118 aa, A.fumigatus
LSFDCSSGLRKKVKVFQQPHYSEAFVTSILLSIPEGAEGAFLVIGGDGRYYNPEVIQKIAKISAAYGVKKLLIGQNGILSTPAASNLIRVRKATGGILLTASHNPGGTWSFSSVKSEC

SEQ ID NO: 29001 - protein, 74 aa, A.fumigatus
FFKDPMPISVSSTTCAMVPPLPSPSPTRSTKPPSHSLPIRSPKFPMSTPPPLAPRPMVPWRSRSFTPPPITSRC

SEQ ID NO: 29002 - protein, 165 aa, A.fumigatus
EEQGTLSTDNERSSSMHTARRPAAIPLACILAQPSFLLRLSTGSTQKGGPRKYWGGQSVWDILSWLSALNKALSLQLWQTDDDIIPFVACGWINGYTESRCILAQAKSYALRASVSCSQRDVVLASHTQTSTSNQRYKCRNITPSNDQMSMVQSIYLKGDDVILL

SEQ ID NO: 29003 - protein, 82 aa, A.fumigatus
GHQYANHSTPNYYDEYTSDARPSMQVGRAGRGPNVLQKNNRKFADAYEYERDPSHHSGSSGAARKVMDFFRRRAKSRAGDDR

SEQ ID NO: 29004 - protein, 108 aa, A.fumigatus
ADPLQTIKSGTSVEHNVLYEYQFVSTQNVYMGQIQTETACVFHHFLKHNPLVSRLQMLIRVSQTGTTRATPTLSSPSRRKPQSMIQTLPPAARAPATETARSAGASVW

SEQ ID NO: 29005 - protein, 67 aa, A.fumigatus
ITGCSTYGGEQNCQNSIFSIEGDSAITVYNLNTLGTRSMVDRDGQSLASFSDNISVFTNNIVLFRSQ

SEQ ID NO: 29006 - protein, 129 aa, A.fumigatus
PTSNHQVRHIGRTQRPLRVPVRLNPECVHGPDPNRDRVRLPPLPQTQSSRVSTSDADTSLANRYYQSNPNALIPFTPKAAIHDPDFASSCKSSSDGNCEVGWGLRVVDSHDLYVYGAGLYSFFNNYDAG

SEQ ID NO: 29007 - protein, 66 aa, A.fumigatus
HVTALTIARGIADSTVLSTQADLHNNYSDPAITPCCTLTVNLMDEYIQVLSGEVAAGKCSTSNTCR

SEQ ID NO: 29008 - protein, 153 aa, A.fumigatus
KCLAVASGMWLGKEGPLVHVACCCANVMMKFFDSLNHNEGMWSSRHQRVILSIIARKREVLSAAAAAGISVAFGAPIGGVLFSLEVCLSDLYSISPRLTNDSNCRTTFQIKPCGRVLSVQWLLLSLFRRLTHFEQETLCSTKLSIHVDGIASK

SEQ ID NO: 29009 - protein, 240 aa, A.fumigatus
TVSLRPLQPLHILTGPICRISFKRKQKRPARFSFSRLFSGDEPESTIHFRASATTNEPTPEVDSSLSQLRSRNGNENLNTSKSGGFLDWYVEGPGRRVGYDDLTAIDWIFEYTKERQRKRLLYSKAPGLSGYARRLLEASNVWVVLIATGVLVGIIAACIDITSDWLGDLKTGYCKNGPGGGKFYLNRSFCCWGHDGKISVLNNARLQLTWHIHQTYLSAWIGHLGVKLLESALPAEAIR

SEQ ID NO: 29010 - protein, 71 aa, A.fumigatus
VVFAVCASFLVRTYAIYARHSGIPEIKTVLGGFVIRHFMGPWTLAIKSLGLVGVPCILYVPFLGCLLSKSV

SEQ ID NO: 29011 - protein, 113 aa, A.fumigatus
QLSYYFPDKTMWQSFVCAMVAAVTLQALNPFRTGNIVLYEVKYTRGWHRFEMMPFILLGILGGLYGAFLIRLNMKVAKWRRSRTWSRPILEVTVITLLSVLTTGRRRMPACAQ

SEQ ID NO: 29012 - protein, 249 aa, A.fumigatus
  UNSURE (210): Identity of amino acid sequences at the above locations are unknown.
QSMSHNNDEDYFLPLEDQRVFGAGIRRKRVQFVRSSEHELNTTTTTTTTRTTTPSTTSGLSPADKYLSIVLPKEKLHTQTTEPATTRNETVSAPPSPEAVPAPVQRCEVCNLPLDGSKAGTDEEGSARPHEASLAHQLCLSHSHPPSHLDRSRHGLRYLSAYGWDPDSRLGLGAPGREGIREPLKGRLKVDTVGLGAEVEPSANGKKKVXAAAAVPSKVQRLNAKQVRKGHFDAKKIREMWRGDFLSER

SEQ ID NO: 29013 - protein, 220 aa, A.fumigatus
  UNSURE (161): Identity of amino acid sequences at the above locations are unknown.
GGTSGIGASVAYELALRGAQIILLTHHSPSDIFLIDYIEDLRKSTGNQLIFAEQVDLSSLHSIRTFATKWIDNYPPRRLDMVILCASAALPASSRGQLTTDGLNEEWQVNYLGNFHLLSILSPALKAQPAHRDVRVIFTTCSSYIGAKLDMKQLEAATSGXKPAGPTAAKKNGKPQKQASTEKEASLFGLSKLDMMIFANSFQRHFNSCSPQGVDGATRA

SEQ ID NO: 29014 - protein, 90 aa, A.fumigatus
TCSLFHSFILFFFFIFSHSLIFSPGYTMPIPIIVQGIREGIDSIPYAYTVLKIAPWVLLVAALKYYFGGARNGSERVMHSKIIMITVNLP

SEQ ID NO: 29015 - protein, 69 aa, A.fumigatus
GTDAYLPPRGEDPVSPSVAGQIMKVKELVEVQEVDRRLTKEEVRAERRPDPGYYIEKASIEEFSENRSA

SEQ ID NO: 29016 - protein, 69 aa, A.fumigatus
LNDIATAVAFKAFKQATLNAFYNKTDCSYQTFDEISNIAPRQQKIEVFIFKKNLTSWYKKMLAQDMYDT

SEQ ID NO: 29017 - protein, 294 aa, A.fumigatus
NPNTVLLVGSAPNFPHGIVDDIPALSRLATKYKIPLHVDCCLGSFVIAFLKKAGFPSPYEEEGGFDFRLPGVTSISVDTHKYGFAPKGNSVLLYRNKTYRSYQYFIYPDWSGGVYASPSVAGSRPGALIAGCWASLMSVGETGYINSCLEIIGAAKKFEASIKEHPVLSKNLGIVGKPMVSVVAFQSQNGAVDIYDVADGLSAKGWHLNALQSPPAIHVAFTIPTAAAVEKLTTDLVETVEKELEKAEERKRQGKSYVLKRGDTSALYGVAGSLPDKSIVSRLAEGFLDTLYKA

SEQ ID NO: 29018 - protein, 617 aa, A.fumigatus
QPAAQQDSDTIEIIPQQQPGLPKHFKSNASRFSFDMNGVESSAQEKLLEEKHKEKEAARRAKAQLEDREYSDVEDDYDNDLLDDFDGLEERIPGVNTDAEEDEFSGFSGPGAALTTSWHAPGLSPVVASPMSAPGLGPAVDINLQLDQGGAPHVSDISVTEDAVAAFPPTTNLSETAAVGCAMQAGARSSTSQLIDEDDDLYFDDGEFGDLAVDAGGETFDESIFDDESSHLYARKTAVVPAPPVEPGTTDQMEDKSRSGEASEPPSLSPKLDQTDGLKHAPSAASDFRDRAVTRYGGLDPEMTHNLTTTKSHGGVLSEHNLEVLHNALEKAANETAHMDRFKRTTSASERSLGQDSTARTNQTMDSYSGLVSDDSHLSQAMDAMGFEEVFDDFNYDDDDAFYDDPIIAAANAEALENDDEGFYGQEFGFYAHAHGGCSSELTNGGYFGPRGVEGISRNHSSRGKFREPSLTPITERSEWSTRNSVISLTAHGAAHSNSAISGPGLAQLVDMGTMDDEMSLSALLKLRRGAWGGSNGSLRSSSGSPPPHHHSSSNRASFTAFSDVSPTVYTVPPDYLFGGPSAAESPTMIPTNGDATHQSLSGEAESQIYPEETVPK

SEQ ID NO: 29019 - protein, 72 aa, A.fumigatus
GILEFEVVQECAYKTKNDDSLYKAATEQCALGEATKAMKVDFGLKNASNLNFGSLSLSLSFTRLSGIAGETT

SEQ ID NO: 29020 - protein, 99 aa, A.fumigatus
SSVSVLFCSYEWFVQISSDIVSTYLSLNTMDDNNRSAVDQGIDAAEPYKIGVEKEAKDVAQETESPESPGSQPDNAEYVKGHPVIRKGEPPSTALPAIV

SEQ ID NO: 29021 - protein, 272 aa, A.fumigatus
ETIEHESAGIGKVGVVYPPGKLGFKLTVTSFNDLDIQNRLDSIHDAVSIIRDSSQKLHHSHPDDKPLAGSEKGQPLSNFSQSLDAIDALMAQLTAMKIRIEKQDDKTESPMDSWDNFEDVKRASLPLMLLQSKVREALQLLSTPQPGHEKLADIDVQWVRTELESLLASSHEKAAAVIKASSQKSDDVTRGCRRHSAGSTLDKRRKRLQPTQQIVSSQVVLQDSPAGKVSIRVQWTKDADSKSARASDILLLLAPNPQGGPRRSSCFAFEAP

SEQ ID NO: 29022 - protein, 91 aa, A.fumigatus
VYCLDKNSPGYRTLGETQTGNLRLGGILPDRINLRMRELWSYQDSITITEPTITLNFYTDGDLFTHIEAAGLLEDFYEGRWIAATPVQPFH

SEQ ID NO: 29023 - protein, 248 aa, A.fumigatus
  UNSURE (16),(25): Identity of amino acid sequences at the above locations are unknown.
LSQFSSFPPFSSCLIXKTGRKKLKXYPPPPSPRAKCKDPIAALTESQLAALDPTGERRALFDYRRNPRSVKVGDILRVTFKNGDPFSGVCLSIRLRGIDTSFLLRNELTRVGVEMAVKVFSPNVESVEIVQRTEKRKRRARLYYMRYVLASGDRHHQEECSSCAVKLKFCSLEFTGSPSTIWEASRTLCRTTCGRSRSLLVSVQPVHGDRNGELEQFLFCLYYDFGEMYYTTILAHGYSGIDSFWRTH

SEQ ID NO: 29024 - protein, 61 aa, A.fumigatus
SQIVLQKREIMIGDRYSILPFPRACPSAMSLGKESPILPSNLIYETLCYPDKWTDGTILQL

SEQ ID NO: 29025 - protein, 175 aa, A.fumigatus
  UNSURE (135): Identity of amino acid sequences at the above locations are unknown.
DATQYVYQPILFCQVNSRMLHIQYLAHVDDITTFRPGIGDIILPNLLYRTSCSVLCSILSTSNNQTVKQSISTTQFDLIHSTIQNNNHNGVHQAGCQLRQRERAAGRARHLQGSQQAGRQGLRCSHWHSVSSLLXYKNLQQSLILCSASAAKDALTDKAHESKHDAKAEAHKQQI

SEQ ID NO: 29026 - protein, 238 aa, A.fumigatus
  UNSURE (191): Identity of amino acid sequences at the above locations are unknown.
SGHSQPRTHRGHDAKFPGMAITYALMQRLEELSEKEPERVQIIKKARVTKVNKSGDTITGVTYELNGETKTADGVVILATGGYAADFGDGSLLKQHRPDTFGLSSTNGTHATGDGQKMLMAIGANGIDMDKVQVHPTGLVDPKDPTAKFKFLAAEALRGEGGILLNSDGQRFSDELGHRDYVSGQMWKEKXKGKWPIRLVLNSKGSNVLELPHPSLLWPWFDEKYDRARNWAKDNRCG

SEQ ID NO: 29027 - protein, 83 aa, A.fumigatus
FEPAFFGGNSTKATSGINGALTRTQVELGIQDSVKTFYEDTLKSARDKARPELIKVLTYKSAAAVEWLQDVFNLDLTLVSRLG

SEQ ID NO: 29028 - protein, 68 aa, A.fumigatus
IVWTALCSEGLGANLQHYSPLIDEQVQKTWNIPASWKLDAQLVFGTPTGDAGEKTFLPIEDRFKVFGK

SEQ ID NO: 29029 - protein, 324 aa, A.fumigatus
  UNSURE (26): Identity of amino acid sequences at the above locations are unknown.
HRSSQHGLHIPQWNQWLVAMGRILPXHPLGHSRIHLHVHLRHGNSRAHHSHVPIPRSLLHPPRAGRNLSVPPSHPHPTIPNTPLTSPGETFGYYGRAWSHKEGRAAIGPWALQEMLILCAPPFVAASIYMVLGRIICAFDAEHHSSIRTKWLTTIFVLNDVVCFLTQLAGAGVQITGDPHVMAIGKKAVLAGLIFALVVFGVFVWVAAAFHRRLDAEPTAVVRECPRLRWKKYMWVIYVSCGMLMVRNLVRTVQFGSRKGSALNTEEAFIYVFDAALMAGSILVLIVWHPGRLVRRAQKATKASQMCVQMEDAPDIPLTGYREG

SEQ ID NO: 29030 - protein, 83 aa, A.fumigatus
  UNSURE (25): Identity of amino acid sequences at the above locations are unknown.
TDQASMDFTFHNGTNGSSPWVEFYXYTPSATAGYTFMSIFGMATVAHIILMFPYRAAYFIPLVLGGICPFPRLIPIPRYQIHR

SEQ ID NO: 29031 - protein, 65 aa, A.fumigatus
LRGSSAPWARWNSRAKKIPNEERKTTPYMTKYERARVLGTRALQIRFVICDMWHMKTVELTFVTV

SEQ ID NO: 29032 - protein, 96 aa, A.fumigatus
RAQDNSVHDQIRKGSSSGYQSFADQVRHLRHVAYEDRRTDICHSMNAPVLVDLEGETDPLQIAIKELNQKKIPLIVRRYLPDGTLVIPSPRVWTHV

SEQ ID NO: 29033 - protein, 249 aa, A.fumigatus
CENNDPSLTNHGVGAGTSPYLVAVKRSGIPVLPVVVTALIFLSSVASGRSFLFTSSRTLHSLAEAGHAPELFRRRNRWDVPYVAVITSAFFSSLAYFSAMISSSIVFNSLMYFITTCGCISWVGTCVVYLHFRRQTEALGFTSVHRARIQPYGVYFGIVTCTLLPIVNTFIIATPSQLAASKLLPVYFGISSFFLLYIGHRVGYAVIRRRTRMKKSSIEEPGDWSIELPPTTSNGRTGGADSSLHNTAL

SEQ ID NO: 29034 - protein, 100 aa, A.fumigatus
ARVSANDYSSRVDEYKQDAQPTERVIDEYFPPPLAFPFCPSLWEAFNLTYSRLENPLARIPKDRLLRDVEEYAQSYDLNDILPELKKGVFTTAWADQSFN

SEQ ID NO: 29035 - protein, 61 aa, A.fumigatus
KPFYELANWSMASVKVFKDLSGTLTSGFSRLPLPFPCHVVPSNDLRKVRRQPISLAQQVRK

SEQ ID NO: 29036 - protein, 162 aa, A.fumigatus
SISIVSSRKDDSGNCIALSEFGDARTNSSPQVDIDRSEDQGRTVVKPGLDRELDRMKDTYDGLNDLLKEVATEIAATIPESLDIDVNVIYFPQLGFNIAVPLNDMGEAAYSGTADDWELIFVTENRAYFKDFRMREMDQSLGDIYGLICGIPQRISFAVTMT

SEQ ID NO: 29037 - protein, 162 aa, A.fumigatus
KRVDKTTIEKRSRPAWEKAFMFAKLFGEQLEDLGLPENQNPAAHWQKMVALHSREVLSAMSGPLRKLKDAKQTERAPRPNLSRDDFDFVDHDSSDPIEEHEIFAAKKTTREELDILRSEVRDLKEMVYKLRPRFRRNRVASTDNGIETPEGTQDNLQSATVH

SEQ ID NO: 29038 - protein, 308 aa, A.fumigatus
  UNSURE (63),(99): Identity of amino acid sequences at the above locations are unknown.
WLSGLDPPRKKLPSKHKGCFKTELIDQTYPEILRFNLSSTVLELRSWEIDDLVHFDLMTLQAXETLMRALEELNYLACLDDDGNLTPLGRLASEFPLDXALAVMLISSPEFYCSNEILSITALLSVPQIFVRPASQRKRADEMKNLFAHPDGDHLTLLNAYHAFKSPEAQENPKQWCHDHFLSLRSLQSADNVRMQLLRIMEREELEMISTPFEDKKYYENIRRALCAGFFMQVAKKEPQGKSVYTTVKDNQNVLLHPSTVLGYDAEWVLYNEFVLTTKNYIRTVTAVKPEWLLVCHSRPSTMIKYYD

SEQ ID NO: 29039 - protein, 104 aa, A.fumigatus
LTNALEMDGMTSKKNVFVIGATNRPEQLDAALVRPGRLDTLVYVPLPDQASRESILRAQLRKTPVAPDVDIPFIASKTHGFSGADLGFVTQRAVKLAIKESIGR

SEQ ID NO: 29040 - protein, 410 aa, A.fumigatus
SFTRIAPCGEDPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLAEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTGRFDKTLRYLNTCD

SEQ ID NO: 29041 - protein, 93 aa, A.fumigatus
RRQKQREGAGEDIKMDDEGEEEARVPQLTRAHLREAKKSARRSVSDVEIRRYEAFAQSLKNSGGSSFFRFPSSGEIQNNDTFGDAGNDDSLYD

SEQ ID NO: 29042 - protein, 74 aa, A.fumigatus
ISQGFVKPTSKKLVDHTVRCTTSVTDGATTGLGDRIQLVKENDARRSSTGLVENVPDVALRLTEPHAQKLRSLD

SEQ ID NO: 29043 - protein, 330 aa, A.fumigatus
DEVGSTLVRHGLGKHGLTSTRRTIEQNTTGWRKAELLELFGVIHRVLDALDELALDLLQTTNILPTDIGNLDNSNLAKSRGVGNAEGVTEVLHCNTKGVKHLCVDSVLVKIDQIHLLTNLLHSGLRAERGKIGTDIAVSLGRNGLQIDVLSKFHVLGVNGQDLETASGVWDTDIHFTVETAETTKGRVDGVGAVSSSHDDDVGTSLHAVHQSQELRDDTALDLSVGLLTLRRDGVDFVNEDNGGRVFLSLLERLAQIRLGFTGHLGHDFGTIDQEEEGTSLVRHGTSHQCLTGTRGTVHQNTTGWLDTDGLEQLRMTQRVFTTGRDPRKA

SEQ ID NO: 29044 - protein, 140 aa, A.fumigatus
LPQQLLHSSFRISSSCRSHRQTIPALARSPPSTPTPTTPNPSSTSTSATSPARQASPGFWRCLPPRCPQKRPKTASSPPSRARAQLRVQVQSGDTTRRKMRPPRPFLPSGNGSTTCSLSRARRRKFGGHRAGRIAGRRSR

SEQ ID NO: 29045 - protein, 113 aa, A.fumigatus
  UNSURE (20): Identity of amino acid sequences at the above locations are unknown.
LLMSCLVFLLLIVLLPVFVXLHLLVAPYTKVEESFHIQAIHDILKYGIPTGDVSGILARYDHSTFPGAVPRTFVGAVVLSGLSQPFIWLNESIDKQALGMLFLACALIRESIS

SEQ ID NO: 29046 - protein, 490 aa, A.fumigatus
FANLLADVILHVARGILGLFNSVSLISFALGVRRAFGKTTAIWYLLFQASQFHIIYYASRTLSNMFAFGITTLAMRALLPEPVAPAVYRKRCRVGLFLLTIAGIIFRSELALLLAAHTLCLFSTGRIRIVQEIIPAGALGLVVGLAITVSVDSFFWQQFPLWPELAAFKFNVLAGQASAWGTHPWHFYFSSAIPRLLLNPLTYLLALPFALTHPSTRSSTAYIIIPSLVFVVIYSAQPHKEWRFIAYIIPPLTAAAAQGAAYIWTHRAKSIIYRLLSLALIASTAASFFLSNFVLLPVSSANYPGARALTTLHTHANNTKPVINVYLGNLACQTGVTRFLEMPPPQMPAKTAQNSELATVESAGSAPGSGSVWRYDKTEDETTKAFPPFWKRFDYVLIEPSEEKKVRRASGRPHSWEEVEVIHGFAGLRVLRPDDEATGQLEERVFSIVLGPEGARYWTMVRDYARKHVTRGWWAELKMEPKIKILRRIR

SEQ ID NO: 29047 - protein, 372 aa, A.fumigatus
YASSLCIDFLDHYFDLLSYVHNRQTRYSQFRAAYPDPPATPIDDYEPALLKYLGRERAHLRKRRTRLRQHDFQILTQVGQGGYGQVYLAQKKDTREVCALKVMSKKLLFKLDEIRHILTERDILTAAKSEWLVKLLYAFQDDEQIYLAMEYVPGGDFRTLLNNTGVLHNRHARFYIAEMFSCIDALHALGYIHRDLKPENFLIDSTGHVKLTDFGLAAGMLNPGKIESMRVKLEEVGNTPVPFGRPMEQRTAAERRQGYRSLRERQVNYAKSIVGSPDYMAPEVLKGEEYDFTVDYWSLGCMLFEALAGYPPFAGATVDETWQNLKNWQKVLPEPVYEDPNYFLSRRTWGLITKLVAAKENRAQNLPGDPCA

SEQ ID NO: 29048 - protein, 69 aa, A.fumigatus
RRSMLIGAIYQLTQLEHIIKRPDTYIGSVERTTQFMWVYDSETEGMKYKEVSYVPGLYQNFDENRRQRC

SEQ ID NO: 29049 - protein, 130 aa, A.fumigatus
KPRAKAAPKKAAPKKLTQTKLTAKPAAKATASKKRSKPDSEDDLSDDMGMSDDDSDSSLSQTPPKKVKKAPASKKGGSNPLADVENESFGGDIGDQPATSTNASEKYQKVSLLLTLRHSFCTPVCRGEAC

SEQ ID NO: 29050 - protein, 66 aa, A.fumigatus
  UNSURE (15),(50): Identity of amino acid sequences at the above locations are unknown.
SMHTVPVLSITRTLXMAQKVMKLFHIQPRYSPGKAGCSSLMLQYGIQAAXAATSYSKFFFSYHTIA

SEQ ID NO: 29051 - protein, 274 aa, A.fumigatus
ASGSKSVSILGSRFTNVMASQEMFPELGQSPAPGIKSRGVSRSPHPHQQQQQQQHQQHQGQFTGTVTGLDLDSSIATASSFANSSFDPNSNNVSPSAESYGYTAAGYLSGTPASQTDQNYANSLQIPQSYGTGLVPQFNESRGLPIQQQSQQQHHQQPSLDDNFSDLLNSNATEYDFNTVYQTHSPSSNTAPEYDSSLLLDPQVHQQSHPTQIPSSHSSTSPQISPLEQQQHSSPGPMSTQGSTTVAYYTPQHSRHASLDPATSSPRGWKEPRH

SEQ ID NO: 29052 - protein, 103 aa, A.fumigatus
FARCTPKSRNSKFHPALIAADAFLFWPSFSPHPHWLSSLRSLIPLSPFTAPLFPPIQTYYGGASLSTPPPPRARSLVPVFTTIFIAKPQGPNLCLFWDHVSPT

SEQ ID NO: 29053 - protein, 159 aa, A.fumigatus
HHRGSFQPRGEDHERISIQAALLISGVTPLVIIAVYTLFIDGLFSHHKPYNPASGKRKLTGPYRWKDRLWEFNCGFLGLLLSQGLAFLITQVLKTACGKPRPDLIDRCKPRPGSEDLIPGLSNSTICTGDPAIIKDGFRSWPSGKFYPGLLIFVLGYAD

SEQ ID NO: 29054 - protein, 234 aa, A.fumigatus
SRNIASFAGLFYLTLWLCGKLHFMDNRGEVWKAIIVIIPCLAATLIAVSRIMDARHHPFDVISGSLLGIICAYISYRQYFPPISEPWKKGRAYPIRSWGTDPVAPSKTSPLSDCASTSALRNPGEDRINASSAPEMGPARISPTYMGSANPYTSNLRNRRSHDNDGDWSSSSEDLADGYEMQHGYARTQNPAIGGLPRYEADTSYHSQTQNVLPGVTAAHVPPDPIATRPARDS

SEQ ID NO: 29055 - protein, 60 aa, A.fumigatus
VLLLRANTATTFLNIIYCTCVYLPQRKGWDVGAQNILRPFFLLVLHQHGTRIMISLLVNG

SEQ ID NO: 29056 - protein, 192 aa, A.fumigatus
YFLFASTNPAMASTGGGNSAFRNYNNELAHVEDARERRRQALAEIDNAKFSWYHVRAVVVAGVGFFTDSYDIFAINLASSMLGVVFWQDAKSSPGKIPSSADTAIKVSTSGGTVIGQLFFGWLADRIGRKRMYGIELMVIIMATLAQALSSDSRAISIVGILIFWRVIMGIGIGGDYPLSSIITSEWSSPRG

SEQ ID NO: 29057 - protein, 67 aa, A.fumigatus
GSICYLSIAIYLIAIIFSPLLDLARLGTFKPFKLITFLDLPSPGWKLYLLKLYTNYTSISFLTTPVS

SEQ ID NO: 29058 - protein, 72 aa, A.fumigatus
GCTDYLYLDKYSESRGDYQLATATVPLPGVPTYYISVTKAPPHRSALRVSHSETTNHTKSTIFQYFDYLKLF

SEQ ID NO: 29059 - protein, 70 aa, A.fumigatus
AHFSPVVKTFKREMHMCNTAGLPFCPVRRCASGSDISLPQAGAAVRLDFPSSHPSDNSDRMQGIYTLSRM

SEQ ID NO: 29060 - protein, 220 aa, A.fumigatus
LPKLNRIMSNMSTNRPFLSNFLAAFRAQSTYKASTAGSQSAAGPSSSLSAAQISQGARAIATKTGAGSNASTSAEQSSSSTTTAVHAASNHHYHHHSSSAAAASSHARPHSHPRPSLNQTSPSTESPASSISTPLAPSSPPTPASSNPIPIADGPDRQRRGSDSSSGSGGFRDALGPEKWYIGGRTATGEERFYRLGMVTKGGGRLGGSGRVGSIDQLSL

SEQ ID NO: 29061 - protein, 86 aa, A.fumigatus
  UNSURE (26): Identity of amino acid sequences at the above locations are unknown.
ATTLVSVLCTTTHTMRSGKKSRRVTXMSLFLFRCNPHTMSAPPIHQGLQTLGDSRDTWDSINNETSFDASNGEFEHWINSQASGYA

SEQ ID NO: 29062 - protein, 282 aa, A.fumigatus
  UNSURE (282): Identity of amino acid sequences at the above locations are unknown.
KCSLWETRTSGEHRPQRGAPRRELPKKNGKVARPMNSFMLYRSAYAERTKEWFAQNNHQVVSEVAGDSWRIETPEIREKYEVLANVEKANHLKAHPGYKFSPSKEKKKRSETDDDQLTVDGGEMTSGSSPAFLQVRAVGSSEVDSNGWASRDSTPFDFPEHGLPTTTYYDSSWQTSHPSMSAPKPFSYLQQPIHPNLIGPPTEDSRFKHVGLQNIQFTSSTALAGLPGAAHHDLLQPQNNFGAGPDGQLDPQLLSLSDHSGQRAMYNHSHYAIWQEVPTSNX

SEQ ID NO: 29063 - protein, 126 aa, A.fumigatus
IVLRSPSLPFRASHTATRHQFTVARRGKVAPIFYRPKENPYMLDLPPKRSRDVLKAPAADTSEAKTISFACKTDQKGKTAPVDCTVLFEGIQNNDLEIPKVQSAIYASMPRVAVFTHVRRPDPALM

SEQ ID NO: 29064 - protein, 218 aa, A.fumigatus
DISPRDCGCALKQILTDGFHKGRTASEGGQTPRSATMNQMNVTGMNPGAGGPVGGVPMMNNGSTAPRNDGNVNNIPETMINNLNTYIYDYFLKRGYHECARALVKDESIKLNTEPPTKTSPGHRREDMNGVEGDAIMTDSKDGDKIKIPDDLPRPNLASESQQSSFLLDWFSLFWDFFWAQRKKGNSNDVRQYLQHTQVIPHLSCCGWNGPNWYSGRI

SEQ ID NO: 29065 - protein, 67 aa, A.fumigatus
VRFLSLPYGCHIAIQTDVVEQNVDWISKVLYSLSCVGLDLPDLGSNNHDKGHSSYFFRVRGCSPPRT

SEQ ID NO: 29066 - protein, 96 aa, A.fumigatus
TTSWLIFMQENSIPRLSENESERLGSRKMAIPRLTEGTESAFTSPGRFHRRHVRRACESCRQRKTKCTGDKSGCRNCREAGIICCYTDGKREKSKR

SEQ ID NO: 29067 - protein, 190 aa, A.fumigatus
HTSATHYRDSPYNMAYELSTLQLSCVAFVAFMAVLVFRTRTRNLKQNVPPGPRPLPIIGNFFDLPPKGQPEYLHWFKHKDAYGPVSSINVMGTTLVIFHDKDAAHAVMGKKAQKTSARPQLNFAQLCGFENFLITHQYNDKYRLHRKMVHQEIGTKGLSAGFRPVQEQESIRFILQTFNRPDDILQHLKT

SEQ ID NO: 29068 - protein, 258 aa, A.fumigatus
VPYDVVICLLHCLMGCRLAAAIVLKITYGYSIERKGQDPLVELIEHAMENLSQAFVPLAWAVDSVPAIKYLPDWFPGMSYRKTARKWRAINEAAAELPYDFVKRQMAHKAHQPSYVSNLLEKHMIKSEDNKINVSAADEEAIKWTAVSLYAAGSDSTVAIIHSVICGLVMFPEVVTRAQEEIDRVVGSDRLPNFDDRTNLPYVDGIIKEAWRWNPVGPMGLTHKSEEDLVCGEYLIPKGSYLLPFLWWFLNEPKKVPR

SEQ ID NO: 29069 - protein, 202 aa, A.fumigatus
  UNSURE (199): Identity of amino acid sequences at the above locations are unknown.
YSGLTPIALSGSPANLYAISAVLNTHDRLMGLDLPHGGHLSHGYQTPTKKISFISKYFETLPYRLDESTGLIDYDGAEKLALLYRPKLIIAGTSAYSRLIDYPRMRQIADAAGAYLLSDMAHISGLVAAGVLPSPFPHSDIVTTTTHKSLRGPRGAMIFYPKGVRRTDKKGNKEMYDLENLINASVFPGVFTTGLEGCXATP

SEQ ID NO: 29070 - protein, 89 aa, A.fumigatus
RVHMIAEAGKPHNLVCSECRSPDDLMLCETCCRSYHARCLPDPARPASTGNFYCPSCRDKRWDLTPPLINSLAASPGSLGAAHLFHPRL

SEQ ID NO: 29071 - protein, 195 aa, A.fumigatus
YRRRHNDSVVVFDRDSQQLVLRNASDSHAGLELTDCPYCHRPLRESNAGQEGHHASPQPEFVNPDYFRMLHNSLPSSADSSTPPSPRRRLVQPALADGSTSEPTPSISGTQGISSAAFTQNYFKKFFVEERILGKGGKGVVLLVKHVLDGVSLGHYACKRVPVGDDHEWLEKVLGEVQLLHLQPVAARYRAEPRC

SEQ ID NO: 29072 - protein, 66 aa, A.fumigatus
IGRDTRQHFFQLGHRDNAMVTELMLNASRSDIIDTHTLYKWKLTKQMSYFRLLYLGKDCRSQMGST

SEQ ID NO: 29073 - protein, 67 aa, A.fumigatus
SFNPAAQGNYLPLSLTYMRGRKCKGQFNVYMNLLYPASLNDILCPEYLETTSQSHIGNIHISDISRT

SEQ ID NO: 29074 - protein, 339 aa, A.fumigatus
  UNSURE (41),(42): Identity of amino acid sequences at the above locations are unknown.
DRVLRSFIGCYVIICPLAKGGDRWILNFRWPLIYSKETCRXXGTLRKLRQSNMSLFRKYRAATAQVRSFSSSTCRRVGPESPNFVDVPQTIQPDLRVKPRVKGTLPVPRELFPARRVDKPSEEYIAAATPLPLKDIKIDPNDPHAEYKDWKRRMADMRRQNLREGLLELHSRKQRTDKLMAYRSIQRQRRREQVLRQPERDDERLTRPSIVQEMLPKRTPVLPDPDREERLAQARAKLESKKVRDELERQDSLQTLYMNARTFITTEAQLAAEIEKVFPDGENEAWRSDHQQGENIWNLGVPPTVQNIVNDSKKSEAARWDLIQGRVKKLGEQITGGKI

SEQ ID NO: 29075 - protein, 220 aa, A.fumigatus
GAVTYSDSMEQTFDLPDSTDWLETPLSLVSPLESSLRCQVCKDFFDNPVITSCSHTFCSLCIRRCLSTEGKCPACRSSDQELKLRRNWAVQELVEAFQNARPSMLELARKAANSRLDGGYVTGQPAAKKRKVDQEDGPDASGSEGIRTRSQSRRGNSQAEPVVVDAIEDDQDREYIPGTLFTPLKQVRLGVRRAMAPNMNVFKRTVWLHALIGGRRMENE

SEQ ID NO: 29076 - protein, 333 aa, A.fumigatus
PSMRFSTVLSALLLSSTALATPAQVSSPVDASSQGSVADEQSVAQTTAVAEATPVAQQSPSPNQQNANAANQEQSANVNTQAAPAPPTSSGPQPTENAEPSPSPSASQKDSNPLNILSNLVPTNTAGEQAQSVSTAITPTAASAESSSNSETATKAAAPTAAGSTGSGSSSGGASDGFSGNIFQDLQNLLQGVSGLLSPTLLKDIESFFHHFAYLFDDKTTDQTKSLIDTGYNLLTPELTKEVLGLLSNANALLTPSFVNETQELIGAVGPLLTPQLFKQISTLLNNGNNLLTADFVKEVNGLIGNANTLLTPDFVKETRVFTTGLEGSAVDL

SEQ ID NO: 29077 - protein, 114 aa, A.fumigatus
ETRTITETDSHRYDRTPPCSAIKAVTQCSQFFHEVSLDKLESGTTYYYQIPAANGTTQSEVLSFKTAHRAGDRRPFSVAVLNDMGYTNAGGSFKQLVKAANEGTAFAWHGGDLR

SEQ ID NO: 29078 - protein, 160 aa, A.fumigatus
YFLPSINLSTVTKNNDQISYADDWYSGILPCADDWPVCYNGTSTELPGGGPVPDEYRKPLPAGEIPNQGGPQGGDMSVLYESNWDLWQQWLGNVTRKIPYMVLPGNHEAACAEFDGPGNVLTAYLNNGVSNGTAPKANLTYYTCPPSQRYDPPPAVSRTS

SEQ ID NO: 29079 - protein, 184 aa, A.fumigatus
PTTHALRPNGMIHPPLSPAPANPDRNFTAYQHRFRMPGPETGGVGNFWYSFDYGLAHFISMDGETDFANSPQWPFAADIKGNETHPTASETHITDSGPFGAVDGSYKETKSYAQYKWLKKDLASVDRKKTPWVFVMSHRPMYSSAYSSYQKNLRAAFERLFLQFGVDAYLSGYGACFLRRERRY

SEQ ID NO: 29080 - protein, 75 aa, A.fumigatus
  UNSURE (3): Identity of amino acid sequences at the above locations are unknown.
HPXVKPATANPKNNVNVISLSYLPDGMHVHFQTPFGLGVRPSVKWGKDPKHFDRVAHGYTHTYVLASELGNPNHN

SEQ ID NO: 29081 - protein, 113 aa, A.fumigatus
CSHIHWYERLYPLGANGTIDSASIVNNHTYRTNPGKSITHIINGMAGNIESHSEFGKGQGLQNITALLDTTHFGISKLTVLSEKEVKWEFIRGDGSVGDYLTLRKEKTQSKEK

SEQ ID NO: 29082 - protein, 235 aa, A.fumigatus
  UNSURE (3),(14),(23),(26),(31): Identity of amino acid sequences at the above locations are unknown.
FRXEDVHRHNITFXQRPLSLSFXYVXQAPIXPQTQQLTPAYDSGDMALGPALTFFTLFDKLVIVPQGTFSSNAASKRSVSERDVMAESFHRKQAVQAGDRPWFCWWNGTMMEFFLYTNQTSKHARQTSTASSAPTETSPPQNGKRGLAPLDSLFDYPRRIKIQEKRNHPGSRPPYCQQMKVLDDGSIATASPETIEIKEVEPTPTTTLKGSGSATQTYTAKAQYESVCYCASLTD

SEQ ID NO: 29083 - protein, 441 aa, A.fumigatus
TTEQPELEAMISDIAMRINSMHSTLAHQPLVFLKQDLAFPQYLALISVADALMITSLREGMNLTSHEFVYCQDGKYGNKKYGSLILSEFTGSASVFGNHALLVNPWDYRQCAEAVHTALTRSEADRQRVWEQLRRAVLQNSTGNWVKSFNERLQRVWNEQSSREIMAVPRLPVNKVEEMYRKAARRLIIVDYEGTLASWGSPKSIIVTTPQRAIVTLTDLTEDSKNVVYVMSSRMPEEMERLFRRVPGLGLIAENGCFVREPNTEEWLKLTNKERTDAWKEGVSQILSYYQERAEGSWIEKRHCSLVFHYGSAEDNEAASRLASECAGHINDACASQGVHAVLIDRALVVGPANTNKASAAELVWRDCLNASQKDEQIARPDFLLAIGDGRDDEPVFRWANKLESAKAVGYAMTVTLGSRSTEAKATLTQGVTGKLFVVPY

SEQ ID NO: 29084 - protein, 199 aa, A.fumigatus
  UNSURE (196): Identity of amino acid sequences at the above locations are unknown.
TGIPPIASPLMGHLLQHGRATVRRLSRRTSRSQRLQLRHHSKASPNPVPEKNSTSANASRSGATPSCTSPCSPNTSSPTNTPLAASTPARSSPRTFFQAIQAGPIGRLADSYARVQQRRPYATQVVSSIVVYLCGDLSAQLLFPSESPAQTSRVASEEKPADSAEDGEGKAASSGGYDPLRTMRHLTVGVGSAIPXLHW

SEQ ID NO: 29085 - protein, 64 aa, A.fumigatus
AQLSCLSLSRHLLLYIYSKKYGRLNAIRMQLVYQRTGIFGLPHAPPSLFSCQIRPLHEKSISKR

SEQ ID NO: 29086 - protein, 60 aa, A.fumigatus
RVFRGLGALVAQKYAAEGCNVAINYLSSKDVAEELASSLRTQYGVNAVTVQGVSHARLLW

SEQ ID NO: 29087 - protein, 284 aa, A.fumigatus
ENTSLSFLLAACSRPTFQLGTGALSISQNFRVRKWRRKNSPTHLLVVLGSGGHTAEMFSMLRRMKLDPSTYTYRTYVVSSGDNFSAARAVEFETEWLKQSPKLSFPANGSNSTESYAVVTVPRARRVHQSYLTAPLSTLQCFYACFLVLCGRHPEQKSPLPTTNSPYPDVILTNGPATAVCMVLAAKSLRLFHYLKSLFYIKDHQDRDSSRSSQVKRSEDAPAPVHFQLRTIYVESWARVTTFSLSGKLLLPFADRFLVQWPDLAGKQAWRGMRETEYAGTLVD

SEQ ID NO: 29088 - protein, 71 aa, A.fumigatus
RLVGQTSTPSVLFHNNLSLGNLLLSAHINVQTRPTSNSRTILSISQNRTGLDLNITDLHRSQGHTMLLTLV

SEQ ID NO: 29089 - protein, 400 aa, A.fumigatus
QLLFTSDGIQRDIHRYHSMAKESDAPPSYPMTPRRPNEHTQRPLSQQLEFGKPSPLGPYQRPNPPHQQQPNHPFNIPKPNRARPEHHRPAPQSRSYNAPHPGISHQGHRPTGGSSSLVASTPKRSEPFDPFKPVRPSAYNNYRNSRPVNNDVVEIRRPENVTFTTPRAPKTFYASSAIKMDKASKNLSNFVDLTREGGFTPSTRPRNAGFGSMDANGYVDPVKANENIKALLEGAFTSDDDKQGSRAKNRKKSKNRRKKKKEAKEKKKQGTSEIDDLASQLEEVTVNESSAATEKSELDELKAEGNVGETKDDEKSSEDEVEDDENDYEEDDEEVEEGEDEEEDDGTVEGLKVKLLPHQREGVNWMCDKERGSGNAKGVLPKGHSSSPRAGRTAQALPPH

SEQ ID NO: 29090 - protein, 83 aa, A.fumigatus
AQAVLLCFLKYILLINMSECQCVTEGLLYIASAPFTTFHKAQPVSNQSNIGLTSGLDSLLGSLLAVETEGWTGPFSIRSRPND

SEQ ID NO: 29091 - protein, 136 aa, A.fumigatus
AQFRKETEHMFYHGFENYMKYAFPEDELRPLSCRPLVRDRDNPSNAELNDVLGNYSLTLIDSLSSLAILSSSPDEGERAWNHFQDGVRDFVKLYGDGSDGPAGQGERARGFDLDSKVQVFETVIRGLGTRLLFCQC

SEQ ID NO: 29092 - protein, 267 aa, A.fumigatus
VEYTLSNSLQYIALSNLQAANFQVMYQLKLLVGSICGLVLLKRAIPLRKWGFLILLLVGVYLVQMPDGATDEISLDHEAVHHSFPRSFAEWKAVIGKRANLHKRSATYEGIEEDLLTAMPRLNSTVGLLATIGACVASGLAGVYFEKVLKDSVNSTSLWVRNVQLSVYSLFPALFIGVVFLDGEKVAANGFFEGYNWVVWSTIMVQAIGGITTSFCISHAYKDARNVATAISIVLSTLGSMWLFGFELTGNVCISLNHELLHMVTDV

SEQ ID NO: 29093 - protein, 68 aa, A.fumigatus
SIVPIYIIDILRNIYIGTSYSYISYSTALVAFFLIPFLTYSSIYSSIIDTSNNILRRSYSVLYIISIT

SEQ ID NO: 29094 - protein, 92 aa, A.fumigatus
LNQAFEKLDQEKNNTPEKASPSHGATVKEATPTSQPIPSGTRTTVQTPASASSSTAAAPKKKQSSTNMLSHIPIIGGVLGGGEGLGSLLPSR

SEQ ID NO: 29095 - protein, 101 aa, A.fumigatus
SEYHHFSSKMARFNLSFLALCFFLALVVSALPAKPGDDDLDAGDAVAAALSALKVRISAPNIILCKLFKSDAQTNSIRPLRSWTRRRTTPQKRPRLLMEPL

SEQ ID NO: 29096 - protein, 60 aa, A.fumigatus
DTGTSSQEEYTPRSRLQKWFYETTQNGMVGYAYISTCEPAYFGATGSICGQPKQDEDKKG

SEQ ID NO: 29097 - protein, 264 aa, A.fumigatus
  UNSURE (56): Identity of amino acid sequences at the above locations are unknown.
SHYRCVLVNQLFSLKSLPWIAFSNKLGYLSEGKDTDGILSILQSKFMFACYISTTXIVGWLVNFVAGFIGPRLDSIFPKAAQELQSRRHNEKASHRDFLAHFMDASQKNPETLEERGVLGATISTIFAGTDTTGTSLTFFMYYLIKHPAALARLREELDSAVRSGNLSYPPKWAEVSTLKYLQAVFKETLRLHSTARMSLYRVVGPEGLDLCGERLPSGTNLGCFGYTAHRNEPIYGRDAALFRPERWIEASNDALLSMERASL

SEQ ID NO: 29098 - protein, 80 aa, A.fumigatus
VLNENTEPATAARWNFINFQTPSYSAVMMEYTTPPSYGSTVVNVRGIVKDDEIIYAGATNSATHTASGHDADSHWPAPTS

SEQ ID NO: 29099 - protein, 86 aa, A.fumigatus
CIVSTVLIDHALISLASVAGTQEPIYGPEAIQSVAQQAQQTPYTELTKDDLRWRAYQYTNVETETFYVMADNGTVVMVQVIYSNIA

SEQ ID NO: 29100 - protein, 155 aa, A.fumigatus
HLCRGIHTTAQFNSKIFNLKGDQPHIWHSDPLYNFMFDENMLSFGADNLALTLNEEGTAYTIKSAVNEDSLVNLTFTRTAPGFVVGKDGTSYFGTDPANPWGSMMHAFWPRCRVEGTITTKEKTYDLTGRGMFIHAIQGMKPHHAGGFPSPSIKC

SEQ ID NO: 29101 - protein, 93 aa, A.fumigatus
  UNSURE (20),(65),(66),(76): Identity of amino acid sequences at the above locations are unknown.
EFNARTAHINPGVPIPARVXVRPDRSFTFDIRTPTTTYLLLQAANVEPRKNRIRGSHENRPRDHXXKCPLKHVVPXSPKIQPFRERDYRGVEF

SEQ ID NO: 29102 - protein, 178 aa, A.fumigatus
  UNSURE (129),(174),(175): Identity of amino acid sequences at the above locations are unknown.
IRTKLGPQIVGRSLHLCIQTYHIFVSLQTHLTMAKKALAKDQIVKLIVGAGQASPSPPVGPALGSKGVKSMDFCKVRSSLQHLFSALRRIWTERLSSIILLNHYAPQYRSSMPEPRTSTPESPFPHESXFVLTDPLLSIFEPPRRHISSCRLRTWSLARTASGGAMRTGHEIIXXSVP

SEQ ID NO: 29103 - protein, 85 aa, A.fumigatus
RVVFLVYHMADAIQESPKSYLSKEIPQFLAAYRALHQAALTIFIVSFIIFFVLLLLEATGKVDNFFEVHNARVRQIQLCQQVALI

SEQ ID NO: 29104 - protein, 64 aa, A.fumigatus
WCSSLTVFYCLFTIHCLSPPARAILTPLPSDVLLSTLKHLSHIKFSLEFQMELSLPFPAEVTNA

SEQ ID NO: 29105 - protein, 71 aa, A.fumigatus
TRSISNHYHLVLLVHHAAIEGNFTGHWNRTSNHIQTSYVRKPASSLTERLPLHQYINMSLSYTYIPKSATM

SEQ ID NO: 29106 - protein, 67 aa, A.fumigatus
  UNSURE (50),(62),(65): Identity of amino acid sequences at the above locations are unknown.
RGGEGFMKISGRSAGDLAINTGLRVMQAKATPRHPRSSQFYLYHEGRTTXTKSYNRHGWIGXVTXGS

SEQ ID NO: 29107 - protein, 82 aa, A.fumigatus
FDPSACAREGPADFDIYNMETISRISSMLETGNILSDVIFRPPLLIVVWNSSRTNHGGSSVGSFYERVEYRLCVAQSQYFSH

SEQ ID NO: 29108 - protein, 263 aa, A.fumigatus
LMYSSEPSLPFFSYVVKNVANTNIEVKKLVYIYLVHHAETEPDLALLSINTIQKSLTDQNPQVRAMALRTMSGIRVPVISQIVSLAIKRGCGDMSPHVRKAAALAIPKCYRLDPNTLPQLVGYLSTLLGDTQYFVAGPAVAAFLEICPDRIDLIHKHYRSLVKKLVDMDEWGQLATLRLLTFYARKCFPRKTQKMKSAVSRGFYDDEQGGETQGDGEEYEMPVIDPDLELLFRSCRLLLHNRNSAVIVSVVRCLHQRGRRTSV

SEQ ID NO: 29109 - protein, 321 aa, A.fumigatus
  UNSURE (128),(167): Identity of amino acid sequences at the above locations are unknown.
NEKGRVEWYRTLHPQRRKKRMKASAKIELKRGCFLLPSEIFLPEAQKISRTDRERVIIREVLFRREIFYCGIGYGGFPTQENKQFFKGERVSTLVFWTLNSGWKRKVFLEGSMRESSERLKMDVIGLXESDTQRIIMGNRDISQVLAEELGMYADFGPVPNKHTWGXVILSKFPIVNSTHHLLPSPVGELAPAIHATLDMYGELVDVVVFHSGQEEDPEDRRLQSQYLAKLMGESPRPMVLLSYLVTKPLEGNYNTYVSELSGMKDIDPTDWDRWCEYILYKRLKRTGYARISRDSITDTEIQVSIYDNSPSGYVYADLLN

SEQ ID NO: 29110 - protein, 117 aa, A.fumigatus
KISLRKRTSLIITLSLSVRDIFCASGKNISDGSKKHPLFSSIFADAFILFFLLCGWSVRYHSTLPFSFYKHSLFLSAPPFLFFAWHTSIFHVAVPATSTYISPIPMSHRLSSLTLYY

SEQ ID NO: 29111 - protein, 96 aa, A.fumigatus
RYYGPFLSQSKLSVANLMIIAFPFSTYLSIIDKKTSLPVRSVFTTSGFLVLLGLINIGSTTAFNAILSLAVLGLHMSYLIPTGFMLWRRHCHQGDV

SEQ ID NO: 29112 - protein, 136 aa, A.fumigatus
FKIALLPGTFGWVAFTASAPFLAATMIQGLVVLNYEEYQAKRWHGTLIYWALLAISAVVNIWGARLISLIENASSLIHLAAFIAEFVVIWVCAPTKHSASFVFTLFRNESGWSSNGVAWSIGMLSSCYVLAGEYSS

SEQ ID NO: 29113 - protein, 120 aa, A.fumigatus
GYDGAIHLSEEMTNAEVAVPWCMLGSLAINGMLGFAFLLTVLFCMGDFEAALNTATGFPIIQIFYNITGSAAGSAAMTSMLIIMAGLATIPLTASTARMLWSLTRDRGIMVLFCLRASSL

SEQ ID NO: 29114 - protein, 99 aa, A.fumigatus
TIGHDEYGSTIAIHSLAVLPEYQGKQVGSTLMKSYIQRIREAAIAERISIIAHDHLVPFYQSFGFENRGPSKCQFGGGGWTDLVSSFLTDYKVYGLLGL

SEQ ID NO: 29115 - protein, 113 aa, A.fumigatus
IPPVPTNQEFLDIVLSRTQRQLPTQIRAGFKISRIRGMADAAEFCVDLRTDTMSVQFPALLRRAVTLTKILCATTGFYTRKVKYTQETFCEKFQAILDGFPRLQDIHPFRMLF

SEQ ID NO: 29116 - protein, 137 aa, A.fumigatus
HPSDKDLMNTLYDADHFRIALGQVSTAKHLIETVSRDYVRLIKYAQSLFQCKQLKRAALGRMATICRRLKDPLVYLEQVRQHLGRLPSIDPNTRTLLICGYPNVGKSSFLRSITRADVDVQPYAFTTKSLFVGHFES

SEQ ID NO: 29117 - protein, 263 aa, A.fumigatus
LLGHGLNSNQFHVRCADVCVRMFSAFLVSGRYSFDHSLYFIYIGVIRLLATYLYAALFTYVAYHLTRNIRRNYLRAAFSQEISYYDQGTSGSISQQATTNGNLIQSGIAEKLGIVIQAVSTFVAALVIAFVTQWKLTLILIFMVPTLLIVLGTAGGIDAMIETKILQIHAQAGSYAESVLGGVRTVQAFSLRPRVIAKFDSYLQEAYSQGMRKNKLYGIVFGGQYFVVHAGMGLAFWQGIAMLDRGEIPDLRTVFVSVSHTRE

SEQ ID NO: 29118 - protein, 75 aa, A.fumigatus
WLMSRDDLSQRVFTFGDTKLYLLECIAFIAAIASGTALAMVNLVMGQFLTLLSDFSFSDMDSTPTNFMSAVRTSA

SEQ ID NO: 29119 - protein, 174 aa, A.fumigatus
SSSSDVLNYIIPSRWVFYLSTMPPVFLQVCLPYSCPLSLTTNCTDAGIWKIIKGWINPDMVTKIHFTKSVADLAQFIHPSQIVSELGGDEDWEYEYSQPEMDENGLMEDDEARNTLLSERQQISEEFLSLTSQWIEATRHNYPEEVAMVQSRRFNVMEKLRVNYWKLEPFVRAR

SEQ ID NO: 29120 - protein, 289 aa, A.fumigatus
LFCPQMVPDPNNIPLGFLGNLSTEQERCLQQLWSLVLYLENAASFNDLEHLFGVNSVERNKSISISSFARRNSLLTRTDSILLRRSSTASFPAPSNPLLQTLSNIGMTASEIRSVAKSLTYLSPDDVRWGILTASKQEYPDRWMLRYLRFCKWNVNKAFILILNALQWRIKDMHVDDRLLPEGELGAIHQSQAPLNAAEAQQSRGFLSQLQMGKCYVHGVDRLNRPLCVIRVRLHRPEDQSEEAMNRYITHIMESVRLLIAPPVETAVCTPRRRRRWIALLTPAVDCHF

SEQ ID NO: 29121 - protein, 77 aa, A.fumigatus
TVIFDMTGFSLANMVSSVYGWGGYLLMFYIQDYALVKFIIRCFELYYPESLGVLLIHNAPRIFAGVFALFVSSVAHY

SEQ ID NO: 29122 - protein, 72 aa, A.fumigatus
YSSTAAHSTIIFIKKLQNLSCIVNTYTSFRDLLGQTVNPLWANLNLQIPRIMHIPLNLCPKGGKKIIMNSWG

SEQ ID NO: 29123 - protein, 253 aa, A.fumigatus
HYSLRISLRIRKAYKRKALELHPDKNYGNVEAATKMFAEIQTAYQVLSDPQERSWYDTHKDAFLSRDEQPSSSEYCYDSRMTTSGDILKLFSKFSPRMEFSDSPSGFFGGLREIFARLALEEEMACRADMLEFVGYPTFGSQCDTFEDVVRPFYSVWSSFSTKKSFAWKDIYRYSDAPDRRVRRLMEKENKRLREEGIREFNEAVRSLVAFVKKKDPRYKRGTQSEAQRRGAPPSNCRCTSCYIKNSKSSKAA

SEQ ID NO: 29124 - protein, 152 aa, A.fumigatus
SNRYFVKITGKEGFHLRVRVHPFHVIRINKMLSCAGADRLQTGMRGAFGKPQGTVARVNIGQIILSVRTRDSNRAAAIEALRRAMYKFPGRQKIIVSKNWGFTPVRREDYIQLRNEGKLKQDGAYVQFLRGHGLIEENMKRFPSAYENLSQA

SEQ ID NO: 29125 - protein, 88 aa, A.fumigatus
  UNSURE (10),(19),(23),(24),(25),(30),(31),(37),(45),(48),(69),(88): Identity of amino acid sequences at the above locations are unknown.
PLPLSPGFNXFFSPTPKIXYVKXXXLRRPXXMTSLLXVNMVSKEXEQXSSEAFEAACICANKYVDPPSXPHPQPQQQQQHHHTTTSVX

SEQ ID NO: 29126 - protein, 175 aa, A.fumigatus
HENGELKIGLSFFIFSLTLLGNHLSLRQVLVGAREALHVLLDQTVATQELNVGTILLELALVAELDVVLATDGGEAPVLGDDDLLAAGELVHGTAQSLDGGGAVGVTGADGQDDLADVHTGNGTLGLTEGTTHTSLETIGSGAGQHLVDTDDVEGVHTHTQVETFLTGDLDEVPI

SEQ ID NO: 29127 - protein, 179 aa, A.fumigatus
YTLCPPMAHCSVSGLTYRPSKIDGLTVGPRGTYHPIQKCMVKEVSAYGHQNTEGIIGDGCQAGSLCVLNNLTNQLFINASHSVVYQTISKDHTFAPSSLRHRASPCNPETHLYTSTLLYFTLLHTTNSLNYRPTANIYISPKQLKTTQLKKVPCSSLSPEYAPNAQPAQDPEMQPPSSA

SEQ ID NO: 29128 - protein, 141 aa, A.fumigatus
THSRTFEGVVKTILTTRLITSKRPHPSNPSKPSHQPSTHSSVHSKSPFQSPPTSKNDPEPQSPPSSASTSAQQAPPHPPPSYVHHPQALKSHSQRNSHPQAHPHNQTPLKPHASSDAPPAPTSATSYPGPQDKQKPSPPHP

SEQ ID NO: 29129 - protein, 64 aa, A.fumigatus
TDPFKTKLGTNFPTPITCRGFPIACNFNSFFITAFTISTPLRVPYLPRLPPIPFLPPVPQRRRP

SEQ ID NO: 29130 - protein, 87 aa, A.fumigatus
TAHAKLSYLGHYKNKTYSQNFVHKYHGPKCRIRSCLFIIEDSGQPLRIMIITLLKAHGHNYSLVSTSASPILQVRTMHRRTPMQILV

SEQ ID NO: 29131 - protein, 752 aa, A.fumigatus
GPFLPYWRFPALRGEDGKRPPSTPKEATIRSLYSNVLNLPIDLIGMDDTFLRLGGDSLQAIRLVAAARAAGLILHAKDILSSQSTLAEQSKRACLIQTIYRTWESSPPFALLHGPTRHAIVDLAQKQCRVPSNLIEDIYPCTALQEGMFITSLKHPGMYTGQIIFDIPDRMELPRLRAAWLSVVSENAALRTRVIETHEGLMQAVIVDDFVWEEETDEMLLSSDGEALEITKIGVPLVRFRYRPRHRQLMMTIHHSIWDGWSLRLVHEQLHRAYIGRDLLPSTSYRSFIQYTQELQGADEFWASELAGVNAPIFPTLPSGNYRPRVNASHRHVVRNLASTGKEEHTAATYIHLAWSLLVAHYTDADETVYGVTVNGRSADVPGVENIVGPTIATVPTRIRVNEEDTVEMALDHVQDALARMIPYEQAGLQRISRCSRDASEACRFQTLLIIEAPTDSDVDCEKNEAGNFSIIGGTTQTGMDYTAFSSYAMMLVFRTSANKSAISFDITYDAQVIGHDEVERMAHQFEHVLRHIYTLATGRIGDISFIGPRDIEQVQQWNSTMPPADNRFLQELIFAQCSRRPQASAIISWDGSWTYRELWAHSSFFARQLQRYGVTRGTPVAVCLDRSRWSIAVILGVLLARGTCVLIDLLAPRQRVRDILQIAGTGILVHSHATATLTSGLCPTVVNVSFLAAQSDSSQPEFPFTLETWGGTPEDLAFIIFTSGSTGHPKGIEMPHRLHTRAWKSPRMRIK

SEQ ID NO: 29132 - protein, 189 aa, A.fumigatus
SIPASPVMRPEIEQELAHTLLVELLAYQFASPVRWIETQDVILAEKRTERIVEIGPADTLGGMARRTLASKYEAYDAATSVQRQILCYNKDAKEIYYDVDPVEEEAEAPAASPAAPTAPVAAAAPAPTAVTPAPSAGPAAAVDDIPVTAVDVLRTLVAQKLKKGLSDVPLSKAIKDLVGGTLQSLVRNS

SEQ ID NO: 29133 - protein, 62 aa, A.fumigatus
QILSIIRHKCIHGCIWGNIDYSMKTRYTDVKCGVRLSDIAGGIYLEIVAVSCGIICTDGLAM

SEQ ID NO: 29134 - protein, 62 aa, A.fumigatus
VVQMLTDFRGKAWFAPFPLQVSNLSTRPFDQPSLHFFNLVTLNNTSKVNTLLRMLLRPPSFW

SEQ ID NO: 29135 - protein, 350 aa, A.fumigatus
TNYRTDTQLVTFDIMSALAFGRNFKAISRGSSSIMKWAGLIMEMLESPAVLGLLSLLPFSLIMRPWKIMYRELAAFSSDAVEMRKQLLAEDSTDKPLDLLQAFIDAEEPESKIKMSPHEVQAESIMMMLAGSETTSSAIMWTFHLLLLYPETLRRAVHEVRSAFSLNHLVTYKDVRSSLPYVEACVYEALRHSPTTAGLTPRISHSTGITLQGYYIPPGTEIYVNLRSPSMHPSLWDDPARFNPDRFLDSDNNKRLLFTFSYGPRNCLGRNLAWVEMLTIVANVLKDYDIALTEDSLFGPHCTDENGLPVLMPAKCFIASFPAKPERDCRMVITKRMAGVKACAREYSPC

SEQ ID NO: 29136 - protein, 209 aa, A.fumigatus
KDEFGNTEYLQSCHGTDCSVYKVLLIRPTLVVTELLPLTMATDSSMPGTVIGKAEFSDTKAASEFGTDLSRWRLNVDNGRHMWEYLESEDEARKRPQSFLEKYWLGLPYELPARPRATCALEAVENGWEFFKRLQTADGHWGCNDDGPLFVTSGMVIARYIVGIPIDSHMKQEMCRYLLNVVNEDGGWGLFIQSPSTVFTDRGWKKTRW

SEQ ID NO: 29137 - protein, 99 aa, A.fumigatus
PKVQMARTQKNKATAFHLGMCRTKIKIHVSWERITDGCEGQLKAKLAKLKRELLTPSGGGGGGGGKWKGVAIVFYRRLTRRFSWFRCRSYRCCQCVCID

SEQ ID NO: 29138 - protein, 67 aa, A.fumigatus
  UNSURE (22),(51): Identity of amino acid sequences at the above locations are unknown.
TSTSRCSTKRLSRTNWKGVVSXSTNNPPNFVFKKKDRGGIAITTTVPLTHXDHDVCAPDVWLSQARS

SEQ ID NO: 29139 - protein, 125 aa, A.fumigatus
  UNSURE (94),(124): Identity of amino acid sequences at the above locations are unknown.
PRRAERKLTFGFAAAAYEFTTLTTVPGQVLYNGAKIQILDLPGIIQGAKDGKGRGRQVIAVAKTCHLIFIVLDVNKPLLDKKIIENELEGCGIXINKQPAQLCFQKKRQRWYCHHYHRPPNTYXP

SEQ ID NO: 29140 - protein, 91 aa, A.fumigatus
SNPISTLSEENGASSGLHFGCIAFCPLFCDIELVAQHAQDASVSISCMGRESSMLPRISILALHLGLLINKLCGDLHTAEFSPPGPKVKRK

SEQ ID NO: 29141 - protein, 89 aa, A.fumigatus
SGRSQVDPLGTINFSGAVMIWPYLHVAETNAHMYRAILSQGSHANNVLWQLILVWSPGRGSAIHDHANAHCVMKVSLATRLHPRSGRNC

SEQ ID NO: 29142 - protein, 104 aa, A.fumigatus
RILTTMPYLDSTTSLPPSQSKYPDNAFENLVLDLSAALGPSSGLDSDDVNPLDIQRLMEQYVSNPEEWRPFALGDNSRGYTRNLIDQGNGKSNLVGRRSIPSVL

SEQ ID NO: 29143 - protein, 72 aa, A.fumigatus
VLKGSLQETLYTWPDQDKLRNGQPSSPQIIKKTTYTENQVTYMSDKVCKFPPRYFTQAYDNSKLTICQAGPP

SEQ ID NO: 29144 - protein, 248 aa, A.fumigatus
CAHAILTRALDFPEQEDCIFAKMNQISKYLYHIVLTISHLTKNPNNLVEKVRVLGSYTTLPAAKVAAHSCLFDAGYEREFFTKYEVDSTDFEKQDLVQRPGLAVLAVAADGTTFRVRIDTTPNNMRLTTELEDGRISIPLYYVIQTTVVYNGQKEATNVRDLNIEGTFKTYDEARAFAKQVLLSTEDNVTKDSFAEYDEAAPDEKDCGYGENVIVHAASNYGENFLISVIQTQELKNVALTEAAMRIA

SEQ ID NO: 29145 - protein, 78 aa, A.fumigatus
  UNSURE (66): Identity of amino acid sequences at the above locations are unknown.
LSLQQDCGQIVASKFFPVDAEDGSGQYPLCETDYFRRLDLLCHECGGALRGSYITALDHKYHIEHXTCSVCPTVFGAQ

SEQ ID NO: 29146 - protein, 249 aa, A.fumigatus
RYFIDVLLKSSRQGLQKRVLLADMPPGDVPLPDSLVPGNGAVRPTLNTSGQGGSFQKQTPTSPADSNRTFDSPRARSGGRNGSAVTSPVDGMQNPDGRTGRRLDSNNPGQRDPSTPRDRAGYWEKSAQRDRPSQSGRLPTKSPGSSRICKKCGEPLTGQFVRALGATYHLECFKCEVSLVVHLNETRRVLLANCLCNRIAGKLWHLSSFLSTLRTEADSIHCVRQITFGDWTSSATNVAALCVVPISPP

SEQ ID NO: 29147 - protein, 87 aa, A.fumigatus
NTQDDTLRQVRVQIGPSEARRTFCKYANYRGILWADGRSEKVCHVALTSPNNQLDHAELMDPAGQGCSSPIFGPCDRLDFASHPPGL

SEQ ID NO: 29148 - protein, 140 aa, A.fumigatus
PASIIAAALNVTEPSSTGIGGDMFCLFYDAKSKKVHSLNGSGRYPANATLEKIRKDLNLGANEKGSIPMTSVLSVTTPGATAGWVDTVERFGSGKLSLEQILTPTIELGEQGFAGSELSSYFEGLSFFDRSSICSILCHS

SEQ ID NO: 29149 - protein, 338 aa, A.fumigatus
  UNSURE (307),(316): Identity of amino acid sequences at the above locations are unknown.
QLFKWRESEDLLRNASPNFREMLKLDPKARDGVRSPRPGEIMKNPTLAKTFRRLAAEGKKGFYEGEVAQELVKVIQDLGGYMTLDDLKYHAETGTQNTEAISLKFTGQDIVKKQTAGTDGEENQGVEIWEHPPNGQGIVALMALGILEELERTGKIPVFTEDQHNSTEYLHAVIESLRIAFADASWWVTDPDVEKVPSKELISREYLAERAKLFNPEKAVDIIDHGSPAHNHCDTVYFAVTDEEGNGISFINSNYAGFGSGIIPKGCGFTLQNRGANFSLDPGHPNALASRKRPYHTIIPALITNCXDGSLHFCYXVMGGFMHPPGHVQVLFNMPAFN

SEQ ID NO: 29150 - protein, 75 aa, A.fumigatus
PVYNASTPKGGDPTKVDVNAQYAGFEYHYVYIVACSFVVWLILPGIGLLYSGLARRKSALALLFQSWMVLAVYVP

SEQ ID NO: 29151 - protein, 86 aa, A.fumigatus
DHTTSMILSMSRTTFQWMFWGYSLTYSRDGGPFIGTLKNFGMRDVLVAPSPGSAVLPEIVFCLYQLLFCACTVRASAHLRQMRPVR

SEQ ID NO: 29152 - protein, 145 aa, A.fumigatus
QARQAGIAYTIYEQHDDEAYARRAGQWTMALHSSLPYLDSILPSDLRAKLNSTTTNPWAEPDPTIAAAIPFVNGATGELMAKIPMPSPKRVIRGKLRDLLRTGVEVRFGRRLTDIRVEDDGVIAVFDGEEVRGNVLVGADGGRYS

SEQ ID NO: 29153 - protein, 72 aa, A.fumigatus
PYQPLVYDTSQVMTKGCYTCRRRRIICDNGLPTCRKCRDAGKECLGYRKPLVWVKGGVASRGKMMGRSFDDV

SEQ ID NO: 29154 - protein, 105 aa, A.fumigatus
EDEFFEDRLQAKTEKLRTLIRDNEDRFQGEFLSFPLATAILTQSQFSNLLGTVYRKGNLLFTPDGNCLLSPVGNRVTVFDLVQYVRSLTCYGILVGSFELIEWPC

SEQ ID NO: 29155 - protein, 199 aa, A.fumigatus
RNTSYTLPFSHRTNIDRLDLSPRGNLLLSVDENGRAILTNFVRRIVIHHFSFKGRVTALKFSSTGRHFAVGVGRRLQIWHTPSTPGTDNNGEIEFAPFVLHRDLAAHFDVIQDIEWSRDSRFLLTASKDLTARIWSLDPEEGFEPTTLAGHRQGVKAAYFTADQESVSRIEIFTISLADIVQDLHNQFGWSSFQVGVRD

SEQ ID NO: 29156 - protein, 111 aa, A.fumigatus
VESKYLQFPLLTSSKIYTISSDGALFRWEYVTKKDPDTMEDIAEARWRIVKKDYFMQNDAKVNCATFHAPSNLLVVGFSNGLFGLYDLPDFNPIHQLRYESCYLIVNCEAD

SEQ ID NO: 29157 - protein, 225 aa, A.fumigatus
  UNSURE (212),(215): Identity of amino acid sequences at the above locations are unknown.
PLLTCARPQPYEHLMIVFFDILLLDDDICLRKPHRERRLLLKNVVKVIDGYADIAEQHIVEFSHPSGRSRLETIFSKAVTERWEGLVLKGCEDPYVSIFPGSENGSGGRWIKLKKDYIPGLGDTVDLTLIGARYDSRDAAALNSSTKIFWTHFYIGCLVNKDAVLQSAAEPRFLVMDVIDCNSMSLKNMQILNHFGQFGACRLDSGHGFRIXFWXGISLRLEYPV

SEQ ID NO: 29158 - protein, 76 aa, A.fumigatus
  UNSURE (47): Identity of amino acid sequences at the above locations are unknown.
GCKITPRPSSPRTVDTKIFPSFCITIGSAPTNQTIGAFSPLCHLTDXSFMSMICSHFKRSDIVKRMGHLSFTFGEY

SEQ ID NO: 29159 - protein, 326 aa, A.fumigatus
LHKDHPTRQWIKPKLTEEKAPKLVAFEFTTSTSRKPHSLIFIGGLTDGLCTVPYVAPLAAALEPTDWSVFQAQLSSSFGGWGIGSLDKDVEEIAKCIDFVRSLKASSASGSASAPGKIVIMGHSTGSQDVLHYLYTQGDRPVVDGAILQAPVSDREAMLAEMRKPRDVGAEAKGSWEQLVSLARQAPVGDIILPLNLSSKVGLPPDPVSARRFLSLASPDSPDRPAEDDLFSSDLTDQRLRETFGAVATRGLLRSKLLVLYSGNDEFAAPWVDKKALMARWREATEALKPGTWDQNSGVIPGASHNVKDQGQADLTERVTRYLKSI

SEQ ID NO: 29160 - protein, 177 aa, A.fumigatus
RKGIERITMTLLLSLLFLFFSFHFSFSSGFLFLPLSCPLLSSYSSFPSSPPSSPLLFSFSFSLFIFSLSFLLLLSFPLLPSLLVFSLLFLSFFIFPLLSFSFLLFFLVFLLSPPVFLLLSHFLLFVAYLSSSSLLLSSSISPFFLPVSLPSLSLRLPSFVLLSFYLPSLFSFLSLSL

SEQ ID NO: 29161 - protein, 168 aa, A.fumigatus
PFYSLSFFSSFLFTSLSLLAFFFYLFPALFSLPTPLFLLLLLLPLFFSPFLFLSLSSPSLFFFFSPFPFFPLFSSFLSFSFLSLFFPSFPSLFFFSFSSFSSLLPSFSSYLISCSSLLISLLPPSFCLLLYLLSFFLFPCLLSLFASLLLFYFLSIFLLCFRFSLSLF

SEQ ID NO: 29162 - protein, 180 aa, A.fumigatus
ELKKRDREDHHDPSTLSPFSLLFFSLLFLFWLSFFTSFLPSSLFLLLFSFFSSFFPSSFLLFFFSLYLLPLFSSSSLLSPSSLSSRLFSPFPFFLYFSPPFLLFSSFLSRLSPLSSRLSPLISFLALRCLSLFFLPPSVFFYISFLSSCFLAFSLSSPPFFCFTFFLSSFSVFVSLSLSF

SEQ ID NO: 29163 - protein, 147 aa, A.fumigatus
NCLPLCWFRSLTGTLERQTCTGRQVATTASHLQPVTSLVVDPTSNFILSGSSDASIHVWSLVDILSFTKPPSGRDRQQPNSPVRTFSNHRAAITSIAVGHSSGRYNIAVSASKDNTAIAWDYHTGRLLRTFLLPGSATCLILDPVVF

SEQ ID NO: 29164 - protein, 116 aa, A.fumigatus
DFVDGMMEGFSGLVTQPIKGGKEEGALGVVKGLAKGTAGLVTKVPSAGLGLVAYPFQGIVKSIESSVRSKTRKAIITARLRDGYELSRREEVSQEERRFVLQKFQSLLCGPTATPT

SEQ ID NO: 29165 - protein, 224 aa, A.fumigatus
FSDALGIPLYYALLTLRTLAQRRLWHTLPHSLHFCELPQHGPQVLDIVTVHIYFPYILRYVKHPSASRIVMEANPQAVPRLVPIALAPARASSVDMQNDSNADLTTMRFNCQGCVRKKGKCNRVVPTCSNCSKSKLQCVYQAPLPRKRKRSQVEEDVYERLARYERILRENNLLPTASALAPCSKAMDTSVVSTRDPSPAPNMQPATSGKLLSAGGKSRYIDSV

SEQ ID NO: 29166 - protein, 535 aa, A.fumigatus
DGIEEILKARILASARHKAFVVSADEREGCLRNLLNWGHSIGHAIEAILTPQILHGECVAIGMVKEAELARHLGILKGVAVARIVKCIAAYGLPTSLKDSRIRKLTAGKHCSVDQILFNMALDKKNDGPKKKIVLLSAIGRTYEPRASVVPNEDIGVVLAPSIEVHPGVSTTSEVVCAPPGSKSISNRALVLAALGSGTVRIKNLLHSDDTEVMLNALERLGAATFSWEEEGEVLVVNGKGGALQAHPSPLYLGNAGTASRFLTTVATLATASSVDSSVLTGNNRMKQRPIGDLVDALTANGAQIEYVENKGSLPLKIAASGGFTGGQINLAAKVSSQYVSSLLMCAPYAKEPVTLKLVGGKPISQPYIDMTTAMMRSFGIDVKKSTTEEHTYHIPQGRYINPAEYVVESDASSATYPLAIAAVTGTTCTIPNIGSKSLQGDARFAVDVLRPMGCTVEQTDTSTTVTGPADGVLRPLPNVDMEPMTDAFLGASVLAAIARGKDSNHTTRIYGIANQPVVFYHKATRHPRIGSPPG

SEQ ID NO: 29167 - protein, 101 aa, A.fumigatus
RAPPLPLTTRTSPSSSHEKVAAPRRSKAFSMTSVSSECSRFLIRTVPEPRAASTRARLEMLFEPGGAQTTSEVVDTPGCTSILGARTTPISSFGTTLARGS

SEQ ID NO: 29168 - protein, 61 aa, A.fumigatus
  UNSURE (15),(23),(28),(34): Identity of amino acid sequences at the above locations are unknown.
AQVQGTDNLYGTRDXLSRNEKLXTSGSXKLEEPXNGNARAILSGDPGLYLPNGPQRTILPI

SEQ ID NO: 29169 - protein, 99 aa, A.fumigatus
PVATSVFPAVTSPIRPQYPVDLHIHSGAEDTQSSTMQAVPESRQQTFEEIYGPPENFLEIEVCSNNFHHETTPPNQLTDKSDIILAVQVKTNLSSYSGP

SEQ ID NO: 29170 - protein, 75 aa, A.fumigatus
DHDNGSMIMRAVTRHFTQNSLEDKDDPMNSPAIPLPSSVILNAIVENSFSYLSAIILHIILTAKKSTFFKSPRPL

SEQ ID NO: 29171 - protein, 228 aa, A.fumigatus
RSRFYLTDQSQHPSSPRSLPPSALSILSIFTFTLGQKTPSHRQCKPSLNRDNKHSRRSTDLPRTFSRLRYAAITSITKLPHPINSPTSPISYSQSKSRLTSHRIQVRNPQTHGTSRNMYTSYEIVCRTNIPAFKLKHSVVRRRYSDFEYFRDILERESTRVTIPPLPGKVFTNRFSDDVIEHRREGLQRFLQIVAGHPLLQTGSKVLASFIQGELSSLGLVVYQEEKD

SEQ ID NO: 29172 - protein, 168 aa, A.fumigatus
  UNSURE (160),(162),(167): Identity of amino acid sequences at the above locations are unknown.
LLPYIALSSHILFAIDSRQMDCRLDSMENVVIPLIQRQFHFPNMNFATQGSNSFSESSKGCCDNRIRLRSLRGLRKIFLRGKEEASRLRRVITVSFSLVSGRSLVSSSIFYFSFPSPFLDPSAANAEPEWMKACFKILISKTIVYCRVLVWTKTERLRCXNXERDDXN

SEQ ID NO: 29173 - protein, 511 aa, A.fumigatus
  UNSURE (411): Identity of amino acid sequences at the above locations are unknown.
NVGCCSSGRTCSLYSASSSVELTTRWRIYPPSSGGRELLHAPQVRAFQCGTPLVSRRADRYIGNHAQGVAFSARKLKIPATIVMPSGTPAIKHLNVARLGGSVILHGNDFDAAKEEAHRLEKQHGLTSIPPFDDPYVIAGQGTIGMEILRQANLEKLEAVFCAVGGGGLVAGIGVYLKRIAPHVKVIGVEAYDANAMARSLGEGSRVFLREVGLFADGAAVKTVGEETYRLAREVIDDVILVSTDETCAAIKDAFEDTRSIIEPAGALALAGLKKYVSQNPSPDTSRELVAITSGANMDFDRLRFVAERAALGERKEALLSVKIPEKPGAFANLVEVILPQAVTAFSYRYARAESADVLMGISLSALTGREDLAKIMDQLEKAGMPAKDLSDDELAKRHVRFLVGGRCDVXDERLFMFEFPERPGPWPISSRRSGPTRTSPGSTTAIMVVMSERYWPAFSVQLNKKKISRPSSTTSGYPFKQSKPNLPPYQKFPTLLKKNCCYPTPRLFLA

SEQ ID NO: 29174 - protein, 68 aa, A.fumigatus
APIMPDQSATNGTTTPVTAKLSNLALTEYTAAPTPPSEKDQDTALGVSRDWGIPNAFLLPNGYPDVSS

SEQ ID NO: 29175 - protein, 105 aa, A.fumigatus
PNGFVFPNIISQPLLATQYLRLILTSRVYDVIQETPLHHAINLSNRLECRVLLKREDLLPVFSFKLRGAYNKMAHLSPEQRWKGVIACSAGQSLSMWYTTRLEES

SEQ ID NO: 29176 - protein, 92 aa, A.fumigatus
ISRASRTLANFLPTLRPNQNISRFHYRNYGGDVRKVLAGIQCPIEQKKDFEAFLNDLRLSVQAKQTESPPLPEIPNVVKKKLLLSHPPVIFG

SEQ ID NO: 29177 - protein, 204 aa, A.fumigatus
NQDDIVNYLTSKTICFLSHSLHSRSVRKQSNLPKEDSRSFAQRPGHGVGIVGLNSDDLHMRRNALQINPDTGNQTPSADSTENSFEFLQVCLTQNFHSNGTLSCNHVRIIKGRNAGQAVLLLQSMSFLLGSVEVVSVKDNTAAKTRNIQMLDGRGTRGHDDGRGDLELAGGKCNALCVVTYIPVSSPRDEWCTTLKGSDLRSMQ

SEQ ID NO: 29178 - protein, 148 aa, A.fumigatus
GRITSTRFAKAPGFSGILTLSSASFRSPRAARSATKRKRSKSMFAPDVMATSSRLVSGLGFWETYFLRPASARAPAGSIIDLVSSNASLMAAQVSSVETKMTSSITSRARRYVSSPTVFTAAPSANSPTSRRKTRDPSPNDRAMALAS

SEQ ID NO: 29179 - protein, 189 aa, A.fumigatus
FITNDGTTTGTLSEIRRQYIQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCLYP

SEQ ID NO: 29180 - protein, 128 aa, A.fumigatus
YRVEEVETPALLDAWKKTIALIAALQPVKVIPGHLEPGWELDAQADIAHTQKYLDLFAEKVTYAPTKPQVQELYDFFQGAFPQCQQNLDFFLGHLSNQFGEGGKVWEENRHHDVGKRTIEGLTGYWFK

SEQ ID NO: 29181 - protein, 153 aa, A.fumigatus
SSTHGQSLPGMENMNSLMDYNTKRKSGDPDSDNKVSPALKRRKVFGPVLPSSPDSEDTETERRAEGARTVESTRTDGLNQEDEDQDQDEDEDDEADDDYGPSLPPLGGEVTANSNMDKIYDESHIQPGKPDAHNNNSQRDAWMRLHHELENPR

SEQ ID NO: 29182 - protein, 97 aa, A.fumigatus
RKIGLKYIVMCSLLLAASVCWTVYSSTLVTHIDNAQQGGLCLKTAQVVKVELEGLCKFKKSVNRRYDVIGAADPPIPRTGGLSRRCPRRHCIESDRS

SEQ ID NO: 29183 - protein, 98 aa, A.fumigatus
RGASEIWRNLRLWEIQTSCKADNDKHLNTSMRHPSHRSEIICKLIDDFFLNFNGRLISFALTYKDIPWLPLRRTEFASRTLNVIFCAKVPTPAPYIRN

SEQ ID NO: 29184 - protein, 117 aa, A.fumigatus
LLPKPHPCLDPIAVYHSTMSEPGPESIPTSADPRSKRPVKRRAVTPLSEQASQIEHLFRDPNKEIKLPEPSKQRTADSLAPPPEIVANVQGSSAGAGSGEFPFYKASRKKGIRSSAP

SEQ ID NO: 29185 - protein, 125 aa, A.fumigatus
TVYLTHKLHSHSFLCPVRHPYTPFPHVSMRHHGLPLLPNPTQDERDPLRWPVWLKRCAIVTTSMTNFVTNMAGAGLSVAVPELIQEYHKPESAVVQLLTVGSPFNQSDYSSLLMVRRLGSITSCF

SEQ ID NO: 29186 - protein, 117 aa, A.fumigatus
IQRRRTKINRRLNKMIPTTYLLLAVSIFLWLQLLPSIHASNTAGTTVIVTVTPTISHPASYTSLEIFKDTVLSTSNAYRREHNASHLTWNETLTKYAKRWAEGCKWKHSVSHALLIR

SEQ ID NO: 29187 - protein, 178 aa, A.fumigatus
QVHVATELINKGGPYGENLAFGYQDPAAAVAAWGDEGQKYDYKLPTGFSEETGHFTQLVWRATREVGCAAFNCGYQNGNDAKNKEGRYTRAQGWYVVCEYSPAGNVVGNQNAFFRVNVQPTSTYSGPETAGSATGTSASASGSATATATSGVEELYDGRLRDQYQNAFVGLIVFINLV

SEQ ID NO: 29188 - protein, 137 aa, A.fumigatus
  UNSURE (6): Identity of amino acid sequences at the above locations are unknown.
NLHTFXGQTFSENPTDKFKQFFWRPRPPTLLSKEEQKQVRKNLREYSKEFDEEDRYAVDIANTAVVEKRKRVLNEWIAWIRREKELLAEEKDAYGLPEEADDPKLAKDAAATTQEQGETVVEEIVEEIIEESEEVIG

SEQ ID NO: 29189 - protein, 329 aa, A.fumigatus
TCLRYHNSGRSNWTLHGLTTRAAQSIGLHRDGRHFNLSPLECELRRRLWWHIVTCDQRAAEDHGLSIIAHNEPCDTNLPSNLDDQDLSATATVPPAPQPRWTEMTFPLLTIQINRHLHEISRKTSQGVSPDPLVRELKDYIQRNYLQYGDANIPIQQQGLVLADVLTTKVAVYVRQKALQIHSQGQSQCPPQESATAQETLAMACHGLERALELQTNDLLRGFRWLTATYTQYHLLCYILWHLCVYPASVHVERAWRSVEAIFEVVERDPTWPDPGPKWAVMSQLRAKAMRAREGLTNRQADVQEKGPENVLDWGNWDLELFGFGEWTI

SEQ ID NO: 29190 - protein, 68 aa, A.fumigatus
YFRFSRYETRIWMSYTWLSSTATNPMPTSSIIPENSFISVRGAATNFCPWNCCLRRRRAIDMDPRSAR

SEQ ID NO: 29191 - protein, 604 aa, A.fumigatus
SGLSSANEYIILPQSPRHSSEGLSEKLRRRLSRESKRLNVVSRRSDRRSGTSLFSISSKSAKYNGAVVTPHEFGSGLMSERGYDSDAQFISTPTHIADNVKAAASIGREGVLPAQPYPNEGNSFLAKDGKCPVYQHTEVSLSSPEHESWSPQAMHGFFKSHEPNVQSPKARGSPRPSASLNNRASSGENNANCGLVPAASASAASLNIFEGKDIITPTLQEQSGSPGRGSGTLLHTFNLVSPSTERYSELLITKRRQRHPTCEDQSIHLADLGISKMLASASTSPVILSPSQSSYEDPHSSTSGIGTTQYQGGGIGRPARILTPVWDGGVLKLGVQDARQASSCYSPRTSSASADVPANLEKREVSCSRTPFAALSSNSSSRSVSLLEKHVPSLDCGSLGNTDALKSRFTEQFDLNRSITSLGSVAMRSGVTSPRKVSIGWMSGGRRLGYGYTVVDGDTYETAEKDSGKASSTRWESPNKPPIAHIIDRLRVSRWSGATALIRPSNASDSASCDSVVNSRSWRRFAVRRKNLADAQMSDNRRVPWSQKPTNCSSDCAGERQASGHYAQAFNESLRDSSMESARELQSSHSLSSPSGGRRIRANV

SEQ ID NO: 29192 - protein, 419 aa, A.fumigatus
  UNSURE (37),(74),(77): Identity of amino acid sequences at the above locations are unknown.
RCSVPGIPPSQRFRKGWTFKGQPRFSQTRDPGQASCXRRPDRAIFEPWVSRAHEGVDYEVQRVAIKRKWDRLLXKSXGQQVTVNYRDHTQYATFDTIGALAFGREFNALTNDDRTVIRWIEATGLYLGIRKNFPLLKLWPFSRVLRQYRERYERFIAYSKESVTRRKNLLSTVGERPMDLLQAFIDAEDPENPHVKMTADEVMTESIAMQLAGSESTSFVTSWVIHLLTLYPQHLAKVTEEIRSQFSPSHLITFAECRDKLPYLEACVYETLRYSPITSGFLPRISYTKGLTIQGHYIPPGVEIAINLHGAHINKDVWTNPHLYDPTRFLGDDQAKRNVFAFSYGHRNCIGRNLAMMEIMIIIANILKEYDIALPEDSVHGPWNVDALGRPRIMPTRSALFTTPKYPERDCRLVVSRRQ

SEQ ID NO: 29193 - protein, 407 aa, A.fumigatus
RSSNSNLHKPLRSSSLCRSSRLISKETNLRVSLDEGEYEAYPNEYKIAAKNTDEYNSERIGLVFGISAVLYHSPTQSYSKSAAENKMEGLNISNQVFDLSPLDIIPSHLYITNAFFYENKTPGPRPFMQPSLLKESLYRALQNFPILLGHVRRHRRNAMQIVVDCDNLNLPLYEEQTHPQLHFRHLKDHQFHRDVWPKDANVIDPRASPNGELLQVHIHRLAEESGVVMVVRIAHCAVDAKGYVDFMQSWGWFARNHSHPEGDSWPRLLADRRVMYEYLPPDVQPAAPRSMWHPASWLLRLLSTLVVLFLGLYKRLLGDKTPPDEIESHLFSVPPHTLDRLRYAATCIDSSSRVSDHDIISALFTLAFAHTKLLLTCRTQTVNDKRRLRLSPPHWCTEHLHMQLRNR

SEQ ID NO: 29194 - protein, 91 aa, A.fumigatus
SNLGYCLTPRTMKLSVALLSCASLLPGALSFSDACRQGLLYCGSTLEKYNGTCTPVDSQGKLSCPLAKSTLNRILINGAPIGHQRQSGRLS

SEQ ID NO: 29195 - protein, 283 aa, A.fumigatus
PICKMRYPFDQGDQETWTQVGQLLVATGLSSIIGIEREWRHKSAGLRTNTLVGIGAALFMLISKLGSFDVLARGLVVLDPSRIAAQIVSGIGFIGGGIIFKQRNEIRGLTTAAGVWLSAAVGAACGAGLLRLASVATALYFVAVLVYPTVLRVLRQYLDRKDTTEISPVIRYRIGADGLQTLLMNIMQAGFRVRMITRLEEVFVNQAASKGPAGGDGYQSISSISRSPMTPAAQIERLERIFDIRLTVNGTRGPDSLMHALSQLESIISVSIEDDEGEFVQRV

SEQ ID NO: 29196 - protein, 126 aa, A.fumigatus
  UNSURE (119),(123): Identity of amino acid sequences at the above locations are unknown.
ESEIRMASQQLSPVPKPLALFDRFIAQQTETMALKEKVLSISGDSFDVKLANGQPIFQIKAKHMSLSGRKSVLDMAGNHLFDIVKEHLHIHTTFAAVDPHGKKLLEVKSSFSWSCVFYXTGDXDQA

SEQ ID NO: 29197 - protein, 139 aa, A.fumigatus
  UNSURE (19): Identity of amino acid sequences at the above locations are unknown.
LGTGESNCPRYILDSRPIXTVYELQGVALIPVNRRSSPRSMADEHSHSRVELYDSGLTDPSDSEIYSANHEVSSPMSACSSPLILYKPPSIWGILRGAAINLILPFVNGLMLGFGELFAHEAAFRLGWSNTKVRSMKSL

SEQ ID NO: 29198 - protein, 203 aa, A.fumigatus
LAILQISSFRPQSSRFPVRYGGPTQTLSGKISWKPASSIPGVMSARFNSTSSVTDAAASEHLSGAPTDTGVPDLSDLSAADLSSIPEHIGYLKDLGLDYGWGPFSIIQFSLSISTYGEGLPWWASVVGTGILLPIALLYPTLGAVDTSTKMLNIKPVTEPFAQQIIILGRKAIQIEMLKLPTRNSEASPGARYRGMESINSHA

SEQ ID NO: 29199 - protein, 79 aa, A.fumigatus
SRKLYLLHLTPKGYVSKNSNLINPRTPASRDYLQILGTFLFPNANNFINLIFFVYTLLLGPIPYGFSNNSNHPCPRGGT

SEQ ID NO: 29200 - protein, 116 aa, A.fumigatus
SLPRRNNRIQRFNVPCSPTPPTSSSSRRSFPPSSAGPCRCAPHLCTTGTPPSHGEPGASPPRQVPSSHTPTPGRRHCASSPEARSKRRRYQRPAARASGGRCHGSGRRWSRPWRRR

SEQ ID NO: 29201 - protein, 310 aa, A.fumigatus
APSARRQHRRADRCPGETIEYRGLMSLAHQLLQLLPRLADLFLHHLPGHAAVRHTCVPQVLRPLTESQVLLRHDRYLLLILPHQVGDIAHRHRKQGPSGDDTKGQRRERAEEDATVPGDDGAGHGGDDDVDAAGEEALAGFGRGGQRGDGVGEGVLDVQGAGEEVVEAVLNGEGVVVEEETGLADLGRQDVSWGRRGGGGRGSLSAGGRELDGGPGRFGDVGWEVIIDGFFLKTLVKSKICRRLWYRNSLEHTLPRGSSAYAVRLGYRATPPARRVAAIGATARWTSQQSSKRETEKGHSPAGTLAGMTS

SEQ ID NO: 29202 - protein, 288 aa, A.fumigatus
SIDDSLQVFLPGRLAMKDQLLVPLRRRPWTCQKCLQRLQLPRHQTRRSFETAASPFPRPLDSLPADYARTKTVDDDTLRRVFDSQQFWREFSQQRAAQPKLTGLVQNQYLTSPDGFRTFANVSLQKCQAIVSKVLAASTLEEYRTMARDLDRLSDLLCRVIDLSDFIRVIHPDPQVQEAATLAYALMFEYMNVLNTTTGLNDQLNKGGAIPDVTSQWSNKENIVGQILINDFPNSANHMPPHERARFVKLFNEFPHLGSSLVNGAEPGQFPVQCWRPKAWRGLYSILM

SEQ ID NO: 29203 - protein, 68 aa, A.fumigatus
AADDDGEDRASRTAAKRKRLGSSNVNQPRYFFLFISTTTRFLSLSSPPPLALIDLSPSGCHSGQCSSR

SEQ ID NO: 29204 - protein, 210 aa, A.fumigatus
RLQKKPIYDDLPTDIPEPTRAPVELPPTRRQTSSSSSSSPTPTDILTAQVRQARLFLYNHSLAVENSFNDFLSRALHIENAFTNTVASLAPSPESGERLLPGGVYVIVAAMAGSIVSRNRGIFLRSLSPLAFGIVAAWTLLPVTMRNVSDLVWEYEKKVPVVAEKHLALRERAEYLWYTGVAHSGMARQMMEEKIGETRKKLEELVSKGH

SEQ ID NO: 29205 - protein, 269 aa, A.fumigatus
RGSFQPPWLKTTTPSHHPSTHTLLPTGGEGGKPTHTGGTGTGTGTGTGHPQPTTTVVPGGDSGSVSTVTETITKTTFQPCSTPIHTQSGTTYYSTWLTTSTYETTTCYTTHIPTTIPASPQTTTVTLPGPGNSCPPPSTVTVTVTVSSGGDTGPHTQAPAPGGDSGSGPNPGTGTGTGSGPCKHCETITYTNTYGYTTTIVIPPISEPTSSATTRTTGTGTTTTKPTPPVGTGTAPGHSHTRGSPTGTGVGQAPTETKTWHFERRIVRV

SEQ ID NO: 29206 - protein, 139 aa, A.fumigatus
  UNSURE (132): Identity of amino acid sequences at the above locations are unknown.
FPPEIDCTMNAADHEIERAEEDAIPVSSRTSLDSSLSSSSDGSQPRLRTMYSRRTETDLERYQTSSQVIDRIETQRLQHALTVGESIKTQSRSSGRGPLPAFGAGKPYPPHLPNREKYVVEFDGEDESLFPXKWSTRRK

SEQ ID NO: 29207 - protein, 232 aa, A.fumigatus
VIPTSGLAMAARLKVLGMENLIIERSEEVGDVWKNRYEYLSLHFPHWPDALPYFKYPQHWPTYTPAQKQGLYMKWYASALELNVWTKSEVVKAEQDAEGRWTVVINKEGKETRTLHPQQLIMATSLCGVPSIPAVPGMAVFRGVIRHSIAHKSARDFVGKKVCVVGTSSSGFDTAYKCARLGIDVTLLQRSPTYVMSLTHSVPRLLGWYSPDKDGNLPNLDVQDPLMFSTPF

SEQ ID NO: 29208 - protein, 184 aa, A.fumigatus
ETMATYVQESAGTDSAFPASLQSKGAVLNHDQVPKPVADDFMYAFKYNHSLPTTDVLGVEIPADCDAQKEAEGIVARLSTATSQGDAHAFAGLFLDYGETLSKTRPEIPTFADFQCTGVWRDKLSFTWDFRTFNFRAGHPQRPLPIFLLQTRATNFTFLEPAPFGGLALLPGLLAATIRCVLRD

SEQ ID NO: 29209 - protein, 462 aa, A.fumigatus
  UNSURE (434): Identity of amino acid sequences at the above locations are unknown.
SSPALLSSFTFSLLLPGFIMIGATSFLNHSGPRPPRYRTPSPPRRAVEPISPFTTTTDFRASWIDRGDSQAASYDRDRVTSNNDVYSSTNRGSHGRTSHGRSSSTIDTLATIALATSPTFAPLSYRPPSQDPTPAMPLFPSQSIESTERPAKRPRSEKSPSPLHQPQTTVAPDANPSSTFDSMKTDAELLLNFARPSNFQPAAFYPSKRVSIDESYHPHYGEEPKSHFRAGLGSTYILPDGEKSAYHTSANTAFPASRMRSQSDGSAFISRPVIQGVRPNTSSSTLPPIVWQEEEGNAKTGPGPPSTKFPGAETRYENSVFTGIDTGADRASLDVPPRGDDDTESDENNQANCAACNLVRIPVDSEEQGDVTWISCDGCKQWFHIVCAGFKNDREIRTVDKFICRRCRPIHGQTTFVRKSSRARTAIDYAGLNXSLVKAASHSLEHHYIEPIREGKIRFLPE

SEQ ID NO: 29210 - protein, 74 aa, A.fumigatus
LLVASTETAPYDMSASGTLRANTNPQMRKHDSAIPESGVVVSIIINSNPEALISRQNMLSDYSDTKKGCKLLCH

SEQ ID NO: 29211 - protein, 65 aa, A.fumigatus
CHEAQTNTVANVSGTVITQYSQKFPDMIHDFAPPSFDKSKKFVPNRPYILKYQPLSATKVRRGLH

SEQ ID NO: 29212 - protein, 87 aa, A.fumigatus
FYCMSSPALTSIISRPENRYANYPEGSIDDSPVLRQKNPNVFFPPEFFPVIRADLNGTFFCDYDIDGDGNVTKHSLSNPLPSSSSPY

SEQ ID NO: 29213 - protein, 66 aa, A.fumigatus
LLQAGVTHAFVNLGSDHPSILEAMVKGQKEKPDQFPKIITCPNEVFLEIRLSHTLSHSETGPTSTC

SEQ ID NO: 29214 - protein, 96 aa, A.fumigatus
MVALSMADGYARLTGKPQCVIVHVDVGTQGLAAAVHNASCGRAPVLIFAGLSPFTIEGEMRGSRTEYIHWIQDVPDQKQIVSNTVVIRPKSNPART

SEQ ID NO: 29215 - protein, 217 aa, A.fumigatus
SEGPVYLTGAREVMEEEIEPYTLAQGVWGPVAPSALTPEAVELITSHLAAAKEPLAIVGYSGRSARGVKELVTLADTFKGLRVLDTGGSDMCFPGDHPASLGLRYGVHDAIKTADFILVADCDVPWIPTQCKPSDSAKIIHIDVDPLKQQIPVFYIPSLATFRAESATAFKQINDFIASSKALQEVVHSEEQVAFGQRREEVCHTGPEGHANGATRP

SEQ ID NO: 29216 - protein, 77 aa, A.fumigatus
TSTPELQYTAVFYSSFYNKINLNRTNKETYATYQYPISIGLYPAAEILRWLHDNPRASPSVGVLLTFGSCRNSEPDT

SEQ ID NO: 29217 - protein, 86 aa, A.fumigatus
SGQHIWAYCRVHWSGDCLGAEFRLQGKSDRFGDSITGADMKQYSATMKKIREQQPGVDTPPMFNVSFTPVEHPDTWRLVNQGGQGM

SEQ ID NO: 29218 - protein, 395 aa, A.fumigatus
  UNSURE (32): Identity of amino acid sequences at the above locations are unknown.
TRGGRGLPITTPEWHFQKPPGDDRISNFPLTXNLRLIREDALDEERRVRDPTDWHRRDIDDSGMQYPFDGIRTGEVNRFPHALLEIKLRGSAHHIEWVNELMVSHLVKEAPRFSKFVHGVAQLFEDHVNSFPFWLSELENDIRRDPETAFREEQERLAKRAEDDMAVGSFLGNRASPTVRPMVGSPVTMFSELGSSARARQPSQPGPQPSRPTIQEGEGRTFPEESAPGETQPITSSRLAALFPSFPISRSSRSHRQSVVLPPGVREPLTWIKDSGPVRVESKVYLANQRTFIKWLHISILLSSLSLGLYNAAGKHNDIARALSIVYTFFALFAAAWGWYMYEKRSRLIRQRSGRDLDNTFGPIVVCIGLAIALVLNFAFKVSLIGSEIRLLGLT

SEQ ID NO: 29219 - protein, 265 aa, A.fumigatus
QVCPGRGRSGRLHEGGVEICVSHLHIQARITANMTSLYLVYLFIAKFVLVYIHTAAASIAAIRATKALRLDFLHSLMRQDMSYFDSNAAGSPSVKVTTNGNLVTNGLSEKLSVFVQSCATFIAAFVVAFAVQWKLTLITVCIVPTIVIVTGICMGIDVKNEDKLMGIYSRASLVAEEVFSSISTVHAFWLQPVMAKRYEDHLAELERVGMKKSPNYGVLFSTEFFCVYAGYGLAFWQGIRMYARGEVHEPGDIVTCVCCLLDGCS

SEQ ID NO: 29220 - protein, 91 aa, A.fumigatus
LRPDEVEEAPKPSGLRSYMRIFNYADRTSMILYAIAMVAAIAAGSALPLMDLVFGKFVTTFNKFALGAVGPDDYMREVSKYASVICTSKRG

SEQ ID NO: 29221 - protein, 208 aa, A.fumigatus
  UNSURE (207): Identity of amino acid sequences at the above locations are unknown.
FSVSVIFAVVVAATALTQVAPQIITITKAAAAADELFRVIDKQSAIDSLSISGLAPETCVGEIEIKALDFAYPSRPDTQVLNGLNLSVPAGKTTALVGASGSGKSTIVGLLERWYDPAAGTILLDGIEIQKLNIAWLRTQVRLVQQEPVLFSGTIFDNVAFGLEGTSYAEAPYEQKLALVKEACRDAYAHEFMSSPRGWKNQGPHWXS

SEQ ID NO: 29222 - protein, 69 aa, A.fumigatus
ASSYCLPGSTTTRLPASQKSQRVLGIQDVHRLALDTIERITEFEKLKGSPVFNARHNNCCALLKHHIVH

SEQ ID NO: 29223 - protein, 288 aa, A.fumigatus
TTPFGTSRVDPAGKKKYGIAKVNYRISKLQRHTTSIQVLKHKMKPSLPLRRICRGTNITIRPPTSPALVPRILHEQRTPPAPSTRSTPLTATTRRSFNLSSLSSFFPPSNGNGNDNNKSRVLTATRTLPYQPSALFKVISSVESYSQFLPFLTASTVTHRDPETGYPTRAFLTVGYGPLSETFTSRVDCNRDKWTVEARSGAKFGVDSKDGQEGGIFPGANEGIFEYLSTKWELVPVPGGSVQTRVQLEIQFEFRNQFHAAMMSAVEGQMAGVMIEAFEKRIREVEGR

SEQ ID NO: 29224 - protein, 74 aa, A.fumigatus
ISSCTRVCTLPPGTGTNSHFVLKYSKIPSFAPGKIPPSCPSFESTPNLAPLRASTVHLSRLQSTRDVKVSLRGP

SEQ ID NO: 29225 - protein, 89 aa, A.fumigatus
RPPSAPQQRSSSPHETGSETQTESPAAPVSAHFPQGPAPTPTLYSNTQKSPRSRRERSPPPAHPSSPPRTWPRCAPRQSTCPGCSPRAT

SEQ ID NO: 29226 - protein, 130 aa, A.fumigatus
MIDEDEEDDEGSGEEESGKRRKSKKRRQRRVWVNQLLGRRMRMEFAEDATTRYKKRFGKDGEGKKKDESVITEVEDGPLERESTGDRPQQSHPEKPKRNNKPEYSRYAKETVQKLSGAIVEPQGKKITFD

SEQ ID NO: 29227 - protein, 248 aa, A.fumigatus
HEETSHPVFTYILFFHRLRQPKMASRRRNIGASRRRRRRDEEGEDEGSLEEELEDDSLSEGSVISHPGDDDDDDDDDDADGEGSDESDGEASSSPHLDRTNRPQVNGLVPEINQRSGRRHSSSPGKRHIATAVSDTEAMMNGLTLSDQASEVAEIHFDDMKGESGSLTGRTPSAPPTEAKRGTFAERKRREHERYAKERDENPAFVPTRGRFFLHDKRSTEPGPNGHRPFSKSKSRPYGLIVDGNVRR

SEQ ID NO: 29228 - protein, 570 aa, A.fumigatus
PESSNGIRFSITDLSPPTARLLPTIYQDRVGISLYDAQFSQTENGQRVRGPVSQEIIEQVVDRLVRFKITCDDFCVPPGNIHVLATEATRTAPNSDEFRARIKARTGWEVRMLSKEEEGRIGALGIASSSHSVAGLAMDLGGGSTQITWVMEEDGVVSTSPLGSFSFPYGAAALKLRWEEAKRQGGDAEAKLKEQMTKNFQDAYARIQLPERLVEAAKRSGTFDLYLCGGGFRGWGYMLMNQSKVNPYPIPIINGYRARREDFHDTVSVLETVSDSEVSVFGVSKRRASQIPAVAVLVNVIMDALPPITHIQFCQGGVREGFLFDRLPQEVRAEHPLLSATSPYAPPSAEAIKDLLLQALPTSSSPKASLQAPESFDACLISALANMLYAHAQVHRASRSAAALHSTTTGILASINNLTHIDRALLALILCERWEGDLPPADQTFHYQLSRCVSAQEAWWCQYLGRVAALIGDVYPAGRVPETGDRIQLETTWTSTVKKKESCDMLCLRIIFGDDAAAAAATGRHMLQERAEEIEKAGKKKNWINEYGVRVGTHIFYQSPSTARISQRNF

SEQ ID NO: 29229 - protein, 326 aa, A.fumigatus
TTCHSIMTEQVRFVTLDVFTSRPYAGNPLAVVFLPDSNKPAVTQQQKQSIAREFNLSETIFVHSEKGEKRIIDIFTPDSELPFAGHPTIGAACWFLYLSPDEGDKGVVKTLTTKSGDIPISLQLGQPWPAVTARIAHNTRLHQSRFPLQQLLRLHPFLSGFFRITGTVEPAFPIFSIVNGMSQVHVELPSLEALAAVTTASGGEVISGGSGYLDEGWDAGLCVTYFYVRNVKDPQTGANTIRTRAIFGNLEDPATGSAASGLAAYLSLMERKPGQYKYNIVQGVEIGRRSEIGVEVVVNQDNKIDTVELQGGAVKVSEGNILLPPK

SEQ ID NO: 29230 - protein, 235 aa, A.fumigatus
SLQHSFEDQSSVVNRMSSTQAPVEPPKRRRIGVLTSGGDAPGMNGAVRAVVRMAIYSDCEAYAVFEGYEGLVHGGHMIRQLHWEDVRGWLSKGGTLIGSARSMAFRERAGRLKAAKNMVLRGIDALVVCGGDGSLTGADVFRSEWPGLLEELVKNGELTEEQIEPYKVLNIVGLVGSIDNDMSGTDATIGCYSSLTRICDAVDDVFDTAFSHQRGFVIEVMGRHCGWLAFLPPRG

SEQ ID NO: 29231 - protein, 129 aa, A.fumigatus
ALAVTCLGVTSIFISSLEKSFSAAHKSLTQGASVAVTMADDRFTLPLRPLIEKRDRPDPLPLEIAQINAQWGSFRDVSQESLRAKIEEEKSKEYTIEEEEGEGAGAELDTTERLDQLYKRRAEIIQFAM

SEQ ID NO: 29232 - protein, 157 aa, A.fumigatus
  UNSURE (97),(127): Identity of amino acid sequences at the above locations are unknown.
IAARSGASADEGIRGGVLPVSGGLLDNTPQASNSAIIPFVPQSMSFGILLLWITLWMSPAARWHIICRLCQGLLQPSADQMVYKMTAMDPSPASSSXLLEFHNKSPHYSSLPFVLHLYFTQFFLQYXTLFTHILTIQSINMYGLKAGDSFPSDVVFS

SEQ ID NO: 29233 - protein, 134 aa, A.fumigatus
LSFSYIPWSEDKGEITACGIPINYNASKEWADKKVILFALPGAFTPVCSARHVPEYIEKLPEIRAKGVDVVAVLAYNDAYVMSAWGKANQVTGDDTVCSHPKKEILRFHYLVVVTNALILYFSTTGGRRTSVRS

SEQ ID NO: 29234 - protein, 312 aa, A.fumigatus
SPSCSPSCTPGEDFLLAIALCHTCIPEKNESGSVSFQAASPDELALVMAAQDLGYLVIDRQPNTLTIRTYPNGPEEEHQDEVYEILDVIEFTSTRKRMSVVVRMPDHRICLFCKGADSTLMRLLKRSSLAHEKAVEIERRASKRKAAEANEVMRRNSEHQSRKDSGVRASFSRPSFSRPSFGRPSMTKNRRSSVSGQNVSVLRESIDVWLRDRETDGGLLTREYDDEYYSPRPSAQLGRQSTSFSDSGSSVNEEDQDDLVEEALVVNESAVFERCFQHLNDFATEGLRTLMYGHRFLDDSTYHEWEGGLSRS

SEQ ID NO: 29235 - protein, 561 aa, A.fumigatus
TIPRITSGKAGYHEASTSLIDRQGKIEKVGAQIEEQLELTGATAIEDKLQKGVPEAIDKLRRANIKLWMLTGDKRETAINVGHSCRLVKDYSTLVILDHETGDVERSILKMTADISRGSVAHSVVVIDGQTLSIIESDETLRAQFFKLAILVDSVICCRASPKQKAFLVKSIRLQVKDSVTLAIGDGANDIAMIQEAHVGIGITGKEGLQAARISDYSIAQFRFLLKLLLVHGRWNYIRACKYTLGTFWKEMLFYLTQALYQRWNGYTGTSLYEPWSLSMFNTLFTSLAVIFLGIFTKDLSASTLLAVPELYTKGQRHGGFNIRIYLGWTFMATCEAMIVFFVMYGLFGNVLFTNTGSDIFSAGLVTYSACVIIINTKLQALEVHNKTYLSLIVIVISVGGWFLWNLILSRRYQIESGDGIYHVPCNFILQSGRDLAFWAVLFVTVVAVVVFEVSVSAIRANLFPTDVDIFQEYEQDLDIRKRFEEAAASELQQGWDRGKKKSSFELAREAAEMEAREKQVQELLARPRVMTKTGSGQIEMQEIDLSELNGSSRDVSGQVT

SEQ ID NO: 29236 - protein, 623 aa, A.fumigatus
PSLGRPGSRSHPAAMLEGLVANLLNRFLGYYVKNFDAKQLNIGIWSGDVKLRNLELRREALDQLHLPLNVVEGHLGELTLSIPWSNLRGKPVKVEIEDVFLLAAPKEDADYDPEEEERRAYNLKMEKIESAEILRERNTEGMSQEEQRRNQSFTQSLVTAVVDNLQISIKNVHFRYEDSIASPGHPFAVVLTLKELSAVSTDSEWNPTFIQSTSTTTHKLATLGALSVYWNTDAELLGTGRGSDLGAEAQGISHAELIEKLRTFIESEESQQFMLRPVSGRAGLELDKSGKHDRPAIKTRLLFDELSFVLDDDQYRDALMLVDLFHYFLRHQEYKKLQPKCRPKEDPRAWFRFAGEAVLSKIHDRNRRWSWDYIKERRDDRIAYIHLFKKKKREEPLSPQEAEDFERLERKLSYEDIRFWRSLARNQLRKENIGLKKPARQQTWSEWIWGTKKEESEETTMTEEQRQELYNAIDWDEKKAIAESVEVPREWVKLQVNSGLRAGSFTLRRDPHGKCSEVMKLVFDNLRAKALQRPDSFFIEVDLGGLRVYDGTTEGSLFPQIVKVKDSLPQSEDSQTQPPDGGELHPEANEEYEEAEDNLFQFQLEKNPLEGDADAHAGVGGTP

SEQ ID NO: 29237 - protein, 445 aa, A.fumigatus
KRGSFQPLWVKTQCRVADHKYIQESYIELPHDGIRTRDDLSGYLSLEGPGYHYSQRDMRGAALPIENAYSNQAQLNYTCHDSVQADAEVLKVVRQKLLRNISSSTRAEALGDAEAQAPNSIRVSLPSHDRKPSSAESDSSKASSKRSIKEEATAFLQSVVENSHLDAKGTRSLAVTVQSEESAVARLQQGSQETEYVKSEPVSMCDRNASLEDTRLINEQINLGDKGTISLLNAGTNEYLLRNTNHHLVHRADIIKDNQGNTYHKLFIANSKAVPPPPGLPIPLEQQKDADSLFFDTLAPNRARLEEANSWFHTDNRGASELRQLVSSIAYDNVEREALLHGNSRPTSETTTAWQTTLLLGNVIANLQLHASSDLTQQADYFSDYAVVDSACCEPSHGGRRSYFFQDPAVTHWKLPADRATPGTAKESEYELAGPQIYSQPSGTW

SEQ ID NO: 29238 - protein, 394 aa, A.fumigatus
RGLLQVLSFLFLLLASQVVTEHTSNWAVLVSTSRFWFNYRHLANVLSLYRTVKRLGIPDSQIILMLPDDMACNPRNAFPGTVYSNADRAVDLYGDNIEVDYRGYEVTVENFIRLLTDRLDEDVPRSKRLGSDAGSNVLVYMTGHGGDQFLKFQDSEEIGAWDLADAFGQMWEKKRYHELLFMIDTCQANTMYTHFYSPNIIATGSSALDQSSYSHHADNDVGVAVIDRWTYYVLEFLETQVTSANSKATLGDLFDSYDESKIHSQPGVRWDLFPGGEQEGRLRTVVDFFGNVQNVEVEHANATEPGSLKEDLIEIARLVEKWRKRDRDFASLREPLHENKTDAPPSSQFTKARNVAPVRMAAESSWEKRLVGASVLGACAAVWLAGSILGRPSV

SEQ ID NO: 29239 - protein, 85 aa, A.fumigatus
RFFISPKYHSANCTASACKPFGPSINYFECDRLSILQKYKAMSLDWSKMHKDIFTIAPAYKAIFLFLIEPFNNSRFSLAHLAQLG

SEQ ID NO: 29240 - protein, 61 aa, A.fumigatus
REAGIVKWFNEEKEYCFISRSNGEDVFVHFRPIQGHGFVFLKDGQAVTFEVVDGRTKGFAG

SEQ ID NO: 29241 - protein, 243 aa, A.fumigatus
  UNSURE (228): Identity of amino acid sequences at the above locations are unknown.
NLSRTFRLCGEHERIRRKSTTDPNAVDFGDVPFDIPITRSLTAANTSGVPATFCLERPDHGSEQKTPSWLEYKIEAPTHHEEDKKRKTNERTLFPGELANIDITAHVRDIEHVRLLNNGQLKLEDILVLRVTGGRDHFISAYGQWLPTCFGRSVEELTMMPEAGARSLLKRDKSEKERSHVETGRLSAPRELFRLTEAISKQSERAIAEWGMTKNDSDEKLPPWAKEXGCGWPFDPKTWTLKG

SEQ ID NO: 29242 - protein, 99 aa, A.fumigatus
ASRTGFGHHSKFFHAAPKTCRQPLPISRDEMIATAGHAKDKDVLKLELTIVQQTNMLDISNMCGYINVGELPGKQSTFVCFPFLIFLMVSGCFNFVFQP

SEQ ID NO: 29243 - protein, 550 aa, A.fumigatus
  UNSURE (17): Identity of amino acid sequences at the above locations are unknown.
PLPSLHMTPQFVSPVPXSVSSAAASHTSNDPRDGESQVTRALAGMNLSAANGDVLPVHPQPVKATTTRATVANRLTRMFSNTGKMPSKEPKESREPDPARDSSDSSTESINAPTNGSAAPSRPTSRPSSRAPSRQTSTKGDNEKEKKTKPTNGKDQREGSIVHKRFEMFPDGTHCHHLKSARRQEKLTDLLRDMLGGGSRKKDDHVDDQQLSLMSTWIDQFKTERDKLAADKKGGPNATASLVDKYGKCQEIVGRGAFGIVRISHKVDPKDSRVEQLYAVKEFRRRPQETAKKYQKRLTSEFCISSSLRHPNVIHTLDLLQDAKGDYCEVMEYCAGGDLYTLVLAAGKLEVAEADCFFKQLMRGVEYMHEMGVAHRDLKPENLLLTTHGALKITDFGNGECFRMAWEKEAHMTAGLCGSAPYIAPEEYVEKEFDPRAVDVWATGVIYMAMRTGRHLWRVARKDEDEFYQRYLEGRKHEDGYAPIETLHRVRTHRGCLRGSPALTFSQARCRNVIYSILDPNPSRRINASQVLKSEWVREIKLCKAGEEGF

SEQ ID NO: 29244 - protein, 292 aa, A.fumigatus
SCLVNSCVTCEIALRYTIMIDFNVDTEAGPAVVRFGLPPTSLFKFPPSELPEPLPAPLISEPTWNQPFNIPPELYKQLLDVRVPITIASVYAVTVVIINRINKSRGYKPWGFSQTRLFKLFVILHNVFLAIYSAWTFVGMFQAFRNSWPHREDPHGVVGVLDSLCKINGPRGYGNAAIYDSVTDQWKLPNPEFQLAAGGVPDPTDVGRMWNQGLAYLGWIFYLSKFYEVLDTAIILAKGKKSSTLQTYHHAGAMMCMWAGIRYIAPPILIFTLVNSGIHALMVCKYRSYNRL

SEQ ID NO: 29245 - protein, 74 aa, A.fumigatus
YTYYTLTALHIRVPGVIKRSLTTMQITQFVVGTTWAASYLFVSYTLPGKVPTASAAAGSATSVIEAAAANGLGC

SEQ ID NO: 29246 - protein, 392 aa, A.fumigatus
RFFIETAIMQSQSQQHSASADSGQAPQAQSGQFARDSRAPFAAGYQQNGHPSQPEGYHDGSAPLQADQNFQNQRSCSKYSTIKGSMPFTMSPNFDLSGANRAPYNGQFVLLPSGPMLNGIPPISSFNPTSVLGTNQLGSTSYLPAMYPSASPNFPMGPATMQGYSFPFVADNNLQNLAGQKRNGWVASENQKVTGQSTSETPGNQCEFYPGPAVSTIDGPSIPLLNYNGPPQPCLPYQVMKTPNGYMLQDLESITQQEPPIPRAVPAMWTNPSEVTLAKCLENREGITNVYIRGFLPQTTDEMLHSYAARFGKIDRCKAIVDLDTGLCKGYVKAASSMSACQLISLPDSVLSSFTTLSHARTASGAFSILDIKQVLHKYCESMPTRDSQTLT

SEQ ID NO: 29247 - protein, 212 aa, A.fumigatus
RVYKGFQGNNDARLSIEDPNNPDNDVSGGTREIHLIFRSFSRAFQLLKERMVSSAVSGDTKASILQSIIAANYEEYTQQRAHLRAVFETHPRFAQYRRAPTPPPPPSESPPPPPADLAPLPPNLPAKPPSAKYSKAPPAPASKDSKGSKEKMTKMQRKQQASRERAARLRRLRPDIPAIPNSISNEQALSLGGYKTQSEMDRDLASREKETK

SEQ ID NO: 29248 - protein, 116 aa, A.fumigatus
NERVQDGHLAGVGALNWIYIPIMLHSYQCIPRTSPPYPDPKTPGSQPPYLPRSVHHRYSYRAPSPTNPAPLPPPHCRSCDGYSPHRRARPHGRQPPWHPAPSGPRPHQHPPAACSG

SEQ ID NO: 29249 - protein, 109 aa, A.fumigatus
CFTRISVYLEHPLHIQIQKLRVPNRHICRVQYIIDTRIEPRPRRIQPRCRRRIVDHAMDILRIVGPDPMVGSPRGIQLHLARAHTNTPQLHVLDDVVDVQVGDLRRRRQ

SEQ ID NO: 29250 - protein, 76 aa, A.fumigatus
FACASHKLIPESSIERLLGENPMQTLPVGYNKDELVSQINANPERAEQLINEIESMEGNAGAIIGAITEVCLCVRN

SEQ ID NO: 29251 - protein, 192 aa, A.fumigatus
RKQVMHNLCNQKETMTLKNICNSLSRRPQALDVVLIFRNPKQVLQPLCALLDSWHWDEDQGEYQPVYDEFGSILLLVLAFKYRFDLRPADLGISSSDSFVLRLLERGSCSQKLDALDEKQNKNLGSWIAALFIAEGISEETMSACSPQEFYLLVATLFSQSLEACETGKLEFDTLKGGFECMSLGLDLLERY

SEQ ID NO: 29252 - protein, 274 aa, A.fumigatus
TSLLARWKSSSKMCARDTRRAPTSNRSSTTWSRAYRSSWWAAATVPNWRVGRHIPAAAAGQHPQHVPVVGDMEHKPRGQHGTSSVHPSPDDRRRADVGGVARATCADRGAEAPDRGRQRPPGAGLGRDADLRAHGGDLFCGAEQPPARGPEQGGAAAVRDPDPPRRAGAPARERAQDLGKGPPARGGARAVVPAGQRPTGAAVAGPQPGRQQHHPEHAAGGCWCGRGPDGAGCHGGCRPWGRARRCGEYPSHDRQCGGGSGAGFVGDGARYEYR

SEQ ID NO: 29253 - protein, 61 aa, A.fumigatus
RRADDNVTIVTYTPITKDRPAREPNMIVTFDIGSNKYLPFTPTIPWTSVPVSQPSSRQQPL

SEQ ID NO: 29254 - protein, 226 aa, A.fumigatus
  UNSURE (226): Identity of amino acid sequences at the above locations are unknown.
SYQSANMRVTVMFISLAAIQLVVCQFSFNGAGNSNLSTATRSTHSKDGKPDGSHLARPEIRFGEWIVKRDTTTIADAVTSTTAIETVTSATTRDSHATTTSDSRTTSSSETSSSFTTTTAAATTTSTTTSSTSSSTATSSSSASIAASTTTTTATRTTITSTTTPTPTESAELKEWNHRGTIAAIVTFSILGSVFVGACIARCFRNWAKKRHMSSPRGWKEQLTIX

SEQ ID NO: 29255 - protein, 112 aa, A.fumigatus
HREQQVSPLYTNNTLDKRTGITTVVAAATIVKSISNVILAANAGLEIYEDIAAMTKSESNQNSCSLVYGTDSDRTYVEGYAYEATTSGENCDTTAKKKTIIAAVKCAKQLNT

SEQ ID NO: 29256 - protein, 171 aa, A.fumigatus
MVSCSFQPRGEDICRFFAQLRKHRAMQAPTKTEPRMLKVTMAAIVPRWFHSFNSADSVGVGVVVEVMVVLVAVVVVVEAAMDADDDDVAVLLEVLEVVVEVVVAAAVVVVKDEEVSELLVVLESEVVVAWESLVVAEVTVSIAVVDVTASAIVVVSRFTIHSPNRISGLAR

SEQ ID NO: 29257 - protein, 154 aa, A.fumigatus
RLDVLLTVTSVTTLDVVLELAGAEATSGVGELEGPEEVVGLLEVGANSVDLVDQILHADNAVLAEGLLNDLVVGKRDTLLVDLSVTTLVDELTDTLEVGVTVSDVWVDDGQHLLGGLGETDEGTVVDLDQTEKLQDLARLRSNLVDTADSLAPG

SEQ ID NO: 29258 - protein, 70 aa, A.fumigatus
QANKKKREAIFKRAEAYVKEYRDAEREKIRLARVARQQGNFYVPDEPKLAFVIRIKGYVSLEHSVSLPWC

SEQ ID NO: 29259 - protein, 158 aa, A.fumigatus
IRSINKIAPQPRKILQLLRLVQINNGTFVRLTKATQEMLTIINPYIAYGYPNLKSVRELIYKRGYGKVNKQRVPLTDNQVIEEALGKYGIVCMEDLIHEIYTVGPNFKQANNFLWPFKLSNPTGGFRTRKFKHYIEGGDTGNREENIKSSPRGWTDSR

SEQ ID NO: 29260 - protein, 152 aa, A.fumigatus
  UNSURE (102): Identity of amino acid sequences at the above locations are unknown.
HYLDIYISAPATIASLLHHTPISTPIEPPSPAMAYNNRPDASTAFTFDNDDRFVNQQPKGPDPLSANWSYDSAIDLFSLNTMLPETFPLDIPNDMLLDPKDXPTDLFAPPADISGFAISHSGEDSLSSVCLVSLLFYVFYFITDKDSPGSGK

SEQ ID NO: 29261 - protein, 158 aa, A.fumigatus
SPADNISSCIYSTEKREHTGGKPEIITPRGHQARPPRQRRIPAHDLLGRLPVHNKVLQLLARNGDIDSRGALRLQLQTDLAGVVHKHTVPLRADIKGNVLVRQLRRGPAVLVPDVDALPVLNEGAKPLSESVQLLADAEVQFGEHVSLALEEDAVVPA

SEQ ID NO: 29262 - protein, 62 aa, A.fumigatus
GEMVCPVVLFMWLICLYIQEGIRIDWMSNVERLHIQDETVDLLLNKFQRHRGDTLNSRELQF

SEQ ID NO: 29263 - protein, 287 aa, A.fumigatus
RGPAQRLFLRGLRRPSRASLESNLCTGGSLCLCSHSRALVDIIRAGGLDKGPHYRLNTSSGHAKIDHVAKQKLSYTSGDLELNINTAPNELDFVFSSADKGKLTGHSWRSIGYVGDQTTDRSRWDDGIFFERQGYMLAELDLGVGEKLYGLGERFGPFVKNGQRVDIWNEDGGTSSELAYKNIPFYISSKGYGVFVNNPGKVSLELQSERTTRVNISIPGEELEYFVVYGKTPKEIVGRYTALTGRPSLVPSWSYNLWLTTSVFPFFCRIYTTADVVRRASGPIKTD

SEQ ID NO: 29264 - protein, 202 aa, A.fumigatus
EAPEYGVGASNSSAKRWARDMSGPVKRSDQMSWMLLGSALSLAHELGIYETGDKARDAFVAYERFMTKDQMRLRRQRAQRLLYVYINQLAWRIGCVSLMPQGLSHSILNRQTSRELSQYGEEWLTFMDSWMDLTKLAKSVTDMFFPSVTFARQQLQSGRYIDLLDHFRPLLDKWKERYLQPQCKLPYLRMFRLFFGGFHEDS

SEQ ID NO: 29265 - protein, 61 aa, A.fumigatus
HFRCTVTSVKDGDAMSAESGSALCKAPGNLDISSANLQKTWLGLEVYSKTMGSSMKRLFEQ

SEQ ID NO: 29266 - protein, 260 aa, A.fumigatus
LANQSILNAYLLLWIISGLLLVTSMLSWIRPSARLSFFHSKDNKLLLTKKPGESGVKQQVALADVCRSATPTKCHLNPFLFNGHLQTAWTAVKFDDVPVYYKRRMFEADNSMYKGHFAVDFVVEPYETPRDNAEATDEARRYTLPSGLPERTSFFSEEEFQALPSDDTKPMLVLLHGLSGGSHEIYLRHVLAPLIADGNWEACVVNSRGCSQTKITTGVLYNARATWDVRQTVKWLRKAFFQIDPCSELGSLLAQIFLPM

SEQ ID NO: 29267 - protein, 129 aa, A.fumigatus
SVRPRTFSQNNFYIILLLIIPSGHCNVQPGDTLRKGHTIETQHRSIPCLPFESHSSRCRLKMIRLVLQLTLRFNVELIALQIASVDALPFQEMTQTPYGVMLTTSWGGHLGWFELGGDRWFVKPVCIFL

SEQ ID NO: 29268 - protein, 106 aa, A.fumigatus
LSCSGALCSAWGIVMFIFLPDSPVSAPGLTPRERRIAVERLRENQTGVENKHLKPYQVLEAFMDYKLYIFFMLGCVCEYYCILCSHSSALICKATSPMAASPTSAH

SEQ ID NO: 29269 - protein, 75 aa, A.fumigatus
LCCRPTYSLGIWSMIVSHLIEVVLISTLGLLLRWENKKRDRIQSQMQGGLEGRDLGSTAFLDLTDRENLKYVFHP

SEQ ID NO: 29270 - protein, 93 aa, A.fumigatus
IPYGVLIALSILLCVYLNDRFENRRCVFILLFLLPNIAGAFGLRFVPLDQQVGRLICYYLTGPYNAAFVLILSMQIANTAGTAHSICRSSSEP

SEQ ID NO: 29271 - protein, 98 aa, A.fumigatus
FFRTLPSAMHFSTLIRYVGVIVILHWARLMCDFNVQTTLSYAAIFGIVEDLKLHGTQYSWLSSLFYFGFLAWAFPTDFLLQRLPIGMCSIQTCRRIGL

SEQ ID NO: 29272 - protein, 124 aa, A.fumigatus
REVPGRQHLHVVRTASTPGNSSPFFPKSIILMYIRGVFFMIQAACHNFTTLAFFRALGGADEACADLAFMLITSMFYTRKEQPVRIGLWYTANGFGIALGGLLGYGIGNLKGALPSWKYEFLVM

SEQ ID NO: 29273 - protein, 181 aa, A.fumigatus
  UNSURE (20): Identity of amino acid sequences at the above locations are unknown.
RDRFPPKQGYERGELRSKSXTHAPMATEVRTFYTPSATTHISSHAPAAVDELISKYSSTMVTASSIHSASHLTLKNPRRNILQRVVDHIQLGYYRYEVTFGLYVMTPGEKLVANTFVIVVLSLLFWALVLYFPSLLYQKLSRLVWLLTGHSGEEMGAAFGILDSHVSPASSAFSAAASPSL

SEQ ID NO: 29274 - protein, 72 aa, A.fumigatus
ITPLPFLSLSGFSSFLYSPLLYRNATLSLFFACYIKKHSRSFSVVLFKRLDSSVLAFSLFRLSRHPFCQPIT

SEQ ID NO: 29275 - protein, 91 aa, A.fumigatus
ILHPNTVHASKIVIYFLGGFQTQAKHVSSLPSIYILHNSTYNLSAKLRQPWLSGCNTFLQNHVITGIIRNPLSVWSNKSCLHHGAGRVRSI

SEQ ID NO: 29276 - protein, 76 aa, A.fumigatus
LSSSQAHLDCGLIRNTSPNVSKKCQALLASHVKVDWKPYKCACGGQRQAAPKLKLGETVSPYTGGVYSVTSTFSQW

SEQ ID NO: 29277 - protein, 193 aa, A.fumigatus
EPRNLLQTFVEDQTFDPHYQSVTMWSSIAAFPVLVPVALACLGYEGGVPTPTAHHSNSAVIEVAAGQVFDAGWAKYDRGSGACKGQSEGDWKDAVFYLHSGATLKNVIIGANQAEGVHCDGPCTLQFVWFEDVCEDAITIVSLQAHIHIYSVRFDDRVEKRQGGPGDLDHRRWCLSCLGQDRPAQRLWYCQCE

SEQ ID NO: 29278 - protein, 76 aa, A.fumigatus
IINFYAEDYGKVYRSCGNCDKQCKRNVYVEGTTARNGGEVVGINLNYGDTATLKNVCADSAHPCVFKHAPLEGKAL

SEQ ID NO: 29279 - protein, 151 aa, A.fumigatus
RHDNTIDSTFEMNCPICSRVSSSRLRFYCPTCACNQIYTLRIDNARALLEKETLGRQVEKALLHQTSPTLSYHRFEECSTQSPDKVPSPQDVLQIITAKAESSIRKKDLALQIQQLKSEIRDRQLGISRRELTLARRTSDAESSKFPLGKS

SEQ ID NO: 29280 - protein, 505 aa, A.fumigatus
SAIRFAMAAPLPPAVKTSSNCDLSLPKWKEFLDLVQSRLSQMLTKPRHWAAAFPLHVLLLCVSSKEVFLSQWLSVIQSLPARLKDRPTRGPALQAMCRLLWTYFFRYTDSPTVTLRKVEEVARIALPAGKRSYLSTDPAVAEPLIQLVRMIGFKHPDVCFRNIIFPLINSDLFLSGRELKIEQMEPEKMVIGIRSFLAIVTDLENCDQLCPPFPTGSIPNPFTDISAPTHLHRPQLLTDPRLPGSMESKDTALSLPVNTSRLSDNVKEYYTRFCDILGKITLLCDNTFGGQATLDEKFGGTTPKTPISEAFSFGRRDDHPSIGDQRQGFYDLFHVAVQALPRCLSDRIPFNSLINLLCTGTAHVQSNIASSSAESLKAIARQSHAQQVTIGFARFIFNFDARYSTMSDEGMLGPGHIESTLRLYVQLLQIWIEEIKQKTKGATTDPVDKSGTGSRALQLDLSTVLAHVEEIESHGLFFLCSQSRRVRAFAITVLRLITEFDRALG

SEQ ID NO: 29281 - protein, 167 aa, A.fumigatus
LAVRNPVFCNDILTTNLPRWPRVADTTVEETKAHMMKKVFKDPDAAGAVGRLFFFVIIPKNEPDRIIGSLGVNSLSPAPSVGYAMHPSYWGRGYASEALRGVIDAWWKLPRVDGLGHEEKLFAAVNIANKGSVKVLQRNGFKIYKEVVLEGDTVACMELESACRAIP

SEQ ID NO: 29282 - protein, 102 aa, A.fumigatus
SILGYDQGVFSGIVENEDFLYTMHHPGDSLMGIIVSIYNLGCFTGCIFNFVVAEWLGRRRAMWVAMTWIIVRCCDNSSLRRLSDQTSRLVPRCKHQHFLLPT

SEQ ID NO: 29283 - protein, 70 aa, A.fumigatus
  UNSURE (47): Identity of amino acid sequences at the above locations are unknown.
LDQKHIQARPSFDRPSGVSIVNPYMYSANSRDSLLAYGMSSPGAGRXDGSAMQPTAALSGGEKAEIFDVN

SEQ ID NO: 29284 - protein, 108 aa, A.fumigatus
PDEQIGASLQTSAFSVAHLMVGRFVTGIGTGIETSTVPMYQAELCEASKRGKLVCSEPLLVGVGIVISYFFDYGMSFVGGQIAWRLPIACQLIFAFVSRILRQARGAI

SEQ ID NO: 29285 - protein, 69 aa, A.fumigatus
QCVKVVIILVFGLPESPRYCYKEQRNDEALQILSDVNGLPKDDPKIVAEQKEILEALELETKHGGYKWR

SEQ ID NO: 29286 - protein, 375 aa, A.fumigatus
PGITSYKPIIDKHVGILLTRLPSQSKGPLPEAKNNGTTAVNMAPIVHQCTLDAMLELVFGPRLSEHPYSDTPAGEGVCSNLRIMTKMAWSFSLWPAFGWLMNTRPVNAMLRRPTYSKQGELTGMAGLMGVAMPRLLRNPQQVVASSQPSIVKGWLEVPPDDATRMTPAEVASEASNLIIAGPGSTAAALTAVIFYLGTKDGQGWQERIREQIRASQSHDLGPSSLELQAVIKETLRLSAPFPTAFPRVIRPGAEMAIPSLAAPLPVGTTVSANTFVLGRSRELWGNDADRWEPRRWLGSEQHRREMETKFVAFSKGSRSCIGRELALLLLAQAVIGIVQQWKFRSRGQLQGKSFLEMQYDECWIKFEPLDLSLSA

SEQ ID NO: 29287 - protein, 191 aa, A.fumigatus
PTIGRLQLTEVFCHSAIVDNILCLHSYFNLGNGPTIEGTKAQLSTADYLPLDSTGIPLGNIDKFPLDVSKPFVLGAAEPDIDDVFLMETDPSKVVLDTRSQPLKLLAQFSHPDTGLHLEVHSTEPAFQFYTGKYINVPAMDGLPARVARAGFCVEPSRYVNAPNEPGWRSMVLLTKGQIFGCKTVYKAWKA

SEQ ID NO: 29288 - protein, 214 aa, A.fumigatus
LLLRTGTSTPPRYRNPLFYNNSHAQLNYLTPLSPFPTSDKIPNKIGRRPDIMSGESEFAFLPLGAIIQEFRVGGKNIVLGFNTQEQYDKYNSAHFGATIGRVANRIKDAVIHNLNDRDYILAKNNGPNSLHGGGKGWGKCVFDGPQTVKHDGKDALLFKYLSKDGEEGFPGTVEVRVWYTASKEDSKTVLTTEYEVEFVGNECEETVVNMTNHR

SEQ ID NO: 29289 - protein, 114 aa, A.fumigatus
TVSPKLKIRQTANNFGLINRTYATDPDNENTKLTQWQRFYHHIHALNKHAPHKTEYKVFFFGRHGEGWHNAAESLYRTPAWNVCHTPLAQPFFFFFFFFFFFFLFFFFFFLFLL

SEQ ID NO: 29290 - protein, 61 aa, A.fumigatus
IANKSKMKCALSLLTLGLAATTQAAYYEYTTATGYFLQDEASTDPSTFDYVRPPSLIYPKL

SEQ ID NO: 29291 - protein, 225 aa, A.fumigatus
GKLKMPVPWIKGPGQVWTYPSLCGKIHPKGKLSNRSGPLEWPPRLSRGIFQGFMAIGKVVSALITETSIIVKPSPFTPYTALNLPELAIPFVPPGVFQALSGDDQLGPWMTRHPGILKVSFTGSTLTGKRIALAGAETFKQCTLELGGNDPAIICKDVDLDALVPKVGSPLVHGIGGSEPWASRRQVADVGSDQGRSSLLFELQPGMHDDQTALCTREHVRGIPR

SEQ ID NO: 29292 - protein, 218 aa, A.fumigatus
GDQNLGQVEDKLLMLDPTRVAPLCFLNSSQVCMMIKRLYVHESMYEAFRDKLAAHVKTLPVGNGVQPDVFLGPVQTEMQYNKARDLLSSISAEGLRPALGGTVEESAGSFIHPTIVDNPPDTARVVTEEAFAPILPLLKWQTEEEVIARANADPAGLGGSVWSRDLDQAQRLASRLECGSVWINSHFAVAPHVPFGGRKESGSGVEWGVDGLKAYCNP

SEQ ID NO: 29293 - protein, 466 aa, A.fumigatus
RVPPTHQFPHVLQPVVSGLDCEQRLSTGSSVGTGVRDASCFGIWAISRKYTTQELLTLDTQTISTASRQDEKSVLQMLATELVCAACMDPSGNIRRGASAALQELIGRHPNTITEGIPLVQVVDYHAVARRSRAMIDVAKATAALSHHYWSPLVESLLGWRGIGSPDAESRRQAAKAIGELSIHQSCRTISVVLHRLRHKLSSLPRGDVEARHGCLLSISATVDAFNAHKATAAASKEKSEAILVARQVTDLWDIFSSAVGPTKDDLTLQISRPELTAEATSCLIRSLSQSVTQGIEPTCSQPSSTALDRAHGTLLLCLSRSEDIAIETSSEAVSEFFPLLPSSQQEETIQDWFAHIRATWKLPTGRGQISALGAVFRQLEPDNIFRQFVIETLLRCTDKEELIEKRVAAVKGLTTGVLPYICEFNIYQMKQYADFRAAITEDIANHIISFLNDYTTDRRGDLGPC

SEQ ID NO: 29294 - protein, 241 aa, A.fumigatus
ALEEEDPLPALHTAEAAHLLDGGCEEAREGTAQGSGGEEEGDANLEFVAAVEVRQEENNARKESTFKQAEEEPTCEEAGVVMHLRLERRHEAPECAESGQEDTGADDLQQEVGGKFRQDVGDIGDGNRCAVRTRPPAIEDGAHNIPVLYCRSVKWRSFSRPAYARLSNRSGGDGEMTHHSCVSNICTIQPSQQVQHQGHGHKQKVQPEKSLAVELQCLLVQNNLLIGDLLLGLRIFNMIAK

SEQ ID NO: 29295 - protein, 319 aa, A.fumigatus
VESSRATVADKFLAISTKRRRLVSKLYKIFSCPRALASCRISTMTDQKSFCDHVEDPEAKKEVADEEVVLDEETLKLDRQTLLRLDLLLMPMTLMLYLLAWLDRANVGNARVVSHLPVTSRSVAKPSIGRSGKGPPFDRSAIQDRYVVCTVLDCWWPGSDCAAITVTYVPYVLSELPSNLLLKIIGPRILLPTLCTLWGLVTTLQSQVHNYSGLLACRFFLGLLEGGLFPGIVLFLSNFYRRHELQVRIALFFSAASLSGAFSGLLAAAIQQMSGLRGMKGWQWIFLLEGLFTVCFGIFSFLVLPNGPVFTRRWQEQRQ

SEQ ID NO: 29296 - protein, 175 aa, A.fumigatus
FQDLNMSLVNLAHVCSHLNNASKARLGLTSIPHSNLHLKLCLALQNSGYLSSVVRGGPTPPPPHILLGHPAPNDEVEGIEPLTQANIASRRLWLGLKYWQSEPVLGKMSMVSKPTRRITIDVAGLRRVIRGEKSDYVEGLRTPGESLYLSTDRGILESRECVEKKIGGLVLCRVR

SEQ ID NO: 29297 - protein, 83 aa, A.fumigatus
YSAAGIYKYLIRGIGSFADIHSYFTAPTPKPQYHRFDKGSYLYLYKNASQQKLRIEVANNPGSSDQDAFNGCQFSDCILQSKR

SEQ ID NO: 29298 - protein, 387 aa, A.fumigatus
GLLFHFILCIGIDTLNATVYIIIFCHTYFSGHSGSGPRYPLRKAAPAVSFPMFVFRLLLLTSRNQRCGIHDPGDGPQIIWRHVGCERQLHVRIPGRDDGIGIHLEVDRAVFLSGLFLLALDAHTRPELAKRQPVLDIAFKVAVDLKQIICSPSASSSKTNKDTKYKSARSTAPPTLPPSPPSPRTNAPSTASSPGPADHSTQNAAPSVPSRACSPRSPRPAPPLYPPASPPPAAAETPHTHRWDPDSPRKPPAAPTNPSPSSRPCAGASTRDAQRTAGGSPWPAPPPARCTPGPPSPATAGSAQTSTPSGNGGTGRPRPGRARPSSRCAARRRAGSPPLRRASAPCRRAWSPALHARSPRRAARGQSTDRRALGPPSPAPSRIRGAW

SEQ ID NO: 29299 - protein, 109 aa, A.fumigatus
TGCRWRRGTRRTTSRRWRWPRRSTRGSLCIASRRARAWSGRWRWICRRRWWLPRGIWIPSMGMWCFGCCRGRRSRWVEGRCWPRRSRTTSARWNGRGSILCRVIRWTWG

SEQ ID NO: 29300 - protein, 93 aa, A.fumigatus
WTTDDLFEINRYLERNIKYRLAFREFGTCMGIQCQEEQTTEKDRSVDLKVYADAIIAAWDPYMELSLASDVTPDDLRPITRIMYAAALIPGGE

SEQ ID NO: 29301 - protein, 96 aa, A.fumigatus
KYRDVIYKLLGFTAAMVVGPIGMYFVTVNSGGMSFFHQTSNFSLFETLTRIASPTVAGITAAITANLVLFGYIYVAWLDDREEREAASKRNEKKAQ

SEQ ID NO: 29302 - protein, 259 aa, A.fumigatus
SRRCALPAVKTPQSTDRIGWIKELTTCSYLMVIYTPRLCNDVAFLPPQQDEAHAIECREILSEEEVSDWEANREYHLAQQLVESAITPEFPVVGDIEVGAHKWVGSEGKQIEKGRVASIGEEKIEVVAKRQNGEITRLSKEELKKYGLDPEKIETLKSRLEELAKGKDWTLEIVESNGERGLVGTVDSNDDEKEDHAAQGSISQPAQGTTADKGESNAETGEEKKKADEKIDHYEPEKSGPTTDDADDGSEEIFFKDEL

SEQ ID NO: 29303 - protein, 174 aa, A.fumigatus
RSWCYSKCHRRYYSLLKILSRAPNAEIQTAGASNGPKRNARSMGTTGQPAIVYLPSGTYLMKSSVQFFVGTVLVGDPTNPPVLKAAPDFRDDHIVFAKDPNVEGTNNFYIGLKNVILDSTSVDTARTIALVDWTVSQATQLTNVVFNMPTGSNAHVGLTTQYDYNSNIIVVGTL

SEQ ID NO: 29304 - protein, 184 aa, A.fumigatus
ELIQSRNRAVELTNFKYSAGNANKNHVEGQTVVTKRVTDLLVGGKNYFIMPPPTYSEFPVEQVLNIKTVSDKPVYGDGVTDDTQNINDILAQNRDCKVIYFPAGTYIVTDTIFVPANIRIVGDPYASAISASGSKFTDINAVRPMIRFGYPGDIGVLHVSDMMFTVADVLPGCQVVRMPPDTRS

SEQ ID NO: 29305 - protein, 340 aa, A.fumigatus
QTDVSLCKLVDLPRMVTDANLLDSIIKLLGQGTFGKVVEAYDRQRKTRCAVKIIRSIQKYRDASRIELRVLSTLASNDKTNRNKCIHLRDCFDFRNHICIVTDLLGQSVFDFLKGNGFVPFPSSQIQNFARQLFTSVACESPYGFLWSLASFILIIPVLHDLNLIHTDLKPENILLVSNAYQTFTYNRTIPSSSHAVSRNARQRRVLLDSEIRLIDFGSATFDDEYHSSVVSTRHYRAPEIILNLGWSFPCDIWSIGCILVEFFTGDALFQTHDNLEHLAMMEAVIGSKIDTKLVKQATQGGRNGTQNQAAKYVLNHYASVRTLMLTSAQILQPKQAGLS

SEQ ID NO: 29306 - protein, 177 aa, A.fumigatus
KNGIPKEVIVIDDTHPPEQSKGKSGTMAAAAPNGGMAQPAGKKRRTGIESAYDLGYYDRPSFSTNPQQYGEESSAASICTDRTTSLHTTAPTSLGSQGSTGATNGVFYEDANVGQKRKRVTTRRSAREEQKRRELETAGDAFLSYIPPPKPPIKAKEVPVPVVRDVSIDGSVSGCTI

SEQ ID NO: 29307 - protein, 63 aa, A.fumigatus
AKWVLVGENIKDWRGKKTDNTWLTMFGYCYLCRYCLGRFYDNPPTNLKARQKGSVRRLGLIRR

SEQ ID NO: 29308 - protein, 509 aa, A.fumigatus
FGRSSRLLGPLWRRAIGDDLYHTIRQGLLKRIRDKEPSVRVQAVLGLGRLAGNEEEDDDDNDDSSKALLEKLIDIMQNDTSAEVRKTLLLNLPLVPATLPYLLERARDLEATTRRALYSRLLPTLGDFRHLSLSMREKLLRWGLRDRDESVRKATGKLFYDRWIEDCAGTNNDSENGPSTQRSPPNIPALLELLERIDVVSSGMDSGIAHEAMGSFWEGRPDYREAVVFDEPFWESLTAESAFLLRSFNDFCRVENEGKFDRLADEKIPEVTAFAHFLKKYMTELLQRKKMAKDTSEANDDDTVENEFIVEQLLHIAITLDYSDEVGRRKMFSLLRESLAVPELPEECTKLTVETLRCVCGPAAAAESEFCSVVLEAIAEVHDTIATEDSFVSAKSEISDATSSRQRSVTPADSEAEVPFNKEEAKAKVLREIVVNMKCLHIAQCMLQNVEGNLQQNMNLVTMLNNLVVPAVRSHEAPIRERGIVCLGLCCLLDKVSFLHINIFPQQSG

SEQ ID NO: 29309 - protein, 342 aa, A.fumigatus
SKLLLTNTFTPFGANIPQAIQEYNESAVETLLQSLIVSFFHPRTRENPAFRQALAYFFPVYCHSRLENTQHMRKVTVPVIRAVLNAAEEYYSLEAEEDSDGEIDETVGQRELKALMAGVVGMLAEWTDERRVVGLGGEKILAGVPTSSSPCGFVHLALVKDILERVLGISTGPNRCSKEEKKLLFSLLSKLYISPPVVPSRSGSRMPEGDDQFRSSIQSASGGEISPENVALAQEVKELLDETIQEGVAAEAAGRNALVKVKNAVLKLLAAAQGIRSDSVRPREGTEEPESDAMSIRSGSVQPSIEHPGKRRRMFSVEPSIMEEDENDDSRGTIIKSEAHDD

SEQ ID NO: 29310 - protein, 253 aa, A.fumigatus
PQLLLHTTPTPIKLPYSYLSLKTTSHQQPHLPSPPSHNQKKKKKKMTSKKPPSPADFPTNLTVTITPPQSPPRATHPAPPNILLLLHGLGDTAAAFTSFARALNLPETTIVTIQAPTSAPLRPGRLPLGRRRLLRPGDRRARYGRRVQALDGPARRRGHPGCAGAEMRISAAGDPDPGVRPGRDGGLGCCEGDGRGEDAGRECECECWWCCGGYVSVRGDFDRGAVSPVWKYGWSEEPDAGVAGGWAGADGCE

SEQ ID NO: 29311 - protein, 60 aa, A.fumigatus
TPISRLTYCTIPFSTIYITHVISTLPSGTPCQLRNRRAKNCITGIISSRFRGIPSPLRAY

SEQ ID NO: 29312 - protein, 94 aa, A.fumigatus
LITPRKIYFSVRLPHSLNFDLPTMLEIITSVNLQVTTMSDILSDMWESKVEVYRPDALRPAVHGRRNATDTQTSKLIQLGSLRLMFHTASLTPP

SEQ ID NO: 29313 - protein, 941 aa, A.fumigatus
RITLSTVWTRGRFNNPQIHASLSVRDSLFAGERSRTNPRRSRCWRESLDESRTENEGLTDRLSRSTKETRSLKHQLQLLEGGTSSALTELAKERDEALENISDVRRKLEQAQKKARSREEELERTQGLLDRERESWEGERRNLERKVHVVEGRLKVVLNEVAAAQAAASAPPVSSKSGTPEPVRPSTTERWSDSASVHSSSQGRRRTSVTSVSSEDDADFHNVRYSTASLANARDSKPNGVSLAQELAFDEEEEFDNEHDDSILDSPEALPEERPTSVHSHMSLSMSLKARKILGLSIDSSIDCHTVFDRGLNSPAKVSSPTCEYRDTGIQYSPPPSPQLPPESPLEHSSQALPLAYQAKDSGTSTLTIDMKSTSCQTVGNLPSPPWTPQVAETPITAGPQPAATASTSTQTDLVPAPAASEQDAVANPTKSVPTAIEVPMIAIHPPHSEPSSPRGSVVLPPQTKTVSCQTTFKTIIDSRSVAIQTEEIRIDKRPVKLPASLLPSAIPDVPLNVSRAESNSDSPIQPYRPPSRRLEHGESKPPPLPAKAPSRSKPPATVQAYPGNNDNGPLSADSKSDLRRPFRSSSLFAGFEDENDEPREATRDIFTDDELLNRPFASYKLKKGKLISAQERSSLDDTLLAELDDSQVHGNLEPSESSPQGQRRGVTGSGNERDARTATRVPNAAAGHRRRARSPSEPSIDSGSGASSIAPPFPVPIRLSSRKFPGNGSDGRQSPTPSNPRNFSDRGRAPIVRRPTLRRVRSAAAMSQSEHPERPPSQSSPSSYGLESPQYPPLPFDDITAPRDRMAVERRSMQRPSITRPFAHERQDSNATTSVQPTSVVDAIAQTMIGEWMYKYVRRRRSFGGVGEPKDSWEGKNADEVSANITNSGVRHRRWVWLAPYERAVMWSSRQPTSGPAMLGKSGRKRKFPSFFLERVMSPR

SEQ ID NO: 29314 - protein, 87 aa, A.fumigatus
EHCIGGGSHRKLGEGHGPVPGHVRCPGEETRNVSRTPSCYTEPFKLMNVYSYVWGDDVAKAKTQCESLDYLFQLAVEMHKLGLPWVK

SEQ ID NO: 29315 - protein, 97 aa, A.fumigatus
VVAFYRTFPSGDSVGDNFLVRAGRRVPGRWFRNSANIEQIKGIPGGQGEGHAGFLRHNLGFLSIENTALEEDLTESLEKAMDQYPDTYAVLVRRHGM

SEQ ID NO: 29316 - protein, 75 aa, A.fumigatus
NPLPNLFLSIFDKPFSDFNSLFGQGFYLKVIFYLASRTSNPFQDNPHTTAVFKARMQVEVFNTYSRYRIAMIAVF

SEQ ID NO: 29317 - protein, 145 aa, A.fumigatus
SPLSSEAAGRRAVLSDIGVLPPGRDRMLAPLQVPRLTRIKLIARSRRSMIGSHPVGPSPVLMTVELGQGPYKEVLATSEDGDHSDAISGVRIEDFDLHPCLEDSRGVWIVLERIGGPGGQVEDHFEVEALAEERVEIGEWFVEDA

SEQ ID NO: 29318 - protein, 61 aa, A.fumigatus
SPTSLYLPYLLVTLTYTTIDSSPYSNIYLLPLQNYSQNSLTGLDYYLPLRLISLYIIKVIS

SEQ ID NO: 29319 - protein, 125 aa, A.fumigatus
FHSQKNKEKMGSGIPLTDADRWDWLISLRNAAIKALSPSEANNFHPPSGVVVACSALKQKYRDVMRVAAYGTPSVQIHFVYLKLDENALLQRVAARQAHYMKSTMVQSQLQDLEEPKGEWECADH

SEQ ID NO: 29320 - protein, 90 aa, A.fumigatus
GSPRSAGVFPSCLIPPFALLQKTRQHHIPVVRLDRSFVLKMAADWQHTEHDMKDEGSTLQSPGFDLDFTDTAGDGPQEEDVRDQKGDNLW

SEQ ID NO: 29321 - protein, 77 aa, A.fumigatus
SNDQTPLGLFLTSGKCLAAAGPGGVVVAYVIMGTVISSVISSLGEMTALMPVNAPMMEFPRRFLDRGVGLAVGWIYW

SEQ ID NO: 29322 - protein, 71 aa, A.fumigatus
SVNVFELRFPGRPLQACHDTAPNQGGTTVKPVGTKSKHPFSGKGFLTLIGLDSEWEFPVLLFKLGLTGVRI

SEQ ID NO: 29323 - protein, 197 aa, A.fumigatus
IGTGYTAVTGEFVVPTPSVPSGGSSSKQYCASAWVGIDGDTCSSAILQTGVDFCIQGSSVSFDAWYEWYPDYAYDFSGISISAGDTIRVTVDATSKTAGTATVENVTKGKTVTHTFTGGVDGNLCEYNAEWIVEDFESNGSLVPFANFGTVTFTGAQATDGGSTVGPSGATLIDIQQSGKVLTSVSTSSSSVTVKYV

SEQ ID NO: 29324 - protein, 63 aa, A.fumigatus
VAINRCSTHQGSTPVIQRERQIAHELIVSYRFSFAEIYSYIFYLLCKGMIIKSGEHKETRPYG

SEQ ID NO: 29325 - protein, 222 aa, A.fumigatus
FQIQLDPEPWESSTPHRVSVNSFGYGGSNAHVILEDTYGYLQSHGLQALVGKPRTPFLKEALEPSQKPHSRHDESPIRTRLFMLSGFDDHSLAKQIENIRVYLRERESIADDQFMSNLAFTLNHRRTTLMCRTAVNGNSASSVIKALGGSIRVRKATRKPVVGFVFTGQGAQWCGMGRELVKAYPVFRQSMERIDAHLIRLQAPFSALGERRIRDIESKVMA

SEQ ID NO: 29326 - protein, 119 aa, A.fumigatus
ESHLSAGIPLPEIMGSQTSCFVGSFNADYTDLLLRDPDAIPMYQCTNAGQSRAMMANRVSYFFDLKGPSVTVDTACSGSLVALHLACQSLRTGDAAMAIAAGVNVILSHEFMSTMTMMK

SEQ ID NO: 29327 - protein, 133 aa, A.fumigatus
RNSANHGATGEILENQDASRLNHPLHSQTICTALQIALVDLLSSWGIEPDSVTGHSSGEIAAAYTIGALTMEDAISVAYYRGVAASKLLHNDEVKGGMLAVGVSPAQIAPFLDTLKSVFTTGLEGSTEVSTLC

SEQ ID NO: 29328 - protein, 187 aa, A.fumigatus
ILSRFLSPEGRCYTFDEKSNGYARGEGIGCLILKPLTVAIRDKDPIRAVIRGSGSNQDGRTPGITLPSGASQEALIRHVYNMAGLHPHDTEFVETHGTGTQAGDPIETGALARVFCVGRNSDKPLRIGSIKTNVGHLEGASGVAGVIKAVLMLENRIFLPNRNFTSLNSRILLDEWKLKACIPYYPS

SEQ ID NO: 29329 - protein, 138 aa, A.fumigatus
YWFPCDIGYAIASILCKISVAIFLLRVMVHPFHRRIMYAVTALTVIVGIIFFVYMMIQCSPVSYFWTRMLGNTSGKCGYVDAIIILLYLFSASSALFDLTVGLLPILLVRNLQMNQRTKIAVAGLLGMACMYVNCTFT

SEQ ID NO: 29330 - protein, 63 aa, A.fumigatus
SPSRLCGQSSFRYPGVVIIPSCQLPPGSKLKPTAGVTTEKTTGPWFAFSKLLSQDTIGHGYGS

SEQ ID NO: 29331 - protein, 73 aa, A.fumigatus
IAIWSNIETGLGITAGSVATARPLFRILHSRNGSSYRIFASSGFQSRRRQHQFPLGDLESNTWRSPYDPTKSN

SEQ ID NO: 29332 - protein, 156 aa, A.fumigatus
RTKNTSILRDEAGKEVVCDIDYIPKARMGLKCLFCREVRGACFQCNFGKCTRSYHATCALLAGVQVEHGSIAVIADDGNQYSVPSVDLKCKYHRQKRPTWMTNDAADYDRKVNATAQRLVVGDLVQFQADKEINGAVVLQNRPEERTLLVKILPRG

SEQ ID NO: 29333 - protein, 479 aa, A.fumigatus
PDSPLTPTISLSMHLRLRLPLLPLLPRQHNHHLSPAVAGNRCRRQCCCCCCPIALPFMQGPPLAPPPTAAAPRSSSSSTVVSAAAASAMPSAYRTLPTQSARHAPYPQVIKAHNNHHHHQQHPFYHSPQPLQPPQQQQQNNTNNNTTTTNTASTNGLPANTFANVRELIARRRLAQITDHANVFAGYTIVSPELVVETLLGPMGSVPPPNGLEKLELAMAQQRVQPRAPDGTLLPLQPLNMRSEEVTRLLQMLRFSLVSHRERLDVLQKRESENIKQEATAKGSAASAKLAGKYAYLDQQRAQAPTVYQSPYDMPSGFTEYAKKTYELIPCAPELPKPSVANDYFASLSTEDQEKILKTCGSFVQRAIERSAPHSRQNSASNLRLTSALAQQTENPTIDITTVEDLPLSGLDLPLHADSPCSSFSRSHLRFQSPNDFTSHGPEAHHDHHDLFGDQQANTRFWQHGRFHSRRRQGSAIGL

SEQ ID NO: 29334 - protein, 157 aa, A.fumigatus
PVTAAAASAAAAAAQSPFPSCRDLLLPLLLLLLPLVPPLPRLLFLLLLLLRCRRPIEPYPLSPLAMLRTRKSSKHITTTTTTNNIPSTILRNPSNLLSSSSRTTPTTTPPPPIPPAPMGSPPIPSPMFVSSLLAVAWRKLPTMPMSSPGIPSSALSW

SEQ ID NO: 29335 - protein, 121 aa, A.fumigatus
SQRGSCQPRGEDQIRQGNMSGNPFEEPPRRISEYTAQEIATLQARLDKKLGPEYISSRPGAAGQKVHYLSADKCINLANEVFGFNGWSSSIQNIQIDFVCLMKHIRMRPGGGRAKLLMDAP

SEQ ID NO: 29336 - protein, 103 aa, A.fumigatus
RMVLTMKYVFNGCFHLVVLTNSSGLTQDIGYGHIENCKGKAAAFEKAKKEGTTDALKRALRNFGNVLGNCIYDKDYVAKVTKVKATPVCCKPQLDTQTLSCSD

SEQ ID NO: 29337 - protein, 347 aa, A.fumigatus
VKQTLFISCGHSWLMDLGDLFDEADFGVTASGNPDEIVLGPETQAKPQPPTPVKTGPQGNFHRPNPAVLTPSRPEKPFNQTVNNRQPSVLPSLNQRHNPALQNQYAGQRQPVPQGQQQNFQNSRMAPPDQPRTSQDSNLPSAAGQMPVKREIDAKAQDTAPPASSPSVLPASFFSARAVDLLRENPHTAVNAPQFDPHAESPSIRKTAGVDHSKSVPISKPMLAAASPASNNTRDFINPSTDMHRKIGAPGGIGSPMMNRGQTTSSYRPLTRQNLDPKQAISNAAADRAGFGPPNVNGKRPPLSDVTNASVSGSSGPASAVNANDPKRPKIDGNSTPSLPPQQQQQQ

SEQ ID NO: 29338 - protein, 261 aa, A.fumigatus
  UNSURE (9),(103): Identity of amino acid sequences at the above locations are unknown.
GTPARRRPXKAPFVRAFSIEQIARLFWGPGSGAESDSFWPPPARSNAAGLSPQGRAFLGAVRRTVQRPRPSATLSPFGSQHNGFAEFQECAWSDWICRGAEAXLRAGRWSSLAQSRFVPAQYFRDPEELDAYLEHSNFLADINNERVLKNKRYAENLAGLNRFAMYMFEDDTMVNPKESAWFAEVNRTNGEVTPLKERRLYKEDWLGLKALDEQGKLDFRTVPGGHMQLAEETLEKVFKEYFGPVEVEIPPVNTLLKQTGL

SEQ ID NO: 29339 - protein, 89 aa, A.fumigatus
LDTDTIVLPPIRTINVPRCFTSLAVATSKSPASARKTPPTCSTRSKATRSTLPSRTSAWTQPPTPKILRRILTDSTSAPARMSPSRPSV

SEQ ID NO: 29340 - protein, 141 aa, A.fumigatus
MHKMLYPRNLALFSLLSLSSAAPSQVERSPDAVLKPRAVCTPTAGGSPSIDDVPAIRKAIASCGNGGTIVFPAGSTYYLNSVLDLAGCSNCDIQVEGVLKFSGSTEYWGGKTAMLNIDMINGLRLRSLTGSGVIDGNGQNA

SEQ ID NO: 29341 - protein, 152 aa, A.fumigatus
RGLVSSMAMDRMRKVHLSVRLMPELTRYRYDRFASDKNYKRPTLLYITGGSNIEVSGLRQKNPPNVFNSVKGDTQHVTFKNLCMDATSNSQNPPKNTDGFDIGASTHVTISSVSVTNDDDCVAFKPGSNYVTVEDVTCTGSHGISVGSLGKS

SEQ ID NO: 29342 - protein, 248 aa, A.fumigatus
VAKKRFRWHYILTGPPGTPYENGQYWGTLMFPPEYPFAPPAIRMHTPSGRFQPSSRLCLSISDFHPKSFNPAWEVSTILIGLLSFMTSEEMTTGSVSASEAERRVLAARSRWWNSTGGGSHISATPGVTPTARGINNVKAGDGGLKFRSEWPELDQENWQWMRENRIDTNTGQLIPDPNSSVTKCSPETSALRRRPNASAPGLGCVMEGGQVAREACQSWARRNKIWIGLALIFGYALLTRLVNDVQG

SEQ ID NO: 29343 - protein, 81 aa, A.fumigatus
YEILYWTVSDMLTDIFQQPISVYIDQSQDAKSQNGIPNIDVFFSEKEKSRVLQKTGTDGENGGVRQRNFDGGEVRGGRRDL

SEQ ID NO: 29344 - protein, 79 aa, A.fumigatus
PESAVTSIPVVKTKPKYSPKDQKAPRADPPRGSDKLEDLYITAINTNNRYAGDITLQAYLLTLYIIISVTCDRAYNNHI

SEQ ID NO: 29345 - protein, 136 aa, A.fumigatus
ACVSSRPCRIICNCLRFATGRSESSTSRRASSTGNTMNPSPLSPKCSKPAQPSTHSMRWNSAAASPLNVNSRIPSPSPKSTSSSTSQATSCSTAPSTAPSASTPTPTAWSASTQRTNPSAPSTWPCIRANHKRKAS

SEQ ID NO: 29346 - protein, 358 aa, A.fumigatus
LRIFQAVSNNLQLSAFRDRQVRVFDFATGKLYRKYDESITTITEMQQAGTALYPLDEVEFGRRLAIERELENPITQPKINVIFDESGHFVLYGSLYGAKCINTYTNRVVRVYTKDEPFRPLNLALYQGQPQKKGVMTVSMAASANPLLQESEERDPILVSTGFAKIRFYLFTNETEISKSSRDVQNERPTHADARETTAKKAAETGTSAILHTTMGDIHLRLFPQAAPKAVENFVTHARNGYYNNTIFHRVIRKFMIQGGDPLGDGTGGESIWGGEFEDEFSSLKHDKPYTLSMANAGPNTNGSQFFITTEKTPWLDGKHTIFGRAVQGLDVIHKIENTKTYKEKPEQDIKIVSITVT

SEQ ID NO: 29347 - protein, 419 aa, A.fumigatus
DHVNKQAQRCLSLLTGPSVAQQLDSPFQLQEHLKALYNHFTRPEGSETVVPISRDVAIQLAGPPEGVDKSLWLYELCRFLTMKVNNLIVAFFAENPPCSAQTCPEMRASEWQYLCAVHDPPKSCCAIDYCCHTLDWATNILTSPKHFPSRLTLGSEAGGGAQASLRYLTNIFRRLYRIFAHAWFQHRDVFWQVEGNDGLYIFFKTVCDMYKLIPEDNYTVPAEAEGLDANQSMQEQAGNRRMTILRKDSEGPLENIEPSSISTGATTRRHKNSASISSHVTTISEGAEESEEQPKAEPVIKSKDEKSTEAVPKVESEPQPAEEVVSEEQKEAADAPVQDPAESQDTVEEVQEDEEGKPSNTNTETAAKDEPEAVQPPEEPEATKAEESRADTQASAEDSPEAKRREDPTGAWSSVNNRA

SEQ ID NO: 29348 - protein, 65 aa, A.fumigatus
RSLPSLHQKIISLTVRKVFHLTPLSFALVNLKPILPGHVLVSPRRRVPRVADLTAAETSDLFLTV

SEQ ID NO: 29349 - protein, 71 aa, A.fumigatus
  UNSURE (8): Identity of amino acid sequences at the above locations are unknown.
SERNHKNXVFSVRQTVWAFSAKSHYPFLECALFHYKASASTTSSQRSTGLLCLSACSLQPAALACPLVCFR

SEQ ID NO: 29350 - protein, 134 aa, A.fumigatus
TSFFFVLSPLLFSFLLFPPPLFLFHFSFFPLFFFTLRFVVNLFFLFFITLFFYSIPPPNYGGIIITIIIIFIALDPFQSSTQNFPPEIPPPRWLDPGRSLVLTVEWSGYSRFLGLGLVWLLCLFLFSSFIIWSV

SEQ ID NO: 29351 - protein, 75 aa, A.fumigatus
LSSLPYIILLIIITGAGSASSFLPLLSSTLTVLPISAISVLRIIPQSDHFHRLPSPPPSQHNSLHHGAGRIRRWF

SEQ ID NO: 29352 - protein, 62 aa, A.fumigatus
MHCDAFFSWIFYFFWTGPSHVSVTSPKEGTIQWVEGEKSVIVELTIRFTIRDNSTVPPFSPS

SEQ ID NO: 29353 - protein, 131 aa, A.fumigatus
  UNSURE (67),(76),(86),(124): Identity of amino acid sequences at the above locations are unknown.
LQCSSIGSNLWYIRSIVPCQGIYPTICNNTKNADAMVRREIRGCFPRYDQACRVNISRQSAMRNESXNVDRLADIXPGITSNGFLXALDLSESVARTMVDLDSLVEDNTYEDTFLDIQTMKVSXQYTIVSA

SEQ ID NO: 29354 - protein, 65 aa, A.fumigatus
TVMVLKYLIKQYPLPTLYFGIANVIANGLVMLRFVDVSPAAIHLSRLLTGLLQYYCSMDLAEHRG

SEQ ID NO: 29355 - protein, 531 aa, A.fumigatus
YRRPTLGRGGGTKNCKISGGPDSPVGLSHLHVPSSLRNEDLRTTSKSPLSSRARSEKRSGVSMASEPSPKRPIPRAGLSGVQGQDEEPSPFVSHGAPWLRKDRVWINSRNVDPPTSPTTTVFNRQSDMRARATIVRSSKRRFPGNTTPPQRYSSIDSSTSAESPVHMVTRQGFIASEDRSKGNATESMHNQSVNGLDRQCTVSNERMSSSLQILSSSSQLPKFEYRRRKVRAASGQEHTSSPMVLDKRKPSVVAEVEKAPNITADRPTQALALRNVSFADAADLCQTESSQASHLLAKDETTVSNPPDMETVHNSKAARSMQGSTSERLHSAQRVPGNSAMMDCVTSLHTIAVSKEHTEYDGDTIPEAQFSTQAAVLLAQRSFQKDLESPEPEELPLRRTPSLSTSPAHEITPFCQVNTPGEVKITNKLSGPAGTGLPLMSTQCIIDAVTPFTFSTDKKSNYRVISSAKSRSGRRKSEGVNFPTGIAPSMHRSPSPSIRDHSELRNPDADRNIDDDSRVFTTGVEGSSGGA

SEQ ID NO: 29356 - protein, 411 aa, A.fumigatus
KYALRLIKAPQSLVSLVSFLLIREIHTFNSCIQASDFAMFLSKLPNEVVLLIAAHLVCYRDLRALVLSSRKLHHLLKARLSKHSYQACHGDALCCAAAQGDEGLARECLKRMTIAAESFQGPRVSNPYKHPLCTTNWRVEDSVLIQRALLVAVQAGSKRVVNLLLDHGAQTMFRGPMGYINNIPPLYLAVQNSHEDLVDFLCERGDPCYRENTCPLLWAIEHNQRRIIRTLLRHESCDHCWYVLPMAMNRGDTDVLHFLLENGLHGTNYARDALFAAIFKGDLEMVRFFIAHGADPNRLGDCYDKRWETSHVQLRQKIDSRSLLELGGIEDDFSTWCNGVCVDEEPMFCTTTYVAIYYDQMPILRFLLEYGVHPEPEDIQLARKKGNEEAVGLLSRSSNEDVPRKKSCFQE

SEQ ID NO: 29357 - protein, 182 aa, A.fumigatus
IILNNSNLFLLPKGNGIFMESWFNESEALPSNTTIATQANGWISDELALQWLQSFIKATNERTKRGEKRILIFDGHGSHLTIDFLQTCEDNGIIPFGFLPHTTHLCQPLDGKPFLSYKQHFRRINNEHAFWAGEPVGKSEFLRVIGPVREKAFNQRIIREAFKDYRIWPVNSKIANDLAILL

SEQ ID NO: 29358 - protein, 124 aa, A.fumigatus
GYQGRSYAQVCTLRLCQRLRRIFDRLPHSVQSYGGKRMKQRAFIDGRLRMTASSYGCAACVFSVASSSCYRAAGKIDKHVYHELYHLSKGNTFKHKRALIEHVSLPLDSYPFFIGMQRWRLRGE

SEQ ID NO: 29359 - protein, 267 aa, A.fumigatus
THISVSSLWGPIEHGHPSSRRHCFHMIPSLRLMLRIISGVEYLHAKSIIHRDLKPANIFLSPSENGELDGCPSCMANYGSTPDYCHPRIGDFGLVADVSHLNDCPTPSFEENPKLERVVGTEFYRPPLTTNGENYSNGMFQTGNHQFSYIIDETLDVYALGVILFELLYRLNTKMERQMVLTDLTKGTNRQSPTRICIRNTVFPADFAQKLDMGSIILEDSVSVADSLMRCISGMLEPNPHRRLRCADVKRALENILDATATQDRSC

SEQ ID NO: 29360 - protein, 121 aa, A.fumigatus
VRPPRKRNPGTDIVKDFNPERLTLACAALRLARVCAEDAFHYAVQRETFGAPLIQRQAIQSKIFRFGLMIEPAYALMEQLVNIIELTKDRPADDVKIGGMTALLKVMSTRALEKSVREAQQ

SEQ ID NO: 29361 - protein, 200 aa, A.fumigatus
LSIHFEGHHLYLFLSSPQKLLSQLSEKMTRKDPPPTAPYSEPLLPQLDIKNPYYTDLHHELRAYVRNYVETSIVPYAQDWETAGQVPEEVRRRHCDLGFGIVHPLTSEEDAAGISLPGNVPREKWDTWCNLIVTDELTRVGYVGVIWGLGGGNSIGCPPIARFGTPEQRRRWLPKVARGDIRFCLGITEPDGTIYDFYII

SEQ ID NO: 29362 - protein, 192 aa, A.fumigatus
PLRKTRQESHYPVTCPVRNGIRGVTSLLRTSLPGSDMWVLYGAWGVEIVSGVRLSPGSEPRSRGEDGYLRLRGGISGFAWGLQSLMVQFMIFTSFKGGDSLADGILAGSDVANIQTTARLDGDHYVVNGAKKWITNGIWADYCTAAVRTGGPGRNGISLLVIPLTAPGVTRRRMHNSGVNASGMTCLQKKFP

SEQ ID NO: 29363 - protein, 312 aa, A.fumigatus
QPRSQSEELIRHPLIQVQSVRLLGHEMASCKSSFVSILNNDDHPSFAVRSSHGVSRQPSTSSSYSLQSEQQPRTLLPDYSYGAPYTESTARSPGRVKRQPFDPVSEAMQPASPGSSDCSSYDYITQNSAISYYPSGRQDSYAYPPPTIAPAEKRLSGHSASDPPSPPRSIGGSKDGAGAKGTKKNKYPCPFAASHGCSATFTTSGHAARHGKKHTGEKSVHCPICNKAFTRKDNMKQHIRTHRTHSEDMPSGTGDRDGEAASSRWAPGRTSPPDNHSRSTSQSQTDGNVYHRSTSTMNMTTSSGSQRRHSPY

SEQ ID NO: 29364 - protein, 428 aa, A.fumigatus
  UNSURE (40),(56): Identity of amino acid sequences at the above locations are unknown.
VVRSLFHSFSSYIVSIFFFFLFFFFLFFFFLAFCFFSAQXGAWVDRCPDRARPPRXIHASMNMGRIGSASAWANANVPPPEIKSGSKGNKKKKKNDDEVKLRYHIADIIVRQRYIMQLCRAFMRYGAPTHRLEEYMQMTARVLDIEAQFMYLPGCMIMSFDDPYTRTAEVKLVRVPQGLDLGRLEKVHGCYKRVTHDMTDMQTAIGELTEIMDRKPRYPRWLVILLYGVGLGRGGSVWFLSAPDRYAHHFCAGMLCRVHAAGSRATFGPVLERLRGHGGHPGLLPGPRLWQHPIPRHLGPGLLLRHHHSVLDRPDPARFLRADEQPGAPVASDDRRIDPSRVHHPLLPLPGLRRHSRHHHLRRHRPRRNQRHHLRPAERLAQPVRLSLPLRRGILRHRGTDQPGQIPTDPHDGPDRDLGLRHQLFQHP

SEQ ID NO: 29365 - protein, 116 aa, A.fumigatus
  UNSURE (107),(113): Identity of amino acid sequences at the above locations are unknown.
KEMDNLTLYILTFNCARNPVDIDLFASHFFHALPHTVPSAPHLIALSLQELAPIAYAFLGGSYLTPYFTSFRQVVARAAASRWEDVQYATVVEDHVGMTGLMVFARXFKQAAXDPT

SEQ ID NO: 29366 - protein, 323 aa, A.fumigatus
SCFTALGSAAVGPFGFSARPIDMPIIFVLGCCVGFMQLVLAPLSALYSNVFEVTAAILVSFLARAFGSIRYPGTSDPVFCYATITQSSIALILPGFSVLTSSLELQSHQMIAGSIRLVYTILYSLFLGYGVTVGTTIYGAIDPDATSDTTCARQSVWRSPYASHFPFVAAYCVIAALINQAKFRQIPMMVLIGTSGYVTNYFSTHKLGSSSQVANTVGAFTIGLLANLYSRLWHGNAVSSTIPGIFTMVPSGLASSGSILSAIEYSDAVRNGTADTSGGTSGTSLTSLGYGMIQTAIGITVGLFIAALIVYPSGKRRTGLFSL

SEQ ID NO: 29367 - protein, 153 aa, A.fumigatus
RPVHSHCRGQAGACATGAGPGPFGKSARVLQARDARHDGHADGHRRADGDHGPQAAVSALAGDLALRRWARPRWVRLVSQRARSICPSFLCWDAVSGSCSWFSRHFRPCTRTSSRSRRPSWSPSWPAPLAASDTPAPRTRSSATPPSLSPRSP

SEQ ID NO: 29368 - protein, 245 aa, A.fumigatus
LPYPSLTQICGGISIQSSFLVAFKQLVPEHTVTIFKGLVKMRVKHFPALFLLLNTISGLVFGTQVAALLAWLGLLASWSYLRFYKRQPDLTGTSTDGQGIKGDASETFAFACLFPDVMQPPIAFVSDQIYTLLVALKICTPFSEEDIASGNQQVLARGEAGLPSLLSNQRGGGIRGIGKREEAERRRALALKALDQRLQAAAAGRVQSQSSTLSQPGSSHAHHATPTVSTGQNMLGETSYTPDHA

SEQ ID NO: 29369 - protein, 163 aa, A.fumigatus
AAVSALLVKMPYRINIPPATRTCLVSLVTLSLLYNIARWRQIDTRGKTPTTTPIVPYLTVVPSQFFFYPWTLLTATFVEQNIFTVLLNAATLFYGGKYLERAWGSREFAKFIVIIAVIPNLVVALVHLLCAAIGASSVSGYEISPQHSCISSCALSADSHIQA

SEQ ID NO: 29370 - protein, 79 aa, A.fumigatus
NIDTSYWGQMTSFLISSVYTVTNAGFSNYRLCSGISREGQKRFLRKLPALPDYVLVMLALCVMKTAMMYKGVKLNCHPK

SEQ ID NO: 29371 - protein, 203 aa, A.fumigatus
  UNSURE (20),(27),(40),(53): Identity of amino acid sequences at the above locations are unknown.
MCVPGLPLPYYARTSNGANXASSSLPXEFKDLQLSFFKPXFFSPFVCSPAAEXIKQYRRTGEQGTFRLILSEDAPVGIIDPDEAGVIAAHLLSQDDPSVHNRAKYILNGPQDITGKQIVDMVKQHIGVPVKDVSYRDVSFIDQLYEYQYAAAKPSKNVIYSIKRAPETAWEGKCSTSTTSNVILELAAPKRTPADTLKTLLEE

SEQ ID NO: 29372 - protein, 213 aa, A.fumigatus
  UNSURE (8),(22),(31): Identity of amino acid sequences at the above locations are unknown.
VAMGITVXLKEGGPFFPTQGNXCVFFPGAAXGAIFALLAMYLMRRRKNNLPPSVKIAQHTQRTSSGTLIGISDPIPSEENAYRTDFLLRRSLKRNSEGARSMLQRTGTRVKSLFGSTPKPSQMVSKQPPLPLTPPQQARMPSTESIKVYTPPGTFASTGVLRPEPYPTIVVGNGSTFTEMIDQAGSNNSKGDPSYSVDEAPRSRSKSPLRRLC

SEQ ID NO: 29373 - protein, 231 aa, A.fumigatus
CRQLIHTKMSLRLVSSVRDDLFAAVASDTQAAQDNCFAFSPDQLNQLFNPKSPPALYALGGLYGLEYGLRTDLSAGLSANERILPGAVTLEEARQAALCQTESKRPLLANAARPHPNQEPSVPFSDRTRVFGRNVLPDAKRKGFGRLLWDAYNDKIIILLTIAAVVSLALGIYEAVSGQSQVDWIEGVAVCVAIVIVVAATAGNDWQKERQFARLNQLVGFELLPGAGKQT

SEQ ID NO: 29374 - protein, 167 aa, A.fumigatus
HSIVFCIYTITTKASIMPLAPQETTLVDTATSIITRIPVSDTHSVASAARSTDGRIFTGVNVYHFTGGPCAELVVLGSAAAAGATHLTHIVAVGNEKRGVISPCGRCRQTLIDLHPGIHVIVPEQGEPMPVRVEDLLAFALSRGINCRKSRVETVQASKVVGENRPT

SEQ ID NO: 29375 - protein, 71 aa, A.fumigatus
GQPDPTTRLFLGKTNRTNRTSRGAKAAKSQFFINEVSQAEESQGPLQSIILMTVFPPVSIKIYLFCEEFLL

SEQ ID NO: 29376 - protein, 264 aa, A.fumigatus
YNKWMFSEDRVVFPFPLFTTSLHMLVQFSLASVILWLIPALRPRHRSSASSGSPFRNSHDASESTPILTKRFYLTRLVPCGAATSLDIGLGNMSLKFISLTFLTMCKSSALAFVLLFAFIFRLETPSVKLIFIIATMTVGVVMMVAGETAFNAVGFALVIASAFFSGFRWGLTQILLLRHPATSNPFSTLFFLTPVMFVSLIIISLTVEGPVKIADGFAALSGTHGGVFAVFLLIFPGVLAFCMISAEFALVFTTGLQGAAASH

SEQ ID NO: 29377 - protein, 90 aa, A.fumigatus
TAAMTSRKTQQEIDKTFKKVAEGIQTFEGIYEKIRSTSNPTQRDKLEENLKREIKKLQRFRDQIKSWASGNEVKDKGPLLEQRRAIETVG

SEQ ID NO: 29378 - protein, 61 aa, A.fumigatus
HSRPFLASSPSASTFALSPNILLLLSNWNRSFQLADTFPYLPKSTGIPFLPTAICPCEQQP

SEQ ID NO: 29379 - protein, 160 aa, A.fumigatus
QRLQCMEQFKAVEKEMKTKAYSKEGLSAASRLDPKEKEKLEACDFLSTCVDELQLKIEAMEAEEETLHVQMKKGKKDITKNNRLSDLSRILERHKWHVNKLELLLRALQNGAVETSQVMDLKENIKYYLDDGPHVDYWREDKTLFDDLNLGEISQSPIWK

SEQ ID NO: 29380 - protein, 65 aa, A.fumigatus
VAVIQRVKSASVTVDEKLVSSIGRGLLVLAGVGKEDTEKDADTLIQRVLKAKLWPAEEGGQVSSL

SEQ ID NO: 29381 - protein, 126 aa, A.fumigatus
LWLFIQWKRNVQDIEGEVLCGGFGCSEILECAPLTVDAVSQFTLYGQLKKGSKPDFHDAADAETARKLYEYFFRRLGEAYKPDRVKNGVFQAMMDVELKNDGPVGVDYRSEDAAVSFCSSSYLVSD

SEQ ID NO: 29382 - protein, 109 aa, A.fumigatus
  UNSURE (95): Identity of amino acid sequences at the above locations are unknown.
LTNNEPVGCIMLVKDVDSPDTARLRLLLVDPSARGTGVGRSLIKQCIEFAREVGYRRVVLWTQSILGSARRLYKAEGFRLVKEEEHEGFGMALVXELWELELENKSQGE

SEQ ID NO: 29383 - protein, 70 aa, A.fumigatus
  UNSURE (58): Identity of amino acid sequences at the above locations are unknown.
SGLYVTTLLNYRHDKYNNCSCNQVNYSHAGIDCSSYTISQCIIHPETCSLAPAPITLXPTPSQTLHAPPP

SEQ ID NO: 29384 - protein, 65 aa, A.fumigatus
TQYLISSYRTASMASTGALSDPQEYQKIFHWAETQKDGTIPSFSTRRNDPYQVSSYSICSFLRDS

SEQ ID NO: 29385 - protein, 66 aa, A.fumigatus
CRDIYRFVSEAVPGTIPQGQNSPRNVRFGLYAEQITATAFVAPRHCNKKAWLYRARPAVAHQGFVR

SEQ ID NO: 29386 - protein, 81 aa, A.fumigatus
VPYKYDLTKFVNVGSISVDHIEPSIFCVLTAKSRDLTAPLADFSSSLPAGMERLRSCFVHKGYAVSLLTISRHLPDHFTIT

SEQ ID NO: 29387 - protein, 269 aa, A.fumigatus
DSACMLSRSPRLLLSPHGIATRRHGCTVLVRRLPTKDLYVDAIRSIGRVLMMLQTDLPDNKDTESNFLPINPRVRVSPTQLAWHPFEIPTGEEVDFISGLKTVAGSGDPTLREGLATHVYTANTSMKKKAFVNSDGEFLIIPQQGALDIQTEFGPLFVQPGEIVVIQRGIRFRVELPDGPSRGYILEVWGSYFELPELGPLGANGLANARDFLAPHAKYEISQEPWEIIYKLGGKFFKSTQNHSPFDVVAWHGNYVCLIPYGFHYTRRS

SEQ ID NO: 29388 - protein, 228 aa, A.fumigatus
AEKACCCRCCRLHRDPRGLRSLTTVWAEHLSDEVKRRFYKNWYKSKKKAFTKYAKKHAEENGASITRELERIKKYCTVVRVLAHTQIRKTPLKQKIAHLMEIQVNGGSVADKVDFARNLFEKPIEIDSIFEKDEMIDVIAVTKGHGFQGVTSRWGTKKLPRKTHKGLRKVACIGAWHPSHVQWTVARAGQMGYHHRTSCNHKVFRIGKGSDEGNASTDFDISKKQITP

SEQ ID NO: 29389 - protein, 92 aa, A.fumigatus
SLMKYPYSMGGFVRYGEVKNDYIMVKGSVPGVKKRVMTLRKTLYPQTSRRATEKVELKWIDTSSKFGHGAFQTPEEKRAFMGTLKKDLVTSA

SEQ ID NO: 29390 - protein, 303 aa, A.fumigatus
EALVVREASMRRWQLSRRVYCVINRNLVWASTSTASSSRAALSPQSLILKSQSFSISFQRRLYSNLCIRTSPQTQTLLVSTHQTHYTIPSPNPRRSPIISRAMSDDAYMSFLDKANADLNNARAQQPQQSSGVRTETVDVGVQIPAPLRSVDAYYISETDEPFEPVALKWEGADNGTWPGPGSCSPMGASCCLKRQKAFANDALSAQPNSRDSSPPNADISSSIETLTPSTFDPKNQYSAALRAVRAAVAQTFGGGEPGIDESDVETKVYRVEVGKSRVEYYILGLDAVGGTIVGLRAKAIES

SEQ ID NO: 29391 - protein, 63 aa, A.fumigatus
YTEKERLHRAKCRLFKVEEHGKIYMLQYKHASNMNGTMSNVITIDNLVSDSLPEHTSSTLTSF

SEQ ID NO: 29392 - protein, 71 aa, A.fumigatus
SQPGLGFDFHCIIKSGCPLSPILNFKVSEFFHFLSTSLIFQPVHPNFSADTDASSFDPPNPLHHPITEPSP

SEQ ID NO: 29393 - protein, 627 aa, A.fumigatus
IQGLPLVKTKNHSLFLLPACESSNCNPTGSLLPKRHFDSKDNINMSAIQFPPVPSPVSATEKYFDLGAHGFPITTKNRDAQVWFDRGLIWSYAFNHEESYRCFQQVLAHDPTCAMAYWGLIYAMGPNYNKTWQLFDPTDLEHTFKFCHHAAQIAEKLAHDNQNIKPVERALIKAIQHRFPVDHPVSDFSTLDRHYAVAMEEVFREYGNKDMDITTLYIDAIMHTAIRMMYEVNSGAPVEGSPVHKLRAIFDEALAKPASDSHPGLLHFWIHFMEMSSTPGVALPGADKLRRLVPDAGHNHHMPTHIDVLVGDYRRSIDSNTAAVTADEKYLAKEGGKNFYSFYRLHNYHSLIYAAMLSGQRRIALDATTRMEASITDELLRVEAPPLADWMEFFKAVRVHVYIRFGMWKETIDLPLPENQALYCVTTTMIHYGKAIAFAATGNLVQAEKGRGVYHAAARTVPPTRKDFPNLISDILKISDAMLDGEIEYRRGNYLVAFENLRKAVHFDDSLRYTEPWGWMVPTRHAYAALMLEQGHVEEAAQAYAEDLGLDSSLTRAHQHPNNVWALHGYHECLVRLGRESEARIIKQDLDLALQVADVPIKCSCFCRLGALESDENGGSCCQGAYQ

SEQ ID NO: 29394 - protein, 76 aa, A.fumigatus
ESIGSEIVTKLLLPLLPRVPSIIVFGLIVCVIYVHPSTLNIPFIFEYFVRFTIYSTLLLLPFSKHLYFPKTTASAH

SEQ ID NO: 29395 - protein, 558 aa, A.fumigatus
GPRRTVCPLPERDTINSRLPRRTLGHRSCHVCGSRSRTETTTTIHLTPLTSHNSIHSVGFVQSFFWRNAGFEVIRKIPQLRDYAPRYNPTVIPVADSKRAATEELPPSPKSRKGSANYHTSADYHALYKSGKLTPTAVVEALLPLIRRDVRPPGKHSVAFVESQVERIRAAAEASTQRYKQGQPLGPLDGVPVAVKDEVHVEGYRRNLGSNLDFKGGFEGTSWCVQKWEEAGAIIIGKTTMHELGLGKNRTSPLLLKSRISQAHPEADTTNNNPNYGTPRNPHNQDYYCGGSSGGSGYAVGAGLVPIALGADGGGSIRIPSSFCGIWGLKPTHNRVSGFPTASLAPTVGVYGPMAASIDDLALAYRLMAAPAPATEDPVSATFPDPMSSISSTAQRPRSKTIGIVPSWIDRAEPPVRAVFDAALDFYRKQGYTVVDIAIPYLPEGQRAHVLTIMSEISSGLTPAQIGALTAPNKVLVSMGMWQITAQDLIAAQRLRNLLMSHLAYLFRQHPGLLILTPTSPIPGWRIESETDLARGVSDGKASVGHMSSRRGWKEPRT

SEQ ID NO: 29396 - protein, 106 aa, A.fumigatus
LQPSASTDRWQPASMTWLWPTASWQPLRRQPKTPSPPPSQTPCRASHLQLKDPGARQSVSSPPGSTAPSHPSEPYSTPPSTSTASKATPSSTSPSPTSPRASAHTC

SEQ ID NO: 29397 - protein, 198 aa, A.fumigatus
PGSGLPPHGSPCAGNRRPRLRHLPRPHVEHLIYSSKTPEQDNRYRPLLDRPRRATRPSRIRRRPRLLPQARLHRRRHRHPLPPRGPARTRANDYVRNLVRPDTSTDRRPHGPQQGPRQHGHVADHRTGSHRRPAPPQPPHVPPRLPLPPTPRSTHSDPDISHSRLEDRKRDGSCPRRVRRQGLCRAYVFTPGLEGTAN

SEQ ID NO: 29398 - protein, 129 aa, A.fumigatus
CLMVYSPIGPKSKLSSGRTVMNLGSLNFYNFNTNEGLKEKAIQTLRNYGVGPCGPRGFYGTQDVHMKTEADVAAYLGTAACIIYSQAFSTISSVIPAFSKRGDIIVADKGCQFRHSERHQDFAQHGPVV

SEQ ID NO: 29399 - protein, 141 aa, A.fumigatus
PRSACPSSPVVKIFPFTMDIQETQRLLSEYLHELANLFHRLPGSAIFLRYVKSSYQNDPIRSAVELFLFLFAVRYLLAPKYSTKPGVVKLSEDEIDDLVDEWTPEPLVGQPTALEEMEVEKRTVIVGYFYSHSNCYCDADV

SEQ ID NO: 29400 - protein, 129 aa, A.fumigatus
RPKLMLLPISAQRLASSTPRHSLPYRASSQHFQNVEILSLLTRGVNFAIRKGIKISRSMVRWYEHNDLEDLKRVLAKDHQRASEKAPSREGFIITRGLFESYGDMVDLPKIVCNSSIPSGSENAYHGTV

SEQ ID NO: 29401 - protein, 184 aa, A.fumigatus
HTGKIELKLKYKFRLILDETWSFGVLGRTGRGVTEHQNVDAAEVDMIVGSLAGPLVAGGGFCAGSEEIVHHQRISAAAYTFSAALPALLSTTASATINLLQNGPELVSQLREHTKAMWAQLDPRSDWVYCTSAPENPVMILVLKPEVVAAKRLTAEDQQYLLQDVVDEVCNLGSERFHVVMGVQ

SEQ ID NO: 29402 - protein, 60 aa, A.fumigatus
CLANGVLISRLKSLDDNFEPKQIVPPALKVCITIGLTKKEIEKAGTIIRHAITKVVSKRK

SEQ ID NO: 29403 - protein, 69 aa, A.fumigatus
QSGHSAFCDTIFKFLHPIRHTFRDSVHNSMPVERPQAHRSFSLALFHVQPSSERELHTEWKATAWRASQ

SEQ ID NO: 29404 - protein, 65 aa, A.fumigatus
EQLTLRANALREELHTNVESMLNDVIRFKVHIQKGLEDYESFVVDEVEQELGGDLPATKDVTSQT

SEQ ID NO: 29405 - protein, 183 aa, A.fumigatus
YSSGDLSEARGGRCQNPELYAGFSSISASRCLLRSRRSAALASARASASLAACSSLARCASRAARRALLSSRRLASRSSSSRIWLSYSSRSLRLARLSSAALASSPRNRSEGAWRDVRCDRCAVLLASASSASASRMPLTGPPSVTKPSSSISGFMERRLLSCLNRRASSRSGSVMYLTSSSR

SEQ ID NO: 29406 - protein, 451 aa, A.fumigatus
CTVQNSKILSSHQSRPRAYEDDAVIVEPDQHYQGPDVMSGPDDLAFVEAPRERRVKRSNTLPKKQDTGGLMGLIGSLRRNTRPEMPDRRKSRSYRDEDVRYMTEPERDEARRLRQERRRRSMKPDIDDEGFVTDGGPVRGILDAEADEAEARRTAHRSHRTSRHAPSDRFRGDEAKAAEERRARRRERELYESQMREEEEREARRREERRARRAAREAQRAKEEQAAREAEARAEAKAAERRERRRQREAEMLENPAYNSGFWQRPPRASERSPEEYYLDHRHNVEQRHRRSHRSIDEREKSRRRGSRTREPVRPPPMMSGARRDKTTSWVDSQAADPPEPPPIVPTVLDVPLPPGDQNAHSISSDEEARRALRRRARRRARYPGLNDEEIEELRARRREARRSDRAKSSSGSGDYERDRGMRSYDGRYPAVPPPTSGAKMSSWFKKLTNL

SEQ ID NO: 29407 - protein, 78 aa, A.fumigatus
DDWRAYSVWSPCEHVLGTLASARYGWTEADGVVFQVTLREQCTPEQKKLFLEPAEKYQIIGCYASSHGAGRMRGQRIS

SEQ ID NO: 29408 - protein, 171 aa, A.fumigatus
FTPPSSTFPVEKRKAVIRVIVHSFIRCLICLISYLPPPDYSVPPIFAMPSPPPEWVKALTPASPQGTDLLKQERAQSNVEVDKLAEFLHTKAFLEKQQRFVELLSSEKVFDKSQMHSQGRSERIQRALAKGKRLQQLKEKYNWSTEDFHFASEMIGEPTPYGLHASMFLVR

SEQ ID NO: 29409 - protein, 62 aa, A.fumigatus
DRGRLSCLATIDSTLFSTMYRGCSVVHLGPVSTAHYVQELCWASHIVDSSNSSGNLLSVLRL

SEQ ID NO: 29410 - protein, 63 aa, A.fumigatus
MHLAPIRQTIPHGLILPLISPPITRKHQVINLRYITIPRYTIPKISTITGSSMNDYSEQPLVV

SEQ ID NO: 29411 - protein, 161 aa, A.fumigatus
PLNIARLKLRDQLFWDDDGTVYLSSTYRKLVRTPGATLKDFAIHIATVDLETGNSTYEPRLIRESASGVAEGSHIFKRGKYYYLFTAEGGTESGHCEWVCRSEVSPFGPWEVGPCNPLWRNGVDDEVQNTGHADLVEDAEGNWWAVFLILAPRGAGRDPAL

SEQ ID NO: 29412 - protein, 144 aa, A.fumigatus
CRMYNNPIIPGFNPDPSIIRVNHDYFLVTSSFEYFPGAPIYHSTDLIRWSLIGHALTRPSQLQIHTPEPGGGIWATTLRYHKGTFYIIAASFERYRPQEDDRVWPRGFYVKTENIWDSDPWSDPVYFDQVGFDQDVSPALESSL

SEQ ID NO: 29413 - protein, 85 aa, A.fumigatus
IGIIFWLFAQLSYQQASGVLSIITVSSDVHSHYVSESYTTLHNICHICGSHKTIMRSALLTLLYYLYPRCRNGTNSNHPIISILL

SEQ ID NO: 29414 - protein, 77 aa, A.fumigatus
AIPNPEAFDQVISYSKIKIGLFSDLVFCSQVSQRSVLLYGLELFHEKLLYLTCFKGVLVTSSLYLGLRISFTHWNQL

SEQ ID NO: 29415 - protein, 509 aa, A.fumigatus
  UNSURE (10): Identity of amino acid sequences at the above locations are unknown.
MGCQTLLPSXERQKKGTSSLDRTSVWLAAQQTYLAALRETNPVNSLESEESDALEGYHDNCEQNAPGLCRKKSVRSAESVSEAARPPSALASKDSIYWRGFQSVLGLSTRRDSFIHRNTRFDAVQSIRSGLLSMHINCVLGHYELVRPERPPYKGPFSQAPRNSVRTSALAEKAQFSILEKEQLVLSQLRPPMWAMDALRYLNGGHLVTSPARSRLSMATAQQAPPQKPKGHRVRVLDLGGHASCEWAWQLAHDYPNVKVYTVFTEHQAVNHGIKGPPNHCQISVAQLWKLPFPDNKFDLISARSLPALLKNERPVGEMHDEYDLCLQECRRCLKPGGYLEFFVMDAEISRAGPYATAASVEFAFNLKTRGYDPLPTKRFLGRLRSAGFVGVKRAWTFLPMGNEPVQAQLPRETPDPRVKSWVDEYEAVHGPVGSTADIASVTGLFGGWMWEQWLLKLQVEMGRERHRLLEGIGSVFDEGRKNGAGWTCLSGWAMKPKRKMPPSRLRTG

SEQ ID NO: 29416 - protein, 565 aa, A.fumigatus
  UNSURE (523),(564),(565): Identity of amino acid sequences at the above locations are unknown.
YQSLLVGIMTDSAIAASALRDSENISNRLDPKGPDLLTVASGVKLGSPFLSQSENERSASHFRDGKADPTDERRIADDAQSIKENVNHANEGGGKPRSEKAGGLKDAWNDGQGEQPVLPSLRRPNESLDSPQQSPDHKQHQSTTPGAAVSPRRPSVQFTHETSDIDAAPEVTGSRPPSVLDDEPDSGLKGKQSIFTKLKSLASPSFTSHSRSASGATISDMRQTNTDLATPGSERGAFRFPDTLEEEGSDIDADAEESAGEQEVRQRRKKKISRRQPEPQSAPQTEPNTPKTTRRPSFHLPASFGPFENYRANLFARRVSTGDFAQQREGVSEDEGRDRLNRDAWRRRIANARALTYGSRQADTPGNQEERRPSNFKRFTGLGGPSENAEGNAPHWRRHRAERGSSLSAQKWRQIKAGFKFMRRKPESTVDHAKSAELLAELTSGVPAALILASMFQRDEHGSKRIPILLEQLKVRVTDSKFEPHSGDRHLVFRIELEYGSGMTRMKWIIHRTLRDFANLPLXYKLHFRNAKVLSAGKYRRAAQNLPRFPRNAFPYLPRSPRSXX

SEQ ID NO: 29417 - protein, 81 aa, A.fumigatus
  UNSURE (3): Identity of amino acid sequences at the above locations are unknown.
LIXQGQIRKISQGTMDDPFHPRHPAAVFQLDPEYKMTVTGMRLELAISDPNFQLLQKDWDPFAAVFIPLKHASQYQGGRHP

SEQ ID NO: 29418 - protein, 76 aa, A.fumigatus
YMLVYNFLLSISFKYIYTNYSVFIKHSITILLYIDNILILLNSNNFINNFLKQLGKLFKYTNNSKVSVYLGINILY

SEQ ID NO: 29419 - protein, 62 aa, A.fumigatus
  UNSURE (32): Identity of amino acid sequences at the above locations are unknown.
LILGTYLDITFTISKLAYFTRNPSLNYFIIVXYIFYYLAEMLLLLLFYPFIFSNLNSFINTN

SEQ ID NO: 29420 - protein, 426 aa, A.fumigatus
RPLALPANFASATAYFIERPPANFGEERPTLSHLLTIYPRTQSKDFPRRPRCWSPRTAEITQQDWDMFLKYLFPPDLGLAASSAHLPRQLRAEIQRDRKDRPQETDEQRRLRIAAVIEEWNECFFEPRATRIEFIYVTESENAPVSPLCPRCYPAATRATRANRSTHAQEAGESPSSVPASMLPTVAGQPTAPPASGTYAPGMFPYPPPQMPPAPYPPYVPPAFFPPGMVPNTPPPPPAPHAYTYPPQPPSQYQQPPSWGWNNTPYGPQYQYSSTSKGGPLSWLSSLASHAQKYSERITEQAQHYGRQVEEQAMAHGRWIEEKAGLHSRKLEDVFGGFSSPPRVEYPTNNPQAQGFYAHGYGYPPVNVVSTQPVAPPITQPTQPARRTSVSSVSSESSFSSIDSISTTSDLSSTDLATVRNAASIA

SEQ ID NO: 29421 - protein, 91 aa, A.fumigatus
QHQRLHLRWSSLYVLFPVVTLRTRTDRPPVNPYGKTHGAPEDSERHVGDLGNFETDAEGNAVGSKQDKLIKLIGAESVLGVSFFFSADGNA

SEQ ID NO: 29422 - protein, 74 aa, A.fumigatus
LTLPSVAVLRGDSKITGTVTFEQADENSPTTVSWNIKGNDPNAKRGFHVHQFGDNTNGCTSAGPHCMSSSQWSL

SEQ ID NO: 29423 - protein, 61 aa, A.fumigatus
RTLVVHAGTDDLGRGGNEESKKTGNAGARPACGKCISVYGHKRRMYVNLLSLSTGVIGIAA

SEQ ID NO: 29424 - protein, 371 aa, A.fumigatus
NRILAWQMVRQIAEHSHYVQGMAWDPLNEFVATQSSDRSVHIYSLKTKDGQFTLTSHGKFLKMDLPAKRISSSSPAPPELSIRSQPASGNSIAIASPATSTPGTPLTSHLPMDPPPVSHSRRSSFGSSPSIRRSASPAPSLPLPAVKPLEVASPNVLGGLTIKNANIYANETFTSFFRRLTFTPDGSLLFTPAGQYKTTHVPATDPTKTTDEIINTVYIYTRAGFNKPPISHLPGHKKPSVAVKCSPILYTLRKAPQPARHITLDTSSGEESFASLPEPVVSTKPTPDKPSMEPPSTPSASESSKTNTVSKNAENEGASAGQNPSPVFSLPYRIVYAVATQDAVLVYDTQQQTPLCVVSNLHFATFTDLTW

SEQ ID NO: 29425 - protein, 226 aa, A.fumigatus
CVRYADKNRSDDGLTLIMSSSDGFCSTLSFAPGELGQPYTPPAGTAQHPASASTTSANQAPQPSPANNPSPLKLSQPSLSSSPAQPAEVPPASPARSNSVCSMTTQSPIQQVTAQQSGDFVVNNPTPTLGSVPLVTAANSAQPPILPFTTPPQTPMSAVAQSGANSVSNSVLGKRDISESEKEDSKDQSSVPQVQQPKKRRVAPTLISAGTNSNPPSSSSPNHEVS

SEQ ID NO: 29426 - protein, 664 aa, A.fumigatus
SSHFPRLAPVCCNLYRFIPVPCHTTAYFAQFVSTFSSSTHPQQFTLLTTTMSSPAEHSSSESSHGHNWPNPALRHPRFNLAEMPDPPPSWKFLGESADVVLRTRKYVREQMVAMLDFYSWGIDTGMPSRLTNLRILQALWKIFYYTADYHRPRSFRDLLDFEGKDGGPRLLSCEIDHPSLLPISRYYPDPPALDGTTQPDFVRPENAAANIPDIYLERMSKSSRDLNMSEAETLGSSPPAVGTLNIGGNGNTAAFQSNNQTTAVVTAAAGSLANPSLTAPANPTGVFIPAPAPSAVVRVPAHMARAIIEDVERVVMKYAYMELERDASAAPQTVARPNLTAFHEGDISKSIVGLYHANAQVRLSLDPHDPTRTIIDPTGNDYPCRGRGPIWKNNSSTIDSLIVVGKLLNAGSTVIDRKKTGWETRFSSLERAFIEATDVNWDVLSLDESTEMRDHFWDVVQEHVAGIQPGVLSPLWTVWSDCAGHFDQFHFTYREAVAPCQCTGQGATIQAHTKTFVAPDRHARDMHGVCMSEVMARPFAPLLYADCTACNAPQCVTIERRFDTLPLRMVVGLDEQVSIKNHTKDITFDFCDGDGQLQKATYRWLGRIYYKDYRYRVFWTDTKRGETDHGFLKMYDSTMNSGLIIGDIPPAHKDERVPPEWWRN

SEQ ID NO: 29427 - protein, 113 aa, A.fumigatus
TIIMASKTWNVGIVGYGFSAKIFHIPFVTEVPQFKLYAIVQRTPKPEDDAEKDHPGIKSYRTAEDMIKDAAVDVVIITTAPDSHYALARLALENGKHGEYPFIDYLDGTCADL

SEQ ID NO: 29428 - protein, 238 aa, A.fumigatus
SMTNFNLVVCEKPFTPTSEEANDLVTLAQQRNRLLAVYQSTLDQTKFSRRIHFQELTSRLTDRRFDADFVTLTKLVKNGSLGRVVEFETHFDRHRPEEPPADVSKWKNKVIPGGSAIYDLGSHLLDQAVQLMGMPDRITGFVGSQRAVNTTGFEDSFTVLLHYNNGLLVTAKAGVVSPEEKQLRYWVRGEKGSFKKVRNLITFPRPNADTVSIVPPRHSGGSAQGWNETGRQRIRSGA

SEQ ID NO: 29429 - protein, 88 aa, A.fumigatus
AASALEGLGVIWLTMLCTGTLTTIQDGKPVAEIFPTVEPPTYTEYYRKFARALAGEGDLPASGAEAAKVIRLIELAKESSKLGKTIDV

SEQ ID NO: 29430 - protein, 440 aa, A.fumigatus
KVKVWDVKSGFCIVTFTEHSSGVTACKFAKKGSVLFTASLDGSVRAWDLIRYRNFRTFTAPSRTSFTSLAVDPSGEVICAGSPDSFDIHVWSVQTGQLLDQLSGHEGPVSSLAFAADGNHLASGSWDRTVRVWSIFGRTQTSEPLQLMSDILDVAFRPDGKQVAASTLDGQLTFWSVDNAVQEGGIDGRRDVSGGRKMGDRVTAANSAATKHFNCITYSADGSCILAGGNSKHICLYDVRSGALLKKYTVSVNTSLDGTQEFLNSRDLTEAGPRGLIDETGEASDLEDRIDRSLPGAKRGDAGTRKTRPEVRVTAVDFSPTGRAFCAASTEGLLVYSLDTEFVFDPFDLDLDITPTTILATLDAAKKAHSMNTADDDNTFLKALVMAFRLNESKLIRAVYEAIPPSEIPLVVRALPTVYLSRFLRFVAQSSPTGLDSIRA

SEQ ID NO: 29431 - protein, 254 aa, A.fumigatus
  UNSURE (8): Identity of amino acid sequences at the above locations are unknown.
GGRGAGLXGRARGTRRRAGRVVRNRYNHSRGGHVGGAALGDEGSGGGLRGGSGGVGTGRARSRGSRRRSSSRRRLGLASGRGLRRRGLRRGRRLGLGGGRAGRRRLGSRASVARVGDTKLGRVLVLAGAFDHEQQTVVGGVGLERGAGSPGKAAGVGDAVGQRLNGHHIGAGTAQEHQRDRPGGSGIPCDCVRLASRDQFVQAGLEDGISRGVLGVVGLGRGHGESRQAGDDRRNGETHFIRNRRKDCKMVLLE

SEQ ID NO: 29432 - protein, 83 aa, A.fumigatus
  UNSURE (56): Identity of amino acid sequences at the above locations are unknown.
TSSTGRIQEHDNVQSMSHPTWQTDSPLVIYRPIRRQSASLPGNEVTSQAPQTNQLXVNAVKNVGPVSALKPGGNTAKNSDLVQ

SEQ ID NO: 29433 - protein, 252 aa, A.fumigatus
  UNSURE (245): Identity of amino acid sequences at the above locations are unknown.
QHHLTVLPSVTNKMRLSIASVVSCLAALAMAATKPDYTQDPTGNAILKPGLNELVPAGKPYTITWDPTTTGPVSLVLLRGPSTNVVPIETLADSIPNSGSFSWTPSTSLEPDTTHYGLLLVVEGTGQYQYSTQFGISNPGYTGSTSQSSSTSPTATETKSSSATESSSSKSSTTGKPETTTTTTPPTTTATSGSASADSTTTASETPATTLVTQSSTANVPTSTVVVSVPNNSAGSSSGASGSPXQSSTPSP

SEQ ID NO: 29434 - protein, 200 aa, A.fumigatus
  UNSURE (194): Identity of amino acid sequences at the above locations are unknown.
TNWSRLASRTQSHGIPLPPGRSRWCSCAVPAPMWCPLRRWPTASPTPAAFPGLPAPRSSPTPPTTVCCSWSKAPASTSTRPSLVSPTLATLARLPSRLRPARPPPRPSLLPRRSPLLRSPRPLASPRRRRLLLLLRLPRLLARPVPTPPLPPRRPPPLPSSPRAAPPTCPPRLWLYLFLTTLPALRRVPLALPXNPAPRP

SEQ ID NO: 29435 - protein, 448 aa, A.fumigatus
PNVTDGTYMINYQRKQLPNYVAPPPDIYMLHPDYGTYFSHDQVSTILDNLDTPDQSYQQYLDRVLVENADDVIHVLSFEGELLYISPSCRKVLEYDPNELIGKTLSTICHPSDIGPVIRDLRSCTNSDPVSVMYRVRTKYSGYMWFESHGSWHIGDRGRQYLVMTGRVCPVYHLDQLANIGNGGLAENDLWAKLSISGIILFMSSKARPVLGRVSDDLVGKGIQDLIPADAREDAKQALEVARTGQQTSFSHKIRHKKGHMLQAQTTLYPGDTKEGEKPSFLVAQLRFPKSPQTTPGTEEVVPFNITATFSRDASVTGRRNVTAAGQPTSDKSARGSSGDQYVPAPDEPTLFAELNTARGSSWQFELRELEKQNRALSDEVQRLLARRKKRKRKQSIVPVEKACAMCQTRTTPEWRRGPSGNRDLCNSCGLRWAKQVRNAIQKKAPTT

SEQ ID NO: 29436 - protein, 195 aa, A.fumigatus
DRLSTWPEIWTVVYHESPSIGGLNYLSIAIGSFAGLFFNLKFVDRIYKTLKARNNNNNNNGQPEFRMPSLAVGSVLSTIGLFWYGWSIGNTHWIMPNIGALMYTAGTISCLQGMQTYIVDSYQTYAASAMAACAVLRSLAGFGFPLFAPYIYQSLGYGWGTSVLAFVTVGIGCVAPFAFWRFGPRLRAISRYAAG

SEQ ID NO: 29437 - protein, 62 aa, A.fumigatus
EWGRATSIIMKANTFGAFARSFSNACAAAVASFSNTLFGSALASRNPWPTWRIRWRMVGDSS

SEQ ID NO: 29438 - protein, 195 aa, A.fumigatus
IIRPFCGVNVIAYYSTTIFVESGYGIQEALLASMGTGILNWVFALPAFFTIDTWGRRNLLLFTFPLLAICLFWSGFSFWIEPDDPLSKKRVAMVTTGMYLFEVFYSPGEGPVPFTYSAEAFPLHVREVGMSWATATTWCFNFILSFTWPMLLDTFKPQGAFGWYAAWCLVGWVLILLFVPETKGESVSPCHSSGR

SEQ ID NO: 29439 - protein, 240 aa, A.fumigatus
YAACLLVDTENTWSSSSNVRAAIISTSASRRVTGGNRLTLGLRDKKQDQHPTDQTPRRIPPKRTLRLERVQQHRPRKRENEVETPGGRRGPRHPHFPHVQRECLRRVRERHGTLAGRVEDLEQIHACRDHGDTLLAQGVVGFDPEGEAGPEEADGQEGEGEEQEVAAAPGVDGEKGGESEDPVEDAGAHGCEEGFLDAVPGFDEDGGGIIGDYVDPAERSNYLAQCRFQVQWNQTLVPVA

SEQ ID NO: 29440 - protein, 305 aa, A.fumigatus
ISYTMNLAQATQAVLEELKLIPSEETPLQRPLPWRPSLALNRRGEDVRPIFWRNRNSSYIARTQTWDEFPNGRWTDSRSPAFGELDAYGIGLKGTNEQNIKLWGEPKSIRDITQIFVRYLEGKLDRLPWSDSPISGEANAIKDNLVQLNSRGLLTVNSQPAVNGVRSSHPVFGWGPKNGFVYQKAYLELFVPPYLLDELIARIEKNPDLTYHAVAKNRELRTNTRDSPNALTWGIFAGREIVQPTIVDTISFLAWKDEAYRLGEDWAKCHDASSPSRKLIQDIMDNWYLVNIGKFAFAPCMCSNC

SEQ ID NO: 29441 - protein, 67 aa, A.fumigatus
VCVCSLHVFELLTLDNLVNNDFHNTYDLFDLFNGLEVKDLDLEVGPDTAETKSQPNGAAPEEVAIKN

SEQ ID NO: 29442 - protein, 62 aa, A.fumigatus
SHNTVAWMARGVLDWFLQLSIITTRKCGPPHFKTGTILTRAEKYDSYFGNFVMEQTRGDVLL

SEQ ID NO: 29443 - protein, 67 aa, A.fumigatus
RTRPRILRAFLHGEPKSSPLSPVPSRRLPNRFLSSQKRGYSDYHSLQMIIYYFQYITLPSSNSTVSI

SEQ ID NO: 29444 - protein, 128 aa, A.fumigatus
MVAAAKLEREAVEKKNEQLRAQVKDTELLLASHQEQLAELKSVMQGMNIAKDDVEVRTTISTVPSSPDGHQQLPGIFPRSLETADPPEQSPHVEEIVPGPSTSFPHLFKSVCRTDIQAFEDFRELFSL

SEQ ID NO: 29445 - protein, 271 aa, A.fumigatus
HLNWVTAPLQFSEFVAALSSPPWQSMCPLPHANLSMVTIEVTNFMSSLIAFQTYHLRHSFLSPSNMIPRSSNHKRSLSSGPRSLSPDRTVTKTKSTNDLAATATEKPSLATRSNSAGDIPDSGFSTLRDPRLVNNSEASDTSSTPSHHPDLSSEVAALSVKLIQAINNQTTLDDNLVATRQELEQAQNRIKSLESENEKYRHDIEQAVLIKKADADREISQLKAALAEEKAQRAIVEKSKKTIEQELETLTAALFEEANKVCRYQFLTRHY

SEQ ID NO: 29446 - protein, 65 aa, A.fumigatus
AVPTLSFRMKLHALIPLLFAPLAASAALSGVLNGVVDTNSELSCYNTEIRTSNKARRCYSRQRSS

SEQ ID NO: 29447 - protein, 405 aa, A.fumigatus
HVNLQVRATKIVLESFEKEELPPDPFPLSTLSGAVRKPSISEFQQVRDFEHLAKCAEQIFVEEGRGLKDEIRNDQPDGATLWVRWRERFHSSIYRVLLAGAILSRAYQEPMYFAAEWGLPNFLEKYVEALASGGMSGEPVGGDELDYLVTFAPYNLGESGRIHGSFRALGEFFVQQGKTRAHQSNLHEQTTAILPPFAAPQALSRSEAAVVFVELGQLFFALEVLTGIQDRQPIIVNGDGSDEHGRTRIAPDLLYKPARTTPVVLFGTFFPEYISMPAKAADAVDSHLVATPLSRTSLTRSGVGFQHIYQFLYDLYRMAGRDNEFSSQNPARYPHHQFFEYMFREYLGLQFVDREFDCHYDEFMGDGFIFAERDDLLAASDFIETSDMTALAALFEPAASVTRKA

SEQ ID NO: 29448 - protein, 528 aa, A.fumigatus
IQQWMKCSGKDIQSSTVICEPPLLLAVERLSSLTLQHPNPGLVKRLVYPILLPLWGLACFSLEQQRPKLHEKVMAILQTYFGISVGIQPLKKLVDNLLWDGGATWTYGLDSNNLLVLEKRKSTGSERSNIVRLVDTLQSRAKLFVTLLGADPSSEERTGDIFLYVSQSWLVQPAQERSLGRLQLPLDNDDSTNIIQKLVSAKLAEVLLENFKDTLSRRPLRVLELIKQVIEGELNRVRVSQKIKPQDSKGVSLSLLANIVANENHGQEEAVTETDAAESLPAVFSLLSTVLASPDFSVTQETLPVLQELKLVLDDLIPHLPSSLAKPGTTSSMLLEIHITSPDEGGQAKSPVQISDFETHRRALTNLNSDLPPVQAEGFSLLSDLIKRSSPVLDIPSTLTLLLSVITDQSGSAADDEFIYLNAIKLIGTLASRHPRTVVKTLVDRYIDRAETVGLDQRLRIGESLLRTVQDLGEALTGETAKILGEGMITVAGRRARKAKTHKRRKEELEKEKRAREREERRNKEPAM

SEQ ID NO: 29449 - protein, 94 aa, A.fumigatus
HADGSYTTAPTSSSSLRPLLTIRPRSAFPLHRSPCTTTGVIPSPFPSRSYPRCPSLSSAGTTLRTVRSTISRNPTSFPFRFSDVSSTVNSRSCA

SEQ ID NO: 29450 - protein, 142 aa, A.fumigatus
SFMRGGFVRELFDRSIFTVQTLNPRSLVPTLACPTGQSDGNDLKLKSFILEYYEEAYPDHQPRLLPGDPYEKARAKVWMDFVTTWVIPALHCFLQYQPQSKDEDVATETDKVRQEFLARLKESTKEMHPGGPTFLGESDFNA

SEQ ID NO: 29451 - protein, 260 aa, A.fumigatus
MPFCRKFGSPGVYALLGQFSPGRPRWERAQDQPRTKDPRAFFSLGPDFLWKLGAGAGGPGAGRTGASSLGAAAGPSLHSTPCAGGPRRRASGRFGFPVPTFCGDTKQPNRWRDSWAEFYAQERLLTVLETSEKRNGKDVGLREMVERTVRSVVPALLRDGHLGYDREGKGEGITPVVVHGDLWSGNADLGRIVSSGRKEDEEVGAVVYDPSACYAHSEYELGIMKMFGGFGPAFFEAYHRIVPKTEPVEEYEDRVRLYEL

SEQ ID NO: 29452 - protein, 83 aa, A.fumigatus
VSRSPSQNQRMQRPNAVFLSQTLPQSLWLICKYQEPARNNQVTTMPSVPDAEIYPEASGPAKALVDRHQAEQPLKLHAGWFCS

SEQ ID NO: 29453 - protein, 61 aa, A.fumigatus
GKGYCEALPVMAARLLKPAADTKIFLCGPPGMINAAKKGLVSLGFEAPGAVGKMTDQIFCF

SEQ ID NO: 29454 - protein, 156 aa, A.fumigatus
LVPACVWASAGYNVHVRDPSPQQREDCLAYVRDNVAAYAESTGQKPGTVGTTESLEEAVDNAWLVIEAVPEKILLKIDAFAELDARAPSDCILASNSSSYKSSEMLEKVSEATKSRILNMHYYMPPQCMIVELMTDGHTSADIFPFMVDRSKEAAT

SEQ ID NO: 29455 - protein, 176 aa, A.fumigatus
  UNSURE (51): Identity of amino acid sequences at the above locations are unknown.
FLNFSGWGGHWRGANATSETVICDRSYTTRRWLVSMCSQGYTVAGSETNTXWASDLMHRLYHVPAVGQGWVDHFADGYDEVIALAKSNGTESTHDSEALQYFAPEAYAFDIAAPGVGCAGESHGPDQGHDTGSASAPASTSTSSSSSGSGSGATTTPTDSPSATIDVPSVRTVRIS

SEQ ID NO: 29456 - protein, 168 aa, A.fumigatus
GCSTSGYNARVTHHPTLKKENVLTNGCSLHALQLSSPWPRRLVATLPTSPVPIAARATPHEPVFFSWDAGAVTSFPIHSSCNATQRRQIEAGLNEAVELARHAKAHILRWGNESEIYRKYFGNRPTMEAVGAYDVIVNGDKANVLFRCDNPDGNCALEGKDPPSILPK

SEQ ID NO: 29457 - protein, 115 aa, A.fumigatus
  UNSURE (36),(73),(100): Identity of amino acid sequences at the above locations are unknown.
FWIRCNRSNDDIVSQAVVEVSDRKFFDLEHDRAVVXHGPLDGRMGISSKTATCQTCGGSLQVCNGHFGHVRLXFTCLPCRILQTCYQHSAGNLQGVFAHXAARSRATCFSSPRCV

SEQ ID NO: 29458 - protein, 224 aa, A.fumigatus
REFHSGPRPNFLERRRNCRSRGGGGFKEPIRSWVTMTFPRRSTLAKSIELCGANRGEQKSLEYFTPRQVILKYELHVAQLVDDFFGKLKGSTKGYASLDYEESAWQTGNIVKLQLLVNKAPVDAVARIVHSSQVERLGRQWVTKFKEHVDRQLFEVVIQAAVGKKIIARETVKPYRKDVLAKLHASDVSRRRKLLEKQKEGRKRLRAVGNVVIEHKAFQAFLAK

SEQ ID NO: 29459 - protein, 149 aa, A.fumigatus
  UNSURE (19): Identity of amino acid sequences at the above locations are unknown.
RAIISSWAAETDICISLFXQLISLAGLHSNATITTELSRAFKDEGMLAYVRLIQSREKELGVEVLTHQKWSGAPYMDGILGAIQSGSSSSKSMGEGNTEKGKLSIHFDLLAINANNPKLQASKQIPRHGRIIIMPSVLLDRCRDKKKSP

SEQ ID NO: 29460 - protein, 114 aa, A.fumigatus
PGGQDSQIVTKESVTHMRSNYVLQTADDPPAFIIVKTEGWLTGAKDVLDKVNDPNIADTINPNTYKYRLNLSMETGDERYAFLNTLMWVASGCRRGHEGRSRYSCSLRSHANNL

SEQ ID NO: 29461 - protein, 342 aa, A.fumigatus
FLFSCRRTISDRPRGCLILIKILLCKLRVVYLVTQPIFRFSYHIFIHSVHPSPICPRRGGRDESLDRPHSGTHTMPTYPIRRRPRECKTCLPCRASKVRCDRNVPCGNCVKRNFNCSYGRPPPKDPYPLPTPTATTATTSLPKTPHSSSLPAYTPTYHQTTNISGHDASFGTGTGTDSTPDQEPLSDTVVITQGEWDEINAKMRAMEQILGSLHTLFDTRARRKPDNQVTDISPEAEGSPPSEGIYEPDALRTGSVHIGSRSALVDILNRSKVAEGTAQALPKDDLLAELAMGNESAAYPFVDLWSSDPYTFNIAGVCGVLPHDDQCRRYGNWFRWSIVLPY

SEQ ID NO: 29462 - protein, 285 aa, A.fumigatus
PRFVAAVGHIDQALFLWIHFLPACPSHLRLSLSSYTTPLKMAEKDQDHPPSAPPPTSYMSDTTSDPALLDPFRAIAWSNSLLNSPDYYPIRTWSRLFKPHTGEDGYFAITLVTSSTIPHCLTLRRRNLLPPPQEPPVWPSPTATPSSAPSPIPPDIIMMVDLATPGVSGHPSTAHGGVVATLIDEAMSLAVAIHAPSSGDHPRGAIYTAQLDVRYKKPLRVPGLVVIRAKVVARVGRKYWVRAQAVQEESDENNGRGLGGPLEWAKKKTVVTDAMAFWIQTAPSL

SEQ ID NO: 29463 - protein, 153 aa, A.fumigatus
SRCSASRSGTSTWPVSPLPIPFLQRRLWCLPPSSPCPCCQTHPAPSGTCPPETPRPHSSTAPPCSHQAGTVPTGRQPAACPAQDPVRTVQPAATPGGTWETAQPAGPIAHHDRSPAMLQGSHDPEAPTRELPRVARSSSRAPIRPLQLSRGSP

SEQ ID NO: 29464 - protein, 77 aa, A.fumigatus
AHEQQRAFLCFWMVWYDSDPLVLFLVPPVLNNNYNNNNNNNNNKDNKNSYTYCVKCRSFLDFDDTESTTGVLLCSTL

SEQ ID NO: 29465 - protein, 136 aa, A.fumigatus
GQPNIVQYIDHHEHDRWIYIIMEYVPGGELSTYLSIHGKIPEDMVKTLARQLLHALQYLHKRRITHRDIKPDNILIASLEPLRVKLSDFGLSKVAQEETFLKTFCGTLLYCAPEVYPEYENYRRGEIRKRRRLGDP

SEQ ID NO: 29466 - protein, 300 aa, A.fumigatus
LILICSPPKTSPYDQSVDMWSFGAVLFHILSGTPPYTGRGDDRGSQMLRNIMTTEPDYDVLRREGVSEAGVDFVRRLLNRDPHSRPKESECFQHPWIRDVPDVDEYDDNDIQPADFGALSDIGEDLENELDASQISLNDNQEPVITGDESHDSNNLAQSKRPRIDHLPADIRYPSLPNIESLPAARPIPESTPRRLFGEITSSALHSSNVFGASMNAFGGDDLSVHDFVSSTGESIISDGNSLNSVLSLPDNPFAGSAPSLMGAENLVGQLNMNSWHPGTSAHSPPAAAELPALKTSLDE

SEQ ID NO: 29467 - protein, 151 aa, A.fumigatus
RRGNMYNVTGQIGKGAFATVYKLATKQHGAVYAAKELDKRRFMKNGILDQKVDNEMKIMKDLKHVSFGTPSSNTGLLELITTEDSPTSCNTLITMNMTDGFILSWNMCLAASFLLIFQFMAKFLKTWSKHWPGSSCMHCNIFTNAGLRIVT

SEQ ID NO: 29468 - protein, 118 aa, A.fumigatus
TIPPAACTANVDSPLLLLLLLLPLPLLLPLPLPLPLPLPLPLVHKSFLIHTPLAQIQISLITLPFGPCACLEYSCRLLNHFALAVTFCSAFLKMRQLLSGLLEPPRYVPVFFRGLGSS

SEQ ID NO: 29469 - protein, 209 aa, A.fumigatus
PQGDALWDIPSDWSGEETRPRRNARTEPRFLRRSQRARKSVQVEDTPTRTSRRLARVIEDRHERSSEEDDSEMEELDKIIDKQLGGARLIQSINENRSTDVSHGSIGEERGPQEGEDDRASEVPVESTSPSKKLGFQNFKTTDAHEDQEDDPEWAPDTAASEELGEEDDERGWDITRPDGVNTNHPDWKIDSGAAQPAEEHGDIPWWFQ

SEQ ID NO: 29470 - protein, 141 aa, A.fumigatus
ETTRVLETGTGTERQSYQRYLNLSKRSVNQKALMNQRQRQRQRQRQRQRQKQRKRKKKKKKKQGRVDIRRTRSRRNGLSPRDQARDAELMGISATLKSRFYAHGQHRRQCIHIDRLLMTMKATEARVNLRKVLLLPQASSL

SEQ ID NO: 29471 - protein, 420 aa, A.fumigatus
LRSCPTRGRTRGHTLVVPVAQTEVDAFSKKPNRRSLPVRNGLRDDTSTRDRHRDRTAELSEISESEQEECESESSYEPEAEAEAEAEAEAEAEAEEEEEEEEEEAGASRHSPYTQPEEWSITARPSKRRRTDGYQRNPQVEILRTRSTPPPVHSYRSTPDDNESHRSSRQPSQSSAVAASLITVISDDAQNEALVRSDRDYAGDKAWFAEACNLGQQRENWDIIVTAASELKENIDPSRAESFGTIDKQVSQLRTRYAKINKKLKSQQGPLRENLRECDDLREAISDEGTRILDSVYWLSLRQAESHEMLKQAHRLVKQFEARVFPTMIKVILLCFEGYYTNRKLFPSAYRHFAGAMKLLLRFCDRIASLRTERYIRCKIHSRTIRKPLRELIKAVEDNLLQRHLNETHGATRGEKEGMD

SEQ ID NO: 29472 - protein, 482 aa, A.fumigatus
LSFHGCGEDAWEGPQWLLRESNRDTRHAYIDAFLTWLSFETTQDEIKATSRPVKGTGTLPRRESPEVTKKDDKRPLNVSQREKVIIAAQLNFLRLFHLTIYDIALDCPTDESEILLLHLLLTNLVERLGVNAVRFGLPMVLKLQEDLASVQSLRSPTAKVNIGSLVHGYLWAVCEKFELEGYKVGNEIRIEIDRRKQNGLWLDRVRMPAIGIDDIIESREKSPRKDDSMAQSELITFKDGIEELVNRIEEVYNSSITSAASSPPASPEHSYALPVLGHGAATASSLKCNLPSSIKEQMLSPWSREACLAASEKEKAEAMSISGSRHGTLGLRNYATLNGAGNSSHSIATSAHQSAFGAAAGLQHLRRTSIPDSQGTPVNGSGRESPVRVNELRQVLSVNVEGNARRLSPLRGRLDASNGSIVSSSSESMVSGFSLSEYDADGNSIRPQSIRDGRLSANGDGMETPKASSIGVNGAQSRQSSS

SEQ ID NO: 29473 - protein, 599 aa, A.fumigatus
ANILQLHGRDKVSTLYKNMKGHKTVLEKNRIVLESLNGLTTCFMHVEPDGCSRLYQYSGRHEQEPSQRQNLVAINTYTDKLTLRSREEYDGKGALRNEFVYDYPEASKTKLPMQRQCLAGELEGQVVQYDQRGYITTGSAMRGVNPVQFQYWYRKNAKFDDELLRAEYVFPHIKIKVAWSMPPRTRPERLDKWIPYPRVTEAVFIQDGDVYNAQWTYDHKFHPIIATTLNGEHIPTPPMICDDWFHVLDKPTGCTLLHDNPLVSFSSTKTNIIARLMRLNVKQYPIPTSRARTHLWKSWKASKEFDAVTTRWLDEILLRSDRILRPYWRRRDWGRLESAADYLDAQVDTILARVDIDPEISSWTQLAFKISDLYSFGQGGDARINTRTLSTQLQDTDSELHVLAMDTGTWPNEPGGVSACRRDMVNDLKHIRWHILAEAANDFGVPRFQIERNVQSLTVLPQWGLDFLNPTHGVFQNCLDSAVVEKSYDTTVADIRRNFLPILSSIVRCSRTDQLTRSHIEEATRALVDLNTYFESSRSWNDVWMSDTVKQAWREMWLSEDTPGAVPVSQWLESEKPTLLQLDAALDGFQRGARSRSIG

SEQ ID NO: 29474 - protein, 912 aa, A.fumigatus
RRKTDQGSIHTNDEGTETNPEVPPGDEKQSSQPEVGEERSPSPSRASSTFGDSSLGHRYSSISSVSTATGLGSPVPLSSIQKLEPEQVATPPSPRRISPERSRSTSPTKGLGGFVQSAMMKRSDSVSKRWSAQLPSGVSRGVNSFASNRNSIAGLASGDAHAPASPSRLGREDPFIASKRPSSSHSEATIVHNAKESERPATPPVVNKVETDEATARPTLHIRALSTLSGNGHDSDSNSLPSTSPVVSRTMDPRRWSPTKSTWLESALNRPDSPKHKRQHSQQTSWAKDRQSRASVDLGRVNSFKEVTTVGLMRSAAPGSHYKTPSVSGIPDLPSNLDINKSKESRDQPLSYSVDSEPSPAETLKVEPTPDHETTQKVDNTRESVDMKPEASPTKKEGGPEGKSEDAPTRKHAPSLLVPVKKSETRAPLSSPRDLLWNRPKPQSPVIDFGANLRKREITKDEAPKQEPEFKNVFGKLKKTESSTYVAPDELRNNILKGKAALNATGGPKKTSKVDDLKESILRQKEAMKATGGLLRRNTAGEIDAPAKMIPEAIAKRNNLSKSSSSSRSTHSGGALASPSSEDNSVPNDLRNDQKSPSFPRKDEQAQEAQSSQTAAEVSTPNEGKEQLADLASSEAGNGEIKKGDVENQLITDSAVTAENTSEIRDKQIEEAIKPVRALPSGTVAEAAEAPAATEGLPTKGQLAGRINPALADLLSRGPLIIGGNSNKHFSTDSIREGSSKFSDTQATAPLAHMTKNRAKGPKRRPPKLAVTELTTPLANDDATIPENDNSSSDFHETGLAPSSSQDIAKTSVGWPLPDAETTGPIVFEPTLPPLTYTASEKPVEFKRTIPHLMERRLEQKLAHRDSKSSLDMNPSPSPMDDLEDIENLGDSPSRRPTLPPKVFKGAGRSHS

SEQ ID NO: 29475 - protein, 87 aa, A.fumigatus
FWSLPQGHTEYDVAMDMNYITLVEHMLPVEAHARLRLSQVLGNLMYKDMGHAIEPKPRNIRYCPTNHWKKAFATELTPRFATTNSRL

SEQ ID NO: 29476 - protein, 133 aa, A.fumigatus
HQIPGFDTIVSCLGRNMIAAQINLIRIAETCPNVIRFFPSEYGTDIEYGPQSAHEKPHQFKLQVRKFIREEVKRLEHTYLVTGPYADLYLENASKCPRAGTFDVANKKAVLLGDGNGRISLTTMSEYVAWTCP

SEQ ID NO: 29477 - protein, 61 aa, A.fumigatus
PLLLYFPNAGRQPEDNAFPLDFPGRTAEQYPTSDARWAATYTVECVSVPEYSCSSHAADDV

SEQ ID NO: 29478 - protein, 249 aa, A.fumigatus
LARGGECLSGGDDSAIRTRLRDLVWSVSHVPNRAWNGSYRFRNVSALYWHCHGDHGGCYDIPTIDDNYSFRQAFPVLCRILTELKLLGTNVGVIVLSAGVGNDVVGWVLLALCVALVNAGSGITALWVLLVAAGYIVFLALVFRPLFMRFLNKTGSLQKGPSQSVVTITILIALASAFFTQIIGIHAIFGGFIIGLLCPHEGGFAIKLTEKIEDLVAVLFLPLYFNLSAYSTNLVLLVFATGLAGLALR

SEQ ID NO: 29479 - protein, 167 aa, A.fumigatus
LDQASIIIILCRLIHWPLSKLRQPRVIAEVIAGIVLGPSVMGRIPGFTEAIFPAASIPNLTLVANLGLVLFLFLVGLETDLRFLISNWRVAASVSAAGMILPFGLGSAISYGLYHTFRTEPGMAHIDFGTYLLFIGIAMAITVGVMTSQRLMTTTHSGRLSRSCAVS

SEQ ID NO: 29480 - protein, 102 aa, A.fumigatus
LVFSHILRLSLLQLFFRATTIMAEALTNTDLQGALPLIARGKVRDLYEVDDKTLLFIATDRISAYDVIMENVRLYVLDAPIVLHIGSANECLFRVFRTRVFF

SEQ ID NO: 29481 - protein, 150 aa, A.fumigatus
RMSLQGIPNKGVLLTLCTKAWFKILTDAIPSLRTHFITLDLPPQIPPSLRPALQNRSMQVRKLKILPIEAIVRGYITGSAWNEYKKSGTVHGIKVAPGLRESEAFPDGPIYTPSTKAEQGEHDENIHPDQGMHGPPCSGNVYQVSEWIQS

SEQ ID NO: 29482 - protein, 191 aa, A.fumigatus
KRSKKQKRSKMSRYLTPSKIALLCLISVYTDGVVPNSSAIDVLSFLMSCLSPLGSDASSSLNRGDSNYIVAIDDLEDALSSKASSIPGRSIWDLFLKKIWSIDSCDALEVFFTEISDILVKSREEQIRDRDNGLAPETGRMRLSRCSPLGAFVRRAQLEFTRLQFHDSVKLWKGFVFTTGGRRIRAKRIPQ

SEQ ID NO: 29483 - protein, 72 aa, A.fumigatus
RCPFLEPSLATSTDSYSSDTVGTLRLFRNSIISLDSGIGHKSNVSTLDVTIFNILINRQDKPIEEFVTHSCS

SEQ ID NO: 29484 - protein, 117 aa, A.fumigatus
SEFLTMMARKMKDTDSEEEIREAFKVFDRDNNGFISAAELRHVMTSIGEKLTDDEVDEMIREADQDGDGRIDCTFIKQLSSVAPRSSWDISLIVSRQRVRSAHDAKISLSFGCFVHS

SEQ ID NO: 29485 - protein, 63 aa, A.fumigatus
LVGCQYIYPLFPSDLSCYYGVSNKYGIWTAIDSYDPSACICWFSCGDSDMIALVFTPYVERSS

SEQ ID NO: 29486 - protein, 84 aa, A.fumigatus
PCSVITLPPTDMKFQTSILAATLLAGSALSAPNGRSLERIRARALARQSHPMDGPGASPAEADPNAEHRTADCLHRGAARADSH

SEQ ID NO: 29487 - protein, 558 aa, A.fumigatus
SFGLSKLGIKAFFQLVQIPVSSLDHLLSSLQDTFTKNSEIVYERAMRGEPASELVSENKSIHEKMDAIRLMKQEKEEYQAFEAKQESLKKALIQLISRGCDPQTMPDELAQSREVTSKLQQIEEKMSRLLRTAGIDTETLNSMSRDAKKSSSQPAACDSRPCTTGSLRNGDMECLERAREVPHSHIMSPVRNSFDRNLSRTSVVERTSDTSFRTPGGGDNARDEFDLDDPMIYEEREAFTGTMGTPSRPLGNVDEFDLDADDVDMLEAAEDFDDGLTLTTKTSGYESRRVFAETSGNASRIPATQKSQIHNPLWNQNPWTKDVKNVLRDRFHLRGFRMNQLEAIDATLSGKDTFVLMPTGGGKSLCYQLPSIVTSGSTRGVTIVVSPLLSLMQDQVSHLKRLKIKAFLLNGETKQEERQWIMQTLSGPAAEEQIELLYITPEMVNKSQALIRSLEKLNRRRRLARIVIDEAHCVSQWGHDFRPDYKALGEVRDQLPGVPMMALTATATENVKVDVIHNLKMEGCEIFTQSFNRPNLTYEVRQKTKSAEVLENIADIIK

SEQ ID NO: 29488 - protein, 137 aa, A.fumigatus
RVLKSNILLCIMPPSGSQDNTPSCFTDTHGVITTTANDLPGYKITKVLGTVYGLTVRTCNWGTDLGAIVRSSVGGELRPFTNLMYTSRNEAVERLVGECMGRGGNALIAMRFDVSSIGACSQVCAYGTACVVERYEG

SEQ ID NO: 29489 - protein, 62 aa, A.fumigatus
PLISTYTFGNNHLARVYEGRMVDALRNFSTSKASASPNPSGNEQQYDNVCSIAIWGVYNILL

SEQ ID NO: 29490 - protein, 113 aa, A.fumigatus
GFRFYMSRLLASLHSRHFHTEHNFQVQDTMTDKMNVNMFKAEDPLCQPSSSPEPPYDPLPPVEELPLPSSFEWGTATAAYQIEGAPSVDGKCRQSGTRSPILFHPGTMARNVT

SEQ ID NO: 29491 - protein, 232 aa, A.fumigatus
KTVFAKRWLSIMTRITNVQFEHYHPPNTIGVEETRPRISWQFRDYPPSFQQDAFEIEVSEVAWNSQVTVLSSTRQSSPSSYLVPWPHSQPLISRQQVSIRVRAWDPDGHDTEWSEPASLEVGLLNPSDWQCERIAAPWGPGTSKPDTEQLYRREFKLADSFVKARLYITAQGVYEAEINGRRVGDHFLAPGWTTYDGRLQYQTYDITDYLSTGDNCIGVRVAEGWFFWSHWF

SEQ ID NO: 29492 - protein, 88 aa, A.fumigatus
  UNSURE (58),(74): Identity of amino acid sequences at the above locations are unknown.
SNRLPHRYEARGEILLFLFATQPAVPEYSLEHAREFFSVPTDCPQRDDRLGWVGDLAXFAPNALLIYDCFSFLXNWLIDVAYDHNGLG

SEQ ID NO: 29493 - protein, 103 aa, A.fumigatus
GHMFQASGNTYSHKILMSAHSRLMYTNIYKYFEIAKVVFISITAKRPTPFDSRLGIYEVHHYPRLFADNRQQIHLHESRLAEHVKPLIDISVTLNRLVEPELL

SEQ ID NO: 29494 - protein, 65 aa, A.fumigatus
RSPRRTDVRPLGAWGGGGSSSDIMAYVGKMALMVGLQAALNASVWGVISGAAIRIGKRFCGWGNL

SEQ ID NO: 29495 - protein, 398 aa, A.fumigatus
HKLIRLVFLIGFVGMNNIKANDYLNVVVQVLAHVLPIRNYFLLHQFPVPGTPELALRFSTLVRKLWNPKAFRSHVSPHELLQEIALRSSKRFTLTQQSDPVEFLSWFLNNLHLSLGGSKKPSSTPTSVIQAAFQGHLRIESQAITAHSDTQNARLVFTESGTINSQTIPFLILTLDLPPTPLFQSANRESIIPHVPLTTLLNKYNGITASEKLAHRVRHRLLHPLPPYLLFHIKRFSKNRFVSERNPTIVTFPSPRSLDMSPYVEPNPEIWPPGEPILYDLVANIILDPTVAAPGTTEDAAEKGLTAAGGTSSAGAGAGSERVAWLVQLHDKAMAEENRRHQSQGAGEQQGPEWLEIQDLFVKKAESETLFTREGYLMVWERRKIPGMNNRKGKGAAK

SEQ ID NO: 29496 - protein, 101 aa, A.fumigatus
SYAANIPRARVPRSYAYFHALEVGHHVFINISTKKVYVLPEGYEVKSKSLEDIKYVVDPHYSKEEVSKLDKEVHDAFDLAGNRYRPGKYFLSFLSEISSTN

SEQ ID NO: 29497 - protein, 80 aa, A.fumigatus
QLKWVQFINITRPEIQSDVCPTCSLSTAEQTGSSVFHTLWSYVPEFTVLWVIVNLPSAPYVLLGCYTTDISHLSPKFATI

SEQ ID NO: 29498 - protein, 65 aa, A.fumigatus
TNLDAQLVKRAERVSRLGLTGGIVQMPEGCAPTEQIMGSGMTVYYLVDSLDMVSSLSNTSRLIPL

SEQ ID NO: 29499 - protein, 251 aa, A.fumigatus
SFQPRGEDILAKDYYTNAFGDQNLTKRLGLPVIPLSCLFFRVSVQTYQMFLAALLPHQPSSTAVESTSLASIHSHYVPSPIPSAPPLTLRTILPVSAAHASAFFRRVLANAMPSPAQSVYIFTIVLILTAFILLLILKLLLGMLLLVYSRSRYRRMKVREAEQAAHKTDSGSATGPASRGREFAIEGSRRVGGWGSVEVNDDKRRWIYTDDPEGLRRLKAREERDKEKAAKEGEASMDHVQRYEMVAKRIW

SEQ ID NO: 29500 - protein, 61 aa, A.fumigatus
PHLATAIGASWLFFRSLYLYGYVYSGKPQGKGRLLGGFFWFSQGALWALSVFGVAKDMISY

SEQ ID NO: 29501 - protein, 232 aa, A.fumigatus
STFDDTGLGPYIAVIKTHIDILTDFSVDTINGLNVLAQKHNFLIFEDRKFIDIGNTVQKQYHGGALRISEWAHIINCSVLPGEGIVEALAQTASAQDFPYGPERGLLVLAEMTSKGSLATGEYTKASVDYARKYKNFVMGFVSTRALTEVQSDVSSASEDEDFVVFTTGVNLSSKGDKLGQQYQTPASAIGRGADFIIAGRGIYAAPDPVEAAQRYQKEGWEAYMARVCGKS

SEQ ID NO: 29502 - protein, 69 aa, A.fumigatus
PSIPTMSSKSQLTYGARASKHPNPLAKRLFEIAEAKKTNVTVSADVTTTRELLDLADRTEAVGSNTYAV

SEQ ID NO: 29503 - protein, 369 aa, A.fumigatus
ICTELLYQPLTLLNCLHTFCGSCLKEWFAAQASRRRPSSSIPQFTCPACRAVVRDTRPNATVTTLLDMVLAANPERVKSAEEKEEVAQRYKHGESVFPVLSSSGQDGTASDVEDRRLLEEVRELSLRESRAGTGQSSRSRQAESVDADGRRADGRSRRRREEERVLRRQPGARTEDNSERTRRIEHQSSLRSLLSFSDTETMEEEILRQIIEDGLLNGIDLDNLGPAQEEELTERIADAYRRRHMRRPRSRQRQEADEEPQASPRPRARSQSVQRPPASPTPQPSSRNPPVSRPYLLEPLVSRSEGFNHQRRLSDQGTRRRRTSPAPVNAASTSEGRLATCCEIVQRYSFGSPSSFSVLSSSRGRIVDC

SEQ ID NO: 29504 - protein, 78 aa, A.fumigatus
EGAEEMLEHHPGHVSVDTASTAGSSGVDASTGYHVGSDGPWSDTNPTAELVRDYVEDDTTEWKGMYRWFWEKQKHEQE

SEQ ID NO: 29505 - protein, 237 aa, A.fumigatus
PDVLDNFSKPTPQPSTSAPPPATAPASATEDFDEDAFMRQLEQDMAKMMNHAAQESGAPDHKEFENAINQGADAFTKQLEESGIPPGDFLKQLLADVMAEEGESAGAAAGAGARVGPSAGGSSGSATGAEKATAPESFNDAIQRTINRMKESGDKATAAATEDGGISEDMLMQLLKGLEAGVGNGGDNLDLTQMIAGVMEQFSNKEMLYEPMKELDAKWGPWLKENKGKVPAEDMVF

SEQ ID NO: 29506 - protein, 149 aa, A.fumigatus
PSLSAAQTRRSICLVVPVFDTSILNARLYILWSVFRFGLPLVLPSTYMRSPSDIKPNHIMFGIADDSFSATGRAGAHSSCPRKELDRRIIYVSRELRMPRVWSAPVLCDFGSGVSSGIEHSEDIQPNIYRTPEVIVEVPWTYSVDVWDV

SEQ ID NO: 29507 - protein, 563 aa, A.fumigatus
WRGSFQPRGEDMNDDLKMKDYQIVGINWLSLLFEKQLSCILADDMGLGKTCQVIAFLAHLYEKGIKGPHLVVVPSSTIENWLREFQKFCPTLSVMPYYAGQAERAVIRQTIEDNRDDINVIITTYTVAKAKVDAHFLRNMDFCVCVYDEGHMLKSSTSVLYEKLIRIPARFRLLLTGTPLQNNLQELASLLGFILPKVFQERKEDLQYIFANKAKTVDESHSTLLSAQRIERAKSMLKPFVLRRKKHQVIDLPRKTSHVEYCELNSAQREIYEHEKEEVRQLLADRAAGKKTGNRSANILMKLRQAAIHPLLYRRHYTDTILSRMAKACLKEEQWSQSNPDIIFEELQAYNDFECHQLCLNHPHSLGKFALKNEEWMNSGKVDKLCELLKRFQENGDRTLVFSQFTLVMDILEHVLETLHLGFVRLDGRTNVEDRQSILDAFHERTDIPVFLLSTKAGGAGINLACANKVVIFDSSFNPQEDVQAENRAHRVGQTREVEVIRLVTKDTIEEQIYALGQTKLALDQAVAGDETESKKGEEAGMKVVEDMLLAKQEEVKTDSTNA

SEQ ID NO: 29508 - protein, 94 aa, A.fumigatus
VTSSITKLSTVQSIYLFMNAISSAIQQGLTALSTDPLLIWNYGFVAVLAFVAGNLFYLTHYSLDKEEDRLNNLEASAYLGTNPGARDEKIDPEP

SEQ ID NO: 29509 - protein, 208 aa, A.fumigatus
AYAVHHHYTRPCIKHGKFCKSRRHIPTQDAKKKKTKQDRKSTRLKERQGPHASRSSTKQKSTRDKFTSSPSPPSPPSPRAFPSAPAQPAHSHRLDAHEASHTAADASASTAPPQQQPYLSTDRHSEDHAPQQGSESESAPPPSRPQPSSPSSPHLATPYPSSDPRSQTPPTQPAQRGLGPAHTHAPARSSANRSGTGCGSPWQTSQSC

SEQ ID NO: 29510 - protein, 263 aa, A.fumigatus
TITNLNFIREVLKGGTVGGIVGLIGGFAGVVAASKRYATIRNLTLPMKSFLVTSSGTFFGIIAADHASRSFEASRNAERQWYESREERLRQEELAGMSFIDRTMAFARREKYKIVGATWVASMIGSFAMVSRNPYLTGSQKIVQARVYAQGLTLAVLVASAAFEISDQRKGKGLLDAAKKGKKAAGEKEAAPTQTPTPAAAHDPQSGDLWKDMVAAEEERLKQKHQPLYEKPHEHQDDASAQAAPAPTEKHEEKEEKEEKEKK

SEQ ID NO: 29511 - protein, 99 aa, A.fumigatus
  UNSURE (43): Identity of amino acid sequences at the above locations are unknown.
GQIPFPGTLWPPYSRYGNALKAHRFGILGMFIFPSAKCPRTNXILINPCTRLRGRAPCAKRNSYPSSMKCATPNQPATIPVIKSQISIGIQMPETRVAT

SEQ ID NO: 29512 - protein, 134 aa, A.fumigatus
AEEPGWMRDPLFRHLYRIRTLEGAAESDERSVNYALLLAGADNFEEASGIVYEAMVSKLVKALNISQGDVDPSKPLHALGVDSLVAVELRTWMLKQLDADVAVFDLMEVASLRALASLIATRSGYVKKDNGKEK

SEQ ID NO: 29513 - protein, 71 aa, A.fumigatus
VSDTPSAAERWMGEDQEHFEASTDSLSSIWLDERIPLGPISSSMQQYVCDIDLNNLVNRCISMQPVASCLP

SEQ ID NO: 29514 - protein, 370 aa, A.fumigatus
VGSSLELSQRLDEPIYNMPTQSNPTQDSTIPETMHIFDIRRSNSVTELWKRFEFNPAGRETEDAKKAVESTSDNSTPPSPDGRVSNAGLASNEGSEPLLAAFETEMAKILSASEPRNTDNAEEIPSSTEVPNEPPSSGRRTNPALALAQAMHHLINGAEMIGSEVRSRLPELEHQLEHHLQNAQRVLPENVGSTVQAALASLDAQMRNLTNALNNASSARDRRTSNMFRGDVRTPADAVDSLYNMASELGQMGHTLYSAFETEFGSRIGARDASQPSDESLQKSTPGDEAAVNGDPSAAASVLSTKTEETAKIPLTAEESDTTSRGQGSKNREEPRSSSNRTEEPGRAQRVPSQQDEPSELPSSHTAAGR

SEQ ID NO: 29515 - protein, 284 aa, A.fumigatus
PYRIARMLPPPVREELPTPEINLFAAGHDTGVMVFKLERERPASAVYQNQLFYITKEKHVKSYDFAKNLESPPMLSLRKLGSPWVPPRTLSYNPAERAILVTSPTDGGAYELIHLPRDATGAVEPTDVKRGQASSAVFVARNRFAVFSQANQQVDIKDLSNSTTKTIKPPSGTTDIYFGGTGALLFITPTSVVLFDIQQKKQLAELAVSGVKYVVWSNDGLYAALLSKHNVTIVTKSLEQVSSLHETIRIKSAAWDDAGRPSLLDLESRQILSSKWVCIDFPFH

SEQ ID NO: 29516 - protein, 193 aa, A.fumigatus
LYSTNSQADPLAYLTAKSHGLTEEAESILEACGLTEDQITLPTTEEPLRVPQPIVPTFKSNWPVKAAAHSSFEKALLGEVGVEDEDAAALGLEPEEEGEEAVLARETLEDEEEDVAGWDMGEEINMEDDVDFLNVDSADAGACSSDADLWAPNSPLAADHVAAGSFRYRHAPTQSVSWCGQLPSSQDSLPRYY

SEQ ID NO: 29517 - protein, 204 aa, A.fumigatus
KPFSDNGIIRTLDHTVYLVKVKGKSVYCLDRNAKPRVLEIDPTEYRFKLALVKRNYDEMLQIIKTSSLVGQSIISYLQKKGYPEIALQFVQDLQTRFELALECGNLEVAIEMARELDVRKLWSRLGMEALAHGNHQTVEMTYQKQRNFDKLSFLYLSIGDSEKLARMAKIAEHRGDFTSRFQNAIYRGDVDDRIQMFKEVDLCK

SEQ ID NO: 29518 - protein, 211 aa, A.fumigatus
PKTRSRSPQPRSLCGCLSPLSLLSSRIGPLRLQPIRRLRRHCLEKLVWKMRMLPPLASSPRRKARRPFWPVRLLRMKRKMLPAGTWVKRSTWRMMSTSLTLTAQTLAHAAPMPTFGLPTLPWRLIMSLLGLFDTAMLLLNPSVGAVNFPPLKIPFPDIINASTTYLPLIAGPLLGLTICVPPVERKLTPANSWPYFPSVFLITLAFVPPSG

SEQ ID NO: 29519 - protein, 124 aa, A.fumigatus
HSTCRRGFAYILQTCTKEGMAKIAGPKVDFNDLIGAASALNQLSTLITGSSNESVKDPQGRRYVHPLVLLHVARARQRPRSSTDQGHSPVGHDFGFQISFEGGIKCQIMNSAEATNLKTRKSQY

SEQ ID NO: 29520 - protein, 494 aa, A.fumigatus
VFAFSPVAQCIDGDCSDGDGDVDDDAKWWDSLTLGLDDLCVRFIINLPREELESVERICFQVEEAQWFYEDFIRPLDPALPSLSLKAFALRIFQHCPLMSQWSHYHHITAFSEFLAYKTRVPVRGAILLNQDMDEVVLVKGWKKGANWSFPRGKINKDEKDLDCAIREVYEETGYDVREAGLVKDEKDVKYIEITMREQHMRLYVFRGVPHDAHFEPRTRKEISKIEWYKLSDLPTLMKKSKPNDENMAVANANKFYMVAPFMHPLKKWIAQQRRLDAKAQSGGVKQQSQLEGETSMDEASQPAIHQTPARHAAPSDLPEVTSAEDASSHLKRLLNIHSASTQTPFPPPQTSAPDASKSNALLELLRSGSSHKPTHEAPTNDQELPPNVLHEAMPPPHQPQTLSAPDFFPGFPQQVAYSGQHDNLLHISGQPNHGAALSHLPTPVHSLGVGGPHAGYHGVSQFSNRHPSELHAAAQTQRPAPAPAPYQRTGDVF

SEQ ID NO: 29521 - protein, 451 aa, A.fumigatus
  UNSURE (440): Identity of amino acid sequences at the above locations are unknown.
SRALSDKHRAETLYQLDSQLRVIDPRQDDLLDTVMASAPSHSSQKRPLPAEPNPVLHASQTQWLFTDEELTRTPSQLDGMKMEAEHTSRSKGVNFITQVGIMLKLPQLTLATAAVYLHRFFMRYSMVDIPQRPGMHPYPIAATALFLATKVEENVRRMRELVVACCRVAQKQPNLVVDEQSKEFWKWRDTILHHEDLLLEALCFDLQLEQPYRILYDFICFFGVNDNKPLRNAAWAFVNDSMFTVLCLQFTARTIAAAALYAAARHCDVGFPDDDRGRAWWEQIDVDLTQVRRACMRMAQLYENNAMQKHSQYYPTTPILSDEGTEKTRIPHDGSPANLPPAESDVTHGRKRSKEPEDSGEPRGDGSAPSNGERSPKRPRRDADAAPRGSWQDQQSPSAPSSQSLPNAGSPSSSSQGRPHLNGQAPPSLPHPPVQPGHRXLPKGRQGHAFK

SEQ ID NO: 29522 - protein, 140 aa, A.fumigatus
PAISLTNQCSLPAMRRSSSSSHSWQSALQKVFRRRSSESKGKQPALDDDFKIGEHKDGFYKYSQEVLEKKNRKFEPPTMRALDSAEVYDMRAYSTVSSTVRVSRVRGSDSTETSYASAVSGRNILSWQFAKPERREKKLT

SEQ ID NO: 29523 - protein, 75 aa, A.fumigatus
SFSTRPSQFKNSGCAPRQVLNFKTLSLGFLSTSIANCHGVMPDRSNIRVSRPVTPMSLGFPMPASKFQAVLPGAG

SEQ ID NO: 29524 - protein, 647 aa, A.fumigatus
RRCNDPLRVTPLPKPPALNGLASPEHTFGQQPSGSWQETFYNARNSTVGRVVRKVFSYAWSTVTRLFKPSGVSSRRTAAAVSTSPTRANLRNFPEQQRQQLKSHQWRKERGYPTVEHYPFPELSLDIPLYPAGAASQAESTAEVRGRSVSKKPSGTPRQPRKRIGTSGPRTVSLKERGKHGMEKRARVDSLSPRLKRRLLAGTRLSRWRNARRERALAHALETTEHDAVRPVQTSAQALSISPIESRRSTLIQPRATIEPKSKPKRVRFQEPLTETPTLTAPTLLTELAPHLTPPSPKIDRVAHRTEQIVEEKENVPPAPEAAKTVEHAAHDDELRTRHDDWLRTEFPFGRPVSAVRLFYPVQKPLPPGRTESIYAAEWRKIEEEQKAKQKPVRVKPEGPAVRPLPPKWEAKVSEIKSMPNNRQIATTLSGDPLTKRDLATCYTPMAWLNDKIINSYLALIVDYLRRSHGNAGRHDKPRFHAFNTFFFSNLRDKGYQSVRRWATRAKIGGEALLNVDTVFIPVHNSAHWTLIVVKPGERTIEHFDSLGSLSRRHVGLVQGWLRAELASRYVEEEWTVLPSISPQQDNGSDCGVFLLSTAKAVAIGLEPLSYGAKDIGVLRRKIVAELMNGGLEGDFDPTSGGGEPLL

SEQ ID NO: 29525 - protein, 90 aa, A.fumigatus
SNIASSLQLGQGSIWCRYASGSSYNQLHVEARAKMPFFTHLSCNQGRVAHWTFGVESSDVPYYATSRCIYIEEVPARTSLSHCLYHHSSF

SEQ ID NO: 29526 - protein, 81 aa, A.fumigatus
  UNSURE (52),(53),(60),(63),(78): Identity of amino acid sequences at the above locations are unknown.
NLAFGQTIVSPPTATLDGTRGLDGLYVVVSRCPLIRMRPAWFGALRIWCLTXXDSAWGLXGHXGFLISPKPRALLINXMTT

SEQ ID NO: 29527 - protein, 178 aa, A.fumigatus
RSSRQNFSLALPLPSLLILSRKCSSKDTMPPFAFKGLALIALGTAVAQAQLWNQIIQTNYGPVQGFKYFNESTLERFFGVSESNVTAFLGIPFAADTGYQNRWKPPQPREPWNETLKATRFGPRCPTGESSYISEDCLSLNLWTNAGSADAKLPVMVWNQGSDETSDQSWWYGGGMAL

SEQ ID NO: 29528 - protein, 102 aa, A.fumigatus
DVILITFNRRDDVFGYLAHPDLNAEGLAVTGHNTSGNYGVLDQLEVLKWVKKNIADFGGDPDRVVVAGQSFGSSPGVSCCEQSTVQRLLPWWNLSVRHPIPI

SEQ ID NO: 29529 - protein, 65 aa, A.fumigatus
LIQRHRPLSSFFIKSTGATTGLDNSLIYPFLSILLRYLYRASSSSYNIANRGLYSSNFPLSSYIL

SEQ ID NO: 29530 - protein, 60 aa, A.fumigatus
RHELFEESLEQFVVSTVSLAIIEPTRGFHIVFETLSYLSIDSSAILEALPDGQNGKYLYT

SEQ ID NO: 29531 - protein, 151 aa, A.fumigatus
  UNSURE (10): Identity of amino acid sequences at the above locations are unknown.
TLTKRFAMFXNQVEASVGHYRRQSQPVQGMNGISRTHSNASSNTISGVTGRSRADSAVSQDDPFPDNRGSMALDSLANELEALRSHWESTNRNYRLSTQSDFDRTPTKETHGLSDSLAEWRRKLDEEEARAGSPEKNKPRAAGEQAAANMI

SEQ ID NO: 29532 - protein, 346 aa, A.fumigatus
PPPPGEPKEWLKTHVKSGDPTERLSAGIGRASSLNSETSIRQMPDQRVVALEAQVDRVNKLAKGNQAAADEAADKMRRAEERIAGLEAYQEQASREGLQLRRQLQAIMKESQAHAAENRELKSKMENQQREAGALAIQHAALKDLLAERGVSYTDSRRSPRLESPGSRFGTPEQTRLRELEQQLSASLKAHEELKASFETREQEADRAYREKLEQLENDYQSAVHYVKGTEKMLKRMKDELTRYKAQNAKIQADLEAAQRSISQASGLGSEPPAEWESERSKLQQSISDLQQDTASSIANLESQIANLKEDLSAAEAEKDKSRSEYESVKQKFIAAAEKIRANWSS

SEQ ID NO: 29533 - protein, 101 aa, A.fumigatus
SRMISNVDGQLSSMTAIWLLPIASCVVASGTGAVVADLLFNPNHALWTIIVSYVLWGVGICLSMIVYVIYFQRLTVHKLPHKGVIMSVFLPMGPLGSGTFA

SEQ ID NO: 29534 - protein, 110 aa, A.fumigatus
FTPNPSGFRALKLGTAGKTVLSKTQMLNDSSAASIVYVVGAMTALILWAFGLPWLFFAFASVLKSGRFPFNMGWWAFTFPVGAYAMGTCQLGRQLASAFFKVLGTSSLHE

SEQ ID NO: 29535 - protein, 68 aa, A.fumigatus
GHGFKMGIMASLDPWSEYSFGILDNCLFFSGLAGVSCHCSFGPKRRLPSPISPYRIRILKKNLIYRSI

SEQ ID NO: 29536 - protein, 74 aa, A.fumigatus
LCSPIFWLCNGQANNNLVSQASSLKTYGMPHDMSMSSIELVIRALSNVYSGPLQPSDHFDCRPSIVCCFTSFHV

SEQ ID NO: 29537 - protein, 65 aa, A.fumigatus
  UNSURE (51): Identity of amino acid sequences at the above locations are unknown.
SQPFENVIKQICAPRRLDQDFGVAIMLCTEWSILSRIISTLFEEDEILFNXNNPISMDIHSLINL

SEQ ID NO: 29538 - protein, 76 aa, A.fumigatus
IVHQTRRRFSYLDPAFLRHVGRNSTLLTLTEEGRDKLGGVEYRAVCLLTIIVPVYYVAWPPSVSASWRRVILSVIR

SEQ ID NO: 29539 - protein, 295 aa, A.fumigatus
HDQNWLNKPDGDEGWASYSLSQGYECYLLDHTSRGRSPWDSRNGQLRKYSAEHLQKYFTDTAKYNLWPQASLHTQWPGTGVMGDPIFDSYYASTVPSLAENAAQEASMQPAGAALLDAIGKPVILIAHSQGGAMARVTADRKPDLVHSIVSIEPSGPPFQNAIFGSGPARPYGLTDIPITYSPPATDPDADFVKQTITSNSSAISDCVIQADDPPPRQLANLSKIRTLVVTAEASYHATHDWCTARFLKQAGVPTKHLQLREVGIHGNGHMMFLEKNSDQVVRAIHNWIEDSTFS

SEQ ID NO: 29540 - protein, 200 aa, A.fumigatus
EIPYAVLKSDFCRYLVLFGRGGVYSDLDVHLVQPLPWTVMGSEDRHHRPPNVIIGLEGDATTKGLPRSPQFVQWTMASTALHPMFRDLLTRIAERTPNFVKQAQALEGDAEVNVMDWTGPSVWTDTILDYLGCSEEQIQNLRDLKDPVRIRDMMILPKRSFAVTQGEDHTLPDVLVKHYFSGTWKGCKNHWHGWSLPWLC

SEQ ID NO: 29541 - protein, 71 aa, A.fumigatus
IHLFLNHFLATTYNMLIVHHLQRFQSERIVWLCEELGIPYELRTYQRDAKTLLAPPELQQLYGSPGISRSK

SEQ ID NO: 29542 - protein, 165 aa, A.fumigatus
LNPSFPQPFLSDYIQYAHCTSSATISIRAHCLAVRGTGHPLRAQNLPARCKNPFSTARIAAVVRVSRNQPIEVKRLIRVRHPTQAAPVIQDGTTTLAESGAIVEYILTKYGKGKLTVPPTADNYADYLYFLHFANGYFQPALVGYSTVPPIGDLPVFTPRLEGTR

SEQ ID NO: 29543 - protein, 535 aa, A.fumigatus
KVAFSLTSSWNNSLLNGAYHARFEDHRGGESYRPPAPRGYSRHASPTRTRSPRLVADTWVPSPSRHYGRLRSRSPLPFRRHSRSPPYRHRDSEPGLFTNSAPRRFSPRRDARLRSPQIGWRPRSPYGDRPRDTSRGRSTPRRRDQSPLRQDFTYSNRERYPSTVDRYKKSVSPLRRVPGRASDITPLTTSHRRRSSSQEFRERRPDNNTSQARPSPSLRAASTIHNSTSSSRTDSRRSSPLLNDRTSATVHESRSRSPMTRDFPQRRLSVSSDYSSSRQVETISSNEHKGEEEATDMPPTSVQIAAQSNDRSVPDSKLGRPENNPEPADAISSTTPQSGPRAVCSSYGQTALPNISAGPKPSFNARGSMISLLSAPTRPRGNLNPKDFARSTRRGQVSISQAAPPTGPRNGHIPTGPSVDSDRQHIYRQNSFSGTSYPRQRPTNYLASLNIIVPGGRFLTHDLDTAVEKRLAQLEMDKERLYEQIADSQRLKHVVIRDWERLDRESSICALKSELAEGHLLCITDGESMHTSTTF

SEQ ID NO: 29544 - protein, 103 aa, A.fumigatus
GVVHRYLSDVILGAPLTGTETLSLDYLQTVPRGDSRLDEMHASDRLRLGGARVHHTATALAIPLAVGLPLDEEIKALLGRTLPTRIESATHQLSIVTKSLFLP

SEQ ID NO: 29545 - protein, 234 aa, A.fumigatus
HHLIWYSDAYRHTLDIIPVGKLRNHHTIPFYIIFDLNIYSPSTPFNIQFKIQMAVTLSTTPSMNKRWPPLADKTSLPYRLTTLSKQKLAREATAPDPDIRRCLGHFRLHCTSMEWAQRDMTSRINSFDLDSDSEDEEETQDDEVQEVVERLAEKASTVTITDSAAKEETTLHVSFEVVSSAPATTPTPSTPPPTTTEQEKESLLEKGRSCLERTVQMKHFWPARGPCLPVRIAG

SEQ ID NO: 29546 - protein, 83 aa, A.fumigatus
IFQSNRLLISSTVQTVKPQATQPNESYSVLHNPIRIPGVPSTQGTKSSAPTFQTNDINLMNSIIAQKSPNNAIIQLNSTDHTW

SEQ ID NO: 29547 - protein, 244 aa, A.fumigatus
LSADCHPRGEDPAISPWRTFTAEDRAEAKPRDFSKIKFDAILVFADSRDYATDMQLIIDLLLAEDGKLLTRAKDPVSSRIPIYFSQGDLLMPTDHKGPPRLTQGCFRIAVEAQYKALTGVDLERVVYGKPERATYTYADEVLKAWMEQIHNENRLPKNIYMIGDNPQSDIVGGNMYGWNTCLVRTGVFQGGENDEHNPANFGVFPNVLEAVKAAVRKELGQEFKFKWNPKVNPVTHGDGSSAVE

SEQ ID NO: 29548 - protein, 68 aa, A.fumigatus
AAISALNLLQSNFAAIQQVNKDRKNMNLRSIPETIEWLRRIGYKVRIHPICDISLAEPCSPKIRMAMY

SEQ ID NO: 29549 - protein, 391 aa, A.fumigatus
WNVYKIVQPSDLDQLNLVHIAGTKGKGSTSAFVSSILSQYTVSQSPELESSSPKITKVGLYTSPHLRFARERIKIDNAPLSEEKFAQYFFEVWDRLEEAARVAGENPSDPQTKPQYFRYLTLMAFHTYISEGVDAAVIECGIGGEYDCTNVIDRPVSTAITSLGIDHTALLGNTIDEIAWHKGGIIKPGVKVFSSPQPPSAEEVLHKRAQEKGTQLQIVSGHRELHGGSELKLGLAGDFQYTNASLAVATAAEFLAKLGLEDIPPDFMERPLPPKFRKGLESARLGGRCETRREKDITWYIDGGHTLESIKLAGQWFASQIQNNSSSSAAAKRKLSLLIFNQQTRDSNALAQALHETLSSALGSESPFTHAIFCTNVTYKDAGYILRPRAG

SEQ ID NO: 29550 - protein, 338 aa, A.fumigatus
  UNSURE (47): Identity of amino acid sequences at the above locations are unknown.
NPSHHPSFNCSLSRFNTARCRARSRRHPDCEYVTASLRRVSTTANIXRFLVEQIVALNCFGCPLLSRESHRRTMTGQAQLDHDEQKFHSCGVWLLASYINHSCCSNARRSFIGDMMIVRAAQDLAAGTEITFWYQSPLNSDFPEKRMNLQHWGFKCACAICQDAQQTEKSIVMTRKKLTADLKKEIQCRKKPNTTTITALLSRLEETYRQPASEVPRLGLWRPYWNLAMLYAMHGQPQKTIEFALKTLESLGYVVEGGHLPRISGTPLRVKQWGLMTDSLVGCWMSLSHAYQQVAPDLAPQAHEYARITYRICLGEDETFDETYAQVSERSYGFLAGE

SEQ ID NO: 29551 - protein, 83 aa, A.fumigatus
RVTLSMDAATATSMQHVLEAECRDCTVLAVMHQLQHVERYHLVALMDAGRIVELDSPAALLARDSEFSRLSRAQAATGTRQLT

SEQ ID NO: 29552 - protein, 142 aa, A.fumigatus
  UNSURE (118): Identity of amino acid sequences at the above locations are unknown.
HPQERWPPGSELRFPADSSRHQARICGAPQRQVLAHPLLPATLRHPARHHHRRRDPPRDPGPGESPDPLRHRPPNTLLHAGIHPPQSRSAQHRLRRRYYPHPASYGPLGAGPRAGRPXRRTQGHGLVCGRAAVTLPGACAAP

SEQ ID NO: 29553 - protein, 178 aa, A.fumigatus
  UNSURE (125): Identity of amino acid sequences at the above locations are unknown.
MNISGRNNTPRNDGPPALNSVSLQIPPGTKLASAALRSGKSSLILCFLRLLDIQQGTITVDGIHLATLDPASLRTRFGTVPQTPYFMPGSIRRNLDPHNTASDADIIRILQAMALWERVHALGGXTAELRDTDWSAGEQQLLCLGRALLRRSRILLLDEATSRFVSGPLPSSVVVMVM

SEQ ID NO: 29554 - protein, 69 aa, A.fumigatus
  UNSURE (33),(57),(59): Identity of amino acid sequences at the above locations are unknown.
RIFFVLLCHGLSTFFTGNNCLPKLFSSVEGFSXPKTTWKNTSNLQNPHSRVPYKKAXPXFGGAIIFLNQ

SEQ ID NO: 29555 - protein, 369 aa, A.fumigatus
  UNSURE (335),(336),(360),(361): Identity of amino acid sequences at the above locations are unknown.
TMASTSATNGHEPEKRSKLENQSPPRFTAVNGREITAPTSVGPTAADSSSNEDIPNNQGRVELDAPSRTEERPRDNGNTEIDPDERSTQCSTSHSDSLSGGQGANKRKRSEIDERQELLSSSSKGSRSPAIRSDAAVESHTQQLAVNFAITPPGSHDLKHPSPSIAQSDRNEDSRSASANASLNDYDSHLVQQAQRAQQIDPSDAQLVEVLQRESQDHDGQSLQQKNWSATNRSTEGSAQTKEPQHAFSQEQPQAAIQVAPKRKRVFSNRTKTGCMTCRRRKKKCDEQHPACKLILATSLIDDGFFSFFFAMVSQHFSQATIVSQSCFPLLKGFXXQKPLGKTPPICKTPIPVCHTRKLXXNLGAQLFS

SEQ ID NO: 29556 - protein, 73 aa, A.fumigatus
PITLSFFILAIIHCALLLKESKQSQPSSSIASHHSTTHPISYLIHCLTYYDHSTSIFNTASDLLVQRQGIESE

SEQ ID NO: 29557 - protein, 491 aa, A.fumigatus
RHALDGALGEDHAAFGAAVAVEPAKDDGHLLDGRVEGELGLLVPDGTLALGPPVAVPVEPRREDLDGDLGGLAAGVPLAVVGAVDVRQVGHGRDVEELLEPGFLGCQFVQFADHHGALVRLVEAHRWHRGEHHLPDGRVERLIVTANRVRPLGGDPRLLDHHLALRQGARLVRADVGHGAQRLQGIKLAHDHVPLDHALRPHRHGDGQHDDQTRGDHTQPGPDRIQNDLVATHEFVRGHHDNRKQHRDPKQQDRQLGQLALQRRPDINAQEPADGVRPRQRPRLQIPPFLGLAVGAPLDGSAAAVARAQGRSDRANLRGHAGGNDHAAGSAARDGAGAVGQVEPVAGAGVFLEHGVAVFLDREGFTGQKGFVGLEVDCFHQTVLVSSPVEGTGQVVSGWGAYRISAGTVSPVRNSTISPGTISALGTEKVCPPRETVPVGELRECNDSMVFSAAYSWKNPTTMFSTMTAQMTPPSIHDWMPKLTAMANIRT

SEQ ID NO: 29558 - protein, 254 aa, A.fumigatus
TCDRLAMAATLRNSSSRGSWAANSSSLPITTGPSFASSKRTGGTGANITSPTVGLNGSLLLPTEYVPLAGIHAFLTTILPCVRVPVLSEQMSVTAPSASRESSLRTITFRSTMRFVPTAMVMVNTTTRHAGIILSPVPTAYRMTSLLLTNLFEAITIIANSTATPNSRIASLDSLRCSGVPTLTPRNRPTASVPVSVHACRYHRFLVSPLGPLLTGRRRRSPARRAAAIEPISVAMPVAMTTPRARPRVTVLEL

SEQ ID NO: 29559 - protein, 127 aa, A.fumigatus
ARLSRSPGPVSSLNTASQSFWTGRDSPVRRASSVSKLTASTRLFWSALPSRALDRLFRGGGHTEYQQEQYPPCATRPYPPGRSRHWAPKRSVHHGRPSPWASSGNATTPWSSRPHTPGRIPPRCSAR

SEQ ID NO: 29560 - protein, 407 aa, A.fumigatus
YSVCPPPRNNLSSALDGRADQNSLVEAVNFETDEALLTGESLPVQKDCDAVFKEDTGPGDRLNLAYSSSTVTRGRARGVVIATGMATEIGSIAAALRAGDRRRRPVKRGPNGETKKRWYLQAWTLTGTDAVGRFLGVNVGTPLQRKLSKLAILLFGVAVLFAIIVMASNKFVSSNEVILYAVGTGLSMIPACLVVVLTITMAVGTKRMVERNVIVRKLDSLEALGAVTDICSDKTGTLTQGKMVVKKAWIPAKGTYSVGSNNEPFNPTVGEVMFAPVPPVRFDEANEGPVVIGKLDELAAQEPRLEEFLNVAAMANLSHVYRSDDGEWHARGEPTEIAIQVFAARFNWNRDRWTKGERPVWHQKAEFPFDSTVKKMSVIFSRFDGDGGTERSMVFTKGAVERMSSTT

SEQ ID NO: 29561 - protein, 123 aa, A.fumigatus
VLILAMAVSFGIQSWIEGGVICAVIVLNIVVGFFQEYAAEKTMESLHSLSSPTGTVSRGGQTFSVPSAEIVPGDMVELRTGDTVPADIRYAPHPETTCPVPSTGELTRTVWWKQSTSRPTKPF

SEQ ID NO: 29562 - protein, 333 aa, A.fumigatus
QRVPGADRYVPFREFINHHLSSTPPVEFLVPKLRVTKRKSRCDPGIPRCSPCERSNAKCVYYDSARKCTIPRTYIISLREKARMLEKELADLEKDIQHAADAELMVRGAGRIRFKENDESRYLGPSSGIAITRLVMEMAKQNTDSKSIKDVVPEFTAQEIKAAFALESSKPTSKVYPMISSIPQPNLPPRNLTYRLIDVFVVKGEFCLSKPTIPGASRLTISAAQAMLPTLHEPSFRQEVEQVFNGSDDPCLNFQLRMVIAISMQKMSTEYAGLADSYYLAALPYLEASLRRMDLRALQCLVLIAQYSLLTPPKTLPYWVVGNGGQTLFKTTV

SEQ ID NO: 29563 - protein, 75 aa, A.fumigatus
SSDARKRGVVVPPRSRSHRGAKSSDEPTTRDSAGSYAPAGGNINHFFYSTHPDAQDHYTPRCIYVHLLHHYFDIQ

SEQ ID NO: 29564 - protein, 85 aa, A.fumigatus
ARILPAPVSEDKQPFFINPSSDKAAAMKVVSIGSTLYTSLELTSAESPILILANYPVGPLIIFFSEYHFRQFWTSIHHRRNTYAP

SEQ ID NO: 29565 - protein, 69 aa, A.fumigatus
FLVLELTLLTENPSAHFKNSFETLSASLGILAEPLDASLLYLILDFLPAAAKGSDFGLLTEIRDQLWFR

SEQ ID NO: 29566 - protein, 145 aa, A.fumigatus
PERPIQLRTERLITCDQSVPQWVLSLFGGSATSHVYEISYVDPGAKKVTMCSTNLTWSNVLNVRETVIYQPSSSKPELVTDFSQEAKITALCGGWQKIKNKVEEASIERFSQNAKRGREGFETVLEMSRRVFGEQREFENKKLQS

SEQ ID NO: 29567 - protein, 115 aa, A.fumigatus
VLKFHIAGDILLFRMSDSIYTNYPPELNPAQKDFLVKTIKDWATQNGLMVRPHLSFVSKESDPYGVLATNAPVTLFPSLFPRACFEEAKALQTVYNQLYAAITCNEEWLGKIMEE

SEQ ID NO: 29568 - protein, 844 aa, A.fumigatus
  UNSURE (265): Identity of amino acid sequences at the above locations are unknown.
DSINKLAPPDGMEADDGDPLDWTVDEVVAFLCHNPETPWSQSASQAPRPNPVQFEAALREHLITGEVLLHDVDKETLRDELGLKAIGHRSSILMAIRYLQRRSQKYQSSRVELASQLDNRRYSVTPSHLTAVVPSPFEEFSSPIHRNSALPTVTPQNLMQCPRWVTPSAFTVSQTKRTFPRDAATSGELRGNESTTTTVTTTGSESATTTSERRPSIAPPAEQRTDPSNPGERVRAYEHIVVDAEGKKRRRLDLSSLPDSQKNLXASKSSNAPQDKDWYMDPDRILLSQLFYPSISDDDDDHSFVMLGPPNLPTAQRHFVRKCMNYFLRQKPIQLSSDNESSRMALIPYDHSSASEHDKKFFTLYTATRGNVSVTQEDIKKWPQLEQTGAAGSRLSQTLEPSDPYSYLLQKYPAAEDNQDVCPLYGDSGSEGEFDEETWQEIDNERNDAVQSKPAKLTSAEVDSVIEDCMAEFVNRWRQNGLPREEYKARKLWVTARRAKCTYQKVKAINRDITLLEKRLGKVLEAIRGSEYASKSELQTQCQSMEQTVIDIQKQKWRISVLEEEKCPPKVAPAPRPKPLPKPKPSAADEESLYSESDVTSDFQDDFIDESEAQEEVSSVENFGNVDSIDRGYVPASTPSTSESDDDIISPSGIRRKSRAKRSPFMATSSPSPAPSGNAQQAEIIDLTMDSPPASADEFRIETPPLNPVRPPRLSESDDVSLKVERSPSISPPPRLSSNVVVEIPRRRPEITNQKPEVTKSSHKPNTPDLPDHNDFDGLLSYPWELLEERYDRRRLLAKLIATMPDCDREEMASLIPEYEYDELNDLVKQALRVLSEGQEEIVF

SEQ ID NO: 29569 - protein, 250 aa, A.fumigatus
DDSIIIDIQHISTCLGIQLLFLQSAITAHTTMMETQTTAPALASSRQSGRSSESSSSVDVIAQEKQKVAAAAASSKTSTASKDRPDLHNSASPKRWKTFWAAFRYLQHLTPKQVDDFMASYVIYNLDWSDEKQMIETLGPNYQEKVGDCLKAYYGVLNHLCALGDVEKMYIPPFMSKKATVLENQLLYEESIARDIGLGPGDKVLDLGCGRGRVAAHMTQFSGGAQVTGINIDPHQVAHVLAPPMEDVLL

SEQ ID NO: 29570 - protein, 70 aa, A.fumigatus
PIDVALPENLTVVTEILNEFRVYVSGSSHTGAIDMRYLNSVESQPVTYLSDHSTLAGTWGPADIQTTALS

SEQ ID NO: 29571 - protein, 181 aa, A.fumigatus
AGFYKLVLTTADENTKPIEFKTPSKSRYRDALESPPVTPKHRVQVGGKSMTPRTPRQISSPSSSQTIYTAARQLFARGATSGRLVGRDAEREKLTSFIQERVTSRKGGCLYVSGPPGTGKSAMVREVCNGLGLDTVQVAHINCASMRGPRDVYSKLIEDLGDDGQIFRKSDVDRLKALVSS

SEQ ID NO: 29572 - protein, 359 aa, A.fumigatus
KPLFLPDKKHDGLFLVTLDEIDHLLTADAGVLQSLFEWSLNNKSRLILIGIANALDLTDRSLPQLKAKNLKPCLLPFLPYNATQIANIITNRLRSLLPSDQDVEPNFVPFVQPAAIQLCAKKVASQTGDLRKAFELVKCAIDLIEQETLQKLEKQSSSVDGASKTILVENNNLSSPARTSISKQNPTATYDILTAPRASIGHIARITSSAFGQGTVQRLQALNLQQKAALCSLLALDRKRRESDLSSTPSKTKMSAPTIKQIFDTYCTLCRKDNILHPLTATEFKDVISNLETLGLVGEFQGRGRGGTVSGGSDIRRTPSKSGCGPMTPRKGMDEQGLICFVSQKEIEGQIAGLGDGPS

SEQ ID NO: 29573 - protein, 60 aa, A.fumigatus
QQPLDPSTASLPPQGNQRTGRLAIDSTSSVYVSNVLWASLDDEVFLYPQVSISIRPVQEL

SEQ ID NO: 29574 - protein, 206 aa, A.fumigatus
IEYLRDLLHEFSSKNNDDDEEGVWHEETDEKEGPVSAIGLNAAIMGFRSLAHSLRDYHPSISQSVALFEIFQTNVAPVVKIFHMPTLTTLFWNAVASLDTLDCNTEALLFAIYYAAITSTIDQTQCPLGLTRPQALCTCRSAVEQALACADLLNTQNMVLLQAAALFLCALRHEKHSRTLCSLTAFDCTYLHRRMGLLSERRGLWA

SEQ ID NO: 29575 - protein, 68 aa, A.fumigatus
IRIASNIKISKISGYGAIGGYGAAHPQRGSGEGAYGTDTVLYKASLRCRVMPLQLIELILLYIHVPSV

SEQ ID NO: 29576 - protein, 286 aa, A.fumigatus
RQEIGSAWPLYRSLNTAIEKLYRLGNVPGPSLSFQPSCEDSFSRNRHALSDTVSKIATTMGAAPGTRNPPDGSRTHSDIRGFQPGAGDSDSTSTILGISIPVDTQYMTPKDTTMDTDDLSMLDISFQQQTGGDSSNFGKSNSTNELGAALLPSAQTHPHPPTPDSSSSNPIIHGKSNVHDRSQQPGPNSSRDLGISITDGQTTPGDIDAIFKDLAYLDTTDWATSREAGLKDFGFLDDSTFHAFCHDPDRLVGSQPLLHPPSIADIWPPPGFFPETFQESTDDVES

SEQ ID NO: 29577 - protein, 256 aa, A.fumigatus
HKFLHPQAMNTRSHLIPSIAKSLASVLKTTRNSSLQSRINDLQALHNPRTDASHAPGSTDSRAAIQTALWKIAHKQLYDSRASRKLSASDAVTTSADDYRGAEEDILSEAGIDDFHDILNSENHEVCDSDSYVGSNSEYLEFMNEDEMNSILSFDGNYSHHSIDMLGHDDTELDQIREDQAIVDDTQGRTTIPVLNLSEQLSCHFSLSDGEMLASDCFEDEPTSPHLLPYSSSFSGACESSDEDCDLMLCDHNWVL

SEQ ID NO: 29578 - protein, 171 aa, A.fumigatus
RLRFFQARRQDLARAKNGTGKTAAFVIPTLERINPKSTKTQALILVPTRELALQTSQVCKTLGKHLGINVMVTTGGTGLMDDIIRLNDAVHILVGTPGRVLDLASKGVADLSECPTFVMDEADKLLSPEFTPVIEQLLSFHPKDRQVMLFSATFPLIVKSFKVRRDFYCSF

SEQ ID NO: 29579 - protein, 315 aa, A.fumigatus
AALVISPKGQTGDALQRHLSVNCQIIQGKARLLLFVLSCPLISFIKDKHMRNPYEINLMDELTLRGITQYYAFVEEKQKVHCLNTLFSKLQINQSIIFCNSTNRVELLAKKITELGYSCFYSHARMLQQHRNRVFHDFRNGVCRNLVCSDLLTRGIDIQAVNVVINFDFPKNAETYLHRIGRSGRFGHLGLAINLINWDDRFNLYKIEQELGTEIQPIPQNIDKKLYVYDSPETIPRPISNPSQQRQITNTAANTSTTDRRHHNPPNSGQYQFNRGRGSYRGRGQGQRRSAQIESNKFGHPQGQHSGKTSTAPVS

SEQ ID NO: 29580 - protein, 137 aa, A.fumigatus
LLVNILGNGLYFRSQFLLNLVQIEAVIPVYEIDGKTQVSETTRSTDPVKVCFRILWKVEIDDNINCLDIDTSSEQVGADEVATHTIAEVVENSISVLLEHSSVRVEARVAQLCNFLRKKFNSVGGVAENDRLVYLKL

SEQ ID NO: 29581 - protein, 122 aa, A.fumigatus
RGRYQKSYARHQNSSDENIQLSFDKKDVPMSAIFDYIHQLVDQAFAFTKLIQNREVGWLTVDRKTGECKREKQALWKKFKLLLLFNPLTEWIDQTHLIRMYTHEKNLAAGSLSSLRNKVYDH

SEQ ID NO: 29582 - protein, 119 aa, A.fumigatus
QNGSIRLISYECIRMRRTSLQVRYHPLGIRSTTTDCIQGRKEGKPQSHKQIKTFVDFYQIDMSKFDPSDMEKYETFEDFFVRKHAPGARPIHAPNDPTKAIVVADSRVVVYPTVEASPR

SEQ ID NO: 29583 - protein, 100 aa, A.fumigatus
PVSIETIQFQLHETYLSTIGPLICRFLEFYNPGTLVYEVGLKYFATDLDLWYGESESAPSLKRSKKLTKWKPTSDISVCLSQVSRQSDWHNWELRQESTP

SEQ ID NO: 29584 - protein, 72 aa, A.fumigatus
TGEYSRRRDLPKYDVQSEGDHPSDVMTTACLSFYLYVFWCSISIMWAKLAKGLCFSLLVQCIFVRILDKAEG

SEQ ID NO: 29585 - protein, 428 aa, A.fumigatus
ASPRVTPREVTQETHEATAEAADAHAPSSTVSPVKPVLKKKAADEQAEPAAAANGVEKPEKKKKKKAAATAPVTGESPAKAKEATFTADRGLSGESGIVPQPSEQTTQVAPSTTQPSTMDAPFPAATAAAPLSPEAGAKKAGEIWARHLEALQTGVTTEFNKSLGRELEGLYSRFDEERRNWDAASAAKQDQVLRLVSSTLSDNVEKNLARIVSSSIQSDVVPALTELTSAAVGKQLDQVISQHLGSVVPREVRQALPDAVARSVKQPEVMKAISDAVGQKIASHLESDMSRALHNSITPAFKSLALQAAEQIGSDMQKQLQVQMKQYEIQRHNDAAKIDQLTSFVRGLSDTVASMAAAQTNFQNEILRLNRVLSAKQQDEESRSSQQASSAGRAAAPSEARTAEDLELAEIAQLMSEGRYEEGSVKV

SEQ ID NO: 29586 - protein, 327 aa, A.fumigatus
IPDTIQWSRSKKVQSQLLLGFDLLLSHLLHLTSENNLGFGRAVDTVGLDGDNDTTLVLQEHVGIQADNTGLIGLGNIGEDNVNHGNEHTVAERVSGVLDDGNNVGAVGGHANQITARTVGELNSVDVSGRPDNISDVTDGGTTGRSKVENFGTRLHVDIIETAQDTGGKLGTEGVPHTVLDLSDGAIFTGRGLDSNALLAIDRLSRSQVLRDKQILLTTTGNEDTGVTVRLLHTPVLVSKPIDRSQPQKTHTMMTLAPPLAPLAPPRPPPRPPRPRAGPPRPPPRAPPRPRPPLPSPPENEHKWCWLAVLPGDLLKGERLTSQFGPL

SEQ ID NO: 29587 - protein, 208 aa, A.fumigatus
EPHRHAGVFVARGGKEDLLVTKNLTPGESVYGEKRIAVESPAGEDGAVTKIEYRVWNPFRSKLAAGILGGLDDIYMKPGSKVLYLGSASGTSVSHVADIVGPTGNVYAVEFSHRSGRDLIGMATHRTNVIPIVEDARHPLRYRMLVPMVDVIFADVAQPDQARIVGLNAHMFLKNEGGVIVSVKANCIDSTAKPEVVFAREVQKMREE

SEQ ID NO: 29588 - protein, 337 aa, A.fumigatus
LFVPVWCLQAVCVRTRHSTVPSGAVQVRLPERMAQKQHLPPVPELLSDRLVCKIIFDPILSKSWFANDAIFFQNRIFGIIVYFISATLSYIFIWDKTTVKHPKFLKNQIPMEIAQTMRSMPVMSLLTAPFLVAEVRGYAKLYDSVDEEPFPYYSILQFPLFIAFTDFCIYWIHRGLHHPLIYKSLHKPHHKWIMPSPFASHAFHPLDGWSQSVPYHVFPFIFPLQKLAYVFLFGFINLWTVMIHDGEYVANSPIINGAACHTMHHLYFNYNYGQFTTLWDRLGGSYRKPNEELFRRETKMDEAEWKRQTKEMETILKTVEGEDDRKYLSQEEAKKDL

SEQ ID NO: 29589 - protein, 190 aa, A.fumigatus
  UNSURE (14): Identity of amino acid sequences at the above locations are unknown.
TVCQALQPRAKFRXCVKNAFSFPGIMDIVLEIWDTFIGDCVYSAMLPLSLSSTVSLPGLTNAANSSLSLFGASKPFVYEPATQLFRLEPSKYAYLSAWPRNNIYRQFLSFFLIVWYAKSSLTPSCPKAGLLMTRFSFKIGSSALSFTLFPQPSPTSSSGTRRQSSIQSSSKIRSPWRLRRPCDRCLSCLF

SEQ ID NO: 29590 - protein, 158 aa, A.fumigatus
VTLFYFSSRTDLCIFFVCFHLHDQSVYSQRNTILMFLSADAICHYWRTLAYFMARGSRSKVLFSLFLREVLAVVFAFHCFENCLHFLGLSLPFGFIHLRLAPEEFLVGLPVAATETVPQCGELSIIVVEVEVVHRVASSPVDDRAVGNIFSVVNHYRP

SEQ ID NO: 29591 - protein, 66 aa, A.fumigatus
  UNSURE (16): Identity of amino acid sequences at the above locations are unknown.
CTGCEVLSFCVIDGLXIKSVQRRSSQLHEYDTCELLHMFASQTLLTPKWKDTQSKPRWNGVPPYFD

SEQ ID NO: 29592 - protein, 127 aa, A.fumigatus
AIYGRNHNPQDLPVERLTHVLYAFANVRPETGEVYMTDSWADIEKHYPGDSWSDTGNNVYGCIKQLYLLKKQNRNLKVLLSIGGWTYSPNFAPAASTDAGRKNFAKTAVKLLQDLGFDGLDIDWEVS

SEQ ID NO: 29593 - protein, 70 aa, A.fumigatus
LVWFQCLRSTPYYLGKSSELDYFSSCQIFPVLSKEIMIRGPSMSKVLLKILLETFPSNCQAWFITDGLLL

SEQ ID NO: 29594 - protein, 243 aa, A.fumigatus
NSEKNHAGLTENPAASATATHPTVPHLYTKSPTSASEFENDLRLDKISIECVDMIPWEHESAAAWKRVGKRDVKDNPVATGIGTDILGGLRTKGKYIPLDQQTSESIWGIVHLYRDAEETPFLVSEDYPLELKGSAAAARQPYDQLGGRQDAPAKGHSPSLRQDEDCTTLCILAVPSYMSPSDFLGFVGETTMDEVSHFRMIRTARANRYMVLMKFRSGKKAKEWQKEWNGKVFNSMEVSLLG

SEQ ID NO: 29595 - protein, 124 aa, A.fumigatus
RRLRYKLLIPTLTSPHPSRVLLLLRMLRLAPSGRPCLPLFSRAPYPLPPSRVNPLRLPHPRSLSYPPALCAWNAWMKRRGLLTILCQHVFHCTCLQKWKGSGCPVCRYTQDDFRRGQSRSGLRR

SEQ ID NO: 29596 - protein, 124 aa, A.fumigatus
FRPQPETCHVVFVKTVEIQAVNSDSDVSTSQQSTPSASHAATSPQRTTMSTSVQPSSIPTATLSSKPLAPPSPALIELPTCPVCLERMDETTGAVDDIVSTCLSLHLSAEMERKRMPGVSIYPR

SEQ ID NO: 29597 - protein, 269 aa, A.fumigatus
FPQGAVKERPTEMSPAECSVCRSEVNLWICLICGNVGCGRYDGAHAFAHYKETSHAFAMDLASQRVWSYVGDAYVHRIIQSKTDGKLVELPAADNSALDPPDWSDAVPREKLENMSVEYTHLLTSQLESQRAYFEEIVERAADKASQATAAASRAQETAEKATASLRVLQAQYDKLTAETLPGLERDKARAEKRAEKFEAMTRKMEKEWREEKTMNESFMKRIAHLTSEVTELKAANADLTEQNRDLTFFISGSERLKVLTAASKDTSQ

SEQ ID NO: 29598 - protein, 150 aa, A.fumigatus
AATRSRLGSAARRRCSCSSCSLRNFARRSLSCASLFCSSSSACLIRLCSASFRLRSSSSALSRATRAARSSSSFAKRAFSASAARRSSSAIRSFSALFASSRRRSSDSDLLATVFASSMGISARWPTSCLSPSFFTALESVAVCGVLSTC

SEQ ID NO: 29599 - protein, 553 aa, A.fumigatus
ERPMIITLEPSACASRRLLHRNDRATGRRKTSGRAADTPRRPRFLPGRPYQVQAPVTTESSLPKMLLHRKEKKREGVTHLKERSGSSTNRPRIAHKGSDNAADADGFRVESAQSTSLATLTRDEEAPRRRRLIAGRPPQDRDRRRPSIPSSDSLSGLEDSAKSRIDPSTEATTVPTGPVVLKRGRSSASPERPRSRGADSDHHSREGQKKKRRVLSEDRTPSISNGGLKKSHSNGIAEDSKADVRLKKTEVQSLECERDQQVDSTPHTATDSRAVKKEGERQDVGHLADIPMEDAKTVAKRSESEERRREEAKRAEKERIAEEERLAAEAEKARLAKEEEERAARVARERAEEEERKRKEAEQRRIKQAEDELQKRLAQERLRLAKLRREQEEQEQRRRAALPSRLRVAAHLIGSNDPRARSHAWLKRFMPVVTAFTKQLDPSCDTSVADERWVPNYLVAPLLATNDLQLSQYTSWEKRNATPTQRENLWRVTRRMLVQGDDMDFMNSSFGQIMQKDCETRPKYFDMEHVFWVKVSHFPLRPSFIVPQNQFNH

SEQ ID NO: 29600 - protein, 371 aa, A.fumigatus
  UNSURE (2),(3),(8): Identity of amino acid sequences at the above locations are unknown.
NXXLNTRXSFQPRGEDTKNIDKDTPLIDAVENGHLEVVKLLLEAGANPRTVNAEGDEPYDLVPSDSEDYAEIRRVLAEAKANPRPGRRSEERSGSANKEISSKRVAASSPRNSPPVNVPRSPPLFGATTRRKTVRSEATRNDLLWTKATPENLQAFAAKGDIAGVANILNVGQKADTESMIAAAKGGHDEVLSLLLGMGDADPDPEPLHGGNQKPGYNTPMLAAIGRGNLAVIRLLLDQPKFNPTRRLYRDRTYFELSRERRADNWEEEYDLLREAYDNYIRAKRLRKQEASSPKRPRDREKENKRPGRRHSPSPAVSSRKAVSSPGAGHHRELSSKDAATSEGKETGGCNSLKGEIRIQYQSPQNSPQGQ

SEQ ID NO: 29601 - protein, 296 aa, A.fumigatus
KTVATSIEQPAGPSPVCNGSDMGALGNSTVESDNDKAVDPALPSPPADSPPSTAANESERSSTSTTATSVCDAAVKIKVEETIEQSAEKVSALSEANVELPTTSLRSGSTEGDTKLELSDQPSTLKQGSIGSNRKERRKSRGKPLVVESVEAERQLVRVPGDYTKTSKLLAQTYDRWVDCHTCNAWFVQHDSYLTRRECPRCERHSMLYGYRWPKTDKEGPSDDEERVMDHRTVHRFLYPEEEALISRKDRGVSFGVTPTPELSEPRTETEGSEGCEDRRTTRASRRRTRSLRMTM

SEQ ID NO: 29602 - protein, 72 aa, A.fumigatus
PWLGVAFNFVRTFATFFTTSERIDSSKKGVVKTLKISVAPEFWSLKIFSKTSSPGLKNNARKTISRASGSLR

SEQ ID NO: 29603 - protein, 585 aa, A.fumigatus
  UNSURE (38): Identity of amino acid sequences at the above locations are unknown.
IQIVKEFGATDDDTLNITADIQRAIAYQAFEDEIHRIXEPSPTRMFDAPRIRDIRKRIDNGSCSIQEIEETAVAMLPEIAELSSDYLGNTVVQKLFEYCSEQTKEQMLVPIAPHFAEIGVHKNGTWAAQKIIDVAKTPAQMKMIVDALRPYTVPLFLDQYGNYVLQCCLRFGAPFNDFIFETMLSRMWEIAQGRFGARAMRACLESHHASKEQQRMLAAAIACHSVQLATNANGALLLTWFLDTCTFPRRRTVLAPRLVPHLVHLCTHKVAYLTVLKVINQRNEPEAREIVLRALFFSPGDEVLEKILSDQNSGATLIFKVLTTPFFDESMRSEVVKNVAKVLTKLKATPSQGYKRLMDEVGLSSRGGARDNHHGREQSGHSENKQHRPTSRQAQSTMDRHFNGQFAPSLLAQNMDNSRSVPEQQPGAAPFDPYSISAVNGMSPTGALSSLNGLAAMNGAGFVQDPLLPLTQQQLQYQALLAAQSRGVSPAGLYPTLGNPSFGYPPGTPSLEQSSAVCSYAWNTHSIAEPASLCSPAVQPCYGHAPDLSVSSSILFTNTSGPWTVGWGTPRTCKFISRWVTWCVT

SEQ ID NO: 29604 - protein, 180 aa, A.fumigatus
AWQIGLSSRPCIEHPLLYQCRTKRACLGDDGLVRLVPGRRGARSGEGRRRGLRVGQASCRTRYVHTRTQLVNMLTLYIGLAKAQYAVGYFTEMGIGCRRDPLEANVWYVRAADQGDERAKQRIATIRAAAEGRSPAQNGKEGQKEKQKSLGAFNDPSCYLKLIHGTDAGKSGKSKRFTIF

SEQ ID NO: 29605 - protein, 65 aa, A.fumigatus
VTSYVLSAMNHLVSASTRYDVIMDMLGLMIVAFLLDEDAPFIQLKQMYKESGIRNAAFSGLSMIF

SEQ ID NO: 29606 - protein, 125 aa, A.fumigatus
QYNSAPYELGLLHETGFGDDVFPDPAYAAQLFTKSADLGHVEASYRLGDAYEHGKLACPRDPALSIHFYTNAAQSGHVLAMMALCAWYLVGAEPVLEKDEGEAYEWAKRAAELGMCTHGLNWLIC

SEQ ID NO: 29607 - protein, 160 aa, A.fumigatus
LPCLQNLDDFKSESCLTPFSYFLVYVFLLVSIAVYGVDTFTAVNLLAFSRWAGSIEPAIPFTVSRWIFAVCIIVSFVLLFLRWLHAIRAMRSGSIARSYLDPLAARVQSIRMGRRGRGWRRFLVFAELTKSKKGAEYVALFAYFSFESKPLALSTFLGFN

SEQ ID NO: 29608 - protein, 61 aa, A.fumigatus
  UNSURE (55): Identity of amino acid sequences at the above locations are unknown.
TQSFADGPRQVVNAITLYSVMRMDLLPGGKNSVDDDKAGIIQFFENVKILADLLXRTGRTH

SEQ ID NO: 29609 - protein, 65 aa, A.fumigatus
VYNNYTFSNYFIYLLLYYITLVLLLYSYILYLLLYLILLECLILLDYYILFYLFFLLISRGDYYI

SEQ ID NO: 29610 - protein, 139 aa, A.fumigatus
  UNSURE (131): Identity of amino acid sequences at the above locations are unknown.
PDIPISLFLPILHPTALTFPGFVCSFNLFGLFLPVSSAVAPPSPPPPPPRPPPPPPPLSKAWFPHPLCKNYPPPPLGNFWAPPPGFPKKNNTYTPPAPPPPPPPPPPPPPPPPPPPRPPPPPPPPPPPPTXPPPPAPPP

SEQ ID NO: 29611 - protein, 242 aa, A.fumigatus
ERADGYHSSCRIVYGRVRWYLMRMISISKSALLVAAALSGLSQAANYTEWMASSFMTKNISLSRNYANGVLYTGMEFAYNKTKDERYFTYIKSQVDAVVDPSGGLIDYPGSTVSLDDIRIGLNLLWLWTKTGDDRYKIAADTLREQLNFTPRNKAGGFWHRKPTYPNQMWLDGIYMAENFYAQYTAWFQPNNATAWDDIMLQFDLIEEHCRLKTGLLVHGYDESKVAVWAGMSQQNPTDLCG

SEQ ID NO: 29612 - protein, 210 aa, A.fumigatus
  UNSURE (202),(204),(206): Identity of amino acid sequences at the above locations are unknown.
KRDNRLHKMTKPLTEIKPSSPSITRSTTTKATFTNLTPADSIFRSTVENTSITRSPTSGAPSSASISVKRSKLQSCTLTNSSTRRCTLTNTTLLNVPAARSLDATDSSLSNIRRLRRSEIRASAVSDSAVRRSTVVDSTVKQSLLWRSKLNHVDMFKSRVKRAVLTDCEVSECVVIGTEFKGMRLRFGVWKHGRLVGRVGEXHXAXNALR

SEQ ID NO: 29613 - protein, 253 aa, A.fumigatus
YCQERLKRCYCRTAQDAPADAGRTISKSICSPNSRFVIFALGDHPQSANSITTEQSTAALSSLSESYTDLDSLLSSSRDLIGSLLRSQKSDTWYLETAFYILVGTISWLIFRRILYGPLWWLVWLPIKLIARSAFAILGTVGITSTAVQLQPSASLSQSMPHEAPTLGQTAAMPSASISASWDESQAPEEQSETDRLIDQIGDTIEKNSKLGDETNIDDVSPEERQRQEEIPRNPKKRMYEATEIEQDLRDEL

SEQ ID NO: 29614 - protein, 417 aa, A.fumigatus
  UNSURE (400),(407): Identity of amino acid sequences at the above locations are unknown.
TLYHWRILRPCGEDKEMTAAELQDYAQLMDEFAKGFDPDSLAREIMATLPLLEEDLFPSSFAHLLILLLQTDGKIEIAQVKLVRWLRARYPIALCEPSETQLVDETFFMSEIEMLRRLLSTLRGDDDKPIYWINCRPFEIGKSCEQLEASIKVIRAFECDMRSATEEIDEESKIARHPPFHLPMKLTTINTGHFYHDLPVCNERTVLISMRAQRWDSSRASIGWNNYLSSEIELTRFHQYFKHHVMEHDPNKARGYGWLPPDHIRVPLSSSTNVDLVDVSDWPLNDHQKRIMSLLFKVAQWIGLARGLAAVHLFCDIARNFTIHKPSENPSASYVLFMQKLAEARLCPSSIESQIPTPFPYNDETYAKRNPAFFIDVFRSAKGLVCCQVQMNSFLKKKAXRISWLSXTRPSLGFFLG

SEQ ID NO: 29615 - protein, 65 aa, A.fumigatus
NLPLLSPPLLSNGWTRIKTRDKILPVQYYAPTSIQTVIGCKGPLQFSFLQTLDWAYVSLLHGLAS

SEQ ID NO: 29616 - protein, 472 aa, A.fumigatus
FIMATLTSSASRPQSQVVTSMTNLSVLPPIITDASGKTQIGQRTSLYAKDRLSTYSNVSTTSQNRSRPGSHVFPIFHSSLPYALVRDFAYPPVHPLHYGPLPPRASGVSTPASEHRRLSDPPAPWDNSRGQWSSGSWRADQSHGQHQLPAMSFGDGPPYSEDEDLHSPVFSASRHRKNKSTGMNANGRRTRSPGRGHQSAYFSGDVDRGILVSMNADGSETYYVNDDDDGSDDGPGGEYVTYPPSESQYSHMGNETYGDYEDREHDAGFESEDDYSGAGRYSGDFQFAVGCPDEEMHGKAVALFDFTREHENELPLTEGQVIFVSYRHGQGWLVAEDPKTGESGLVPEEFVRLLRDIEGGLTSLSVDPSLDTEEDDSTYLSPDSTDSEQAITPTQNDQLPLTTERGSVHIPNGASNLESSAVIPDGGGEIESNQSHFLHNGQEIGSTPPIEQQMPEKQKTERESQMGILAKT

SEQ ID NO: 29617 - protein, 81 aa, A.fumigatus
  UNSURE (6),(39): Identity of amino acid sequences at the above locations are unknown.
GLHPFXVDNNLMDCIDPPKIQEAQYMHSKFYNIISFAHXTDCFHLRFVRTLKWRGSPLQKNSRRTTARPARLTRPEILPIN

SEQ ID NO: 29618 - protein, 330 aa, A.fumigatus
GLHCLVGAKYLNTITGHGACTIIWSLVTAIVSLVFSLPRTFSGLSKAATLSAIFTFVSVILAVIFSAVEDHPAGYSAAQGEPIVTAIPVVGTTFVSGVNAFLNISYTFIGQITLPSFIAEMKEPKDFWKSVTAVTIAEIIVFSLVGAIVYDYTGNQYMTAPAFGSIGNEVYKKVSFSFMVPTLIFLGVLYASVSARFIFFRLFDGTRHKGNHTVVGWASWTGILAVLWIMAFIIAEVIPFFSDLLSIMSSLFDSFFGFIFWGVAYLRMRYADHGPGFYKKRGIRGWVGFIVNIGLILTGLFFLGPGTYVSLPLKHSHERVANVTLCRLPL

SEQ ID NO: 29619 - protein, 292 aa, A.fumigatus
RTDVFKRHLTSVHGVEQTPPNCRKRSPGAASVKKVSDYCQDATGKCSTCSATFSNAQDFYEHLDDCVLRVVQQVEPSEVINQQRLAEVDCDEEVKKTMEKHKLLDAAGDVDDEPEEDDDDYNELNLQLRSSKGAFKSNKANSSLGSRPIMGNHNAVTKNGKARATISKRRNNRDRYPPSWGCPSSSMKTKKRVLCVFDGQRRLWKDEMMLDNEFEVRLKLPGGAGDGTNREAYITDLDVETLKRAEGVLSANEDEKGPWLEGPATHLMGQPAKMLPALSHTHEDVDIDDLMS

SEQ ID NO: 29620 - protein, 172 aa, A.fumigatus
CFQGVLDEDERCAEELSPCPADGASYLGREGVRYLDEVLEHDGEEAEGRCAEEGADDVRRGDACGTGRGEYEGDVADGDDGDQDPDGAEVVLEAVGDGRDDGRTNEADNDENAACNAGVCLGETVWFENLVQEGGDAVEEADVDGEGDQDEPEFEGFEELNQRRTEGCFTAC

SEQ ID NO: 29621 - protein, 150 aa, A.fumigatus
  UNSURE (145): Identity of amino acid sequences at the above locations are unknown.
WGANGFDMLERKPRGGIFGGAMLGQIFIGLAQPFCLSAPTRYSDLWFSDQGRISATAVATLANPLGAALGQLLDSFWATTPKQVPDMVLYISIIVGASSIPSAGVFCRKATHISSNTDRMHNLTGNRRVNPIILHSSRTPNAPKXFISRQ

SEQ ID NO: 29622 - protein, 289 aa, A.fumigatus
  UNSURE (22): Identity of amino acid sequences at the above locations are unknown.
QATVASIPSFFIPAAPPTPPSXSSAGSKTPLRPALIQLLKTLEFWLILIPFSVYVGFFNSVSSLLNQILEPYGFSETDAGIAGGILIIVGLISSAIISPITDRFKHYLGTIRILVPIVAICYIALIFAPSSPAGIAPAYVVCALLGASSFGLLPVVLEYLVEITYPFSPEIGSTICWTGGQLLGAAFILIQDALKASDNASPPQNMRSALIFSAVVAAVAAPFAVCIGLFGRDVRRRRLEVDRGVPLENAVCRDPEAASAGVHVGDENPNTGLDHASDMPKLAPKYSSY

SEQ ID NO: 29623 - protein, 79 aa, A.fumigatus
DSVSPLQDPVQTPAQKKLTERFRTLVKHVMQWRKSCEHSLHIMVTEVKSRGFLQPFMPEFVPQNRDSNQFMADEIGLLD

SEQ ID NO: 29624 - protein, 657 aa, A.fumigatus
SPLTTQLQQSDPGIGIIGKAQAYREVELTETWFEKLQRWEEALAAYKRRERIDPDSFGVTMGKMRCLHALGEWKVLSDLAQEKWNQASLEHRRAIAPLAAAAAWGRGQWELMDSYLGVMKEQSPDRSFFGAILAIHRNQFDEATMYIEKARNGLDTELSALLGESYNRAYNVVVRVQMLAELEEIITYKQNIGDPEKQESMRQTWNKRLLGCQQNVEVWQRMLKVRALVTSPRENLDMWIKFANLCRKSNRMGLAERSLASLETVVTDNNGTRTIAPPEVTYARLKFNWATGRQREALQMLKEFTANLTDDLNRFNALMASQSDHNGVDGVNGITEANHADMMGLRERIGDVAKFRKLLSKSYLRQGEWQTTLQRGDWKPEHVREVLGAYSAATKYNRDSYKAWHSWALANFEVVTTIASQTSRDGGIKPVVPGHIVTEHVIPAIGGFLRSIALSSTSSLQDTLRLLTLWFTYGGDQEVNNVVTEGFNAVNIDTWLAVTPQLIARINQPNLKVRTAVHRLLAEVGKAHPQALVYPLTVAMKSHITRRSQSASTIMDSMRQHSATLVEQADLVSHELIRVAVLWHELWHEGLEEASRLYFGDHDVEGMFATLAPLHDMLDKGAETLREFLLRRRLDGILQRRNTILCVFTHRGWKVPR

SEQ ID NO: 29625 - protein, 134 aa, A.fumigatus
QCQQWNTELCPDNESCAQNCALDGADYAGTYGVTTSGSELKLSFVTGANVGSRLYLMQDDETYQHFNLLNHEFTFDVDVSNLPCGLNGALYFVAMDADGGMSKYPSNKAGAKYGTGYCDSQCPRDLKFINGMVR

SEQ ID NO: 29626 - protein, 258 aa, A.fumigatus
ALTITQANVEGWEPSSSDKNAGVGGHGSCCPEMDIWEANSISTAVTPHPCDDVSQTMCSGDACGGTYSESRYAGTCDPDGCDFNPFRMGNESFYGPGKIVDTKSKMTVVTQFITADGTDSGALSEIKRLYVQNGKVIANSVSNVAGVSGNSITSDFCTAQKKAFGDEDIFAKHGGLSGMGKALSEMVLIMSIWDDHHSSMMWLDSTYPTDADPSKPGVARGTCEHGAGDPENVESQHPDASVTFSNIKFGPIGSTYEG

SEQ ID NO: 29627 - protein, 180 aa, A.fumigatus
WSPSLCLPGCYPRDAHASFTIAPQVCHWIRQLTRSLDLDVQSHPLQVGGSNLAKQQEQLGTGATDVTSLFDFCFPENGLMAFRLGKPLASTSFIEWIGEEKYQKLVNFILRYFADLQLPKKRGTFIEFRNGMINVSPIGRNASVEERNEFEAYVYELGLSQPLQRRQLICGYHQLTIRQI

SEQ ID NO: 29628 - protein, 87 aa, A.fumigatus
QSICSYSIGGQISFDVFPTGWDKTYCLRHVEAEKEISGVEYTTIHFFGDKCFPGGNDYEIYSEPRTIGHSVHGPEEYMKQLKELFQL

SEQ ID NO: 29629 - protein, 69 aa, A.fumigatus
HSFLDPFFLFYTIRHSYSQQECLKSSCLHPQRPLQRIPRTTSNTTHFLITTPTSQTPPFPSQPLQGLLA

SEQ ID NO: 29630 - protein, 212 aa, A.fumigatus
  UNSURE (50),(60): Identity of amino acid sequences at the above locations are unknown.
TWKIPDPVNFNVGVLVLHLLNRFSIEYNKKPGKLATVKVVKDPAVARENXNKSVLIHTGXGEHANSVSKPTPRPKQVSARPVTKGKLLRPGGPGGGPSKLAARPTPAAQPLPRATPQPAEPQPAARAVPQPVAAVAASHTRTGSTASVRAPPPPPPAAAPAPKKPTAKVLYDFNSQQSNELSIKAGEIVQIVSKEGNGKPGSSISSQQSTNE

SEQ ID NO: 29631 - protein, 141 aa, A.fumigatus
RVIGWWLCMNMTTSAQGWTPEAYLEEQVAPTPKPAPPPPPAAPRSTPAPATNGAAAAAKAKPAPPAPPAKRPNMAARKAVPTPPPAPRDSAVSMNSHDSSGGSGRGTPNSMSNASLAGGLAEALRARQHAMQGKQDDDDDW

SEQ ID NO: 29632 - protein, 228 aa, A.fumigatus
  UNSURE (24): Identity of amino acid sequences at the above locations are unknown.
SNTGVLGNTPHYFLSLWLSLSHCXARSVPSSYVADLTPHQQTEYTRGPVGSILRTHPHPSHIYHIQPSLIPYTSDINQLTKMSFSNIIQDALSGHSHSNNNSRHDNDYDEFNPAVRYAESHANTSDSSLFTSALSFLNENKHRLSNDNDINEQEMIHAHQSLYDGRDSERRHDSSSVGAGAAMQALKMFTSSSEGEKSGMDKNAFIGLAMAQAKKMFEEKEAKGEVVS

SEQ ID NO: 29633 - protein, 65 aa, A.fumigatus
GEMHGVRPQGTPSPLLVGRCTLSVESLQLSVPADFTSSQTAAYLGYLTVVHNHHQLQASLLVVVA

SEQ ID NO: 29634 - protein, 419 aa, A.fumigatus
HTAKFRVHETQTLLIIPNYTVSRGLLFMFRSIIGRHGHSYGSSRLTGSAPRPTLCQTRPNHPAPFVEPPYPAHSEQHHHRNHQSPPGYHREPAPIFSQFHAVKTTQSKVVSPGDRAKARKEVQNGLESKFFSIVREGQPDLVMRALLDPKFENLVGSLPESTFVEAFRSLSPAYFIDPFRAIYRPLHPSTVAVKGYPQLDKIFDRFASNLASIVSIRRSAGHRLGLAEYTHLLDCARSTGDALMADHIWHAMRQDDVIPDVQCYNYYMESKVWDGAYTGREKYRLRVTPFAYRKRSFGKRNLGWKGYGTAGCTVRKEIMPILADMTEERTAGDQGTYVNVILASSSVGYISTMNHVLNNVGNIDIDALPPLGVSLNPPLLLGIPSFFHPLYPTNSPSLFACPHPPFGFPQPTFPAPLSG

SEQ ID NO: 29635 - protein, 62 aa, A.fumigatus
LILGTYLNITFTISKLAYFTKNPSPNYFIIVKYIFYYLAGILLLLLFYPSTLSNLNSFINTN

SEQ ID NO: 29636 - protein, 64 aa, A.fumigatus
EANRTKFSDMPIRMCPIMNQDSAAFMDGYKMAAVQLLDSFAAENPQVLFTMCIPDSSKRLCLPS

SEQ ID NO: 29637 - protein, 152 aa, A.fumigatus
FHIKITHVNMQLATFLLVALLSIFHMTLAAPTYHHYTVTPANPALTWHVSNFYTSCSPGGCAYRFDILGIATRNTPGFNTTCNGTDMETDYTFCRDKHIKAKLTAVKSRSWKVEVMHAWFKPGAEFYAEGSANVTSSMRNFTIPVNDTYGAA

SEQ ID NO: 29638 - protein, 159 aa, A.fumigatus
  UNSURE (25),(26),(29),(33),(42): Identity of amino acid sequences at the above locations are unknown.
DRVRLCSVRFPALNGSDNGRGRGWXXLYXYCSXFFFFSFYFXFFFFFFLFFLTPPFFFPLFLFFLFFFLSFLFLFSFFSFPSSPFFLPLFLPLLFSSLLLSPFFPLSLLLLFSSSFSLFLSSSSFFFSFLFLSFSFFLLLPFSFLLLFLPSFLFPFLPL

SEQ ID NO: 29639 - protein, 145 aa, A.fumigatus
  UNSURE (11),(12),(15),(20),(29): Identity of amino acid sequences at the above locations are unknown.
TAVIMEGGGGXXICXIIVLXFFFFLFIFXFFFFFFFFFLPLPFSFLFFSFFFSFSSPFFFFFLSFLSLLLPFFSLFFSLFFSPLSSFLLFFPSLFFSFFLLLFPFFFPLPLSSSPFSFSLFPFFFSSLFPSFFSSFLPSFSLSFP

SEQ ID NO: 29640 - protein, 141 aa, A.fumigatus
  UNSURE (7),(8),(11),(16),(24): Identity of amino acid sequences at the above locations are unknown.
WKGEGVXXFVXLLFFXFFFFFLFXFFFFFFSFFSYPSLFLSSFSLFSFLFPLLSFSFFFLFFPFFSLFSPSFSPSSFLLSPPFSFFSPLSSSPFFFFFFPFSFLFLFLLLLSLSLFFLFSSPPFFLPSSLPSFLPFPFPSP

SEQ ID NO: 29641 - protein, 263 aa, A.fumigatus
  UNSURE (118),(127),(131),(134),(135): Identity of amino acid sequences at the above locations are unknown.
EGKEREKEGRKEEKKEGKREEKKKGKREKEKGEEERGRGKKKGKRRRKKEKKREGKKRRKEERGEKKREKKREKKGRRRERKERKKKKKGEEKEKKKEKKRKEKGRGKKKKKKKKKKXKIKRKKKKXRTIXIQXXPPPPPSIITAVQRRESDGAESDPVSLGYAVEFMPLGVPKDAPMELSTVRFTVLDLDGHPVPLDTVAITIINDFKGNIYMAKTDFEDTSPNRLSWKQCRGKPKCLRKLLVERIRGLFSRRKGAYSWNEA

SEQ ID NO: 29642 - protein, 81 aa, A.fumigatus
DIMLLCDSRIKVSPNRWTTNEIGLCWLKNLFIPTTSSYITGKYCLLILNSHSSHLMPQFNQLYSKNNVIPIYIPAYSSHKL

SEQ ID NO: 29643 - protein, 351 aa, A.fumigatus
  UNSURE (8),(314): Identity of amino acid sequences at the above locations are unknown.
TGSSSLLXAGSDSIMICHTYAVQVASIQKVCEAVQSGQLSASRLEEAYRRVVKLKSKFLSWDTALLTRSLDDLVTLNRKAATLASNAYSLSVTLVRSDPDVLPLSKSGHLVLLFPGERTPAGGAVDGEGLRMKGAYDATVFGEALKAHNQATVELHYGSAGLSTEQYKLVEAADAVVLVTFNARESPFQREMGLKLAQHTRKLVTIAACSPYDFLDDDSIKTYITTYEPTIEAFTAAANILFGAIIPKGALPVGSKNVALSSVHVSPFEAASDLAELAEVWNTALPTYPLPADSLHRFLTQANGHHFVARLESXIIGFCVMYMTTNRGTTCCQLAVLAIHPATNARVWAQP

SEQ ID NO: 29644 - protein, 241 aa, A.fumigatus
  UNSURE (234): Identity of amino acid sequences at the above locations are unknown.
SRYQSLTLALQEEARLAGHEYPLFIGIDQENGLVTRISPPIAAQLPGPMALGATHSPELAYQVGQVTGETLRFFGINMNYAPVCDINSEPLNPVIGPRSPGDDPEFVGRFASAAAQGLREQKIIPSVKHFPGHGDTAVDSHYGLPVIEKTREQLERCELIPFRRAVAEGVEAVMTAHISLPAIGDGKLPATLSADVLSILRNEMQFEGMIITDCLEMEGIQATSGTEQGAVLSXKLVVTVS

SEQ ID NO: 29645 - protein, 61 aa, A.fumigatus
RAQDLVEFSGACDRAYDSVLKRRAAAVLYKTMLLPEHAQYVWYVSIESGLHIGRMIYCYGT

SEQ ID NO: 29646 - protein, 98 aa, A.fumigatus
LTQLLQCLEKVLILTVDGRTLLGTLLSTDQLTNLVLLDTIERIIRTPDDPEPSSQIEHGLYLIRGDNVVLCGEVDEAIDNDIDWSKVKGEVVKGTKNA

SEQ ID NO: 29647 - protein, 125 aa, A.fumigatus
NCSSKNRICKGNFCPWFSSEQAQQPNSAFRIEMRRLMYHRSATVSSHVRGAWPSFGSEICLKTRLLKGEIESGYELNEYNVLEKYLQEDISPKTIRLGYHVQDLTASVYIDRGSSVSHICSEAAQ

SEQ ID NO: 29648 - protein, 371 aa, A.fumigatus
NFDRSNRKHRLPVVIFETQTYQKREGETDVFRQKMQDEFLNIIKNTTTLLNSVDNRRKVVISQHQFRSVFGHIGPRLSHSNSNICPLQRWRVIDSITSHCRKPTPTMKGINHPNLCVGSAPSNHSRQSRQRIDFLVCQLIKLTGSHHHGVRNIFGKTVHVGWNDANLRCNRSRSTRVVARDHVNRNPSAVALVNSAGRLRSGRVIQTDESTESEIFLHFLTRRDNFPFDGVVILPTGEAENSQALLCESFHVLQDFLLYVLVQGDRVGTSCPGDGGASLDDTFHRALGEDHLPIIIGVLKDDRHLFHSRIKWIFSFLAPNRLLAFGPAIASPVKARGKHLNRNVGRFTTSLPFIVLGPVHMGKVCHGGHVQ

SEQ ID NO: 29649 - protein, 414 aa, A.fumigatus
LNVAAMANLAHVHRSEHNEWQARGEPTDIAIQVFASRFNWGRDRWTKGEKPVWRQKAEYPFDSTVKKMSVIFKNTNDDREMIFTKGAVERVIEACTTVTWTAGSDPIALDENIKEEILQNMEALAKEGLRVLCLACRENHNPVKGEVVPAREEVEKDLTFCGLIGLYDPPRPETAGAIDECYRAGISVHMVTGDHPGTARAIAAQVGIIPANMDSLAKDVADAMVMTASQFDKLTDEEIDALPTLPAVIARCAPNTKVRMIDALHRRGRFAAMTGDGVNDSPSLKRADVGIAMGQSGSDVAKDASELVLTDDNFASIINGIEEGRRIFDNIQKFVLHLLAENVGLALTLLIGLCFKDDNGQSVFPIAPVEILWIIMITSGLPDMGLGMEIAAPDIMDRPPQSVSTSVTLSGIIY

SEQ ID NO: 29650 - protein, 79 aa, A.fumigatus
NPSLSLTYATVLTICNFGPLPCCSTMNHSQTPSFTAGPEGYCALNVAPVISKLPSIQDPPEFEVYWERNDPENPRLWSL

SEQ ID NO: 29651 - protein, 296 aa, A.fumigatus
QAILGSPIIASLIATMSPPSLTVTHITTATAVLNIDGINFLTDPFFGSIKGTEYDTTPAWEKMDLKAFGFDSIPPPPHLVNKQGPALQLHDLPPIDAVLLSHEDHLDNLDPEGRKLLDGRRVFTTMDGASNLRPRPGVVGLRPWQTVTATIGGKVFRITGTPCKHFPVGEVTGFILETDSFGVDATGKPNAIYFSGDTVYIDELREIGKKWHISAAILNLGNATFDFPTGPIQITMDGKQAVQLTRDIGADVMIPIHFESWAHFTEDREDLVKVFTEERFMDKLVWTVPVVPKVVY

SEQ ID NO: 29652 - protein, 84 aa, A.fumigatus
VSIGENRQYGSFTKECYPWMLYEVCSIGACFKHWQGIITEMDYVTVHMQPQLPGDQLPGNEAEGEAACRTLLLISSIFNIVSVN

SEQ ID NO: 29653 - protein, 110 aa, A.fumigatus
  UNSURE (30),(110): Identity of amino acid sequences at the above locations are unknown.
KQTCHWRNIVTVNALLLSSRLLGLPCLNVXLGGNMQGQGMQNKDKVPNGHVLNRRLWRSVLPSDANSELHPITRMITGRTQYASLCSRWSNLNELATAFGWRRLYRAVGX

SEQ ID NO: 29654 - protein, 86 aa, A.fumigatus
PSRKPIINMPLMDRFLVPLPDYWNNWAKKPDAGYTQEPTDISTAVLKDLWRSLLEEQNDEAEAYQSLPQRFGCEKSNRTLRANGCR

SEQ ID NO: 29655 - protein, 112 aa, A.fumigatus
KVQRNCQTWIVESADEWLIATKSAKIQISQLLAKRRCSPEQFKEIFSLSLINGNMMPTLVSGPTYNPGSAILQAGGLLKAIGDGLALKDIPLQIEEVIDDPVEAQSTASGVS

SEQ ID NO: 29656 - protein, 155 aa, A.fumigatus
AMLSRAGSTLLSLMSPTTWMQGLLNGAPYLCSAVIECWTTAPLNRWFGRRGCIFISCFISFASSFWMAAAHTWWNLLLGRFLLGFAVGAKSTTTPVYGAECSPANIRGALVMMWQMWTAFGIMLGYIASVAFMDVTHPTIPGFNWRLMLGSTAIP

SEQ ID NO: 29657 - protein, 78 aa, A.fumigatus
  UNSURE (73): Identity of amino acid sequences at the above locations are unknown.
FCGVNAIMYYSSSMFREAGFDTRMALITSLGCGITNWIFALPAVYTIDTFGRRNLLLTTFPPTCIFFFISRRXSTIDG

SEQ ID NO: 29658 - protein, 221 aa, A.fumigatus
KATSTSPVSSPDLSQNSSQLSAFFFVGLYSARHIYFLLNFYCLSATMVEKSSDPEVPSLSHHESSISIEKQGDAATAREWAQDVNSTTTNTKLKNPLAGLTREQLLNDVEAFAKEKDLEHILDDLRKGALVAQDPREFEQMDALTESEKELLRREKTHRWSQPFMMYFMTSESSRYPPTEFDFNPACQSSVLGSAIVQEMVQTAVTVAQEYVLYHYSSELC

SEQ ID NO: 29659 - protein, 101 aa, A.fumigatus
QSWISPFFVCIQVYFCPESPRWYMMRNRYHDAYKALCKFRPSTFQAARDLYYIHAALKVEEKLREGKHLFREMFTIPRNRRAAQSSFFVMFMQQASQSLHI

SEQ ID NO: 29660 - protein, 151 aa, A.fumigatus
HIGTSNARDYLRDRGRPQHQSPVEARDCGMRHIHKRNRGNISQHNTKCRPHLPHHDQGTADISRRALRTIHRGGCGFGAHGKTEKETAKQQIPPGMRGRHPERRGKGDKAGDENASAATKPAIQGCSGPAFDDGRAEIGSAVEEALHPSGR

SEQ ID NO: 29661 - protein, 430 aa, A.fumigatus
RMRGSAVPDLRARGEDICDLMNHIFTVLKTHCDKHNADTELIELSRSVLLGLQSVEPRILSSALATNDLREINRTLNELTETVFEKPSPSQCEGANLCYASTSNSANELLFDLIVFTSLMSPLGEMGSEVSNPTRTSSLTNFLLKAKSSIPKNNCSFSEFKPWDSRVELPLVVLPKRGPTSRHDWRTGIAETLTLSLRMTHNNLIQKMEEVCFDLEQRCTTIEAPLRAVEDERDQIAVQAEQLKQQKSELELQLQQASSTISELQQEIFHLENHARSTSARVEELSTSLDTARRELEDQRRTSQETTNSEREKARTRELDLLASITEKDDQIEELQEETRNLREDNNALRQILDTVSKEKNTSLEHTAALKQDVVRLEQCVEHGKLLLAQRDEEMSRLQADQGHMKSQMEALQKKVQKFLTSPAVRNTLC

SEQ ID NO: 29662 - protein, 87 aa, A.fumigatus
GFHLRLHVSLICLKSTHFFIPLCKEELAVFNTLLQPYYVLFEGSCVLQRSVFLLRDSIQYLAQGVIIFPQVPCFLLKLFDLIIFFCD

SEQ ID NO: 29663 - protein, 269 aa, A.fumigatus
RRTSPQSPPPAPPLPHLHLHHQQQMTLPPSPHHPQLSPQLSPQFPSPPHLASPLPPVIPRTPPSRGRSVDRAYTQDLHIRSRSPKTFPPRPEERSYPSTDTSDPANNLGTFRSNPRTSRIGDQELPWKLTLPSDSDEERAADAGTTATAREREGSWLESTTQQLLQSSRLPTYEEDSEVHGQPPRFVVADEKAAGDEPGDQRRGQGQGQGQVQSQRHPHRGEARAINPDDAPVELPVQRDDDSGEEITMSSTAYPGQEWRPLGFSGWEY

SEQ ID NO: 29664 - protein, 245 aa, A.fumigatus
HYPQAPIIPNFLHNSLPNSLHRRTSPPPSPQSSPAPRPPAAAASTAPIRKTFTSAPAAPRPSRHARKNAATPAPTPLTQPTTWGPSAATRAPAASATRNCRGNSHCRATQTRSALPTPARPPPHASVREVGWRVPRSNSCSRRGCRPTRRTRRCTGSRLDLLLRMRRLQVMSLGTKGAGKGKDKDKCRASAIRTAARQERSIPTMHRWNCRCSEMTTRARRSPCRVRRIPGRNGGRWGSRGGNTR

SEQ ID NO: 29665 - protein, 224 aa, A.fumigatus
DSKPSGQAELVLIDHGLYIHMDPNFRHQYARFWKALLAFDNSTLSEIAEGWGIRNSDMFASFTMMRPYSGGDLSTRQHLEGLSKVERAQRHYEMQQAARKAIREILADEHKWPQELIFIGRNLRIVQGNNQFLGSPVNRVKITGMWASRALVESPDLPWSEKLANLGRHLLFRVVLFSSDLFFYFTKVRQLLHLGGGMEDDIEKQMKDMAKDMGVDLNQSIFEG

SEQ ID NO: 29666 - protein, 141 aa, A.fumigatus
CGPTAAATSPRASIWRGSARSSAPSATTRCNRPPARPSARSSLTSTSGRRNSSSSAATCASSRGTTSSSARRSTVSRSRACGRPARSLSRPICPGPRNLRTSAGISSSASCSSAAISSSTLPRCGSSCIWAAAWRMISRSR

SEQ ID NO: 29667 - protein, 339 aa, A.fumigatus
PVVLVRQLLDLFSEIPNTLDIQVAVIKSCIDWAVSERRSFLRQNLETRLVAIYMQKQSYYDALTLINSLLRELKRMDDKLMLVEVQLLESRVYHALGNQAKARAALTAARTSAASVYTPPHLQAGLDMQSGMLHAEDKDFTTAFSYFIEALEGYSSLDESDLATAALQYMLLCKIMLNLVDDVTNLLGSKQAQKYASPRLEAMKAVARAHANRSLEEYEKALSDYRYELGSDVFIRNHLRRLYDAMLEQNLIKVIEPFSRVELDHIAKMVGLDTQQVERKLSQMILDKVIVGVLDQGAGCLIVYDETERDQAYDAALETIEKLSNVVEGLYTNQASLLE

SEQ ID NO: 29668 - protein, 112 aa, A.fumigatus
RLRGLRLQYQKITLGQILIHSYSDTPSLQYNGGAQGIGKVTYTVYNAAGYSSTKQLSQLKTTTLYGTVMMPLRGTWPYPANTLCVVPGPPISALILKIKNPPCAYRSNTNLY

SEQ ID NO: 29669 - protein, 89 aa, A.fumigatus
SPLVPKIDIAVIDFTFRLNSMFTHGIPVIKPGHNIFPQWRCVSDDGITIFIDFIIAIRRVNHLHLVTRIYHIPSNCIVRRSHPVMCVNF

SEQ ID NO: 29670 - protein, 231 aa, A.fumigatus
PFSGCFIASSRPGIRAPLADVLQSSQSSDLSDFSRPDEFSDHDEENDPIIHSFGPFGDNLLPRMASFSADESPLRGPRTSRPLQPTHSPKQPKQPSEEDSSERKSGLTDETYERIQNHAANQLAFSRLSSTPFSTILNNLPPALWKRDDRSKQGPSSEEIRAILESTKCIGKVAREGKDAAGKPLESEYYYIPDFDDDDMRREAVVNDLRKPGLRNCRKQHKVCFRSLTDR

SEQ ID NO: 29671 - protein, 66 aa, A.fumigatus
  UNSURE (4): Identity of amino acid sequences at the above locations are unknown.
YWDXNPCWKWPCSLVTKLGRPGFFGLNFFRAGIPDILKSQNFQPQYGSTGSYLSEAKWSGNLQTVA

SEQ ID NO: 29672 - protein, 303 aa, A.fumigatus
YMDPTYKYNSAQVLIWAGSCMFDNRNIFDFKAVHNIDDRPHLSFILQHAYHDDGSEKGLGYVLDEHYEPEYAVGVTNDLSAFNMHEFNILDGGKTALACLYRPEYMDLGDLGRPDEHGWVMTGGFVELDVATGAVLYEWSSVGHIPINESVQVNPWDSPSAQPGWDYVHVNAVDKNAAGDYILSARFTNTIYLISGQDGHIIWRLGGKFSDFVQDFTFSKQHHVRFVDSNETHTTISFLNNASDEGGQDEDHSAALFVEVDTSASPMTARLLDRYDRPDGGLTRLRGSVQRLSSPTGAGRTRA

SEQ ID NO: 29673 - protein, 123 aa, A.fumigatus
FLTPYIDLFQGNIEQSQLTSHVDMYGLDPTIGCQTSFTKLPPNAALLDTPKWHSRITVLATIDPDHSRINLCSNPMRSFQVSCKHGCPKAIDGIVGPTDGFFFRCEWLDNHHGAKDLLPHDSH

SEQ ID NO: 29674 - protein, 118 aa, A.fumigatus
KFIRLLAVDFYTRHTNIGSMAWNRSVSSWIIFFVFLVDETPPWFAAHDRQDQDLQVLRWLYNDDMHESDIDITALHEDIPRTDACAIPLLDIGGKNSCRSRCLGTGGYKEADLLLFLG

SEQ ID NO: 29675 - protein, 275 aa, A.fumigatus
DTSPSLVFSAYTNKNNQIRVYRYFFQYGYLTTPAVEQPPKPSSDILKPKSILTRAPIMEIDVNMHKSNSTYFSDLDVSRTALVNSLLMKGSAFLEKRLQKQGKRGLLHFVLGGVYTSFKREIPAYMKYEVQSHIASYDEKWIYIVTYFLQPRTGKKASAETDEDRRKRLLAVSISKYVLKKGRYTVPPNDAFEAAGYRPLRAPAANGTANGAANENGSLTQRKESKSGHTWDDNSEWEQLQKEIRKGKEMVQPFVDQEEKLLDDYMEKMKLPAFA

SEQ ID NO: 29676 - protein, 61 aa, A.fumigatus
LYLCWCFLQLENNLNASLVKGINAAQSSILFFRHSRGFIEYGQDKYTSVKRSRTAYSANHC

SEQ ID NO: 29677 - protein, 131 aa, A.fumigatus
FPEGDRNRDGYFVRPTVFTGTTDSMAIVREEVFGPVVIIEPFATEEEAIRRANDTIYGLGAAVFTRDLERAHRVAAEIDSGMVWINSSQDCDPRVPFGGVKQSGIGRELGEAGLAAYSRIKAVHVNMGSKL

SEQ ID NO: 29678 - protein, 416 aa, A.fumigatus
SWIRINMATTSSSATGLGGCDVLQWQHEGRPAKRRKGISMTSTCQPSPREIGIMRETERDDSATFLGSSSGIHFIRTVYSAFAKRSAVLQEARVRNQSLVPGEDDQLQRSPGKSHGLDELCLKHELSLQAPDSVSFESLVGWSRSYFEYWHPIFPFLHAPTVLKAMERVGESGIGSLDRINLAILRSILSISVVDNRQVQNSGMTADPIPSVLVYRTVQEAMESIHALLLEPSTLPLLQAVFSVQLVLTSVLRLNTASRVGGLISRTAFHLGLHRCPARFSCFSREDADIRRRLFWSIYCLERYLSQALGTPPSIQDDDIDVCYPDNERHGEIGKVPRAKGPHSHLRLLTHLAKFARLRGLILELRNKSILHSHNNTLAATYVYGELAQWWNEVYDKFYPMGKPPSRFRPNLKPWL

SEQ ID NO: 29679 - protein, 108 aa, A.fumigatus
RWFSHGIKFVIDLIPPLRQFTVDIRGREGVIMTVQDGFVAKLQYQTPKSRKLGEMGKQSQVAVRALRPRHLSDFSMPFIVWIADVDVVILYTRRCSESLGQISFQTIN

SEQ ID NO: 29680 - protein, 268 aa, A.fumigatus
DVTPDSFSDGGKHFSQDLSALTETVRHLIAAGATIIDVGGESTRPGSAPVGEAEELARVIPVIRHIRTSIPEANNIAISIDTYRAKVAEEACAAGADIINDISAGTLDPEMLPTMARTGKAVILMHMRGTPATMTKLTDYPNGIVQDVGAELRARVAAAEAAGIRRWRIILDPGLGFAKNMPHDLAILRDLQQFRTGIEGLEYLPWLMGPSRKRFIGRLTGVEKASERTWGTAATVTASIAGGADIVRVHDVREMWQVAKVADAIYRV

SEQ ID NO: 29681 - protein, 121 aa, A.fumigatus
STEEELERTRSRFGNQKGISSDEFFGRDRFDPNAQAEAKERLRQFDGGYRHFRVTFILFLREDDFATGDDTYGDFESAAKDFFRRFGITAGDDFEKLTQLVGEGAVKLQGTYRYSVVDHNL

SEQ ID NO: 29682 - protein, 199 aa, A.fumigatus
  UNSURE (168): Identity of amino acid sequences at the above locations are unknown.
QGRQGQIHLQRCCQVQGGVEKTGCAGCSTVRHPVILDSITHTNADLVLFRYPEEVVVTDIPAGTASDGSSTPAGDADDDFFSSWDKPSIKRPSNPPSRTGTPPVVSRTASPFLNAGANGNGARSKSPLSASDKEATSPAPTAIRASASVRKASSTTTAKKGSVLGAKXAPKLGAKKIGRGGSHRFRGGGTKGKGGGRAH

SEQ ID NO: 29683 - protein, 108 aa, A.fumigatus
LLSPSPQSWCPYLLCSFHEPRPYGTLLPQPLSHVLKTNYLFTEWQWEQLRIMKVGGNESATKYFQSHGGSAALASKDVKVKYTCNAAVKYKEELKRRAAQDAQQFVIQ

SEQ ID NO: 29684 - protein, 143 aa, A.fumigatus
  UNSURE (4): Identity of amino acid sequences at the above locations are unknown.
ALRXRLSWVLRRLGGAEAIDFEEAERKAKEEAERIEKLGYDPEAEQAEADAKAKTSTAATAIASPTPISPGAGGFGSTRKSHERSASEVERLGMGIGRLGFGQTVGAKPAAPKKLGFGSVAPVRSAEDGLFHFCHLWASFIGF

SEQ ID NO: 29685 - protein, 91 aa, A.fumigatus
DSGAEFNARQKEFRENLEAARKKREQQESQSVDASGSTPASPAIRDRFREYATAPTAPRLSNASSELSPVVDAADVLDSKALGLLSTHRSV

SEQ ID NO: 29686 - protein, 125 aa, A.fumigatus
DEQLSEANQSPKRGPLSSLIYGTKEGQHFDKDIERSFSQVLARGKYVHSIVFHDVKPDKVDEYVALVGEWYPRMANTEENRVNLVGSWRTQVGDNDTFGISLYEPRNRQWSPLPLKVVSIEFFRC

SEQ ID NO: 29687 - protein, 166 aa, A.fumigatus
RSLPEVHIWEYQRYEGYHASLHNISQHPEFPAFDRKLKSLIKSKKTSLMQEFSFWPTTPPRRLGGLFELRSYTLHPGNLLEWETHWRRGLRARREVMEGVGAWFVQIGDLNTVHHLWQFANLEERKTRREQSWGIEGWAETVHKTVPLIQSMQSRILIPMPWSPVG

SEQ ID NO: 29688 - protein, 145 aa, A.fumigatus
RTTPSSQPTHGYVAPEILRGQLTGYQRMTSTEVSNGLVLPYAAMAIAGKGGAAAILLITFMAVTSTLSAQVIAVSSILSFDVYREYFNRHASDRQIIRASHFGVIFFAAFSAGFSTMLHYVGIDLGWTLYMLGKYRVVTTFSRDN

SEQ ID NO: 29689 - protein, 112 aa, A.fumigatus
DWCAYCGGHIPLACGCDRLYLRRWHQGNVSAELSRQEWHLTLRRRFLTDYFHTAVILTIACYFSVKAVTVGEVSSIGHLYELVKSASERHPVSGNHAATYLTMTSKGVRHLP

SEQ ID NO: 29690 - protein, 108 aa, A.fumigatus
GILFGILHICSNFGLVIVSARPNAMLPLTHQMDTSFFIKAFSAAPSAVVPGYTIGGIAYFAIPWALGTIMSSVALGLENNPIFPTYPRVCSPRDPQGPTDRIPAHDID

SEQ ID NO: 29691 - protein, 61 aa, A.fumigatus
PWRSRHGSQGVLDGASNASLDNEFGTHNIDDCIVKILERGTFQTYTVSLLSKSAGIAYGKS

SEQ ID NO: 29692 - protein, 78 aa, A.fumigatus
VNIVNNVLHTRSLCFSDFYDRGTFYVAHRLWQFQLFSQQKGFCNEFPLLESFVGLIDALDCWAQTIQLIIKTELEKEG

SEQ ID NO: 29693 - protein, 76 aa, A.fumigatus
TQFFVRSALSRSIRSFDNIYSIDIIQPLDNMAYHKRPTSNYQPCDSYFVEFYDDFPAPRIDPKEHAKLVGRGTTVC

SEQ ID NO: 29694 - protein, 381 aa, A.fumigatus
  UNSURE (359): Identity of amino acid sequences at the above locations are unknown.
EEVQSNEIFPFHSFHRPRLSSKVNHPSQITAANRLTHPTMKENTCIQDAMGPKLVLTNAISEYNPLPCSKYSTPKTGVFSIMPRRWIPYAELMRLDRPAGYWAFYWHFVIGLTLAANMSSPIPSPLTLVSLFLFFAVWVIILRGAVCTWNDTLDQDFDRKVSRTRNRPIPRGAVTTIQGHLFTLAQIALGTAMLLPLPLGCMYRAALMTAILLVYPLGKRVTDFPQVILGIAFGMSIFVCSAALDADPHPLSGLYSLGTETDDLRLVTALCFYIASILWTAIFDTIYAHQDAKEHAKVGVRSLAVRLGERTKHTLSVLAATQVMLLSAAGIACNFSAIYFAGSCLGTAISLAALLWVCXSCGIRRTARGGFGRGSPPVGCQ

SEQ ID NO: 29695 - protein, 66 aa, A.fumigatus
TFLQAYHYHKVRLTAKAIFTVSVRDSGPSSPVFELSKTNQYIWQFDQLSAVDLRCIKPYYSNTIAF

SEQ ID NO: 29696 - protein, 66 aa, A.fumigatus
TFIFCFRALGRALLSRVLGRRTFCCLPVFRDNDIWLQMQMKNVNKGISQIRLENMIETSKTAALDA

SEQ ID NO: 29697 - protein, 99 aa, A.fumigatus
LPQPCRFHPSCTDVYEVSSLFGNIFLLRSPRKWHTQRLNMLTTRTALHETGKLRRVTHTFTPNPGLYLGITTDCLIVNDLPILQSESGSCPVLGHVSHL

SEQ ID NO: 29698 - protein, 74 aa, A.fumigatus
GKIYTACGQGKIPFISVIDIIAITYHALIDPNSHNYDHQVLGPELLTYNNITKKLSHVLGQIIKHIKLSGEEQY

SEQ ID NO: 29699 - protein, 424 aa, A.fumigatus
LLISAARFLAPTIITTAPTSNELDQPVKKKPKFKILSGSKKSSSDGPQMYAQRQSPGTRSRHGTQGSTGSQATDATLATSKMSGEEPGRLSTTSIRSGGREPGNESQRSSVTDARFSESSRSDQSSGDHGLYHSHSPNDGTLSGGKRFRMPRLKRNRGPLFPLPPRPAGSQPMNGHGQDSQTSRAISSDPSPSFEPPDEKDQDRVSPLPSPSRSTVGLASPAFPLRRKDSANSANSARSATSTGSGHRIRLRPRSSTLDSLANLREDGQQSPAHLASSGRTSTSTSGRKSFGDIFSISHRLRQNSEPPVMRDGSPGVRRSDTPVHKLSYPEREENDTPATYLTRLEESIPKSTIAGVLCQSNEDFYKTALRKYMRRFIFFGDPIDMAIRKLLMGAELPKETQQIDRFLQSFAVFTTGLEGQRWS

SEQ ID NO: 29700 - protein, 140 aa, A.fumigatus
FPLYPEETDAQISSFIISFPQGSHYLPNIIQLLAPPFSYVPTNLSVLGFPFSPVCFPFLGISNVLLGRVSASDPRTYYYSILLDAWQCKGCINPLRLFICLSTIRGSLAQSSAPLFPLFSLFELSATSLLDSRQIARFSS

SEQ ID NO: 29701 - protein, 278 aa, A.fumigatus
FILAFALRPLFSPLPLLPRGLHHLHQRLLALAAPRSFILLLLFRRQLPLILLLVFRADFAALLGELGLEGPKLGAFGVHPDEGLEEGDFAGPDRRVRDESFRASGFRLAPLGGLFLAGLFGLGCRVGVDVGLNVTWFVLDVGGGWVGGAVDGRLEDHGEAFEARVVHDVVEGAETQEACADVGVEVAFAAAWGLGVVEVQGAEVLQTDLVFELLHEGLVACWRGEVVSCCEAVAGIYADADAGVMLARDQGEEVPELGEVAANCGAMAAHRLKDGNDG

SEQ ID NO: 29702 - protein, 67 aa, A.fumigatus
PRCRHILPHGSYLVNLAQEDKVKAKQAYDSFLDDLRRCEALGITLYNFQLGSDHHHQNQPGRSLTIP

SEQ ID NO: 29703 - protein, 137 aa, A.fumigatus
DDVRPWHHNWRLPLRVPGPPRLDPARASPPHRHLHRYLPQLRSRIRPLLASRLPVLHEGVRRPNRSAVPPRPAPQRLQGPTRQQTRPPRQHRHRLLGSPRLPQHHERPAPRRPPHDPRDAHRPPRQPNPRQHQGRTK

SEQ ID NO: 29704 - protein, 335 aa, A.fumigatus
AQITTTKTNPAVHLPSHSPGSANQSSLPDALSRLAKALTNALEATSTVVPVLETMCGHGTTIGGYLSEFRDLLALIPREHHPRIGICIDTCHSFAAGYDLSSPAGYQSFMKEFEDQIGLQYLRALHLNDSKAPRGSKRDLHANIGTGFLGLRAFHNIMNDPRLEGLPMILETPIDRPANPTPANIKDEPSDVEADIDADSAPETEQTSKKKTSKRSKSKAGGAKALVPDPSVWAREIALLESLIGMDPESPEFRALETQLAEEGREVRAKHQEQYERKLAAEEQKKNKAAGGGKGQKTLMEMVQTAGKKRKGAKKRPESESENELESDDEGCQSH

SEQ ID NO: 29705 - protein, 71 aa, A.fumigatus
EFLMPCITACTLGTIRRLWPIEWILADVPSSGNAFALFLKSQRKWENPPLQDDHRDQFRQLCLEHKYDGAK

SEQ ID NO: 29706 - protein, 136 aa, A.fumigatus
LSTWYAPYCQHTRQRQHLTAKQSQSSLPSPTNSAAALSFLTSVGGIIGYTRTGSIPSIAAGLSVGALYLYSFLRLRDGQPYGEEIGLLASAVLGGSSVPRVIKTRGKPVPLALSVLATYGLVVFGLAFREKRASRI

SEQ ID NO: 29707 - protein, 94 aa, A.fumigatus
QQNSRNPPSLVPRTPPLRCPSSPRWAESSATRVRAPSPPSRRVSQSARYICTVSCVCATDSPTARRSGCWRRRCWGVVLCPALSKRGGSPCLWR

SEQ ID NO: 29708 - protein, 75 aa, A.fumigatus
ESRSIRHATLCIPNSKSPPQILEALFSRNANPKTTSPYVARTLSARGTGFPLVLITRGTELPPNTADANNPISSP

SEQ ID NO: 29709 - protein, 70 aa, A.fumigatus
INDTMPICIECSYPVSHLYSTYSRADDRSLGKGVRLTQCPRCKRFADKYVEHDFVVLFIDLVLIKPQVFG

SEQ ID NO: 29710 - protein, 412 aa, A.fumigatus
SAVPSSPVCEDRMGRLQKEVSLDRVILLDPLGGIPAFNRRQPSHVFINMEQEYDDIENELLQAREMVPATETSLLKAGPNSVADNNPISKFVHAEVVPVPSGSTPELKTAVPQRSAIEGHLENLRVAQKALAMLPAASSGIITSPFEVASSAQTSPTSEFSAVGTRRQRNPLIHNLLTDKPLLSSSLPMSRRGPTNNGQGAVYPVTSHTTFVKRGMPLTMLPNPWTEPWTPQSRPRLKLDDPSIDLPRLVHLIEDSFDRKLDVQDYLNRVNDRLAGLIIAGEYEGGAILTWELPPGVEDDGSEASNARMVPYLDKFAVLKRSQGAGGVADIVFNAMVRSCFPNGVCWRSRKNNPVNKWYFERSLGTWKLSDTNWTMFWTTPGLVEDSQKFRDYEAVCRSIQPSWADDTGVVD

SEQ ID NO: 29711 - protein, 345 aa, A.fumigatus
ESADTKLQMKAAKRFKRLLGPAKAEPVMQSILGQEYESRFVEPPLAMEPEESVSSSDILMGNRSQSVTSYNRKPLEREEVLKGYHQKYEKSPEISDSAGKYTTQQDLLLSISTERSVGITPERQDSSSITSYKPCTKLVDDLQANFSRQSPSPQTTLSRASSATTKRSVEGTRGHARDPLEEAFPYLFIGPSTYTGSDPEDIDMERNADQSETFRSDEPLETSLAGDEVIPIVSESPGAADFDIYETAYRQEIARIRKLTLAREGTLPKVYLTRRVEDKDEVLRLVEDRSLDTNYETAAREADTVIGEKIMAPSSPRSGVSMIKTQLDGQLKLTANEAHVQQRLE

SEQ ID NO: 29712 - protein, 489 aa, A.fumigatus
RQSQSVKNQIKDLQQQLKDADSQQRWSAEREVELEEYRRVLPRIEQECSEIQNLKKQLEFNNHALTERLSSAEEQRERDDALISELRERIRELEGSPGSPSLTPGAETPKRGTLQEDFEGIGIQESQLSVLPTIFEEAELTDSSKAENDELRKDVESLKEQPSVSWLEEELGKFAADDADDEPQIGSQFERFSENFSQIHRLAQANSSQGYVIEPLFSPRTHGTFSDEYWKLYEHYTQALGKLADAQDSLEITKRALTDAMAEGELLIYTAYKTSRQSAYETTVGLAGKEKVDMIHEVKESNSAEVAKLRAEWDECQHRIHSLEAELDASQELVREVCAERDELRSLFDKKQAEIHAEDKEMSNEMKRLLAELMAQENGDSADASQKSGPELAKEVAELIEKYLEKLAKRAEVSKFTPLPSNGAGPTHSGKGISESSFTAAVNTGLRAQPRRVPDFDAECTNRENPAKPLKRDVPSSRWKCLMSRFKRS

SEQ ID NO: 29713 - protein, 101 aa, A.fumigatus
QLRFLDAYALKVFLQCASLWCFGSWSERWTSGRALKLADPFSQFTDQSIISLALFFGTTEAFRKRMVVEFKLLFQILNFAAFLLDAWKDSAIFLKFHFTFR

SEQ ID NO: 29714 - protein, 147 aa, A.fumigatus
ICEKFSENLSNWEPIWGSSSASSAANFPNSSSSQLTEGCSFSDSTSLRNSSFSALLLSVSSASSKIVGRTDSCDSWMPMPSKSSCNVPRFGVSAPGVSDGLPGEPSSSRIRSLSSLIRASSLSRCSSALLRRSVSAWLLNSSCFFRF

SEQ ID NO: 29715 - protein, 271 aa, A.fumigatus
VIAFRDWRVPHLTAVEALEDAVFRQERPQENRPGSDTSAVAAALREGMEMLLGHLQQPHSRKRQCEDSVSDAPRSPCNKRRRVTDTLVEPDEFSDLSSSLPPAAVLEAVVDAYFALVQPWIPIFHEKRFRRRLRSPDKARLEVVLHAMVVAMLKHVDQSVLPADLHDIEAVCERSRKIVVLTAMDDLYVENLQALIIICFEDVCWMPLCDLPPLTGLDWIRQSLSSVADRRLLDANGGVPSVERSVRKTTIPDESCNPRPFLPTGGRLGGR

SEQ ID NO: 29716 - protein, 83 aa, A.fumigatus
SFKISLISETLFCCVCLMETTKDWHPHCSYSYSSYSSCYHSYQLLPCIAAAGPTSSKKPLLPCQGPQCSETLSKTYLIMNLSY

SEQ ID NO: 29717 - protein, 61 aa, A.fumigatus
ARAFADGRYGDAEDAKQVDQRPFQKRIVLVKIYLEHDFSVSDSLRRISAECRETVALGQER

SEQ ID NO: 29718 - protein, 171 aa, A.fumigatus
DICPFGNALLVKKLPGEIIRQSLENSVSDKHTDGRFLQISGLRIVASWHRPEGSRIIDVQLERSDGRLEPLDPRRMYTVAMPSFIAQGHDGFTWLPQLETIVNEEAGMTDTALLLDIFGHSEDPYGGDCESSSHALGVERARNLTIVGRSMSDSLPVVKPAVEGRIRFVDA

SEQ ID NO: 29719 - protein, 61 aa, A.fumigatus
PPQQPHSASLPTAACPWWCGYSPLTMAAFVRVSGPPNGNFLIGYPGISATMVSAGQNNVKP

SEQ ID NO: 29720 - protein, 70 aa, A.fumigatus
QYEGCDNMAAALGAFRLSRRRLEIILLLIFYIFYLSPASVKYLMGNEFRVDLGQYWHRYELMGQDYETIY

SEQ ID NO: 29721 - protein, 233 aa, A.fumigatus
PNLVIFMILMIAKVNQGLQGTARDILTTYWQHIINHLESDNHDYKIHQLPLARIKKVMKADPEVKMISAEAPILFAKGCDIFITELTMRAWIHAEDNKRRTLQRSDIAAALSKSDMFDFLIDIVPREEATSHAKRSSQTTAGAAGSSAATGAQLPPSQHGVQHPPHHMGPPDYGSLGQHGMGQDQEYRQPTMYGGAVQSDPTAAYGQPQSQIFEGMYNPYPHLPPQQVCQNSS

SEQ ID NO: 29722 - protein, 156 aa, A.fumigatus
DELPSNQVCDTLVERLSSQYLGQIVQILINLEHFESACRELEELLAAARSQGAAGGPISLRATEKFRSNKKAAEKRIFEVVNSKIDDLIETAEYDWMALTPPTEPSNYMQTLTRFLSNIMNSTLLGLPTEIKELIYFDALSHAANMILVIPYYSLI

SEQ ID NO: 29723 - protein, 70 aa, A.fumigatus
KYHTSIFFAVSEMQNILQWIADCPNSTTWIDTKMSTSKERAETGAKNYAPYLYTYLQVRDTLCVLFYCLS

SEQ ID NO: 29724 - protein, 226 aa, A.fumigatus
LIPSFAVLRELRTLFQNMITSSNSFVTPRPELARLTLISPSNEAAIRRRSTISMTRPGGLGEINGMPIMGPLGPPLPMADQTQSPTDAETETPKRKTTSDVDSEATLVSETAKPDTSLGPSEDKENEVPPADAMLTDIPVSQDIESNLSPKDETPAIAFGPPNQPPPVPPRPTIQVDPQKQLLEEVEIGAQQDVTEVINNVLFQSQCAIKPIAFAQDGEQLDQVKE

SEQ ID NO: 29725 - protein, 157 aa, A.fumigatus
HMIASLFYGRTKSYILAEAGARSKEEWWCDIKVDVATGPRDIYSAIDGAFDAQKVNVDDTVVEQFGAISKLPPVLQIQVQRVQFDPVKKSSFKSTHHLELKETIYLDRYMDTQHPEIMNRRRQCWEWKNTLKTLEDRRAELLRQTVRDDIYQCCVKN

SEQ ID NO: 29726 - protein, 82 aa, A.fumigatus
VLLHRRMNRAFVSGESGIAEEVSVSSPWRKTVSDPLYKFRYITVLIIEQGVTNVEQAEIFLGVDSTTSDEFVLTMYTTKVKG

SEQ ID NO: 29727 - protein, 294 aa, A.fumigatus
MLIVFRLMTTRRLGTLHGVLSKLMQKGRNSAVLRHFLKTGEMTTGEMDVADAYRLLQIPDRTVDDAAIMAAYTICVDEAPGQAERYYQALSIIAKEKNSSLLSSMIAGPGAESGRDLSEWPVGLQNIGNTCYLNSLLQFYFSIRPFREMVLDFESFRMELDDESLSKKRVGSREVLKKEVERSQTCRCCPVVCTISERLTNSFIRSPERITDAVSKHDHFIKFFCDSSSGVSTFDANKPVQRGSNSAPVDDIYDPTWRTGRDQRHAYHGSPRPATANGRSNSKSNRCRDRDAQT

SEQ ID NO: 29728 - protein, 174 aa, A.fumigatus
VDLILNHMFSKGCPPTTIISMNARYDPHYHMKVGATLRPLRYENYLLIGTGGAVHNLYRNRWAPMLRFRDNFAMETPPEEWALEFRQAVEDVITKTSGPALRRAMTRLMKHPQYRDAHATDDHFMAAMFVAGAMGDFEDTGSPAVLGAESWELTNMCNSQFTLGSWSKDIAVYL

SEQ ID NO: 29729 - protein, 173 aa, A.fumigatus
SLLSLTVFRSGPLAATYAFGSASAAKYITQFIDAAVSWINHVPVDMLSTSSFPFPSTQLTDSVGPAYPINTAPSTETRYTPALFQVPRPQFVTEANTSALVRSILDPSDATRSATAWREALAPLPSTGQRPGRRIGFFEQGLITGGVITLATLIATVSTVGWYTFTYVRRLRA

SEQ ID NO: 29730 - protein, 172 aa, A.fumigatus
SARSSASAAASPPSPPPPPPAQSKSATASASAPRACPAFALTASPAPKAARTTAPASQAPTTAATPDKSKAYGGFAEFWRGPAHFAFKIPDALPSAAAAPLLCGGVTVYAPRRKYAARPGTTVGNVGIGGVGAYGDTVWQIHGLGTAWVAISRSSKQTGGKAPGRGLGATFL

SEQ ID NO: 29731 - protein, 79 aa, A.fumigatus
PLLSPVERFHLSTTNLCISDGNTLRTIRRLYTEYTRTNYKFTLKTSSYPINDVLVTTQNISWLGCPRRHQPSDIHHLRT

SEQ ID NO: 29732 - protein, 230 aa, A.fumigatus
RPPHIQSMMSSSPPKTFHGWVARDATSPLTFTTFEPKPFTETDIEVKVSHCGICGTDIHTLRSGWGPSDYPCVVGHEIIGTVVRIGRSVPTLASSPASRTIKVGDRVGIGAQSMSCLRADCEPCAEGRENYCPRITGPYNSRYARQEQSIRRVRGILARACTLCVQDPRCAALRGRSATALRRRDGLRAAAEICCPAGDNRWECRDWRGGGIWGYCLANPWAGNRVGCNL

SEQ ID NO: 29733 - protein, 211 aa, A.fumigatus
RSVRPTNQHESSARLVRGAQEFTMRGSKQLTESSIFRSQPLCILVGSEQIRLSIHSAVVERFPQPLREDLDIPGRIQGEEPIVVRNIDLDTFALYCEYVYTGNYSISETVLASQNSSQVSLQLEEANAQAFDGPFAVVVPKHPRESRTLLPTLFIHSWIYIHAAKYKWESLKSLSFQKFQNALETSPLTAALIDELAPMFCFISEQESESP

SEQ ID NO: 29734 - protein, 61 aa, A.fumigatus
  UNSURE (21): Identity of amino acid sequences at the above locations are unknown.
GPEPTPVCSLGVAPSPPPPPXEGDQETPKRVSPPPPTPPPHPPPPPPPPPTTAPPPPPTPP

SEQ ID NO: 29735 - protein, 268 aa, A.fumigatus
  UNSURE (80),(228): Identity of amino acid sequences at the above locations are unknown.
DYDEELVVACDLLCESSFLIRIGRVEPVAQGMRRRGRKVRGGTKEIVEGNFLKEKEMWKIKKKKDKKFRENITIFTDSSXKEAEYPPGRSLTECSQAPIQWHHYHPHLPALRPLTPACPCLPSDPHPSPHSPLPPLNAPPTPPQPLPAPLPAPHPPPLLAPQRHPPATPLLPPPTPPHTPSQCFGTNQTNTTHPHHPAPTPDPLSFKGLSRHRFVPLAWPPPRPPPPXKGTRKHQSECPPPPPPPPPTPPPPPPRPPPPPPPPRPPPP

SEQ ID NO: 29736 - protein, 96 aa, A.fumigatus
PISCFLCRIKNPLADLTPSQVIRDVEEFANEHDLIDILPELKKGALVARDPEHFETVPDMTEAEITAIRDETEHKWRQPFALYFTIILCSIGAAVQ

SEQ ID NO: 29737 - protein, 135 aa, A.fumigatus
  UNSURE (41): Identity of amino acid sequences at the above locations are unknown.
GGGWAGGGGRWWGAGGGGGGGGGGGWGGGGTLALVFPGPLXGGGGAGRGPRQGNKPVSAQALKAQGVGRGGGVMGVGSVSLVSAKALGGGVGGSGGGEEGSRGRVALWGEQGGWVGGGQGGGEGLWWGGRGVEGR

SEQ ID NO: 29738 - protein, 172 aa, A.fumigatus
SQSFSCIKTWLTSMSRGPYIASAAIGCWLSDPCNAFLGRRGAIFISAIFCVLTPIGSAVAQTWPQLFVTRLLLGLGMGLKASTVPIFCAENTPASVRGGLVMCWQLWTAFGIFLGFSANLAVKDTGDIAWRLQFGSAFIPAIPLLVGVYFCPESPRWYIKNLHHGGGRIRAS

SEQ ID NO: 29739 - protein, 329 aa, A.fumigatus
GPLQVGRRLASNFTKGRIHLAGDAIHTHSPKAGLGMNMSMQDGFNIGWKMALVAKGVARPSILATYELERKRTAQMLIDLDRRLQPLFVKQQQSDATESTAPSNGKETLIDVIQLSIAFANGYACHYGPSSLVHKGGENIAANLIPGERFPPVKVRNQADGQAWWTTRLFKSDGRFRIVLLAGDLRHKYQRQRVEAFSAHLASAESVLQRYRLEGEKLDSLIEVITIHSAPMREMDFPDFPEMLRLFDQERGWAYDKIWSDDDCFWDRQCTGKGYETWGVDRIRGALVILRPDQHIGWVGNIEDVDEMTCYFEQIFQPPQKSVNMEGNA

SEQ ID NO: 29740 - protein, 89 aa, A.fumigatus
LLVADIRRVCTVETEHGTLLIIPRERQLVRLYLPLQVVDGISGSLDRSSVTLDMVRQRAKEMLRPFDFDFKVCDWWTVYQVWFNSNSAF

SEQ ID NO: 29741 - protein, 69 aa, A.fumigatus
SDIPLYYIDQTIQARFATADQRRVLIFEFNPFTWQYALIFSTTCFDRHIGHALLPSSYSQLKARDVLIG

SEQ ID NO: 29742 - protein, 156 aa, A.fumigatus
VSYSDPSLRCSTNGPSPIFRSVEFASDISVTEHDVQALARLSSACAKHFALSNDLYSYPKEVIAEKENGEPLVNAVKVVQELMNVSSSSAKSILRGIILDTERQIGEEYESLVNAKSTTLSQLVYARGLIIAVAGNMFFSATSYRYAKAVDGSRLM

SEQ ID NO: 29743 - protein, 101 aa, A.fumigatus
TRQRGCAIDCPAQVYSNKSKVFNYKKMESDYKHGVSCQEITTGAHRSPSVLDSECHDIVIRHVMITKLSISYALLNVMDQINVKDLHILVLGVLVLSIYPN

SEQ ID NO: 29744 - protein, 422 aa, A.fumigatus
AYACADAGSCGEDYRACDTCKKKKIRCDGTIPCTNCTKRKVSCAYDMKYGRGRPPTPPSSAAIREHQNRLRSNYSYDLSNWQPPVSVAPEISSPLVHSRASPTGEIEGQYFDPTSGLNFLHRAWKKLLTTQNDQPASYRLSVAEQNQLLTSAGDRPFHIESDALDSFIPDASTARKLQQFYFETCVVTYRMFHRPSVEGWMEIFLKDGQGAGPTARSLGKAKTATLLTIMAIANLRLHRVSGETSTEAESLALKRSDHLFCAGMRMTEEEIGFPRLESAQARLVQVLYLLQTSRINKAWYTFGNAFQITLSLGMHRRRDQKRDYPFTSRRQDYITSECYKRTFWVAYTVDRYLSVVLGRPRLYQDEDIDQNFPDIVNDEDMTPDGFSISDDPADCYIDALIYHAKYITTPADHHNTALLIRL

SEQ ID NO: 29745 - protein, 238 aa, A.fumigatus
SFSKFKAGIADRLTSLQNEADAARMEERQLAVEMDQLREFEREKQNSRTRIKYMEGYFNNAQPPPTSDSESNSGSDQTTPVRQYTNQQKALLAQEYHDHECMDRLHSAKIKVLRDRQEIRLQEAIARMARELDALIDKHALEFAELQRQHQQEEALAMHAFEAKKTKLRHRWNLEEAILRKKLELQHGHPYGPLPPLSFSESHYETRDSAICVSENSTNMSGDEQTHPKESEESEPVH

SEQ ID NO: 29746 - protein, 278 aa, A.fumigatus
NNEDEALRAWRSALDTISYHNAYRLSSTYTPKNETEKALQDSIRQLELQCRERVDLLEALRESRKEAQEKDSPTTSGISHRFFKGKSASKPPTSNTPGWIGDGTVPPVDYTDLSRPPPIPGRPAPVTQGSSESVIQDSSVASATSLPALRIPSHSSAKNQSRNSSPEKRKTMPTTLRKSDGHKKHSKNRDTLRRKDLRPAASQAAGLAWGNIYRLPSASGNLASDAAATSSRQSISSDSGFRKDSGQFRSHSGDELVSKKNVADDSGLHRGLQGRSLP

SEQ ID NO: 29747 - protein, 113 aa, A.fumigatus
QSCLPDSNHPTTLPASFRTSFPLRLNPLYLARRSESLTTAAMRLPPPQVLLTWPTPNYVDPLTRGNGALIVNIVCLSFAFVVTLLRLYTRLKITYSPGLDDALIVIALVCAKT

SEQ ID NO: 29748 - protein, 65 aa, A.fumigatus
LKPSNDTTGLFSDLFSFTTEPSVFGTSIRISNDRRNETATSPGSAYMADTQLRRSPHSREWCPDR

SEQ ID NO: 29749 - protein, 254 aa, A.fumigatus
RAITFQPPPCKTNLGSDVATEWKPTDNSDSICQKVTTRNLIKSTQMSKAGSTDLAAVGSLAAVTDKVDTHFTLGGLNGGVSLTRRNGVSLGEEKEVVDQRLHVLLHGGTGRGRDLVVFDADRTSGHLVQALVNDAQGLAELLHSAKVTVVAVTVDTNGNVELNLIVGIVGLRLADIPRDTGTTEHDTSETHVDGVSCGDNTNTLSSSLPDTVICKQLLGLVNAVAELGGPLVDIIEKAKGKVLRYATRANICSM

SEQ ID NO: 29750 - protein, 192 aa, A.fumigatus
TGTGDTLVELLLKMKGQCIALNPYAIKRKNATYHELLTLLETPQERCQSTNVHSMGKNRHEVVQDTRNLAEHSPNPLGSLGNFDVKQLLNSQREALLIRHHGNIVKTIKVGQSLHVGLVLDQLLGTTVQQTDMGICADNFFAIEFQNQSKHTVSGRMLGTEVDSVVTDLAVDSFRLRLKIRGSLGLCGSLVG

SEQ ID NO: 29751 - protein, 308 aa, A.fumigatus
RGYALETIGRPTRGGVMTRTIYHVIIQFVPQPPSVSSHRPSCKSASFTTSGLRTVGQFDPSSFLAIFRMAASFARLAGSAPKKLCLRPSTFARNTRSISTTLPRRYAEPTSYQATRLVPTDSTFTHLANKATAESEAASNLESQAEGVDRKIRHYTVNFGPQHPAAHGVLRLILELNGEEIVRADPHVGLLHRGTEKLIEYKTYMQALPYFDRLDYVSMMTNEQCFSLAVEKLLNIEIPERAKWIRTMFGEITRILNHLMSVLSHAMDVGALTPFLWGFEEREKLMVGGIFSLNRVWVESNALTFHLQ

SEQ ID NO: 29752 - protein, 249 aa, A.fumigatus
EFYERVSGARLHAAYVRPGGVSQDLPLGLLDDIYQWATQFGDRIDETEELLTDNRIWKARTQGVGVVTAADAINMSFTGVMLRGSGVPWDIRKSQPYDAYDQVEFDVPVGVNGDCYDRYLCRMEEFRQSLRIIHQCLNKMPAGPVRVEDYKISPPPRAAMKENMEALIHHFLLFTKGYAVPPGETYSAIEAPKGEMGVYLVSDGSERPYRCKIRAPGFAHLSGFDQISRGHLLADAVAIIGGFPFCCHI

SEQ ID NO: 29753 - protein, 191 aa, A.fumigatus
  UNSURE (37),(58): Identity of amino acid sequences at the above locations are unknown.
KISPRNFRNQKKNLGAPPSDNSHEVVFFSKGRSISRXYFARVAILLGCSWRKCLFPPXESKEEPRGIYTEHEMFKVLAALYNCLYFDIDKTKSYPLHHASQAVGEPLGKALEANVKALGGSSLLSGIFRSFRENKNALKEYGVHLTKQLLENGLGAHEIAWAQFLPTVIAMVPAQAQAVSPSPNDCAPRDN

SEQ ID NO: 29754 - protein, 106 aa, A.fumigatus
AKANRDASVFPDPAEVRLDRPMNSYINPTLGPHGFLSKETSHIALTAMLRAVGRLNNLRVAPGVQGQLKKIPQPGGYSAYLREDHGSYSIFPTSECSRLPLAHQSC

SEQ ID NO: 29755 - protein, 94 aa, A.fumigatus
FTQIVDFYLSKEGSKHLPAIQRLAKQDTKKSDEQLLHYCLEAVRLNDMSGLYRQSETTLAVTDEAVEVTIQPGDKVFVSFVRSTPLVLYYPASF

SEQ ID NO: 29756 - protein, 190 aa, A.fumigatus
  UNSURE (177),(186): Identity of amino acid sequences at the above locations are unknown.
DTGNKISRRSQIHGTQHIILGGKTVIQADAVIRGDLYRSSSSAPADGSGGGSTRPSQPSTPFVAITIGRYSYISRQAVLRPPSRLHRGVHTFYPLKIGDHVFVGERAVVEAAMVGNHVHIGREAVVGSMAILKDFAYVLDGAVVPAGMVVPSWCVVGGAPARIVGEVGEGYGVEGAXGGMATEKYXMVGR

SEQ ID NO: 29757 - protein, 103 aa, A.fumigatus
  UNSURE (11),(19): Identity of amino acid sequences at the above locations are unknown.
TFRVIYRPTIXYFSVAIPXSAPSTPYPSPTSPTILAGAPPTTHQLGTTMPAGTTAPSSTYAKSFRIAMLPTTASRPICTWLPTIAASTTALSPTNTWSPILSG

SEQ ID NO: 29758 - protein, 67 aa, A.fumigatus
RLNCVRFLNYPCCSHHLHCTYHYYATLDYKANPQYPNERYLSRVKSWHAHLYTSYKTKLGTARRSLA

SEQ ID NO: 29759 - protein, 482 aa, A.fumigatus
  UNSURE (445): Identity of amino acid sequences at the above locations are unknown.
WYPLGSPDLSIPRQQTSDSTETMAAESERSPYPNGSSDGPGVAQDDDEATSFTSRRSASESDMVELPRSAFKSRTQASTLAQLPKVSSAVPSISAPPSTTNSARSSRESSPIRSSRRARNPTSAPRTSRSRQNSQDRSPQRSLPVPTASAVQRALSQPSSKPLVLSASPNVESSSNVPSPDKSNNMPLWGSTPPNTSSKRSLPPSDDLATRGDRSAPRNVSSRISAPGSALETVEEMTSDPSTPSADTILNQPLSEEPKLQKIDEDTTPKASRHNTNVESGSDSGGNKSSERMEDTRRWVSTGTRRSDSLLAKRSTTSLSGARGKPAEGSVRNMIVETETVTSIPQVSLGVVPGERGISGRVDSGTLRMKPSTETIRPRKEKRKTRKPAALASGAASSKADIFEAKVASAVDEADVSDSDETFVYESNPPDPYPVRQNRYHSRTXSATSMASQVDQLAGRARHSMRDSTHSITRQTQHEIHK

SEQ ID NO: 29760 - protein, 77 aa, A.fumigatus
QAAWDPTTPFTTAIGPLGPSSGIRILSFRTCKADVVVGLKPGEDEKLRETQGGDNPKARKWAWSGKYAVISFCDGKA

SEQ ID NO: 29761 - protein, 343 aa, A.fumigatus
PGIGAEGNALMAECVVVVLRMLSLCVSKYIYVVMRAVLTKTDRRVSTLFALSKNWKGYDVFSRQKMSTFKSSRPAVLELAARYHELALQAQKGKGVDGKAVEEIEEAERLLFSEMCEICLWGNATDLSLLTSLTYEDIQKLQGSKARKAAEENILINDLDAAFDALAKAQKEKKDGERRVDIVLDNSGFELFVDLILAGYLLSAGLATTVVLHPKVIPWFVSDVTPRDFMDLLNALADAQGFYTAPDETGREYEPLSEKELAEVKFLFDQWSKFHSEGKLVIRPHAFWTAGGSYWRMPYVAPDLFEDLKQSELVLFKGDLNYRKLTNDVSFSSAPHNGVYFRG

SEQ ID NO: 29762 - protein, 196 aa, A.fumigatus
  UNSURE (37): Identity of amino acid sequences at the above locations are unknown.
IVSCASAGRSRCRAASAFFRRSCAATIAAVCSAVCSXARAPDSIRSSPPSSASASSTTAGASSSPPSPSPRRAALSAAADARIASAASRSSFAFELPVAGPPTVLQFDFFARRNSALRTEVTKLGPSSSSLSKLVADVRRSGGSSSAIMRPSPAVSTVLVFLRFFFGRSVAGSAVRYFLARYSASDEGGMVLNLRV

SEQ ID NO: 29763 - protein, 168 aa, A.fumigatus
YHQGVQHHIHAESVQIPLPPMQFTHPSATGNPTLPVSLSCFSLQTIPSRTHCPDPPHPTDVPDGSHIGLVEKPPYTAASPSHSRPAPLSWSKTLPQDHSTAAAPSVPHSGHRPRSSAQVASREPPVSAVCVPPAPPAAHRPSAPPSPPLLSPASPAPLAAPPPASGQR

SEQ ID NO: 29764 - protein, 160 aa, A.fumigatus
  UNSURE (54): Identity of amino acid sequences at the above locations are unknown.
RTGRRRRDPSVRCGGERRSPWGRRGRRRRGACCCGRGGRGRRGRAADGVRCSGXTADGGTDGGDGGCAGTTEEGRGGAASRAAGGGTGDDLPRCVWADHQRCPEAGGGAASGAGEAGERRGGEGGADGRCAAGGAGGTQTADTGGSRDATCADDRGRCPE

SEQ ID NO: 29765 - protein, 350 aa, A.fumigatus
  UNSURE (160): Identity of amino acid sequences at the above locations are unknown.
TLRFNTMPPSSLAEYLAKKYLTADPATDRPKKKRKKTKTVDTAGDGLIIADDDPPDLRTSATNFDNEDDEGPSLVTSVRSAEFRRAKKSNWRTVGGPATGSSNANDERDAADAILASAAAESAARRGEGEGGDDEAPAVVDEADADDGGELRMESGARAXLQTAEQTAAMVAAQERRKKAEAARHRERPAEAQETIYRDASGRIINVALKRAEARRAEQEKREKEEAAKEALMGDVQRAEREARRQQIQEARAMPLARTIEDDALNEELKAQQRWNDPAAGFLTKTKGPGVSVTGKPLYKGAFQPNRYGIRPGHRWDGVDRGNGFEKEWFAARNKKGRLEALDYQWQMDE

SEQ ID NO: 29766 - protein, 76 aa, A.fumigatus
STPASTSNVPTCSLENALFRKRTQYPSIQLILCLVDESEITQVPVWSGSHMKTGNGGGADEELMEFVADISGDLNG

SEQ ID NO: 29767 - protein, 81 aa, A.fumigatus
LRLSRARRSTVVQIDKYDDLGSVNIDLSSIRVKVTINMERMEMMDSTAMPHRSNLKVFAIMVALSVRKTITEDDSVSTNNS

SEQ ID NO: 29768 - protein, 118 aa, A.fumigatus
LIKIQLSMFVAALDQTIMATAIPTIAAKLHSAAGYTWIGGAYLLANAAGACIWAKLSDIWGRKPILLLAVAWFFGSSIICATAVDMPMLIAGRALQGVAGGGLLQLVTIVISDLFSVR

SEQ ID NO: 29769 - protein, 164 aa, A.fumigatus
RRHSYCNARPAVGRICTPRSYIVKSVNTYLRMETMEELTGRAATISLESAKPARSIQVQPGPLSSHLDKIYASLTSTSTTDFIKDLQKEAIAGSVEAANPLASLAAFRAYMASPASDALLPAEGEDLSAPITDYYVSSSHNTYLTGNQLYSDAAAAAYTNVCLT

SEQ ID NO: 29770 - protein, 268 aa, A.fumigatus
  UNSURE (253): Identity of amino acid sequences at the above locations are unknown.
VLLNGCRCVEIDVWDGDADDDSVSGDDTSSSSSSSSEWSSDEENPSRRKKQDVQKTDGSTQSAKAPSRRKGLSSKLGSLLGRKSSPPNGATDKPASTATAAAVGTAAQTLRRPEPRVLHGHTLTKGTKFRDVCYAIRDSAFVASDLPVIVSLEVHTCIEQQATMVEIMEEAFKGMLIEVTPELEASQAPPPLESLKRKILIKVKWVPATGDGQAEAQKDDQTDTLDTPPSVNQDGEPAPAKPSKILHSLSRLXVFTKGFSFRQFTQPG

SEQ ID NO: 29771 - protein, 395 aa, A.fumigatus
PHRLERSAFGQDVHHRRTNDGRFAHGNHRHRMQPLATALPSMDATDGFGLRPVRDNERLPSMLPGFHTGLTSQPDSPTTPNAPVQPRSSAQATIARQRPSLRQQQSASGESDDGNGDGSTMDEDPASTEAAEPIVGLQNRMDIDDVGDRDTILGGVSDSHDLTVTDPSEEQEAETFNITHRSTVDGSMINTDNAQNNAALGLSPTQAADNANSPALVPSPYSLYFRDRTTTAAHGVLTTLPRDEDVLMSLQLLAYVSKYCNLRSYFQHSHFVPKLKIDRELQMLEEGTSPIEFPEDEDEYLLPDDVNIFPLVEKFTVRHHSKDMQYWACVVMRNLCRKDESRGGIRQCAYYKCGKWEEFQRQFAKCRRCRRTKYCSKDCQKAAWVYHRHWCHSTP

SEQ ID NO: 29772 - protein, 222 aa, A.fumigatus
LVIPRFPLIAIAQIPNDFFTSRHDPQNGPTGCILRYLYYPSIFSPATSSYQHDVDVRAGAHSDYGSITLLFQRPGQPGLEIRTPDGSWAPVPVQPGNAEDASAYTFPPILVNIGDLLSYWTDGLLKSTIHRVVFPLSEQRNPNPQDRYSIAYFCHPVDTTELVPVPSKAVVAHREYCRKNGIANEQVGFGGGAGNMAPGKRALTAYEHLESRLAATYGFKKE

SEQ ID NO: 29773 - protein, 102 aa, A.fumigatus
SLSHRSRTTSLHPAMTPRTVPQAAYSATSTTPRSSHPQHPPTSTTSTCALVPTPTTAVSPFSSSGPDSQVSRSGRQMVPGLLCPCSRATPRMLVPTRSRLFW

SEQ ID NO: 29774 - protein, 172 aa, A.fumigatus
LLFEKGIMLLTIPLGIAYTVPDLDAKVRIYINSTETRKSITCIEASLSNGKTVYQKGVGWTTAIISGLGLAASAITSGLGHSNTAAHVAANALSLFGFMQSQAMFGMISVAMPPIVEAWTQNFQWNMGIIHIGFLETLCTWDLPSTGGTPSTLLSQLSTTFRQSPETPKTFH

SEQ ID NO: 29775 - protein, 163 aa, A.fumigatus
ALFSPPSTNFFPAVECKNTARQSPATMRLMSLIISLFVAFLATPLVSAIRLIESNALNLCQDSSNFTATFFSVTFTPNNRSLAFAFDGVAAISGKVTAELVLTAYGYEALRKELDPCQMNLAGLCPMNAGPIDVPSANIIVSEDVAKQIPGEDAYTDCCLKRV

SEQ ID NO: 29776 - protein, 61 aa, A.fumigatus
  UNSURE (54): Identity of amino acid sequences at the above locations are unknown.
GIYSASGQSGSPKAEIEYQALRTNGHMEYQMQKSTGIPACNVAINCSIPDAVRXGDLGVSA

SEQ ID NO: 29777 - protein, 88 aa, A.fumigatus
  UNSURE (76): Identity of amino acid sequences at the above locations are unknown.
GRTITGHYIGRYADYFMGGAKAFEATKTDYVRSGQGRMKRLTVEKVLLRETEIVQKQIKALLRCDVGLHLTVTGAXSVTDSSPSASDR

SEQ ID NO: 29778 - protein, 418 aa, A.fumigatus
RDWPLEHYFEMSRPDSERALEIYKTFTAQTEEVVKFLGVARHFQSATRLEIPKLKHASTDLTRLLEDDLNDPDFNIRRREYLARKGAKNGGADTALKSSITGGPQNTSNMSSAPSRPQTEPNPQKKTNPADLIDFFEPIEPNPQPTAQPTNFQHPYQAQQQQQTMPFQPTGFQPQQTGLYTQQTGFQQQPQGASFGQPTGFGEPFPQQNNNQFGQAQAPQPLQSMPTGAGFGGYSAQPQTYGFQTHLSPIPQSGVASFSQQQQPALGVQQQPQQQSTNPFRQSMLMSTPTGTAVPASPLSRQNTNPFARRLSTVNPQVSSGPTEGTQSPAQQPLRPHRTGTNPFARSSSVPPQQSQGLQPPAAAPLRPNPTGSTNPFRQSAFVNQQTGQGWHVGGQQGTMGGLEKLETVPVFPRPGMA

SEQ ID NO: 29779 - protein, 276 aa, A.fumigatus
QSVLSTLCERSPYQTESDLLLYRYFRPEGRKRPSRVQYCGNMDETIDSESVLAPVRASSPSPSIPATPAISSCPSPDRTFSTISSLSTSSATSADARSSISVSSKRHGYIRPQGAEFAESAKNRESVMSLGSIAHLQYYFARTGLLDGKGGHAREWKKKKKPEEEPRLLLTPNARFIDDLTESPTEEYSSDLGEEDPEDEMMLPPTVSTYSVKTHHIPPPRDVLALRKDLLHAVDQAEKTFRDLYSQNGPPPGCDGPRGSVVSPEDPESDFPAQAP

SEQ ID NO: 29780 - protein, 105 aa, A.fumigatus
QSCSTGGKGGKGLGKGGAKRHREILRDNIQGITKPAIRRLARRGGVKRISAMIYEETRGVLKSFLESVIRDAVTYTEHAKRKTVTSLDVVYALKRQGRTLYGFGG

SEQ ID NO: 29781 - protein, 343 aa, A.fumigatus
DSYQLYYRYDNPPPEKDWKRAALRGPALPAVGNAVAGAVGAAISNVVTYPLSLIVTRLQTQAQRRTKKKNKSESEDLDEEEDEEYTDVLDATRKIYAKEGLGSFYTGLAQDTVKTVADSFLFFLAYGFFRQRRIRARYGDGRRSKHVVLPILDELAIGVLAGAFAKLFTTPLANIVAKKHAASGKKALSTKDIAARIKTEKGLRGFWSGYSASLILTLNPSITFFLNEVLKYALLSRKKRGKPSPATTFLLAAISKSAASSITYPFSMAKTRAQVDGSGNSGKPSIKSVSEDGISFAPQIIMDVLAIARNEGVSALYAGLPGEVLKGFFSHGFTMLAKDAVYS

SEQ ID NO: 29782 - protein, 463 aa, A.fumigatus
THPTRSSQTVEMSSSPTRRERIHLDGRTLEGGGQLVRIAVALSTITGQPITIEHIRGHRTGKKGLKASHLAAIKYLADVSGSAVSGAEVGSSSLTYHPLPDAETCVRQQQEIDIRLRTAGAISLVFQALYPYILHTASCLAVAEPKPQPVRVSITGGTNVSFSPSYDYISQVLVPNLARVGLPPLAVHLEKRGWATGPFSLGKVTFVLHSMDRNEESPYGFPRVDLDRYPRGEITQVDVTVLAPDTLLFGGSGQHEARKKGNSQISDGTSQSITLRQVIEYETMRVLRTRLRQLPSSIVKRARADSPFARTYENDEIVPIRLHTSERTHHHSHIYILIVAHTSNGFRLGRDTLFGAHGEDSHRKSGGRKGRPTDDRGIALKLVERCVNDFVRELYDPRLRSTSEGRQPCVDEYMRDQLVIFEALGKSTSKCEADGRGKEDERYCSLHTQTARWVCEQMLDVDQ

SEQ ID NO: 29783 - protein, 202 aa, A.fumigatus
QDQHDDRYAIAEEYVRVTYKLWESSWRDDAVVLDRERGIYTDPSRVREINHEGKYFNVPGPHLCQPSPQRTPVILQAGTSKAGKTFAAQHAEAIFVAGHSPVVVAKNIAEIRATAQAQFGRDPKSIKFLALLCPVLGRTEEEAREKFQYYRSLGSIDGALALFGGWTGINLDTYGDDEELRHVESNAIRWASMVVETRDGAN

SEQ ID NO: 29784 - protein, 74 aa, A.fumigatus
PSSSAVEGWSKSTPEVAKWTKSTVGQHITVGGLGATPVGTPAQVADEMERWVREADVDGFNLVSCPADDHSHRS

SEQ ID NO: 29785 - protein, 78 aa, A.fumigatus
QGKAYAIKPGSFKDIIDLLIPELRRRGLFWEDYAVERGTYRENLYGKPGQTGPPADHPASRYRWHAGVDAADHKIPEN

SEQ ID NO: 29786 - protein, 251 aa, A.fumigatus
LGPFRDFWCRFGPALDRGARRLISTISGFDDHRSPPNCIALDMSKLFVITVRIQVDSRPPAKERQSTIDRAQAAVVLEFFASLLLRPAQNRAQQGQEFDAFGITPELCLRRRPDLCNILGNHYWTVSGYKDRLGMLCGKRLSCLGGARLKDDWGSLGARLTQMWTGDVEVFALVVDFPHTAGIGVDSALTIEDNSIVSPGRLPQFVGYSHIFLGNGISVVMLVLLEKASGLGMEPTCGCWAWPRFRAAESR

SEQ ID NO: 29787 - protein, 80 aa, A.fumigatus
MAGHAYNSSKRYGAESNDACKATLTDGLPQTKGVNAASITRQSRHDVTEPKPIAMIEARLLIHTFFVALFIKLLCGTAAE

SEQ ID NO: 29788 - protein, 76 aa, A.fumigatus
YAMVCRDPRELPFDRVLGDLSLPPAVLYADIASPMFKDFHHTLSALAKDGQVSYRVRYRPTQHWISRPLFVSGYGV

SEQ ID NO: 29789 - protein, 655 aa, A.fumigatus
HSICLSIDLFLFFLFHPLFFLGSLCPYKPPFHCFPLSQLPTLRYRPSHRSRPTLSTHCERGASTLSYLLCRSEITTYLSLMAFRLPPQVTRRRNSYSTQYVPEPDIPSPVSPLFENENESTQWVLFSPPQPSTARTHTTSTERTPRRTGASRLSDFGSFDTATRSIFGSEGDNTEGDAEEPLDEDGTELDSLDDGLHAFRAPSVTQESTSRLNQSTPAVLPTHDGLGSFHASSQPVQEQLWQYEQFNPRRRGDVRPRRRSSVQRQLDTVEDREQVDMEYDRWRRIEKWRMDQSRALLQEIERETRRRRRNSRVSVQTDQVTSRPIVPGTSDGALETPKEDSLQPHQESEEDESFWRRITRKVIRDLIGIDDSLLSVILGESLPNMGSEDNKSAGTDNSLDLSKTLGELDSMPDEQGLWQSKLLQRIARELGILVHHLCEHPGAFTTYLNVTNEIPSEYAGIPLGRLAEENEAASQGASAEPALHTAMSSQDSMMSPQFSPTMRDPTSREHAAHWGIEDEEDASREPLPESTRLQQEKEYWERELDVMMVFRYLRNRFGRRGSNADSTHACSRRHPQDASRRAVIIRQHQPLVAGAHSRSQTQLRRQSWPTSFTSPAAPSTPPPNQFQLARSHKKLSGSLQFGVRLPHFQTRNYWE

SEQ ID NO: 29790 - protein, 66 aa, A.fumigatus
  UNSURE (10),(15),(28): Identity of amino acid sequences at the above locations are unknown.
TVWAGGLSPXTIILXGINNPVNSLGGFXTTALIFYPVLALQNLSRTNKEPSPPPFNSRWFRIVSTN

SEQ ID NO: 29791 - protein, 157 aa, A.fumigatus
PVLTNGTVGDQLWMSRFLLHRVAEEFGVKISFEPKPIKGDWNGAGLHTNVSTAATRAEGGLKVIEAYMQKLEARHNEHIAVYGEGNEERLTGRHETGSIDKFSYGVADRGGSIRIPRQVAKDGKGYFEDRRPASNADPYQITGIIVETVSLHLLIPR

SEQ ID NO: 29792 - protein, 82 aa, A.fumigatus
  UNSURE (17),(61),(75): Identity of amino acid sequences at the above locations are unknown.
HFSLGMTGWPLWGGPRXGFPVAPGSLLLRCWNWPGFTAWTLLRFITAPGLYAGIKISGINXEVMPSQWEYQVGPXQGIESTS

SEQ ID NO: 29793 - protein, 62 aa, A.fumigatus
PELAICEAVLSSQSARLPTATSTIPYDSGLYTFGKVLVSAEHLQWLYSTDPWVSHCLFNTFG

SEQ ID NO: 29794 - protein, 235 aa, A.fumigatus
VINSSDCIQAPPSARGLGRSGPRRRSGCLTCRARKVRCDEAKPICANCTRLRLGCVYKTIVPAAVPRQANGPTASVTGNPTANAFQRPDAGYFSTVLRPDGQQAYRPPQASNASQLRSVDNAATSPGPFDMLGFMSEITSELERKHLDLTNGLSEFTSSTSCKASNDTANVPHTDRSMSCDSCFHSKGTQSQPPATEGLWPETGAAYEEHLLASFLSSEPPATIFGPVNLEWKYV

SEQ ID NO: 29795 - protein, 291 aa, A.fumigatus
VYNAIPELVRTASVPTDDGYRAVEDAREHPTANQKGIIKSAIHLVKRAASPWRQYVASPVFLASFALSLLYLTVLSFGTTMVTYLLHMGFDPLQVSCMRIGAVLAELSGTWAAPFIMGRIGPIRSGLWFLNWQLGCLATAAVAFALYDSNSRLVAVSLILGVALSRIGLWGFDLSVQFLVQEVITFSPEGCYQRLLMFINKGVEEDTRGRFSSTEMGVQNVFEMLSFATTVVFPLPEQFKYPVFISYGAIALAAICFAAYVRKERGHLLHISRCWGGDKMRRSYQALPGGL

SEQ ID NO: 29796 - protein, 163 aa, A.fumigatus
  UNSURE (158): Identity of amino acid sequences at the above locations are unknown.
LDMSDQQHHQDAMRRFSLGTGQGQVDPLDLPLRQVTNDANMEEYTTETAAGEIIKPVRSSATGKVEDWKLVTFKVDDPENPKNWSKAYKWYCTMVVSFTCFVLSFGNSFDPADLDGAPKGTKVYSRTRLVIESALVTNPRWVRLKAEKQSPGPSGLIXPCCGD

SEQ ID NO: 29797 - protein, 62 aa, A.fumigatus
RPVRVTIADEKAAKAGRGAWTLDGKMIDIPVAEKARAIVKKAGACGFNVKELQDKWQHQEPE

SEQ ID NO: 29798 - protein, 198 aa, A.fumigatus
NAQTNISLSAAQAWNRNDARAAKALSLRGQAENEAMRRCHREAARQLYEERNKHLLSAGLDESSEELYVDLHGLHPEEAIEYLEKILLKHAREGRCVIYAITGTGHHSKNGKDKIGKAVKAWLNEWKYLYREFSVPGERGGYVGGILGIDPTSYDKTLAKSLEEGEDGKGGDSNGSQPVMTMGKIQLLKREDLESKSS

SEQ ID NO: 29799 - protein, 430 aa, A.fumigatus
  UNSURE (19): Identity of amino acid sequences at the above locations are unknown.
MEIGGVADAEALVPDMTTXYGILFRARTQGLLVYAKALNCDWEGVDAGLQEMHKLKLTRRRRDFLPIFDRIFLEYWVSHSGIEIRNFVFRYLDKFDIVPDRVLYKHILEAFVEKGDKEMIAEFTSMAKQRSWNIPINEQQFLEILRSRRLALEGAPVGFWQMLQAARVKYGHSSTSQRIMGYDQQSFPLPEVNSMPYTQNPLSWYQRTMQETTPSKPVDQYQKLHKQMTHFLHAGKLKEALKCFQNAKNARFQMRQLHVELAVIATLLEDGLSAARSLIESEWRTIRHLVRFSPIFFRQVMAVDEDAGGHIVQMAVLRFYQLCWSTKHMKVKHHLTVATSRRLISQHKPEMALELLTAVYKSRYRFAATFDGVCMKMFARAFAATDNILGLRWCILTALSRDSALNHDFVVEVRRILGTLSPPSASSPRG

SEQ ID NO: 29800 - protein, 187 aa, A.fumigatus
FILIDKPRRTNRYLQKYREDAEAKRAEAARRKAERDALLAAEEASLPSKPKGAGAKQAQKKTRGLDLSQLDDEPASRKAAALNASGIDNALDALSLTAKDSSKIDRHPERRYKAAYAAYEARRLPEIEKENPGLRRNQRVELCKKEFDKSEENPFNQVHVAFDATREEVAAAREAERRKVEARLASR

SEQ ID NO: 29801 - protein, 76 aa, A.fumigatus
PVGHGAIRPLQDLWGMPIPCVAVPAGPVMGMELGRMNRHTEFVTGVDWCLFGSEGWCASVGWDENLYVWDVRAVMG

SEQ ID NO: 29802 - protein, 71 aa, A.fumigatus
WDKDAMIYCSPVPPTLYWLFRLPRDTIMTRLRDSDFTFPKKSHEYVKFCVNEISPTILFSSKSSHEIYPIR

SEQ ID NO: 29803 - protein, 248 aa, A.fumigatus
  UNSURE (2),(14),(15),(19),(22),(36): Identity of amino acid sequences at the above locations are unknown.
HXYPLTHFVTGSDXXSISXWSXHKRSLLHTIQCAHXLDLLLPLDELSAEVDQKLADSNSRFFRRMPRWITALATVPGTDIVLSGSWDGFIRAWKVSEDKKTIIPLGPVGGGKLGSATQDTPSRQLKQTLEFNTAADADSMSVDEPQNQHTEDTKNEAEPLIKGVINDIAVFERRADTAKPGQGQAESKTKTKSSEPEPRGLCIVAAVGKEHRFGRWKCFANNFHEGSAADGRNGAVVFEVPFISDSKQ

SEQ ID NO: 29804 - protein, 276 aa, A.fumigatus
TSFQLRSIRSSRTQTPVFFGACPAGSQLWQRFLAPTSFLAAAGTASSEPGRFPRTRRQSYRLAPSAEESSVLRHRTHHLDSSNRLSSLTQPPTRTPCPSTNPRINTPRTPRTKLNLSSRVSSTILPCLSVVPTRPNPAKARPSPRPRPSHPNPSPAVSASSLLLGRNTGSGAGSALRTIFTRDLQLTAATARWSLKFPLSLTASSDWNTFAEWGIGACILHAHLIMRASVAQMKFRNPPRVDLWYRKTRMPRRFVCIFLYWENSPAFGTLPSLQCT

SEQ ID NO: 29805 - protein, 156 aa, A.fumigatus
EPLSNADGSLNAADASVGAGAGAAGEGVAGTAGAEGAADGAGADGAAGVEAAALEGVEGACEGVAADEGALGCIRWYGQMQCSESFNGEAGVITFDTMHTMKPFSSMLYVSMVLSSWRIFPASYSAKRQRDKLRKSRSKGHKKQQLTVPFQRIPEK

SEQ ID NO: 29806 - protein, 87 aa, A.fumigatus
RRRFPRKKDGRYLSSSSSIPVSLTMITLGFVISQESAGMAQSIVVFCVLCFCFFLAYLADASLNNSQGKSSKMTRPSRHTTLRRRVS

SEQ ID NO: 29807 - protein, 131 aa, A.fumigatus
PYHLIQPKAPSSAATPSQAPSTPSRAAASTPAAPSAPAPSAAPSAPAVPATPSPAAPAPAPTDASAAFNDPSALLSGSQSEAVISQMESMGFPRSDINRAMRAAFFNPDRAIEYLLNVSCHLLYSTCASHD

SEQ ID NO: 29808 - protein, 159 aa, A.fumigatus
GIPDNIQQEQQQQAAAAAAAPRPSAPSGESAPSSTGGDEPVNLFEAAAQAGTGEGTGRGARAGAVGAGEGLPNLDFLRNNPHFQQLRQLVQQQPQMLEPILQQVAAGNPQIAQLIGQNEEQFLQLLSEEDDGALPPGTHAISVTEEERDAIERVRTSPY

SEQ ID NO: 29809 - protein, 79 aa, A.fumigatus
ERDPPDKHRSSFCQVKEQNGQTIHTASLPYVLCVVPRAMSHTVKICEQMAAIDGVQSAPLSASPDGLSAWGHCSIIAQV

SEQ ID NO: 29810 - protein, 103 aa, A.fumigatus
LIDGQVYRYREKSLQQKLEILYQRNLYILAINLAQKKGIDALQQNAIYRKYGDFLYQKGDYDTAMQQYLRAIDNTEPSQVIRKVLPLALGNKSIYLTGLIAVP

SEQ ID NO: 29811 - protein, 197 aa, A.fumigatus
QSCPCDFPGLTQDKAYHNLMKYARVLLANCPQETTELFMAYYKGQYRPRTEVEVPAAPQTQPTSTLQSLAGFLPLSLINAGSGTKAEKTKDIVDEETKIERPTPSYEIPRPRTAFSAFVGRPQEFIAFLESLIDLETLKEEDKVDIYTTLFEMYLDTAKRKKGSAEKEEWENKAKTLIEGKDVGALAPVVAPPLIGF

SEQ ID NO: 29812 - protein, 146 aa, A.fumigatus
  UNSURE (139): Identity of amino acid sequences at the above locations are unknown.
IPISTSNVLLLSDLSNFREGSTLVREQEGLRSDIFRSFTSAKDTHGAIKALRKYGPEEPQLYVDALTYFASSPAILEEAGDELDVVLKRIHDDGLMSPLQVIQALSNNSVVTMGRVKKYLSDNIERERKEISTVGCVLXIFYVVSN

SEQ ID NO: 29813 - protein, 216 aa, A.fumigatus
ISAFAALEDLSQVAVGFGNGSVTIIRGDLIHDRGARQRIVFESEEPITGLEVQSGVLSTLFISTTSRILTLVISGRGQGQPARVLDDSGCGVGCMALDRDTGDIVVAREDAIYTYGPHGRGPSYAFDSPKNSINVFRDYMALVCPPRAALGNLRSQADEIFSTTTFTLLDTDLKFIAHSESLAASVRHVFIEWGDLFLLSTDGKVCSNTENEYCYS

SEQ ID NO: 29814 - protein, 127 aa, A.fumigatus
SQYLDTQRIHNLIEYLEELHDHDRATVDHTTLLLNCYAKLKDTNKLNSFIKAPGELKFDLETAIAMCRQGGYYEQAAYLATKYGENDMVIDILIEDSKKYAEAVEYIWRLEPDLVRNDSRVLVIFQG

SEQ ID NO: 29815 - protein, 132 aa, A.fumigatus
GAASLYFSPQDRSALAMAASIITRGSSSLESLKGRSRPKIQIDLVNQTEGLVSSYTTKGQIEGTVTIRVDHDTRFEDVEITFEGATDSPVSWPGFACMLTAENRNSKNISRARGLPRPHRGVSDIPQAAPAH

SEQ ID NO: 29816 - protein, 106 aa, A.fumigatus
QPRIGTARTSVERAAYPGRTGAYQTFLKLRQPIDDAAYPTPRILESGRAYQFPFTFVVPDRLLPHVCTHSKINAHVERSHTLLPPTLGDPILASNGKTLLDDMVPE

SEQ ID NO: 29817 - protein, 109 aa, A.fumigatus
HSPVVALPLLQGGAEKLFEFKAFDLDAVVGTSVVSFGKRDSSYICLNGQRASDFGYKEESVFWTFPFPVDQVAEQKINVSKLKSADLIRLSRTETGPSFLFDVYTEKSS

SEQ ID NO: 29818 - protein, 165 aa, A.fumigatus
TGSVLSYISIIDPPGVIEALRFRSFSACVYRLDMFPSPPSPHLEAIENWRILYSLIAAYLSRSQLKMPFAQLVIGPPGAGKSTYCNGMHQFLGAIGRKCSIVNLDPANDKTSYPCALDVRDLVTLEEIMSEDQLGPNGGVLYALEELEEHFEWLEEGLKDLGGRP

SEQ ID NO: 29819 - protein, 80 aa, A.fumigatus
MLQLIVIHLIDSYNLTLPSMYISALLLSLRAMLQMDLPHINVLTKIDNLSNYAPLPFNLDFYTEVQDLSSSPREAAPQQH

SEQ ID NO: 29820 - protein, 139 aa, A.fumigatus
STIWHQVRSIETAVHACTDRKLDQFAVANPPADAISALKFSPDPNSTRIVVSSWDKNVYLYDLRDENGNVSEGKLLQKFEHRAPVLDACFGENEDVIYTAGLDWDVRKYVFPSPLGAFSRLTVSCYWQDRCHIIYTDRA

SEQ ID NO: 29821 - protein, 261 aa, A.fumigatus
LSLVIGRIDVTSSTQTVLSSHNAGVRCVAYSKEHNIVISASWDSTLHVHRVNTEADSIPAIIPLPSKPFSMSLTATKLVVAMASRSLHIYDLKALALLTDQSDATSPNKVDIEPWQRRESSLKFMTRCVACMPDDAGYASSSIEGRVAVEWFDPSAESQARKYAFKCHRQTADDVDVVYPVNTLAFHPIHGTFASGGGDGVVALWDGIAKRRIRQYQKYPSSIAAVDFSGNGKYLAIAVSTGFEDGRHDSSLRELPDTNIG

SEQ ID NO: 29822 - protein, 260 aa, A.fumigatus
HAALRKAHNNRYCAFPPQLPFSKLEILISLGQRPKHLQDALAECGWEDAAEFRQQDTSEAFTFITEKLELPLLTLKMDIYHTGKEDVSSDHKFVNERLLEVAIPEPVDGKTVTLEDCLESYFNNRIEVKRHLERRNTVGSTRSFDSTSKGFISHIETVEVTPSPAASPTQLTPLRSDDSALLTPIITQSEVSGSNTPRGAHMRRTSIVQERFVPDSEDGANADGRFTTKSHSGRGSYRKEVMMPAWQFFSLIRRCIRSLA

SEQ ID NO: 29823 - protein, 137 aa, A.fumigatus
LKILGRRIAQLGYTGLKEEHFEYALQSAQGDIEKAFDLLLILEDSIEGIIRPYTPSTKLLGAVNRQGVTCYLDALLFAMFARLDSFEAILYKSFNDEPRRKLSILLRLWVNMLRSGKLITTDIVRFRLSCLFLNWKY

SEQ ID NO: 29824 - protein, 236 aa, A.fumigatus
  UNSURE (34),(70): Identity of amino acid sequences at the above locations are unknown.
NPDCSNQFRSPKYDRGPLHPHRPPPPSDPSSRLXVPGPFSLPRVSQTWESTIAPDILTLCYVHTPPGFKXPPKGSRLREWDDSSPYHKNRPLRGPRGGDVLRLLRKPITFNNIPQLERITIHSYVKQAATENSSWLHVAGMAVQAISNVRVQTFKSKSSVATWGIAPGRDTVAVKAELRGEDMLHFFGKLVDVVLPRIKDWEGVKGTSGDSSGNITFGLEPENVALFPEIEVNYDM

SEQ ID NO: 29825 - protein, 140 aa, A.fumigatus
  UNSURE (5),(114): Identity of amino acid sequences at the above locations are unknown.
RPSPXEESEVEEAPEHLSDAEAAALPLTGLTGWRALVVKAGERNSGKGAAVLITGIGGGVALIVLRFAVARGADVYVTSSSEEKIQKAVALGARGGVNYKEEGWEKKLLGMLPXGKQNFDAVIDGAGGDSVEKATKLLKV

SEQ ID NO: 29826 - protein, 101 aa, A.fumigatus
PRQAGGVLSVYGMTVSPKMPFLMQAVLKNIDVRGSTMGSRKEFKEMVDFVKPNKIHPVISRVVQTDLGDIEGLDRLFQDMKEGKQFGKLVIEFGKSSGSKL

SEQ ID NO: 29827 - protein, 211 aa, A.fumigatus
AKMAQVTVGSVAAEVADNYALDHDIQSDSGLESLDNDSSWDSDVQNYDWDSDWSDEDATLARPTKRIAVNRDKHADFIDLTDKPSLPAPGTMSTPTTAAPATLMAAAPCQYSHDIAALSVQIMELFPDICREYLKGLLSRYADNMSLTGSNVASGMLLAMKEMVVEEILANPSYPKRKQLKRKRKDTKDDDKDNTWTSINHNGEPWYQEAA

SEQ ID NO: 29828 - protein, 227 aa, A.fumigatus
ELIQNQKRQEEAERRNQEQHARAGTLVECQCCYSDVPPNRTITCEGENVHFFCFSCIRKSAETQIGLMKYQLQCFDTSGCQAGFPRSEIKEVLGSSIMAKLDALQQQDEISRANIEGLESCPFCEFKAICPPVEEDREFRCCNPSCEVVSCRLCKDVTHVPRTCEEAKKDRGISERHLVEEAMSEALIRNCPRCKLKIVKEFGCNKMTCPSCRCCMCYLCKKDITRE

SEQ ID NO: 29829 - protein, 63 aa, A.fumigatus
TDTVMSRMYNQTGNLYKGAFDCLFKTIRKEGILAIYKGYFAHLARILPHTVSNSRISRLCVTA

SEQ ID NO: 29830 - protein, 187 aa, A.fumigatus
  UNSURE (131): Identity of amino acid sequences at the above locations are unknown.
YIYQILLNGCRLGFYEPLRKGITTAVYKDPQVQSLGINVFSGAASGIIGAAAGSPFFLVKTRLQSYSPFLPVGTQHEYRNSFDGLRKIYMSEGVGGLYRGVGAAMVRTGFGSSVQLPTYFFAKRRLVKHLXMEDGPGLHLARNTVSGFVVCCVMHPSPVCIIGHCSITRPANFINRHGYVQDVQPDW

SEQ ID NO: 29831 - protein, 65 aa, A.fumigatus
YVQKAQAASQQDDPEVNASNEYTQRFERSFRCNRSTMQTTNAALYRNSTIPITESIEDAKGVPLR

SEQ ID NO: 29832 - protein, 279 aa, A.fumigatus
RPPHFSQFLDEMSVNGVPTPNLPQSQSQVPQSQPQQQQQQQPPQQQQQQQQQNKPQSQPQPMGQPPMQASIVRDPTPNHSIPVPQNPQVGMVMVPNQPMDVSAMGLNNSAWNTGIDMSYGNTPVFAVLEVPEGPALDTEMLSGKSSTLFRTCLPEVSSAKDEIPMIERPPNTKEETNDSPVGVENPDIQFDESDPAFALFADSPAKASSSDSPVEFPCTIRSEKSSPAFELVVENESKATADRFIVLCNSMEAAFQRVSVMTSHLSCFPRAAPEHLRYL

SEQ ID NO: 29833 - protein, 240 aa, A.fumigatus
LRSVIHSFGESFSTATLASLLFSGRLFTKAFRLVPSPAGSSCFSRAASYLKSRHRVYEGTSGPPKLSVSRPFKALRTRDYRRDINPEAYLLRAPKLVFRRGKTYVIYNPASHQDSGFDSTPTSPVGNKPMKFYYQVLTTPTADTPGTTVVLHFPEKRYFFGQISEGTHRACTERGVKLSYLTDIFLTGRTEWANNRGLIGVILTLADGLATAANALELTAREKKAKGRGGSPGQTTGSPT

SEQ ID NO: 29834 - protein, 132 aa, A.fumigatus
LLSCLAVLLTCYNSEGFDTVVGSKGGMLSGGQKQRVAIARALLRDPKVLLLDEATSALDSESEKVVQAALDAAARGRTTIAVAHRLSTIQNADIIYVFDQGKIVESGTHHELIRNKGRYYELVNLQSLGKTH

SEQ ID NO: 29835 - protein, 188 aa, A.fumigatus
TLCFSEILFGAQSAGTVFSFAPDMGKAKNAAAQFKKLFDSKPTIDIWSDEGEKLESMEGEIEFRDVHFRYPTRPEQPVLRGLNLSVKPGQYIALVGPSGCGKSTTIALLERFYDALAGGVFVDGKDITKLNVNSYRSFLSLVSQEPTLYQGTIKENILLGVDKDDVSEETLIKVCKDANIYDFVMSLP

SEQ ID NO: 29836 - protein, 199 aa, A.fumigatus
PSSPLIGCLLGAIFALIFGEILGRRKMVICGASVMIVGVIIQVTSFPGSLPLLQFIFGRVITGVGNGMNTSTIPTYQAECSKTSNRGLLICIEGGIIAIGTMIAYWIDFGAHYGPPDLVWRFPIAFQIIFGIVIIVGMLYLPDSPRYLIAQNRIADGEKVLAALAGTEISDRHTQLEKQLIVDSVRAYVPLLCTSYSHS

SEQ ID NO: 29837 - protein, 66 aa, A.fumigatus
LFLWVCLAQGLKNVYTNSSLTVFDSNDYRFVTMAPPTFAGMSGRKLSWTVSTIATMGFLLFGYDRK

SEQ ID NO: 29838 - protein, 116 aa, A.fumigatus
TRSERTFPYFAHHILIADVRLRSGAQKASFRDLFTGGPSQHFRRMIVGSSSQVFQQISGCNAVIYYLPVLLEDSIGQSHDFALLIGGVNMICYAIFATFSWFFPQRVFTKGAADRE

SEQ ID NO: 29839 - protein, 140 aa, A.fumigatus
WGVMAEANQVTTDMTTLKYVEPAPMGSGEEPRPVTTTNMDYDKGQLRQLMKSQLMGVGMMGVMHLYFKYTNPLLIQSIIPLKSALESNLIKIHVFGKPATGDLQRPFKAANSFLSQGQVKTDKASVENAEKNFRGGVKEE

SEQ ID NO: 29840 - protein, 75 aa, A.fumigatus
PCLDLCRTNLAIILVMMQLAKKVPFDNPDVLFLVRCIYLASNVIILGLYMYTQSKINQKKGMHLSAVVMGSYGGG

SEQ ID NO: 29841 - protein, 534 aa, A.fumigatus
  UNSURE (18),(37),(38): Identity of amino acid sequences at the above locations are unknown.
PLIRPQHPLLDRGSASPXAPCAEPRPARRGRGATYPXXRPRASQPLNSDDSERASEDLSMGGELPTHSPLDQSGGLAATKLSGPGRRTELSQPTTAEDLVDSNPWLQQVMHKSPGSFPPGPGLDANTPPVLQRFPECWDSTNYSPDVSLEDGVFLPGSDYLELHSTLRSHLMQEARSRYPSRRNSTDSAGPARSSLGREGFTTVPIIQLRDYEDYSLMPNNQTSVDLPKDVEYDLWKNWLEEIAPWLDKFDSQRHFQYTLPVMAQSHEHLRYAMLAVSARQQEQKNKTLPIERSLTLYHKAIQLLLPQLPTRTTAVIASCVVLCVLEMLSCAPKAWRRHLDGCAHLMQAVGINGFVGGVEQALFWCFARMDVCGGLISSIKTLIPVNHWASMIDLDTDIRLFQSTSTFETCANQAVYLCAQTLDLLAPSHLLGRAASVRCDPSDIAYMERWLKLWRYVEDWHVKRPKEMKPIVNLPSTDPCPTILFSNAAAISGDQLYHTAAILLLQSKPTNVRLRTQATLDPVACPPNLWHLP

SEQ ID NO: 29842 - protein, 206 aa, A.fumigatus
LTLFAAYHFPFLCRQKAHLLTRKKEYVTMSQSTTRASSAPRASASGLTRVYLLAYNAISFCLWATCVIRGATLVFSLAPNGHLPAIFHHVYSPLLTTTQTLAGLEILHSLVGIVRAPVMTTAMQVASRLLLVWGVMYLFHDRGNGHGGIVGGDFHEALPYGPGAKVGDYAFLGCLGAWGVTECIRYGFFALQVWGSGVPSWWTWLR

SEQ ID NO: 29843 - protein, 99 aa, A.fumigatus
WCPELVDLVEVIIPALCKVRMLLADNVRYNTFYVLYPIGISSECIMVWKALKPAAEWNPLYWWFLVVVLIIYVPGTSVVWQRAPPVANFLQAHTFSTRT

SEQ ID NO: 29844 - protein, 136 aa, A.fumigatus
ARRPTLTAVVTLWGLLTTLNCAPQNYAGLIVLRVLLGCFESAVAPAYVANPGNLNVRVHSDRYQTDSDYFKVVQEEWQGVSLVAGTLANLRKTAQADRFLVFRYWNCHHHRSSRCTRTPLLYRWLLPVLADHVPHL

SEQ ID NO: 29845 - protein, 177 aa, A.fumigatus
DVLKAQLLRRMLPTPAISMSEFILTGIRLILITSRWYKRNGKVYLSWRGPLLTFAKQPKRIGFWYLGTGTATIIGALVAHGLLFYTGGCFRSWQIMFLIFELITIAVGICFMIFLPDNPMASRLAHEEKLFAIESLRENRTGIENKHFKMYQFLQIFQGPPDLISSPLIVGAMKLSH

SEQ ID NO: 29846 - protein, 191 aa, A.fumigatus
YRHVYQCGCTLHHRQSPIIHLRKVIDVPAMLSATALITWAPKCSESHFYKKSSKDIVPSPCFTTKATTIGFLRTVPETGDLSMDTEAKKLSSAASTEADAALGFLASEGTAAFTEIVEEKLVRKIDWTIVPLMWAIYFLQYQDKFLSNTDSWTVLIPPATYPTPVNYASVMGLLKDTGMQTDQFSKLALAF

SEQ ID NO: 29847 - protein, 104 aa, A.fumigatus
SIDRWDWHQYLSFSHSSVQCSACLLSPPTHAGKSNDHYHYHYSRLHTSSFAFFISLKNHTRQFIKSERRLYVTVGSEDNRLFILDHRCQTYMEHTLLLPHTKRF

SEQ ID NO: 29848 - protein, 296 aa, A.fumigatus
  UNSURE (235): Identity of amino acid sequences at the above locations are unknown.
IDGIGINTYRSPTHQFNAPPAFFLPLPMQGNQMTTTTTTILDYILLLSLSSYLLKTILGNLSSLKEGFTSLWALKIIGCLFLTIVARPIWNILFSSHTPRDSKSPQIRTFLPLGIDYITRGIIYSAQNKSLVFWEELFRKYHPFQTLEVRLGPQTVIVSRDPQVVKALLTTQFGDFGKGERFHTEWREFLGDAIFTTDGDKWHASRALIRPMFTPDRVSNLSTFERHVQKLLRIXESPRHERQPVNVLDLCLRLTMDIATDFLLGQSVDSLSNPTHRFSAAFADVQRIQSWITMAG

SEQ ID NO: 29849 - protein, 204 aa, A.fumigatus
  UNSURE (2): Identity of amino acid sequences at the above locations are unknown.
GXWNLPVMSGSQSMFWISAFDSPWTLPRTSCSDRVSTACQTRLIDSLQHLPTCSEYKAGLPWRGRFQTGSISSPQKISLLTISIFRPLQVFLPKAKYYEGLKTINSFVDPFITRTLALGRRSFEEMEGSEEEYNFLEGLATFTQDPKVIRDQLISVLLAARDTTAATLARTLYEPSGHPDVVQRLREEILIRPRGWKSRVGEPV

SEQ ID NO: 29850 - protein, 149 aa, A.fumigatus
SFQPRGEDSPIMMDLQKRPPQYPSLFGTSHDPRAAPQPPPTYSVPPPQQVYYDSMKQHGIPSSQPANTMAYPYSTPMSSAPPTPASSTPYNMSAAPRVDNQSYQVPQKDYEPSKRHQLEDHNKRHRHSRNNSHDQLISREGRQYYFVSF

SEQ ID NO: 29851 - protein, 190 aa, A.fumigatus
DGSTFDAGDLFATLISLLREYEMMSWLSSNVRKCADKSPSVISDTSNSTFSLKDSTPKGNGERVVTILEDLFATDIKPRQAIGLPQSYILTLGIRDVLSWVTRQGEVAYPNALVYIQCDLIAKNNFDLAWDFLRFQAATSWSTYVKGRLYVAMSEFDTAALYFRKAAYLLCKLYLAVYFNPNRLTYYSMR

SEQ ID NO: 29852 - protein, 391 aa, A.fumigatus
RITACGKPLGNLHEMSSTLLDIVSVDCFHNGLPKYFQHILSIFEQARSFSHVADFASLALQALASENRDEKDPERINMRTDLLSRLFYASLKTCQFDLAYSAMSRYEDHALQRSALSSLITAILNASGPGLSGLQQILHFPTSLLPNIATHVDDTLVSLARKQTSFNSLLEAGTKWADTTPDYQRILQAYRVARNDYRGAAEIAYRNVQRLRHARDSPSHHLVLAKGRDADDTRQTVEEDDPESKEIRNELLSLINLLGCVDKSEAYILVEKEDSTPVARHHGVPADDDGNVFMDDADTSSLTPTGSRRSISSSTSAIKPHTPRDSKSSVSGAGINNHRQRRVIVTLDHIRREYQSELDRVSRIERGDWEFGLLDAPEADNGLSAAEWIPG

SEQ ID NO: 29853 - protein, 83 aa, A.fumigatus
PITRATRLSRWYGPVLLHMDMYGAVLRSGLSNMETVWGCNYGTQMDSEVCRLGPSTAQDLNNSINPSPQALNIQVLLYLNIPA

SEQ ID NO: 29854 - protein, 94 aa, A.fumigatus
  UNSURE (1): Identity of amino acid sequences at the above locations are unknown.
XGLTPPPPPPGGLEPVTIGLLFVPLILPSLVSSDTFPSSGLWSAKGRLLPPPFSPIEIYRDGDQGYRLLVAVALATTITHSFLTSHGASELFPF

SEQ ID NO: 29855 - protein, 240 aa, A.fumigatus
RIARVLGPLWRRLAEKLVSLAPGEKLQAAGELHAPPIPGLEKYPKLTLRALLMDYIDIRAIPRRSFFSAIAHYTSNEMHKERLLEFTNPEYLDEFWDYTSRPRRSILEVLHEFHSVKIPWQHVTTVFPVFRGRQFSIASGGELKRTSGGGAKFELLIAIVKYQTVIKRIREGVCTRYLSVLRPGSTLKVQLQRGGLSSSVNQLVGPTVLIGPGTGVAPLRSMLWEKAAFVKAYRRRASGC

SEQ ID NO: 29856 - protein, 203 aa, A.fumigatus
SSGSEKECVQDTCLCCGQAVPSKSNCSAGDSAHPSTNWLARLCLSDLVPASRHCDQCSGRKLLLLKPTEEEHPDANPPIGPTILLYGGRNRAADFFFEEEWQELSDLIGLQVFTAFSRDQRHKIYVQDIIRRNFGLFFRLLHDMNGSVYICGSSGRMPQAVREALIEAFEHGGQADGPQLARRGAEEYLIGMEKSGRYKQETW

SEQ ID NO: 29857 - protein, 162 aa, A.fumigatus
KTRAAPLVFLSPLNSKKRPLVYAWTTYRHIRGLNIPQLEVLATLQSELLLGLAGSALKTQDDLLGGLSLLVEDGLGLTTVTALLAVVTTLTLGEQGGLIDPSSVPVPTHLPWCVGYVHLASLVLGDLVLGVLAALLGLAVRPASFGNVHLERKSYQQLSATI

SEQ ID NO: 29858 - protein, 77 aa, A.fumigatus
ASLFAQGKRRYDRKQSGYGGQTKPVFHKKAKTTKKIVLRLECTACKTKKQLALKRCKHFELGYVESANVAIRGPCIY

SEQ ID NO: 29859 - protein, 91 aa, A.fumigatus
TLPPVEDRITIAVAHRLSTIRDADIICVFCEGRIVEGGMYDEFVKQISMVQADVRRSEPRQEHHGLGPYCGLQCVTSEDGSGFNVYLSCII

SEQ ID NO: 29860 - protein, 316 aa, A.fumigatus
RKALEFIDNSQIREDPLGVHHVYRQPTRGAWPFSTRDQSYAVSDTTAEAVKVIVLLQRIEGFPSRISDERLQQAIDLILGMENAGGGFSAYEPVRGPKFLELLNITELYENVMTDNLYPECTSSVIMCLTTFAREYPTYRPRDIQACLSRSVDYLLRSQYPNGGWFASWGVCFTYATMFALQGLACMGWNESNCAACQRACSFLLQHQNPDGGWGESLDTVRFKQYLPHPDGSQVTNTAYAVIGLLAARCGNHEAIRRGVAYLVKEQQDTGEWLPGPLEGVFAPPGGMRYPNYKFHFTLMALGRYVAIHGNECLAI

SEQ ID NO: 29861 - protein, 198 aa, A.fumigatus
HARLVVVAQQQTTSFDKGKQAFSTSSTGVHECFSLKTKGLMLISSFVVVAIPRKGPVMGARPITSRKSSGLDYDAELALPMPKPRHLPVEDNGESVDACKSEVMINPTMIKKRSVTEPARPEDVKIKADDNSQKEKMKSRVAALRSKLSLKELAKEFRRNSSKNEPAAGNERGQISYVDTQDFNEEKLLVPKPRDPGV

SEQ ID NO: 29862 - protein, 74 aa, A.fumigatus
KETAYYFCYVAMASQSGNAWAQMKAQEQKQQQETANTNFDKGKQASASSVSSPGVHECFSLKTENLGANMLVWL

SEQ ID NO: 29863 - protein, 63 aa, A.fumigatus
FPLPSRFSLEDHLFPLLLLIIKLLPLFRQYHLLLSFHCLTESSEFIVLPSAYLCLHLLPTTSP

SEQ ID NO: 29864 - protein, 64 aa, A.fumigatus
LTSLQALCRICEPIAFMSIFPYVYHMVEAFKVTDDDHKIALYAGLITSSFTFAEFSAGMFWGRL

SEQ ID NO: 29865 - protein, 250 aa, A.fumigatus
SVPRTNETRTIEGTARDVSLLMDYLPAYVFPQGERMISKHMVLGVSLGGHAAWSCLLHEPRVKAGVVIIGCPDYVNLMVDRARLSKLPSWVNSDPPGSRILGSEAFPSSLLETISKLDPASIFLSYVNSNSDAGPPRNNPLPEPTENEKQALRPVLRRCLAGKKILNLSGGADKLVPYHRGEVFLTWLKKAIAPDGWFADGAITFEDIIDEKAGHEVTPKMVDEAVRFITETLASSDDAKKSAYVRESKI

SEQ ID NO: 29866 - protein, 76 aa, A.fumigatus
LGYFFYYSRGHVSAGYGRVGKHRKHPGGRGLAGGQHHHRTNLDKFHPGYFGKVGMRYFHKTNQQFWKPTINLDKVR

SEQ ID NO: 29867 - protein, 89 aa, A.fumigatus
FVLVMDKVTDWDVFFLQLWSLIPTETREAYLSGQKTDTAPVIDLLSLGYSKVLGKGRIPEIPIVVRARYFSRDAEQKIKEAGGVVELVA

SEQ ID NO: 29868 - protein, 153 aa, A.fumigatus
FSAYLLFSKTILLSTRSIIDSDSTEKKKIFKMPFHSRYHVDIPNIHLASLLLKSPTHPLSSTHRCFSEAARPNTHYFTTHDFRLWSQRFAAGLRKAGLQPGDRVLLFSGNDLFFPVEFMGIIMAGGIFTGANPTFVARELAFQLQDSGALFLL

SEQ ID NO: 29869 - protein, 418 aa, A.fumigatus
MSIFGTFQPRGEDSVVQSCLEANIKGVPQEAIFERIQQTRVEFAQALLQRLVEAGAKGAEVFGLLRVVWDALRTRRATYEEALVNDDAEYYRSVLNVLFLALQCHLDSNPRTTPDTSSRIAEIPSDLTLVIEIVKTVVAHGFRSLTTYLHDQPDKCEPKDFALLTAILQTSLQIKNADRLYEHIVYHIEDNNTARHAMSLFSWADQLAVSGDPVYGELSILFLVKLSTLPMLAEHLAVEAVLTRLSTCRLTNILQQPRGFGPFDAVPRLYTIWTAGFLPLCLNLLYHVLRTAPEVAAFLNQFEGQLKRAAESFVADRSGSPSIRICLSMASEAYSLALISFILNRFREAGPSAGVDAQSIQDLKWDKTQVKEDLGELLERRQSLRARMVDTSEKEVELARQKPVKFCLGRREPSGGEN

SEQ ID NO: 29870 - protein, 107 aa, A.fumigatus
SECTCRRAYFLVTTSSDSISGPVNDTATHRKPTEIAKGAGRLSCRDRSSKSASSSATAKAVKDAFTRCWSAYKSRAWMADEVTPLSGTTRNGFGGWGATLVDSLDAL

SEQ ID NO: 29871 - protein, 102 aa, A.fumigatus
IMKLREEFEEAVSAVVHINFETTSLSHFYTFETNIRNLGGLLAAYDLDHDKHLLNKAVEVGEMLYATFDTPNRMPITRWGFHLISLDEYVFTTEAHPLKRAM

SEQ ID NO: 29872 - protein, 95 aa, A.fumigatus
  UNSURE (7),(14),(15),(16): Identity of amino acid sequences at the above locations are unknown.
VGGLHLXSRPSLYXXXPADFLFNCTSLWTPVAYAVDPPAMPDREDLLVRDPKTGVAHPTARSKKIAFGGQAAWFELEYTVATAATILVFVYSFFF

SEQ ID NO: 29873 - protein, 86 aa, A.fumigatus
RRGTDWDVIRKCICSGFYHQAAKVKGIGEFINLRTSVSMQLHPTSALYGLGYVPEYVVYHELILTSKEYMSTVTAVDPHVSRTIFI

SEQ ID NO: 29874 - protein, 125 aa, A.fumigatus
WLAELGGVFYSVKEKGYSQRERRVTEQEFNRRMEIETQMAADRERAAAEKLREQERNDPSRRKKEVEAGSVVRRPAVTGARRIGGVTASSTTRNGTNGASGGGTVVKKPQIKRRPGRAFYDHVQA

SEQ ID NO: 29875 - protein, 88 aa, A.fumigatus
TSMPPKRIQTPSSSSLSSGPAVLSSNSSVYQIAHHVWQQYLTTTPQRTMMLDAFMVFLLFVGAVQFLYCVLAGNYVRPVPRSVGSITN

SEQ ID NO: 29876 - protein, 62 aa, A.fumigatus
PFNAFLSGFCAAVGQFVLTASLRMQTSSELKGVNSKPSSKGKNARFAAVEGGEQQGAVSHER

SEQ ID NO: 29877 - protein, 74 aa, A.fumigatus
LSTTMRLLPLVLLPLTAQAINIVSSNDDGWAEINIRQFYKALTAAGHSVVVSAPAENQSGKGSPVSPHPQLNRS

SEQ ID NO: 29878 - protein, 242 aa, A.fumigatus
SQLTNSGSSDKTPTTRTKPCEFNSCPSGSPATGFNASDPRLNYVNSYPVTSMKYGISTAAPPFFNDAPPALAVSGPNVGSNLGLAVYFSGTVGAAHYAAEAGIPAIAFSGSSGSPTAWNAAVPAYSRVYAQLATKITNQIVASGTPYLPDQVWLNVNFPEVSSECAAADDFKFVLSRIFTGIFSADDVETCGSSRLPTESTVVGTDGCYVSISVGWSDKTDAAADVQAIVLDKLGDLLVCLP

SEQ ID NO: 29879 - protein, 243 aa, A.fumigatus
AYRGSSNLNQLPSGTFCAVHCSEAVPVTNPSLQVITMAGVGSNLKAHQYEPSQTSEVGSETRSATTIEYRRHPIYYPSEWLLESISSLMALGLLLGIAIIFWYMDNKPLSAWRGPISLNATISILTTACTAMLMHGVSTFIGQSKWLHFKNRPRKLADLETFDGASRGVWGSILLLTTIKWNLATIGAFITILRLAFSPFTQQVVLIEQHEIISPSDTAAFGYAHNYSRNVLSGLANAGVGKP

SEQ ID NO: 29880 - protein, 186 aa, A.fumigatus
NSLQLFFLDSGTAPVVTELSETSKAGSDSEEDTEAEETHRAVWHDSDDERLTISLASHQRLRKLRVTEAEDVISGKEYIKRLRRQFEQLHPVPDWAKPELNKKRTDSDSELDSDMDTDDENERLSTQPLAKLLQGATDLTTLGESTGAGGKRKLRQEVIDIHRLKDVGKDQPVSFCASGNISWFWY

SEQ ID NO: 29881 - protein, 325 aa, A.fumigatus
GCWQGSASKFLRQRQYFMVLVLMFLLQSSIDSLMFHPHYPLLLSSGPAATLFIHHISPSAEAPNPLLTSLHIRRTPIHTSAFAPPTGNKIFASGRRRYFHIWDLDTGKVEKVNGTADRKEEQKSMERFKLSPCGRYVGLVGSSRKGGGIINVLHSETAQWIAQVRVDGRGGVADFAWWSDGEGMTVASKNGEVSEWDGRLNRVVARWMDAGAVGTTTLSLGGRSGRTQLGGDRWVAIGSSSGVVNVYDRREWAAAYAAQPASSEVSPIPRNPEPVRALDQLTTPISHLVFAPDGQFLVMASRWKRDALRLGKSLVLSLLMVTFFY

SEQ ID NO: 29882 - protein, 272 aa, A.fumigatus
RYYITALQQVPSMCEVRSIENIEAMALLVVYHLRSASSHGLWYIIGLAMRTAIDLGLHRKANEINLDPWTAQMRRRLFWTIYYLERVISMSLGRPFSIADRQIDLPLPVDVDDDVQDPAILTAPPRTDRITSLTFAIYLFELRRIDSRIQHKIYRADRPLHTLRSKMDRLFIELEEWKRSALQRFSGSDLDYPMLHYNRALRLLIQPFLPSLPLSDPYYHICLRAAGDICQTHQRAPPDPRIMANPFPPCSKTVFLGPVSTPFGYPLLERPP

SEQ ID NO: 29883 - protein, 60 aa, A.fumigatus
GVVQENVAKAISRGILIVPTLFQQLFSPQRLMLTDELLYYEKLYIWHTLLFTNDTALLFL

SEQ ID NO: 29884 - protein, 67 aa, A.fumigatus
LSINLAPSYSEDSQPLNTHTYRTNIEMTIKETQDLFRPGTSHQMMLILIVLIENAQTLYYFLWMDDG

SEQ ID NO: 29885 - protein, 65 aa, A.fumigatus
AGVPSSCRFCPTNFFFFFFFFFFFFARICHKASRVSPYRITKHSFSIYFSGNLVLNWKIKYSVSP

SEQ ID NO: 29886 - protein, 79 aa, A.fumigatus
HIKTSLWVSGNQAYPAQCRSLYVLTQARLASHSQSKALLTDVSSSIALAVAYKDSDIRNVAAIVLGTPGTPYQFGLFEV

SEQ ID NO: 29887 - protein, 61 aa, A.fumigatus
FSIGFGKGRTADRLITICGECQMADIVSDYPATPPIVQITTTNAGRCRFGPNLYAGGKVCL

SEQ ID NO: 29888 - protein, 60 aa, A.fumigatus
NNISHLTLTADCNQAISGPTFAKTDAELAGSQPMGLILSVNEFKPQRDRTDKESPGFPTQ

SEQ ID NO: 29889 - protein, 64 aa, A.fumigatus
WPLDKRPPYYASQGDRFSDILHMLLKMRSLPPKAAPGPDGILKAMDGSDENAARWFDMIKITRK

SEQ ID NO: 29890 - protein, 308 aa, A.fumigatus
TPDPTSNARQSQLSMIAASASEMVPQGIPMDHDPNALMPDGLPKLGSSPWNQQLSSHEQLLFDSLQEHDPTLTAATQRAASFPRPIAMNPNSQTKGFVNEFGNATKPTKPKVRGRFSAARRREVQEVRKRGACIRCRMLKKPCSGDSPCTTCASVESARLWKHPCIRTRIAEEFELYNANLHATLAYHDVSSIKNQVKFEHYAGRIEVTHFEESMVYITFSGLHGHKPSMSTLDPQLQGLGDDPQFQGPLHELYLLDSDADDLPGKIEMYIKKTAPFFYARETSEIIKHTLLLASELSQQKKVSISSV

SEQ ID NO: 29891 - protein, 83 aa, A.fumigatus
RTDGRVAPRSGLASKHFIDTGAGVIDADYRGEVKVLLFNFSDVDFTVKVGDRIAQLVLERVRLFLCVILGVLMLTVSRSIRPT

SEQ ID NO: 29892 - protein, 297 aa, A.fumigatus
RQLPNNTRVGSRFRDPCSPASSRIGVEKPEEPGDRNSPGNEKAGHAPGQLQSCGPRQNSPIGSNPISLARAWTCGASELGLLKLCLRLRSSAKLANMPSQLNSAVRVHRQTRLTNTCIFLLGQLATLLDKYTAISLSSIHLTISTQVMTKETTPPPQQSKAPTHEPPSLPASPLAKRTKPDSNNTANSNKMTTGTAPAVTSISQPLPPLLVKKLTESAQAPTRGSAFAASYDLYSAKETVIPAKGKALVDTGLAIAVPEGTCMPPSSPYFLWSVYANQLTNRRPRCPPEWSCLEALH

SEQ ID NO: 29893 - protein, 104 aa, A.fumigatus
LQQFGFGQSNPTYLITGSDKQQYVLRKKPPGKLLSKTAHQVEREYKIIHALEKTDVPVPKAYCLCEDSNVIGTPFYIMEFLDGRIFTDPAIPGVSAEERTALYV

SEQ ID NO: 29894 - protein, 245 aa, A.fumigatus
PSALGQTDTKCRRWRDAVRTLAKFHRVVPKSVGLERFGKPSGYYDRQIATFTAVSNAQAQAVDVETKKPVGELPHFMDMVRFFSNKATQPLDRGTLVHGDYKIDNMIFHKTEPRVIGILDWEMATVGHPLSDFCNLTSPYFLDGTDHKTEQFQPGVVPGLPRREDCLRWYREVAGWDPTPDFSWGDAFFSWRSSVIMQGIAARYALRQASSARAQEYAQKTGPFALEAWERVKKVQEQVRQKGKL

SEQ ID NO: 29895 - protein, 63 aa, A.fumigatus
IFRRRSSIYLSIIPLSGSYPYVFFDTAYQASANAYWCTTQCVLGHLENLTCYYFKCRPLFSDF

SEQ ID NO: 29896 - protein, 645 aa, A.fumigatus
EKLRCVCVSCNLKRRNLLIISCHPLSIGTISSSDLADFDTLPNDGQADNSSRIPSSQSPSVAALPSDRPRKPSVTRRISSRRQVPHKGQEFSTDDDVQEVEEDIAMQQQGSNPQPSPRLRPLRKQSSTLRRRLNARPSPLARADSDNDSGEESLLPESCMEAIGTRPPSQQSEASSHHGINHGDGDNDETSDAESFTLKDRQQAINETHPFGIRLWKPALYKKSRSVEKMLREIFIRLLAAEWEIYSSWPICSGLLSLGGGSLLLLSSVPSHVSYLHILLAQWSTEKSSGDFHGTSSIHSGLLFVWRPTNTMRRKMRVKAAALASMSNGRTVISSTAGFSLAPVAAGLSWVGVAIAIDSVSEQDSLLGRTQRISPRESNLHSKRRLFGRGEWTLGRVVFFVFFYFLIGPLMLFVSMVCWLLVFWIPMGRVTLILFDHLRRHPLALSFHSDTSYTRLSPGSPSSILLCTYRAAGLSYWKYTVDGTNIFLINLLGVVLFVIIDYFLLAETLGLHNWMTHPGFVFTLALVSIIPLAYFIGQAVASISAQSSMGLGAAVNAFFSTVVEVYLYCVALTEGKGQLVEGSIIGSIFAGILFLPGLSMCFGAIRRKTQRFNVKSAGVTSTMLMFAVIAAFGPVFTTGAEGSAL

SEQ ID NO: 29897 - protein, 168 aa, A.fumigatus
DERCGELHPERSSTGHQRNAPIWHQTMEAGSLQEEPFRGEDAEGDIHSSPGGRVGNILFLANLLWTAFFGWWLALAALFGAIACFIFAYSPSAVEYGKVFWGLSWYLLYPFGSFVRLETDEHYAEEDEGEGRSISEYEQWQNGDLEHGRLFFGPRSSRSLVGRRRNSH

SEQ ID NO: 29898 - protein, 250 aa, A.fumigatus
LVRIPNQFLVPLNLPVVTSYRRIDAPQLERLAAGDHVRFELGGYPDNMFFVELPTFDAFVESAQQGVVTFRCISYPPAFCASARWRMRHCGSFVTCQAMLDALVALVEKKQNGCVLYPLLVENKSPPEYLPLGPAYDFREDLNECQNRAVAAALTSRLSCIWGPPGTGKTQTVVAILQELLQRRPEERILVTAPTHNAVDNILKRYLCVAGSTGAIPLRVSTNVSVSSILGNSFEYSHSNASASANSFVN

SEQ ID NO: 29899 - protein, 275 aa, A.fumigatus
IRKVSSDLMQYACDAMDRREFNFDPAARRRALERIQQSRLIFTTCAGAGLGLLRNEQFHTVVIDESSQQTEPMSLIPLVKGSRQAILVGDHVQLRATVRNHAKAMGLEVSLFERLYMGGDTANDALSKVMLDIQYRMHPQICEFPSAEFYNGRLQAAASCQNNPLPPSNFPWPSLPSAGGGQVRCVFVPCLLEEDIGHRSKANAGQAQLCQRIYQLLTDSRSSTGAATMPIAILTPYTRQVKNPSSLLFPTSCFKFPPFQRVSKGQENKMFITLC

SEQ ID NO: 29900 - protein, 399 aa, A.fumigatus
  UNSURE (381): Identity of amino acid sequences at the above locations are unknown.
ERNILLGLALGEYLSTVHQTSFSVLTTVDEVGVVESELNSTVDNVVNGFDTQHEGVVLVANLVAPATEAATRPNVLVLQLGQDLSESTLTLQCGGGVAMVEAAVVGGDNLIGGLQHLGIDQTLDAVGQDSLLVDRLHRGFGDLQHDRPIRALLGLSALRPGAIGKLHGGKLLRGLRLVVRGVVGEDGGTVERAVVLGEVELNSPYVSTKNGDCRTETGPVVLTYPALVTDSLGAGATNTNTDDVGGRVEQLLGETNELLVVHGLGQEINSHGGDKLLVADGGAVLQRHRLVVGIDLGNLTLLTEAGLLLRESVGHGNPDTTSTATGGEAECSVRTPVTSGLAEDNVGRHGLEIGSSNTLTEPGALHLIYISLFVPQVNRGXTPPGNWGPPPPDFQTYLG

SEQ ID NO: 29901 - protein, 406 aa, A.fumigatus
  UNSURE (31): Identity of amino acid sequences at the above locations are unknown.
GPTTSRSGLCPLSKVRLKIGGGGAPISGRSXAPVHLRNKQADVNQMQCAWLGERVAAPNLKAVTTNVILGKTAGNWGPNATFRFPARGGTGGIWIAVANTLPKEKTRFGEKGKVTKVNANNKTVTLQDGTTIGYKKLVSTMAVDFLAEAMNDQELVGLTKQLFYSSTHVIGVGVRGSRPERIGDKCWVSQYYRPSFRSAVSVFCANVWAIQLYFPEDNCPFYRATIFSNYSPYNQPEASKKLPTMQLADGSRPQSTEAKEGPYWSIMLEVSESSMKPVNQETILADCIQGLVNTEMLKPTDEIVSTYHRRFDHGYPTPTLEREGALTQILPKLQDKDIWSRGRFGSWRYEVGNQDHSFMLGVEAVDNIVNGAVELTLNYPDFVNGRQNTERRLVDGAQVFAKSKAQ

SEQ ID NO: 29902 - protein, 88 aa, A.fumigatus
LPNYCFSVTRIWQPFGRFWVISWCPERRRTKIHRIAILGQPGQFRTQLDLFAFSGRVRELHKPKAKAGKTLFAVNYYLPYPLRQANHE

SEQ ID NO: 29903 - protein, 384 aa, A.fumigatus
  UNSURE (183): Identity of amino acid sequences at the above locations are unknown.
PSDQITTRTAQLLQHNPGEPTAGALNLLFIMAAPNMPIRLSVHTGTQDGKHPQLPKGSQPTPPITPTISHGRSSPGVDTPSRSISPVPFSGGQLHDAVPSDHQNVTAPHKFSDELEFHYDSKGRKLEFGRGVWSVVYMASSRAPSIPAALSPPSSPASGSRVVAVKMPGRRDAPPVLDAEALXLTRLSMVAGCADHIVPFHGYIADSHAIVMGAVPLALSAYIEEKASAAKKHMSTSTMFDPVQGMAEWHGLANKLVAGLDWLHNGARMVHGDIKPNNFLLRPRPIANDLDSDEFPFEAALRRLFLCAPHRRLHLPQTMATALKALMPPFTAPETLVHLGAQVPWNFVPNSNRQKSSSPPNGILLPNLRMGRFPYSYPGPPAKL

SEQ ID NO: 29904 - protein, 346 aa, A.fumigatus
  UNSURE (5),(8): Identity of amino acid sequences at the above locations are unknown.
GPVDXDQXMAARVLKGLQGRTDEWGYRIPFAIQWVWPVPIFIGVFFAPESPWWLIRRDRRDDAVKALNRLARTGHPDFNADETASMIVYTNTLEKQVETGTSYVDCFRGCDLRRTEISCLVWAAQSLCGGGLMGYSTFFYRRAGLAVSQSFTMSLVQYAIGVVGTFLSWVMMTYFGRRTLYVGGLALLAIVLFVIGFISIPHSTPALSWATGSMLLVYTFIYDSTIGPVCFSLVSEIPSSRLRTKTVVLARNLYNVINLVSGIIIPYMLNVDAWNWRGKSGFFWGSFCTCCLIWAFFRIPEPKGRSYAELDILFERRVRTREFATAETGLVEGRSDYKVDPLAVRV

SEQ ID NO: 29905 - protein, 228 aa, A.fumigatus
VGLPHPLRHPVGVARPHLHRRLLRPREPLVAHPPRPPGRRRQSAQPAGQNRTSGLQRRRDRVDDRLHQHAGKTGRDRHILRGLLPRMRPAPHRDLLSRLGRPESLRRRAHGLLDLLLSACWPRRLPVLHHVARPVRHRRGGNLSLLGYDDLLRSSHAICRWTGTAGHRSLRHRLYLHPSLHPGPLLGHRVHAPRLHLHLRFNHRPGLLLSRLRNPLIPTPHQDCGASP

SEQ ID NO: 29906 - protein, 124 aa, A.fumigatus
RSQRLFVLESRHCRTVAMSHLDNPGTLLKEILVRIPLILKTALLHALHMSPGSGKQDLRTELTVAIIRSFINFKLPVSKQQKGSMRDPGIKGPMWVSKVTFPRPENDVQDAVIKASSPRGGDQR

SEQ ID NO: 29907 - protein, 104 aa, A.fumigatus
IDCLPTTIVPSTCLTWVSSIIVAPSTALEFSVPQSHISTLSFFHSSFALMGALISYTYAPSFFALFLSFFCQYVFHILRHATGDYLIFSSPRPVPIILYSVQAV

SEQ ID NO: 29908 - protein, 149 aa, A.fumigatus
  UNSURE (3),(13),(16),(20),(21),(24),(28),(31),(32),(39),(42),(43),(46),(49),(50),(51),(52),(53),(54),(55),(56),(57),(58),(59),(60),(61),(62),(63),(64),(65),(66),(67),(68),(69),(70),(71),(72),(73),(74): Identity of amino acid sequences at the above locations are unknown.
GGXGGGGGGGGGXGGXGGGXXGRXGGGXGGXXGGGGGGXGGXXGGXGAXXXXXXXXXXXXXXXXXXXXXXXXXXXXXXXXPHPPYLALTYPSAVPVSHSTITHMRSKRPPQELSPEHIFLAHRLIGLNVLVKVESTDFWLQLNQSGKQP

SEQ ID NO: 29909 - protein, 65 aa, A.fumigatus
PSVVDDVQVAPGKNACQHAERSWTDGGNPPLRLAIGALFSYKCSDPQSLYGVKLYIRPGLHLSRG

SEQ ID NO: 29910 - protein, 72 aa, A.fumigatus
IWGADSKFAASPANGGMGNQKISPIPSQSWPDSPEHHQVSVPVFATALVTQNRQNVEITAIPSIQGMELQRQ

SEQ ID NO: 29911 - protein, 342 aa, A.fumigatus
  UNSURE (314): Identity of amino acid sequences at the above locations are unknown.
QVWQTFKSALTGRANYCFFPWGYRLKDPYIGFNELEARWVNEKSWTYKTVFQKPAAPAGSCIVLAFDGLDTFAKVKLDGNVILENDNMFLARRVDVTKALEAEGDHVLEIDFDCAFLRAKELRKQDPRHNWASFNGDPSRLSVRKAQYHWGWDWGPVLMTAGIWREVRLEVYSARVADLWTEVQLASDHQSAQVTAFVEVESVHSGSHRACFTLSLHGQEITREEIGVTENGTAKATFDVKEPSLWWPHGYGDATLYEVSVSLVKEQEELHRVSKKFGIRTAEVIQRPDKHGKSFFFRVNGVDIFCGGSCWIPXDNLLPSITAERYPQWIELMVHGRQVMIK

SEQ ID NO: 29912 - protein, 219 aa, A.fumigatus
  UNSURE (123): Identity of amino acid sequences at the above locations are unknown.
YPCLTRSRTRMNGATQTFRRPSVATNPSQTRDLPQTTSATHPTVGAYTPPHMNSNQSGAIRNGAGENRYSKEQLLSLYKAQRESGTLGKNVADYFIADWEPHVETPPTNGAWGKREDSKDNPXGPEICWDHGGQVEPLGLVDMTGDEKEVGFVFVCPLGSEHLKIALLIHVGTCRAESCSYFPPRSTLRSSLPRPAPPRKIPVLPLEDASHPFRIPRAT

SEQ ID NO: 29913 - protein, 147 aa, A.fumigatus
LFSASVNSPLKPPPTSATKENTGAATGGRKSSISYPQSHMNNYNTSSPSSARPGPRRRETGESVSNAMSPTTSGSRFFRDEPTTFTPPPSLLRRKTDFRETTSISKWDQKDKEAPARDGGSGEVASPFGSVQRSATLMITPGSRRNR

SEQ ID NO: 29914 - protein, 65 aa, A.fumigatus
AQMELVKLILISSWSLTQVANNEVTGSSFTDSTLMIKMSIVDLQNVLIETCKTDTGYKRYLLSTF

SEQ ID NO: 29915 - protein, 116 aa, A.fumigatus
PPMRLFTDFVTKVIGPVNTMLSKIYPDTYKNSPASRNVSSIVFAGTVLGQLIFGYVSDHWSRKWALMVSTVILIIFSALSAGSYGAHGSQAGLFAALTAYRFLYCRPGPGRYRDGV

SEQ ID NO: 29916 - protein, 108 aa, A.fumigatus
THNLLAAACRHTVLIVSLPTGSGLHKSLPFRDSDWWCWHSGKLPISSSLPHVDVWAADLLQVESLLIYPAPSGEIPSSCGLKTINYIGNTQDQRQALKNLWWRQYWPA

SEQ ID NO: 29917 - protein, 65 aa, A.fumigatus
LTLLIGCFVFIHHRCPSSPSSGFSLQCLVIPVTQTDDILSSADQTNAHQSATDGVLYRASVQWRS

SEQ ID NO: 29918 - protein, 171 aa, A.fumigatus
DERIGSIVWHSFLPSPENPATICSINLQKMHSAFIVLAALAAAVFVEGTDVQVFQAGPTTLPLHAVKASVVNANAVATTLAIKCEGNVCTPGDHCGLCSPFTITQGPSTYSVSAVYSASVGGVEETHTVVQDCDITSSTELGHVHTVRQSGSLGTWKKDRHLVLGDGYLPL

SEQ ID NO: 29919 - protein, 599 aa, A.fumigatus
  UNSURE (590): Identity of amino acid sequences at the above locations are unknown.
HFASSFRHLYSLICVLGQQGNSARSPPPVFASSLQQLSAVSTPVLTLPAAASHDAHDDNVIFLRSRVRSPHRSSSSSRQRRRRHQILSEFESDPMELDESTGVRMSVEISRHPIGRRPREEPTNMPNYEGRVSNIRSLYGWAPCSDEDDEDDLVYEPLQDPNSASSWFGRLSDRNATSRRHARRDVTGRSPLPIPVEPSERSRHRMDDTTLATAEALLQSVRRQPRLSRTRTLHNYLLDRERTSQDSEDGRERATQSSTSRAYRFIPSSRGESSRISTHGDVRARANAHRQLHMDHPPSPRLKEIITYLDRLRYSTSFEESLSSAAAGGFAQLDFSWDEDDFILDTTSIAPPPPCSWLRPGMVFKGSQMAACTPSSIFAHVGPTFHPATEPVIVNGSDNGRISVYTTSGRRYLANNNIPSFGIGKDENWPVKVTIHNINYQEMTLSGTMEAYNIPDKTSPSHDAHIVTFLEGEIIDFNTHTLETKNFKSDAETDSTYWRELQPFKHLTDDEMTRNLVSRKWITEELSKRWILMRWKGVYLIFQHLSNLFMVCADDGTERCFITPTDARQGLTISGFYYISLRGHIGHMSXSQRWRSTLV

SEQ ID NO: 29920 - protein, 90 aa, A.fumigatus
KHTFRLSLTWDRRSFGGGCRPKHSLPLPSHKHVFWFHINSAKLKYFWVINIGGGATVPNDNIDTCIIVYQQYVNDSRSIYQSGEVFSQWS

SEQ ID NO: 29921 - protein, 118 aa, A.fumigatus
MMPHQSQGACMAIEEPPALGILSRPPPPHPPAPPRAAPPPTPPHYPPPPPPHPPPPPPPPPPPRPPPLGTPRFTGPPPPPPPPPPPLKQPPISQKTKAASPPPPRPPTPRPPPPPPQL

SEQ ID NO: 29922 - protein, 212 aa, A.fumigatus
ATNATADSAPSLRPAHRTAVRRGGHDERMKYKTSSLDLWNESFITRNKTSNMRLPQADADSASNMRSTATGWRRLSVGVVGGGIGGLAASIALRRAGHEVTIYERHDFAGEVGASISCAANGTRWLHEWKVDIAKGDPVVLRKLINRDWKTGEPVSVYDLAGYEERWGYVYYMFHRQYMHAMLKDCAMQEEGEGTPVKLLVNHQVGLLAHTQ

SEQ ID NO: 29923 - protein, 166 aa, A.fumigatus
EQCKDINLETGLITFANGKTAQHDLIVGADGIGSAVRGIIGLKPEKKPADSSCLHANVRTEDAVRLGLVDYSQHSALEYWGGQDNSWDKIVLSPCNGGSLLSYYCFFPREKGDFTNHTWGGTDRPVEELLAPYPELDKQVRAHLPHWAGDPAVAAVGASAVPVSGP

SEQ ID NO: 29924 - protein, 159 aa, A.fumigatus
RGGSWGGGGGGGRGGVGGGWGGVVGGGGRGGSAGGGRGVGGGRPGEDAQGRGFFDSHAGALALVRHHLQPISGGRRGGKWEPKVPDDQHRPADTPCYGPDTGTADAPTAATAGSPAQWGRCARTCLSSSGYGASSSSTGRSVPPHVWFVKSPFSRGKKQ

SEQ ID NO: 29925 - protein, 125 aa, A.fumigatus
WGGVGGGAARGGAGGWGGGGRERMPRAGGSSIAMQAPWLWCGIIYSQSAEGGGGGNGNQRYRMTSIAQQTHHVTDQIRVRLMHPQPPRPDLLPNGAGAPEPACPARDTAPAAPQPAGPCRPTCGS

SEQ ID NO: 29926 - protein, 203 aa, A.fumigatus
APDWNRRILELITILENSDTRKQVNQGWGAQTGDKAGDKAWDDERAAENLAQNESEPQTPANEEPAEPAEKTKTYAEYLAEKAAQGDLAAKPIRAPNEGSNLDKKWANAKELKRTPEEEEAYIKGKEEKAKREKQRKEKNVLEVDMRFVESPRGGSAGRGRGGRGGRGGRGGRGNGAPRGEQQQRGAPPVTVDEKNFPSLGAK

SEQ ID NO: 29927 - protein, 72 aa, A.fumigatus
PLNRQNPVVMSNADKVFGYIVQALEAETLQGQTAGRVANSAKQLVAATGLNAEQILAGVSPDNQAAVRSYFQ

SEQ ID NO: 29928 - protein, 303 aa, A.fumigatus
AINEAPRLLQTTFRRHPTLATLATGPDQRVDVHAPTIPIISIPTSLSTGEYSDFAGATDDTTRRKHSFQAPTRGPQLVILDPDLATTTPPSIWLSTGIRAVDHCVETLCATTGKSETTDAHAMHALELLVPGLLRCRHDPAGHDRDARLQCQRGAVNAMATLTGGSSVELGASHGIGHQLGPLGVGHGETSCILLPAVCKFNARHGANREQQERARDFLVRNAEVARVLRDRGVDASLADLGDVLDAVIRELGMPRSLKEVGVGRDALDELAANSLHDRWCKTNPVPLTEKKQVLEILEMAVE

SEQ ID NO: 29929 - protein, 93 aa, A.fumigatus
SNPRHKMLPEAPKNKSLYEEAVEAFSFLKERLPETLQHPRVAVICGSGLGGLANTIHDEPRAEFEYSSIPHFPCLTGKNEALKLNINLLISDL

SEQ ID NO: 29930 - protein, 79 aa, A.fumigatus
KLQHIFPAGFAGTHPLRGPNTEEFGPRFPPLSDAYDLELRRHAHQAWKAVISENSTRRLHEGVYAFVAGPRFVTISPGP

SEQ ID NO: 29931 - protein, 120 aa, A.fumigatus
LFLQDHEFVCNHTLIIHSYETRAECRMLRQVGADLVGMSTVPEIIVARHCGIRVLAFSLVTNKAVLSPVPRGDDHLLQAKDVKELDSILQEGKANHEEVLEAGRTAAIDMQVSALRSLSV

SEQ ID NO: 29932 - protein, 127 aa, A.fumigatus
LTILSQPPKLSKSAKEDLIVSHLRSTRTCHTLKDLEKMLPSVASINGMQVKEYIQNLTDEGKIRVEKIGSGNWYWCFGGDEKREKQARLNQLEKEVKMLQASYDEAEASLADKRGLHHGGGRIRAKI

SEQ ID NO: 29933 - protein, 86 aa, A.fumigatus
KQPADTARISETDSLSWKSSEDFPRCSPTGDPHHDRTMSYGKSLALSQNSFVQPPDQDDGARDTQGEPVLRRQKRQATVYDAVAGW

SEQ ID NO: 29934 - protein, 67 aa, A.fumigatus
SIQQRLGTSTTHQTTTNAPFKPILTRNHQPHTAHHPFSLRFFDHLSTSVNAQLPSHTVHYTRRDLPL

SEQ ID NO: 29935 - protein, 408 aa, A.fumigatus
THSSPSIRIKRVYELTAGRLLILLRGTDSITTNPLQKRSSSTASMSRPASVAEDISQGYQDEAGTDDENDVPVNKKTSFNGRLNQYFHASKNVAPTGESLSKVASAPDLPTATIKRKPESDSEPPSDPSSNASALQLPIKRPRTLRSSRSSPVITNLTPRITRSRSASSTTSLPPSTPNSPLTPSTTPDEISRSRSRRRQPSTPATSSICLLRDTIPPNLTLLLVGVNPGIMTGTTGFAYAHPSNLFWKLLHWSGITPIRHPPSDTYRLPELYNIGNTNIVERPTRDASMLSKAEMNAGVPVLEAKVAKQRPEAVCLVGKSIWEAVWRVRKGRPIRKEEFRYGWQDETENMGRCDGPDGWEGARVFVATTTSGLAAGMSIAEKQAVWNELGRWVIQRREALAGKRPSQ

SEQ ID NO: 29936 - protein, 544 aa, A.fumigatus
  UNSURE (512): Identity of amino acid sequences at the above locations are unknown.
KRKKKHVLFLPTWCNTELLRYPREIARKIPANRFNIDAFYHPDGDHHGTTNVQESYFLDEDVRAFDAAFFYISPTEAAAMDPQQRLLLETVYESLDAAGLRMDALQGSMTGVFCGALRNDYSQIQTMDPQALPAYMVTGNSPSIMANRISYYFDWRGPSMTVDTGCSSSLLAVHLGVEALQNDDCSLAVAVGSNLILSPNAYIADSKTRMLSPTGRSRMWDSQADGYARGEGVASVVLKRLRDAIVDGDPIECVIRASGANSDGRTMGITMPNAQAQQALILQTYARAGLSPQERPTDRCQYFEAHGTGTQAGDPQEAAAIHASFFGPESVADPLDRLFVGSIKTVVGHTEATAGLAGLIKASLSLQHGMIVPNLLMQQLNPKIEAFAAHLCVPTECVPWPAVPEGCPRRASVNSFGFGGANVHVVLESYTARQITPSHNLPSSLPFVFSAASERTLTSVLESYATFLREHAAVSLPSLAVSMWTRRSAHRHRLTLIARSVEELQDHIDKEXSRRATGTPSSIVSRPSSRPRRVVLHHGAGRTA

SEQ ID NO: 29937 - protein, 109 aa, A.fumigatus
  UNSURE (97): Identity of amino acid sequences at the above locations are unknown.
WMVMQPSTLIVLCQQIAVPTNLLNQRGLMASAAAFATQTETRKALTGWLFQDLKGDLTPNALKNPGCTVHGTTSYITPNQAEHSRGDHILFAALLLXKAPKSCYKLQLL

SEQ ID NO: 29938 - protein, 60 aa, A.fumigatus
LHRHTFDHDITAEKKQKKFLDPGLSLTARSIQGAISSILFLFFNLYFSSVNSFICIYGSS

SEQ ID NO: 29939 - protein, 755 aa, A.fumigatus
IDYRRSFQPRGEDDRRLNWAMDIFSAGCVIAELFLEAPIFTLSQMYKYRKGEYSPQHSQLAKIEDPEIRGMILHMIQLEPESRYSAEEYLNFWKNKAFPEYFYSFLHQYMSLMTDPSSGRAQVEAESANRGESDDRIERVYYDFDKISYFLGASSKPVKDGPSRSNSRLTGNGFPIHLDLPNYGLQAAKSQPRTDDGVLIFLTLVVSSVRNTARASSRIRACDILLAFAERLSDEAKLDRILPYIMILLNDRTDSVKVAAIRTLAQLLEMVQVVSPVNAYLFPEYIFPRLQPFVSSSSSNPSPMVRAAYASCISSLAQSSLRFLDMIQALRSDTRLSALIPAGSEPRWTEDATFHNLYDVARVELLDYFENHTKALLTDSDASVRSAFLSSVPNVCVFFGNLKTNEVILNHLNTYLNDRDWILKCALFETVVGVAAYVRSTSLEQYILPLMIQSMNEPEEFVVERVLRSLAAMADLGLFQRSTTWEVLQVVVRLSVHPNTWIREAAVCFIINSAKHLSIADKYSILGPLVQPYLRVNIVDFSEEKLLDGLKKPLSRSVYDLAFVWASKAEKGLFWKSTARDEVFSVGGTDHLLPKGGQKNQNFSHNAQPKNEEDEQWLSRLRNMGLGPDDEFKLLALRSYIWGVSMRQMKESDDAVSSLNNVIALTQYGVTPQTVFFDKQQSVKPQGPPLPKVDDAGLGESKPHTITDALLDASTTIDSASHTRRRHLRTRSQLQRDPGNANDMSSPRGWKEPRH

SEQ ID NO: 29940 - protein, 69 aa, A.fumigatus
TKLSNCIGYLADADDNYPNLERFVAVFLIKFAQDSIYGSGNSVVIRRLSLLAITEPALSHFTLDVEELG

SEQ ID NO: 29941 - protein, 72 aa, A.fumigatus
CAPRCGAMPVAEKLALILKLWSFGNERGLLHRIFRDDMVYGVYNMSTMDQFSEGHSLFPLELKTGFLSLIRL

SEQ ID NO: 29942 - protein, 186 aa, A.fumigatus
IHGSANMDEISWVATEKGQTLGLSNTTFGDRSWPKILDGEKLMNEAINAHVQAGEDEDQLINRLLQVLSRDTLPRLSGDATMDTYLLLLRQSIFVPVIGAQAEKPRAADEVAAARDTDRVPVESQPPHDSLDKSFLQGAYGTQKQTVVLVSANGRVRYFERTLYDNDVNAIPTGKGDRSFEFHVSR

SEQ ID NO: 29943 - protein, 685 aa, A.fumigatus
QGFWPPDSTSTGWNKEDFMESEDEGPFPVMVVPRITKLGRIEAPAVAIDDDGFATVGRGGKTLQYTPESILKHLRVIVESRGKKNTDRMEQIRTMEKLLEVAQTPYQRIRVYLTLISTRFDLTSTSSANYMAVDQWKSAEQDFSSLLSVLENNRDHVVFEDAEEWEDDEKQPTIAPGETLYIPGSIVSFAERLDDELTRSLQHIDPHTAEYIERLSDEKLLYTDLVRAQAYVEGLNEVEKTDPRQDSVNRVVMRRLEHVYFKPSQVITILEDATWKSLPSELDSSITPRASSGNVENLVLSLCNYLFKYSDGIIRARAMLCQIYFLALHDQYYRSRDLMLMSHLTENISNFDVSTQILFNRTLVQIGLCAFRSGLIYEAQNTLSEVCGSGRQKELLAQGIIMQRYSTVSPEQERLERQRQLPFHMHINLELLECIYLTSSMFLEVPLMAQTSSSPEMKRRVISKTFRRMLDYNERQVFTGPPENTRDGVIMSAKFLAAGDWKKAAEMLNSIKIWDLMPQPDKIKEMLSQQIQEEGLRTYLFTYAPFYDSLSIATLSNMFELSEKKISAIISRMISHEELAAALDQVNNAIVFRKGVELSRLQSQIVTLADKSMNLLEANEKTLEQRTQGMANAFQRDQGAGARGGRGSGRGGQARGGPRFPGGQQGRRPGGQQFGGGALGGAIKA

SEQ ID NO: 29944 - protein, 68 aa, A.fumigatus
IYTMVAETKLYDALNIKPDASQDDIRKAYRKAALKYHPDKNKDDPKAVEKFKGELLLITRHCQRMNPC

SEQ ID NO: 29945 - protein, 207 aa, A.fumigatus
QKAEVSQAYEVLSDPEKRKVYDQYGLEFLLRGGPAPGPGGAPGAGGFEGFEGGMPGGFSFGGMPGGGTRTFHFSTGPGGGGGFRFSSADDIFRNFAKASGGGMGGGMEDDDLFNILNGGLGGGGRGFRTSRGAGAGGAGGGGFQQANRAPTPEPSVVEKELPLTLDELFKGTTKKVTVKSKTFDASGKRTVQDVTLEANIKPGLRTG

SEQ ID NO: 29946 - protein, 184 aa, A.fumigatus
PVRRPGLILASSVTSWTVRFPLASNVLLFTVTFFVVPLKSSSNVSGNSFSTTDGSGVGARFACWNPPPPAPPAPAPRLVLNPRPPPPSPPLRILNRSSSSIPPPMPPPLAFAKFRKISSAELKRNPPPPPGPVEKWNVRVPPPGIPPKENPPGMPPSKPSNPPAPGAPPGPGAGPPRNRNSRPY

SEQ ID NO: 29947 - protein, 464 aa, A.fumigatus
ALLRQGNKGRTPFPGGQYHWSGGDQYDGRGKERNLPELLEDGVPQSSYESVESGGRDNTAQLSLSSQTSLSQASEISQELHKAVPDATSTQQDNDTPSDDTQLSAKRKRSISDLRGDVPTTLQQQQQQPTPGGLQVLKSPPSLRLSLSFDGEAMVRREGELTPSPPKGRNSLRIAMSSDGKAVIRTEDEPSPSKGRISMFSTRSSRFAGLRRSSSAVALGTPRAGAIEKEKAFGRSRDPRNWESFFDTDARSALSTPTSSQSAPNSASPNLMFAPGQRSLTRSLSARHTNMSTSTTHDYLNTPIPQHAGEKRRKLSRTVSSLGRLESSFSNLNRRPSGAYNISKVRDTMKDKDDLDIECGDSDKENWIPGTRVSHVRQRAASHHQSHRPVLKEANGRDGRINRNLAATGGRSRISQPSHRKSIKSMPELDADVSAFMAGGGVASQEEDLDCVQGLLSLSQGAWR

SEQ ID NO: 29948 - protein, 69 aa, A.fumigatus
LISESRTPECFPASRLAKWTFASKTSPQSDADNMHMSTCALETSTTLYHTAYANTIIFDASGVTTIWYG

SEQ ID NO: 29949 - protein, 400 aa, A.fumigatus
RHATEFFAAKLIFVENAHSEKESAVGFQKYESVRRGAMDVLAKIFSRYPAQRPFILDEILVSLEKLPSTRQSARQFKLADGKSIQLLTALVMQLVQTTALDTPSSKTRKSKRTLSAADDDEESQENEEDLDEDDDEDQTDASLERLATKVNRLYDNAVRSAQYIVKFIVQRAMTSTKTGDQPFRNILDIFTEDLIGVLGSTDWPAAELLLRIMASHMIGIADLDKSPATAKSMALELLGWMGSAISDLVVTAQHLLPSMEESDSELSVYLRQLFEDYSNHALHPQDLVVPEGPYRIALEYFLQAQSSDNWQLSSARGYYLAQWAKTVCSVYYNSEDRDVVPDGEATEGLVVLLTKLFSEPLWLETHRYGLQQRPFAANANAAILDTSIGYQPLMGGSLTF

SEQ ID NO: 29950 - protein, 129 aa, A.fumigatus
HLTFISRTALLLHILRLFMTLAHTATPVHLLLLVAQTKTTTTKAVTTLPRITVPLPSKDMAVTARPLPRVNLCTILRKDTRHSSKATIRKTGEGLQAVAFVPVSWPLLHAVAAWIFCSKQYEEKGLGPL

SEQ ID NO: 29951 - protein, 373 aa, A.fumigatus
HTLAMSTSAFGVVMRFESASPIANPAAVVRKDRQGIARTPSEYELDHMRESRQSPASGPSTGVHMPITSVTPNELESLPGSPAEDGAIDAIDAIDPLPNLTSSATTRWRLLSACMMSVANGLNDSGPGALIPYIEKDYNIGYAVVSLIFVTNALGFILAAPVTQFFEAKLGRSKSYALSMSLLVAGYVIILSKPPFPAVVASFFLLGFGMALNLALNNVFCANLANSTTSLGALHGSYGIGGIMGPLIATAMVSDGVQWSIYYSINLALAVFNLVFAIWTFRGYEKELPIQLLTALQQTVSQQEHGHNVASKKQLLKQAVKNRTTLLGALFIFAYQGAEVSISGWVVSFLISYRKGDPSHSSPRGRRIREKLR

SEQ ID NO: 29952 - protein, 64 aa, A.fumigatus
IGWFLRNRISRCSRIREGFLEMDDASLVFSCSPNICVKEIVEDIARPLALIWCTVKDKDPEHAL

SEQ ID NO: 29953 - protein, 172 aa, A.fumigatus
LAISASSRKKARCPGEKPTCSLCQRLGQRCSYNARRAANDATSGAPLGLSQPCTPDDALPGTSPNAQHFRRVEQRLDAITALLQYVLKIRCISSLASIILMLVRSERGCRQAVPGIGHLTGRTIPAQEKGCHGKLLAIFIPIAMNGVMMNFKCPISNGIYQISGRGLPGSLS

SEQ ID NO: 29954 - protein, 746 aa, A.fumigatus
VVSYTGPPNRLPQFEYEPTQKVPLKANMWLETVITLLLREKNWEIYSYVLTHLAPQLSNRGLFRNAVPQIKLLRSVMCDQVKNESFREPPVSTGVKKTDVAGYIFDCLSVLVSYHEVFAKSEEDELVRAFMMGIIGSWGDTSRRCVHALSVCCHEIPLSVTKSLNGIFDKMAKVITMSNLAVHILEFLSLLARLPDVYVNLRDEEIRTVFGICIRFLQTSREHRVRAGDSSNRPSQTSSRLAGGVKEIATPGEPSDPSQQDGMSRYIYTLTHHVMVFWFLSLKLQDRAKHVNWITSRLIFRDEYGQERVEEQSQVFIDLMQRVAFSDLGETIPYETFPPSPSDGPVSKKSWVVGMSIVTVETAGVSGLTQITKRQASGTTYAMYQQRTAPVLPHQVPTSPDAHTHSDDMRTAVLPSHVLLQLTTTAFPTPTVMQPIPLPDDDMTRRALSIFDRNDIVDGHKIGVIYIDDGQTTESEILSNTIGSPDYEYFLSGLGTKVPIRGAQFNTQGLHPDVDGEFTYAWRDRVTEIVYHVATMMPTDFDRDPACINKKRHIGNDFVNIIFNRSNVPFNFNTIASQFNFINIIISPVCRIASAPGAATPTPSDFERTSYTVKVMSKPGLPEISPASTAKVISGKNLAAFVRILALNASVFSLVWNSQGGEHVSSWRNRLREIKRLRERALGSQLQMSEAAEGAYPGQRRNTKPNIFSEEVPSRITPVKTDFATDWNAAADANILQNLDFSRWGR

SEQ ID NO: 29955 - protein, 87 aa, A.fumigatus
TPTKSPSRDTPGTVITFHVVRFSPIPLMADALVLNPDNLSRLDFKLFSDWNAYHFKNPNPPSFNPRLVPLSIWGFPLLSKFPRLSSP

SEQ ID NO: 29956 - protein, 755 aa, A.fumigatus
  UNSURE (735): Identity of amino acid sequences at the above locations are unknown.
FVVSYSGSCVRALGDDVFVLQTLMAETDTQCHTGNGGLARIRIDEARVILQVSVDHMRDLAFRHPSRASALRGILLNMLLGFHPVASKIYALSVNPRDCEKWSEYYRTAMADIKAHGYFQKIMALPSRPAGSSDSNQPPIMLNMTAIFQEQREAESLARNYHEKSNMAYSELEKGNIDGYEAHLQEFLDDSSSSGAPQDLVATFRLLTLSSLGDFEQAKTELPRAVPRLFGQEENLTERCMRLLHMEGQVIDHSIQIDSNQALRAISLCFLCRDWDRWSYLLETISQNVPGYLDLDEMRDHSTDWMLATWVGAIYDHNGQYDTAFEWYLWANEVMETHREGTSDDEARRGSQSSIHGGELFAGLIRVCLRYASLSTTNPQPKAPIDWGLPAPNWTGQALVFLERTFARTLLEFLIGRSKTDPEIIEAWAAFTYINRQITDLTLLLPNKSEDEGKKSRVEIELDRLRAESEKRPMPDAQISQVTRSLLSATRFQIDPESICRVIPEDAVVVEMNLSRGGLILFCLTTAGVVSIHQSERTILDLRRQVLRYVKRLENDQCSRDELSSLIMGISREIIHPFEEVIWQKDHVIFVPTQEFNFFPFSALTFNDKPLFLEKAVSQVPSLATLEQIVKRPHPGMLPELSTIVNTHEPDASGPKHAGEPVPMVGVGAAVVSHIFSVPPTDARYLEETGFKNIFENSEIVYIGTHGAKHELSPWQSCINLKDEFRVMEVAKFSXKASLIIFGSMHVGPWPRYCW

SEQ ID NO: 29957 - protein, 115 aa, A.fumigatus
QILGDTRMHRLISLMEIAVMLPLSLAMYTDNGRLTIVDGINYYIDGLPVSRLSVPLPLNSTWIDAGFDLIPVTVVQSRNANFTWQDMQETISRFTMEDDVFQPGFLEGNRCTRLE

SEQ ID NO: 29958 - protein, 116 aa, A.fumigatus
LCAHDNIAIFLNHAAYNQGYLINAHNLSAYGNINKKVIFATPGYHSRDPIVQASLDGDVPEGPYFLAVGTGALYQAFRLYPDHQLAFTEAAVSDGNGGFRPLPAVTDVSISHAWIL

SEQ ID NO: 29959 - protein, 184 aa, A.fumigatus
HTSQLRLGIKDIFDLAGLRTGGGNRAFYNLYPPRNTTAPAIQRLIDAGAIVVGKMGTVQFANGDNPTADWVDFHCPFNPRVYGPLCPLVSILPLRIYVDIDALCRVTDINRPAAPHRGPRPGLRRTSGLISLLEVIRADQCAIPLDCKGSTEIGRQPELLPWRGFCRYAMCWIRPGCLPGMPER

SEQ ID NO: 29960 - protein, 76 aa, A.fumigatus
RHMNMRNKLNCCSAPTKPPMGFKDGRIATMAGVPDVVVPCGEMSYASTVSLRTEYLPVTMILVGAKGIHLMPCHLG

SEQ ID NO: 29961 - protein, 121 aa, A.fumigatus
TYAILTSVHQYKTLALSFFTDYAAKHNGSQPYINPGPRVRWAWGQENGGDTGYEMALRNKTIFKDWWESHGYGVPNEDTCSEGIYIYPYSTGKTQYRDVYTRYVLYSSRHCTDVEESCEDT

SEQ ID NO: 29962 - protein, 177 aa, A.fumigatus
RSMQGDGYQSPGGSSSGPASGIASYEWLDIAVGSDTGGSMRNPAGLQGIYGNRPSTGAVAMEGVLPLCDVLDTAGVFARDARTLSTVLHAWYQDSDKAYKGYPRRLFYPNASFPDSTTEAGALLEEVVTGIEGFLRLRREVVDTPSRWAETHPSGTPSNITQLLNTVSSIGLTTKSW

SEQ ID NO: 29963 - protein, 82 aa, A.fumigatus
CEDCVCLIGIVSYHDFVVKPIELTVFNSCVILLGVPDGCVSAHREGVSTTSLLNLKNPSIPVTTSSRRAPASVVLSGNDALG

SEQ ID NO: 29964 - protein, 83 aa, A.fumigatus
RGQPRNLLLTGMWQKGDTPLLEDFEIIKYQCNMATETPMKSHVDNGHLSPHGTDPCTWAHHGATSVEPGLDSLLESRNRKDDA

SEQ ID NO: 29965 - protein, 105 aa, A.fumigatus
SLSLCWTLFIYVPVFLPSAPDADCAICVRLQAMPLFSDYGDHPDSSARLSYPSLVFAIVTPLVVIARLLGRRFLSGRVGADDWTILVSCVRISNGGWLSTYIDSS

SEQ ID NO: 29966 - protein, 184 aa, A.fumigatus
CSTANERVVCGWAFGKHQNEMPKELVLRTLKVSPSNADPLATGSSQRQLYFVAQILYKVNLGLTKISILLLYIRLFVHQWFLRTCWVWIAIIVSFTIGTVFSSIFQCTPVQWAFNKSLPDRGTCINMTAFWYANAAFNILTDLVVIALPIPVVLKLQLPPKSKIALCGIFAVGLLWVASLGPCI

SEQ ID NO: 29967 - protein, 81 aa, A.fumigatus
LVLDTDVLTGSTCITSVLRITTLNVATNHLDTTWNSIGSSMWTVIESNLGIICACLPALRRPLSFFFPRLFSRLHKSSAAP

SEQ ID NO: 29968 - protein, 165 aa, A.fumigatus
EVSFFSSPVVSKRIRISSSILGQSCLAAMEKQPNHEVSQTGSSLETAAPEIEVNEKREKALLRKIDLHLMVPLWVIFVFGFLDRINLGNVAVLGILQELKMDGKDNGACHARSFFGPDINRGYPEPYCASSGLRRPTLNKGLNFLPGGSNQTPPLLCNPFSTLDR

SEQ ID NO: 29969 - protein, 222 aa, A.fumigatus
GCRRALVQSAEEPRKEKGERTAQGGETGADDAEVGFDDGPHGRADAVPGGVEVVGGDVEGGDAQDGGDAGAAGQNISIQYQLSDAWTQGGNPQKTHGEYAAEGDLGLGRELQLQHDGDGQRDHDQVGEDVECGVGVPEGRHVDAGAAVWEGLVEGPLHRGALEDAGEDGADGEGDDDGDPHPAGPQEPLMDKQSDVQEENADLGQAEVDLVEDLGHEIELSL

SEQ ID NO: 29970 - protein, 340 aa, A.fumigatus
PICFPKPDDWSNVENRPSPTAQIVQPKRMHSLYRPIQWTTSPEAVLLAATIYQPVSVCKGRRGHTLQQCDGQQHGAGLDGRVPKDQLVEGRDIVHLHQEIPSIDKHGQTRAVDDPRAEDMHRDQWKRGPFPLPQHERHADGHAHDEGSNHMRRVPGVLASTPVQAQQQYSRPAECQRRADKIHRRQLHLPRARDLAQGHEEEHAQRREHGEWEIEPEDPPPRLLLDRCGCERASDHGPDAVRDREHCAENTLIFTSFAQRDHVADDHLGDGHKAAAADASEGAEDDELGGCLGEGGGQRAEEEDGEAGEEDVFAGPDVGEAAVEQLEAGGCTGLSAARRT

SEQ ID NO: 29971 - protein, 70 aa, A.fumigatus
YLPLSRSGTTSLTIIWATVIRPPPPMPVKARKMMSWVAVWAREAASEPKKKMARPAKRTYLRDQMSERRP

SEQ ID NO: 29972 - protein, 61 aa, A.fumigatus
DKQIFLACSTVDLVALMDQTTLAASLSIVGNALNASNQTSWISGAYFVYVKILASSSPACC

SEQ ID NO: 29973 - protein, 288 aa, A.fumigatus
QASTSTCFQLLYGRLSDIWSRKYVLFAGLAIFFFGSLAASLAQTATQLIIFRAFTGIGGGGLMTVAQMIVSDVVPLRERGKYQGILGAVFAIANGIGPVIGGALASASIEKESWRWIFRLNLPLTVLTTLCVFFFMPLRKVTGSWKVKLAAVDFVGAALALSGTAVLLLGLNWGGGEYAWDSAHVIATLVVGVAVCVAFVLWQWKGAAFPLVPMHIFRSRIVNGACLTMFINGWNFLVQVYYIPTFYQLVFGYSTVKAGAMLLPITLLQSMSSPPLADRHGLIDGSRQ

SEQ ID NO: 29974 - protein, 208 aa, A.fumigatus
DQPLLRLPHELARRNFKSVQRLVEREREYVIPALKEAANASLSNAQTPDQTLAALDSMLARMQNLKRKMESIQQEEKKVQNQSRKRIQHLEHLHQIPSLADVKYDQWSRIRLDRLVVDHMLRSGYTESAQQLAQEKGIEDLVDLDVFVQCQRIAQSLRRGETKDALQWCNENKAALKKSQVCGVHMNNSCVSDPVSFSNKPDTVQSRV

SEQ ID NO: 29975 - protein, 151 aa, A.fumigatus
ILQLTDLQSMYSFDRWNYLSDLFIRTHHELLSLPSSPLLHIALSAGLSALKTPSCHSAYTSSSSNSLSTTTSVCPICSTELNELARNMPYAHHAKSYVESDPIVLPNGRIYGQQRLLDMSKKLGCVETGKVKDPTTGEIFDKSEMKKVYIM

SEQ ID NO: 29976 - protein, 760 aa, A.fumigatus
TRWVKSLSFIGSINGKVYDLTRYIAGGRLTKALPGETVPSDVDTDFMDNSVVSLFQSLPGQDLSKHWENLKIDPALRRRMQLCLDNLFFVGHVDTRNSAQCEFARYFILVISVLICSIIVFKFLAALQFGRKNVPENLDKFIICQVPAYTEDEESLRRAIDSMARMRYDDKRKLLVVICDGMIIGQGNDRPTPRIVLDILGVPESVDPEPLSFESLGEGQKQHNMGKVYSGLYEVQGHIVPFLVIVKVGKPSEVSRPGNRGKRDSQMVLMRFLNRVHYNLPMSPMELEMHHQIRNVIGVNPTFYEFILQVDADTVVAPDSATRMVAAFLNDTRLIGVCGETALTNAKTSAVTMIQVYEYYISHNLTKAFESLFGSVTCLPGCFTMYRIRSAETAKPLFVSKEVVDAYAEIRVDTLHMKNLLHLGEDRYLTTLLLKHHSKYKTKYISSAKAWTIAPESWTVFLSQRRRWINSTVHNLIELIPMQQLCGFCCFSMRFVVFVDLLSTVIQPVTLAYIIYLIYWLVKDTSTIPYTSLILLAAIYGLQALIFIIRRKWEMVGWMIVYLLALPVFSLALPLYSFWHMDDFTWGNTRIITGEKGRKVVISDEGKFDPASIPKKKWEEYQTELWEAQTSRDDRSEVSGISYGTKSYHPAQSEYGFPGSRPMSQLDLPRFGSRMSLAPSEMMSRHADMEMENLSHLPSDDAILAEIREILRTADLMSVTKKSIKLELERRFGVNLDLKRPYINSGKGYTFPFPVLRTVC

SEQ ID NO: 29977 - protein, 142 aa, A.fumigatus
KEDCPTFRSNGPGFGARDVLRLVLGVVLEEKCSQVPILTQMKQILHVKCINTNLSVSVHDLLADEQWLGRFCRANSIHRETSRQTRNGPEKTLESFREVVRYVVLINLNHSHRRSLSIGQSSFTTDTNKTSIIQERSHHPCC

SEQ ID NO: 29978 - protein, 78 aa, A.fumigatus
ISSDRILPILALLFLCSFLDRWGNRMPLISARLKIDPNVPSRTNVGNAKILGLQNDLNITGHQYDIGLTVFYLTYICR

SEQ ID NO: 29979 - protein, 97 aa, A.fumigatus
TRADSELPSNLIIKKASPKIWLPTLTMVWGIITMCLGFVRNFAGFVAVRAILGVAEGGLLPGMVCEAYPGSFSQLLAGSVPVSETKTPSGTLPVFLL

SEQ ID NO: 29980 - protein, 73 aa, A.fumigatus
SQILNCFHSQCSLYNLPQHLAMDTMKPSHETLEDVRHKSLDNMSFGNAYQQKLTRSILFKLDTRLVRFDVYGQ

SEQ ID NO: 29981 - protein, 67 aa, A.fumigatus
SQVGSLIINRSNMYSVADRMPSSSPVIVALISDRLQLRGVIMLFILPIAIAGYGAIANIESVRVKYG

SEQ ID NO: 29982 - protein, 209 aa, A.fumigatus
  UNSURE (17): Identity of amino acid sequences at the above locations are unknown.
KTIPSTTSSARPHPTRXEKFSQQASIEAPEPSDLPSLRRQHVTAGYRDGVSAAKGEHVQHGFDAGFPIGAQLGMRAGTVIGIIEGLLRGFESPTASRAVKKPLQRKEEGQGIEPDEAKAARQAKREQLLRLYQKAVKELEVRSVFAGSEDESTRDNGGQEKPYVVLRRKGDAVISQWEEQVRVAHWEENMAALEPKEDEKRASTPTEQI

SEQ ID NO: 29983 - protein, 102 aa, A.fumigatus
PRHTLYISCYRTVEPLINSPLPHANARHNRDIIEVIALQLQLHIQHLKATRPARNTTLLVVPKASHNYLERGEGQITQYPVPPLEGSGGPNQQSIAPFQGPM

SEQ ID NO: 29984 - protein, 132 aa, A.fumigatus
RLLVVFTFRCQGVYPVGKSTTATSESKPRPYLNQSLGSRLASFARYYIRFLVSDKSCRDLIHRIAVSSTCTKGKGMISGHFHATNGNVELPIGKHVAFSLAVPYQGSADPPFSGNRSSGHERCRCSMVTGKC

SEQ ID NO: 29985 - protein, 320 aa, A.fumigatus
LSNWIDALAAKREDYEQSSDRGSIKFLLNGGTDSFTQQFLLPPRSDRTRSLEYHNKKSLEDAGSSILGYELKDSRTDYAPTFIESDAATLSFFQDTFIDFFNGPFGDPHKLLDDPYVGQVAYHAVVPPGQDPNLTLTGQQLSYEPERPFATGMIQAILARAWSVPLDAKAQQELSTNLNFLLTTSRIRKFVAMYFKYWQPSCAMLHRTSFDPEIVSLPLLTAVTFMGAMYTNDEREAYIAKRVLDFAELFIFSSEVYASETEISSMFCGNRCLDDESSDWIQFQNFQAGFIIVVVQYWAGSRISRNRVMENRFSEVIKVG

SEQ ID NO: 29986 - protein, 82 aa, A.fumigatus
STAAASAAAEQPGRDWSTSVPRKESRPSACHPRCRWPAVQAPVPVECTSAARFPCPNVDWWQTSAGESQLLSQFAEHDQLCH

SEQ ID NO: 29987 - protein, 90 aa, A.fumigatus
FPICKKDNMNAWSVLCNPSNVEGRLTRDKRKEALTQTMAKAKEEQKSRREAEVSLRKEKEDFLFFYPLLNGFIMSPGIPHKKEELDVSQP

SEQ ID NO: 29988 - protein, 89 aa, A.fumigatus
  UNSURE (1),(4),(5),(12): Identity of amino acid sequences at the above locations are unknown.
XGGXXKKTAPIXYQYISLLSSFYNFFLLTLLLIHLHPFSSLPPFNSPYFSSLSFPLFFSHLFPVKYIFWKQPNNNVYSYFAPRRLTVIG

SEQ ID NO: 29989 - protein, 270 aa, A.fumigatus
MCLLHIFLPSTSPSVRRRFLIPLRTSRSHLLAGLRTAPKSATLPSASQRQQHLGLETGRYGAHTSGTADRVPQTATGAGFPRRSFATNQHLDMGNGRPMYTLPEQVLAPPAIDIAGDMPMDETLYAELMSTNLFLAAQQQRLQQQLISVTAAAQQFQGLNLGASMGQAPEMPSLSVPAMGFYQQQLQQGVQPVVQPVPGQPGLFSVYNPLTGQHNYVYDNSYMQENGSSPYVEDEDQSPVMQTPAFYAEVSPPSESVQSPLERQQTVSPP

SEQ ID NO: 29990 - protein, 125 aa, A.fumigatus
ITRCISLAPTTWFPSPRRPQCTERPPVSPGRDTFQRFLFTMVPEGRHVRSVYLDSHAGVLTTSVDDKILVDCSTIDTATSMDVGAAVCQNSKTAAFYDAPVSGGSLGAVAGTLTFMVGCVADDPN

SEQ ID NO: 29991 - protein, 363 aa, A.fumigatus
VPCGVVMRTPHITLDASWASCPRQKQTEKKKRGKTSSGHPDQSGMIAQPLQSQRHSIRVVAQMGDPLPAPIEGQAYVTVGPINGGLITLPERAFVSPSGDAAVTVPSLSFLITHPGSGSEKSPRHLLFDLGLRATLGDYMKEQQAHLELRRPCLLGPGVAQSLQRSGIDPGKIDTIILSHVHYDHHGDPAHFPNAHFFVGAGSLKLLDEGLGIAASHQFFDPDLFRNVLRVSEFPSPGASPWRALGPFAGALDFLGDGSVYVIDAPGHLPGHINLLCRVGPDTWMYLGGDSCHDSRLLTGERQIATWDDGHGNTGCIHVDQTRAEESLSRIRRLQEMEGHKVEVVMAHDVEWWSTNQHRALGL

SEQ ID NO: 29992 - protein, 103 aa, A.fumigatus
SRVNNMHLILTGATGLVGSGVLDAMLAMKEVTKISILSRRPVQMAEDAHDPRVQVILHQGFEAYDPKVLSQLQGATGCVWALGISQTKVNKESVCALSFERNY

SEQ ID NO: 29993 - protein, 67 aa, A.fumigatus
SAFKSSPMCSAIALLLTAQEYGYGTMLEGGISSSPSILRSSNICNMNIYTHAYPRLKPAGWADQRSE

SEQ ID NO: 29994 - protein, 188 aa, A.fumigatus
  UNSURE (156),(157),(158),(161): Identity of amino acid sequences at the above locations are unknown.
GGLITEESFTSVFPEMKDANIQGIVIASFELGALAGALACLDLGDRLGRRLTVWFGMLFMLVGGTLQTSAWALSQLTVGRVLSGIGLGLQVATIPSWQSECAKAHSRGRWVMIEGGLQTFGVACGQLVGYGFFFVKGQAQWRAPVGIQLIPALIVXXXINXLPESLRWLIKHGLVEEVCILSMMEVSR

SEQ ID NO: 29995 - protein, 264 aa, A.fumigatus
WRFLADRTNLQGAYNLSKLRNLPFDHPELMFERDAIIASFEAQSELAPFSYREMLRNGKTKMFHRVAIGFFMQSAQQLSGINLVSTYANKILQESFGLAASTSHLIAAMGGLEYAVCSLLSVFLIEGLGRRRAFLWTTVGMSSCFAVIAGLQSTDSRTCQLTAAGFLFLFNTFFGLAWVGGPFLYSAEIAPLRCRAQANAFASAGNWLFCFVVVMIIPPAFQNIGWKTVRLLRVPHWPSSNVRLVYHFCHFECLLRTHHLLFPC

SEQ ID NO: 29996 - protein, 82 aa, A.fumigatus
IQVGGNQAGRSVAVCDMFQVKISSSVSIMAIFPLTRYTAHMGASGLTLNFLVAGIATCAFWLFGYDMSVMVYLLPNGTCTPV

SEQ ID NO: 29997 - protein, 89 aa, A.fumigatus
LGSAQLRRGPRTPKHVLLQCLSYQEAYRKMANKLLNIEGSLQGKITDYNMLMFDPQAVHYIAKLMHSGKHGQKRGNLLQGSGMDVEDSS

SEQ ID NO: 29998 - protein, 634 aa, A.fumigatus
VARALTYILARFVNSLGAKVHSSPPTIEKISQRFQDFYVRAESHIATHISALASRINRDPSPNPPPPRASRFGQSKSTNRDSGNVPSSRQMLTASEVAERRKARKSLASKGAALEEAIERRACECVYDRIWRHKSTLDEVRDEKLRSKTAALLLVGINLKDLGIDIDMATINEEDQKEADQCLSVARKCLARMNEAKYPLGKLQHLAGAHKAIVDALTKLLPSSSSADEILPTLIYTLITCPPEGINIISNLLFIQRFRSTKKIDGETAYCLTNLEAAISFLENVELSELRADETQEGKLQLSNETIGTPDSLDTPHQMSKAPVSTVTKANASPEISKSDAKEDAAEGLLKQQSPATPQQPRLNNLFQPPSKVLGAANDVVRNTADQGLKNISASLDSSFNFLFGRLKELQSSQLSAKDGGSPILPKTLAEARRLVTSPPSLDKGVSRDNGGGDSLATPDRPPLRRIGSRAEDTFMGLVSGHRTPRDRSTDSVRTQASLKTATATTGALKDEPSSAASQTNPLPTTPLESMRNFGNSINPLNHIPGMIRNFGRSTPDSGGSFAALAPSEKTKTSPSSREVPGNNSSNQPKIDPPIQRFLQTQHANELTIGDVVVLLEDYKRLAAALLRQASDSS

SEQ ID NO: 29999 - protein, 640 aa, A.fumigatus
  UNSURE (551): Identity of amino acid sequences at the above locations are unknown.
ANLTRILAPVVENKGRAFVWGLVKWCGIGTLASYTNAMIKFLQSKVSIAFRTRLTRYIHDLYVADNNYYKLLNLDGGIGQGADQFITQDLTLFCSAAAALYSTMGKPLVDLFVFNYQLYCSLGPLALSGILTGYFSTAVILRKLSPPFGKLKAVEGKKEGDFRGLHSRLLANAEEISFYGGADIERVFLLRSFKDLQRWMEGIYSLKIRYNMLEDVILKYAWSAFGYLITSLPVFLPAWGGAGGALELANAYEETGRERGRMKEFITNKRLMLSLADAGGRMMYSIKDISELAGYTSRVYTLISTLHRVHVNAYYPPRGSHAELYSLADAQGTIHNGFDGVRLEQVPIVAPALHPRGGDELIESLSFIVHSGEHLLISGPNGVGKSAIARIVAGLWPVYRGLVSRPRGFGLDGIMFLPQRPYLSVGTLRDQVIYPHTEIDMREAGRTDAELQKILEDARLGYLPAREGGWNARKEWKDVLSGGEKQRMAMARLFYHEPRYAFLDEGTSAVSSDVEGVLYQQAKDRGITLITISTRASLKKYHTFSLTLCLXAEGEQWEFEKIGTEKEKLGVEKEIQELRKRLDKVDEWKRRREEIDKELHKVWAEEGELAPPPYELGNEEAVAEVSNEATEEANVDKTQE

SEQ ID NO: 30000 - protein, 452 aa, A.fumigatus
RSFEAEFVVKKPTMYEYIHKLRRWRDKFEEKLDRRGQYQFLETYSPHLSEFRFLKFDEVEVPGQYLLHKDKNQDFVRIDRFLPDIDLVRGIGVCHRRLKIRGHDGSVHPFAVQHPAARHCRREERILQLFRIFNGLLGKRKESRRRNLYFHLPLMVPLAPHIRLVRDDPSYISMQGIFEDYCRRVGTSKDEPVLFTMEKMRSLAETKQNVRQTDNLMVERANVSQRTPDQQQVLRTEILTAIQEKWVPSTIVKDYFQKTYPNFANFWLFRRQFSYQYAAIAFMTYVMHMGNRYPNKIMISRSTGDIWGTELIPAINPAKAFFYNPEHVPFRFTPNIQTLMGPIATEGLFACALMAIARCLTEPRHELEQQLSIFVRDEMMFWATAQHRGVLPVQQLRDLVYNNSDIIVNRAVSLASPPEGNLPANQTTIDLISKAVNPQHLASCDALWMPYL

SEQ ID NO: 30001 - protein, 62 aa, A.fumigatus
GAFEGCRYRAFRFMGCTALSWNPQYSYLVHIKYDTSISIEPISKHSKDKWLPMKFSAQVQNQ

SEQ ID NO: 30002 - protein, 101 aa, A.fumigatus
SVHGLQHLPSFCHHSHLFKSTMPATTADTLSLVTRTVTVAPLVLLSVADHYGRSAKGTRKRVVGVLLGENLGQTVRVSNSFAGASSPKPAYLCSLVDGRQF

SEQ ID NO: 30003 - protein, 98 aa, A.fumigatus
CLCLLVPFEEDEKDPSVWFLDHNFVESMRDMFKKINAREKLVGWYHSGPKLRASDLEINELFKRYTPNPLLVIVDVQPKEVGVPTDAYFAVDEIKDVG

SEQ ID NO: 30004 - protein, 198 aa, A.fumigatus
DGTTTSRTFVHTPSVIEAEEAEEIGVEHLLRDIRDVAVGTLSTRITSQLQSLQGLHLRLRDIGQYLQKVLDHELPVNHAILGNLQDVFNLLPNLSTPAATSRLSGSEPQMENSELARAMSIKTNDQLMAIYISSLIRAITAFHDLIENKIQNRQQQEENESKKEQEANAAKGDKEGAKKANGMNGEPKEDQEKSKKKS

SEQ ID NO: 30005 - protein, 99 aa, A.fumigatus
YIQSVLDLNLITIFAPEVAPMDTPRVQVGAPDVAQAPESTQTTDTPDVDMDETQQSPLNEIQADATQQDISLPDAQPTGSAPTEPPQPPKKKPGLHFLE

SEQ ID NO: 30006 - protein, 264 aa, A.fumigatus
GSNLRGASTMRPQLAHARLTPLSYLTSPIVELIVGKDEHKTSLTAHQSLLLESPFLAQAVAAFSESGPVRTSFLLSSILDAFTNTISVMQRRIELPDENVEAFGCFLQFQYTHDYTASHADPSADQDVVGELDDSGELLLKHARVYTLAEKLGVPALKSLAHSKIHRINSTSHGEIAYARYVYTHTPVDDVTIRKPVASFWATRSHVLRHEAEEEFKKLCLEVPEFCFDVLTLVLDQKEKRAQDRAETESGIKGSGRKRLRSGI

SEQ ID NO: 30007 - protein, 82 aa, A.fumigatus
  UNSURE (28): Identity of amino acid sequences at the above locations are unknown.
RQFWRAPRTRYLKKRVSVGFIPHGLGHXLGMNTHDTGGNPNYADKDTMFRYLRVRGRLPAGSVITVEPGVSWGLPMFPKLIH

SEQ ID NO: 30008 - protein, 67 aa, A.fumigatus
VYFCRFIIEPYIKSPESNKYIDTNVLDRYWRVGGVRIEDNVLVTKDGYDNLTTAPKAVDELERLAAS

SEQ ID NO: 30009 - protein, 103 aa, A.fumigatus
IALFSSFSSHSLFSFPLFIILPPLRIPVRPGKNPESFRADYIRLLDPYLITPGSRTIFTALVSVRAIADNFPPSRIFWAGSCKRRSPSAPLSRLPRHELLPRG

SEQ ID NO: 30010 - protein, 190 aa, A.fumigatus
LLSTCHPGVGKTSLVQRYVKNAFNPATITSTVGASFITKRVLDTTSDTIVRLQIWDTAGQERFRSISRLYYRGANACLLCYDITDEQSFEEMTGWLLELKKHLADDDPIVIHVVGTKSDIVTLDPSRRRVPFERTIAYVAEQLYPSRASTPPPTAGMGLGLGPSSTALQSPDSKRSSGFWGQGYRLGLLP

SEQ ID NO: 30011 - protein, 106 aa, A.fumigatus
SMLSGPSRISLRLIRPAAGCRLSGRLHMSLSSCTHRGRRRRRRRRGWAWGSVRRLLHYRAPIASAVAGSGDRDIGWDCCHEISAQDGEGIQEAFRVITRKLVEQRE

SEQ ID NO: 30012 - protein, 67 aa, A.fumigatus
KVIFPSYITRSSRNKEIFKLVKAYLISSLSIRTNFNPTIVWERDILIPTLYIDFSFEDNAWRKHLTS

SEQ ID NO: 30013 - protein, 73 aa, A.fumigatus
PVLGRLALSVLLVIKSLAPATIPTTIFFWIRLSMNDINQNGSSVDAMEMELRHTHTTMIVSAGNLALSGTYSR

SEQ ID NO: 30014 - protein, 67 aa, A.fumigatus
LRCNLFCTVTNYFKCLMAGKGKGKGKKKTKPKISEISAGSAIASTETAVAKDEVSAKMKELVLRYEV

SEQ ID NO: 30015 - protein, 81 aa, A.fumigatus
VLIIVAPSPIFPLMLGTSVQGGKTNFQHKVRNRFQKGAVQYGIVISPQKQKVIRCHLDDKVPEPSVVVFRRAIYLKHSGSI

SEQ ID NO: 30016 - protein, 111 aa, A.fumigatus
GLGFNLWNIYHSLPVACTTPQTAFIMEQQLLTLLADTQSPAVDTTKAAELQRLHLYSNEQFPLSLAAIASHDSVPTNLRQSSLSVLRTFITAAWSPNLDEFNGQVLINDTN

SEQ ID NO: 30017 - protein, 63 aa, A.fumigatus
PTYSVPKIIHGLLPRDYSLSDFETTWPFGALSAFRLINSVTIKLGAALHTTLVKSFRYEQESQ

SEQ ID NO: 30018 - protein, 166 aa, A.fumigatus
LEYDQEWLAITRVLADELQLGDLAVQMQPDRGQAFYKPLIEEAEQWVEENVVKAGKMMVPENFTPTAPFFDPAVPITTDELPPEFTNPQTAQFCELIGIENKFHLSDEERQARVEAGPRPNKPKPEGGWNRGRRRNYNNNNRGGGSQWWGRGAGRDRGRSGGNQRW

SEQ ID NO: 30019 - protein, 211 aa, A.fumigatus
AVAMRLVTCLEHLLGRGRTGTNDLLILSTLELIQGVLLLHPPSRTLFAREIYMNLLLDLLDPINCPAIQSATLLTLVTALLDHPANTRTFEELDGLLTVTSLFKQRATSREVKLKLVEFLYFYLMPETPTYPVGASAPNTAVCGLQRSPSKLGGGPYSRSLNVAGPGHGGKGHGDTRTTEEKQALLGRYLNNVEDLVEDLKETAPFGATVY

SEQ ID NO: 30020 - protein, 77 aa, A.fumigatus
GRGWRLPRRYNLGQYFGYHISLFTTLTGCSAVHINSMTIHDEPVLPHGGVKNSGWGRFNAAQGLEEFLVTKSVTWMD

SEQ ID NO: 30021 - protein, 156 aa, A.fumigatus
SGQICMSTDRILIHSSIAPAFMDALKKALGSNLDPSAPPPTLVNVASKARVEGMIDRALESGAHLIHGSLDKTVGKSGVRMAPVLLGGVREDMEVWQEEAFASLAACMVVNSDEEAIRIANSSGYGLSAAVFTEDLRKGLAIAKKIQSGSVFWVSY

SEQ ID NO: 30022 - protein, 391 aa, A.fumigatus
NNEVIESATLRSLSVASNLKKVDLVLVPEVDFVDQRIYRFEPTDGASDAIARLDTLSFSLNTTMSVQRFNQWRQKTDIRRLRTWSIGRINNTTLARTIGAVAPSFQRLERLELNLRETPRRSVGYWRSVEEMMLSLPPLKGLWLLGNRNASFISKVLSRHGATLLSLGLDTRNIQHDVLTQRQTRPYYNAQAIARFASKCPVLRELHLTVHRVQGLAPEVKVYKALGRFSSLLHLCVKLHYFPSAGDPHDNVDPSTIPDYLSRYDFAMVRKARALYINAVMDDHLAESIFNTILSSQSTRRLASLRLFPASELQPQAPPLFVRNAYQTHLFHGFTVTRSSNPRPGVLDIKRTRTAIACPVAELAPFSVLGRDYILEWIWPNDITSFPSQDA

SEQ ID NO: 30023 - protein, 109 aa, A.fumigatus
LLTYRFTTIDPQRAIGYLQIECACKRFKVSDKCKPNYGSCVDGRRSVPIELLDVAGLVPGAHQGRGLGNKFLDDLRHADALIHVVDVSGTTDAEGQQSYSAFTSCLNIS

SEQ ID NO: 30024 - protein, 123 aa, A.fumigatus
  UNSURE (78): Identity of amino acid sequences at the above locations are unknown.
IAPLGKATRGYDPSVDIEWLRSEIVRWVLGNLMQKWYDMIKGDPGTSLCLSHEAYGHTQGFYQKKTCCEQSVKAGFPXIDRSCLTGGCRIHRSKNITKANFPRIWEAPPAKRLAPLFWEKKRV

SEQ ID NO: 30025 - protein, 133 aa, A.fumigatus
SKIPLHDKPFPSIITEKLGDNAKGALHELSKLLADEAGYPITYNHYYTDNVQRARNNRWRQDLRTSLNNAITQDWNSRFHVNNSPDEISRLVTSLQNHHIIVDMEERACYEAEMDLDAYYKVCFPWDTGNRVY

SEQ ID NO: 30026 - protein, 70 aa, A.fumigatus
GFFSQPWFSLSVTQMREQCLMHWAFCLSDLIKKQCDFVIELPETAVLSLFRGPDAPYETISYVRSQEKKS

SEQ ID NO: 30027 - protein, 229 aa, A.fumigatus
DASCAGARRSGLGSISAVDPVRALERGWTYDDAFRAVVDGVVERIVLHILVRVEDVDSGDGGDVAHVESGLTGGHDGRVKEVRLVGDDGAEVAHLDGLEGVHGVGVCLGDVVRGHNAVVHDDQRTTVARSGVRGDGHGLEEVERAVGGDGGCGPHGADDDDGLAAVDCSVEEEGRLLERVGAVRDDGAAHGGVVADDLVDGPGHVEQKGRRHVGAADIGDLDAGHVSNV

SEQ ID NO: 30028 - protein, 136 aa, A.fumigatus
YADTMRSFMTTSAPRLRAVGCAATVTAWRRLNGPSAEMAVAGRMAPTTTMGLPQLTVASRKKAVSSSVSVPCVMTAPLMVGSSQTTSLMVLAMWSRREDVTSGLPTLATWMPATLATSSISGTASMSCWMPIAPAV

SEQ ID NO: 30029 - protein, 154 aa, A.fumigatus
RGRHPGRQCRQPRRDVFPSAPHGQDHQRGRLRRPHHERRRHHARHRHARGDGLLPRRYSQLRQAHRRRRRHAARNRHLRRRPVQPPPGRDRRRAPHCAQPWCAGRHERPHCVRVLRLQDKRQHHGHLQGRRDGQPRRHHLQQAVLLLPARHAHR

SEQ ID NO: 30030 - protein, 324 aa, A.fumigatus
YRCLACTAISLPRKQSSSPREIAKMTKLSFKIITLAAMIAVGNASPFVYPRATSPNSTYVFTNSHGLNFTQMNTTLPNVTILATGGTIAGSSNDNTATTGYTAGAIGIQQLMDAVPEMLDVANVAGIQVANVGSPDVTSSLLLHMARTINEVVCDDPTMSGAVITHGTDTLEETAFFLDATVNCGKPIVVVGAMRPATAISADGPFNLLQAVTVAAHPTARNRGALVVMNDRIVSAYYVSKTNANTMDTFKAVEMGNLGAIISNKPYFFYPPVMPTGKTTFDVRNVASIPRVDILYSYQDMQNDTLYDAVDNGAKGIVVSPAPF

SEQ ID NO: 30031 - protein, 87 aa, A.fumigatus
SRSPGSGAGSVSSGYYDAIDDIASTHSLPVVLSTRTGNGEVAITDSETTIESGFLNPQKARILLGLLLAEDKGFKEIKEAFAKNGVA

SEQ ID NO: 30032 - protein, 203 aa, A.fumigatus
YQTECRSSSSHFDHHADELADSVPPRPVTPPLCESAECVHAASEILYSLDPNYAEIDPCEDFEQYVCGGWRERHDLRLDQGSMFTGTLMAEAAQMRLRHILKSTSVPEAADEENLRKLKSAYNACLDEAVISKRGSEPLDALLAQLDDIYSAESTAVGSDVNITDAVLFLMNSGVTALVEMGPGVSTSAVGIRQLLVLTGEAR

SEQ ID NO: 30033 - protein, 70 aa, A.fumigatus
MANGVLPTFRNTRRLRLTFGSSITESEITISLVLSFVANETKYTANDVSNHHLSWLSSHQSPPHALHPFN

SEQ ID NO: 30034 - protein, 219 aa, A.fumigatus
HCLIDPSDPLSLRHEGSERSSSRPPFTSLATTPISMFNLLSHPEPETSLPGTPASASPSGRLLGHAPTRDIRAEVLDGIGEIIDELGQVDDQIAAYALDHIHSNEIILTHTSSTTVQKFLLKAAAKRKFTVIHAESYPNNHEATHTTVSGAASTDEEILSTDSFQKPLIALGITVILIPDSAVFALMSRVNKVILGTHSVLANGGLVFTGGARALVSNT

SEQ ID NO: 30035 - protein, 122 aa, A.fumigatus
YRAFLESHTFCTRSYRSNRNIRLLKRRQIRHSRSCATATAYLLLRVVSACRTTDAAKLIERVQSVGRRLVAAQPREMVVGNIVRRVLGLIRDEAEDERDGDFTLSDAGSEGQPQTPRVSEGR

SEQ ID NO: 30036 - protein, 527 aa, A.fumigatus
LETAVNTDIPCALHVFIMEDISDAPHLTEFANFTPNGPLFGSSPSADGPAPINGTKTASDEDSPHREEERRLSDDAHMPVQDCGYNSSESSTQHSTSDTSSHDMDDDDLAPSDSRASSRSSISSIPDSVLIHPPSELKSAIGCGTDERIRHSWINQNSPGHGRMEAQFKSIQTIRQREAAFRKPSSVRAMQMHTEDEDDDEFLTPPKRRGGHRMSDISIRSAGSSPLKRSPYYSPTGSTGRQKVKNEYPLVLLHCTLLPPSLPVPGLIGYPDQKILKVVLPPEYWRRWKLLEEKVGSSVVRDRGVLISHPEDMYDLLEERLLESLELQRPRLHHGHFLGHEDTESDKGDQSATEDSATDDEQGEECPDCGGRFPRHDSSRKWEIKVFAANGLMRAGAWAAAWKEMEKVDVEVGLWLPSEIRRELEKRLLDNDRPSTDPKLQVPQLREPATSITPELYDQPLRTNTPTPLIHETSVCVPDEAARPSSPAPAITTPAKATGMPPPNVSSEVRGKNRTAYAAHQLLPGLG

SEQ ID NO: 30037 - protein, 154 aa, A.fumigatus
RRPVRPIKPWVSTLHSLSTRLSTIPSGMSPMESCRTPTKEPNSPSQARTNRPRCSQTFTSSSVLSSPTSKWPRAPVSSAVSCCSLTTWMRLTGNGWVTTPARSSPTISARVTMRPSTAAATTMSPMPTRNSTTTPRTGPKRSWSGGLTASSPGP

SEQ ID NO: 30038 - protein, 100 aa, A.fumigatus
QVNRGNSTIANAIQNPPKSLSEKWAELPTGAKAGVYIGAGCVGAALLAGFIFFFIAQRKKGRLEHALEDAKWANERTEMSTFQNDWKQSEWKHKGYQPVN

SEQ ID NO: 30039 - protein, 86 aa, A.fumigatus
  UNSURE (83): Identity of amino acid sequences at the above locations are unknown.
ALSRTIGSRASGNTRDTSRSISPALQNDLVLGSLSKGCPMSLLPLNALFAAGVSETYVLSRAALLVKLRGGIVELGVGRRLVXNVF

SEQ ID NO: 30040 - protein, 79 aa, A.fumigatus
TTGTNPMNIMDRVVEQSSDSHWYNDYNNHLFSSDPKGLCITSHPTSTPSTAAECLTNVISPNPVCLVSRYPSGTSARDT

SEQ ID NO: 30041 - protein, 280 aa, A.fumigatus
SVVLPAAWLRHPIMSLLYLVALFVASICSVTAQTWTSCNPLTTTCPPDQALGINTTFTFNKTLDDTIWNVTNGVLSHTDEGTEFTITGENQSPTMQSNFYIFFGIVESHVKMAKGAGIISSIVLQSDDLDEIDWEWVGYNTSEVQSNYFGKGNNETFNRGGYHYVPNADTEFHNYTTYWTQEKLEWWIDGKLARTLTYEDSQGAGKYYPQTPCNIRYGIWPAGIKGNAQGTIEWAGGLVDYSKAPFTMVLQSVRVHDFHTGKEYNYTDHSGSWQSIDVIA

SEQ ID NO: 30042 - protein, 146 aa, A.fumigatus
PADTPPPPPPPLGNTPPHDPAPGTALRAPPPQRRIAPPRTRSSRNTSAPASRSRDVPAMDPLDRTPRGSRRRSPCPAPPPAPPAFPGRIPLLRELPAGNPVRRRARRRSAATALPPLLLRPDRSGWCVSRGRIPGRWGVGREGWET

SEQ ID NO: 30043 - protein, 360 aa, A.fumigatus
  UNSURE (6),(10),(11),(12),(13),(14),(19),(20),(21),(22): Identity of amino acid sequences at the above locations are unknown.
NGLLAXQHYXXXXXVPRAXXXXFAIAPWRSGDLETAAFDAGCVISALRSYAQWDATPQARAVADLPILLRRIGDAPPGLPPSMRSAPTDKCLRGLRVLELSRVIATPLSGKTLAAHGAYVLWVTSPNLPDLPPIDREFGRGKRTIQIDLDAAEGEAELWRLIDDAHVFVQGFRPGALAARGFSPETLAARAAAQGRGIVCANLSAYGPTGPWRARRGFDSLVQTCSGMNVSEAEQYGAGEAGRAAPCQVLDHAAGYFLAAGVEAAVYRQATEGGSWVVDVSLAGVMKYLRSLGQYEGRTGFDEGRDYVSLADVPEGYLETRQTGFGEMTFVRHSAAVEGVEVGWDVMHKPLGSDEKRWLL

SEQ ID NO: 30044 - protein, 160 aa, A.fumigatus
DPRRPRRIRPLGHVSQPSRPTPHRPGIRPRETHHPDRSGRSRRGGRAVAADRRRARLRTGFPAGSSRSKGILPGNAGGAGGGAGQGDRLREPLGVRSNGSMAGTSRLRLAGADVFRDERVRGGAIRRWGGGARSAVPGAGSCGGVFPSGGGGGGGVSAGY

SEQ ID NO: 30045 - protein, 247 aa, A.fumigatus
  UNSURE (203): Identity of amino acid sequences at the above locations are unknown.
YRQPLGEDQEIRVNWAYQSNSANKEDTSSHFHIFVGDLSNEVNDEILLQAFSAFGSVSEARVMWDMKTGRSRGYGFVAFRERADAEKALNAMDGEWLGSRAIRCNWANQKGQPSISQQQAMAAMGMTPTTPFGHHHFPTHGVQSYDMVVQQTPQWQTTCYVGNLTPYTTQNDLVPLFHNFGYVLETRLQADRGFAFIKMDTHXNAAMAICQLNGYNVNGRPPEMQRTFALAFFALILRLLLLTVVVG

SEQ ID NO: 30046 - protein, 125 aa, A.fumigatus
  UNSURE (11): Identity of amino acid sequences at the above locations are unknown.
ALRAQGIDRKXYLHWISPLQPYMAIVAVILGFSTALFNGYAVFKPFDAQGFVTSYFGLAFFVVMFAFWKVVKRTKWVDPATADIYTGKAEIDEECRIWEDGTWDEIHKAELAQMNIIRRMWERMW

SEQ ID NO: 30047 - protein, 254 aa, A.fumigatus
SVQYPHYLPVWDHSEKYPPLEPFTHSDPGLRADPSFPDLLKPGTKIQNLTPTIGSEVTGVQLSSLSAAGKDQLALLVAQRRVVVFRDQDFADLPIADALEFGSHFGRHHIHPTSGQPEGYPEIHLVHRHNSQGELDAFFADRNSTVAWHSDVTYEAQPPGTTFLYILDSPEVGGDTVFVDQVEAYRRLSPAIKERLHGLKAVHSGFEQAEFSRQRGGVVRRDPVKHEHPIVRTHPVTGEKALFVNGGCKCPSPT

SEQ ID NO: 30048 - protein, 111 aa, A.fumigatus
GNEPSDECAVTRSIVGLKKEESDALLGFLLNHVGRGIDYQARIKWAPKTVVVWDVSHPTLSSPLDDQTLMREEPRHGTFCAGRLDDGGTSSFGADYPQAERPYETPYVPEE

SEQ ID NO: 30049 - protein, 149 aa, A.fumigatus
RLPSAPRSRVCSSRPCQLPERTSWHFLWRNAEWWSFATRISPTCLLRTRSSSAPTLAATISTRLPASQRGTPRSIWCTGTTARASWTRSSPTGTARLPGTRTSRTKRSRRAPPSSISWTPPRSAETRCSWTRSRRIGDSRRPSKSDCTG

SEQ ID NO: 30050 - protein, 97 aa, A.fumigatus
PTYAARGNRRIPYNRVSIGEYILSVDIVVSRDAMKPKSETVTLWDDVLSESRAMRSSCLSLACRHMYSSNSTNVSKKKNCFHLPLGGRWQEVDLNIL

SEQ ID NO: 30051 - protein, 107 aa, A.fumigatus
VYRSHRNNQSVDGSSLWNNIDAINSINQTYEMADNFDIWNYRSHLLLTELKDQITRFSCSGGIWTQTTDVEGEVNGLLTYDRRLKRVDEKMWKDDIQALYDAAKART

SEQ ID NO: 30052 - protein, 144 aa, A.fumigatus
QSVVTSSPASSPFITSNNKRTSWTVRAIGPATSCVSVTGMIPLREICPLVGLNPMIEHADAGERSEFIVSPPHPTSARFAARAAAVPPDEPPGVPPEVIPVPRLTSQRRNSDTLQRKFVEIGLTKDNGASATQLRDDEGVGFCL

SEQ ID NO: 30053 - protein, 317 aa, A.fumigatus
KPSIPYRQKPTPSSSRSCVALAPLSLVRPISTNFRWRVSLFLRWEVRRGTGMTSGGTPGGSSGGTAAALAANLALVGCGGDTMNSLRSPASACSIIGFRPTRGQISRRGIIPVTDTQDVAGPMARTVQDVRLLFDVMKGEDAGDEVTTDCQRDAMERSSETCGRRKRIGVLRSFFADDGDPEGSIVNQTVLDALDKARANVPVELVTLSPQRAHWDIPTLISTADMQAYEFRSVIDTFLQSSLIAFTPHDSLNSIVASGEYLQEAVTPALYRTLQKDGPYTMQSPEYESRLATIAALKKSVEDCFESSPRGGRTESH

SEQ ID NO: 30054 - protein, 214 aa, A.fumigatus
LSCSKKGDMGSIGSIDIQELTVSEYHDALRDRRTTCTEVVVAYLDRISRYNSLLKALITVNKNALDVARQRDQETEALLQQHGKDHTLPPLHGVPVILKDTYSTLDMPTTSGVKALHSLQTKADAFVVTKLRRAGAIILGKANLHELSLEGVTVSSLGGQTRNRYDLRRDTRRFVRWDGCCSSGESSTRRMWWGYDEFATLACVGVLDHRIQTN

SEQ ID NO: 30055 - protein, 209 aa, A.fumigatus
LSRHSHVADTYRTRTMPPKGTKPTNDELLAQFDDLGIDSTTEKRPSKPIAASTTAQSEDDILAELDNLASQRPNSGPGTPRLSTNEPRPATKSPKPAAVATPRSSEDKSAPRKSGESVRSAPSGNKATTTQPSEQEKPKAQEAPASGGGGWWGGIFATATAAMKQAEAAVKEIQQNEEAQKWAQQVRGNVGVLRDLGEWAMLVFSFDSC

SEQ ID NO: 30056 - protein, 140 aa, A.fumigatus
YSLGGELKNKALPTFTSLLHTIAPPISSHERLQIHVTHDISGYPAIDPIVYSVFSRVMAQVEGGDLLVIQRGQESAPKRGLDLGTSFSTAGWQDGPWWRTVTPGTPRSIAGVRGTGEATKLARASAESYATEYFALRGRV

SEQ ID NO: 30057 - protein, 162 aa, A.fumigatus
AISQTSSTELFQAGPTTEMATPPGVVDVPEVTEEEVAFALYLHDPIHGIAFHTISQTIPRKWIDWLDAEAPATADPSVEDAKAPRTTVPEDIAEIVASGGVDPREWVAEWLEESLALAIGVVAQRYVARRMGVGERGPGKGKMRAEQASVVESGAGEAARAL

SEQ ID NO: 30058 - protein, 233 aa, A.fumigatus
QVLVAGALNAEVAAANVVDGLVVDHEAAVGVLQGGVSGQDGVVGLNNGGGVLGSRVDAEFQLRLLAIVHRETLHQQSTETGTGTTTERVEDQESLETSAVVGDPADLVENLVDHLLSNGVVTTSIVVRGILLARDHVLGVEKATVGAGADLIDHIGLEITVDGTGNIFALAFTLSDHKVVSRRTSANSKRTSFREESAESVVGVGLLALLGQVTIGLGNSKKMSVNLRVNSKR

SEQ ID NO: 30059 - protein, 100 aa, A.fumigatus
RQANATKSGYAIWQLYAASLPIAINTNTIKQPTSFTLDTFTLSSTMERTISPLLDQPLLLTQSCNARFFNLILKTPPSAKAKYNQPASFQWITHQPPNRV

SEQ ID NO: 30060 - protein, 137 aa, A.fumigatus
IYSISYQAQHDHIDHFYSHQYIRVEDNSILKMKNFNPLVLLSLIPLVVANVEKTIFVAPQPSHIPSTDSTLDDLGLERLSPSYPTLRTFINASFPTPDSPGTDSWFFLENLTPGQRYEVRICYLATVRRLPSHCNQH

SEQ ID NO: 30061 - protein, 174 aa, A.fumigatus
QRKGQGKYVPRTIYCDLEPNVVDEVRTGTYRSLFHPENMITGKEDASNNYARGHYTVGKEMIDQVLDKVRRVADNCAGLQGFLVFHSFGGGTGSGFGALLMERLSVDYGKKSKLEFCVYPAPQNATSVVEPYNSILTTHTTLEHSDCSFMVDNEAIYDICRRNLGIERPSYENL

SEQ ID NO: 30062 - protein, 70 aa, A.fumigatus
DRVDLNKLLAYVSEEIKTRLGIQLEEQITAWSKDAKSRIHSISYAELFIAWVSIASLGTPAANGDTASMN

SEQ ID NO: 30063 - protein, 111 aa, A.fumigatus
LCHDNESPRGASKQPTSTSSSTQTASGIVSVTDSSLLPPRTHPVLTATTSATTTTHREPGCLQTSGPRPRRPGYPCDGPRARLQRRRCQVGLEDHGYWRGHRCKCRGCTAH

SEQ ID NO: 30064 - protein, 301 aa, A.fumigatus
TDKGIEEWTYYVLTLGPSAVLSIGSICAFDDSEATFQTAQSIGLTKWEPADSSISRSTFLKEAVSRAYKVREGSPSLPGSRLSNASSTSSRSSAGRKTTSQASSNTSDSNQINRRRQAVFAAQLRNRRTQQQNNPGNPITFAEERPISSYAMIMSRLEGLPSNQPLPPAPPRQQVASSASLTPRYYPPAPIQYSQPLLPPPPPPTANPVAYRPQVLDPVDQAIHVMVHELGFKEEDVKWALKITDTGEGIDANAAVALLTREQERYEQRRSGRFAFRSKSPSLLESVINSQESVNSGWRWA

SEQ ID NO: 30065 - protein, 74 aa, A.fumigatus
PQRSRSRWLVRRALSRSMGMVFVTAGGKQKPESFKESVQILKGATDFVGKFFYQISQHRNYQRELDGLASTIAF

SEQ ID NO: 30066 - protein, 253 aa, A.fumigatus
MSIVKELAKRSWDRRELNSSFFFVQLFSVPPLYFPSRSCPATNSQKSFELPKNQQQPLHKMSFRKRNIGLSGTVDRTPIANTSAQAPQATTTTESHPGIRPSPDDGRPTTSTGTRSLDNLLAGHGGLPIGKILLIEENGTTDFAGALLRYYAAEGVVQDQKVHVIGMPEQWGRSLPGLIGPADMLDEKSDKKKSERMKIVWRYERLGEFGAGVAGSRGMHRQQMRLSIQILLDEIVLTKSSSCCFRRTKPNSC

SEQ ID NO: 30067 - protein, 239 aa, A.fumigatus
QKVAPAVSGEQSPTAADMNKQEAFCHAFDLTKRLTHPSISNLTYIPLTPSNEPLFISIYKRLQTAIASSHPSTVHRVVIPSLLNPTIYPSEVSQPDHVLPFLHALRALMNTQGHRITAMITVPLSLFPRSSGLVRWMEIISDGVIELCPFPHSADALATSGAATSQEEPPQGMLKTHKLPVLHERGGGSDQNVGQDWAFTLSRRRFEIKPFSLPPAEGDKEAQDAAGPGGMPKKADLEF

SEQ ID NO: 30068 - protein, 61 aa, A.fumigatus
FRPHALCFDRGIDLSCTTHLLTICAYRAVFVSFGGLLLYLEGPYKKLAPLRIDYVYLLLKK

SEQ ID NO: 30069 - protein, 125 aa, A.fumigatus
QFLVKSLSNRSVANMSDPLLFDDTFTITAINSQKYDRVSRLSCTSSDSVTTFTLDINSELYPCAVGESVSMALASTLSLDGKEATGAKASWREVGAGEQTLANDYDYVCHGKVYRFEEAATQGNM

SEQ ID NO: 30070 - protein, 546 aa, A.fumigatus
GVAEKQKVGSIHDSRSMSSDHRQVDSAHNSGSVPDTFGADSGSTLMAAPTVASPGPIEDSTSQDGDRPRHRDDADMQESSNKAFSYPMPTGHLGDARRGLSLPNSGFQKSGQRSPSAKKHRCPYCATEFTRHHNLKSHLLTHSQEKPYVCQTCQSRFRRLHDLKRHTKLHTGERPHICPKCGRRFARGDALARHNKGQGGCAGRRASMGSFAPEDDYGEGAVAPSAENTMDGLVYAEPERMDEEDERRLNMPSIKKHDAPSDSIPRSHSGSSYQPRQPNTYPPIAAGRPSPGGLFPPPTSHGGSSASTSPVSQSGNMTFPPPGQPSGATVYQSTNVTESPRPLSPNALTSHQGGHGPEGGSIQLHRSHSPSMSQPFQQQPFSRSGPSQGPVTNHSAPGLGLPPSQPGAPQLPPPPGLGPSDTRFSLHNPGSVQPPQQAATKHGSSLGHSTNHSGSLSSKAGLDATAGNGTHLPGPHDPSFVEQSRDREDKLWAYIRSVHEELAGLKSEVAALRSQLASSNASNLAPTNTSAASAQPESSSGSTAQR

SEQ ID NO: 30071 - protein, 76 aa, A.fumigatus
NTMRNPIIAYPESYHIARGLNYGVCSLLNGYSKGSAKRWATYPTAKPDGSTQSLEDSNYITAQSSSGKRHTLVRSQ

SEQ ID NO: 30072 - protein, 187 aa, A.fumigatus
VSGLTRSVGIGRGLAAHYLAQPGTTVIGTVRDNSSEKAKDLSKLPKGRGCDLIIVPLSVDNPSRVAEAASEIQTRHHIEHIDVVIANAGICNHWGPIQEMTDLDVLSHFAVNTLGPLRLFTAMAPLLQRASTPKFVYISTLLASIHAIEQMPSLTAAYGMSKVAGNYLVKKIDAENKHLITLSIDPG

SEQ ID NO: 30073 - protein, 109 aa, A.fumigatus
RIRAGSCPERRGLTVDGFSETKDRICVNVASEAQNRVAVDTSVFKVDPSTSVLAHNNLQFVVPPVGTGTNLDTSDDLARTTEHVGAKLRRIFRFCVVQTEDKQCCVDNV

SEQ ID NO: 30074 - protein, 85 aa, A.fumigatus
YISQTRPYFPILGAENTKGTLCGLLYWGLFGIANYHLQIDGDILLAHDQVVVIVKNIKPVELTPAQNHDVLCVRVLADDTPIVRG

SEQ ID NO: 30075 - protein, 154 aa, A.fumigatus
TSLAKRRTVWPSTPVCSKLIPALPFLHTIICSLSYHRLVQVPTWTPLTTSLVPQSMLAQSCDVFSGSVSSRQRTNNAVSTMFRHSELLDPSSLVSISLRPDHTFRFSVLRTPRAPFAASCTGVCSASPIITCRLTAISFSLMIKSLLSSRTSNQ

SEQ ID NO: 30076 - protein, 147 aa, A.fumigatus
  UNSURE (9),(26): Identity of amino acid sequences at the above locations are unknown.
PGFNPGLMXRVMPPNPNSWTAGSARXRSGEKKGLTFANQDSLPKLPIPDLESTCKKYLEALSALQTPREQEETKAAVQEFLKTDGPILQEKLKNYASSKTSYIEQFCMYSLKHVACNCSNIQHIGYDSYLNYDNRKDFSMLLTALDR

SEQ ID NO: 30077 - protein, 561 aa, A.fumigatus
ADLVTAVVLNLNPFFLLEDDPTPARNNQVTRAASLVVSALSFVRAVRREELPPDTVRGTPLCMYQYSRLFGTARLPTDNGCIISQDPHAKHIVVLCRGQFYWFDVLDDNNDLIMSEKDIAVNLQVIIGDAEQTPVQEAAKGALGVLSTENRKVWSGLRDILTKDEGSNNSECLNIVDTALFVLCLDDTEPENTSQLCANMLCGTSEVVRGVQVGTCTNRWYDKLQIIVCKNGSAGINFEHTGVDGHTVLRFASDVYTDTILRFAKTINGQAPSLWATASPDPSKRDPKSFGNVSTTPRKLEWDMVPELSIALRFAESHLADLLQQHEFAVLDFEGYGKNFITSMGFSPDAFVQMAFQAAYYGLYGRVENTYEPAMTKFFLHGRTEAIRTVTNECVDFVKTFWGDNPAEQKVNALRKATEKHTAITKECSKGRGQDRHLYALYCLWQRSFDEDSPSAGNSVENGSNGYSSPVEKRIAIGSPKTSSSMSEDGLSSNGYSYRGIRTLQPNSGIFSDPGWDKIKTRSGQHPTAGTRVEAFRFRPTSEKDLGSLHYPRTTILNCAL

SEQ ID NO: 30078 - protein, 175 aa, A.fumigatus
DDRQLGSFQPRGEDSDEHPQISSANIKRGDTQLAIFKVKGKYYATQQMCPHKRAFVLSDGLIGDDDAGKYWVSCPYHKRNFELNGEQAGRCTNDESMNIATFPVEERDDGWVYMKLPPVEELDSVLGTEKWKVRKGEAPDPFQKVDKRYKGMRGKKACDISTKAPTTQAANIIDW

SEQ ID NO: 30079 - protein, 62 aa, A.fumigatus
TLGFSCAWSIFAVNWSVRSFYITPPMGLILLQLCNLVSVLIFSIKSVHYLSKVFDATRLVHP

SEQ ID NO: 30080 - protein, 109 aa, A.fumigatus
NFSMIFSFPRIFCWMALDCKQPSFSRLSQVHTGSPRNSDIADQVWVWENEDGSTFYFDIGEIVRFRVEMEEWHDQIPNAPDLGDGTTIERKPPYSIIVCGHAFRFQTER

SEQ ID NO: 30081 - protein, 72 aa, A.fumigatus
FDVVKRQRVVSLATQLAVCYIQVSNSNCLCKRKALHSPKSLLTSRIMHMQNKSASQVFNQCLLSAKAPIPKS

SEQ ID NO: 30082 - protein, 214 aa, A.fumigatus
HKSSVNEIFNPERVDKFYSQSAAERQRSLLADKATNYSVVRLELIEEIYNDMYLQRVKNPDETQWQHRILPERKITRVEHHGPQSRMRIHLKSSKPESEGAANDVKETLEVDALMVATGYNRNAHERLLSKVQHLRPTGQDQWKPHRDYRVEMDPSKVSSEAGIWLQGCNERTHGLSDSLLSVLAVRGGEMVQSIFGEQLERAAVQGHQLRAML

SEQ ID NO: 30083 - protein, 356 aa, A.fumigatus
  UNSURE (6),(352): Identity of amino acid sequences at the above locations are unknown.
MVVNVXHGAPLAGTVQRHLMWKVDRLVVLASTSGMFCVLLPRTARGSVGFANGRVCSCVPNKMTWNFASINEALHVGEHYGYDIPKDVKINYRQFKETRDAVVKRLNGAYERNWGKEGIDLVHGRARFVEPKVIEVTLNDGAKARYSAPHILIATGGRPSIPPVKGAEHGITSDGFFEIEELPPKVAVVGAGYIAVELAGVMAAVGVETHMFIRGETMLRKFDPMIQKTMTERYEATGVHIHKKHGGFKEVQLVKDGKGKDKVLKLIGNDGSEEEFNELLWAIGRQPEVEDLHLEIPGVKLNESGHVVVDQYQNTSAEGVYALGDVTGVAELTPGTLFSSSPRGWKDRRGVXDLCA

SEQ ID NO: 30084 - protein, 305 aa, A.fumigatus
RTWGQFRNASDITESINTLRRGVLVLVDNDVATFVELHAGDLEMQILDLRLTADSPQQLVEFLLRPVIADQLEHLVLALAVLHQLHLLEPAMLLVNVHAGRLVPLRHRLLNHRVELAQHRLTPNEHVRLHADGSHDTSQLDGNVTGTHDSNLGRELLDLKEPVASDTMLGTLDRRNTGPATGRDENVRRRVPRLCAVIERNLDDLGFDEPSATVHEVDAFLAPVSLVGTVQTFDDGVAGFLELTVVDLDVLGDVVAVVLADVESFVDGSEIPGHLVGDTAANPPVSKSHASPGRTWEQDTEHTRR

SEQ ID NO: 30085 - protein, 741 aa, A.fumigatus
RHERCDFSTIHGLRHFHHSLPGYCPTPLVSLPEIATELGVKAVFVKDESDRFGLPSFKVLGASWGCYRSVVSHLGLSPTVALDDVNQRLKESPVTLFAATEGNHGRAVAFMARQFGVTARIFVPASMDEETRNRIASEGAEVAISDGDYNLAVQEAWIASQNDGGLLVQDTAFDGYEEVPAWIVEGYSTMMTEIDEQLSQLGLQSTLTVTPVGVGSLGHAVVRHCKSRTTPIAVVAVEPDSGPCLISSLEAGTMVSVTSSETIMNGMNCGTVSATAWPDLQRAVDAAVTVSSYESHCAVQYLASHSVRAGPCGGASLAAIRRLRASGQAASLLHRDAVVVLLCTEGARPYPIPRDVAVEDVVGLTQVLTQIDSSNPTLSVADGVGETEIANYLAAWLAHRGIEYHRVEPVAGRPSIVGVFRGSGGGQSLMFNGHIDTVSLSSYESDPLSGHLGEKEGRQVIFGRGSLDMKGGLAAALAALAAIKASGRTLRGDVIVAAVSDEEDASQGTRDIIAAGWRADAAVVPEPTMGAIAIAHKGFVWVEVDILGVAAHGSDSQAGVDAILQAGWFLQSLEQYQKRLPIDDTLGQATLHCGLIKGGQEPSSYPQRCTITIEFRTIPAQSNESILEDVNALLSGIAKEKPRFRYAPPRLTISRPTQKLSADHPLVQTAVACATEVLVDGPGVISVPFWCDAALLSEAGVPAIVYGPSGAGLHSKEEWVEVDSLQEMSRVFEKLIQELCA

SEQ ID NO: 30086 - protein, 118 aa, A.fumigatus
IRDPRGEDEFGTKGDANTFIGTSYYMAPERITGQSYTITSDVWSLGVTLLEVAQHRFPFPADGTEMQPRAGLIDLLTYIVRQPIPKLKDEPENRIRWSDNFKYFIECWYVYSAMDEWG

SEQ ID NO: 30087 - protein, 96 aa, A.fumigatus
PCDCLECYRPRVLRFYHVICRQGSAGAWCQHPSASQVCICRRCADGKSPILWSQFMKLHQAPTESYADIGGPESQIQEIEESVELALAPPRNCMKR

SEQ ID NO: 30088 - protein, 179 aa, A.fumigatus
QSLCLQKEKPKYEPPPPPTTRIGRKKRKAAGPSAASKLPDIFPTSRCKLRYLRMQRVHDHLLLEEEYVENMERLRKAKAQATLDSVSRGDLDIMDRNADERSRVDDMRGSPMGVGNLEELIDDDHAIVSSATGPEYYVSIMSFVDKDLLEPGASILLHHKSVSVVGVLTGRVRSSGLSS

SEQ ID NO: 30089 - protein, 68 aa, A.fumigatus
FECWSPRPGQMATTAYLRALRPSLQRKLHSLTFTPSSTLLTSTALFNDSSGSKVAVVRGLILLPLSNS

SEQ ID NO: 30090 - protein, 79 aa, A.fumigatus
YIFSAELSCECSNYSSSASSSPHESLLEPQSSKDSEAQYAFIYQYQTSMLTFSLALPVPPSPRSSSRFELIKKITDHSC

SEQ ID NO: 30091 - protein, 61 aa, A.fumigatus
NHLIDHCNMLSARGETYAKAGLANSYLEALKTPYNKDNKQGVVSFRNAENVLSHILLLVGS

SEQ ID NO: 30092 - protein, 185 aa, A.fumigatus
RKMYCGNGSLMRVAPIGLVYFRDMEIALSNAALSSNATHPYPRCAECCQIYTRLIVRALNGASKEELAEEFARINFTDVKVKQRLDRYSNLTDWENTDEEHIKSSGYVLSTLEAALWAFFTTSTFKSGAVKVVNLGDDADTVGAVYGGLARSYYGLEKIPADWIASLQKKNIVEEIASGLCSLTE

SEQ ID NO: 30093 - protein, 159 aa, A.fumigatus
LTALDAVPKKRGPKTDVLEALLKRVDGLEKRLQDENKNPMSPTSPVEPHKEPPDPSASMHALARPSTSSTSTTSVPPSEPFPRPFSFPSQPSPPVHYFALPDSVLDAYFARIHGKPYFILDESVTRQSHQMGQLPVALSMAIYAITLRFVPPPPCLSFI

SEQ ID NO: 30094 - protein, 79 aa, A.fumigatus
FSTDHCSYTSSPNPSEQSLRMALDYALQARRMVDVDQPTMDGLQVLLLLSQTFLAHGLGKKAYMTFSMQSIAFWKDKTG

SEQ ID NO: 30095 - protein, 177 aa, A.fumigatus
  UNSURE (166): Identity of amino acid sequences at the above locations are unknown.
FDCIANCASMAIALDLYREPPKSLPAGEREIRRRLFWAVYIMDRFLTCGSKRPGLIADHSIVLRLPAWSPHTAGLNVEGELFNNVGPNIQYSSDPRRKPAATALLIDITRILGITNRYLAAGGVKGDSHFPWHSLSNLSKIRQELDIWATGTPDVFASVEALFGHXESSILLLSKLI

SEQ ID NO: 30096 - protein, 170 aa, A.fumigatus
YLVHCLIYRPFLPIDLVELRGTGQHQSWQIEATNLCFSHSNAIAELVELARNSPLIEWPAFVGYCVCTAGTVHVHGVHYKGREGEVFSSSAEFLTREMHQLTWLGSYWAGVQHQREMLQTIYTCHAELVRTLATSPMRFSPVFHLEDFLDRYPGLTADGSHVRLVDMDDT

SEQ ID NO: 30097 - protein, 165 aa, A.fumigatus
LGSPQLDPYYRSMPAYSMYHNQPLRAPVTLPSNHNPSPRRDSHSTASTATKPPGVSSPSLTFPPSQHPQPSPQQLHSTFPLGNADLTHPSSSDASNHHNHNHNHSFSPPPPSAMFGFSPPAFLTESLPVAPTPPSHPQYATFPFDSSSSNNNNNNNSNHQTHTGQ

SEQ ID NO: 30098 - protein, 69 aa, A.fumigatus
SLCCSLLSGVGLVASCGSESGDNRSGLFGSKVGSRVVAISSFFRAILHAIWDDQTNPSAGVLCVDCPEK

SEQ ID NO: 30099 - protein, 456 aa, A.fumigatus
LTGRRTSCLLVLTVRGCSGSGKTQFLLSLLLAVQLPEPRGLGKGAIYISTEAPLATSRLSQLLEYHPYLSDLPKDRAPTLDNILSINAMDLESQDHILNYQLPVAITRYDVGLVVIDSITSNYRAEHTSHNVLGLSTRSGELARLGQMLRNLAVAKNIAIVVANQVSDRFDPLEDNAALRRAAAYGNTIGSSSPVSTQQQPTTPLHRDSAIASPLPAARSRPPESGNAELSPHITIAPPSSSPAFPSSPFLADDNPSEQQPQDFDGSYLIGNPVRNELLSLMHQQRFFTGWGDTPQAAAPPSPYYFSGQSTHKTPALGFVWSSQIACRIALKKEEIATTLDPTFEPKSPDLLSPDSEPHEATRPTPDSKEQQSDHRVLETSLDVPPVRQRITPQPAPPDIIPPRTLRRTMKLVFAPWTAGRVTTTVGKDGNSTVHVQDEVEYTIWKGGLRSVEAQE

SEQ ID NO: 30100 - protein, 69 aa, A.fumigatus
GATKRSPRLGNKLRCPTRTATDHAPTGTTGHNPPSHAPKNYETGLCALDRREGDDYCRQGRELYRSRPR

SEQ ID NO: 30101 - protein, 199 aa, A.fumigatus
CAKVEAIGFISRSISAQHVSERTPYVLQFSLIILAPVLMAACCYILFGRILFHVVPPEARTFQLCWVPPRFITPIFVGFDIVALLLQLGGAVLITSADGTSSDAKDKFDRGRNIALIGVIVQMVAFGLFSLAAFRFNFTSKRFAKPVDEQFEMLASNDAGTGGREKSANWNALLRVVNFSTLMILVSVSKRSSPVLNHR

SEQ ID NO: 30102 - protein, 152 aa, A.fumigatus
TSVNYWLKYPSYHPFGGRPEDTPMINTGGPALSRNDTLPNSLEKNNPSFHLVLPAGQKSAALCRTITSAMILNYPPPTLVQYGRKLPSGSSEYDYVVDRVTAIYNFLQYTPHVRDGDFVLIADGYDVFFQLPPEVLIQRFQNILRENNAKLS

SEQ ID NO: 30103 - protein, 152 aa, A.fumigatus
PIGEGSSFSRVVPFATRPLFWRDRKFKSPLELMVNSRRSLRFPISSTSVSYIPVWTGGIVGTAAGINPKILDNLQSDTVLSIASWEHGGYDQQFEWDTSPDSNQDEAEVVDLGVIHGSLADDQPSASVFGHNSDPRLAQNLLFRRDGCNRSS

SEQ ID NO: 30104 - protein, 416 aa, A.fumigatus
LMDLSLACSNPGLISPEKLSAVDAAIEGTISGTVSPRTLPSSTDDNFHVDETWPHFQLINPMAAGLPVDAPMALPYAKDPTSNNTVIVDDGGELSNGQGFPEVQPEQYLTFQNLSQAFQFAGDPWAEPPVNLDANTSAQAPISVPQMRPQVQIQIINQPRSFQGSLRPLESRWLESLESQLPTNLTLPASLTTDCQDHSLPKDDRRLQDAFQYKSESSSVSGDLSGVYDCSYSGLSDDVPAFAERQLEDDGAWKDAQKKESSSATSRPLQGATAFVVSENPQESFFMTAPSRSRASSTAAQRASGRPQALALQSVATVRKRKQRTSNVSIDQSLPKPLQIVQEDGQGGSIASADFVSPPRGARRKGPLSMVGRANAGLRRKNKDTCVQCRLNKRKVGLPASGLFWSQYHRKLMIAV

SEQ ID NO: 30105 - protein, 71 aa, A.fumigatus
PHECVSCNPIIYLKRCAFAHSQGNACTNTGVHPATEFMEVYDSQDFEKTTTAYGLQTRLIIICHVITWSMI

SEQ ID NO: 30106 - protein, 61 aa, A.fumigatus
TYALANCHPFCISLGICKTSESAQGSNVVAQNNLPTEYKSDANYASYKNGGLFCQIFNYPH

SEQ ID NO: 30107 - protein, 116 aa, A.fumigatus
SLQFLLKSVIMASEQPVEAAPTGGSLADRITKPDESNTSGTRAYHLPSADQTEHTTNLLKAETPAPIGDQTDGAPAQLGGSDLHEPEYNVEVKLSDLQADPNNPLYSVKNFEDLGL

SEQ ID NO: 30108 - protein, 174 aa, A.fumigatus
LTSLRPNRDPRILKGLSSMNFRKPSKIQERALPLLLNNPPKNLVGQSQSGTGKTAAFVLNALSRVDLSTEQMQKTPQALILAPTRELARQILGVVQVMGQFVDGLIIGAAVPTDRDSRPKRLECSIVVGTPGTVGDMIKRRTFIPNKLKVLVLDEADNMLDQQGLGDQCIRVKA

SEQ ID NO: 30109 - protein, 128 aa, A.fumigatus
  UNSURE (109),(114): Identity of amino acid sequences at the above locations are unknown.
VSNGIQWLDEIQQFYRERSAIEKEYAAKLTTLCRKYSDRKAKKISSLSVGDNPAMTPGSLESASLTTWTTQLTAVESHAAERDKFASELVAQVAEPLKQAAAQYEELRXCHVDXHARLEKERDSSYSE

SEQ ID NO: 30110 - protein, 181 aa, A.fumigatus
  UNSURE (25): Identity of amino acid sequences at the above locations are unknown.
ISLLPVLFPIFDTQHSFHTMSSETXYKTQQDLRKAESHASHAAGGNTPANSNVSAMKVTPNLLIQFGDTAANSTNQSIVDEHTDKAKAIEERKANLPLPDQPPVASDWQSADQRAVNVGSGGVQGSVSGESNTALRDPATAGSSARMSGEELHKETQPTGNVGRQATEGLSDIPGDAKARK

SEQ ID NO: 30111 - protein, 84 aa, A.fumigatus
LPLWGKYGDQTLSGPRRDGKTSQRFVRSMHHPQWFIRPRPVTKTNGVSDGRIQAKVQDAAFGLAARLAGLSTKENFHEQYPHDK

SEQ ID NO: 30112 - protein, 132 aa, A.fumigatus
RLYRTALALLAELPKTCDTIADAFNKNSRELKAARDELCNAQSELTILKGLLEILFNLLEKMWATVRTYQMGKDMKEAEVQGEGEPLGAILDLAIMQLDLQSTKIDCDALRRENTFLRSLLHGTEAAADQCE

SEQ ID NO: 30113 - protein, 111 aa, A.fumigatus
YKGDEPSLEMTFNFLSVSNNTVWSCFPETLTMASVLGLVASAWLLPTAYGASHSLAPSTSATSAQAQYTLPSSIDVGAHLIANIDDPLAVDAQSVCPGYTASDVHQTSHGF

SEQ ID NO: 30114 - protein, 82 aa, A.fumigatus
VQANGFRAVTYSGSWQNSGNGYLSVYGWTTSPLVEFYIVESYGSYDPSTGTHPSRHRPIAKGPRTTSTRPRGTKRRPSSAPL

SEQ ID NO: 30115 - protein, 111 aa, A.fumigatus
SYPLTRLTNITSIHNSHTLLICNMASFRGISLHMTVYIDPAKLPTFWEAFKPVYEHVIAEPECTFFEVYQDPENPGTITWVENWCVVANMMKNLTDWSPWTGQNRRNGSLR

SEQ ID NO: 30116 - protein, 131 aa, A.fumigatus
SHDYLSLGIATKDIIFSIEAIKQSSNQTTINMVSFSSLVLAASTVAGVLATPGSEQYVELAKRQLTSSQTGTNNGYYYSFWTDGGGQVTYTNGNGGQYQVDWNNCGNFVAGKGWNPGNEKYASSPCLLGSS

SEQ ID NO: 30117 - protein, 282 aa, A.fumigatus
  UNSURE (27): Identity of amino acid sequences at the above locations are unknown.
EEAIEREKPEVEERSLQRETGGGAENXRMGAVKEFTVSHEGRHGCSQNSSVFVKLRWVREGRGLELDQHRLMSLFKPFGKVENTFMLKDKRQRVGDKREKKTVATGVVVFASIVSAHAAVLDSEKKRRQSAGQPDNDWSLIESVSWAFGNQPDIVGTETRAASPISTPDEASSAQKPPPHVGPSKTAFDFSKLKSAAPPGGSGKTPGKAPSFASFASAAGSSKPTPSDTSANGRSTPSFQEITLMRLKNAQREKERKALEAQLMKEDEAADAAEAAAAEARC

SEQ ID NO: 30118 - protein, 306 aa, A.fumigatus
TSIESGRIGGPEKRGTPVMVFQGKTMLSPRWAENNLESELSSPFAPWSSVAECIDTRAPGFGSRLVTPGEEDLRVHLPDEAQVAGSQVDLGTYTVRRMLHGIAEGQDEIIRESALPLECNMDMMRGVDFRKGCYVGQELTIRTHHTGVVRKRIVPVQLYANSAPQSGDTPVYDPSAAVALPPSGSNISKVDGRKGRSAGKFLGGVGNIGLALCRLEIMTDIVLTGEGSHYSPEQEFKISWSAPEEGSSSATEPGEVKVKALVPPWLRDYISSGARNLARKVDNQEGHRAKELLYQLEEEEEQRRNE

SEQ ID NO: 30119 - protein, 687 aa, A.fumigatus
  UNSURE (4),(10),(11),(656),(682): Identity of amino acid sequences at the above locations are unknown.
YDIXRPCGKXXEGARDGTNRFSISSSGWHNPFPPHSAGPTNQFAMDYSSPTLNDLGIPPETVSPKSLMAQNPFAETYATPPSMTSVGQPLMAGHSQSMFSSSMATNGESPNPFNLPFTNSDLRSHHAPTSTDTFTDSTRQALLASMALPTGLQNHRKYSQPASGMTPCRDLFSRSATFSGTGQLPSTQDMQRYISAYITYFHPHMPFLHIPTLNFQAPEYTNNLRTPSGHLNLSSTGIAGGGGCLILSMAAIGALYEFDTAASKDLFEAAKKMIQLYLEERRKADMSAAFSRSNPARENSVHNTPLWLVQAMLLNVIYGHSSGDKTSADIASTHCAALVSLARAAGLTHHIDAKDLPQDYLNTHLSGKVGSMGASSESEDSNTASFGPPKERKDWLDWKIVEERKRTVYAIFTLSCFLVSAYNHAPALTNSEIRLDLPCEEDVWAAESPQAWKKLGGHLSAKKGLAFSSALTTLLTASQREQSHGQLSSPDATNGVSASDPTATDLKPSTFGCLVLIYALHNYIWETRQRHMGRQWTARETDAMQAHIEPALRAWQTAWASNPTHSLERPNPFGAGPLSADSIPLLDLAYIRLFVNLGRSKEAFWQRDWIAMSDELARGTEVFPYSDDISSDVLDPSITQVPSELDHRRDSVADLXVGDLTISKTPTREQPMQILMGVYRPXQSKRE

SEQ ID NO: 30120 - protein, 120 aa, A.fumigatus
LDSIIMTLPTANIQRNAGCSIVLYNNTESTTQYCCNSIVNNPNGSLPFCDQGLNTIEVDSASMIAGIAALADYTRIDDSTKTTSSAASPTSPTSNTPDNINSHGSSSHEVSSWSWCGCST

SEQ ID NO: 30121 - protein, 343 aa, A.fumigatus
ADPSSPVVKTHPSVSSLLTPPASTQAGEVTAPSTAAPATTVSATSDVTPSYGTAYWQGHSGYGSTPGPRQPWTAGSNQSYPTRDSFSPSTLNPLSRNQPTSPPVTEGMAQPYDMHHLPPFQQSLSVPPSGLSTGTAPHPAMTHAMLASPTGLPNPGPSPHLLPSNDPYGPKSQPAPVYGGAQQIPSPHQTSFPPYGQPGLGIHPPGRVSSTPTLSATGPPPHLNYSRQPWPSYSLPAMNGPVMTNIHSPNSQMSLLGSMQPGILPGFNSGHVASMQQMYGGHPPHPIHQPGPTNDRPFKCDQCPQSFNRNHDLKRHKRIHLSVKPFPCTHCDKSFSRKDALKV

SEQ ID NO: 30122 - protein, 117 aa, A.fumigatus
LSKPKVHPINTTVFDWWHFDAVSASNPNASGVITLFTNTPTAFPFLPGKSKSKSNTDSVLAGLPLDLISKWDRDHLRTLSRYIPSDSRRSPRRYPRDLARERRFLCWIRARGVSGYD

SEQ ID NO: 30123 - protein, 118 aa, A.fumigatus
MRQSPTLAISAMLPTLRAVCLQLLVPVYLMREARQFSSATLYVVKTGKRHMRVIDMSLQESHNIDTTCGNLIEPAKQISDACRLGNRYTYGYVSRTIVDGSQSYPYLVAIGDDYAFEP

SEQ ID NO: 30124 - protein, 119 aa, A.fumigatus
FEQLRMPLDTSTTYPLTKLRLDGRRWNELRLLQAQISTNPASSGSSFLSMGNTSIMCSVHGPAEGKRGDATGGAAGSAGAVVEVDVNIAGFAGVDRRRRAGGSDRYAALLLRFVSLTTF

SEQ ID NO: 30125 - protein, 280 aa, A.fumigatus
LLANLRNLCLDRDREFKSDPEPPLSTSDHERSKIRQLPSPSNRDTSVVHLADTESGDDSFNDGEAAYKQFKERRALKRKRSSANLRKSKKTKVANPDSFVGKRPKKENEQSTRTRPILRTYGEELPSDDELMEYTLPDYLQKRRTQFDRRMDHLKQSGLKLPPDFDDVEFSDDERLEFLKEKPAFRNIEPCGKYEDITLPYSLGLIPAPIAQWLRPYQVEGAAFLHELFVYQKGGILGDDMGLGKTVQVITFLTAAYGKTGDERDAKRMRKMRRSGRDGW

SEQ ID NO: 30126 - protein, 82 aa, A.fumigatus
NSVVSLRLRIEVVVVVTYVIVLIIYSYLVIICYNTSNFILSSLIYYFNIITSLTFTYIAYLYFYLIFITSSLYKELLLYIIS

SEQ ID NO: 30127 - protein, 63 aa, A.fumigatus
  UNSURE (41): Identity of amino acid sequences at the above locations are unknown.
STYRLIILPFYIKVSFSLIGIAFSRFYYPLAFFIKYLAFYXLSKSYYYSSFTFSIILLDLVIK

SEQ ID NO: 30128 - protein, 67 aa, A.fumigatus
LVSCDVRQIYFYLQAPLLRPPCQHSYQGGVADMINKIPNQYTTNDTDAYTDGFDGNAQNTVLFIMDR

SEQ ID NO: 30129 - protein, 62 aa, A.fumigatus
EENLHLLACAPVLSQIVSARGRSVVLTISLTSGTVYLRRRTELTLDQGDCADGSHSTRNTSR

SEQ ID NO: 30130 - protein, 72 aa, A.fumigatus
RQPFFWERNLKVICGVMTLIFIGRATYGAGPSQVRFTTGVEPSRGSIRLVTMTGKYSLAWIELNRVSDHESS

SEQ ID NO: 30131 - protein, 245 aa, A.fumigatus
SASHGVLQWFVPCPYDGITLNMQANSFQVLVWTGLAGGDGEYCAILVAINSILQMVLFAPLAIFFIRVIGDGDDGLTIEYSLAAKSVGVFLGIPLGAAIVTRFGLRFLISDEWYNRTFVKLISPLSLIGLLFTILVLFASQGRQVVHQIVSVVRVAAPLIVYFAVIFLITLLVTRRLGFGYKLSCTQSFTAASNNFELAIAVAIATFGVDSDQALAATVGPLVEVPVLLALVYVVRWFARRQQWK

SEQ ID NO: 30132 - protein, 60 aa, A.fumigatus
WLTHSIAIGLLVMMYPILCKVRFETLHRSFREKALWIQVAFSLVVNWIIAPLFMVGRRLR

SEQ ID NO: 30133 - protein, 62 aa, A.fumigatus
RYRPLFSFFIKSTSTAAGLDNSLIYPFLSILSRYLCRASSSSYNIVNRGLYSNNFLLSSYIL

SEQ ID NO: 30134 - protein, 77 aa, A.fumigatus
LVEVIKSPPNIYIIRRIMLVSKDYTFPWRSSVNCSISVKFHCAVDAAAGRQDQPSCKNMFISMTALILTLTTTRVWH

SEQ ID NO: 30135 - protein, 104 aa, A.fumigatus
SIDEWTPQSRLQPSLQDFSPCSFNVSFSRILEKVLISSITKGGQEITLSVVTQIPTGSDQSPSLSSKAQIFKSAVKAAKHLVPSGIREACQRFKQLTQFFPSMS

SEQ ID NO: 30136 - protein, 270 aa, A.fumigatus
  UNSURE (1): Identity of amino acid sequences at the above locations are unknown.
XSGRRTVCLPVSYQSSKYPYMAATPFLGQILKGRRGLYPLTKQLQDCVWLAMLSLFGILSLSILTIHSYEHQETVIAKSVRHFRLQNERDILLRFQDRTPCIRPLIEELGDSTVPPTLILKHLDNDALRASNKQRLTRLELKYVAKRVLEALSVLHDEGFVHTRMLRLFRFSTLRVLLMGRVIDIKPSNVLVNYGHGDVRFTDVQLADFGSTVHRDSPYAQHGDPIGTPIFRSPEAHLQMRWGTATDIWSFGAMASPNLTPEMSDLNHDI

SEQ ID NO: 30137 - protein, 118 aa, A.fumigatus
YLITAQLISLLYGDGFHIFKPDVPPDHDDYDVMILMKHHRCFGPFPESYEQIADSQRLAILVWIMQNSPPEKLRPFHLTSTQEICQEDKEFILRTMKLDPRDRPSARQLLEDEWFRHS

SEQ ID NO: 30138 - protein, 186 aa, A.fumigatus
QGIESVFNIHVSSCDSRKKTLALTVSISVNPLYYVTFTTATLCASFILFKGFNTSDAVNTISLLCGFLTIFSGVYLLNLSRHDPDGRHLLSSKLDDEGVPTDGIASFQTRRSMQSRRSNEPHRRSSSFAFMNGHGDREGLMHSYDVENQAFGLSELTEESDGEPGPTYKRSDDIDRTTQHPNKHDE

SEQ ID NO: 30139 - protein, 145 aa, A.fumigatus
HTGIPVKLSCTPWVVISSVSRLDVHQSGSLPPQRILSGDMPGLLRKFVIIAAVDGLILQPHGNGGRNSGNYEPQSVRIDYKTNKISPLPAPASDPAVRKEAGLEAYGLVGKLASSATVSDIVFSLCNSEYTKFFPPGKSLVFTPA

SEQ ID NO: 30140 - protein, 107 aa, A.fumigatus
RWLTRVTLSGFLIYCLAVAIFSTVMIYRVAPVYGKKNPLIFISICSTVGSVSVMSVKAFGIALKLTFNGNNQFTHASTYVFMIVTGFCILTQMNYFNKALNQFSTSM

SEQ ID NO: 30141 - protein, 325 aa, A.fumigatus
RTRYLLGPGRDDSANRGVFKYQLRYCPALANKPSGAPKSDKDRPGPKPDPFENPSTDLLIAQIPQENPKYTLVLNKFPVITNHFILATKTWKSQTDILEKEDLDAAYACIKAWRDNQTEQGDSGSNRLFAFFNSGDESGASQPHRHLQFLPVEDMSQGDSGNWQPLIDTISSQWVCPDSEYRRLSQIPFAHFALPLPPNPTADTLHAIYLSLYRVALWTAKGSLEDHSRVTDGPAAISYNLAMTESMMMICPRRCEAARIPVDPSALPNVQEPGVVALNGTILAGTLMVKAEAEWNELRRNPDTLAGILASVGYPQPDSCGLALL

SEQ ID NO: 30142 - protein, 77 aa, A.fumigatus
NRTGSTHGYDQRSTIAWFSPTTFYTVKEWEDYYYMHIKNSMSRWCEIITYYYTLIWLGYCPFYLGNKSLSLSNYIRS

SEQ ID NO: 30143 - protein, 65 aa, A.fumigatus
TKTTTTTSRSRWPKRMDCQGYLRIPAGNTGADGAPRLKYTVKWLGYDNPTEDPAHYLRERTRDYS

SEQ ID NO: 30144 - protein, 102 aa, A.fumigatus
LVWLDARNIRTLRPQKKLNWKHLGPFYIKKIISPHAYELDLPASMKIHPVFNVSLLHPVAKDPVPRQRQPPPPVEVDGLKEWIVKDILEFPLGTLGPMGPPV

SEQ ID NO: 30145 - protein, 166 aa, A.fumigatus
RIYWGHKSLNAGRNKMYYYYYGHDLIQDSFKTPKTTHMCYSATPILLREMCSETYSTSSHVTHVNRHQSRSSLRVQIIWSMRFLRLFVVCAVSHSHMRRLRAAAAFFSKCDSTIIQINYSYQIIHTMFTTKNWLVGKCFGGRQGLLTLSWLRWLREWYIWNRSIYA

SEQ ID NO: 30146 - protein, 108 aa, A.fumigatus
SKMAGSKTESAVRFPEKDSQTRRLRNQTTQDKKAVARMQAETASAQARVARATHAGEEWTPVENFETAMDQDGNPVPDPAYTDYEKMRQHKGGEDEADDYVAANANFD

SEQ ID NO: 30147 - protein, 791 aa, A.fumigatus
  UNSURE (723),(728): Identity of amino acid sequences at the above locations are unknown.
CNRGEDSEPLAPGDLRRNTVFKMRLEMSQETMLRIPTREPSKDWLWKGRADAIRGATKLKKQRKRRPSRPAEGDKSNLGPDIRPFGWLSLRVAGDSTVTYSMDMVASTTKGFNNLLELDLRDSRLSSSVNHALLWQCPRQLVTCDLSNPLSWNNLRTWTFDVESHNMELFLLRDHIFLLTDLVSDWASGPPQEYFTFVPFTYTLNLSFVDFKLFVNVNDLNIISNPSDLDDNRMLVIKGKKLASDVLIPLTTYKPEQNAVNFNVYLDSGGIDFLSPQWDTLHTFLQDQSIATLDGLSLRGSYNYYLSTAPDLTDTLLLSINGVSPKLYLYGFLIKSFMTIRENYFGDEMHFKTLEEFQELAYSEERVNFHNGINPNRKSNDLDVIVHVTVDDACALLPENMYDRLKCVRLTTPSLEVDLRFTNYYMDLQFSISPLRAAMQVHRVEGPASISNTQLFIDGAFIHGHRLFGLPPSEPTYVCNWDFEVGQIFGECSAEFLGCLAAALQSFDQSFDNEENALPPLVPIALHDVTFLRAKIQPIHIAVLSDQAALILSSGLITTKFNDWANASFSKRMSLLVPDLSIAAVNYRDIDLKGSSSPAGVSPLALFQTTIKLRMAQRRADIDENRKLQQEHIGVHDQRTQRTPWLMFDWEDIDPSSFRTPNDQLAPPTIAIPSMPEPIIKQLHTLSSADSLSDFKSQQSSKSFVLTSDNSSFKSGRRRTTRXMSLPXQPQIDKRSKNPNNRIDDHVPKIITYRQANEFPKYPSLPNPAPNSSKCLDKCPKFHASPKISLK

SEQ ID NO: 30148 - protein, 65 aa, A.fumigatus
GFTSNLVKVIETECTSLCQTAGVHVADYSCVQEEKSKAKQAIDSKRRFAGGNEEASDNLLLSDES

SEQ ID NO: 30149 - protein, 146 aa, A.fumigatus
ILKTFLWSALAFDSTGRHYDQTGNYTDWWDAKTVQGFEDRAQCFVDQYSNFTVLGENGEPLHVNGRLTLGENIADAGGIGAAFQAWKKRDEASPDAHLPGLSNFSKEQLFFIAYGNWWCAKTTKEAAIQAIYTDPHAPKFARIIVS

SEQ ID NO: 30150 - protein, 320 aa, A.fumigatus
  UNSURE (83),(106): Identity of amino acid sequences at the above locations are unknown.
IMPPVPGRPEHRRVICYHQTLCPNRGDYVSVLPLVKNNTGVTHIIIAAFHLNEDPGHITLNDDPPDHEMYNPLWAEVPVLKRXGVKVMGMLGGAAQGSYRCLDGDXEKFERYYQPLLAMVRRHQLDGLDLDVKKEMSLPGIIRLIDRLKLDLGDDFIITLAPVAAALLGIGNLSGFDYRQLEQQRGSKISWYNAQFYNGWGLAEDPRMYAAIVAQGWSPQRVVYGLLTNPGNGSQGYVPRERIGPVLAVLVEQFPNFGGVMGWEYFNSIPGEQQSPWQWAAEMSLSMHMKDVLAAARQMLTAGPMANSLMNVLRDMMHQP

SEQ ID NO: 30151 - protein, 223 aa, A.fumigatus
IQVNVYYIHSPDRQIPLEETLAGINELHKAGKFKHFGLSNFRPEEVQEVVRIAKEKGYVLPSVYQGNYNAVARRIEAELLPVLRENNIRFYAYSPIAGGFLTKTKEQLLAGGEGRWDPNSAIGQIYHRLYNKPAMLEVLDDWAEIAKAEGVTKAELAYRWIFFHSHIREDLGDAVIVGATKISQFEETIAAIQRGPLSADAVKRIDAVWEKIKDVATLDNFNA

SEQ ID NO: 30152 - protein, 80 aa, A.fumigatus
ASTCDKRLTYKPLQFQGTSCLWTTETNLDSVRIYFIQNVNNYSDVDAKLSSVSSGLNPLIFTPCGSIAGLSLRSTFRLIV

SEQ ID NO: 30153 - protein, 117 aa, A.fumigatus
CTPGEDLAILLLARKFGVPIVPHSGGVGLPEYTQHLSTIDYVVVSGKKSVLEYVDHLHEHFVHPSSVKDGYYVTPMEPGYSVEMKPESMDAFAFPGEEGKSWWRTEAAKAILEGPRI

SEQ ID NO: 30154 - protein, 205 aa, A.fumigatus
PRFSDTFAVKEAPSLMQTIGRFLHYRREPDNKHVYMIRDPPRIKNALAIGVHGYFPAPLIRTVLGQPTGTSVRFATMAAEAIHKWTESHGYACDVEKIALEGEGRIAERVDLLWKLLLNWVEKIRKADFILVACHSQGVPVAIMLVAKLIAFGCLNATRVGVCAMAGVNMGPFSDYRSRWISGSAGELFEFALPYSQFSKIMKVQ

SEQ ID NO: 30155 - protein, 89 aa, A.fumigatus
RSFLRLAIEFALETTNVSNAALDVRRSHPSPANPYILPFAMRGILEEEYVRRELYEETMQLLRQYDDWKPSSKVLKDVKFRLEGIRSKL

SEQ ID NO: 30156 - protein, 151 aa, A.fumigatus
EKVISYLKIYLITGIGTMFFIGILLPYNDKRLLGSSSNAASSPLTIALTDAGILPAAHLINALIVISVISAGNGSLYVASRTLLFMARNGKAPRFIGRTNGAGVPWVALIFSNLFTCIVFLTQSSGAGKIYSALITLSGGELASRPPILVC

SEQ ID NO: 30157 - protein, 140 aa, A.fumigatus
RVTVATFIVWAVIGICHIRFRRALVVQGEDPAKLPFKAWLYPWGTYFSVALNIFLVFFQGYTAFLNPFSADDFVINYILLPVFALFVLGYKFWHKTRWVKLEEMDIWTGRRKSPDVDVTDEPPVKKQKSWWARVLAVVIG

SEQ ID NO: 30158 - protein, 715 aa, A.fumigatus
RREMERRLAYLKRLRDQDISSEQASDEKAKSQKFILITPEMVHQSPQNASPKVKEVLHAAHDAEYDNALHHYQTQKRQWEAYISGASSLFDPYAHQNIVVLFSLVCTTTSIPCSGPDLFALEYYNEHGDDTIFEPDCTIGQYVEDICQNANAICTANGCEKRMFEHHRQYVHGEAQISVFVQPYPSKLRGLQDTILMWSCCKVCGNETQVFPMSDSTWKYSFGKYLELSFYSKNLHARAGVCPHDLQRDHLRFFGYKDIALRIHYDTINLLEIIVPRTRVTWKVDNDLKLRNEVYLKIEQRLNRFMGSVKARLKGINVDSVVPKLAEACKAEIEVLTRKANEDHAALIKQLQDKYISSRYWEVTPLNEVLRSVQEKVVEWDTAFADFEKNFFPSEKDIRRLATLQLKKIFLDKDSSVTSLTSSEEPPTTPTEAESGHDQMTEHPRPMRRMTLSPEKAQDVLVSVVEEDSSEKNAHEATLYKDEVPLPSSPSPEETETSIPPAAEPDEPEGSQSPESTAQSAMPEQVPPSTTPSASSLGTSGATSDAAESGKVSPEHPPTEQGDSQRQNLDTESQTPSSMLKQPTPSGIPRLAEGVVRRTGKATSPPLLRAQSQPLQGQRDRVKMSVPLRGFRVGAAGAGGLDNISSPTPESKFRPSDRKFSDRFGLTALRNSRLTPGPSLIPRSVPSRKNNTRVSNLAKHLEQFFYKPAAGSTSG

SEQ ID NO: 30159 - protein, 158 aa, A.fumigatus
IFPSHRWRSPNLRTRRTSRLSTARPPSSCSTRAPIAPSPRRSTLPSWDPPSFNPSSRTSPAPNPPKSAGRSSPPASPSPRTGTSAPPTPGAGSCTNVAPSSKPCGVLSASSASASSFSAVTATSSGPPASLTRCWITPARISSRTRREKASTSSASAR

SEQ ID NO: 30160 - protein, 332 aa, A.fumigatus
  UNSURE (14): Identity of amino acid sequences at the above locations are unknown.
FEKETPPHLIPAAXNQIFHYHVSVNLPIPPMAFAKPENTTYFSFIHGPASFFMLDTRTYRSEPAQVNSTILGSAQLQSLLAYLARPESAEVRWKIVASSVPFTKNWHVGTTDTWGGFLHERRTVFEAMWRAERELGVRVVLLSGDRHEFGATRFPDPMLDYTSEDLLAHTAGEGVHEFSVGPLNMFYLPIRTYRQTDTEDVAVKYVPDGNVKYGLVDISIQDEQIDTASGTPVTVPSSVLTYTLYVEDQVVWKYKLSVPLPEYDSMMAASSAKHPRLRPGKVLIDNRKAEGWHAAIQTMVGRLEEAARQFAHRAVDEFYELLDKTERAERLD

SEQ ID NO: 30161 - protein, 125 aa, A.fumigatus
QPSRMVRIACGSGTTVREVEDLLSQHRMMAGMAKRVGGQKKQMQRAQNMLKGGNKEQQLAAMQKRMAAMGGAGAGGLPGMGDMAKMMQMLQGQGGGGMPGFGGMDLQSMMSQMSGLMGGGRGRGR

SEQ ID NO: 30162 - protein, 152 aa, A.fumigatus
LVLMRMTRHAASTTSQADASKILAQQRLNRPVSPHLSIYRPQITWIGSSAHRITGIALSGSLYLFATAYLAAPLFGWHLESASIAAAFGALPIAAKVLIKGTAAFPFVYHCLNGVRHLVWDLGRGISNQQVIKSGWTVVGLTVVSALTLALL

SEQ ID NO: 30163 - protein, 61 aa, A.fumigatus
  UNSURE (11),(23): Identity of amino acid sequences at the above locations are unknown.
HKWACSSVVVXLALHLIKVQVLXLYMRNVRGSIPRESIFCHAYFCLGLFSTFFFVWFGAIW

SEQ ID NO: 30164 - protein, 133 aa, A.fumigatus
QECVGRTLSYPSKLPWEFTSENPIRSVFPLWPVYSLPMGLLKWFYVELEIGNPSPEVAYYSLRAVMFLLSFVLEDWAIYELVPLPRHRRAAVVLVASSYVTWTYQTHTFSNSLETLLVTWGLVLIRRIAGQKV

SEQ ID NO: 30165 - protein, 146 aa, A.fumigatus
DDISDDEMVRCCKNANIYDFIVSLPNGFDTLVGSKGNMLSGGQKQRLAIARALLRNPRILLLDEATSALDLESEKLVQAALDTAAHGRTTIAVAHRLSTVQKAGMICVFNHGRIIESGTHSELMQKRSAYFSLSASRLWAECDSSP

SEQ ID NO: 30166 - protein, 61 aa, A.fumigatus
TDDSTLLRRKCAFFLVLYFRHGLKIMADGIDSKRIEGQIKEAQEKAEKKRAEVRNSSKKLS

SEQ ID NO: 30167 - protein, 176 aa, A.fumigatus
FGRCSPFCHYRNYQHFVSPPTPLTLRDSIAKVIINLGRRIRKALWQTRRSSFRLSLMSISSYKPVCDPGSQHPKQFNQLHGIIASSNALPISSPDLEGFIDARQKLESQQQENKGVQAEFDKLDEDSRIYKIVGPVLLKQDKNEAVMAVNGRLDFIEKEMCVFPCLILPARVEDHG

SEQ ID NO: 30168 - protein, 61 aa, A.fumigatus
GKLETPAVGVSCGVEHLHTPLRCTSTLMEDSNINQHPTATFAVIANKQSRLDGCRSSYWLY

SEQ ID NO: 30169 - protein, 399 aa, A.fumigatus
  UNSURE (28): Identity of amino acid sequences at the above locations are unknown.
AISMVLSTPGILRGEIAGKSSNVAFAPXHIMEVHRAELESGHCDVIVTVMDGRCCPIVWPIYSANRVIADTHFWQDYFTEIRRLHYAHISEADRTLYCCPIIFDRNSQETPVLVRCADLLWGFAGLSTIYPGTCISIPTSVYSLPLSLAERIGGWDSDSTAIGEDMHMMLKCYFETAGNVITRPVYVPASQCNVASDTGRGWRRSLNTCRARYRQALRHMWGALDSGFAARRTISYIRSHCRCLFFRPRHLALIHLLWEAHFLPCHLIILMVFSTIYTLLTPPASLHPTMAWTFDLTNLLRASSFIGMNMCIFLYEPWHALCVRTRKTDMQQANVADAGFSERIWWSPAQLVERICFPIAGTVFGGIPTVHAVFSHFWTDRLVYRVTKKPTFSVAGAMA

SEQ ID NO: 30170 - protein, 152 aa, A.fumigatus
LILTRYHLNGWAPDDPLWAEQAGEYKKYLSAYQALAKELHICLVPGSIVERHETEADGKEGFNLYNTAYFISNDGSILGSYQKKNIWHPERPHLTSSGEAPHEVFDTPIGKVGLLICWDLAFPEAFRELIATGAEVVIIPTFCEWPVSLSVV

SEQ ID NO: 30171 - protein, 334 aa, A.fumigatus
MRLARMLRPLCGEDDPELKAAFLPSPLTSSFRPFQAAKEFTPYLYELNEAELERTEVSISRDQRRQKRSVNRRGGPALPDLKDRQRTIRTMLVSSVIPNTAASIEESNVFKRSGSSRHRRAAVGQRDGGEESDESDSDESSMTGSPAIGPHLAQGTARTRGMRGAASAAHAALRASLAHSATPEPHHEPRVSARRRDYREESIEEQEKLIVKLKISPEKFRQFLANRPQSLPNASVSTSTPAAQPVSQTGTPQVRTPTPSSMAPPSQPKPQVQVPNTAGHLPQRPVQQLGAVDATHPPQPGVPGVGTSFLLTLLYSVSFLALSRCPCLQFICVC

SEQ ID NO: 30172 - protein, 107 aa, A.fumigatus
PPPPAWLSAGLARLNRSHPNDSFEGVMRYTAVDTETMLPVANANSQPGHRLKYQYLPRIRCHDCPGKLYTPGPGMTVDNFEVHLRNRQHKERVEERLAKAAANGGSS

SEQ ID NO: 30173 - protein, 108 aa, A.fumigatus
GRAFVMRFLNAFERESKVRYTLNRHVCNLSKFYTLGRQVISNSIDKYISAASASHLAVHQSILFSACDMSDTYRSQIKLRLARERTFVMKASLRRIDSTALRLGLSIA

SEQ ID NO: 30174 - protein, 409 aa, A.fumigatus
SHIMSNDGFSSLKFRRTSSKLQKDPPSVSSRILRSQQSNTSLKRHPSAPVYPRSSVTGSREHSRTRSNAYGSSSSSLEQHSGGPSPVLAGGDSNNSFSSKSRPGRFSFNTDPSSDELTGSPFDSRGMLSALEENTAESEKSPPPQPPTLRSYHTSPDSRGLRQSASFTALQNRMDTFTQKSENDQSTNTKRHSDEANGTKVFGRSKKSSFSSFVNSMLGSPRGIKISAPENPVHVTHVGYDNQTGQFTGLPKEWQRLLQENGISKKEQEEHPQTMVDIMRFYEKNARGDDEVWHKFDHAYAHHQPTANTPGSQRNSPPTSPRFPQNHEGSFENPRAPPPIPRGAPAATQAMSPPIGGLVPSRAPRKPPAPANMIPARPAPHPPVARPPQDAYANPFSTPPIPEFRPFAL

SEQ ID NO: 30175 - protein, 69 aa, A.fumigatus
FERWKGEGGRLSKRQVMSRKTGLAASVTISAQRNYVKTINPMFPTTLIPYKRSIDAFSTFCHVKHLTNP

SEQ ID NO: 30176 - protein, 82 aa, A.fumigatus
  UNSURE (14): Identity of amino acid sequences at the above locations are unknown.
PPSIIFGPGTIEVXMDGLPEYLSRCKWRPLLSFLDVIDSKIAGQTYEGGISGSPGSEAHGAYAFCALACLCLLGRPEVVVPR

SEQ ID NO: 30177 - protein, 221 aa, A.fumigatus
RSAFTDHLSTVAECIRYMNIATLLPWLSARQYAPEGGFSGRTNKLVDGCYSHWVGNCWPLVQAALDGTQPLAGPKRSSVGNLYSREGLTRYILSCCQCKLGGLRDKPGKYVNSCAQTFEVEVQRLTVYRHPDSYHTCYALTGLSTVQYYHYCTDSSVSSKDDFSSAFSWKHDPNFASDGQGSDIGVFTENDRLVPFHPIFVIPHKSAEDIRVWFENQSFDL

SEQ ID NO: 30178 - protein, 194 aa, A.fumigatus
LSLLAFELCAHTAYSPSMRAPSGSLYHLQPRLDDILNDVAPFPYTLGAFIAFLSERQCLETVEFLLETKRYCRIYHWLEQRTETCEAVRKAHLCGLWNRLINQYIRPSAEREINIPCDIRQRLMQQFHLQEDDPPPPEILDQVVCNVKELLRGSILIPFLRRSSATARVQPLSMPCLNGSLVFYHRGSKEPRNG

SEQ ID NO: 30179 - protein, 182 aa, A.fumigatus
TWKWERFAGWTFRNAFIGWGDLASEEVPSTRDGTAGVFDSGQLFDVEISVLVRLSITVTIGRITVDNVHRGILGAATILSVVAGTILLLFTIFQCTPVDYYWNRLTKEGHCMDMDLLVGIVYMYSAAAAVCDFTIGLLPAFMIGRLKMDRHTKMAVIGVLSIGCVYVPAPDRTGWTLTFRQC

SEQ ID NO: 30180 - protein, 230 aa, A.fumigatus
IARSAGIAQKLKIGVVQTAYANGSSTEYIEKVLKLPSVCTNTGVKHLHHAAMRFDVGVYFEANGHGTITFSENALKTIKNTEPQSPAQQRSLECLQALTDLINQAVGDAISDMLLVEAILAHKGWTPKEWLATYTDLPSRLVRVEVADRSIFKAYDAERKLESPPGLQAKIDSLQSRYNKGRSFARASGTEDAVRVYAEAASRSEADDLATRVANAVRDAGTVKEILQAS

SEQ ID NO: 30181 - protein, 172 aa, A.fumigatus
DAVFFPAVEILLRSLGFGAIPLHGQLSQSARLGALGKFRSRSRDILVATDVAARGLDIPSVDVVLNFDLPTDSKTYVHRVGRTARAGKSGVAISFVTQYDVEIWLRIEGALGKKLKEYELEKDEVMVLAERVGEAQRQAIMEMKNFDEKRGTKAKKFGKGKRSRDEMDQEEG

SEQ ID NO: 30182 - protein, 162 aa, A.fumigatus
PRANARIVAPVEKTDVCAGIGGNILQAKVALRKAKPAGQFQLKPDSVLDLIGDLTVQDLPGVGYSLGAKLEELGVKLVKDVRGVSREKLINHLGPKTGLKIWEYARGIDRTEVGNEVLRKSVSAEVNWGIRFVNQTQAEDFVKSLCEELHRRLSDNLVKGNS

SEQ ID NO: 30183 - protein, 346 aa, A.fumigatus
PGQRQQLTLKVMRRAADAPLEPVKHLGHGKCDVFNRSVVLGIATNAPEVLAKEAISMLRSFGITPGDLRGLGVQMTKLEPLKLGATNKPEGSQQQLKFKASPARKSHEQVRDPDDLDSPRKADAAAVSHGPTLNDDSYKPLNISGTQFIMPSQADPKVIAELPSDIRSKLMSQGKGRQASRSTSPCPAARRTQTSTATALPPQSQLDPDTLAALPEDVRAEILGYYGRTSSTPEPQPAVSTVPSSRPASSGSLGIKKSSTPTKKRRGRPSTKGTGNMTLTQSNFIIARSTLTPVNTEEQASSRQPSPSPDPEISADFLAALPEDIRREVLEEQKRARKLQRSGLQL

SEQ ID NO: 30184 - protein, 73 aa, A.fumigatus
PEIVHLCIRRVARAEWALLNEEISVRECAYLRDANDVPQQVKDMFLRISFGADEVILEILFLILFMVTRTVVA

SEQ ID NO: 30185 - protein, 131 aa, A.fumigatus
LVAVHHLHLSDKHTLLQISLRSGEPIQREQLFEYTNGRFLVNEKHEMSKRYAKFDLDALCSLVSSLPSVSSPISKVEKMEGGFNKTLLMTAENRKGVLAKMPCPAVVPSRYSTASEVATFEYGKLCVTVPL

SEQ ID NO: 30186 - protein, 72 aa, A.fumigatus
NMTFLPVKSLTSMPVPEVLTWSCDALNPVGNEYIVMEKAKGRQLVEVWGEMDQAQKFKLIQTLSGWKASWPQ

SEQ ID NO: 30187 - protein, 261 aa, A.fumigatus
RGSFRPRGEDIADLAASVVYVPSEVLKTRLQLQGRYNNPYFNSGYNYRSTSDALRTIIRQEGFSALFYGYKATIFRDLPFSALQFAFYEQEHRLAKEWVGSRDIGLGLKILTAVTAGGMAGVITWPMDVVKTRIQTQQNPDAVKPSSASSKGPVEHASTKETLRQHTSNQTTSSLRTRSRPISTGGASTSVRPPGTPRLDTSSFFTGLKVIYQTEGFSGWFRGVGPRGVWTSIQSGTMLVMYQYLLKQLEAWQTTGETGPL

SEQ ID NO: 30188 - protein, 95 aa, A.fumigatus
SVRSYADYSNKDALAIALNKYLQDNQTILINVPELKEYWTRASSTSPARTSPVKKAVGVDVTPAPKKVAPAGRKATPGTTRRRQTQPKKEEVEVT

SEQ ID NO: 30189 - protein, 400 aa, A.fumigatus
  UNSURE (308): Identity of amino acid sequences at the above locations are unknown.
WSEHHQGFNSSIGTYHKIQSNIQSSQNRVRNLKHALEDAKAGLLYTKPELKGLATSSQKYDDLIQLLSQIQEIQSLPEKLESRISDKRFLGAVEVLHDAFRLLRRSELENIGALADIRAYFANQEISLTDILIEELHDHLYLKSPYCSNRWKPPAQEGEVGTANASSWTGVATWEKPVYAFLGKLDATTPLVEDASRNPEADTFYYIRLLIEALNKMGHLDIAVDRIEQRLPVELFAVVDKTNAEVDARHPNLGRGLSSRDGKTSLPTEAIEKRGHVLTEFLWTLYAKFEAIAEGHRVLHDATAGIVXREGIPKTVHLQVVSKSCGNSIKMKSVAPPRFGLNASQCSLSHSFYRFVPCCTITWPPMESPPLDLEKKKPMLNVKFMLVIGIGTRCVCLPHV

SEQ ID NO: 30190 - protein, 130 aa, A.fumigatus
HRASALLDSLRQVAAVMNDASEPHRAAYQETWDFLHDTISLWPLGGPRGGIISWPVHIGEDYIALLKQGDWIARILFLHYGVGMHLLSDKWYVSDWGRRLVAAVLQPLQDIPPIWAETITWIRQAVDLNS

SEQ ID NO: 30191 - protein, 70 aa, A.fumigatus
APALEPDQINQLIVIPGMYHSGIGGGGFMLVRAPNGSFEFIDFRETAPAAAFEEMFNNSTHASTIGGLAR

SEQ ID NO: 30192 - protein, 212 aa, A.fumigatus
DLLYPAELRRRTNVSLSGVPGELRGLEYLHKKYGSLPWSVLVQPAIKTAREGFPVGQDLVKYMKSAVGDGIDFLVENPTWALDFAPNGTRLGLGDTMTRRRYADTLETIANKGPAAFYSGPIAETMINALQAANGTMTMEDLRNYTVAIRNVSQIDYRGYQITSTSAPSSGTVALSILKILSTYDGFFAPGNVNLSTHRLDEAMRFGYGEVC

SEQ ID NO: 30193 - protein, 65 aa, A.fumigatus
PETKRTNLGDPLFVAGLDEFEENMLKQSTIDEIRRNISDYRTQNVSAYNPQGIESLNECEYRSSS

SEQ ID NO: 30194 - protein, 72 aa, A.fumigatus
MSANIVRLLEVLTDKPSSGTSHVVAADHHGLAISLVTTINTLFGSQLMVPETGIFINHELERTCCTGPPPFH

SEQ ID NO: 30195 - protein, 92 aa, A.fumigatus
FLFFSRVHFYILFLNNLFPLKDLFSDRLSLVISLLFILSLFWCCLCGAGHLVSSHLVPFGFVSIITSSLSHSLSGNNLSDIFVSSQSFQGVL

SEQ ID NO: 30196 - protein, 75 aa, A.fumigatus
PFHSAGQLSISLLQQDQRRPSSQYLYECSKVYVVPHGFFGSDLQLNITFCHTQPGTFFAYAYYRLCILGKSSSPF

SEQ ID NO: 30197 - protein, 61 aa, A.fumigatus
TSSVYRVPNGLNLFIYFQPYTIGARLSSRNAVHVMATPRASRKSSMALISVNLGHHIYICY

SEQ ID NO: 30198 - protein, 311 aa, A.fumigatus
WCIYDQEIFLPGVQLLWFCPLIYPQTMLQYKNGIYPILAHEIGEGLPVLIIHGWKMEARVEELDFEPIFSTIPGLRRIYVDLPGMGTTPAKNVKDLDDIYLRLVQFIDSRLGKSRFLLVGSSCGGYLARAIAQKYSNQVDGLLLRVPLIEPKDSMRDLDAFKPLVANEQLMSDMSAEDKTLLGDVLVQTPAYVKTLKAKYDEVYLPAEKKADSQVLDPIRADPHRYQLSFSVDNEGAKFFAPTLIICGRQDESVGYRDSLRLLELYPRSTYVVLDRGTHGLPIDETSVFEALVRDWINRVNEWRGRTDREV

SEQ ID NO: 30199 - protein, 63 aa, A.fumigatus
NLTFKDKLRIYILSIYRYTFNSCNILSSFRFSKIRDFPFLFYTNHLPRFTFTRLESIFIKVIY

SEQ ID NO: 30200 - protein, 182 aa, A.fumigatus
  UNSURE (2): Identity of amino acid sequences at the above locations are unknown.
RXVPTRKSPGVLFSNRFSVNAFALKALCLSSGCTLASLFQACWAVLLQCYVGSDDVLFGYIASNRGLPIRGIDRMVGLLISILPRRVRLSPSASSVSEQVRAIAKHIHEQLHDDLEHHMSAGNTMAEVIQRGRCIEELLFPFDTAINFRSQPSAAVNSVSSDPTSPLQFADGQDPMPVSHPP

SEQ ID NO: 30201 - protein, 190 aa, A.fumigatus
  UNSURE (160): Identity of amino acid sequences at the above locations are unknown.
SYFNPSISSCFSHFSVWIHSRQKVVSADRLTSPTSFRSLGKATQLTPNPRRAHQHPQCLPSRPIPERDRLRYLGPLTRQPSHRPHPAAPRPACPRPNRRSPIRRRGRRRKKPRPRCGEGAGATHGGRCRVCTPADTGTGGELSGECLGAGPGGDGAAGSXPERGGAGGLDEASGEFGGVSFYLSFIQPFS

SEQ ID NO: 30202 - protein, 133 aa, A.fumigatus
  UNSURE (114): Identity of amino acid sequences at the above locations are unknown.
LLIPAELINIHNAFHQGQYQNVIDFDTSALSPDNHLTARILQLRAQLALGQTAEVLSAVEGEEEKNPDLAAVKALAQLTAGDAESALQLTQELAENYPENASVQVLGGTVLQAXGRSEEALAVLTKHQGNLEA

SEQ ID NO: 30203 - protein, 152 aa, A.fumigatus
RSLGTVLLLSSNRNEPLGLRHQQRRTSASSLPNVIPGSRSSSRTTAPQPKKTADGRIVLNPQPDDSVNDPLNWPMWRRDAALLSLGFYCLMGGGMTPILAAGFNQVSESYGVSTQKVAYTTGLYMLGLGVGSVIMSPTAILWGKRPVYLLGA

SEQ ID NO: 30204 - protein, 86 aa, A.fumigatus
GHHGCLGWDPSDLQGQASGYVAISDLSRLTYSNDVAAAQLQPYVESIFQLLHIISQDMSRSEGLMRASMGVLGYGFSVSSFFLPIF

SEQ ID NO: 30205 - protein, 193 aa, A.fumigatus
GAQLVRHQRRERQPAPGRDTVRCYDPASGTDHSHATTGRQCRGSYHPRGDANLIDQCTPGKDSRCASAVYPLLTRWQAIVQRLETEIKPQADRIMHVMLQVLSTVPPKSSVPDVVFATVGAIASALEEEFVKYMESFTPFLYNALGNQEEPALCSMAIGLVSDIARALNEKVQPYCDAFMNYLLNNLRVRHQG

SEQ ID NO: 30206 - protein, 91 aa, A.fumigatus
EESLANIASQSATNQLKPAILETFGDIAQAIGTQFDVYLPVVAQVLQQASAVTASTDVTMEMLDYIVSLREGIMDAWGGILLTYKGKPQGT

SEQ ID NO: 30207 - protein, 168 aa, A.fumigatus
EAAYALGRVCDFCSETLDPDVHLQPLITCLFNGLASSPKIASSCCWALMNVADRFAGDVGAHTNPLSKHFQDSVKSLLTLTERQDADNQLRTAGYEVLNSFVTNAANDSLPLVATLSDVMIQRLEQTIPMQQQVVSVEDRITLEEMQTSLTSVLLVRIPDAPRRYIHC

SEQ ID NO: 30208 - protein, 65 aa, A.fumigatus
RPFSDLADTFPNGEFASFFRNDWVTALVRETRNNREYSARTIDTARWTREQVKRQVNMSTAAAMA

SEQ ID NO: 30209 - protein, 134 aa, A.fumigatus
LNVKESMKYASIRMKEIYDWNYKLIKFRVSDQVYVQLHCGYSLLTKQANHKLQLQNAGLFRVLECVGRLTYCIKLPSTWKIHLVLSVAHLEPAPATPNPFHHELPKPPAVVDAEVYPGEDNIYKVKHLLDKYTV

SEQ ID NO: 30210 - protein, 77 aa, A.fumigatus
LILLLTIRLKYSISYNPHLTVCFSVPILTPLGTYILTLIYYIKGLGVIVYHIQINNHHTNLLIPPIHIVIQPILFLS

SEQ ID NO: 30211 - protein, 88 aa, A.fumigatus
RRETVELFHFFLLKLIGAHLIFEPIAPSTHYPTSSIGQDTHESWLKCFKINAAYHKNLCNCYNSSWKNLAVLDIQKQQCYRWSMVHKT

SEQ ID NO: 30212 - protein, 185 aa, A.fumigatus
TELVSIFVEDCLTYLAERLEHLHCSLKTNTSIRDGDTILELLHLVLRLWRSLLTLVDITLNHDSGNGRLPSSDLGGNCIDHLGLVTVILLAVAVRRIDHDTRLEILRVSLDCGRDRRSVEVGAAVSSTVDNVKMRISFRVDDGCKTLFGDTCRQSAAVNGSPRTLLADLKMSEERRRSSSHRMRW

SEQ ID NO: 30213 - protein, 173 aa, A.fumigatus
  UNSURE (61),(99): Identity of amino acid sequences at the above locations are unknown.
GEEALFIASHAMVILPEDPFLKPMGNDRPETNCRWTCDSVVRAPTAPQEYRSARNCREMVXSTSQATGRPRTVMSNSNYGQPAANGSTDLPVSGMRRLXRYFQSHVDLVGGVDIRIVEKAFPAHRIPRFFKVGTHDDQKIIVPSVLLNGGLQADSVVACHVGIMYGAGPHDDQ

SEQ ID NO: 30214 - protein, 149 aa, A.fumigatus
LSAGVTEQGLAAIVHTKGNPHLHVIHRGGDSGPNFDAASVASTIKAYPKNLQPSIMIDASHGNSQKDYRNQPKVIDAVASQIAAGEPAITGVMIESNINEGKQAAPQSEDEVQKLKYGVSITDGCVGFETTVKMLETLSQVRETVLYKD

SEQ ID NO: 30215 - protein, 149 aa, A.fumigatus
  UNSURE (149): Identity of amino acid sequences at the above locations are unknown.
QDSSPHTRPHLLAGSIVPEPSSPLKDSNVAAYEPLIPPALLLHEIPVTPASRRTIESARQGAARIIQRNGDDRLLVIVGPCSIHDTDVARDYAVRLQAAIQEHGWDNDLLIVMRAYLEKPRNTVGWKGFLYYPNIDSTNQVNMGLKVPX

SEQ ID NO: 30216 - protein, 165 aa, A.fumigatus
  UNSURE (17): Identity of amino acid sequences at the above locations are unknown.
LLFDITVLGLPVACEVXDTISRQFLADLYSWGAVGARTTESQVHRQLVSGLSFPIGFKNGSSGNITIACDAMKSASSPHSFLGPLVKSAAIHLLLLTVCRCHRTRSCSHRPHERKSSSSRYPPWRRQRPQLRRCVCRVHNQGLPEESPTEYHDRCVARQQPKGLP

SEQ ID NO: 30217 - protein, 72 aa, A.fumigatus
MSWSPLLRNALRSQSRSTFIRVPQRTFSSSISQMAPFTLYTHAGKAFFPVDQEVFDEWLQAPDPTLSSGHWP

SEQ ID NO: 30218 - protein, 296 aa, A.fumigatus
LFDSVDRNKYQIMLPLPPKIDPSVTMMTVEDKPDVTYGDVGGCKEQIEKLREVVEMPLLSPERFVNLGIDPPKGALLYGPPGTGKTLCARAVANRTDATFIRVIGSELVQKYVGEGARMVRELFEMARTKKACIIFFDEIDAVGGARFDDGAGGDNEVQRTMLELITQLDGFDARGNIKVMFATNRPSTLDPALMRPGRIDRKIEFSLPDVEGRANILRIHAKSMSVERDIRWELISRLCPNATGAELRSVATEAGMFAIRARRKVATEKDFLAAVDKVIKGNLKFNSTATYMQYN

SEQ ID NO: 30219 - protein, 132 aa, A.fumigatus
HSSTQDIRRRSIRDRIKEARKTDQGQTSECKREDWRQGLLNLVLCYLRTLADFRQESDTGLAPPHIWDVAADRQRMAEEQPLQVARCTKIISDEKDPDKSKYVINVKQIAKFVVNLGERVSPTDIEEGMRVG

SEQ ID NO: 30220 - protein, 165 aa, A.fumigatus
HTLGMNAEDVGATFHIGKREFDLAVNTTRTHQGRIQGRRSVGCKHDLNVTTGIKTIQLCNQLKHSTLNLVVTTSSIIETSTADRVDFVKEDDARLLGTGHLKKFSNHSCTLTNVLLNQLATNNTDEGGVRPVSDCSSAEGLAGTGRTVQQRALGRIDTEVDESFR

SEQ ID NO: 30221 - protein, 72 aa, A.fumigatus
TNSLPITRMKVASVRLATARAQRVLPVPGGPYSSAPLGGSIPRLTNRSGDSKGISTTSLSFSICSLHPPTSP

SEQ ID NO: 30222 - protein, 79 aa, A.fumigatus
HDFGCPVVQALTPDTPEKPKQFLHIVSIMQVSSQFDLRLGDMATSFGLFGTTATISLGTNGKYIYSCPVVSICSPVTIS

SEQ ID NO: 30223 - protein, 461 aa, A.fumigatus
IPLDGNSRSQLGLKPGNVRRFIPGVSEVRSRLKSVTKSGVSIFEGYKEHVRDLWFPRTDPPHYLRIRESPSEGPYVKDLTEVTVRNYNELMKYMRKGDMSRTVASTKMNDTSSRSHAVFTITLKQIHHDLSTDETTERTARIRLVDLAGSERAKSTEATGQRLREGSNINKSLTTLGRVIAALADPRHGRSGKRKGKDVVPYRDSILTWLLKDSLGGNSKTAMIACISPSDYEETLSTLRYADQAKRIRTRARINQDQMSAAERDKQIAEMAETIRALQLSVSLAAANRRETEIQNERLEVYQQKVEKMQRLMEETKMVSECKIRQLQTENEALRNHLKLALDSLKNPIPLVTIEKRKSGLSAWGEHNGNTDDGINETRPQSPISDAGPEPDLIWEDDDTILIEASQVKAQEMQADMEDLLVDLNMFKRKLATDHERFRFIQKHETRRRRRALQVVLANNR

SEQ ID NO: 30224 - protein, 77 aa, A.fumigatus
MIAQRFIFGLQLPDLALTDHLGLFHKSLHLLYLLLVDFKSLVLNLGLPPVSSGQAYAELKGSDSFRHFCNLLITLRG

SEQ ID NO: 30225 - protein, 186 aa, A.fumigatus
SPLLTMSDNSAKRGTGEKSPNDPRKQADSRKSDPESQNSPSLANRIQNSAAGLAWSAFNAAGSSADAAQVFGSGSKAGPSSSASSSALAAAEQYRETATPTSSNRVLANHPAASFRSSSAGQQGAFELPPLTEDEFQCTYDESQVHDRIDFPPSTETETDTEKGKGKASEALSAVFTPELAGTRLC

SEQ ID NO: 30226 - protein, 221 aa, A.fumigatus
LHCLRYRVAAWDALPCFHVLDWDVRNPLCFGDSYTCADCRSWSLIMHWILAITNACNGLTYVTRFSCDIFGFYVAFIYLQKGIQVLTRQWVQVGEASAYLSIMVALLVLMSGWVCGQLGSSTLFQRYVRKFLEDYGTPLTIIFFTGFVHIGHMRDVEVATLPTSKAFFPTADRDWLVDFWNISVGDVFLAIPFALLLTILFYFDHNGGFSLSEGYHPNHSG

SEQ ID NO: 30227 - protein, 75 aa, A.fumigatus
GPSCLCFGGCCFCGLCCAAFGYCWCYWWVCSDSGGCAHDAHLYCAGPITVFNYTVYDIVSPRGTPYLAFMCWIGM

SEQ ID NO: 30228 - protein, 148 aa, A.fumigatus
SVQVYHCTPYKMQRNRRASHTSAREEDTVFSRSNLHPTTSHGSVHSSHSQRNSWQSRPPHARRGSGQSHSQRSQHQHGGVSHGQQGAEGLSGVQTGASSARTSRWWRVRLFRGMIKDIKRRAPFYWSDWTDAWDYRVIPATVYMYFAK

SEQ ID NO: 30229 - protein, 124 aa, A.fumigatus
GFFFCPGYCGVEENTDWCSILPALAFSLDMFEKTKQSYGVNEVLLASVLGAVVFAVFAAQPLVIVGVTGGFVPILGAVLMMLTCIAQVRLRCLITLFTISCRRVGRPTLLSCVGLGCKKPPLLW

SEQ ID NO: 30230 - protein, 89 aa, A.fumigatus
  UNSURE (48): Identity of amino acid sequences at the above locations are unknown.
WLTYCLVSSLIAQGTEFPLRKPAGFHWDIWLLGLTTFIAGILGLPFPXGLIPQAHFHTAAGCVTGALAAVLTTRKKGRKRRKEKRKKKK

SEQ ID NO: 30231 - protein, 204 aa, A.fumigatus
GGCQLRLVSNYIPGSRVENIYRDLNVAYEPSSGVGYLPCKLAGNNINITYTFSSPNITVMIDELLLDAGDLRFRDGARACIFGIVPAGDSTAVLGDTFLRSAYVVYDIANNEISIANTNFNSTEDNILEIGVGPDSVPSATQVSHPVTSVVADGSGARIGAPTGASSTTVPSISSAGALSAGVARADKQYLAIALIAVWFVLGL

SEQ ID NO: 30232 - protein, 143 aa, A.fumigatus
SIGSLQGGKGFTEEERILILERVRSNNAGSENRHFKWYQVREALCSYHFWFIFFLSMLSSVGSGAVTTFGSIIFNGMGFTVFQSLLLNMPIGALAFICILGSGYIGRKVPNSRLYVLSGACVPVILGSCLMYVSFNVDTGNIT

SEQ ID NO: 30233 - protein, 68 aa, A.fumigatus
VRWQLPSSQRAGRIIGFYLINFFSSAWVQCIAMGTSNVAGHTKKATMAAGTFVGYSLGNIIGPLTFDA

SEQ ID NO: 30234 - protein, 476 aa, A.fumigatus
  UNSURE (475): Identity of amino acid sequences at the above locations are unknown.
ATRKEKTPQKFCVAEQPSLVGQKDIFGIKATSAKPEKLSVIIPSSAPPGHLANHSTQPSLDHAVPVRHKPSPNSSHSKTASKVRAQAVEQGPREFASLRNTVNTQNLPPPTPINASASSPSTRYSGSPGIWSRTSTPTSLSSYSPGIIHSAKVGPRFRHPSPSESRLSIFSPIILKSDSQDDPLDSGGDGFPSITAGAGLHTLSMSTKTQSDNPPNRDGSAKPATPPENQLPTKSSTQSSLPRMTRSNLAENSEAYEEQSRGASGDRGNLKGSALKSEVSGSGHVPSRPSREGTHRLELEPSPVIRSNLPPGAVASHRRHGSGASSVALGRSHFASNACAATSVDSLQSRSSARPPSLIPSSPESMRKSPRTLLKEPKTKQDAMSPAKPRSYGLFSKKSKSEMEVQKLEDRHIRKGPAAGTGHEGYGRYAQRGRKGTVGSNSDTRARSTSTNRSTPRSASSLHYEAAESAAWCLXT

SEQ ID NO: 30235 - protein, 595 aa, A.fumigatus
LGDIGPKGGGGGTRPGGEFLREGAKKVSGSTEFHDGGCHLEPWSFSWAVSGALVEIQQDIPATERQSDSTQNLRMALLKSSERRISHIVSSSQMSMSNRSQLSLIASRQLDKRLEGNSTTDTSQLRDLRILYNHAGIPLPWNHSIYVRKCNRMFLLFPKRNMVMRQNLSMPCLLSTEPGHSRLVDRSEGFYAGKNFRHGEVGSHSAQKRPRALAYQMWSARMELQTSKCIRYNQSPLLGPPGSPESGLIGSFSSEHAALLDFIPRTFGRCIADPSDAASRAGCMKQHVDHDKGDMSQESAQDFEAEHRRYKPQLRIDNSSCRSAEVRDSGLQAAPPGAVQSSPRSDSAERPRSSDKTNKTKKLRKRHQSTARHVAHGEVHLRSLSTWEARLAHDLDRRLEWLFHQLSPGRRPFHFALLANHWLNRETWVVLDPISRVPIQARRLWGDPRFNSPYPIPRWGPRPKYPESPCKTANRPHLNSWRVAVNRNRRASGLQDIVKGLALLEDSADEPPDGKVDPASWILRRPPQGFARSITQQDKYFEGGAGWQETLGDWQRVRRGYRIRKAIYEGRTNRSRTKEIAVGLPRYFQAITNEP

SEQ ID NO: 30236 - protein, 262 aa, A.fumigatus
  UNSURE (79),(82): Identity of amino acid sequences at the above locations are unknown.
GNAFQTSFQPIPLPRVGLPSRGNIKQEFTLNTNKTVKSRKAQADLFPDNVSRILLYEPCSREGERSRTCLSTKGKGEHXLEXIHDFVFRLPVLEYRNKTWSNLDLALRLKKDVIKALISHAPAILGNKFSHHRPSKQQLKRYREVASPSQLLQNQDSASNAPSGKTQSLASYDSNSEHSESTSQRSVHSGTSPLARSQSLGSSMLSIQDQGIPFDSRSASEVDVDARWEVCLYTMSYKFRERLKANHHLSNLVGLSILPTDH

SEQ ID NO: 30237 - protein, 60 aa, A.fumigatus
TLLDQNFRWSHKDKEPSVFFDAKNVHRQLLTILIGDTPKFILYFHFVYFQTFTQSFRQRH

SEQ ID NO: 30238 - protein, 80 aa, A.fumigatus
DSSPQEDTDLVSVTIVVPFIHSPSFHRMHPTNTAAWQIAEKAKPLEVRPAAYTPPKENEIVVKNSAIGLVFTTGLEGAAP

SEQ ID NO: 30239 - protein, 211 aa, A.fumigatus
LFASTEVQLLFVCLIAYLSIVYIQRSRVLAVSTPTLSIMRFNAAITGALVSSATLMGQAHAEETEKKADATSLVEKPTFTVSNILSIQYSPPSLLVADDQLSISLLPSKLPSSSNLPPIGTRDGPPLTPRRRTPSRRRIGPTSVNGLSRSLPCSTAWLATRVWLSRTSRLTMPSLRSSPRRSTTRARPWLFSMRLSHRVGHISSWLWHGVY

SEQ ID NO: 30240 - protein, 269 aa, A.fumigatus
  UNSURE (232): Identity of amino acid sequences at the above locations are unknown.
VKVLYEFSLTILQVHFIFRHKNPKTGEYEEKHMTAPPAARTTKLTTLYTLIVKPDQSFQILIDGEAVKNGTLLEDFAPPVNPEKEIDDPKDKKPADWVDEAKIPDPEAKKPDDWDEDAPYEIVDEEATMPEDWLEDEPTSIPDPEAEKPEDWDDEEDGDWIPPTVPNPKCNEVSGCGPWTPPMKKNPAYKGKWTAPLIDNPAYKGIWKPCKIPNPAYFEDKTPSNFEPMGAXKFLDSCVCSWVLRSDKPTKLGFEILDHAKTNFFFENH

SEQ ID NO: 30241 - protein, 63 aa, A.fumigatus
VISAPGYGMECTDTCLQKDSLVCGGAYMKLLQENKKLHAEEFSNATPYVIMFGPDKCGATNKV

SEQ ID NO: 30242 - protein, 123 aa, A.fumigatus
PTTIEAPFLEQFTADWDSRWTPSHAKKEDSKSEEDWAYVGEWAVEEPTVLNGMVGDKGLVVKNVAAHHAISAKFPKKIDNKGKTLVVQYEVKPQSRSYQLLAMAWSVLTPVFKKTPLFAAVPT

SEQ ID NO: 30243 - protein, 118 aa, A.fumigatus
  UNSURE (59),(69): Identity of amino acid sequences at the above locations are unknown.
TSNCHQRQACSMAQEIEKTNNDHLVQSSDPEHPANLIPELCRKFYNWGWVTGTGGGVSXHVSGREKILXRASIEFIKLRSVPANHNFHWHLPEVPKRNWNPPGTNILCSLKFPQSPNY

SEQ ID NO: 30244 - protein, 169 aa, A.fumigatus
SIRCPSASSSTINLYQICLHNGLQPRPRHPRPRRLKPLRRAGHVLLQPGRHPGHRPRRRSQALASDDPPLPLGHPLRRRAARARRGRSSPQSIRAHRRTHGPRANPRDHPLRRRPGRLRQHHGRHEPLRQGRKPASHAGTGSLLPRAGDRDGGGARPDRGRGGRSRGHG

SEQ ID NO: 30245 - protein, 317 aa, A.fumigatus
RHISRAPRILCTNPFVAHLPLHLPSISTKFASTMASNRALAILDHAASNHYGVPAMCCYNLEGILATVRAAEAKRSPAMILLFPWAIHYADGLLVHAAAEAARKASVPIAVHMDHAQTPEIIRYAADLGGFDSIMVDMSHYDKEENLRLTRELVAYCHERGIATEAEPGRIEGGEDGVADTADLEGLLTTPEESREFADTGIDWLAPAFGNVHGEYGPRGIRLEYDRLKSIQEAVGDRVKLVLHGADPFTPEIFAQCIECGVSKVNLNKVLNNEYVRVQREKSGRAPLTAVLEEATNEMQKAVERCMDMLGSTGKAA

SEQ ID NO: 30246 - protein, 68 aa, A.fumigatus
IGIASNIKISKIGGYGAIGGYGAAHPQCGSGEGAYGTDIAVPRSSAVLRGQYVQVCRDSAFAPTAAED

SEQ ID NO: 30247 - protein, 71 aa, A.fumigatus
  UNSURE (17): Identity of amino acid sequences at the above locations are unknown.
TAVHGQVHPVPDTAGAXDAPCHLLHCLLAPEQQRGKIQASISEMATILKIRSEEEEGRTTDTSTVEAFDRS

SEQ ID NO: 30248 - protein, 76 aa, A.fumigatus
TGADHPQANFYLAFFFIAGSLSDERIDPFGHNMGKYIFFVLRYACILVMCLQFIISMGNRPQGLVSRLPNNGKACY

SEQ ID NO: 30249 - protein, 108 aa, A.fumigatus
HPQRAKKLYMSGIIVYSIIMVYTAFCALYLVVLKLMAEAGVGKKELAVNDSLFINIVGFLVSTVGLYFYSSVLYLDPGHNVTSFRAITLRWLPTYILHFCKVLLRFVN

SEQ ID NO: 30250 - protein, 543 aa, A.fumigatus
  UNSURE (26),(63): Identity of amino acid sequences at the above locations are unknown.
SAVEVPQYSSRPDSPLRPWSPARAAXWTRPPAPPSVTGSQYERADLNGSPRPGTPSSRYGGSXRRPLPPAPLFAGPGAATGQDTSIDIGDGNDPEDPFGGGGRTNNRHEHRGSIRSFMSDSTMITDEKEEMAKINLNEDDVVDVDPNMHYGPAPEKQSRRGVREAQMSKKEVQLINGELILECKIPTILHSFLPRRDDREFTHMRYTAVTCDPDDFTQRGYKLRQQIGSTMRETELFICVTMYNEDETHFTRTMHGIMRNISHFCSRSKSRTWGKDGWKKIVVCIIADGRKKVHPRTLNALAAMGVYQEGIAKNIVNQKQVTAHVYEYTTQVSLDSDLKFKGAEKGIMPCQVIFCLKEHNQKKLNSHRWFFNAFGRALQPNICILLDVGTKPEPTALYHLWKAFDQDSNVAGAAGEIKAGKGKNMMGLLNPLVASQNFEYKMSNILDKPLESVFGYITVLPGALSAYRFFALQNDADGNGPLNQYFKGETLHGKDADVFTANMYLAEDRILCWELVAKREERWVLKFVKSAVGETDVPGERCV

SEQ ID NO: 30251 - protein, 139 aa, A.fumigatus
LMASSDTIPEFISQRRRWLNGAFFAAVYSLVNVKQLWKTDHSVPRKILLQIEAFYQFLNLLFTYFGLVCKLVPLTEQVLTIRRQTSTWLSFSLQDLYRTRELTHLDITWENTSSLSCGTHASWSCACNSSFRWVIDHRG

SEQ ID NO: 30252 - protein, 88 aa, A.fumigatus
VQSGGSFDVDYSVVGPGEKVILDGTKERQGDFVFTAQSIGEYRFCFNNEMSTFAEKMVDFEIAVRSGPWHTQWLDLYQGTYHTNWGVL

SEQ ID NO: 30253 - protein, 127 aa, A.fumigatus
VENEERAQLPSRQGASPEQASALEESIYKLSAQLSTIARNQKYFRTRENRNFSTVRSTERRIFNFSVIEGLMMVSMAGLQVFIVRFFFQGARKGTYSLSYGGVKPGIVFDYCLSRSLIQVHVWLTPL

SEQ ID NO: 30254 - protein, 62 aa, A.fumigatus
TRVSTLLSKKQLTDLKIGSTVLLSMPFGSFARRLGIILDHHLFLRNNESDIPTALKENASHH

SEQ ID NO: 30255 - protein, 93 aa, A.fumigatus
NIDLDITDNSNSAVYVQGRDKFNNNGQSSHLGVKAFAFMWTSVALLFLSCVIYCMGGAVGRKDGGYSGREQRRRGFFNSHRSGSLRSNKETAP

SEQ ID NO: 30256 - protein, 104 aa, A.fumigatus
HTAIGVGLGFLGLFFTASALLLMFLAFLGGARNSNPLDRIYWLEAATGNIPGAPALSRWTYWNLCAVNSEGHNECGKSYPDYPFDPPSHRNFNTHVNIPAAFIG

SEQ ID NO: 30257 - protein, 63 aa, A.fumigatus
YNCNAQVAFFCGTCSKSSSRLCSDRLNNVVWAFDASFLALPSNFPNYFLPKYYVLQALRRVKR

SEQ ID NO: 30258 - protein, 119 aa, A.fumigatus
  UNSURE (4),(6): Identity of amino acid sequences at the above locations are unknown.
AQYXAXKNGGDVFVRVCEGVREIKVTKPEPKPKEEKPPKAEDDEDEDSDFDSDEDEEEEIREIVWKTEKPIAELAVKGVKAGSKVELMVHVNADLGMQITAREVGGQNAVRGAVESPKA

SEQ ID NO: 30259 - protein, 142 aa, A.fumigatus
THLTFDVSYSSFERLETHDYQISKMRILYFPLLASSFLVTRTLATDTISTNEVSTCLASSDVEVRELSVTYTRSTREVVFRIDGTSKKVQNVTASLTVTAYGNQVYSKDFDPCNSDNYVAQLCPGMYHHPAKAVNQYPLIHA

SEQ ID NO: 30260 - protein, 990 aa, A.fumigatus
  UNSURE (244),(952),(990): Identity of amino acid sequences at the above locations are unknown.
VRGPFQPRGEDCSLTSGSTGVPKGVVVPHRAVCCSIRAHSEAMNINTTSRSLQFASYTFDACICEIFSVLVAGGTVCIPSEEERVHDLAGFITRSQANWAFFTPTVIRTLGLSPSQVPSLRTLVLGGEVVTVHDARTWAGHVSLFNGYGPTETCVFCATTPIHPDGVTYGRIGRPIGCAAWVVRPDNHDILLPPGCPGELLIEGPIVSQGYLNDPVRTQEAFITHPAWAQNRKLSQNQSSARRXYKTGDLVRQSPDGTLVYMARLDSQVKINGQRLDLGEIRHQIHSVVSEDVQVFIDLLPPTCLPNEKALLVAFLASTRFEPEQTSGFSPPIKTLTSQLEQDLPRLLPRYMIPSVYLPLSAIPLTSGGKVDRQALRRRVSRMSMKELLVYTGEEQGTKLPVSTAEEQQMQMLWAEVLRIPPETIGASDHFFRLGADSIDGMKLVALAQRHGILITLADIFRSPRLSDLATLLESPAHPDDSKHDLKTIIPAFSLLNVHSRNTVLKEIKADYALDVSQIEDIYPCTPLQESLMAASIQSHGAYVHHLVEKLPPSGEVPAIISAWQSVIKMTPILRTRIVQTVSAGLLQVVLKESVQWLHRRQAIQEYLDEDARHSMTLGDPLLRLACLHDPGTPHTGHIVITIHHSIYDGWSLPHIRKLVYATQNGHPCSTSLPFNRFIHYLEQKSDSRASDSFWQSFLYRSQPLAFPPLPSTGYQPVGTDSVQLSVHWPSTFPPSAFTLSTFVRVAWALVLGSYSGTDDVIFGLSLSGRDTPIPGILDILGPTICTVPFRVKFSGESFGALLERAHADSAAMLPYQHIGLHHIRQLGPDCQLACDFQTLLVIQPARDPSDPEPHSELTFTSSGGLTYAFALICQPHPSGIELHGDFDSNCVSRPVAERLLSQMKSVMGTLIFGDRRKLAAEVDVIGISQKATLATWQREPLQPGEGRVEDXIISRAQQAPDDLAIHAWDGELTYNELVKEFATLARKSX

SEQ ID NO: 30261 - protein, 79 aa, A.fumigatus
SHSTYEFCARRKRITVAVKERYNNQIVSAGQLLSLTGEVKQNITRDVVSAADPASAYSRGGVDGHHLLLFGTTTLPCEN

SEQ ID NO: 30262 - protein, 112 aa, A.fumigatus
HFMLYCAVVIFSKSYCPYSKRAKTILLEKYNIVPAPHVVELDQHAMGQQLQSLLAKNTGRRTVPNVLVNGKSIGGGDDVTALDEKEELASTLKNLGGKWIQEFNRKGPNEAG

SEQ ID NO: 30263 - protein, 230 aa, A.fumigatus
LTSTIAFLASFLDVQPRTSWTRRGSAWKNSRWHSRKGTCLQVALVRQCSRFLVMGLTQSDHMETAVDYGLTFFVAKAGDSGEQGDGTDVASKDKSLRVVSKQHLSTGISVGMRMPSFKVLNQSDARPWHLQELLKSNARWRVIVFAGDLTNPENFDRYSQLGEKLSSPTSFLRRYTPRGQPIDSVIEVLTVHAGPRTSIELLDLPEIFHPYREKQGWDYRSSPRGWKDRV

SEQ ID NO: 30264 - protein, 67 aa, A.fumigatus
YANLFYLTLDKMTNLNQPEDHVDVLIVGAGPAGLMLANWMSRLGIKTRIVDKRSTKVGPFDLTWKTY

SEQ ID NO: 30265 - protein, 343 aa, A.fumigatus
YLVQVFSGQADGLQCRTLEIFDSFDFADRAWRESNHMLEICLWNPDKDGVIRRSDRIPDTIPGISRFQQVVLHQGRIERFFLDSIKEHSNITVERGVMPTSFEFDASKAADVDDYPITVTLRTLTEEEATPKQQQATNGAAVSDGLFRSNLSPDDTDDLLRAAELNSRANQTQVVKAKFMVGCDGAHSWVRRQLGFKLEGDSTDYIWGVLDIIPITDFPDIRMRCAIHSASAGSVMVIPRENKLVRLYIQLQSIVTGGGKADRSKITPDMILKSAQRILHPYKLDYSYCDWWTAYQIGQRVGDKFSLEERVFLAGDAVHTHSPKAGQGMNVSMQDSMSHVRSQ

SEQ ID NO: 30266 - protein, 100 aa, A.fumigatus
LTSDHSAYNLGWKLAHVIKGYSDRAILKTYQSERRRIAQDLINFDYRFSRLFSGRPAKDVMDEEGISMEEFKMAFQKGNMFASGIGKTMQPLPSNGAYSV

SEQ ID NO: 30267 - protein, 310 aa, A.fumigatus
PQVLNLKLKRIRRRGIRLVNRERHRIPRIDMSIPAQILRPIHLTIMHIRRNREAPGMHVQRPAGRQPQRRQLIQLQLPRPRGDAHANQHPRNPIVPHSRIRVELEIRRRKRAHPVTRHVQIIVLVHLVVAGGEVPRARGVVVAVVRVGLAQQAGEKVMQLPPAQPVAAQADRVDPLQLADPPRRAGGDLLVEHGVLVDVDGAPGQPVRRLPVDEPRLRGEQVAAAALHVPGVLVGDALVGRDERRPVLPPVVAGEGLARGCGSGELNAGELGANRSSVQSIHWSDSYCGIDARTYRSRWNVRPHICRYCV

SEQ ID NO: 30268 - protein, 106 aa, A.fumigatus
ERQTRFASALSNYKTSRQHGAKFIFLIHDLWGADGTQNSSAPYPGDNGDWTSWDNYLTHLLGDIKANRMTDGLIIDIWNEPDLSFFWNRDQTQYLQMWGRTFHRLR

SEQ ID NO: 30269 - protein, 272 aa, A.fumigatus
TAVSSELAGVELSGPASAGEPLPGNNWWKNWASFVATNKSIPDQYAWHMEGGGGDLLSAQAGLVYWQTTYGLPGRPININEYAVLDEEVPAGSAWWISQLERINAVGLRGNWLSGWKLHDFLASLLSKPNADNSNYDPTGTGYFPTGDYQVYKYYNLNMTGHRVGTLPSADLKLDAYAAVGDDRVARVLVGVRIATGTWQLQLNQLSALGLPTSGTLNVHTWGFPVASNVHYGQVDGPKDLGWYGHVYSGDSVTFPVYQTDTTSAYAFEFKI

SEQ ID NO: 30270 - protein, 80 aa, A.fumigatus
AVLSISSRTLLAGMQRLWALWESMDSMRIARYQVLAVSKDLTYSGVFPAGHSAEPKVKAYGLETFYTSQDRGVIRRWAFK

SEQ ID NO: 30271 - protein, 65 aa, A.fumigatus
NNNRHLSLRSTSFAGLTEPLLMLGVLLGRALHQLENALGGHAAFMGFVGIDGFHAHRQISGSRRV

SEQ ID NO: 30272 - protein, 187 aa, A.fumigatus
TRGVVDGGILGVFYYKGVVLRGPPLFKGRDMDANFWELSRGRKGHFLGQLGGPIFWKNFPVGSVSNSSPRTFYSPVIQFPSFQVLVQGGTRRFGARAGASDVKTHPFFRQTQWALIRHMKPPMIPHQSRGTDTANFRNVKESASVDIGGTSKPKGVPLGSGLATPHGEVADPFEEFNSVTLHHDGDF

SEQ ID NO: 30273 - protein, 111 aa, A.fumigatus
VSTSGRSENQNIQNPNISSLYPLRNRTTTPSQVDMFSFDDDPASAASRNCSSSSPITTENPLLRASNPLVSDLEQEVLDEYTRLLGNVNKVRRPSVYAYASSPMHEWPLAS

SEQ ID NO: 30274 - protein, 93 aa, A.fumigatus
LVPQAIALEYLRHGARVAVNHLGRPDEEPLLEAMLKDVGEITGSEGGRFITIAGDVSQPETGRDFVAKTVEAFGRLDIFVSNAGVCKFEEFLE

SEQ ID NO: 30275 - protein, 186 aa, A.fumigatus
AMLECASLRSSWSKSSCYTCLCCKPSVQLLTVQPGRVDPPLLGHTVNTNLCGAFYATQAAARQMALAQSPPGGSIIGISSISALVGGGQQTHYTPTKAGVLSLMQSTAVALGKYGIRCNALLPGTIRTQLNDEDMSDPVKRTYMEGRIPLGRLGQPPDLAGPAVFLACDELSGYVVSADPYPWLWL

SEQ ID NO: 30276 - protein, 79 aa, A.fumigatus
SQIAYSHPDIIRFGCNLSPEPLLLFISQPSSLKDILYNALPAIPREFIAASTYIANWPVRSKHDSLWTEYLENNIRPWL

SEQ ID NO: 30277 - protein, 88 aa, A.fumigatus
LEWAKVHLAPFGVKLYKNYDDMLKHEGLQAVVVASATAVHAEQTIKAIEANKHVLCEKPLSTSVEIVCFLYLLFFSVFMLLVAPATSS

SEQ ID NO: 30278 - protein, 249 aa, A.fumigatus
  UNSURE (62): Identity of amino acid sequences at the above locations are unknown.
RCQSQTVLDAATRKPELKVMCGFSRRFDASYRDAHKKMTQGSIGSPSVMRSQTCDKLDPTGXFVAYAEFSGGIFVDCSIHDIDLALWFFGQDSKVRSVSAVGITAVEPDLRKHNDRDNAVGLVEFYDGKIAYFYASRMMAAGQEDTTEIIGTQGKLTINAQPAMNHVNIFDSTGVRREIPQNYYDRFEHAFVAEANEFTAACLDNKDVPVKLEGAVQAVRIGCVLQESLITGQKIFFDEAGNRIDKPRL

SEQ ID NO: 30279 - protein, 88 aa, A.fumigatus
QPIRFDKYDINQRFEYVFSEEVNDFDADDYRRIKVTHSTGHIVPILHFTASNGLLILSVDKSELLVNLPNMKLLNYLSIPTVSQIQKV

SEQ ID NO: 30280 - protein, 137 aa, A.fumigatus
HSLYDRDVLRRHWTTCAKRLQSGQEIPKAESGGKHRHACDVCARLKKACNGLQPCAECESRGKLCSYERLTGGQPPRGKRRELMSVYSEQQDWETKDFGYQTLLPSKASMLEVQSQCRSITWGINRGPIATNSIRQV

SEQ ID NO: 30281 - protein, 271 aa, A.fumigatus
  UNSURE (222),(263): Identity of amino acid sequences at the above locations are unknown.
PDAMHLLRVVLPLLSLSPAGLAAPASPAAPTVTIASPAATIVGSSGKVEKFNAIPFAQPPTGPLRLKPPQPIQKPLGTIDGTGSAKSCPQFFFSTDNSEFPGSVAGLLANLPLFQTVTNAGEDCLTLNVARPSGTAPGAKLPVLVWIYGGGFELGATATYDATSLVASSIDLGMPIVFVAMNYRTGGFGFLPGKEILADGAANLGLLDQRLALQWVADNIAXFGGDPDKVTIWGESAGSISVFDHMILYDGDNTYKGEARVPXRHHEPRVA

SEQ ID NO: 30282 - protein, 151 aa, A.fumigatus
  UNSURE (8): Identity of amino acid sequences at the above locations are unknown.
PCLGRRQXPQCCPPPTAGPGVGPRAPGWPPHPPGSPSPAGSQIPPFDSSSRQRQLAYPGRSSLPLARSHRTWPWRPARSRRRRSTRGRAASRLELCRTDAPHSGSGNPLQHLSRSGRGEGWPRDRRRTPETRCCPSKKRTEDTTWRYPCRQ

SEQ ID NO: 30283 - protein, 72 aa, A.fumigatus
SDIINSHNHLDCLSCKFDGAGAHQKWLQDVLLCDVVAHTAATDTDTSIVLALSVAVSQLGDNLDRIQTSVLG

SEQ ID NO: 30284 - protein, 222 aa, A.fumigatus
QLGNMKGQSITAFIKGLKVILAQMEALPQSSCQKKAIKRAVTPLPTIDIDLGDDELFPCECSLQGINSLDVTYLSNPLRSSLKTKECGLDYIRRALDVLEPMSTCTRCTGKDHVRTFLYRFCRTILQRCRVFYQHLVRTYEGKDQQPLLLDDYQLATVEERAALLCMLTYVEIKRFHVCVGSIIETLGDQPMFDEDSWAVIKGQAYKLAVDTAELRFKSIHC

SEQ ID NO: 30285 - protein, 102 aa, A.fumigatus
GARELAGTEAICWKAFADAMEVIPTTLAEYAGLNSIKVVTELRHRHAQGQHNAGVSIRSGGVRDDITEENILQPLLVSTSAIELAAETVKMIMRIDDIALSR

SEQ ID NO: 30286 - protein, 112 aa, A.fumigatus
QSKLSQRRNNMRRNYLPIETLSSWAKLNGISLEGIAFQKLYSEHGTDKGSAIVATAEKKDEEGEANTLLTVPSDLALTLEYVHNHAKIDRHLREVLDAVGDFGRVCYRSRSL

SEQ ID NO: 30287 - protein, 179 aa, A.fumigatus
YVQTARGAILIFLIIQITHASPEFVNKRQKIGISNPWTEYIRFMPASVLLPTFYSAEERELLRGTSLQTAVDAKLGSLEKEFDHLRQATEEIPWCQEHWWDEDTGKFTFDDWKYVDAVYRSRVVDLPRSGHAIVPCVDMANHACEDSVKARYDEEGAGNAVLQLRTGKKLRVGEEVTIS

SEQ ID NO: 30288 - protein, 79 aa, A.fumigatus
FISCVKSPTGSPVPKRYLVIVMIDFEDISTTLPIPNSHYLQWGTHNIQSVTEKHEPAILDSSLTYIESFIGGVRVTTLG

SEQ ID NO: 30289 - protein, 131 aa, A.fumigatus
PPRDTPLTEEIQYTVPGTTLLQGLLSLLSTYIRDTHGNMDLANLSQLQTEAVNPRTAQIDQISTLEMCRLINEEDHCVAPSLTPCIRQIAAAIDALTPRVRNGGRVIYVGAGTSGRSGFLSNTYLAERMRN

SEQ ID NO: 30290 - protein, 172 aa, A.fumigatus
TFDACGEDHPGSASLPREPRWSTSQPTQTVWRLPAPPYRAPSPSQTASWPAWPAHSSATPSRPQSPGTSCTRRQGWPPRRGNSIARPSTSSKIPAKRRRRPHRRYTGKSDRWTARSACSRCPVYAPGPCADHTISGTHTPRPRWPCRSRRGTASPPVRGSGGSPAAYRGSGR

SEQ ID NO: 30291 - protein, 140 aa, A.fumigatus
STKRIIASPLVSHHASARLPPPLMRSLHACETADESSTSVQGQVEGQDSCPTRISPKGCVTDLDDRLGILDASEIPPTFAAPPSQFVGLIAGGDALFDEHKKGPKTVFPRGKPHIATFEAQSPTGKRPPVSPASGRYPLI

SEQ ID NO: 30292 - protein, 78 aa, A.fumigatus
ECQSGSYRTCLWRMQISYPTSSGLESYSDLPQDISYALAMYVIYELTKHRRRDRLPIGLLTPHFGRKGQGHPGLIMAR

SEQ ID NO: 30293 - protein, 490 aa, A.fumigatus
CRRGVGRSLPTAVTAISDLHTLMVPDLADQLHLFLLPRGMVSFNCFSPSLTLVADVQCSLRLGRLRTGRPDSCCQRDSSPARGNSCYGFVHRRTNLRPCRTSSVLADRRMDLLLILGKSIMLQPYEPVPPAMTNTDSVDTANGAFVIAAGAILGVGASFLWVAQGAIMTTYVPESQKGRAIAAFWIIFNLGGGVGSLASFGLNYHSHSGTVTDGTYIALLIIMAIGWLLGSLICPPASVRVQRLQPTAETEKNWRRTAQLTAQTMNDWRVLCMIPMFFCANVFYSYQQNIVNGMTFNIRTRSLNGSLYWIAQMLGGLVIGLILDMPRVNRQNRARVGWLFLFATGMAIWGGGYAFQKWYDRRMAQGHKQDIDYTQSGLSTGPIFLYIFYGAYDAFWQGFCYWLMGARSNSPAVAAILVGAYKTFQATGGAMAWRLNALAKPAMTQFAMDWGLCMGALVVAIPSVLAVTLTSEVHEEVRQTQDGLHHRRRR

SEQ ID NO: 30294 - protein, 81 aa, A.fumigatus
RWLQMYNALSGLGGSGQVDPTVAANATVALLAATAATALFIVGPIFDRVGPRVCLLIGGWTYSLYSGSLLCFNRMNPFPLQ

SEQ ID NO: 30295 - protein, 203 aa, A.fumigatus
  UNSURE (2),(5): Identity of amino acid sequences at the above locations are unknown.
RXVVXQTKSGQRSLVGFGVLIYQMLLQQSPFRGEDEDEIYDAILADEPLYPIHMPRDSVSILQKLLTREPELRLGSGPTDAQEVMSHAFFRNINWDDIYHKRVPPPFLPTISSPTDTSNFDQEFTSVTPVLTPVQSGKLSPVGIGGFKANDVISSSLPSDAGGIPRLLVHRGLRLGYSVLIENYRDIAFVAHSPNQVLGTFAF

SEQ ID NO: 30296 - protein, 123 aa, A.fumigatus
QLGVLCPRRGRVEDGHNVLVSTTLAVESLFPCKDRYLPDYSESSLSSRLEAISAYDADTTLIPQQTSHYEYGAESIAPWSETNVSNTLPQTHTTTTGDTVTKPAKQARKMAEYTAGARIRRKR

SEQ ID NO: 30297 - protein, 108 aa, A.fumigatus
LSPDQKLRIFHKSKILPLESQDSTLLVSTVGRFTAANLGNLQIEFPSVLLPNSITSGSIVDITVSRNHAAEAASTSAFQALQKRILNTYRVKTLPLLSSGSATQQKTS

SEQ ID NO: 30298 - protein, 66 aa, A.fumigatus
DCLRVIAHVELTCAFDKLPLYSLSGHHAKVKVRFWGLPRSSGHRLLAHQYSVEAKSQKTANTNGER

SEQ ID NO: 30299 - protein, 75 aa, A.fumigatus
  UNSURE (3): Identity of amino acid sequences at the above locations are unknown.
KCXATAEWKPCSSTAKNERDPSEGNLRKKVRINQGEISPLSLGDYQKQKGQLTPKLPCQPSQKFPGPTANARTTP

SEQ ID NO: 30300 - protein, 155 aa, A.fumigatus
  UNSURE (94),(106),(116): Identity of amino acid sequences at the above locations are unknown.
RVASMPKNKGKVSCRYYSVSLPESTPLAKVFHCHFVVSACLAALHERGHHGIENDRKILDFDIATDFLIFSYWMLTFVLQGGKNRRRGKNENDXEKRELVFQEKSXEYAQVLKMLXNGRMEAMFFDREKRTGPIRRQPEEKGPDQPGRNLPPLPG

SEQ ID NO: 30301 - protein, 93 aa, A.fumigatus
YPRAENGNLDRLPHHVRDRSSCLGVHRPDRIRILGVVLQSISANYGMFLAARFLIGFGVAIAHGASPLLITELVHTQHRAIFTTIYNSKDRLP

SEQ ID NO: 30302 - protein, 274 aa, A.fumigatus
PAIATWYLGAIVAAWLTFGTNNIDSNWSWRAPTVVQAAPSILQIVFVWFVPESPRFLIYKGKDEQALKVLADCHANGNQQDEVVQLEMQEIKETIRLEKEFESSSWMELVRTKGNRHRLIICITAGFFSQWSGNGLVSYYIAKILTSIGYTSSVQQNLINGCLQILNMIVALTMCFFVDKIGRRKLFLVSTAGMLVAFVVWTICSARYAIAGNHNAANAVIAMIYLYYVFYNIAWSGLLVGYTVEILPYSIRAKGMTVMWLCIDLACKWFRRRV

SEQ ID NO: 30303 - protein, 70 aa, A.fumigatus
RSAVFFNQYINPIALENLGWKYYIFYCVWLGVELTVVWFFYIETRNTPLEEIAKSLRSSLTGAGRPRAYV

SEQ ID NO: 30304 - protein, 94 aa, A.fumigatus
  UNSURE (39),(64),(85),(87): Identity of amino acid sequences at the above locations are unknown.
TSPRSGSLGLPHRSGDNHRPAGHGAAGPDRTRPGHAGQXHGGGARDLRATRVPGGVPGPRALHXGQGPHRSDCASACCSYCRKCXPXAIAAELR

SEQ ID NO: 30305 - protein, 190 aa, A.fumigatus
  UNSURE (136),(160),(182),(183): Identity of amino acid sequences at the above locations are unknown.
MHTDTDVDRTEHQMATRKCRGEDALDPEQPSLPPSEANEHLVEIPGVQRSLISLTGRAFERALLWRLDWYNLMYAPPTRPPTSSHLVEQCTAIDVYRRVLALVASGYRTEAVTIIGQQVMAPRGLIGLGQDTLDSXTAEVREIFELLVFPAAYPVLVHCXQGKDRTGLIVLLLAAPTAGSVXXMPSPRNY

SEQ ID NO: 30306 - protein, 60 aa, A.fumigatus
YKMEILKLAFASPEINPVNHKARSIPVLNPVDRYGRVFFFSWFGFMVAFLSWYAFPPLVS

SEQ ID NO: 30307 - protein, 61 aa, A.fumigatus
RMGKMADLIDCPMVNSQSPGEFPALTNFGWVSPAQAIWTRSGSPPGDNGLKYAQSLTFTSG

SEQ ID NO: 30308 - protein, 75 aa, A.fumigatus
  UNSURE (67): Identity of amino acid sequences at the above locations are unknown.
SDHAVILACSLMFFARQAFAQAIKTSYPNHLRLSIHESVAGTKLSISLLNTKTGFTTPWHCSVARPXSPRCQGPR

SEQ ID NO: 30309 - protein, 136 aa, A.fumigatus
RFRSQLEAPSQCSTMHHSDRMFHKEAGISHLILDIILEHALNKFDPAPDRLQGAAKNFLPIIERFVAAGTRIEACLPAFPFKSANKVYKVLGSLPDKAEELALDRLNTMCARVREVYPPGLQVAIISDGITYNGRF

SEQ ID NO: 30310 - protein, 158 aa, A.fumigatus
LGSIRIIANQSSRAPLDLLCISDQDTWAYGEALRQMAAQKQFMYIVFSRIKDLLDIPLPEQMSEIVYVANCTTFRRLLLNKYERADLDIDHEIASNPDTKLTYLGYRRFLESDLKYIFPRGAHRSAHSYKRDCKYLAKQMLIRGDVGEATMQLSWLAL

SEQ ID NO: 30311 - protein, 278 aa, A.fumigatus
AQTVAAIRYYLVWDQCPRLMSKGKLEQVSAACHHLGFFNNAGLSAHYKLSESSSPAVADLRGLVYAAAGDLLRKHRILFAIPVNEGTPNPHFACLPWIDLRRSIAFLERSVPLASAAEEQDKELDAILEEQHNIDFQTDYGTLPFWRLIILRSKGRNDFTASFIYHHAIGDGVSGLAFHKAFCNALEAASSSTLPPDRAENIIRPDENTVVLPPLEELHPMPISPRQPPLPTASPKEWTGASIHLPCKSRWASLYISPSASNAFVQECKEMKLSVTSA

SEQ ID NO: 30312 - protein, 605 aa, A.fumigatus
KWKTQEVLQDPGAEWLLGKEELRAFRAKAVIWERDPHISRHRDNASWRPAPQFATPVVNGDRAAGVNTASQGTDYDGSEESFQQAQTEPASQISAIENLVANDMCLPSPSLSPVAALNAMNVDSSFESAEDQEMDTDSSLDNNASRLSNVRHLDDSKTHNLSPSRSGNLPGASEIRHASSLMDIPSVLDFFDSVPEELKTYLMYQFLRRCPKPTLHFVADVVNPALKCDFLALLPLELSLNIVKYFDVQTMCRAAQVSKKWRHIINSDEKTWKDLFDRDGYVLTDGELERAIKEGWGWQFPHGDDDWEKDLSSSAVIKPEPDCAPGPAFSSLPGESGERALSVSRRPKRKATRISGRKFAKRKISSSNTDSSDSSGWRNGVTATEGPYAAANAAAAAVPYPEIGLPSLRGLHLFKSLYQRHHSIHKGWMKPNVKPKHIAFRAHDRHVVTCLQFDTDKVLTGSDDTNINVYDTKTGALRATLEGHEGGVWALEYHGNTLVSGSTDRSVRVWDIERARCTQIFHGHTSTVRCLQIVLPVQVGTSADGTPEMMPKEPIIITGSRDSSLRVWKLPKPGDPVYYQSGPHADDTDCPYFIRVLTGHQHSVF

SEQ ID NO: 30313 - protein, 272 aa, A.fumigatus
ILCLSTHSPGLRPWQTTMSKMAELEIIDSKGLPLIKGDYCPAGPGHLRAPCPVLNSLANHGIIARSGRNITAAELKAALRYLGMGIDVITILVNGAFKVHSDDPKKGALLGLRDKDQTNEDGVPVLNLDQVGRPHAVEHDVSVTRQDRALGDCMRVNADLLERFLAAPKTERGFSASAFGKYRKTRYNEQKRDNPALEFDRFNHFSGCAELGAVQCIFGRGFPYRVPEEYIRVLFGEERLPIEEGWKPRRLPLLLPELAPVILRISHFASPF

SEQ ID NO: 30314 - protein, 188 aa, A.fumigatus
SLRDARCPPTVPATMFTPVLRRLASMKSRIPLISGLHLNFISVHYIYIIAMTLITSIILYPGGDLAYIDILFFCSGAATQSGLNTVDFNKLKTYQQVILYFSSMLTTPDFYPLRPRLHPAVLVRETVSTHRAGNLSDALYQGREMPTLRSEKEPTFFWKGREACIGLSPKCGAGPTNPQEFNEKGPKA

SEQ ID NO: 30315 - protein, 217 aa, A.fumigatus
  UNSURE (93): Identity of amino acid sequences at the above locations are unknown.
QWSSLAQFTACPPKTLNGRITLNFYFSRDQMVLYQLGDCYNVDNYVSVHYVQTLRNITRFRCSLSPSSSTIRRNTPFFSCMRARGEANSTTLXASSTRIRSKSATVLIRCAITSIVVDPCPKPERIDFWITLSVAVSTADVASSSTRILGAVSMARARQSSCRWPCERFDPPSATRVSRGDMCVFSCKDSGDDDCQLGALAAVSLSVEDVLPYCANH

SEQ ID NO: 30316 - protein, 417 aa, A.fumigatus
  UNSURE (1),(377): Identity of amino acid sequences at the above locations are unknown.
XKLLSSSLSGLWTIRSYQRVDSFINRMHGLIDRHARVYWNLCLLNHWLNLRVSMSGALFTTAAAMTFTLLQDLKASSTGFAISFIIQLSAALAMAIRMYVMFDLDMNCVERVLEYSEIKTERYDGQDAPAAWPSKGRLQVENLSVAYAPNHPLVLRGVSFAAEPNERIGIVGRTGAGKSSLALALFRFLEAQEGRILIDDVDISQIKLHHLRPRMGIIPQDPTLFAGTIRSNLDPFHEHDDSDLLAVLDRVQWLAQYGSTSSTERETAAKAPSWQSSSPESLQEKTHMSPLDTRVAEGGSNLSQGQRQLLCLARAMLTAPKILVLDEATSAVDTATDKVIQKSIRSGFGQGSTTMLVIAHRISTVADFDRILVLDAXKVVEFASPRALMQLKNGVFRRMVEEDGESEHLKRVIFRNV

SEQ ID NO: 30317 - protein, 154 aa, A.fumigatus
GDATIKCFGRTGCKLRERAPLSLNLLRSESAVRTCFRFTIISQRTTTTKTKHSMAPPAVTALQHLSNALATPEQLSSSSSSIDGVTPDLEASLRFAGAQLTHAAGILLRLSQDIIAQAIVTYTRFWIGPEGGSMRIYSVKVCPLRFNCCILVAN

SEQ ID NO: 30318 - protein, 253 aa, A.fumigatus
LAILIYLPLRSLSSKPLVENISIMDINSLLSPDSNPQSGRSTPGNGSMSANNAPAATSRPSNKPLRKGRTTPARPTMTSSPLAHHVYAPSHLNDPSPPATSSPSVGPNIGGGNGTPPSVDLPPSRQASTPGMDTLADLASMQHHQPQRSNTSILRGTESYESQLSPSTMYPHVNPISHNTPTPRTSFDIAMSEGPREGAARRNYADTSLRPDAQRMATELFAQIQDNPHIYEAHVNFIRLLHEGFVNHVYPPN

SEQ ID NO: 30319 - protein, 95 aa, A.fumigatus
KKDKARITALFCCNADGSEKLLPWFIDTAKNPRAFQAAGVNIRNLNLIWRSNQKAWITTLIFTDFLRWFDKQMSGRNVVLLIDNFSAHQATVTEI

SEQ ID NO: 30320 - protein, 226 aa, A.fumigatus
SSGYPLQNTLIIWLPANSTSRYQPLDQGIIHCWKLYWKQYWIRFILQEFELNYDLIILMNILRAVRWGIQSWEFELSGQVIQNCFQKALDSQPSYQEPVNPAVLDDIQNAFSLLKLSTPIQDLIDIDTFLNPAEEAIQDTHEDIKSQILAQYGPELDDDSEEELEILPQISLDQALEALRTLCLYEEQQAEGIPSLIYELDKHERILWGRKLSLQTQRDIRSYFTG

SEQ ID NO: 30321 - protein, 534 aa, A.fumigatus
FTRILHPWACTIDPSATVADACVSYVTIDSLNDQIYSLLQSITQETDFFSYYRLNLFNKQCPFWDDANSMCGNIACSVNTIESEEDIPLTWRAEELSKLEGPKAGHPGRKLQKERPSDKPLQGELGANVGESCVVEYDDECDERDYCVPEDEGASGKGDYVSLVDNPERFTGYAGPGAHMVWDTIYRENCFLKSPPEMALSPHPSLGGLQAVNDFRNVLQKEMKRSEQLPFDNECLEKRVFHRVISGMHASITTHLCWDYLNKTTGQWHPNLQCFKERLHDHPERISNLYFNYALVSRAVAKLRKHLQNYTFCISDPLQDRETKEKVSQLTAILADRPQIFDENIMFQDPSAPGLKEEFRNRFRNVSRLMDCVGCDKCRLWGKLQVNGYGTALKVLFDYDETKNGENPPLRRTELVALINTLGRISHSLAAVRSFHRAMDLGQGQTFAIMAGTPMLKQHPGGRKAKVLYKDGGSTFYYEDDEDDFKYATERLPWERRPYKESDTAWDSFTAEFEVVWNTFVYVLKSWWNLPKTL

SEQ ID NO: 30322 - protein, 374 aa, A.fumigatus
LALSLQPRGEDTLPMDLDAEGRRLFDFYVNEMPACSYGNHFRSPKAHNWYTAVFVPEGMKGPVAFQNTILVHAANTWAWVRNQEETKMTLVHRNRAISMLREHLAANPGDISDVAIIACLSAAGLEDFDPRPGRKQISWIHMRAAREMIRARGGPAAFENTRLGMLINWQDYILSGYETHGPSFFFEPNPPIQSDLTEASLPTSSCLSTDFEGVPSTARPFSPRDELQHQCNEFIDFLKRCEQLALHQQTHTNPAIAPMRHTAFQPTSLLYQILAAPPGVRFTASGNRKQFVARFVALIMLNAGLWDYRASVAHSESFLHTLEQAVLESEVNMSGSVEALLQIMLECNDGTPTPSTSPNLPSAFVLDEREPAAP

SEQ ID NO: 30323 - protein, 69 aa, A.fumigatus
EHVSGSHVQDGQRCGSHLLKGVQQKIHEQSDKTRVEYFDVDLPSNFILFHIGTPDQVNTGIKTGLKEKI

SEQ ID NO: 30324 - protein, 269 aa, A.fumigatus
LRGPFQPRGEDITRFEDAKPKSMKQVLTSLVKLLAQSRQEPSCQLIQVGLVDAILPSIILGEPRAPLKAFLVSLEIITRKNAILPHELISMLQVWLSKNSEKWIPILQEDCKALSMDVGVLLLSDEDSCNTKRVESRGLAVQILLLGLLNQAKNPELASSAGDTIAAFFQKLKSDLGLAEDNRALLSVWIPPVRYMVLQNLDNLEPMSNYVLQPLFHNDPSGFRSFLDSLPLKNVLAGDMADAALPELTVLFASLQVAKKAGLVDEDCE

SEQ ID NO: 30325 - protein, 319 aa, A.fumigatus
IRLLRTNCSLDGPSKQGTGMKLSLPGEIIGQFLFHREFSIRIAALSLLIAAPATTKPLSSTAIRAILRGLPSMHAESDSYSRGEIISLLRKLIVRLKGGILENQDGPVQEELSTNKTQQAKSGRSDSETRACVSTYIGFLKTDMRPTASYPRHIMALKTLNLFLQSGLDPRVNLVRRANMEEDKVRWKVNIEVFDPSLIRLLVDLLLDPFEEVRATSLTILNMAPRDMLLGGLLQSADRSSAMPLRLIDALTKAEQLASNTSRADHADTVARLYHIIFYATAETHSGGGSQWWETKKGVVDLLLTKLEGKSSPRGGRTA

SEQ ID NO: 30326 - protein, 82 aa, A.fumigatus
VRHQARYGLQSASGSGSAGPNAMLFLAGNTQPWLDWLQQLISGHPTPIDLKQITTCQKKYPDEARAVKVGVNRAVNPWTRPA

SEQ ID NO: 30327 - protein, 113 aa, A.fumigatus
KISCFSSNPIPSVPTFALFPHFQGELYFGLVMVIRVYHPPLESLSLSLLPLVLFHPPAFFVSQVPSALNIPYSNLSLLVLLLILYSLTSPVVKSFLLVSSRLYFLLLLSHPDF

SEQ ID NO: 30328 - protein, 191 aa, A.fumigatus
SDPFLIASHQAHPPTMSDPNTTAVRPVPRVGFATIILGLIVLGILRWAYACYKGNQKYKLPARVPGIPILGNSLQVPAVQQGPWAKDLAAKYGEMYVGVPFPSLPSREDVELKHKRNRFTCQFGGSTWVFLNSSRVVKDLLEKRAAIYNSRPPFPMTQDNISRGGRIVLMPYGERWRLVRRVMHQILSVTN

SEQ ID NO: 30329 - protein, 283 aa, A.fumigatus
  UNSURE (280): Identity of amino acid sequences at the above locations are unknown.
GLQARGRQTGTTNPRRYAAKMLRGEFLASKEITQMDEVTKLFVFGSLMEAGSDTSRVTLGQIIAGAITYPDWVTRAREQLDRVCGAHAERLPGWDDRPRLPYITAVVKEGFRWRPNIAEIGAPTVLIKDDEYQGSRFPKGTVFTWNAWAIALSPDEYEQPQRFWPDRFLNEDLENALKGHGAFGPGMVLPNHCRKQLHFPVNQMTGRRVCAGWKVRKTNVWIAIARLLYCFDFHPVPGQPIDTMRIPQLAGNATSFAARVSVPSPAHAELIRRKCAQAVXTHY

SEQ ID NO: 30330 - protein, 541 aa, A.fumigatus
NRFSPITVASGLTLGLRSIGNGPSAMILSFILHGHLPYYSINRPHPDPLLHAKLKDNPDLLDADVAALTEHFQASRLSYSTQALPVNVLLDTLVRPSIDVDVGDGETRVEWRYVPEKAVPHLVFGNAPKAGGQWNDNLVFASWDIQTLSYASMLSLPGYSFAEHYRKVNGKDLPAFTRPTRREIMDYFSAYPEAVGIDDSFHNNQSLSGVTRTANGFFISSHNIHCKHLVLASGIFSEVLQPLPMLQPLRFLQPTPEIPLLVIGSGFSAADIIISAPTHQKILHIFKWDPEGHPSPLRSCHQHAYPEYAGVYRLMKRAALAAEPAAAKRLGKPRRTTSSPFLESRAWDTVYEGLPNAEVIAVNMQSEAAVVTFRLPDGSTVERTVRGLVYATGRRGSLGYLDRPLLSDVLGCPDGAEPSPIISGETLRAKALEDLEVADDVFIIGSLTGDSLIRFAYGSCVQTAGRLIRAHTGDDKSECKTPTSSRPQSSSLRVMNGMEGHEIYHNGDYYQELEKIDSEATTRPPSSLESLWSRMMRFWRS

SEQ ID NO: 30331 - protein, 260 aa, A.fumigatus
  UNSURE (251),(256): Identity of amino acid sequences at the above locations are unknown.
LTSVQFIAVFLGYVAVSGVAIHRYAKYKGLNGDGIYDSSNSFSLDTNTLILFIFVLCVALAFSYAYFLGARYFSKLFIWVTGILNIVFALATGIYYIARKQYGGGIVFLLFGVFAIICFISWIPRIPFSAFMLQTSIDVSRKYGHMFIVSTIGGLVAVAFAAWFSVTLVSIYVAYEPSSSGSNPSCSDGGCSRARVIGLVVYVTFAMYWFSEWLKNTIHTTIAGVYGSWYFWSQSPIGMPRGSTRVHSRAXFTQAXDTYH

SEQ ID NO: 30332 - protein, 125 aa, A.fumigatus
IDLLSFLYFHRSPLLPSVTTWLFVPLQRYTIMSGQLRSYYNPSQSYGDFQPGMQNPQQQPDYYNNNVSNHGYDPNFQRGPEPKPPTEPPPTYNQAVYGFDDAFKIERPKYHDIWAGLLVSGCTLS

SEQ ID NO: 30333 - protein, 77 aa, A.fumigatus
LHQALEVSFTVVGAAMLRMYLDDEIGMKALYPRPETSQTNLLPAILKPCNTCDMLTAVLERGTDSLVRYVFDAGFLY

SEQ ID NO: 30334 - protein, 572 aa, A.fumigatus
AAANPRSDWGLDSRRVDSVDFLFELVPFQIFFPSIRIIRFVSHILYEKGWEAQSTLAVAKTDPFSPIYLGWRPVQSAPGSDVCEPQAALHYPPSVSGSAPECTCPFRQQPEQIGEGTPNDTLLDWLQEAVGAFQTSSHASTCSESGDLPSSIVEEKPLQPTTNRFHIMMSNQPTFSGKPGEDVDLYIDQCRFMWAGVSLDPEEKKQAIATTLFVGLREAALRFGRTLPKTERKDWEKLAQHLRARFPEQEPSDRIQDAIMRLSELRQGTKSLRGYIDEVQELTMSIPDDWGQSVGSMFARGLSDPMTRKVLNAYIQAQKAMSKTVKIEELIRMARACEDEATVVEEVTASRSRDEMFADALNNQSQLIGTLAEQLSRINLSQGQSQQSSISRQQQQWQNAGQRVCFKCGQTGHIAPICTNPPLPAEEQQRIRQETMGQGQGQLQSQGRYRQPQTNRSASETNRPIQPQGGAFGLESRRRVDPTTSTTSAAITGVESNNIARVRFVDSESEEVAEWNAIDRVNAVLLSSLSPIDVHIPQSSNALVELQRVYAAGDEDAGGKRAKVDTTSDSQL

SEQ ID NO: 30335 - protein, 83 aa, A.fumigatus
RIARLRDVDIYWGQGAEKHCVNSIDGIPFSHFFTFAVHKPDTCNVIRFYSRNSCRSCAGGWVHSTPGLQSKCSPLRLNWSIRL

SEQ ID NO: 30336 - protein, 162 aa, A.fumigatus
CTQCFLSRVQRYSWREDCIRVSLRTTLRSIQFTDVCMHVSSIELISLFSFLSCLPTSSIHIVSLKMESECQCEGGNKDFPAGSVMRKFENAIFPIAGSLYRMKKILWERYNTDYHQRRAVFEAEECKTKDPVVVKFFLECVICSLPYASLLANFVDIGQTHS

SEQ ID NO: 30337 - protein, 74 aa, A.fumigatus
PKLHPVCLSSNTYSSQSKYNIHTPLTLPSDSAIPSSNTSSLACCSGNFTASHSCRCSSVKYPLTTSSRSNGPPI

SEQ ID NO: 30338 - protein, 91 aa, A.fumigatus
LRRHRADPFMREEERGKRTMKDDAANLFHNECEIWRTLSDTGYTPKYYGKREMHQDLAFENPGAYLWILAFGTLSGPLILADTPSIWWKGG

SEQ ID NO: 30339 - protein, 66 aa, A.fumigatus
KAEDAAGDETAVSTTEVSAKNGVDSSALSDAVGGESSAPTNTANPDQSNNNDSIVPLTNGVAGDAS

SEQ ID NO: 30340 - protein, 390 aa, A.fumigatus
CLFFIAIHTIKEIYRSSSIAHADVNPPAQSYFVRWVNVKPDHTISWSIQPHKKSLNFGIFKHPGHSGVLSSTNHPAGDYHSTDSSENLPSAAAAAGSRTSVIEKLTSIGLKQVRWIGKCEADKIVKGTYDVPHNEGGNYALVFDNTFSKQISKTVTLVLLTYPTHSGPTNHSTTQLAREVEFAENANATARNRGNSILSKAPSQAVSTTSGTTHTGLLHKRRRKRHQGWARRYFSLDFTSSTLSYYHDRNSSALRGSIPLSLAAVACNEKSREISIDSGTEVWHLRASNDQDFIAWKRALEKASSKASAEDSHAPEVLLRVPSQRFLTNAAEEREWMQVEHLVSKVSGSRDAVRRLARDTDPKYLNNSSALTPYERPRGSLPQSPPGNQL

SEQ ID NO: 30341 - protein, 70 aa, A.fumigatus
AIYNNITRYYITKQYEILNLTIFRFIKDKERGLTRLKLDKYTYSSPRLIVCLGVFRILTILTDFTKLQDY

SEQ ID NO: 30342 - protein, 198 aa, A.fumigatus
EKAFHRPAFLLLVSHHQSTTATNPLPRMCALVTYYPREPLDETCEKETNPPACLLPPSTTSTSTSSCYASLSLLPIQIHLAGHQNPSFWDDYSAHPSRTRHRCHLFFYPESEPGFAEHPSSTYDWLSSRLAWSRAMDCLKRGFGWPGGSWKTPDVETIWEEYWRTLLFNAGRHSDPDGYAARFMKMMIGSGDPSSLFS

SEQ ID NO: 30343 - protein, 598 aa, A.fumigatus
YLHDGLDIHMLAGCCSSAFQPHIHIKMSRTVELGSQPTAMAGCPSEQQRLVSETNQALQLATQYSKVQRRPGGNWRGQTGINSIATTAEHIFMHQALGSNLDTDRDAFISWFYSVQNSDGSWGISPGDRGDLSVTVEAYLALRILGVSRNVHQMRRSQSFILAEGSIANVCFITRIHLAMFGLYPWNAVRSLPPELVLLPQYILSSICCWPAVDLTVLIPLLILCHHRPIFPLPIQDCAASSYLHELQCKPQEPQENAFCAFPPGTCGDTAPASTSTDLIVHLLNLLKYILPLRRYALDRSVAFILQTVREMGGVGPLSRPLHMAIVALELEGYSVSSRSLRTTLDNIGHFVYEDGGGKRVLSVNTTFRDSSRMITGLQDAGIAVNAPWFRTSVQWLQRCLLPDVNSDTSKTFETRVCHVDDVASAIHAVIRQDPLMLRSHLVANALQWLLKRQNADGGWTSLSSSHYRTSPDKLVRQSTPDVTGHVLETFGLLLTVSRRDTRAVAQGILVDQVASASRRAIHYLSATQQPCGAWFGCCTRYHIYATSAVLRALAYFIGVKERNRWTERDDSINDDVSQAIHWLESARNRDGGWGDIC

SEQ ID NO: 30344 - protein, 111 aa, A.fumigatus
FASTTVGSFQPRGEDDPVSRKEVAQSECRFGPAYAPNTTFHEVVGEFVDIKYADGEILSGVIGTENVTLAGITVNQTIGVMDYAGWYGDGVTSGLMGLAYSSLWVLSVPLL

SEQ ID NO: 30345 - protein, 131 aa, A.fumigatus
STDGVYSASAYTTNNRQPRLYNPIFATMYEQGLIDPIFSMVMNRNASNGTAAGYLTLGGLPPVDINGNFSTTPILITNIKGYPKDYDFYAVNIDGVALGNRSLPEAAGGIQYIVRMYRGSFWIWARLIITD

SEQ ID NO: 30346 - protein, 67 aa, A.fumigatus
YPLYGHCVCIFTMHRITNFVIVEITPIGIQNIGWKFWIVWTITNAACLPIIYYLYPETGEWSSKLPI

SEQ ID NO: 30347 - protein, 206 aa, A.fumigatus
QCTGINIMSYYLPLVLINSVGLSNSMSRLLSACNATSYFVFACVAVIMVERFGRRGLMLMSTFGQFACFLIITILLRFAENDPKYGTASVAFFFLYYIAFGIGMMGVPWLYPTEINSLRMRTKGAAVSSATNWYDSILFMVIAFVYSRCTGSQILSLSKSHLLGYRTLVGNSGSCGQSPTRLVFRLYTICTRRPVSGVRSYLFERS

SEQ ID NO: 30348 - protein, 71 aa, A.fumigatus
QSLANRTLEDLDAYYRSNPPLIVTGDPDAISTGRPLKYIQHEDEELQRQIKQRQATGEEGKIGSATVQHVG

SEQ ID NO: 30349 - protein, 99 aa, A.fumigatus
NKVSIANGFNTSNSSCLAKLRLPPSSGEESWSFWRMALNVSGFALVNWINYGLSSKGGALAWRLPIALQFFFIFILYATVPWLPESPRLAAPDAPHAHS

SEQ ID NO: 30350 - protein, 79 aa, A.fumigatus
HQVERLEMIKIARNGGSITPRYQKIFKHHAARNRVSIHTRTVIRSKEFCPSSQTWRLTTDPPIPDLPPIDYIYCATGMK

SEQ ID NO: 30351 - protein, 60 aa, A.fumigatus
SFWTVNRFESTVDGMSSDKACCSDGWEERLCRLLMVNISLSYLLMKQITYLSILSISLRA

SEQ ID NO: 30352 - protein, 80 aa, A.fumigatus
ALALLQSIDISLYVVAAVVIYYFAGDGVTSPALGSAGPLISKAAYGIALPTVGILIPRRFSSPLARDQKLTLEDRHRRCN

SEQ ID NO: 30353 - protein, 479 aa, A.fumigatus
SLLLARLCPTRTARFLRTSTPKVGPAHEMQGASRQQENQLLHRTVPMLPNATMPIIPTKNGPDEKPPWSEMKTKAGKERKRLPLACIACRRKKIRCSGEKPACKHCSRSRIPCVYKVTTRKAAPRTDYMAMLDKRLKRMEDRVIKTIPKDEPRDMAAIGRSVVRPPQPGQASKTQKKRSADEAFASEMEEWAHEDRRAPQDIFPMRREGKSNDATGLLTEGAEFLPSLEIQEHLAEVFFDCVYGQSYLLLHKPSFMRRLKARTVPPVLILAVCAVSARFSTHPQLSSDPPFLRGENWANPAAAIALSRHDEPSITILTVFLLLGLHEFGTCHGGRSWSFGGQALRMAYALQLHRELDYDPLLSQGSGNGAQLSFTDREIRRRTMWACFLMDRYNSSGSQRPPIGNEKFLQIQLPIKESSFQLEIPGPTEELDRNVPNPVPDDVGQLSNAKDNMGVSAYIIRAVVIWGRIVDYLNLGGKK

SEQ ID NO: 30354 - protein, 60 aa, A.fumigatus
FLPTKIEIIDYATPYYHSSNDIGRHAHVILGIRQLTDIIRNGVWNVPIQFLRWARYLQLK

SEQ ID NO: 30355 - protein, 575 aa, A.fumigatus
ERHSDIDINFLNYVFRNMAREGDSNGTLAMPRLDEILRHPEDLDKIAGLKAEYSRKKGTVDSQLREGLRHQLETVQRSINALTEGQRQVTKTRDELQTIDKLCAESQTSVDDFSRIDKLAKVQRNFEATLMMKKGLENFSIDLAEVEELLRQDDEDLENQPNLLRVHMQISRLRDFRDEAMDQIRKAQDPSSEAALTDYFQGLDSVIDWFDEHLGTACMNLIPLVQSDNRSMVVRLGVIVMTEEKNDATVRALQEAQKDHQDLAGRFKSMNIGPKTVRGYKEKLLQAIELYAENQFRETKEAFLGDPENLDKSFKWYFNDLFSVQQGMQALLPKRWKIYKTYTNIYHRMMHDFLIDLINDPDLPADNLLAILHWSEKYYKKMKKLGWKQSELQPNILDDREPELIRQWQNIIIKAVEEWMERITETDRKGLVERIPDSLDTNAEGYFRTKTLPDMWRMLHEQIVASGASSRTDVVEGIIDAMFRVLKSRQTNWQMLIDEECGKYKAQGGDQLEGLQLLQDWLIAVANDQIACIDDNDESGQLGYLSKFKRDFEPSVDPSLHHGARRIRAKDPRMR

SEQ ID NO: 30356 - protein, 105 aa, A.fumigatus
DKFPRDHCYTSYPSTASTTEDKQTEANWSQLPNTQKPTTEQKTHIPVDMSYFRVTLLRSAIGLPRRTTDVLKALGLKKRMATVFHPVSPSVGGQILHCQARRKSA

SEQ ID NO: 30357 - protein, 729 aa, A.fumigatus
FSSEGLPLAVTLALAFATTRMVKENNLVRVLRACETMGNATVVCSDKTGTLTQNKMTVVAGTFGAQESFGQDRKEDAEPPSDSTTVAEIFKQCSTAVRDLIIKSIALNSTAFEEEKEGSREFVGSKTEVAMLQMARDYLGMDVTTERGSAEIVQLIPFDSARKCMGVVYREPTAGYRLLVKGAAEIMVGACSSKVSDLSASSDGVMVDLFTETDRQKMLDTIESYAMKSLRTIGLVYRDFPSWPPKDAHRVEDDPSAAKFEDVFRDMTWLGVVGIQDPLRPEVPVAIQKCRIAGVQVKMVTGDNLATATAIAQSCGIKTEDGIVMEGPKFRQLSDQEMDEVIPRLQVFARSSPEDKRILVARLKKLGETVAVTGDGTNDGPALKTADVGFSMGIAGTEVAKEASSIILLDDNFKSIVTAIAWGRAVNDAVSKFLQFQITVNITAVILTFVSSLYRSDNTSVLSAVQLLWVNLIMDTFAALALATDPPTEQILHRKPVPKSASLFTVTMWKMIIGQAIYQLAITFMLYFAGDKLLGSRLGTDKRQLKLDTIVFNTFVWMQIFNEFNNRRLDNKLNIFEGMFRNYWFLGINCIMVGGQVMIIYVGGAAFNVTRLDAVQWGICIVCAIACLPWAVILRLTPDRPVEIIINFVVLVVGTTLRPIGKAVSAISRIVSSMMWPVKRVSRRVLRRNAEDDSTTDKEEVPMTDVEKQHTPKAPATPVVVPPITITSS

SEQ ID NO: 30358 - protein, 241 aa, A.fumigatus
KSGMEIRVSVLEYVTTRIQALRAQQQKLRAATATATAASETPSQQQAQIDGKQANANAAADAASPAPSTDTEHMPTTLVPGSYENISAIRSNTMKFFPNFFARHQLSKIFICFPDPHFKARKHKARIISETLNAEYAYALRPGGLLYTITDVEEYHHWILRHFGVELGAEEESEEKSTSPNANANAGVRELFERVSEEELEKDECVRVMKEATEEGKKVARNKGNKYVAVFRRKTDPEWPA

SEQ ID NO: 30359 - protein, 107 aa, A.fumigatus
PFDSNTPFVEKDGFAWCLQCHSRRTAPRCLGCKKPVLEDIVVSAVGGQWHNECFVCHECGNGFGPDGRYFVREGEPKRTSKGRIIGGPVQLAVCERCESIRLKASPK

SEQ ID NO: 30360 - protein, 112 aa, A.fumigatus
DERALGSSRTSTKAKPAAPKEEDEPPVETTSKGASLLSKMGWSAGSGLGAQGTGMTAPIATEVYAQGVGLGAQGSKLGDAVEEAGRNTRNRYDEFLEKTRQTARERYERLGK

SEQ ID NO: 30361 - protein, 253 aa, A.fumigatus
LYRFLNTTVLKSLPSSCAKFISLCIRRHKIITVNFTYPSQPLTTPPKTPQLNTMLLSFFNRGPSPSPTTDSKKTSPAQSQQGSIPGSTEPQTQPQPQAQQTQSQPQRPLTNLKLLFGGVTFFALSLLITRRAFTKRVIASIPPYWTSSVYHRPPVNGAGDAFEALSLATLNVCSFAMMATGGVLYALDINSVEDMRRYVKKGMGTGTVRDEEVEREVEEWVAKVLGEKFGVELKKEKEKEKEKEAGNVEGKGE

SEQ ID NO: 30362 - protein, 127 aa, A.fumigatus
DPLNQNPFDFTDSLTRLSSSLFLLLAPSLSHCAYAGIKLSPSTSPTRVNHSPLHQKHLSSTPCCSLSSTGAPAQAQPQTQRRHLQHNPNKGPSRDQPSPKRNHNHKHNKRSRNHKGPSQTSNSSSAA

SEQ ID NO: 30363 - protein, 630 aa, A.fumigatus
VKTRREINAMRTNYTLSCRCIETILHKSQPAMDKSELDPEKGFLCYSVLYWPEHVRLSQTEFAIREEFKDFFQIQLETWGRWLDYYSYLKGSSYRELCPGLAPIHVAAHWGILPLISFLLPASLEDKDSRGQTPLLIAAQAVQIEAMRFLVERGSYVNSVNNCHENALQITCQNSQYNNCAMTKFLLDRGTSPYVCDKENMTPFLYAIGHQKEDLARVFLQNGFYVDFRIRRRCWTGRMVNNSISYEVDHSPEQHSNLGVQSGLTALHFSALNASAKMATLLLQYGADPNARSDTGDTPLHLAIRPKLLEHKYHDPWISGEYAAESLRDLITDYESEAYDVYESIDRYRVHIIEVLLSSDSVDVNLANDQGDYPQHVIPFERDYASSILCKLVAKGADSSRLNGAGQSCLHLASKAGNLEVVRKLVNGGHDILMPDIDGLSPFHYALRGRYLQVVRFMSTACESLLSKTWRSLDHFGKNPLHHHVSSIFCSAEMIDFLVQCGCNVNDVDREGNSALSLYMSSSHLYIDREIFQLLLDKGADPLCVNHHKENLAHLFMHYREEGIGILQILLKCGVDLAARDLEGRTVMHHGAIPGCVRPTPPRFSSRARGFGPQISWIFKIRSPSNNQRN

SEQ ID NO: 30364 - protein, 223 aa, A.fumigatus
VLVGWMAWIILTNYKQSILSHLPEHVDSETAKIFVLIYAPGLKHAPNQGGSSNPTLSVTSSYSNIAPEEARSPGETLSGDLSTLEPRPADEQEGASPFFRTLYTQAQAIVDKENTIMPFSTATGYVHLVRHLSPDIVYVQESLTGKQGDAVQHISGWVRQVVVVVGDEGGRGGLIDSEDESVLAEKGEKWWQKEGMTGIGKRIDVVDVHRTGEDWRRRVSGHD

SEQ ID NO: 30365 - protein, 75 aa, A.fumigatus
  UNSURE (42): Identity of amino acid sequences at the above locations are unknown.
MSLILYLRSASTQYDIWEAPDYPPEVQEQRHSRSMLSRSNPXNHHTVLHISTRQGKEFEIDSTVISVQTESSGNF

SEQ ID NO: 30366 - protein, 517 aa, A.fumigatus
APVNERATGTRSGFWDIPGNNERDIEDDFLNKFKRHQSRYIVRQSKRLGPRREFRLLGQGAAPQNNHAHKGESQVDDVFGDDEDDESGFFSEIQKRTSAEGPPPITRKSTSQVIDSINAVSDSMFSKQLPAAAELNNSLAVPTADGEIKNFPSEEDLAARWQAELSDDADETMPTEDDLAARWQAELDDDDDDLLLDDDTTNAQRPPEAANIDHMNDTSMLQSPFGTPENLARPKVQPVSYTPHQPSTSDLLSGIPAQNTAAQPTNASMSSYFSAQAPPNPVTTRAESFAERSKEGYKSPYDIPEDLARPRRAVANSRTVVAQPGTVPKPPPRSSSIPAPPLKASTVSPAPLGTSSTAPTAPQKNFFEELPLPPPRPKSRPASSGRYTPNAPVSAPSLPQSIPPPANQYSNVPGAPQSNIGPPDPPQLQQPERLDPYSNLLAPNVPSAPAVPSTASRYSPRPPGVQAGVKPPPSPRYSPAPPQSTNAVAAASYKWLCLTTREFLRARSWFSISNHAQ

SEQ ID NO: 30367 - protein, 65 aa, A.fumigatus
SVIHMIYIGSLWWSLCIRRIIIQEQVVIIIIEFRLPPGSQIIFGGHSFVSIIRKFRLPSCGKIFF

SEQ ID NO: 30368 - protein, 306 aa, A.fumigatus
KEICLKMENEGKFGGKNTEFKARGENALIQVPDRLDRVRLWRLNQVREMGAIPGIPEYQEWARARNFSIKRGGLRACGYTLSPRPAAFPSFSTGRCTTNPSDDPARARKAAKHHSICPLAIQSGRSRRTRTHPAPREDTTTGRRRGRHRTRSGGGGGSRRSSDASFPDLRRRRRLWTSAESRSALLSPRKLRIASPKRWTHALGFLFLPIVRAQPSRSPVIHPLLPRRRRSSATGNPARSNVLRPAPRGSKRTSARARAESLRLQSPGPAPSSISTSDPAYVAPAPDWRLFQLLLRTNPAAHSTEL

SEQ ID NO: 30369 - protein, 323 aa, A.fumigatus
TKLEKWGRSPVSRNIRNGQELATFRSKGGAYELAGTPCPRGRQLFLRSPPAGAQPTPPMTQPAPGKQPNTTQFAPLPYNPAAPAAPEPIQHREKTPPPVDAADGTGLAAAAAADHGAPVTPPSQISGGGGGYGPPPSHALPYSPPGSYASPPPSAGLTHSGSFSSQSSVHSPPGVPSYTPSFLAGGGPVPPGIQPGVMSFAPPPVDPNAHLHAHGQSLYGSNPQVQPQVQSQPQIQPTSPPPPIGGYSNYSYEPTPQPTAPNYDYAVHKQLYRPTEAEANSHAQKYAQKAMQNPGQRSRKFEDGASRVESSVNRFLKKLEKRL

SEQ ID NO: 30370 - protein, 117 aa, A.fumigatus
SACPSIPAGVRPNPYLTLSAMIAAGIDGMRSQQPLRGGDCVTSASELSPGERQALGINTILPKSLDESLNDLEKGLGLRELCGHMIIITYLMVKRTEAKILRQMAEDDRRNWLIARY

SEQ ID NO: 30371 - protein, 457 aa, A.fumigatus
CQCSRISSSAASAGLISINSKFIRSRSFSILKLTVVEALCLIWYTTSATTNTSSKSILNALPKPITLTIVQFAFVSIWCLLLAYLSAVFPWLKSSVPALRNGIRYPSRDVIVTALPLAIFQLAGHILSSMATSQIPVSLVHTIKGLSPLFTVLAYRVFFRIRYAKATYLSLVPLTLGVMLACSTGFSTNFFGILCALLAALVFVSQNIFSKKLFNEASRAESEPQASGRKKLDKLNLLCYCSGLAFILTLPIWFISEGYRLISDLMQDGVISLSEKDNSLDHGALFIEFVFNGISHFAQNILAFVLLSMISPVSYSVASLVKRVFVIVVAIVWFGSSTTSLQAFGIALTFVGLYLYDRNSHDDVADRRANADHFRTKETILPLSVQTKKTWDSNGYAFPPSRTGETHSMDNSAVLAANSKKEDDAFDHVRPRGSSTSRTWLPPGTKQESTWQPGDAQ

SEQ ID NO: 30372 - protein, 157 aa, A.fumigatus
WSTDSVSVLKERPRRMTGLVRLRRRRCVRLAWRVVSPTLPATPLTVRQRHDMLTPTALVKENATPSPRRMATGSASATTGCTTPHQTAWSSATASSSSAVTRNAPPAAPSTPPTRPTSRMCTGMWRRARTRGSGSTMRRTERTLGALPPLLTRVSSC

SEQ ID NO: 30373 - protein, 254 aa, A.fumigatus
TRMSRRTARRTIMRSTRTRTSRRRTGGMSRRWCRGMRARRRCLRGSWPTSPDARAVIPMCCTNGSSRRASTSRSWISGIWFALAMVCSSSPADFLRPSPLTTTLTKCVEGFGLDLLSDGSYPFTYVEGSNFTRNLAIPTIDFGTFHLYPDSWGTSHEWGDLWVQSHGAACTAAGKPCLFEEYGVTSDHCALETPWQKTSLNTTGLSGDLYWQYGDTLSTGPSPNDGNTIYYGTDEFQCIVKDHVAAIKAKQGWV

SEQ ID NO: 30374 - protein, 91 aa, A.fumigatus
RASASTSSPTAATPSPTSKAATSRATSPSPPSTLEPSTCTRTAGAPPTNGAISGYNRTALHARPPASPVCLRSTALPPTTARSRRPGRRPH

SEQ ID NO: 30375 - protein, 199 aa, A.fumigatus
  UNSURE (27): Identity of amino acid sequences at the above locations are unknown.
HKTSHPALVEQSITMKTLALTLAALLXQAPPLQAKMYRQNILTFEVSNDARINGQKIEYNDPDCDQGMQCVVTKTCAAQGTGPTLSADKKHFACCLAGQRLLGSPETAFDCCADGHDLAGSAQTGYHCCPTGYSFDGQQCKQVCKNGRLMVNGQCVCPEGTAEANDGSCQAKTQTMCTSGLESGESNPSGDTLNRQTTS

SEQ ID NO: 30376 - protein, 183 aa, A.fumigatus
YANADGSGKGKCYTFTAENGNRLGLRNDGVYYAAPDSMVQRYGKFQLCSDEKCTPGRAINPSDKTYIKDVYGDVATGAHAGQWLNNAQNGAHIGRTPTFANAGQFVLSKWPCGKYCLGGFAAGIGPACPAEIPAMTFYSQDPQMCVPFELTEVPCDIKANVNNCIWKNGDQCCNKVDCTWRPL

SEQ ID NO: 30377 - protein, 341 aa, A.fumigatus
PLDASAVCLSTTDITTTTTKMKFSWLTVASLLMGQVALAAPSAKTFASASGTQFSIDGKTGYFAGSNSYWIGFLTNNADVDLVFNHMKESGLKILRVWGFNDVNTVPGPGTVYYQVHANGKSTINTGADGLQRLDYVVHAAEQHGIKLVINFVNNWDDYGGMNAYVQAYGETDHNAFYTNQNIQKAYRRYVKAVVSRYASSPAVFAWELANEPRCKGCDPDVLYEWIKSTSEYIKKLDKRHMVCIGDGMFLLPSRLSPSISSNDNTDKMCRGLRPRPPLRRQLPLHLRRRQQLHAQPRHPHHRLWNLPPVPGQLGHLPRMGRSLGTIARRCMHGRRQALSV

SEQ ID NO: 30378 - protein, 384 aa, A.fumigatus
  UNSURE (81): Identity of amino acid sequences at the above locations are unknown.
VRRCHAIPPGPQHSGRVGLVYRRDRLRHVDRAAGPAQLVDPREAPVDHAQGRHDPVRPRLCRLAPQPRARLDRVQRQLHAXRLARVDGAALLPALDPATGGPVPARGQDPRAEQGAHRAQDRQTARRSRARTLSPAQEKIPGGDMIDWFKSRYQAQGKTATAHQLTRDQLLATFASIYNLSNALTYVMFDLAANPAAVDELREELDQVLGPNVGAESIDKTALPRLIKLDSFVRESQRLSPTSLVNIPRIVTDPNGLRLKTGHVIPPGYLVMVRAQPINQSPTLYPNPERFDAFRFARLRQQGGANENRWQHTSTGADNINFGHGIWACPGRFFASAEIKVVVAYVIRHYDLRLIEGRPHPKPKYGGLAIFPDAGAEVELKPRV

SEQ ID NO: 30379 - protein, 238 aa, A.fumigatus
PIAVQHPYPCARNCDCIMTVLPDSENGYLLNYEDQEKRRMNMQHDLIKTYMGKLILAPLPFDQPNLRVLDSGTFNGKSPLCRFDPLETNRRRPLARRRLDPPPVPHARRHRRLPNRLPSQAPPEHRVPRAVHLRPLAHRMARLVRPRPPETGDCMRAPRRRPAGAVPTHRPRQARHRLGAIHRTQSKASDPGASEAIPCSRALPFAGGGDAASFPREPPAGGTGAPLVGRIWTARSAR

SEQ ID NO: 30380 - protein, 206 aa, A.fumigatus
  UNSURE (142): Identity of amino acid sequences at the above locations are unknown.
SSQSQYPDTPFALGVPGQQLVVLPVSEIDTVKALPENQLSIKKHHYNQFLGEYSYMGTKADEFDDAMRYLLVRNTPAVLASFTAEIDYAMSTVLQVPPNSWTRVKPRSIMPKVATILSGRAFVGLPLSREPDWIESNVNYTXDVSRAWMVLRFYPHWIRPLVAPFLREVKTLEQNKALIGRKIAKLLADQERGRSRPPRRRSPAAI

SEQ ID NO: 30381 - protein, 61 aa, A.fumigatus
TSYKAIRQVNETLSHYCTSPEGMTRLEHEQSSPKGDTTYLLIVGSIKQVHMKSVSGRSLDQ

SEQ ID NO: 30382 - protein, 76 aa, A.fumigatus
SRSPGFIMRQKLLGFLLIIRSAFYVFFVSLILFILPLILVSLFVFIIRLFFSLLFLGVCHFFSGICLLFLRLRLLL

SEQ ID NO: 30383 - protein, 447 aa, A.fumigatus
NGSHSTGVIIHELEHFSNGADEDLVRESVRALGRCAQNDPSTAKYCLVVLLRQITSLDETLVSESLTVIRHLIQQDPASHEQTVIRLVKHLGSSSSPEARATIIWLVGEFAGVDPKRNIAPDVLRILVQKFADEPEPVKQQIVLLGAKVYLHHLLRNPPKQPTEDPSVSEPKINQEHNEWADDAAKESEVNDNNKEDQRKEEPKGDQITLLWRYILLLARYDSSYDLRDRARMLKALLADPSSTELANLILLARKPVPHAPSPSETRKELLLGSSTLIVGPDAGPFGLSGYHNLPDWVELGQEPDPSLRESEMKPDVTERATMTAGGKLDRALMEHESRVAAMKRQQNGHVRAGASAAKTKTLDQWLEEESETEEEETDSGEEVTDSEEEETEEETDDEDEEGDEDEGEDEEDEGDEEDVESASDDQQEAQQLLSHDEPGAPGSRGF

SEQ ID NO: 30384 - protein, 64 aa, A.fumigatus
NKNIPLWMVPYVRYGMDPQLLVAQSQGKAFRHENLTWQTKLPWDMVVALKQAVSWGRMNIDSVR

SEQ ID NO: 30385 - protein, 117 aa, A.fumigatus
VVSLAGGQGAGAGLTTVACEQLLDICVKNCGYPFHLQISTKEFLNELVRRFPERPPMRPSRVQHRILESIEEWRQTICQTSRYKEDLGHIRDMHRLLLYKGYMFPEIRHEDAAVLIF

SEQ ID NO: 30386 - protein, 166 aa, A.fumigatus
KTALMILSNSSSSLTADPDSASESSNGVGSGRAIFSGCGLSGTEGFWKDFELRILARISAIWASSSESSEMAYGSRSSSASSSSSPSPSLCSSFSSSSASDSADAARLFVFPTVHISSAPPSARFSSYSRSILANHSSSAFLMSSSVAQAAYRFNSAELISRKASP

SEQ ID NO: 30387 - protein, 284 aa, A.fumigatus
LFRPNAKKILSPADRELLEQFGAAVVECSWVRVKEVPWSRIGGRCERLCKCFVPNRIYVFLQDKELMISRYTVPYLIAANTVNYGRPWRLNCVEALAACFCICGHEDWAREVLKHFNYGEAFLEINSALLKRYAACATEEDIKKAEEEWLAKIEREYEENRAEGGADDMWTVGNTNRRAASAESDAEDEEKDEQSEGEGEDEEEAEEERDPYAISDDSEDEAQMAEIRAKILNSKSFQNPSVPDKPQPEKIARPDPTPLEDSDAESGSAVSDDEEFDKIINAVF

SEQ ID NO: 30388 - protein, 89 aa, A.fumigatus
TKLTQRMVRHKKDNFSRGGKKFSSNPRPRPRPVPRDDDDGSATNRPAFKAACWDLGHCDPKRCSGKRLMHFGLMRELAIGQKFAGVVIS

SEQ ID NO: 30389 - protein, 152 aa, A.fumigatus
GVIEDLVALRYVFLAHNGNLVIIVLTSQLSQRRYRDRDRDSYRRRDRSVDRRDDHRDEDSYRSSRRDRSRDRRRSRDRGDDRDHRRKSRERDYRSRRDDSRDRARRRTDDSADLKHKSRRDDSRTRNLDSKPREVSPTHNVFEIIYKPDANK

SEQ ID NO: 30390 - protein, 234 aa, A.fumigatus
ASKPSTPAPTAPTEDEKRAERLAKLEAWKQKQAAERERKQREAAAAGGARSILEEIDRKSGLSPAVGSPQSPATPTTDATPTPYSGKFDPKAIVRNAAPAPSTPAVLGNDVAVPQSAKASASSSSMNNHVQANKPPAANSTTSCKLYIPTIRFLQIANVTCTATSTVKRNVGGFGLGAKQVADAEKSSAVKTLGFGEEESKRKKLERLPTPPLEDAKDDMGAVGLHQGLKERSM

SEQ ID NO: 30391 - protein, 73 aa, A.fumigatus
KHTSKMSSNKPYVIKGIPVDAGQIIPVRRDIDEWYEDTSRQSRIQLSIFIWALREFQSIDYKDRLSYFQIAGL

SEQ ID NO: 30392 - protein, 97 aa, A.fumigatus
RQYLRFDPVNGTCGEYMGSYMSNLGGYLADEMATANCSFCPIKETNVFLGRVSSSYSDIWRNFGLMWVFIVFNIFAACSLYWWVRVPRDKKPVAKAE

SEQ ID NO: 30393 - protein, 79 aa, A.fumigatus
CTDEAPNNQGKSDDLAGLLVYFILGGGAIPTIAASTVCILMLFLRFNVPAGYICYDLTSFRLVALVAIVTVLCHFSVQL

SEQ ID NO: 30394 - protein, 664 aa, A.fumigatus
NRPSSRSSMSRLQTGKTEFPKPTPARAEKQRTSPDRTQLMAQFVDVGRKLMRRMEELASKDERRDKTPAFVGKDARSAVDRDRSERMAEASRSKTRSGAAHAASSTASDEHSEGSTTSSQEDAHNSFEKREVPPEMLYRPSLSDLLRDASTFNMYRQRAIARRILTQWLKKAVQTQQTHRNMEVVAVNRDRITLLRQAFETWRTIVQGKRRAAQTEKFFKHLEERAGRARDLYLMTKAFTHWAQIASDEVAKTSAARRHILRVKYFNAWREITAVNELKAQRFALQRPFNAWRSKAREAKEMEQRAVAVHNKKLSHAVYWQWFWSFCDRRAPQWYDHRLKRRSLLYWLRKFRMNRERIQEIDAKNKHTATATACQLWHQRSQAIVAAEKDAISMNRRQVLQEKLEEWRVEARLRPIASRVSATIDRNITQTAFSQWARRLRMLREAKEVDRLRVMRNAWTAWNDLLRCQALTARIEERMKIEIMYKWILAERFRLMQRIRDQRITRDVFARFVTNVRDTYTRLLQHADVHEEYRNEELLRSKFNCWREQLALQRQREVAAAEFYAPRLQQESLVAWHSKHQHTTKLERWARDARFYFLATRTIKKWHKATLDSAKRRRQEAYAKMRRRIKINLALKALTHWHSRAQHVARLEFFLRSTPLREYI

SEQ ID NO: 30395 - protein, 94 aa, A.fumigatus
EASLYAKIQKCEFIVPETKFLGIIIGQDSIRMDPDKVKIIVNWQVLTCVADAQAFIGYWFWQLLPAIYQGFLKNYCSLSEPDWEGCPIYVDHNL

SEQ ID NO: 30396 - protein, 77 aa, A.fumigatus
  UNSURE (35): Identity of amino acid sequences at the above locations are unknown.
GSYLYYHEHLYIPNHDKLRAQLLQECHDKPAAGHXGKHKLYELIAREYYWPGMYRYVDRWTRNCHTCCRSTLSCEAR

SEQ ID NO: 30397 - protein, 90 aa, A.fumigatus
PALLMLRPLLVIGFGNFYRRFIKDFSRIIAPLVNLTGKDVLFMWTTTYKLSFEALKKAFVNAPILKPFNWIKDVVVKTNSSNYMSAGVMS

SEQ ID NO: 30398 - protein, 72 aa, A.fumigatus
YDNEGVLHPVTFFSKKLSVTECNYEIYDKELLTIIHCFEEWRPKLEGTPSPIKVITDHRNLEYFMSTKLLNR

SEQ ID NO: 30399 - protein, 73 aa, A.fumigatus
QACWSEFLSRFNFKIIYRPGKQGVKPDALTRRSEDLPKEGDERLQHQSQIILKKKNLDPEIQNSVKLEAITRS

SEQ ID NO: 30400 - protein, 167 aa, A.fumigatus
AFHCSMNVHNEPLWQWPSSVPSNTSLNSESSQSPQKPYQSSDENPTTECPESPRKHYPNRTCRICLESVPPTFYPPSENLPGFLQPKPRVVYESSDPELGRLLRPCKCKGSSRYVHEGCLQSWRHANPSYGKRHYWQWPTCGFQYRLERLKWAHWISSASTPNRINF

SEQ ID NO: 30401 - protein, 281 aa, A.fumigatus
YCDLTMEDQRRDNRIARRDEHIPQSEGRGNNTHPLPSENPQSHELDSYTEACRDLEKQLKAQINLIKRHLGAVGMSQSLDASSQTVQVGPSDAMQGQPIASESAAPITPTKTLSASALTSGHAHIHTPNIGNSEVPVVNQGLVSPAVSTSSAATTCEAFPDYYESCEKNPPIVDKAHEAAYNYAISKVVEEATRFKKIDTNVTNPPVLNAATDPVVKGRSATPSAKKALGTFQTSKHSSTVPMPPIRPSLTETEIAERKTKLLAEMKAFIVFTTGRWKDTS

SEQ ID NO: 30402 - protein, 66 aa, A.fumigatus
GDWLDSEFNEVLEGTLEGHCQSGSLCTFMLQWNAQKLKSQHINQIYQRYGARASSDSSDDRNTRVS

SEQ ID NO: 30403 - protein, 166 aa, A.fumigatus
  UNSURE (153): Identity of amino acid sequences at the above locations are unknown.
ILLAQGINTAQRAIDRPLCSLQTSRTNMDSKRGVVAAVLALLPLVSAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASXRLYMSSSRPCRLD

SEQ ID NO: 30404 - protein, 61 aa, A.fumigatus
SFYFFFSFSYISGDYRLSCNMIYAKNSACLIHLSSSLKERSLYAFYYPQMAVTNERIFPLH

SEQ ID NO: 30405 - protein, 75 aa, A.fumigatus
RDATSLFCHTMASDLQPPNDRKRVKVYELRDNDWFDRGTGFCMGQILDVSPRCRSPSQRKKHRPLSARKLHLASR

SEQ ID NO: 30406 - protein, 116 aa, A.fumigatus
LCPLLDDALSDDLESYQSIMLPPPELGNLPDIDHIMRAASITQGGRDALSKFVIRDEYIPKLIPLVTVAEDLESLPDLHRLCNIMKSLILLNDNTIIETVVTDDIILGVVGALECA

SEQ ID NO: 30407 - protein, 72 aa, A.fumigatus
FIPDDPEFPTHKANHRQYLADQSRYKEVVPIKDPIIRRKIRYTWRLQYLKDVVLARMSSPRGWKDPRWRYVS

SEQ ID NO: 30408 - protein, 489 aa, A.fumigatus
  UNSURE (58): Identity of amino acid sequences at the above locations are unknown.
LLYFKDPVFPAPADAFKGFDQGQHHGMANPMGLDSEDEPRRGTSRANSVRFDESAIHXYYGQASRSTSELPLRTGSGMGSHPLTERSLSHRSDGRQSSSGHSHHSARTNSLGLETTSRLMGSFVGGSPLIPPPGIFFIGPVRCVIRCWLTTNFSHDSLLYAAVCSGSYASILGYPMVQKLGLEDLVTHEDGVRFIKLPMYLPEASVHQASSRPNSPVPQLPTLTIRFLVRDMDPNDPSIQIILGSDVLRSHNADILFSQDKIIMVDDERNKISIPLVRPEDDSVFKSLCTASDCTRVERSTRHALEKGPTEVSGDSAVGAIGELSRSRRSTSASTTARASTEELDESRKTHSSGSHDVSPVAEGQEDSGKSTSAIDFQAHETAKPETAGVWGAWRREMKIDPASSGASKPSRGRTMKVLRPTKSSTRVPTASSGLGTDAAASPQPTSSRASSDESRAGKQLAPNPIGGASAFGWLNSSQPPKRVVTMPK

SEQ ID NO: 30409 - protein, 154 aa, A.fumigatus
PCPFVHTSRHDRKRKRRDQIFENTSIASLVSSFASLTNPLTALNSALPASPNISNKIPSLLVTTAPASRSRASATPLSSLFMLLTPSTITYTLCPRSSKSSVVCVIQICVSIPTMITSRGVSPPFTFGSSASSSGVIIEKSVLSMLARTSGVER

SEQ ID NO: 30410 - protein, 170 aa, A.fumigatus
TTKLLKASSALNIPIYVTTQNRPRLGDIVSELQPYLSTPLVRANIDKTLFSMITPELDALLPNVKGGETPLDVIIVGIETHICITQTTLDLLERGHRVYVIVDGVSSMNKEERGVALARLRDAGAVVTSSEGILFEILGDAGRAEFKAVSGLVREAKEETREAMEVFSKI

SEQ ID NO: 30411 - protein, 135 aa, A.fumigatus
DGLTLSRLPAPTSSLPRTPTGTIDMNCPVTDHHLTADDCRYYVRAAAVARHIYMRKTVGVGRLRKVHGSTKNRGSRPNHHVDASGSVDRKIIQSLEKIGVLEYDEEKGGRRITQAGQRDLDRIAKTTVDEEEDEE

SEQ ID NO: 30412 - protein, 154 aa, A.fumigatus
KKFHSSPAESIVYQTNSSMLPTCMLLDRFNSKPPSFPSCNNMGELFLDKENTERFKMKTSGTFYCFSRRLIYSSSSSSSTVVLAIRSRSRWPAWVMRRPPFSSSYSRTPIFSRDWMILRSTEPEASTWWLGREPRFLVEPWTLRRRPTPTVLRM

SEQ ID NO: 30413 - protein, 431 aa, A.fumigatus
QARGLRTRGTMNENDENGPSTRLTRAKAAALSAGDVPTTTAAAKKPLQSKKAATNSTTTGTQRRRAALGDVSNVTKSENGEAKETKKAASGKVGLTSKATMQTGGIQKLSRTNSSRTALGAKDNAKKEKPAVEGKRPGSGSGIGSTQMKRTSSQKSVQEKSLQVEEPPRKKVEVEKKTTEKKTTVEVSTAKEDAVIATEPEVAKKPDDVVDDLDTEDLDDPLMAAEYVVEIFDYLRDLELETLPNPHYIDHQPDLEWKMRGILVDWLIEVHTRFRLLAETLFLAVNIIDRFLSAEVVALDRLQLVGVAAMFIASKYEEVLSPHVANFSHVADETFTDKEILDAERHILATLEYNMSYPNPMNFLRRISKADNYDIQTRTLGKYLMEISLLDHRFMCYPQSHVAAAAMYLARLILERGAWVRTLALVRQSDL

SEQ ID NO: 30414 - protein, 127 aa, A.fumigatus
QTFHRSTVQTHTSNIGQLNPRLINHRVPHYQFQPIIHSISKQPRKHHPTSPQIHQLTTHTHQLQPQRRAHPQGKNVLVPENVHPSPPLPRLVPHNRRSPLPTSRNPQLQSGHAQPLCPAHQLRALAE

SEQ ID NO: 30415 - protein, 185 aa, A.fumigatus
QHTPTSFNHNVEPIRKAKMSWFQKTFTLPPRSRGSYLITDEVLSQLPEIRNYKVGMLNLFVQHTSCALSLNENWDEDVRADMSDALDRIVPTDRKGNLYRHSAEGEDDMPVCSLSFFVRCLRIALREWRMGLTSGAGSYQVRSCGGVGQYSHHEWAVGHWYVAGDLVFGVSDESAHAQGCCDDSG

SEQ ID NO: 30416 - protein, 205 aa, A.fumigatus
TWFYQKGWCRVHRHRDRSRLVSKWNSRSDRSEELTEFSDWERVIIIHSRDANNMWAPTRAFLFAHSGYHDLAWGDIQNTLTTDEINAGDAKNPNGVQNNDHPKVYVAWSKHAHFDDRNTGWNDPISQSTDNAFRSDDWWYYVDKSYYVSFHVFFTAGLELLTGIRFYQMIPPLLAKLSGLRTGAMRLVTLLLCMQVCALRHDGSK

SEQ ID NO: 30417 - protein, 89 aa, A.fumigatus
IDCTNSYFKHRSIESQTHQSSGPSLSIPAYHPFNLQTTPQTPSHQPTNPPTNNTHPPASTTTSSPSARQKCPGSRKRSPFPPAPAARTS

SEQ ID NO: 30418 - protein, 61 aa, A.fumigatus
SQRKRSQSTRPIYNTFIDKSSLCTLFFLALMLLNNSLHVNMLVIIAQGEVIWRIYRRRRAS

SEQ ID NO: 30419 - protein, 158 aa, A.fumigatus
LVFRVPDKPYSTHRLLIGTHTSSDAQNYLQIAHVQLPNPSAPNPDDYDEERGEIGGYGGSSKKAPMEIKFNIVQKIDHKGEVNKARYQPQNPNIIATMCTDGRVMVWDRSKHPSLPTGQVNPQMELIGHTKEGFGLSWSPHTAGQLATGSEDKTVRIW

SEQ ID NO: 30420 - protein, 86 aa, A.fumigatus
RCPRRPTRAVCISSILSVVRLFDTNFLCSLFQHGGHTNRISDFSWNLNDPWVLCSAAEDNLLQVWKVADAIVGKDLEDVPTEELEP

SEQ ID NO: 30421 - protein, 205 aa, A.fumigatus
LNIWHRDLTTYSKGNKLLKPSRTYTHHSSIVNDVQYHPLHSSLIGTVSDDITLQILDIRESETTRAAASTEGQHRDAINAIAFNPAAETVLATGSADKTIGLWDLRNLKTKLHSLESHTDSVTSISWHPFEEAVLASASYDRKIAFWDLSRAGEEQTPEDAQDGPPELYVYLASFLLFVYSILISYAVSSSTAGIPTAFLTSVGI

SEQ ID NO: 30422 - protein, 209 aa, A.fumigatus
  UNSURE (17): Identity of amino acid sequences at the above locations are unknown.
SRIFFLSWMTLHVPDRXSPTFTSPLCVCGWGLVASFQSLATSFSTFVVLRAFLGITEAAFGPGVPFYLSLFYKREELALRNGLFISAAPLATSFASSLAWLIVKVSSNGPIAPWRTLFLVEGFPSVFVAVFAWILIPDSPESARFLEPRERMVAKLRLGETRSDYCGPDSRKFNWREVAKALSDPKSYVTAVRGSHISPALSLTDVQLL

SEQ ID NO: 30423 - protein, 246 aa, A.fumigatus
RAATIVYVLQLQCRFQLHACVPAHHHRRVSPGMSNPVDQCTHFNSMGYSSLSAQALCAPPYLIAFMVVLATAYLSDRHRSRSPYLIAHALISSFAYLAIAATGYYHEHLSAGVQTFIRYACVYPATSGFFSAITLIITWTMDNRAAKEGKGASMAILNLIGQCGPLLGTRLYPRSEGPWYVRGMATCSFFMVVVAVLAIVLRAMLQRGVRAADRKGDADGEMETRRVLMDGNQFNHSVEERFVNIL

SEQ ID NO: 30424 - protein, 222 aa, A.fumigatus
IVLRNHTRNSKPPKAKPKRNTAARWTTDASTCASNQRSATSSPKSPPAISDCTASSPPQGINHLQSAVEHSQSALNEVMQINYNGVFNSATAAARQMFNYQQKGSILLVASMSGLIANKGMTSPVYNSSKAAVIQLARSLAMEWGRRGIRVNSLCPGHILTPMVELVFEQNPAAKATWEAENMLGRLACPEEFRGAALFALSDASSFMTGSTMIIDGGHTAW

SEQ ID NO: 30425 - protein, 62 aa, A.fumigatus
LLPGVKGFSSYICPRELPSSAMDLLKEVSAWGFLQSNAILSLFIPLPNHASKGLPVMLILTI

SEQ ID NO: 30426 - protein, 119 aa, A.fumigatus
QRGTFHPRREDSEVNKYTHTPVNAVWFVVLFSIGLNCIAIGSTQTATAIFSITAPALDISYVSVILAHRLYKDKVKFVEGPFTLGKWGAAINWVSIVWVLFISTVLFFPPTVPVTASNM

SEQ ID NO: 30427 - protein, 566 aa, A.fumigatus
FRVLLLTENLHKERPSDSKNEHHRETLGSMIWQWYEERKDGVALEKAPGGDLLEQVHSGGRELSWTDVRRKPLDPGEQLIYQQYLATKRQLQDASQTRGQENLENPTDVLDDRSSSTSEDSETEQQGRVLNFSTSLAHANRNKLGLSDEDLGVNILLRRKNVYDYDVRGKKGRERMFPYVAPRKRGDEYGEFIRPEEYLRAEEREEADMQQRRSEAQTKLGQKRRWDEAGPHGRRASHSGAKRQQVAGDAHKREAGGADDLSTTEDADGGDAAISSEDEADEQSFEGPAKAVFEKSTITINARLAFVDFTGLHDKRSLEMLIPLIQPRKLILVGGMKEETTALATECKKLLAAKAGVDVSSPDSALIFTPTNGETVDASVDTSAWMVKLSTNLVRRLKWQHVRSLGVVTLTAQLRGPELNPKEESEESASKKQKVLQDEASSAATSTLGETKPAVDKSDVFPVLDVLPANMAAGTRSMTRPLHVGDFRLADLRKVMQSAGHKAEFRGEGTLLIDGMVAVRKSGTGRIEIEASAQSSTMNQATGRGVASFLAVKRKIYDGLAVVAGS

SEQ ID NO: 30428 - protein, 68 aa, A.fumigatus
RSAITSLRDGSYKIHSNLNQTKYVDRSTHNFTEPNAVLLNLRLNPPSEPLVYTRSSADQYISYRQQKR

SEQ ID NO: 30429 - protein, 199 aa, A.fumigatus
IIAIIFHHHSSHHHRFGTHISVMAFFLRRPFAVPTALRQAPKAANTARFIHNSPIKPVQSKPLGPCSSSIFAQSKQTIQNAFRRTYMQQSYGTAQRGDLTQRLLYGAAIVGGTVMATNFIFNRETREDGGMPHYERSYLNETFMHTGLGVGIIGIAARALHMNGWSYRLMATNPWLVAGVGLAASMGTMFATYYTSPDK

SEQ ID NO: 30430 - protein, 164 aa, A.fumigatus
RVFSYVMKYGLWAAFNVTQAALLSPLMFMHPALLARAGLYTVGMMGSIAFVGATAKQEKYLYLGGPLLAGVTIVALSGLAPLVIPATAARALMWSEKIWLYGGLAVFGGFTLYDVQKILHHARLAERGLVRRDVVNESISLELDFINIFVRMVQILAMQRNNRK

SEQ ID NO: 30431 - protein, 91 aa, A.fumigatus
AEDNGMGIQSPGILVSTTGIIRTRYTYTRAFQAVLFEPDFLQGVKDQAFAQIRRIGQSSPQTTCIRFVVPGMQYKQQVFTRQEHRRQLKRA

SEQ ID NO: 30432 - protein, 208 aa, A.fumigatus
  UNSURE (178): Identity of amino acid sequences at the above locations are unknown.
IATDVSFDRYCFPVISIDDDRRHADPVPFSPGGRRDRPCLRFWWQQLGSGLLSRQRCPAEAQSDRKVGLVTGVKWMGGPCVGNTYKPESIDYPSLCLQDSPLGIRFANPVTAFPAGINAGATWDTQLLYARGAAMGAEAKGLGIHVQLGPVAGPLGKNPNGGRNWEGFSVDPYLSGVXMEKTIRGMQDSGVQACAKVCSPRQQKEASC

SEQ ID NO: 30433 - protein, 100 aa, A.fumigatus
  UNSURE (82): Identity of amino acid sequences at the above locations are unknown.
HWLGNEQEHYRDTISSNIGDRAAHELYVWPFMDAVKAGVASVMCSYNKVNGTWACQSDALNNKLMNEELGFPGYIMTDWNAXHSTVNSAVVGIGLEHAGQ

SEQ ID NO: 30434 - protein, 86 aa, A.fumigatus
  UNSURE (25),(81): Identity of amino acid sequences at the above locations are unknown.
ERIGYTDTMKTFAILGAFFSSALAXTLCDQYATYSNGRYTVNNNLWGMSSGSGSQCTYVHSISHSGLTLAYDLGRGPGGRXPSSKT

SEQ ID NO: 30435 - protein, 99 aa, A.fumigatus
  UNSURE (88): Identity of amino acid sequences at the above locations are unknown.
QGRYRIDSSHQNDEKELMEWRMQEHGGIDLIFHTNLFSSKTMDLAVHPSEVNMSFLDPVSGSWASISGTAALVAEQETVKRYYSPALXAWLGDLGQGVH

SEQ ID NO: 30436 - protein, 95 aa, A.fumigatus
TTDIDISPCLSVQYTMSSTINTSTGNKPVDPYKAKSLEDPPLQQKVEDMVNFISETKFGMLTTKLSNSDLLTSRCMAPSREGTVLILPTKMMKKS

SEQ ID NO: 30437 - protein, 186 aa, A.fumigatus
  UNSURE (182),(183): Identity of amino acid sequences at the above locations are unknown.
SSSTNDDVYPTALYRSISGTGCGATGRMMASTDRPASRSPSRIHIPNSSFSTADRCACNCASCTTLSALPRFTRPCSHGINGSPVPSSRSSIVDPSSTPISRPARPWHLDSAGGTGMSTTSTPAVRRSICATSSSTLATGGSGCTTPSDLSTPIVTFLLRPERGNSPSHNVFTPRPKDRACXXPPP

SEQ ID NO: 30438 - protein, 97 aa, A.fumigatus
SNNPSSAERSEPRPVGPKTPWKCGEVGVTTINIESCRLNTFGTDITTYLSSIGIKMSAEEQVRLDNFDSIFSLDGKVAVVTGGSRGLGLHAASGYVY

SEQ ID NO: 30439 - protein, 141 aa, A.fumigatus
AMVRFAPLLTAKATRESPSRVIVTGSVAGIGVGSIGENATFAYSASKAAVIHLAKNLAVELGPRGILCNAIAPGFYPSKMANGLIEKQGGLKQLEEHSPNRRLGRPEDIAGLVVFLSSRAASHLNGAVIVTDGGAVLKGRL

SEQ ID NO: 30440 - protein, 157 aa, A.fumigatus
  UNSURE (154),(155): Identity of amino acid sequences at the above locations are unknown.
WRRPTGRPAGRHRASTSPTAPFPPQTAAPATAPAAPRSAPCRASRGPAATGSTAPPCPPADPALSTHHRRPSAGPPDPGTWTAPAGRGCQPPRRPPSGAASAPPPPAPSPPAAAAARRHPTSAPQSSRFSSGPNGGTPRPTTSSPHGRRTEHAXXPP

SEQ ID NO: 30441 - protein, 178 aa, A.fumigatus
PLRCILTASSLLQAGCSKVYITSRKAKACDEAVAALNALPNKRPGAVAIAVPADNARMDDLDRLVAEVKKTTDHVDILFANAGATWGERFEKYPESAFSKVMDLNVKSVFYLVQKYVPISFWCISTLTELWLGLPPYSRPKQPVSRPRASSSLVPSLALGSALSAKMPPLRTPPPKQP

SEQ ID NO: 30442 - protein, 69 aa, A.fumigatus
VIPFFLLLKSSPLIWHIGNEKTVDRRVYLDSPLSIQVVTPKQHDYELYRAMEIIDRVVRAEEHKTVAKL

SEQ ID NO: 30443 - protein, 237 aa, A.fumigatus
  UNSURE (4),(5): Identity of amino acid sequences at the above locations are unknown.
GGGXXHARSFGRGVKTLWDGEFPRSGRRRNVTIGVLRSDGVVQPLPPVARVLEEVAQMLRRTAGVEVVDIPVPPALSKCQGLAGRLMGVDDGSTMLDLLEGTGEPLIPWLQGRVKRGKALSVVQLAQLQAQRSAVEKELLGMWMRDGDRLAGRSVDAIILPVAPHPVPEIDRYNAVGYTSSFVLLDYPAGVIPVRKFRETDLELGQEMTAPVLGSWDKANRLLCKSSLSSSCSRVPH

SEQ ID NO: 30444 - protein, 66 aa, A.fumigatus
NNHISTCELISRQNNSLSFLNSGNYGGLFVEHVPTDTGTSRNGYKQPSRHLAEMLWTATHRIQLCL

SEQ ID NO: 30445 - protein, 383 aa, A.fumigatus
CADLGLLGAMFSKTIRNVNWDVPIQFFGGHYHIRDYARYDSKAYGLASGRFMETIGFLSIDGLSTSKNRLKPAQATPSFNRRYIDNNLYSFHHHTGHDRDSFPTEHGPNISHLIQQSRDALDLDRVHGCAPRDLWMTRVKYPSHDSIYTWLEENVLPSQVKDDSRKGKPALVIVNTGAIRFDIFKGPFTQDTTFIVSPFTSGFRYIKDIPYDKAQTVVDILNKQPQILTAPKDHTNHTPWTLAPPEQSMHMHDKIVESDDVAAHYLTDQSRLPMSTPFTPKVFPGYTTVDDGGIDGDDTVHSPISFYRVPNCIQALINPGTSADPNTVDLVYIDFIEPYVALAAKFARLDLDFARDSDVYMPFETLTDLILDWVKHNWKCEDA

SEQ ID NO: 30446 - protein, 355 aa, A.fumigatus
  UNSURE (90): Identity of amino acid sequences at the above locations are unknown.
PDLFSPSSRLHKHSISPPHGTQVTLRLLAAPLNPADVNQIQGVYPSKPPFQTTLGTMEPSAVAGNEGAFEVIATGSNVKNLAKGDWVVMXQTGQGTWRTHAQLDESQVIRIENKEGLSPLQVSTVSVNPVTAYRMIKDFCDWDWMRAGEEWLIQNGANSGVGRAAIQLAREWGIKTINVVRERRTPEETDALKRELYDLGANAVVTESELLSGEFKSMVNEFTRQGKEPIRLALNCVGGKSATALAKTLAPGSHLVTYGAMSKQPVTLPSGLLIFKNLVFDGFWVSRWGDKHPELKENTINDVLKLTRAGRFKDIPVEYIRWTWETEAAELVAGVQETLSGFRKGKGLLKYEGDE

SEQ ID NO: 30447 - protein, 298 aa, A.fumigatus
CRLDAVLLPRGEDHVQKIDRKKLGIDVSTIEQELSEQAAGDAEQTRRLTAEEEEKIKRTATRPDLYELLSRSLAPSIYEMDDVKKGILLQLFGGTNKTFQKGGNPRYRGDINILLCGDPSTSKSQLLRYVHKIAPRGVYTSGKGSSAVGLTAYVTRDPETRQMVLESGALVLSDGGICCIDEFDKMNESTRSVLHEVMEQQTVSIAKAGIITTLNARTSILASANPIGSRYNPNLPVPQNIDLPPTLLSRFDLVYLVLDRVDEQEDRRLAKHLVNMYLEDRPEHAAEQEILVSAFLTT

SEQ ID NO: 30448 - protein, 206 aa, A.fumigatus
PVHSLQPIEFLTAYITYAKTKVHPVLTPAAGKALSDAYVNMRKLGDDIRSSDRRITATTRQLESMIRLSEAHARMRLSPEVTADDVEEAVRLIRSAIKQAATDSRTGLIDMSLLTEGTSASERRSREALKRALLSVVDDLCSGGGAARWAEVFRILSENSSIEVDGAQFADAVRALEAEGAVSVVGEGAPAGISGALAALFCRPVL

SEQ ID NO: 30449 - protein, 130 aa, A.fumigatus
PNKLYAILTPLQQPVYYTSSDSSLDVWTIIAATSEDATVDFTDTGDKTCLVMQMSDNTFQVLLRLMLYFRRRLATRNFVYLYLLILPKCTFLGHLIWIAIRALQMQGSLVSHIPRINGVVTWRLRSPINI

SEQ ID NO: 30450 - protein, 110 aa, A.fumigatus
THLSVSMEVSILSLFKAYAAYVTVAVVLLRLITNRFRRGLAGIPGPTIAKWTRLWKLHSVWKGNHHTTAIDLHRKYGPLVRIGPKHVSVGDPSAIPIIYGLNKGFTKVRG

SEQ ID NO: 30451 - protein, 67 aa, A.fumigatus
KTGFYPIQCISWNKRPQMNLFSTRDEMFHREQKRPVANAYSMTSLLELEPAVDSCTEIFINQLAKVR

SEQ ID NO: 30452 - protein, 113 aa, A.fumigatus
  UNSURE (68): Identity of amino acid sequences at the above locations are unknown.
TPALRSSSISWRRFANSKKPVDLGMWLQYYAFDVVGEFTFAKKLGFLPEGKDVDGMIEAIQGMLVYAXVCGQIPEAHPLLLGNPLFPIFMPSMETWNQVLNFTLKAINSRASL

SEQ ID NO: 30453 - protein, 256 aa, A.fumigatus
  UNSURE (254),(255): Identity of amino acid sequences at the above locations are unknown.
ILILKGFFESRNDPKNDPVVLWLNGGPGCSSLTGLFLELGPSSINEKIKPIYNDFAWNSNASVIFLDQPVNVGYSYSGAAVSDTVAAGKDVYALLTLFFKQFPEYAKQDFHIAGESYAGHYIPVFASEILSHKKRNINLKSVLIGNGLTDGLTQYDYYRPMACGEGGYPAVLDESSCQSMDNALPRCKSMIESCYNTESSWICVPASIYCNNALLGPYQRTGQNVYDIRGKCEDSSNLCYKVFTGGARRSVQSXXA

SEQ ID NO: 30454 - protein, 171 aa, A.fumigatus
VTMRVLPATLLVGAATAAAPPFQQILGLPKKSADTLAKPLHDLQEQLKTLSGEARHLWDEVASHFPNNMDHNPVFSLPKKHNRRPDSHWDHIVRGADVQSVWVAGASGEKEREIDGKLEAYDLRVKKTDPSALGIDPGVKQYTGYLDDNENDKHLFYCEFYLDLLVCVAEY

SEQ ID NO: 30455 - protein, 119 aa, A.fumigatus
KINCAGNLNSLEVELPNLSSGTNMTFRNVSAVSVPSLHNLTGQLGFWGDTFKSFSAPNLTETGDLVFNSNSKLTNISMPALETVNGGFLITRNDELSSIDLPSLKVVTGAVDFSGKFDE

SEQ ID NO: 30456 - protein, 101 aa, A.fumigatus
SNRRVSMPKLENVKGQFNLQSTGNFSCDTFDKAHNDKVIRGTYKCKAAEPNPTTKDGSSGTTTSSGSSASASKSNAADLNAANLPALGFAAVFGALVQYVL

SEQ ID NO: 30457 - protein, 72 aa, A.fumigatus
DIYQWRPDWLWGIKSIEQHWKSLIWWPFTLSLLVCDSLSLSSHFLLSYLSPVSLPRVPPRRTFLGHFSKNCL

SEQ ID NO: 30458 - protein, 115 aa, A.fumigatus
LTMSLCLNRLTEERYVHQPSLNSRRANTSTTPQPTTTQERLTTPTRRKQWRRDHPFGFYAKPHRTPQGVLDLKRWECGIPGKANTLWEGGLFKLDVVFPDGKPACACGRDRSVLV

SEQ ID NO: 30459 - protein, 91 aa, A.fumigatus
TDVANDTGKFVPPLFHPNVYPSGTVCLSILNEEEAWKPAITIKQILLGIQDLLDDPNPESPAQAEAYNLFKKDRPAYERRVRQVVKENPAL

SEQ ID NO: 30460 - protein, 131 aa, A.fumigatus
VGEHGPSSGVLKTGSRRYLAYLLQFRLVYSSSISLAHVAMESLTTHPSTAQQARAFTSPASLSFPGGAGDLTPPSSEKEGNITIGAQGANGTVNGHQQGGNAVNGNGVTPATPAATPGANAPGSGIVPTLQ

SEQ ID NO: 30461 - protein, 157 aa, A.fumigatus
SCVSGNPKTTALIFASGKMVVTGAKSEDDSKLASRKYARIIQKLGFNAKFTDFKIQNIVGSWDIKFPIRLEGLASRHHNFSSYEPELFPGLIYRMMKPKIVLLIFVSGKIVLTGAKVREEIYQAFELIYPVLSGTVILFFGFKSNYMLTIRSDFRKV

SEQ ID NO: 30462 - protein, 129 aa, A.fumigatus
VRHNPRVLVHRHVRNHFLYPLQNNVAANTRTLYSRPTGDFIVDYHPDYAGLFLATGGSGHAYKFFPVLGDKVVDAIEGKLEPELRNLWKWPVKVDQSAFEGDGSRSGEQGLLLMEELAKSTKAQRKSVL

SEQ ID NO: 30463 - protein, 75 aa, A.fumigatus
FVCGRARETTTASTNPKAVPIPGGNGVTMQVSLPENDVPVPLEGQEAFRTALKELLPSFAEREFVTTRVCWYTDT

SEQ ID NO: 30464 - protein, 259 aa, A.fumigatus
TTLTRIGIYPTTKGANDCGPIWSCLLQRGMGFNQLDVPNRYVLTNILERAYALQRRHPITFWGRPGFTMRSVHDFIHNATHSVVSGIIVHNEKDAEGMLGLARLMELFDAIDEEVVDCWNQRCNVNSGYCNNLTEEKALSIHQNLRRVCESERYKGYDWFERTKSVPGEVQSVQPTISMRETQCADVFITKKWLQNRVWVLCSTHGLLRPVSDHPELSFEYTITVAVDALKICQSLRLSSMEAHGIGLVSTVHPNKNLF

SEQ ID NO: 30465 - protein, 125 aa, A.fumigatus
VQSIRTKTYFNFSRYSRARAQVEKLYDIAVSAIGISANVRQPLGEHSTASVAGSMAGPGVAPPGSLVGAMSPNTAAVHSTQSLAEDFMLLLNTLRGGNHPFMEKFKAYLSSLHIVGVGCSNWAQT

SEQ ID NO: 30466 - protein, 416 aa, A.fumigatus
LNQLRGYLCSDVLFENPSISNHLRIFRCSPNSRVSQIRQQQQTQLLRKSSQSSLSDAYPYQRPITSRETGQHGVAPSVQDPTQWPIPQRGEASVSTDVVPPRSNTSIGPSWPATDTSSVDSQTNSAISWNERSDVEYWLPDNLDAQVPVFEFPGSNIYLKASLPSIIQPEQEAAGLQPHHVDTSNLALSTMGVMPAGPVPTRTTWPASIVEANMIPWIEVYFDRLHPTLPVLNRSSLFIRMLAQEHRRNPQFGAMLLSLCAFSLTQPIEIDERPTSSSRASQARSMMNEATKMRSCSDFGEHPTIEAVLTSFFLFGCLFGSNQHNAAWLRLREALDLAATLGLNNPDSYRDIPNDERGQRLRTYLVLSITERYGIQPTRCAKSICADKHPRKSLCPATATSHHFLGETGVHHAFCP

SEQ ID NO: 30467 - protein, 124 aa, A.fumigatus
AVLRHPPGSQSAILLAQWLGQSDSDATAAMINSGPATMTDWMLLAMSQMNGESQANKVGQAFAQKLLEIGDIHTSATVLLGLGDKNEAIEVYVSQNCYMEAILMTCLLTPTDWQRQSYLVRRWG

SEQ ID NO: 30468 - protein, 290 aa, A.fumigatus
VLFHPMTRLKLNPHRPFRKTWSWDVRTKHVTYEPIPTIENPRGFANYGPTATLFTLGPNYTVQQYDLDNPSMVANVQHIPAGALTATPEEPRGGSVDSRALQDPPDLRESARIYDSRPPFDQSGVDAVRQQRAEMSSPVSSRSHANSVSSKASSGKYRMVPFSAPSRSGQTATSFSLASASGRETPQQSGASYTYASSVSMSSVKSSRAGSRLRNEVQFSPTDQRIDLFPFTRARLNDVPYRNHRLIDETHLTPNDLRRQMLSVVFGWDGDIQDLIRDECELSIFTALLY

SEQ ID NO: 30469 - protein, 464 aa, A.fumigatus
  UNSURE (143): Identity of amino acid sequences at the above locations are unknown.
RPRIGSASHIWSVDGGEHVVSHAQQQLAIRCFMCTGVEPSDPWTSPAAQQAASFAEILSGRSPMTSPEPQPLQQQSSNFLRPTPNSQPKVPPSTRSNAKTPALKLITSFDSQPGKFRFPGLKSDDRTPTNAPGITPIAESAVXGSAISPGGLGSYRANNIQSLNNAMNARTGTPAFNRSRLPSIGETPVDVHPPAFLSSGLNNSVEYASSVESTSRLHEGSQSQDEEVLSSLLPSARYNPEKDTFKPSPQTAVQANSDKFATIKVLPPPSPGVFEALKERSDSRNGSRDRKPGVLQLHLFEPGASESDLLGPPSSTMSNIRSPASTLNSYNSAKSPSVSGRSIDQYISSLAEANYRSQKLSRGRRNTDDSVSQSSARKITSRNTSQETTRGRNERRYIQPAKRSPSSPVPMSPEEIARYSKGTGTKHPASKSRNSSRVRKPRSRHSSERRRHRSVFATGWKIRV

SEQ ID NO: 30470 - protein, 79 aa, A.fumigatus
SVGLNCTSFRSRDPARELFTDDMETEEAYVYEAPDCCGVSLPLAEASENDVAVCPDLLGAENGTILYFPEDAFELTELA

SEQ ID NO: 30471 - protein, 158 aa, A.fumigatus
SSSEENSPLMSSSSNPSSESSSLPSVSSDPSVSMPSPSFSSEETCDSFLCRLLSFAEVLDLCGRSSSLSSDASSSSSLPSSESSSSSSSLSSSSSLERGLNRSSSLSASSASRLIFEPAYCFPRLIGSCLRSLAFLFEVNNLILMITNRQKVCTHPTA

SEQ ID NO: 30472 - protein, 62 aa, A.fumigatus
CLQGLPRSGTPPSFPRRRGLPEKRKIRDVKKVIAVSSAKGGVGKSTIAGMKLLSWMPSEYLI

SEQ ID NO: 30473 - protein, 240 aa, A.fumigatus
DTCCWAQELMDVLDNCLVPLTNYGLKSMSMGYLLPQPKPDPSQPTGNIPMDTTPISWRGLMVTKAMHQLLHSVSWGPLDVLVLDLPPGTGDVQLTIGQELIVDGAVIVTTPQDIALRDAVRGFGMFEKMNIPVLGMVRNMAYFACPQCGHQTKIFSHGESHGHGSADSDSGVVAECKRLGVEFLGDIPLDAKVCEDADRGVPTVVSEESDDRSVRRKAFLDVAHRIAQKMGWNGGTNTTM

SEQ ID NO: 30474 - protein, 178 aa, A.fumigatus
RFVIIRIRLLTSNRKARLRRQDPINLGKQYAGSKISREALEAESDDDLFRPRSSDEEEDSEDEEEEDSELGSDEDEDASEESEEERPQRSRTSAKDSKRQRKESQVSSDEKDGEGMDTDGSEETEGSEDDSEDGFDEDDMSGEFSSDDDQEGDEDGDDDEDEDEETGLHHGAGRVRAS

SEQ ID NO: 30475 - protein, 214 aa, A.fumigatus
DSIHQLNRLYPHKPFRSIRSTPKSRREKRLPQVADCIGNGADSAATWLEAKAAPTGQMCGSVATTLWNYLKADDYAAVKNLAWTAGSGIALNVIGNIPNYYINALLAKQSASGEPSDACGQNNDSTYASDAASSVYEFCLSIQTEKMENTATRFDAMDSRSSSTWPAGVQGMAKYFISQQAETWAPICAAYGITWKRDMLLRFKTLTASWFAPW

SEQ ID NO: 30476 - protein, 131 aa, A.fumigatus
EVKLLQILSKVYKSSSKPPVKNLSFFLADMRPQLLLIYAVLAGAETTATVDQSPQEHFGLHSQFIDKLGATYNVFVKDFHGTHKIQYINSTDFIPTSHFVRFDQHPNLDERNVCRKSLIALVTARTVRRLG

SEQ ID NO: 30477 - protein, 884 aa, A.fumigatus
PRVRFENEGARPGVWPLDGSGILPENKFVGITKEVPEPMAVRFCLTNLNSGGESGEIPTGAVVGLVLTIMFRTSRVVSGIRWHLNEFTGRNMIEEGGNPLTLKVHFDNSAGNQHRGFLDCALSETQQWFMEEESAACPYCRSQVPEESDAGWLPSRTSRPRPRRHPQKRGLTSSKRARGNMPDTQESPIFPMRHSTRKIYAHARTSVDWDEDLRPSDEPEKLESQKSIGVTSISSPFPGENFIFGQTSSTGTKRKSKRKTSFCKRRKTSRKTGRDTGKGRHEIEESGLGQESDLKGTVDATYMPEVNAQSETSKGSHTKADRASMDDSDEECPPRQLESLTDEAPEAALVAVMEVSGVEQSVAFLMDQAQEIGCPLIFESSRGTGDQHASQRSNPQIQMPSSNYEGDIISYPDFEEGELGGRGAVVGKKLASAFHPDCTFYLQGEEKEDDNTIRDGVTGSVDKEDDESHAMSASALQHNDFETRAVKVQSQAAMGSRTNRTTHLSPDSAQAVAEKQTSREYPGSIQQISSTRLTRRKSRVVQTEKNNASRKKKAQTKPSTVASSEKENQADEIECQSQEICGLGQRKPGLYALKKPGHGNRRAQTSTRERERVTSGYHSLKLIHRIQKPEEGNSSDSDNPKILSRTKTIPRLTPRKAIVDNNGSPRLVSRHIAGSQCSTHANLNFTQRSGKLMRAGMNLVSQRSSESGYEADFDEQLEQIPLETHEISSFRTKMDAHRDKYVHRNCETATHEELSENPVTGCREGLVASKVVTASGKEFMMRFSTKPPKKSPRRLDRSNAEGDGPTQLSSKKEGCFIDSSCDPTEMSPRSEELPRQADLVSSLQSLYESAHDMLLITNEVCQCHYTIHYDRVLLMQRKAPIART

SEQ ID NO: 30478 - protein, 65 aa, A.fumigatus
NWSTTLTSCNSSSIFINSDMTSHTWNPSHMLDVSAIYLHCTSKSLGPVLAEMRLSPGGALLTIPP

SEQ ID NO: 30479 - protein, 93 aa, A.fumigatus
SAIGINILPLQPTLFTLTSPSFSSICHLSIDSSDMFSSLLNRGALLAVVSLLSSSVAAEVFEKLSAVPQGLFSRPPASYVVTDENRMEILPHP

SEQ ID NO: 30480 - protein, 199 aa, A.fumigatus
LTRTGWKYSHTPSDRDPIRLQIALKQHDVEGFETALLEMSDPYHPNYGKHFQTHEEMKRLLLPTQEAVESVRGWLESAGISDIEEDADWIKFRTTVGVANDLLDADFKWYVNEVGHVERLRTLAYSLPQSVASHVNMVQPTTRFGQIKPNRATMRGRPVQVDADILSAAVPAGDTSTCDQVFTPHCLKDLYNIRDYQAD

SEQ ID NO: 30481 - protein, 64 aa, A.fumigatus
PVNTILDVIQDYSVHPYSAEMCAVCICLGPVSSRRSVHNYSYPHPHLQPGKIRTTKLHCSMTME

SEQ ID NO: 30482 - protein, 142 aa, A.fumigatus
TRFFQTPFHPVILEIDATHTIFVMSQEYFPGKGASAGEGSSRHPPEDVSSENSPPYPRPPPTYMTVGNGSTSESATALMASLNADSGYGGSIASGSVMDGDEGAGWRADMMVDKPTPVPNTSSIGNWNPAGFEFCSCWDDKG

SEQ ID NO: 30483 - protein, 74 aa, A.fumigatus
IVEWAFGKRMTPAERLRKHQRALDRTQRELDRERIKLENQEKKLIQDIKKSAKNGQIGACKIQAKDLVRTRRYV

SEQ ID NO: 30484 - protein, 188 aa, A.fumigatus
VHPEILSDADAVTGHFPPYSGTAAVRELADQCADIDIQTVRSNEQMMQSMKGATMLLGSMNRQMNLPALQRIAMEFERENDIMDQRQEMMDDAIDEATGLEGEEEEGEDIVKEVLDEIGVDLSQAVCFIQWSTSHSCALLTFLPQLGETPSDIQKTSVGETRVAQAVGAGGGTASDDDLQARLDSLRR

SEQ ID NO: 30485 - protein, 192 aa, A.fumigatus
SSISVDTSACRSRHTIHGSSRTHSSGVIHRTNDNGMTPRILSEQLETAHSRSSAARNSGSHSRSLSSNKTVTAIPPSLLPSAPASPPTPASSPTPHQRPPTWQSSDEDDDAFLLNSRIHFTSLSSAKKQRFLEGVLGLCDSQLLSYVSSYVAPRLRKDPFQVFPTELCLRVSFSVDDRLTLPDRTDLSTLHY

SEQ ID NO: 30486 - protein, 174 aa, A.fumigatus
AAENETWDESEHMEKRWKMALKRKYMVMGLATVGGGLIIGLSAGLLAPVIGAGLAAGFTTVGISGTSAFLGGAGGTALIASGATLTGSTIGLRASHRRTGAVQTFEYRPLHNNKRVNLIVAISGWMTGKVDDVRLPFSTVDPIMGDIYSVLWEPEMLQSMGATINILATEVSVS

SEQ ID NO: 30487 - protein, 434 aa, A.fumigatus
ALTQGLQQVLGSTVLMALMASLQLPLVLTKLSYLIDNPWNVSLARANAAGLILADSLMDHNLGKRPVTLLGFSLGARVIFSCLKELADKGASGLVQNVYLFGAPLVANKDEFIKARSVVSGRFVNGYSSNDWILGYLFRATSGGIMRVAGIAPVEGIPGLENHDVTNLVNGHMDYRAAIPRLLKEVGWEVLSEEFAEIEDPDPENHGERQRELIREIDEARKAAEAQPEKKRFGLFKRGKLAEKKGWETYDVKRNDSFPRESTDSNGTGAVLFDIDAIRAELASEMIEVKQLESTLPPMKLDLNSPSTQSPAAATPSEHRAPKDGRATPSVPQTPDENSRGHSASQKTQSPPPRQEQIHMAFDTSYDNPPQRSHSSFEPASYDLCPTRPALRSSVTMPTSVGASALGAMALEPNAWADHDFGHGEEGEISMTFE

SEQ ID NO: 30488 - protein, 145 aa, A.fumigatus
TAPVRLCEALRPIVLPVKVAPEAIKAVPPAPPKKALVPEIPTVVKPAARPAPMTGASKPAESPMIKPPPTVARPMTIYFRFSAIFQRFSMCSDSSQVSFSAAYCISRASMTRLSKRAICNQDTSIDCPTLSSKDRDRASLYTAGL

SEQ ID NO: 30489 - protein, 241 aa, A.fumigatus
  UNSURE (106): Identity of amino acid sequences at the above locations are unknown.
GKASRIFSTPSIGVLTETKARPYSPPNNFGDDNSRPASQAGGTPPSAAGVRGASPRGIDPFGLSQTPVQGNTDTAGGASLQSPSRANSTSSPSSGMNPIFGKLEGXDQPPTSTSSPGRADSPSSRQAAVKPNAGAIGSVGPIGSRPVQQSGPSQISNPALNKRSTTPLPSPLGFGFTSSDGVASGANNDRAASSASNPVASTPATNAGAKESSGGVGLGWGNGSGVWGSKGGLGVQASVWG

SEQ ID NO: 30490 - protein, 65 aa, A.fumigatus
VLNAMFRGNFCFAYVPVFLVLELSTYFISHVIELSVFSHKATYVLAVYAQEVVDALLGDEHVHAR

SEQ ID NO: 30491 - protein, 297 aa, A.fumigatus
  UNSURE (185): Identity of amino acid sequences at the above locations are unknown.
FTDIILAFCDVEGNYFIVLAYRYTTMLSAQLINLWTIAVVVFISFLFGRVRYHITQILGILICIGGMGVLIASDHITGSNGGDVSSGNQIKGDLFALLGASLYGLTNTGEEYFVSSRPVYEVLGQMAFFGMIINGVQAGIFDRHSFQIAVWNSRVGGYFTGYTLCLAFFYCMAPLLFRLSSAAFXNISLLTMNFWGVCIGIEVFHYKIHWMYPIAFVLIIVGQLIYFLGKRVLGEARKPWLGKNQERGFAGLFTAKAKIDSVRAKLASNNNHNVNAGGAHHDDRTAATIDERHSNAV

SEQ ID NO: 30492 - protein, 80 aa, A.fumigatus
LKRWILFIEKGSKECFTSYAPFVDLILEDHEALAKHRHLEVYDVAVFVTVCAISQLSKKLMPVAQAKHDICSQNHKNKTP

SEQ ID NO: 30493 - protein, 74 aa, A.fumigatus
  UNSURE (8),(64),(74): Identity of amino acid sequences at the above locations are unknown.
PRGTITPXCSVTKIVTALAALTFVDRGQFDPNAKVAQYWPEFAAHGKQDIEVRHVLSHTAGLPXWDPPLSREEX

SEQ ID NO: 30494 - protein, 251 aa, A.fumigatus
YNTPLATQKLIQQQPWWTPGSASGYHLSTQGFLLGELVRRVSGKSLTQFIADELAAPLGADFQLGVAEKDWPRTADIVPPPAAPFPALDPQSIAMRAFRGTPADATASMTPEFRRAEQGASGGFGNARAINKIASMVTLGGSVNGKRFLSPQTIDLIFQEQVSGVDLVLGSFLRFGIGMGLPTPENKALEWMPQGKVCFWGGWGGSIAIMDLDRKVTVTYTLNKMGAGTLGNPRTEKYVRAVYAALDAYKP

SEQ ID NO: 30495 - protein, 162 aa, A.fumigatus
  UNSURE (51),(107),(117): Identity of amino acid sequences at the above locations are unknown.
PFFEEHLASGEELGADICVNINGENRCRALGRATQTMHAQSPDPEAPSPRXVPSPRSSLLSPRSPSSTAASLTLTPKSPSTGPSSPRTVSRTSRSAMCSAILPAYPXGIRPCPAKNXTTRPWPRRNSSSNNPGGRPAPPRDTTSRPRASYSASSCAASQASR

SEQ ID NO: 30496 - protein, 234 aa, A.fumigatus
PHTPQRRICQLGTTCRKGFTKPPTSRQGNTRHCRGQISARLSPNQSPTLSQGPPPPGAPPTQRAPSVPPPPKGTAPPPRVTSPPTNPPGPSSAANPYASLPQSPPMGSTMGVPPPPSIPRGPSPYNAPPSMPPPSNRYAPSPATQAASPQLSTRAPVPPPPHAAASPYTSQPGSHPPPANPYAPSTPPPSQLPMQQAPPPQATSSRPSTASSQRKAAPAPPKYRKSFLLLDSHS

SEQ ID NO: 30497 - protein, 646 aa, A.fumigatus
QRAMSSVLLDTSPERRAANCLTTLPPAVKTEGKRASKIKITPFEVDETVAKSTETFENALKEGDLRSICETRASQAASDEEKADWKVIEALISENPRKSLIEYLGFQDQDDETADKLAQLGLNKEEDEVNGKSAKESRGSGAKKHKRLQSMFDANPEADNFLSDLAASKGAKTNNPFQIFNGSETEADKGITRALLLGNFEKALDVALKEDRMSDAFMIAICGGQKCIEKAQEHYFSKQTDGPNYIRLLASIVGKNLWDVVHNADLSNWREVMAALCTFADDNEFADLCEALGDRLEEQIRNTEDKSLRKDASFCFLAGSKLEKVVAIWIEELRENEQRSIETATDDTSFSIHVRALQSLIEKVTIFRQVTNFQDTERTKDADWKLSMLYDKYIEYADVVATHGRLQVAQKYLDLVPEKHPEAEIARNRIKLAMRHATPQRSQQTVPTTRTPVNKPLPQASMYPAQPAFSAPAAAPAAATTAPRNPYAPPTAATTQPVNPYTPPSAAATQPQTSNSYAPIGGGGYTPAGYQPPQLPTYGTQPLGGSVPPPPRASNQSPATVTTYTTATNLPAWNDLPEGLHKTSNLPAGEHPPLPGANISSPFPQPVSNPFSGSATTWSPAYSARPFSPSSTKGHGSSSPSDLATY

SEQ ID NO: 30498 - protein, 143 aa, A.fumigatus
  UNSURE (48),(49),(50),(52),(54),(55),(62),(63),(74),(82),(93),(95),(100),(107),(117): Identity of amino acid sequences at the above locations are unknown.
FPFVVLTLISSRRPLPHPRRRHAYLRDPLRRHAAREVSSAILLQSARXXXPXRXXARGPRPXXRPARRPGPRGXGEPPPPRXPAGPRGPAPAXAXGRRRXRADPAGXPGPDRPTQGXRPSPKEKNQPGTGGPPNRKEGTTQRT

SEQ ID NO: 30499 - protein, 145 aa, A.fumigatus
  UNSURE (26),(36),(37),(43),(44),(48),(50),(62),(69),(80),(81),(88),(90),(91),(92),(93),(94),(95),(96): Identity of amino acid sequences at the above locations are unknown.
SFEWSPLCGLGGLPFLVGFFLWGSAXRLGLGGPAPXXPLGRRXXASGXGXRPGPGRGGPPGXGGGGAPXGPGAPGAAPGXXGAGAPGXGXXXXXXXLRFEGGWRSRLHALHVGGEDLVNRHGVCGDVGAVAGSLSKSELRMGIKK

SEQ ID NO: 30500 - protein, 217 aa, A.fumigatus
LYNKNSQAFVEFTTLQAATAAKHQIENLNVSSQGGRKYMVHYTNPHTNPFRTLPKDAPMRKDNQARSLSGGFNSPNQNMNFGMNNMGGGFRGGRGGFNSRGGMNNMGGFGGRGGFQNTMGGFQGNPMVGGFQGNPMGGMQNYGFNNRSNMMGGGMRGGPGGMRGRGGMAGPNMMGMPAMNPMGGMGMNPMAGGMNPMMGGMGGNMGMQGASSWCSIT

SEQ ID NO: 30501 - protein, 165 aa, A.fumigatus
YRDLYLNTMATEDDNFDIDIYGDGGGYNTNDQGDYIKHEDTELILDAPEQTQNGAASQDQNSTEQKAQQEQGDSTGTNGEHVTQAHAVQQQEASQAAPAPQQGVKRKEHEDRPSDPDATTALLISDLYWWTTDDDIRGWINAAGCEDELKDVTFSEHKVNGKSKG

SEQ ID NO: 30502 - protein, 153 aa, A.fumigatus
RKVFLSDRAPAGRTLHAHVSAHSTHHRVHPTGHRIHTHTTHGIHRWHSHHIRPSHTTATAHSARTATHAAAHHIATVVKAVVLHPSHWIALEASDHRVALKTAHCVLKAASAPKASHVVHAAAAVETSPSAAEASAHVVHSKIHILIRRVETA

SEQ ID NO: 30503 - protein, 254 aa, A.fumigatus
QGASCKLVMYRVFCPIGHADGCLLAQRFTGPQILRMQRKYPEVYKKTARISLVSSFLASLLLGHIAPMDISDVCGMNLWDIKKGAYNEKLLGLCAGPFGVEDLKRKLGAVPEDGGLRLGKINRYFVERYGFSSDCEILPSTGDNPATILALPLRPSDAMVSLGTSTTFLMSTPNYKPDPATHFFNHPTTPGLYMFMLCYKNGGLAREHVRDAINEKSGSGASQSWESFDKIMLETPPMGQKTESGPMKMGLFFP

SEQ ID NO: 30504 - protein, 169 aa, A.fumigatus
KLDPVGGLLISLMVIKAGWANTTTSLLELADTTVDDDIKDSVRNAASKILAKLEDPHAIQIRDVQGMKSGQNYLMEIELAVPGAWSLSRSREIEETVRHAVGAGVRGVKRLKVRFVPSELEHLDFTEEFIAPEVIRQSSPEPQEGDIDAVHEAHAHDHQHKGNENRKTR

SEQ ID NO: 30505 - protein, 300 aa, A.fumigatus
  UNSURE (231): Identity of amino acid sequences at the above locations are unknown.
ILPGKLWSISPNVKGWVGDQEVKNHFPQEPSFPYPEIARERDKLVRDSFHLTFCQLTISLALNPSYCLRIFFYSYFFNNTPHFVSFFFLTLPSSVLSPAFLSVSTSSYLPAGLDSQSFNSHIMTSQGPLYIGFDLSTQQLKGLVVNSELKVVHISKFDFDADSHGFSIKKGVLTNEAEHEVFAPVALWLQALDGVLNGLRKQGLDFSRVKGISGAGQQHGSVYWGENAESXLKSLDSSKSLEEQLSGAFSHPFSPNWQDASTQKECDEFDAFLGGPEQLAEATGSKAHHVSWSCTVSSVQ

SEQ ID NO: 30506 - protein, 99 aa, A.fumigatus
EERCKRFCLTGLAVLISLVLMVVRMRLMYRINIALLRLGATLSDDLWSDKLLRKVQMLQFGRDKSDLEPLDPAHTGPDGMSNGLLNLARSTERPSPRHR

SEQ ID NO: 30507 - protein, 186 aa, A.fumigatus
TLTSLQWYDPDAVTTRNGVLEIRFDSFPNHELKYRSGMVQSWNKLCFSGGRLEASISLPGAGDVSGFWPGFWAMGNLARPGYAATTEGMWPYSYHDKCDAGITPNQSSTDGISYLPGMRLPACTCAGEDHPSPGKSRSAPEIDVIEASVTALNNNPNAVIGSVSQSLQMAPFDIWYMPDYGKCYSL

SEQ ID NO: 30508 - protein, 74 aa, A.fumigatus
PQWLPRTAVKGMRDKSGPKCNPSDPLCLEVRERPLLSNIRRGLIDPDTPDSAKTKKAADGKEWILVVSRGPFFL

SEQ ID NO: 30509 - protein, 62 aa, A.fumigatus
LFVTSLDGKLTSMIQFSDEFNTEGRTFYEGDDPFYQAVDLWYGVTQDLEVSHETCIANWSKH

SEQ ID NO: 30510 - protein, 131 aa, A.fumigatus
RNYIRNLLTDFRGTTFLIGPFLGPALAGYIGAGSNWKASFGVLTAFYALSTILIFLFGYETYYARGHQCQRNSRLQSMFGIKNHSLPVGRTLAHWTKILAIYIFKFPLLLTGIATMVNFCWPIGGWSDPAT

SEQ ID NO: 30511 - protein, 142 aa, A.fumigatus
NTLCALNQLLRQEENTASEQTMTLQVPLLGRLHIRRNVKPPQSTAINAKASSTLAPSSHALSQGNVSASFLQGPVGCQLPTVMDGATVVQNGWGWNDFSWSIEDTHQSLFNDAFMGDSMGQAALWYNTSNNSLSTWNTFNIL

SEQ ID NO: 30512 - protein, 202 aa, A.fumigatus
RPASYTRDTCSPPPRSSTHWRIAGTAGGESNFDPIRGFFNEDGFFAERMGWHLPGFDDSAWTSENSATSASSALSFTGATVRFFRSVVPLNIPAGLDVSISFVLSTPTAAPKGYRAQLFVNGYQYGRYNPHIGNQVVFPVPPGILDYQGDNTIGLAVWAQTEEGAGIQVDWKVNYVADSSLSVAGFGKGLRPGWTEERLKFA

SEQ ID NO: 30513 - protein, 71 aa, A.fumigatus
PGCLYFLSAWYTRKELGFRTAALYSGSLISGAFSGLIAAGITDGMENVKGLRAWYGSLFLFAPSSVVAQSC

SEQ ID NO: 30514 - protein, 100 aa, A.fumigatus
LRSLADFSRRWLFIIEGAITIVVAFIAMWILPNFPRTTTWLSEEEKQLATWRLEEDIGEDDWVDSEQQSLLHGAKLAFTDLKTWILVSRYSLPLTRNGTD

SEQ ID NO: 30515 - protein, 140 aa, A.fumigatus
CRVSVINRLSLCHKLTVVVPSNLMLNKFGKPAIYLPCAMILWGIISTATAGAQNFAGLVMTRFFLGFIEAAYFVRLSNNDYHGRDSFADCIVARLPLLSECLVHSQRAGLPHCCPLLWFSDLRCFLWSHCCWYHRWYGEC

SEQ ID NO: 30516 - protein, 158 aa, A.fumigatus
MLHILCIVSSASVTNFFPTVVETLNYGRIETLLLTAPPYCLAVISAFFNAWHSDRTGEKYFHITAPLYISVAAFIIAATTTGVAPRYLSMMLMVPSLYAGYVVALGWISSTLPRPASKRAAALAAINMVSNASSIYASYMYPDHDAPRFSTSQYFSII

SEQ ID NO: 30517 - protein, 64 aa, A.fumigatus
SLLSDRFIVTAMSVNCVTAFIAILSATLLRIILVRLNKKLDRGEALNDGSVPGQASSRGFRFLV

SEQ ID NO: 30518 - protein, 260 aa, A.fumigatus
  UNSURE (248): Identity of amino acid sequences at the above locations are unknown.
FLYCSLFPFILLSTIALDSFQILRDDTRNILIPHSLLSGISSCHDQAVIPEVGVSRAAMAMQPSYPAPFGAAAISSSAGQEVASTIRRQFTDADADRIVETPLGEKADSSDTAGPDSEDGIDQEGHDKITALARSLSQISQKSAGPTNTFLDPSSDPELDPNSDKFSSRKWMKNLLHIKTRDPDRYPRRTAGVSFRNLNAYGYGTAADYQADVANMWLKGFGWLRSILGCRNRVRIDILRNFEGFVRXGEMLVVLGRPGR

SEQ ID NO: 30519 - protein, 490 aa, A.fumigatus
  UNSURE (39): Identity of amino acid sequences at the above locations are unknown.
LCRAHSGCSTFLKTIAGETHGLWLDKGTHIQYEGISWDXMHSRFRGEVIYQAETEIHFPQLTAGETLLFAAQARTPANRFPGVSREQYATHMRDVVMTMLGLSHTVNTRIGNEYIRGVSGGERKRVSIAETILCGCPLQCWDNSTRGLDSSTALEFVKNLRLSTDYTGSTAIVAIYQASQAIYDIFDKVIVLYEGRQIYFGKASDAKRFFIDMGFDCPDRQTTGDFLTSLTSPSERLVRKGYEALVPRTPDESAARWRESAERQRLLADIEAFENESPLGGSKYKEFTVSRAAEKAKGTRAPSPYTLSYPMQIRLCLRRGFLRLKGDMSMTLATVIGNSIMAFIVSSVFYNLDQTTNSFFSRGALLFFAILLNAFASSLEILTLWQQRPIVEKHDKYALYHPSAEAISSMIVDLPSKFLVSVVFNLILYFMTNLRRTPGHFFVFYLFSVTITLTMSNIFRWIGAISRSMAQAMVPSSILSSAHMQSTSLP

SEQ ID NO: 30520 - protein, 137 aa, A.fumigatus
INALLDQLPQRTQLSEEMDTVLNSLEDVVNLAICCEPSNAKTNAAVSALVAAAQCSKDVAGFQRGRGTGTTRRQCNVLQSHQKRLALNISERDVDASRVMALSIPIERGVFHRQKSIQQTLRQPLNVLPIILLDVLV

SEQ ID NO: 30521 - protein, 162 aa, A.fumigatus
SRVGSNGRLEILHPDQSFILNGQICDFESLILKMPAAVQDTLVLSLRCDNVLLLAGTTKESGHTLDAHVVTFGGATRKDDFLWIRPNQFRNIFSGLFDSLLRLPTICVSPGMRVSVDTGEIGKHSIENTRINRRSGLHIQINRPCSLIHNSCLFQNTRRGTH

SEQ ID NO: 30522 - protein, 119 aa, A.fumigatus
SASWLSTMRLVLFNPWEEIGKLCRAKKVFFHTDAAQAVGKIPLDVNKLNIDLMSISSHKIYGPKGIGACYVRRRPRVRLEPIISGGGQERGLRSGTLAPHLVVGFGEACRIASQDMEVS

SEQ ID NO: 30523 - protein, 293 aa, A.fumigatus
IMSSVTPSVLRQASRAYARRLSSTQHGSLATASFPRRALATSSGAASRRTYVTETKAGNAQVSIDTAIKQEQKNFIKQTGLEPGKVELPASGISGDASMSPSAGILKQATVMDQGTRPIYLDMQATTPVDPRVLDAMLPYLTGIYGNPHSRTHAYGWESEKAVEQAREYIAKLIGADPKEIIFTSGATESNNMSIKGVARFFGRSGKKKHIITSQTEHKCVLDSCRHLQDEGFEVTYLPVQNKRLIRMEDLEAAIRPDTALVSIMAVNNEIGVIQPLGRDRKALPCEEGFLPH

SEQ ID NO: 30524 - protein, 144 aa, A.fumigatus
HIEQYDRKHVERLSKRLLDGLLAMEHTTLNGDAERHYPGCVNVSFAYIEGESLLMALKDIALSSGSACTSASLEPSYVLRALGSSDESAHSSIRFGIGRFTTDSEIDYVLKAVQDRVHFLRELSPLWELVQEGIDLNTIQWSQH

SEQ ID NO: 30525 - protein, 314 aa, A.fumigatus
LPARMGPSLGENTVARSILRKQQSFSQPNPQSSPHTYSSSASPSDFYRQDPHYGQDTPFSEMDIPITAIHLGPVERNCSQSVPPNMRFGHHMGDPIPRPASTKVENHRRRPSHNNNPALCPLDELEALGPIDTPEDLDRTPRAAHCKTPFSPDGPHANDIIHSGWMKKRKTTRLLRHEWEDHHFTLRGTQLAMYPDEDASRRDSKALEYIDVDDYAVACSSLASSSKLTAAFKKTVLKRRDNTQGEAAFAFCLIPSPNAGSDRKSFFNQAAKTHRFAVKTREERIDWMRELMLAKALRRGRESGATLNLNGNPL

SEQ ID NO: 30526 - protein, 85 aa, A.fumigatus
LLLGVKSSLFLMVINLSWLKPNPLRRLVILMALAEGDVDYKGSALCERLSSSCDDAYYKVVPSNTYITYPEYVYALMRMDDLTFD

SEQ ID NO: 30527 - protein, 69 aa, A.fumigatus
SKDYITPLQVVTSRNSRDESQNVSITYSCSVNPAHNSINSNSNKKKKKKKKKKKKKKKKKKEKKKKKKN

SEQ ID NO: 30528 - protein, 156 aa, A.fumigatus
PRRGSPGRREPAAGRAGALVRNTDLPLPAGGGACPRGAGDDRGRAVRQSAPAGCGAGAASGADEGGDGECAGGAVADGGGCDRCARVWAWGPRLGAAVLHRSDCDWGGHCDEAAEYCESGGDAGRVGGGHLRQYPCRPQGEYHSGSVGFEAQRADV

SEQ ID NO: 30529 - protein, 417 aa, A.fumigatus
APTSLNGLIERYRPDLTPFEETYRQIHRSPELSGHEEQTSTIAASHLQGLGFDVHTHIGGYGLAGVLRNGPGPTVLLRADMDALPVEEKTGLPYASTKTATGPDGETVPVMHACGHDSHVVGLLAGASLLQAAREHWSGTLICLFQPAEEHVRGARAMIEDGLYDKVPQPDVVLAQHLVRMKAGTVSVRAGRLLTAADAIDVRVYGRGGHGSAPQSCIDPIVIGAAIVTRLQSIVSREVTPGELAVVTCGSIHAGHKANIIPDQLDLKLSVRTYDADTRARVIAGIKRIVEAECAAAGAVETPSVDIVSSTPATINDEATVRALQETFGAYFGENLVDSEPIAASEDFSLLATAVGAPYVMWTYGGVDDKTWADAVARGTVNELPSNHSPFFAPCIQPTLRTAVDAMSLGALTFLRQ

SEQ ID NO: 30530 - protein, 102 aa, A.fumigatus
GLDAAGGIPCVLDRPGGAGPVGAEGRPRAPGGYVHADAVRGALFGRGARVAAGCAGGSGRRGAHGVGGVSARRILRYSGWRRSGCDAVVCHSGVLSSSLLAV

SEQ ID NO: 30531 - protein, 169 aa, A.fumigatus
SGMIFALWPAWILPQVTTANSPGVTSRLTILCSLVTMAAPITIGSMQDCGAEPWPPRPYTRTSIASAAVSNRPARTLTVPAFIRTRCCASTTSGWGTLSYSPSSIIARAPRTCSSAGWKRQISVPDQCSRAACSRLAPARRPTTWLSCPQACITGTVSPSGPVAVLVLA

SEQ ID NO: 30532 - protein, 203 aa, A.fumigatus
VRMGPLRAMTQYGYANDDWRMCPRDALCSVASMRRGCSPRLVAFCRGADEALTQLVGSHASLTAREGRALSEQKAALELLEGMYMRTLYVVHFSDEARESPRDVQADLEDAALMAWAEFLPDGFLDTLAGGGVGATLSYVILAYFHLLFSLFESVWYVQGGFDGEIVQIQALVEMSGEGELMSLMQWPVAVIAVNHDHRGSSV

SEQ ID NO: 30533 - protein, 286 aa, A.fumigatus
  UNSURE (184): Identity of amino acid sequences at the above locations are unknown.
IKDKMELPSTMKAWLYSNTTGGLENNLELSTSARTPGPPGHSQLLIKVISASINPADYKVPEMPIVPRFFVSYPATPGMDFCGQVVAAGPGATAFQPGQLVYGTTAAPAQFGSLGEYLLCKTEHVALLPDGVAPDHAATVGVAAQTAYQSIAPYVSAGDRVFINGGSGGCGIFAIQIAKALGCXVTTTCWRRNVPFCKELGAEEVIDYTQDDVLAVLRAPGPGVCARRRPYWAARGAVLAVAYVLASGEGVCAGWCAVDADVCAAGGVAGVFGRWAEEVCDLYDEE

SEQ ID NO: 30534 - protein, 238 aa, A.fumigatus
PPPTRPASPPDSQYSAASSQWPPQSQSDRCRTAAPSRGPHAHTRAHRSHPPPSATAPPAHSPSPPSSAPDAAPAPHPAGALCRTARPRSSPAPRGHAPPPAGRGRSVFRTNAPARPAAGSRRPGDPRRGYRARRRASQGRSRRPGRWRFWCLRRAGRFSLPRGGRPCLRGGERWGRARCVEPLRGHTRRCVCGRRNRGLAGGRRQWWRFALRGRRVRGSGGFVGRFLRRGLSLAGIFQ

SEQ ID NO: 30535 - protein, 296 aa, A.fumigatus
  UNSURE (139): Identity of amino acid sequences at the above locations are unknown.
SKSSQPPSTRPTTKSPKCPSSRGFLCPIPPPREWTFADRSSPPAPAPPPSNRANWSTARRRRLRSSARWASTCSARRSTSLSCRTGSHPTTRPPSGSPRKRRTSLSRRTSRRGIGCSSTGVRAGAGSSRSRLPRRWGVXSRRRVGGAMCRSARSWGPRRSSTTPRTMCWRYSAPRGPVYAHAVDHIGLPEALYSQSHMFLLPGKAFVQVGALSMLTFVRRVVWPGFLGGGRRKYVIFMMKSNQRDIATLGEWMQQGKLRVEVDSTYELEDAVKAFAKLRSGRARGKIIIHVSTESS

SEQ ID NO: 30536 - protein, 373 aa, A.fumigatus
VQVVYASLVPKVNTFIYWSCRVLLPEKGQRPQAHRIHGCPQSRLDTRRKERRMVTRQLVHRPPGHGVRPCLVVDAAIRPHHVGRPDGRREQGEILARCDRLRVHQVLAEVGAKGLLERTHRRLVVDGRRGGRHNVNRRRLHGTRRRTFRLDDALNARDDSRASVGIIRPHAELQIQLIRNDIRLVAGMDTAAGDHRQLARRHLPTHNTLQPRHNGRPNHNRIDAGLRRRAVAPTPIHAHIDRIRRRQQPPRPHTHRPRLHPHQMLRQHHIRLGHFVVQPVLDHRPRPADMLLRRLEEADQCSGPMLPRGLQQARAGQETHDVAIVPAGVHHRDGLAVRAGGGFGACVGQAGFLFHGEGVHVCAEENGGAGPVA

SEQ ID NO: 30537 - protein, 68 aa, A.fumigatus
LIGAFKFDLSTVSTIIPRRTTNDCGVTPTSLAETHTWRMVEDRRRVDNSILDINRMIIFIPILHAGGI

SEQ ID NO: 30538 - protein, 390 aa, A.fumigatus
RDIMKGLVGGIPLALLVAAVANGHGQGLKEDGPVTVIGGPSGDDGGNNVAVEFAGSYNSGVKDRYKDDHSVNLKNTVVAHAPPHPPVRGSHKRHHPAVTVIGGPSGDDGGNSAEIEFDSSYASAVEDWYKDDHSHDVENHIITPPVHGFRRRGDPSVTLVGGPSGNDGGNSVEFEFDSSYASVVKDAYKDDHSVGIENHITHPPPAPGFRKRGDGDTTVIGGPSGNDGGNSAEIEFDSSYNSAVKDAYKDDHSVDIDDHIVQAAPSRGFHKRGGGDTTVIGGPSGDDGGNSASFEFDSSYASSVKDWYKDDHSVDVKNTIIHPPPIFHHPPGVGFRKRGGGDTTVIGGPSGDDGGNSAEVEFESTYESSVKDYYKETIQCLHHGAGRTRA

SEQ ID NO: 30539 - protein, 139 aa, A.fumigatus
  UNSURE (115),(116),(119),(122),(123),(124),(135): Identity of amino acid sequences at the above locations are unknown.
PCPPPYHPARPVRHQQIRPVLEQVREPPSASDNPRTANMSSRFFYGGGSDSDSSSSDEEELYSDREEEEKSEEEESSEEEDETSEEEESDEETGARKFLKDVASDSEGRRRKRLXXRCXKCXXXKNWMKLEITIXLNEN

SEQ ID NO: 30540 - protein, 231 aa, A.fumigatus
  UNSURE (61): Identity of amino acid sequences at the above locations are unknown.
AMVAPTSQAAPFHYAAEVYRALRTANESENSSLNKTIPPGIQQQQQAEDGSKQRAAQAAHXQSAAQNAYSMQMNQFHTPSHGQPPPMYNGMFAGHQQGAHPPYPAQPPGYGHQMNLMPGQMPQSQYAPSQSLYAQATTRAGRQRASTMDHQGGGIPPTIQRVASHLDPNAPIRLQPSPAYYPPPPDGYVDNNAQRRRGSRAGAGQRNRDFIRTLEDGVLGGDGYMNQSQWH

SEQ ID NO: 30541 - protein, 235 aa, A.fumigatus
  UNSURE (224): Identity of amino acid sequences at the above locations are unknown.
TDSSSYSSAIDMWSLGCIVVELFLGLPLFPGSSEYNQVCRIVEMLGLPPTWMLEMGKQSGEFFEKTQDEFGRKTYRLKSLEQYSREHNTKEQPSKKYFQASTLEEIIRSYPMPRKNMKQAEIERGSFLQTTISFHSLTSRPELNNRVAFIDFVRGLLSINPLERWSPQQAKLHPFITQQKFTGPFVPPMNLKIPRSTKPYRLEYSSNSRLRMVANSEQPKRHMXSQRPRMHIRCK

SEQ ID NO: 30542 - protein, 140 aa, A.fumigatus
  UNSURE (12),(31): Identity of amino acid sequences at the above locations are unknown.
ANSDSYQQRMQXDLPGVFSASPVADNVRTWXVLHSSRFIRTSEECGNGVTDISVCRNAVIIGPADTPFEDGTFRLVMHFEEQYPNKPPGVKFISQMFHPNVYGTGELCLDILQNRWSPTYDVAAILTSIQRYVEYYYTTH

SEQ ID NO: 30543 - protein, 85 aa, A.fumigatus
QIIWARLEHHQGFVCSVRRHMFEDTHRYCTVVARFRPQNKVELASGGEPIVEFENEQSCKINVSLPSRLMKGKVCWRLKILTRER

SEQ ID NO: 30544 - protein, 312 aa, A.fumigatus
SKEGSGAFTFDRVFPMDSKQTDIFDYSIRPTVDDILNGYNGTVFAYGQTGAGKSYTMMGSDIDDPEGKGIIPRIVEQIFASILTSPSNIEYTVRVSYMEIYMERIRDLLVPQNDNLPVHEEKSRGVYVKGLLEVYVSSVQEVYEVMRRGGAARAVAATNMNQESSRSHSIFVVTVSQKNLETGSAKSGQLFLVDLAGSEKVGKTGASGQTLEEAKKINKSLSALGMVINALTDGKSTHIPYRDSKLTRILQESLGGNSRTTLIINCSPSSYNDAETISTLRFGVRAKAIKNKAKVNAELTFGLHHGAGRVRA

SEQ ID NO: 30545 - protein, 224 aa, A.fumigatus
GHLSFTGILLLSSTTLDNRVDIREVNLRADTLCVKIEGKSDQIDITSSLTISEKSSFDTLSTSHLSQLGGGNSTATVVVGMDRDDKLLSLRHVPAEILNLVCKYVWRCHLHCCWQIEYYGAFFGRAPSSLDGLANLDCELRLGVGEGFGRKLELPLGTSHLWIVLGYRAGVLGASYGNLKTLFAGGSENYSAETRAGSQVDVEDSFLCAFEGIDSATDDFFSAR

SEQ ID NO: 30546 - protein, 134 aa, A.fumigatus
ASSAAATAQPRSLWGWTETTNFSLSVMFRQKYSTWSANTFGVVISTVAGRLNIMGLSSVGPQAALTASQIWTANSGSVSEKVSGENSNCHWVPAISGSSLVIERAYLVHLTAISRLCSRVVPKTIRRKHGLVAR

SEQ ID NO: 30547 - protein, 150 aa, A.fumigatus
PVGCNVVVDQVEARVRLEVVRLLEELDDFLGPQLPVHGFGLLLNDLAELDLQSAREIQLQTAQDDPGGTTLAALGVDTDDSLVVPPNVLRIQREVWDDPFVVVGGVGTFAQLESLLDSVLVTAAERADNQLTTVGPSFIHRNLVALFHHP

SEQ ID NO: 30548 - protein, 275 aa, A.fumigatus
DGDQKFRFFKMLVDIGYTEIEVSFPSASQTDFDFTRRLVKTPGVVPDDVWLQVLSPCREEIIRRTVDSLKSAKKAILHIYLATSPCFRRIVFGTTREQSLEIAVRCTKYARSITKDDPEMAGTQWQFEFSPETFSDTEPEFAVQICEAVKAAWGPTEESPIIFNLPATVEMTTPNVFADQVEYFCRNMTEREKFVVSVHPHNDRGCAVAAAELAQMAGAQRVEGTLFGNGERTGNVDLVTLALNLYTQGVSPQVDFSDINSVIKGGGREQQDSCE

SEQ ID NO: 30549 - protein, 348 aa, A.fumigatus
RRERSLSSLSIPTTTVAVLLPPPSWLRWLVLSVSKELFSEMVRELVMSIWSLLPSIFTHRVSALKLTSRISTRLSRVVEESNKIPVNERWPYGGQLVVCAFSGSHQDAIKKGFKLRESANATDDDEWVIPYLPLDPQDIGRNYEAVIRVNSQSGKGGAAWVILRSLELDLPRALQVEFSKIVQKKTEAVNRELRPKEIVELFEEAYHLKSNPRFNLVDYNITTDRSQSPAPPEPGKALNTKNLKRRFTGIIEIDNIQHAITGVGPGAISSLANALSTLGIDLDVIDYKEHSIGLGRDVKAATYLQCTAAGSKEQVWGVGIHQDVVQASLIALLSAASSVRFLLHFSSP

SEQ ID NO: 30550 - protein, 62 aa, A.fumigatus
FDRLKDPSKKYKPFKPLHLPNRQWPDKVIDKPPRWLATDLRDGNQSLPDPMVRTSFIFFGRL

SEQ ID NO: 30551 - protein, 97 aa, A.fumigatus
SPSSALRPRYVSYYTFPPLKISIISNRLLVQFLTSRAGSPAPFRPQRSNTLTDEDLQALEQLGSSNAAAITASKLTTNDSAKPKVDLDALTAQANSQ

SEQ ID NO: 30552 - protein, 305 aa, A.fumigatus
TIHFVLPIFFYLLSFPFLIQPLVIPDMASYSTCAEVSPLCPVEATTYGYYPNLAGNIFFAVFFGILALFQLGIGIHYRTWTFMVAVAVGAILELAGYIGRVLMHRNPWDSSAFKLQIVCLVLAPTFVAAGIYLTLKHIILALGPEHSRLKPALFTWIFIGCDVGSLILQAAGGGVAAAAGNTNVSLLKAGDDIIIAGIAFQVATMSVCGFLGLEFFIRYSKRGAGLSGEKTSVGRNIKWVIVGEVFAYITVLIRCIYRYVYTFSRLPSRSSCRTLNMATSIPEMAGGWGNPLMQKENEFLVLDGM

SEQ ID NO: 30553 - protein, 146 aa, A.fumigatus
YSLAVSLLSLIRPPFVSVLRAKEQGVRRLSVLVTEPKLFATCIDHCWLSDHIAGSQLKMAFLRTPIVLLLTQILLFLGLVNAVPTPESLDVHGNLARDTASSFWVANIKRQGAVAFGQSSGYQVYRNVKDFGAKGKSPSTETRVFS

SEQ ID NO: 30554 - protein, 432 aa, A.fumigatus
VSFYRDQSIFLTENVGDGVTDDTAAINQAISSGDWCGKGCDSSTTTPALVYFPPGTYVVSKPIIQYYYTQIVGDAVDLPVIKASADFTGMAVIDADPYENDGSNWYTNQNNFFRAIRNLVIDLRAMPMNSGAGIHWQVGQATSLQNIRFEMIRGGGDANKQQGIFMDNGSGGFMSDLTFNGGNYGMFVGNQQFTTRNLSFNDCNTAVFMNWNWAWTFKSISINNCQVGLNMSNAPQNQTVGSVLLLDSSVTNTPTGVVTAFTQDSIPVGGGVLILENVDFTGSNVAVAGISGNTILKGGSVVASWIQGNTYSPANSLNKRATQGKVRVVTETVVETVLACPAQHSETLESAPARTATAAASTEARQSNADAYESTQVAGQPSAAKTTPVVYPTLSGGLSKPGFSSGSTISSQGPSSGNMPSSPRGWKDQGGL

SEQ ID NO: 30555 - protein, 82 aa, A.fumigatus
LKQDVLGDVLHVLYPVDGFDSHIDGHDYLDDCLGESDGQLGRFELVYAAVGDNELLYTCRCDESGDPDGCDGGQHTDDRVGG

SEQ ID NO: 30556 - protein, 142 aa, A.fumigatus
NRTYWVTFYTYYIPSTASIRTSTVTTTSTIVSVKATDSSDASSSFTRLSATMSFYTPAGATNPVTPTDVTAASIPTIVSGDDGRSNGNSGSGGNGGVGISVNGVIGGPGGDLNAANATRRFGWETALTLSIVLGTGLLMIYL

SEQ ID NO: 30557 - protein, 226 aa, A.fumigatus
TVYDEIIPVQTATNRTPANLWLMDRPDLIATFTKIELWRQTQFRKIVYIDCDVVAVRAPDELLTLEEDFAAAPDVGWPDIFNSGVMVLRPNLQDYYALKALAERGISFDGADQGLLNMHFRNWHRLSFTYNCTPSANYQYIPAYKHFQSTISLIHFIGAQKPWNLPRQVLPVDSPYNQLLGRWWAIYDRHYRPVVTVGFDVLYCDTFPSATFIAHDASGSRTLPAE

SEQ ID NO: 30558 - protein, 381 aa, A.fumigatus
SLVYYYIRSLIHRPAVCFGEEHIRSPSILATFDSCKHIIQILQLLDERRLCLSISINRKELVFTSGLGLLWQNTGLKRESKLLKECQKLLTAVIDQLEPESAQAAAEFSSVASLLVSFDSDKRGTSVKNRSMSPPAHKPLKSPKKQLQSLKARSTSDEAPNQATESLSRRATISGTSLGVPHRHLRSPSRVSLPSENYPAPQQSMNRAYYMSPSTTHEHTQTMSSSAPSNAAAGPMSMADWEFVLSDMDHGYSNIFTGIYGGKECGEDSGPFASLTTGCVPTDQSPMPLSASTKDVPGLSPEAWSASSNSDMLPNHEVNPAPQSVLSFSDESINAEDSLPYHDLQLPVDDLDPFRGIMIPAVDDEIDEFGMTHGWDRRLAV

SEQ ID NO: 30559 - protein, 117 aa, A.fumigatus
FRLDVFTKGLKEQGRPLSVISTQALTASPPAISHARIDQAIKTTPRLVSDQLINIFFQEWAPLYPVVHRPTILKAYEKYLSNTESVQGSTHDMVQLNLIFGIAALASSVRNCVWICM

SEQ ID NO: 30560 - protein, 273 aa, A.fumigatus
SVSSPSTLDGSRTRGMFYSQSHSFTAALTGLPVLLREEDVRTEYPEDVDDENVTETDFLPTLPGESTRISSALALFGASRVLNKALEYIFPSDGGYEVVVSKMRSVAEQLDTWVKTLPAHLRLEFSQDKPSTNITSSRSPLLVSCLGRRSQRLCSTLTSALLSLWFIIISVLSFIAPLSALVKSTFGHHRFWLHLTRASILFRSYSCLTKGVFVSRSVSTGKSWCSRLVWGFCGKTRDSNAKVNSSRSARSCSPRLLINSNPSRLRQQQSSAR

SEQ ID NO: 30561 - protein, 120 aa, A.fumigatus
SRTNQDPTFFEDNWSSTLESLANSISISTLQCYVLAQMYCMTKGDYTGLLRYRGLAVGLCHQLRLHQSQKRFSSNPLVAETRKKVFWCQYVLDRLVPRLPWMVRELEECFTHKATVSPLL

SEQ ID NO: 30562 - protein, 184 aa, A.fumigatus
RLQTTENSVYYITHQGVYRKMPSLQQRKLAFIGGGNMASAIIGGLVSQDMNPANITVSEPWDVNREKIAKLGVQTTTSNGEAAANADIVIIAVKPQTTKNVCQELATAWSQRTSLPVVVSIAAGITLNSMKEWLRTNDGRTAHIVRVMPNTPALVKEGASGLLASDDVTAEEKELIGALLQSVC

SEQ ID NO: 30563 - protein, 72 aa, A.fumigatus
LTRISMLTMMLNGNFLDIEQLVQSQQYLKAIKRQLPLIIRRKMVLHMELQWQKIVWVGKEQQGQSSNDQITR

SEQ ID NO: 30564 - protein, 139 aa, A.fumigatus
PVDPLGPLGDKPTDSLAPVNEQAPIPPQKEPFAGRGARPTSSTSRTSSAGGLGDSVHLEEDGAGFRGPPPVQPPVDADGTKRQSQPSISIEEAAKPTFEITVGDPHKVGDLTSSHIVYQVRTKVTSPLHISIHAWDARL

SEQ ID NO: 30565 - protein, 149 aa, A.fumigatus
YAAQTTSKAYRQPEFTVSRRYRDFLWLYNSMHNNNPGVVVPPPPEKQAVGRFDTNFVESRRAALERMLNKIAAHPILQHDADLKIFLESESFNMDVKNKENREPDLGQNKGMFSSFGISVGGGGKFVEHDDVSFLWFAYSQVIKLTRVE

SEQ ID NO: 30566 - protein, 167 aa, A.fumigatus
  UNSURE (154): Identity of amino acid sequences at the above locations are unknown.
WFHDRKIYMDALENQLKALLKAIDVVVAQRKGLAEAAGDFSSSLHALAAVELSPALSSPLDGLSELQLRIKELYERQAQQDVLTLGITIDEYLRIIGSVKTAFSQRQKAFHSWHAAESELQKRKHTQEKLLRQGKTQQDRLNQANSDVADTERXCTRPSCYSTTWAL

SEQ ID NO: 30567 - protein, 63 aa, A.fumigatus
LRGGHPPFDQRLRYFSSAEMTIIINHIREFISKPQIHSQPPIRFFTNTGFLGGGESFFFLVFL

SEQ ID NO: 30568 - protein, 68 aa, A.fumigatus
WWTELCADAHQQNIIIIITLANAAAILDLCLWVILPFFLLLEGVFGPMQLRVCGGTQAHMNRPTTLRF

SEQ ID NO: 30569 - protein, 415 aa, A.fumigatus
TRLYRATSLFLINLSVLIVLCVSPAICTDKSPRAMETTEPIFSAVSSNAHQLYTLLQCIGFVPKATVQITPDGIRFSAEETRVIQGLAFLDKALFTSYTFNPPKTPNNEANDADNHDNTTDTAYYPCFVVSLSALLETLKIFGINEAPSGSFSRAASVQPPNPAASSAFTFPALLLARSCTIQYTHEGAPLSITLSETGVKTTCDLTTYEPEDTDTDIPFQRDGIVMKIIMRSAWLHNAITELGATNPTVLKLSASATREPFFALSGSGGPLSESTVEFSIERQNQNNGPSQTHKVLTDDGSRARAKRAKLAPTVTETFLVSPPSSMGTRINQNYRFSMIQKAARAMAVANKVSIRGDRQGVLSLQFMIEFDNNGHGGAPGGMRSSGASTGGTVTFVDFRFVPLLDDDDVDLEMD

SEQ ID NO: 30570 - protein, 78 aa, A.fumigatus
ERRKYPREPFIIAHSKLDFHLVALLRQRAMRGMNISRRVGLTFTSEAHLFWEGNDPQRWLPQRFIFGLQQTLSEGQQK

SEQ ID NO: 30571 - protein, 65 aa, A.fumigatus
LSFVKICLCMMIAIAIITLGFIVALNGSKKLVQLGFQVCQMVFEYFSCFFTPYRGQKTLSDLSLR

SEQ ID NO: 30572 - protein, 65 aa, A.fumigatus
IVYLRADPSSPVVKTEAFIRAAEEMMTKDLDDNMKIGQNGAEWIIKHALARHKSTATVLTHCNTG

SEQ ID NO: 30573 - protein, 214 aa, A.fumigatus
MDSISSLATSGYGTALGVIRSLASKKALEHAYCTETRPYNQGSRLTAFELVHDRLPATLITDSMVAALLASTKAEVDAIVVGADRVAANGDTANKIGTYGLAVLAKYHGVKFLVAAPLTTIDLGTKSGEDIVIEERPSAEVTKIRGPVDGDHPADIVKLETVHIAAKGIDVWNPAFDVTPSTLIDGIITEVGVIEKEADGQFHLERLFIDNSAS

SEQ ID NO: 30574 - protein, 83 aa, A.fumigatus
SSVFRIGVGSWRVFKSNFAQLYVFDLAQGVYFITPIISSLSGMFSCLYAIIGWLLSFWTAFLWLSGYKTTTLGCPYPAFYYHV

SEQ ID NO: 30575 - protein, 85 aa, A.fumigatus
FENTPRTDANSEYARLTAQQDKCHLLLLSTCMLRGVHVPPILSLTVSEVYKDLHPIESSRSSNSSRLARKLAPPGVAMLGMPSAT

SEQ ID NO: 30576 - protein, 93 aa, A.fumigatus
  UNSURE (60),(76): Identity of amino acid sequences at the above locations are unknown.
FPQFVRNGKTPKVFIPGKPTKKKSWPVRWRVRQLFVSVSQDRTVKIWSTEEGSVVVSFGXHKRGVWSVRFAAKRSXQQAEAGQTHRADATGLG

SEQ ID NO: 30577 - protein, 354 aa, A.fumigatus
  UNSURE (53): Identity of amino acid sequences at the above locations are unknown.
TSSLELSDYSCLLTFEGHTNSVVKVIWLPPSELSIKAEDAEEDDTDASARKIXTQPKPLIASAAADGLVKIWSPYTGEVETTLDNHEDRVWALASPTPSGSRADVKSSPSQKAATPYALASGSADSTVTFWTDTTSATYTAAVSANSARIEQDQKLQNYIRAGAYREAITLALQLNHPARLLSIFTTAIDAADNPYSSDSDKDERVNSLTGDASIDEVLQSLDPSNLRLLLLRLRDWNTNARTSRVAQRILYALFRSYPASTFVELATSSMAKRGSDRRTAAGMRDILQALAAYTERHYRRVEELTDESFLVEWVLGEMDGGVGLLGGPGVSSTSEANGDQVHEHEKDFIMLGV

SEQ ID NO: 30578 - protein, 358 aa, A.fumigatus
LNQKRDDANGGTEPSSPFSRKRRTLDSQRSSRRYSTGTGRGILGVEDIQVHPATMRQEIIAASRNRFDDVSSESDSDQREGDEGDGQPSERTNLLGSKDRATNYTDESDTAYKRQEPIGDDDIHKSHNHAQPKPKEGKHGHGHGHDLNMRGVFLHVMGDALGNIGVIVSALVIWLTDYSWRFYVDPGISLLITVIILASAIPLCKAASRILLQAVPAGLSIDHIKEDIERLPGVIGSHHLHVWQLSDTKLVASIHIQVDTEIKGEGSERYMRLARQVRKCLHAYGIHSSTIQPEFAPDSDAEDTQALPSSSRGSNDEPSGSSKLPSQAPSVRDGDPQACLLECGEECAQKGQCCPKKS

SEQ ID NO: 30579 - protein, 75 aa, A.fumigatus
LFAPRYYYCPVEVSLANDERDGITLPTTAYLYISALLSYSSVTLLYLHFLQHDTLICLSRQNLPALLLCYRALLF

SEQ ID NO: 30580 - protein, 165 aa, A.fumigatus
WQRAETLGALVNGVFLVALCLSIFLEAIQRLVEPQEVKNPKLVCTVGCLGLLSNILGLVLFHDHSHAHGHADDHSNEDIEDVDAAEQGLAHGHGETTVADKRASTATVNTPHPLSTLLWLTESKARRCKRWDRTIFSFLTEAPDSGLSTQFSSVQHGNWTWYLGC

SEQ ID NO: 30581 - protein, 87 aa, A.fumigatus
VVICMSMGVRVVMKQDEPKYIRKEAQASNSANQLRILHFLWLDESLDCFEENGQTQRNEEDTVHQGTEGFRTLPLIQRKRLALLLLI

SEQ ID NO: 30582 - protein, 67 aa, A.fumigatus
HIPLFVILFEIATLYLVRLKHTLFFLIKALAQVLRRLLQGTQHLAPFCNNNRDIICRSIVSCRVWPK

SEQ ID NO: 30583 - protein, 168 aa, A.fumigatus
SVSNKSTDVVCKHGPAECIGDMLILCAANLPFPPEGRSMPRTPTIRSLGFANCLISSYEKIPERSFVEQCALEHGIDFDALNECASQQNDDPGHHGGDKDPLSGIALLRKSALYSEALGVRTSCTVRLDEQVWCVRDDGLWKDCAQGGRGSQISVLVEEIERIWRERN

SEQ ID NO: 30584 - protein, 104 aa, A.fumigatus
HKSHISVEYSNNMVNPNQKTGAETHTDEQKRHFYDSLTEDQKKKQTFGEWVKEAYNDQYEKWMPWLEEQYLKWFGKGDNKASYVAKGKKSPFLIYIRKMTLSIS

SEQ ID NO: 30585 - protein, 73 aa, A.fumigatus
ARLDSLSKSKVSGIKQIDQVQDDVHNLAGNQLGENGFLAPVGYMISIEGIIRAERNGKDDDGSYNGPLGGVSE

SEQ ID NO: 30586 - protein, 82 aa, A.fumigatus
KEQNITPLIFPTTCFIQTLLIMRFLPWAVAILSAVCVQANEWHAYYRLTSDAYQAKFNDLVGQGYRLNSVSGYDRNGQPNFA

SEQ ID NO: 30587 - protein, 85 aa, A.fumigatus
TCLPLQNTSLPGTTWTTTGMFIPAFAILTAYICSINLQHYLVVQLFGYRIHPSIPVKDVNNLRIADVGTGTGYVKLDLLDGSFSH

SEQ ID NO: 30588 - protein, 114 aa, A.fumigatus
RRCNAGDMRYGGVGLHQARVIAIDPVMIQTWAKFLLAIAFIYIFSVILPKLAVLSLYISIFNRHRASRITCYVTGFLMIGNCIGCAAAGFAVCTPLRKLWEPQVDGHCVNINAW

SEQ ID NO: 30589 - protein, 244 aa, A.fumigatus
MAASHTDRIWLTDLADEFPATVQLDGLDVSFDAAPPRDWLPPNMSLHHWDIKAKVPEHLVGVYDVVNVRHFVFVLQQSDMKGVLDNLFKLLSTSDSFYNFRISNSWFTEPGGYLQWTDLDMSSLRVEKINPDIKADANVKLMQLFQANDTRLRTAWGASLPSHFAQSGFTNVKSDVRDAPPHLAVALHECGMLATEVLARNKVGGNEQMVQQLRQTLAEAAKETRQGSVLALTRLTVVGQKPSQ

SEQ ID NO: 30590 - protein, 84 aa, A.fumigatus
  UNSURE (7),(16),(17),(18),(19),(20),(21),(22),(23),(24),(25),(30),(31),(32),(33),(34),(35),(36),(37),(38): Identity of amino acid sequences at the above locations are unknown.
KLGGVGXLFCVGWGGXXXXXXXXXXLDRRXXXXXXXXXNKKKVFFGPSPPWGLYSNPVSCMTKRPTGAPPGLGIPLVKKNRDTP

SEQ ID NO: 30591 - protein, 174 aa, A.fumigatus
RQRAAQRLKPQTGACTTVKIPSTRRRVAPPGFTETLGAPNTKKGNQTPARPRPRLFASREGAKPHKPAVRPEETIPSQTASVRPCRATATKLGRITVGKTKPAEALAPAPAVADPPATLTAQDKKIRGLLKKIRAIEELKMRLASGEKLEDTQVKKIQTEDAVRKELEALGYNG

SEQ ID NO: 30592 - protein, 159 aa, A.fumigatus
VASLSPFAGPGPVKTIIILVEMSTPEQSSPRSPLRAAQRPTRVLACVLCQQRKVKCDRQFPCATCVRAQMQCVPATQARRRRRVPERELLDRIRRYEDLLRQNNIQFQPLHNSVAEQASSSRENRRFDTDHDEKLERDSQKEETPGTETKYEAKSASHP

SEQ ID NO: 30593 - protein, 203 aa, A.fumigatus
TRQTTDASKISVRPQTDPRSLSPILGVAIRIALRMGIHSESSYSRCTILEGEMRRRLWWSLVLFDNRICEMADYKASNLLPTWDCKIPLNVNDFDLQPEMKTGPTMHGNPSEALFAVVRSEVGNFTRRSSFHLDFTNPALKTVAKENPLPAAGSLPAFERMIEEKYFASCNPENPLHFMTIWTTRGQLAKNRLVFTAGVRGSV

SEQ ID NO: 30594 - protein, 160 aa, A.fumigatus
QSEMYDIATQLVMKWARHGPTVPIMVTDDFTRLTLDTIALCAMGTRFNSFYHEEMHPFVEAMVGLLQGSGDRARRPALLNNLPTSENSKYWDDIAFLRNLAQELVEARRKNPEDKKDLLNALILGRDPKTGKGLTDESIIDNMITFLIAGMSCTNLLLTL

SEQ ID NO: 30595 - protein, 315 aa, A.fumigatus
  UNSURE (259): Identity of amino acid sequences at the above locations are unknown.
LTILGHETTSGLLSFLFYYLLKTPNAYKKAQEEVDSVVGRRKITVEDMSRLPYLNAVMRETLRLRSTAPLIAVHAHPEKNKEDPVTLGGGKYVLNKDEPIVIILDKLHRDPQVYGPDAEEYKPERMLDENFEKLPKNAWKPFGNGMRACIGRPFAWQEALLVVAILLQNFNFQMDDPSYNLHIKQTLTIKPKDFHMRATLRHGLDATKLGIALSGSADRAPPESSGAASRVRKQATPPAGQLKPMHIFFGSNTGTCETXARRLADDAVGYGFAADVQSLDSAMQNVPKDEPVVFITASYEGQPPDNAAHFFEWLS

SEQ ID NO: 30596 - protein, 92 aa, A.fumigatus
YAQGPIYRLTTFGWSRVFVSTHELVDEVCDEERFTKVVTAGLNQIRNGVHDGLFTANFPGEENWAIAHRVLVPAFGPLSIRGMFDGMVPDQP

SEQ ID NO: 30597 - protein, 77 aa, A.fumigatus
FFFFLFEYRLVLFFLIFFFRLEEYFYFYFILFIFFFVFLTFFLALFDRLSSHSPSKLLGTHLTGQCLDAPQTGSVFS

SEQ ID NO: 30598 - protein, 365 aa, A.fumigatus
DVGHPFPRGAFLEPISYRTMAQSTVSCYLPNFGATCDGPKRPLSLKLRTDALQSSGLLSAWREGQLTQLLQASWALILHRYTGSEDICFGYHQIGNVSQDLLQSLEAVDPALCKVSVKEGISLKMFFDQFKTHNSPDSPLEIDRSSRKASENARLYNTILMIQICHDSNGTSPAIPLPSSLPIALPQEVSTERLVLYLPVQPSETYLQSRVRLHVKVLQDEVNIFFEWWNNDMPTAQMKSIAGAFGHILTDLLAANDTAVDDLDIFPENDWSRVCSFNSVLPKKHERCIHEMIYDRTLLQPENEAVCSWDGSLTYKELDLLSSKVAYDLQQRGVGPEVCVALCFEKSVSAAGQMIELPAYRHFII

SEQ ID NO: 30599 - protein, 125 aa, A.fumigatus
GRSTNLTVLLLTAGDAINATQWDAALAKVNDLIAQTSLTEKASIVTGTVGFGELCLYDGPQGLHFADLRSVFPSELAAAAPWDRCYLDGDGERWEPSFVAKVPMLCLDESTYSWKIGRGANRGSI

SEQ ID NO: 30600 - protein, 166 aa, A.fumigatus
AGLPRVRYVRLFCDAFWTVRHQRRSRPKYARLSIGGCFQPFILPMWFPGIRNGTIPEWRLNEMIRQILTPYYYSSQDHEYPTIDPSSYAVTAATYGILPAGEVTPAGRDVRGNHSLLIRKIGSAGTVLLKNKDKTLPIRPAWVIGVFGNDAPDINGGLLPEQQLRA

SEQ ID NO: 30601 - protein, 65 aa, A.fumigatus
CCLYLSQNCHYHTLGWCKYNVLADNENVTAILAAHYSRQESRNSITDNPALITLGFYKNQPIGSR

SEQ ID NO: 30602 - protein, 74 aa, A.fumigatus
DVELTEALSSPSAGSLGRSPLVLGGGRVTGKDSSLILLSGVAMQESIRSAQAVGMQACAKHYIWQRTINPSYES

SEQ ID NO: 30603 - protein, 82 aa, A.fumigatus
LQQSQADVFLRKFSLLKKNMRDELDFQGYVMSDFFATHSGLFAINAGLDLNMPGYLSEAAFNHSYFQCGFLVFVMELFLNGG

SEQ ID NO: 30604 - protein, 114 aa, A.fumigatus
KHAQGMRALAWFYLTDKKLIVEGNFNSIYPRPDICLVFPQDPSPGWNCWQSLEADWNLILVVNNVASICRRTVIITHSDGVNIMSWQIMRTSLLFSQRITLGKSLEIPSPTTQP

SEQ ID NO: 30605 - protein, 285 aa, A.fumigatus
  UNSURE (166),(170),(174): Identity of amino acid sequences at the above locations are unknown.
RSVDKVHTPFFKAKPPSTVCTCVAWLSPTDIAVGCANGFVAIWSITASEETPTASLPYFYEPIHRTYILNLASAYPTHPHLLCTTSMDGETRLTSIADYQKDTVETTRMRMASPHAAYSPLLHAFISSDENDFARLLAVRRFFTTTAMARLPSTVSALAPCSFWHXSVLXGCAXGEVIATNPIRRLVHPKEKQWQQTWFTHEWARGQDADSAGTSRFIDGYRAESFSLLRNMVGDRRMVNGTMMITIFDEPRHVTALTWNPNQLCAGWASAGLGCGLIRVEDLAI

SEQ ID NO: 30606 - protein, 76 aa, A.fumigatus
GLISFHGGLIDAGGALMLYSVTHVEVMGMCALCQRAMRTMHANENVDKILFHVLLCLALSLTLMQAPEQIRTAASR

SEQ ID NO: 30607 - protein, 223 aa, A.fumigatus
PGTSILHPRWTLKGHESRNESPWEFFTTSAVTVFSYSLPTVMSDLPIPSWLDVSTASFLSTPEDTTDTLDPRSLFPDEQVANNAPSYDNGSSGILCNASNALFADPLLYEDSFLPSEIDRQPPVQFQAQPTNQMPPSLVASSPGFRTVSGGRGFRREMLQLESAPPRTITPSDPYLPTKPAAAEQCPASNHTKATVKSNGSTHSAPRTRKRHASIRSQLSHGN

SEQ ID NO: 30608 - protein, 180 aa, A.fumigatus
SAPCLTSATAISKCPAAAALFNGAQPVRSGVVTSAPLARSSSTTARWPSDAAALRGVHLFADACEVSAPWSRRMRTTSVWPSFAAQYNGVAPTSPMIALTSAPRLMRVSTISAWPSEAADASGVHPLVVGKLKSAPWSSKYFTIWRWPLFAATFSGVHCFGCVVSDMFTPCSTSTFTEPS

SEQ ID NO: 30609 - protein, 640 aa, A.fumigatus
  UNSURE (6): Identity of amino acid sequences at the above locations are unknown.
KQSLLXVLDMEIKDLEAAVQSLKKLSIVSSGEIAERQNMIVAMEGLISSAKSFNTFMSVAPSAPTVNQEDGHGSAPLPSYAQAMAPDDGAESEDSAPWPSPFNVAAREGNLEEIKRLVAAGEDILATGEIGQSPAYSAAVSGNTEILEYLIEHGADYTSGNENGFTPLNAAATFGHPDAVLALLHHGADPNVPSVDGQSPIYSAAKLGQLGSVKVLVEHGVNISDTTHPKQWTPLNVAANSGHLHIVKYLLDQGADFNLPTTSGWTPLASAASEGHAEIVETLIKRGADVNAIIGEVGATPLYCAAKDGHTDVVRILLDHGADTSQASANKWTPLNAAASEGHLAVVELLLAKGADVTTPDRTGWAPLNSAAAAGHFEIAVALVKHGADHAVADSRGHTPLYSAALHGHHAIVDLLLEAGASINVTNKDKWTPLHAASARGHLQVVQSLIACGANSATRNMDGWSPLNSAACNGHLEVVKLLLRHGAAVDSRSDDGWSPLTAAAGNGHTAVVEALLDRKTDIETSNDIGWTSLGIAAREGYPETVKVLLARGADKNATNINGWTALHGAVEKDQLEVVTLLLAQGLDISAKSNTGWTPLNIAASNGRATIAQFLLASGADPNTPQDVFTTGLEGPTRSLS

SEQ ID NO: 30610 - protein, 78 aa, A.fumigatus
AVIGKYSVKRYTYLSIYRRGGPQKKNGSSDSPEYNLEVPSRDASATNKYMEKSKFGGFLSLDLERMDGSIWLKQSIKP

SEQ ID NO: 30611 - protein, 286 aa, A.fumigatus
PNHGLSLMRFLVSGNSWSRSGQLLASGSDDLHLNIYSYQPESSSAPFTLNTTVYTGHKANIFSAKFMPHSNDRTLVTCAGDSQVRVFDIEYSAGNSNVAATSAFSASARSRRFNNFFSNARYLNERNTNCRVYRSHADRVKRIVTESSPYLFLTCSEDGEVRQWDLRQPSSAYPQPRGGQGFMAYRPGLEHDDSNVPPPLISYKRYHLDLNTISCSSSQPHYIALGGAHLHCFLHDRRMLGRDLLAEKGHPGGLSDSGSHHDDELMGQATRCVRRFAPDGKRRMRP

SEQ ID NO: 30612 - protein, 370 aa, A.fumigatus
RAVVTVKKSQGDVNAAADILCELQVETFGSMTRREKTEFILEQVALCIERGDWSQAAILSRKINKIYFARKPQKSAEEIEKLKKAAEEREKTRAPDEPPMEVDEDVTDLKLRYYEQQIILANHDYKYLAVCKHYREVLDTDSVQNIPEQLRAVSRYLPCLLMWTLTIITKVLARIVYYIVLSPYDNEQSDLLHRIQQDSRLSLVPVEARLVKLFTVPELMRWPMVAEQFGPHLCNTDVFNAQPSQSVEDQAHKRWQDLRKRVIEHNVRVVAKYYTRIQMGRLTELLDLAEEETEKYISELVTSKTIYAKIDRPARLVNFAKPRDADDVLNEWSSDMKSLLGLLERIDHLITKEEMMARILPSRGEIGKAR

SEQ ID NO: 30613 - protein, 293 aa, A.fumigatus
HILLIMAPRQPLKLLMLHGYTQSGTLFHAKSRALIKHITKAFPLHEVSAIYPTGPTRLNPADIPGYEPPAEGSTVEQQQEQIEAYGWYRRSNTADPPLYIGLEGGLDAIAKVLREERPFDGVIGFSQGAAMAAMVASLLEPGRKEAFEHFADPKVASEGFEVKEPVAGVAFPASFEEAGHPPLKFALCYSGFRSPGPRYRPFYENPPIQTPILHVLGSLDAVVDDTRSRALVEACAGDPEKEGKVVWHPGGHFLPSQRPYLDAAVRFIKEQLEGKQAKADAKEDDVRDMDLPF

SEQ ID NO: 30614 - protein, 176 aa, A.fumigatus
EVLPLRQGLLQLSGVNATAKMSKSPTEHVELSPTKLENASDALYEAYASKGPEWHQQMTRRLLRKVDLHLLPFLVVMYLLNFLDRKYASVSQHKIKLTSLKQSLTSATWDIGKGLGDDRDRLQPGDEHSVRRIPAHAAPVQSAADAREAVVAAGWRNGDLVCSLMVLSNRSDQPGA

SEQ ID NO: 30615 - protein, 145 aa, A.fumigatus
LSSVMRINVFTILSLLFASNLAMATTRYTEPIPEGIPVLETRQQLNDMADQYPTGTLDDRNGGYYLLDHDGAVLAVTSDALCEELDASMEQARRFHAGNLDDEADVVPRGDNAAASCSHPRCHTHALCRTYSDCYVCSSSKHWCF

SEQ ID NO: 30616 - protein, 129 aa, A.fumigatus
  UNSURE (99),(102): Identity of amino acid sequences at the above locations are unknown.
SNLSQARLGTLEKDLGMTGTDFNLATSILFVGYLLMQLPSNLLLTRVKPSWLLGGAMAIWYVPSWFCRIGLTSQGHNIRSSCGNDLVHRLGSGEILPGXCGXAFLPGGDHVDVRIHLKPRKRKLPVLML

SEQ ID NO: 30617 - protein, 153 aa, A.fumigatus
ESTSLPSCPFSSPAISPWLQPDTPSRSPRESPSSRPASNSTTWQTNIPRGLWTIETGATTCSTTTAPSWPLRLMRYARNWTPRWNKRGDFMPGTWTTRPMLFLGVIMRLRVALTRAVIPMLCVAHIVTAMFVRRANIGVFDYGLVLPLGEVDV

SEQ ID NO: 30618 - protein, 72 aa, A.fumigatus
TRLAQAGYEVAIVEAGGWYEDSEPIISSTPAFGFANNAANDWGFMVEPQPGMGGRVFGYPRGKCVGGSSARK

SEQ ID NO: 30619 - protein, 163 aa, A.fumigatus
TVTGFIQKCHYQTSYTYIKARLVGFGRPESRLEYRTLHSTSFQSLHFSILRNKRKTSEISIMGSLAPTIVPPGGLVLVTGVNGFLASHIGLNLLERGYKVRGTVRSQEKADWITEAIAKRYPEPSFQTALVPNISAAVGLQRCHPRRQWDRPRGQRTWSFGER

SEQ ID NO: 30620 - protein, 64 aa, A.fumigatus
EETPSGHNPKVDIHQYKWHVMLGSQRSAVGSPARNVKRISGEAQSKDMGKGALLGAGAFSGLTN

SEQ ID NO: 30621 - protein, 121 aa, A.fumigatus
RPWFFRPAKPRPSPPKTTFFQGKAPGPNPGYIPKVSSNPDFPQPNTMRVSSPIPLRPPIPNTYLTPVQIFDPQSAVLTNIEVLAYITANPPRRPPNPPPNSRNWVPSPDLRDHNTVVREVG

SEQ ID NO: 30622 - protein, 424 aa, A.fumigatus
  UNSURE (16): Identity of amino acid sequences at the above locations are unknown.
KKYGLVKDYHPYRKGXEEALQKYSQRVLFAAGKECFPNMTVDAGCVTVPQSSLPPDAYGWKTDTHPEGHLTRPRWLKPGTVIGQAADLKLIYAEVLRFVEENRHNRSDYLALTQMYGRQEYVRELERRRSSNWFNEWVYRLIGISEAANITGVNPHLETGHRYEYGIGVDFESRVFFNTHKSKKDVEWLQYHDIPRTSSVQMKHGIPRERRLLLPPDLASPRLRNPFVQPLFGKDEQVKPEFNSTLDALPNPRNHTWRNMPLLTNIHSASVPALIHLDEEKPAEDDKAWPVKHPERLIRDTWWYNMWYQPWARALLRKYMRSPTGFDAAQSALLGGQDWWDLRGGKGGVWTDKGEWLDYAEVCTGFEGEVFDDDLGQWGHEGGDPDEPVYNQFGKLVKGKGESEDKPGQGKDDSADRQPGRPQR

SEQ ID NO: 30623 - protein, 240 aa, A.fumigatus
  UNSURE (33): Identity of amino acid sequences at the above locations are unknown.
GPVRLRPFGKAPRIQVMGRLLNLFFREGVRPLXLLKNTWSCQGMEAQPSKWLTTSKSETCLDQRTTLFGSRYADHDEFTPQFVGGTVYQAFLSALSYHRWHSPVSGKVVKASVVEGTYYSDPLFEGVGDPSPHQIDLSGQVTAQEYNSATATRALIFIEADHPAIGLMCFMGIGMCEVSTCEITVKEGQHLKKGDQLGMFHFGGSTHCLLFRKDVKVEGFPDPSRGQNVPVRSYLAKVQP

SEQ ID NO: 30624 - protein, 278 aa, A.fumigatus
  UNSURE (220): Identity of amino acid sequences at the above locations are unknown.
NSVGKWMPSSHAAHLEWLGGVITHVDKNTSHQLHPVLQEFKELIETNSRVYLLISAMFAEIPRKRPYRTDPTGCAQIRDYHHLLQVLNYLLTTAPSWNDFSHRVGLVGLPINAVLDWSMGTPSGYAAYLDPEINRMVKKILSAWGDYLKSPKSASVLNDTSSGWFGSTARSDLEEVGNVGETSHSFEDLYVCDPSAKHHGFKSWDDFLTCFFARGSDRWXCLRIHGPAKAWRRSPPSGSQRQRARHVWIKEQPYSVRDMLTTTSSRRSLSAELSTKRS

SEQ ID NO: 30625 - protein, 98 aa, A.fumigatus
DLRSGLSTTLLGSLVAVGSSEVACHGYCRYSNTRVFSFVLRNTIIVQVYLKSMYEVRRMLLSAYKLVFPLDSYPISRTTNPPTTNNPPLTYTGTLVFR

SEQ ID NO: 30626 - protein, 86 aa, A.fumigatus
RRTGASLVFNLDVTQWRSADENEGKGDAMDGFIWVSFSHGHEKEEQRWKGKARCAAVALAGLQCLEYQQTQKGIITIFWVEPLVNV

SEQ ID NO: 30627 - protein, 62 aa, A.fumigatus
TASPAPNAASPSSASDTKKLNTEIYVADGDYIKDIEINDLRNRYTLTKGSTQKMVIIPFCVC

SEQ ID NO: 30628 - protein, 64 aa, A.fumigatus
NPPLYLHVTSTTKEGLEKAVALIDELMQKELPNLVDERRFRRREPDQVERDEYGRVCSRSLVHI

SEQ ID NO: 30629 - protein, 77 aa, A.fumigatus
EGANCVQRKWPEERIPVDLEPIPGFNLRAQVVGQGGAYVKHIQQKTRCKVQIKGRGSGFLEPSTGRESDEPMFLHVA

SEQ ID NO: 30630 - protein, 154 aa, A.fumigatus
VCSAAWILPRLTDLTLAADFGFCAKLTESKSKRATMVGTPYWMAPEVVKQKEYGPKVDCWSLGIMAIEMIESEPPYLNEEPLKALYLIATNGTPRLKKPEKLSRELKSFLSVCLCVDVNSRATADELLEHDFLKTGCSLASLAELLRWKKNSGQ

SEQ ID NO: 30631 - protein, 88 aa, A.fumigatus
LPRKAEHSPNNTPWEDCLPLLQNPLPSIQSNAAPSSNLLLLPGSPTNGKAALLPLPGKNKYNRGELTLPNPPSLNFFGIPAKFGKYNH

SEQ ID NO: 30632 - protein, 78 aa, A.fumigatus
VWRRNRNQLQGSNQLVWARSKPLSRLTNLDMTSAIQKDIITLDITMDNILTMKVGQTLASLGTQSASQQLPFRYFLHI

SEQ ID NO: 30633 - protein, 109 aa, A.fumigatus
LVAPTSTSSGGRYEVQSVGRKGTSKRTDNEAPQMRKSLGTTRATTDEDVLEKWDEGLSDDSNSSSNDEDTIETQGILPENRPSLVSFEVLNAFRELKDQFDEKFHAIFA

SEQ ID NO: 30634 - protein, 127 aa, A.fumigatus
CLKLQKSCIQDTFDTASQLITYLTDMNPSGSSSIGGNRSEESTPRRVSGTVWHPAREWLEQDEEEDDMDYEPESEVTEDRDEDGYENEDQNEDEDEGHFGSFARNGLLFLSYETNLGSNDLKTLTCV

SEQ ID NO: 30635 - protein, 145 aa, A.fumigatus
VLDLLRRKRSFVLIWWASQDLIPGSAADKIIHYDSRCYSGQFSDDGNFFFCCAQDFKVRMYDTSNPFEWKYYKTVDYPFGQWTITDASLSPDNKFLAYTSIRNIVCLAPTDPADQSDPSVLDLSLGRVGRGFHDSSHSAVRIPIK

SEQ ID NO: 30636 - protein, 89 aa, A.fumigatus
STTLHSTITYIFFLNHNTFAYLENGSPDESRHPTNSRTHSLKSASVEASPHSFQQIFSEIVDKIPKIKEFTELIYENITRKMVHWSVSH

SEQ ID NO: 30637 - protein, 67 aa, A.fumigatus
KLLFWAKTMIYVLFDYLGAMDSCSLLMCDAFSLRTILMYMQPNKDMVEDIDIIKRDTPAFDQKLSFP

SEQ ID NO: 30638 - protein, 270 aa, A.fumigatus
SERTQLHRKNMMPAFTVPHVRKLTSIFWAKAQEMVRCMSNELRADSFARIDFREYMSRATLNNIGLAGMGHDFQTLKQPDTDLRSHHRKLILDPTRVFSWVGLLSRYFDMRLLMRVPLKKLIEISQSAKYLRELTTAVIQGRREQLVVAENNRGKDIITVALAGGVFDEHHVVDHVMTFLTAGHESTATAFEWTMYELGRRPEMQSRLRDELRATIGTDLAAVNFGLRVQNLPYLNAFCSEVLRCYPLSPIIVKSHQRNFHQTAPRISGR

SEQ ID NO: 30639 - protein, 114 aa, A.fumigatus
RRRILTGNYPVLFPDNAWVPLRELAETTPNDGLLRIYSALSGEALLVTSPPAIRDMLTVNAFDFTHQDLVKIAIRRFTGSNLGFLSNDEFKACKQHIAPGLVADQREHSSIAKT

SEQ ID NO: 30640 - protein, 231 aa, A.fumigatus
  UNSURE (26): Identity of amino acid sequences at the above locations are unknown.
CLLDSQQHIKHWNFVANFPVFFLFLXLIYFPTMSELPSSQPAIIESDDGTLGLRNDVQMPSLEDDMILVRNAFVALNPIDTKMVGKLASPGAIAGKDFAGEVVSIGPKVQTAAPIKPGDRICGAVPGMHSLTPAVGAFAQYVGATDLTAIKIPEYMSLEEAVTLGSGIGTIGLALFKSLDVPGSPWLPADKPVDVLVYGGSTATGTLAIQLLKLYVTVSVCYSLRSKYLLT

SEQ ID NO: 30641 - protein, 148 aa, A.fumigatus
PSRSGVNPITTCSPTKFDLVKSYGATAAFDYRQKTCADDIRKYTRNSLKFVLDCISEPETMQFCYKCLGRWGGGGEYTALEPYRKFVHTRPKTVVPDWVLGPTLLGKRLNWPEPFGGEGNEEYRRFGFKWFKLVQELAGSREVEDASA

SEQ ID NO: 30642 - protein, 282 aa, A.fumigatus
RIYSPARSPRMHPANTKDPIWATVESSAFFIRDHHTGNEIIIFGDVEPDCVSLDPRNKRVWEAAAPKIATGKLRAIFIECSYDDSVEDATLYGHLCPRHLIAELTLLAGKVMEARHPRMAISSIGKRKHSDSNRYGGSGGQVSPKSKRFQSFSVAAGKRADMDSVTVDMRPRFYSTAEGLAEIPELVHDEPTPSYHEPDDVSDTENSVDPAPQSTSPGEAQTSDSGQLPLSGLSIYIIHIKEDLTDDIPPRERILQQLRSRGEAARLGCEFYAPHRGEGIWV

SEQ ID NO: 30643 - protein, 139 aa, A.fumigatus
LTSCLMKGPTGGPREDSLTGLLVRSTSTNWSTNSVIAVDAGTLVSGIIHTLEQYNAELRDGSYMMNEGPFAGLRMPYKSAQANAAHIFRDIIGAVLITHAHLDHLSGLAINTPMLEAGNGPKPLAALPVNCRCHKKPYA

SEQ ID NO: 30644 - protein, 191 aa, A.fumigatus
TCALSRIQIPWPRASIKRAGINSFGHGGTSCHIIIEDAQQLLDARGIIPHGRSFLSTSTSSWMDEDDDEDHAASQSTPCTSHILLISAQDPLSLRCNEREILRHLASLDVRVDLGNLAYTLSHRRSHHCHRAYAVVTSSALSQARFVDGKILAREPRIGFVFTGQGSQWPQDGDCTHQIIPRSCEAHQAPG

SEQ ID NO: 30645 - protein, 146 aa, A.fumigatus
PLKRMRRSGDKAEMDPQTISKYFIGLEDRVHIACHNSPTNVTLAGVLSALEEVQARLRQDDHACRMLQVDIPYHSKFVAATAEAFEQFTLQERPLVQELGCSGGVTNAVDRHWQPIGGPDLQQLILESQLGVSSFIPSRNGSYPPS

SEQ ID NO: 30646 - protein, 118 aa, A.fumigatus
AAAEASQMLSTVTGSRLEGRTCNSSYWRANLESPVLFRHAMEAILRHDQHPDILIEIGPSDTLRRPVMKPKHSLGQGDGPLKDTDIQYLSALHRGDMSADHMLHIVYTPGMEVLSPPG

SEQ ID NO: 30647 - protein, 101 aa, A.fumigatus
NCTDELTHARDPEVVRRPEFSEPLSAALELAILAVMENHSVRPHWVVGHSSGEIAAAYVAGFLPLEDAIKIAYFRGQAAQGACDTVKERMGMTPEAHEKER

SEQ ID NO: 30648 - protein, 72 aa, A.fumigatus
LGVPGIEPSSMDNTILIRPDSPDVASESPRLLFIYNAGEVNHLNGYFVVEDLTEPTMSGSSMLVFTHSTAPI

SEQ ID NO: 30649 - protein, 459 aa, A.fumigatus
LAMAISATISGAHAILLATQFCATGNVVHLPLLHAQFPSYLSLERLLRIILTFLPESIEPQAYTSVLQELVSGSSIGPTEGDVDVSAVQDLPETVARKRVRKLRLLPLRHPDDEDSEPSDLLTQFLIHRSHRIDSETGLQPLILDLLLPFYQRSTTVRTWLISSILPLLRLNCEYYPSQDEMFSLNTLESMDDATAVNVLLSMTSPRKDKMDIARNLRGLVGAWIYGSNRAKRRRLSEAANQSAISLSPDNHRPKTTTDSIWQQVNEWLLSHSLVEHDTTVNAFVHWDGPGDVDLGGYEEENQQPTQDELTEMRTRYGQTGLAVVYANPDTSSSSLGRFNADCCEGGSVTQSPGLSVCSPQGFSAPFGDFRCGRDPVHIKSHIVTKCLTTEFESVDASVCFVGLVLERTTSLFAGAAWNGRFNTLQASCKPVLAQHRGHATCRASQYGWFGCQAGHSWS

SEQ ID NO: 30650 - protein, 140 aa, A.fumigatus
LITYLAPCNGDCATVDKTTLKFVKIAAQGLIDGSNPPGVWADDEMIANNNTATVTIPASYAPGNYVLRHEIIALHSAGNLNGAQNYPQCFNIQITGGGSAQGSGTAGTSLYKNTDPGIKFDIYSDLSGGYPIPGPALFNA

SEQ ID NO: 30651 - protein, 100 aa, A.fumigatus
TTQMTAATANFYSSYGGYLVNQYPYMSNPPDTIAWSTTATDLGFVDGTGYQSPDIICHRDAKNGKLTATVAAGSQIEFQWTTWPESHHGPVRRRREENIM

SEQ ID NO: 30652 - protein, 231 aa, A.fumigatus
  UNSURE (172),(203): Identity of amino acid sequences at the above locations are unknown.
PTSCTHITGRTQPLRTATVGASGHARITYPSEWTAPLRTGQSSRASTPPKSQRCTKISRPHPTTCCSGSTTSTTPSVCTPAKPSSSTSTMRITPAPRRLKPSSHSGSRSENALMQSATSTSSLASSTKRGIRSSGVTPSTTSTIISRGSPTKSSEWDTTPGVSKRRTCSSMXTCHTPLVRSRPRPNTLLSSLHQMAPPEQRAXRWTSRQARTIWASTTTICTGASLTGRCI

SEQ ID NO: 30653 - protein, 378 aa, A.fumigatus
SFQPRGEDLDRNSKMVCTRILGKHASVKSTGCSTDSSIIVGTVEAYRQVCNAGRQVPQLDVDGFWLSIREKSVLIVGQSERGALYGAYEYLSMLAQGNFSQVSYATSPHAPIRWVNQWDNMDGSIERGYGGPSIFFKDGVIRQDLSRVQQYARLLASVRINGIIVNNVNANASLLMPSNMDGLARIADIFRPYGIRVGISLNFASPSTLGNLSTYDPFDSSVIAWWGNVTDQLYARIPDMAGYLVKANSEGQPGPTTYNRTLADGANMFARALKPYGGVVMFRAFVYDHHISEDNWYNDRANAAVDFFKPLDGKFDDNVVLQIKYGPIDFQVREPASPLFANLFKTNTSIELQRNPGESPTAVTSGVLASTLANDPGV

SEQ ID NO: 30654 - protein, 484 aa, A.fumigatus
  UNSURE (353),(384): Identity of amino acid sequences at the above locations are unknown.
TFSSRLMANLTTMWYCRSSTDPLTSRSASPPRPCLPTCSRPTHQSSCKGTQENLRQQSHLVYLPPLWQTILGFDLRVDQKPPLVRDIISGQRFDRPLGGWAAVVNVGTNSTWLGSHLAMSNLYAYGRLAWEPTLDSEDIVQDWIRLTFGLDRRIVDTLTQMSMESWPAYENYSGNLGIQTLTDILYTHYGPNPASQDGNGWGQWTRADHLSIGMDRTVKNGTKFSGQYPAEVAAMYENIETTPDNLLLWFHHVNYTQRLHSGKTVIQHFYDAHYTGAETAQTFVSQWESLRERIDAERYQHVLTRLIYQAGHSIVWRDAINNFYHNLSGIADEKQRVGHHPWRVEAEDMQLDXYVPYAVSPFETASKYTAIVTASNGTTGTASXTLDFKTGTYDLGINYYDMYGGKSHWTVYLNDRVVGQWQGNSEDVLSHTPSIYLDGHSATRITFRDVKIHKGDRLKIVGKPDGVEPAPLDYVVVLPQGIVD

SEQ ID NO: 30655 - protein, 125 aa, A.fumigatus
AAYKLPYTSQMMAQLMQQNQKVLLLIPCSITEVLLRIFDHESSSGRRCKGKQRGKEDYLAGVVKLLSSAWCTIHHIFLFRCLCKRREYVHRCIIFYAISKLGSYSPITLQTFLMGTSQLRDRTQL

SEQ ID NO: 30656 - protein, 151 aa, A.fumigatus
CRSFLQGMSVLGSPHSLRPGMQGAFPSSSDRPNVLIMSCLNTSRIFAILFRPPPSPPLSENSIMYLTQSLTLVSLATATLAFQIPDSKPPSTKHTDDQTTSPVVRDIFQFPDNGSFIDNIAVRPDGTLLLTRIDVPEVWAVDPQTGSGELA

SEQ ID NO: 30657 - protein, 281 aa, A.fumigatus
SFAQQSSDSDSNSNSDITAVFGITEVEHDVFAVVAGKFALEGFAAEQGSFGVWKLDFNDNSNYDVLELPWWGEGKFPLTRNTPSEVSKIVDIPEAKALGASTLYKPRHDARYLLISDSPDGMIWRVDLDSGEYAVALQDESMLPAPDAPPMGVNGIHVVGEYLHYVSVTKKEYRRVKIDENANAAGPFELITSEIDPDSFDITDDGTAYFATNPENTIVKYTPEGEIVDFAGGKNSTVLPGPTCCALDKKGQTLYVGTNGGLMAPVGGTYKEPGKIAAISL

SEQ ID NO: 30658 - protein, 109 aa, A.fumigatus
IHPAYSLFFSVHLHHHHSLKIPSCISPRASHWCPWRQPPSHSRSPTPNHPPLSTPTTKPPAPLSATSSNSQTTAPSLTTSPSAQTAPSCSPASTSPKFGPWTRKPAPGS

SEQ ID NO: 30659 - protein, 133 aa, A.fumigatus
VARISNRVGSDSAYGDVAGFLVADTTNKLLVVSFRGSRTIDTWLANLDFGLDSISDVCSGCAVHKGFWKSWEVVANALTTELNSALATYSGYTVVFTGHSFGAALATLGAATLRKAGIPVELVSHPLSNQVRA

SEQ ID NO: 30660 - protein, 101 aa, A.fumigatus
LKYGYGSPRVGNKALATFITGQGSNYRVTHTNDIVPRLPPRVFGFSHISPEYWITSGDNAPVTTSDVTVVQGIDSSGGNAGEDSTSIEAHNWYIGHIDGCQ

SEQ ID NO: 30661 - protein, 62 aa, A.fumigatus
PTTGAEHLVATFKGHGGNLSGYLDSIIKSLHILRQIYLQPMQKLIFIRWKLKQRTVYIMPII

SEQ ID NO: 30662 - protein, 100 aa, A.fumigatus
YSWPQPIGFKFPLDLLQRQSGTMFTKKSIVTLLGGLSVALAQTSSEQYLSLSEIEAAQATVLPHSPVSNVKGLAFDRFVNIWLENTVCDSLLNSNCQGLR

SEQ ID NO: 30663 - protein, 508 aa, A.fumigatus
RSVLRTSFCVLGLPSTDLDGAEFQSLHSMIFQLSSKVIIGRRRNAVSQAEEAKLQQTSLLVIRQLLQGPGGEEIAESGIDSFLVDQLSSVLDEGGSIELQGAIIDTLLSALKVRFAQAYLPPPPPRPKHQRAQSRERLTSPSLLSFTSDKADRGALPPVPPQPPSRLLECLLKGISSKSSRDIVEKWTLLLCEVLPLYSGSLFQILLMLVECFCKEIQLSYTNLQLSFRQTDGWPEDRSEHVTITLLTGLETCIAAAHERLLVEEANVPAAKSPDHAHGFFGNMVSGVFATDSNQGRSTAANNRLTVLLCFQDAVRLCFSIWSWGAVERSGPPQDPESLASFQYTSLRMRNRSRRILEHLFTAEALECLETMVEMWSRADPDTSPLILSLLHTLDGSRPKITIPAIFNAIYTRTNPAALEPHRKSALTSNLTESELAGFLVTYARSLDDDVLDEIWTDCTTFLRDVLSNPFPHRQILPRLVEFPAILGAKMENTTFRQQSNDEKGPRG

SEQ ID NO: 30664 - protein, 89 aa, A.fumigatus
GLYRFLISLRVFRIVILRLENLLLRKETLSENEGDNVVISTDDYKECNYLLRTIYNTLCSLSPNGWMSLLTQTLNPVDKQKDGASEGQF

SEQ ID NO: 30665 - protein, 217 aa, A.fumigatus
RVIATVTYRSAREWEKRFGGKRADASKQPALCPDFLIETYLDHAGEKFCLEYDPNSLLYVSKAMDLFDLSRSQRAETEKRRREFEARIAQGGKTLRYNDASCSLTLPEKPYEEQPSTTDSGSSADEAVATGKQPDTPPADLVAGLAPLKNHPVLVMGVASDILFPAWQQREIAETLRAAGNKNVEHIELGEDISLFGHDTFLLDLKNIGGAVERFLR

SEQ ID NO: 30666 - protein, 599 aa, A.fumigatus
  UNSURE (535),(548),(568): Identity of amino acid sequences at the above locations are unknown.
TTAPTGGTAPPGGAAESPITTVPSGGTVPTGGAPHSPITTAPTGGTAPPGGAAESPITTMPPGGATHSPITTAPTGGAATGSRPGTSSAGGIASTVPPVSSPTGGGVPTSEGPGFSPAGGGVPASASNPFTAFVPPSESPVASKVGTQACPPCPTPAAPTCAPCPAPGTSTTTFTVTITETVCTGQVTQGGGGPTASPGVPAISPLFSATGPGALTSTAAGPGGPQGPTATETHLSIAPHAPGGAAGATAGPSTQPTTSATGVPSVPQIPGGGGGGAAAGPATSLPVTSATGVPNIPHGPGGGPSGFPNTTSSQVVATTTETIGSTVPLSTHGGGAATSGAAQTSRLSVTTGISFANVTRTPSGGQTGLPSVTLIPAIPTGPGISNVTGTVGGGVSVSTPTSATISATPTRPGGTAPPGGGVPISTPIIATSLATPTRPGAVSTPIIATSFSTPSGPEVAPPAGTVVPGTAATPGGIVAPGGGVAGGGTAAPREGVASRGAPAPGGGVPTVVISGGRSTATSTTTIQVQTLSVFXSGLPFPQSQGNTXTRPVTTSTVTGVRPPQSTPXIDPKKRTVAEKTDIGRPDKLKANPIVFRRRT

SEQ ID NO: 30667 - protein, 70 aa, A.fumigatus
IWAGEVPMLRTTGFDLICVSVFFFPIPLLRELFWHVRYVDSNTVVTEEEMQKYHIARTAPFFLYPTARAL

SEQ ID NO: 30668 - protein, 261 aa, A.fumigatus
  UNSURE (37),(57),(70): Identity of amino acid sequences at the above locations are unknown.
DGHFQVRRRNTIGFALSLSGRPMSVFSATVRFFGSIXGVDCGGLTPVTVLVVTGRVXVFPWDCGKGRPLXKTDNVWTWMVVVEVAVDLPPDITTVGTPPPGAGAPRDATPSRGAAVPPPATPPPGATIPPGVAAVPGTTVPAGGATSGPLGVEKLVAIIGVETAPGLVGVARLVAIIGVEMGTPPPGGAVPPGLVGVAEIVALVGVETDTPPPTVPVTLEIPGPVGMAGIKVTLGNPVCPPLGVRVTFAKLIPVVTESLEV

SEQ ID NO: 30669 - protein, 531 aa, A.fumigatus
LRGGREDHIQSSPDSASKGRRRHITQEGAIGSAICQLPQHGGDALPGSAVVRSSSRWYNYAGQGTMRPSLDVLRGLLVQLVFDNNMLRAAAMKATADTVFRLSGLGAGGTSPILVGPSIPVQPDAGAHDQGTPREAWGLKSGLYTPRQLVEGFAPLLDTVVFRLGPDPPNARPARAQLLDNLAANLDINTREATLRFPDTDLDASRQEIAEQARRIGQTLVQYARNHTGGPFNPDLSLRSPCEGHLLIPPNVDLMFGRRSQSHLMQLFNEYMHQMVLLRDALLPFQNYEDVIIPVDGRAARGIRHLEPSRSEFLTHLLTKEVTQSAIIKHAQALLAPGLLSHSSLTPSPRAGPGYGFQYAHGLVLPAFLAGGPTPFHLLQYIPAKLVDDAPKGVIFDYRIQDYYLAPRVDIPAGTEKTFPGLLSERYPWPMAGAPQHSAYKAPTLESFHRHPTRTRHPMRSGSLSCNSSSTTASASRLTWDRLRVATDTPTWRPVPAPPRRHPTVCTARRPPWSTTPHPFSWRRSTKKTAS

SEQ ID NO: 30670 - protein, 235 aa, A.fumigatus
DFQRSRSTSANQESHIVAAKCLQDTAVMRNFWHFSQQLYADLPPIDAYLALHRDYVAPIVGPVLHGTLTTTEALALWTGSTPWVAKIQALRQGKEVAERLFSYTKSLCATQQSTLSSLTADEKQISAHLTTEILRRYTADTLGQPTPFTDGVDTAAGGASLAGGSAKNIPQGITNNLSLAASASFGPAESLFDRINYFECFNTALRMIQTAQAQRMIKALDVIAQKLRDWELLYR

SEQ ID NO: 30671 - protein, 77 aa, A.fumigatus
SSIPLGSIAPQHWEHSSDDNDISTCTFCVLLPWNKWQHWQCSMMGYSLLLTNLLDPYTLFVPLQRLKAVLGKGKHTP

SEQ ID NO: 30672 - protein, 346 aa, A.fumigatus
QLDQMLRNDEVQRHTLLSEMITRVSGFSAWLLPSFAWSGGQSPPRLAPVWPSTARRRVIKMTVLVALFCLVTWTLCTRIPQYSTQGTQQPQQPEKTPHPHPQPEDAFPPTHATDLKIHDPSIIHVDGTYYSYSVGRHIRIHQAPSLDGPWERTGAVLNADSVIPKGDRKAPWAPQTVHHNDTYYCFYAVSNSGCRDSAIGVATSKSPGPGGWTDHGLLVQSGTGKGSDEHPFTSSNTIDPSVFVGEDGHGYLMFGSFWSGIWQVPLDESLLSVAGDTSSEARQLVYMEKAPLPASKHPNPLCREPSGARPIEGSFLSYHEPWYYLWFSYGKCCKFDTKNLPPPGRE

SEQ ID NO: 30673 - protein, 216 aa, A.fumigatus
HDIWGLWPHFRSSWQDIGIASCCRSKNSGIMRRAPRGHSARGRVSGGQPKAREEGDEIPEVYQEMLAEAELRNPNVSEADRPIKRRKVGAQGATTLNEVSIPQVPLSMEDSRQVQTDYDEPTSEESDMEWEEVDLQQVPAQSTQIGPVTEVDNEPLQITLEGHEGKRRKVISRQKSLTAAEKKLRLDIHKVHVLCLLRHVQIRNLWCNDDELQVRN

SEQ ID NO: 30674 - protein, 115 aa, A.fumigatus
  UNSURE (61): Identity of amino acid sequences at the above locations are unknown.
HLKGPGFTARASPYPVFWVEAFNEAVQKWVPVDPLVTKSIAKPSKFEPPFSDPSNSMVYVXGFEEDASARDVTRRYAKAFNAKTRKIRVESTKDGERWWARKKLFYEKTILGRPR

SEQ ID NO: 30675 - protein, 151 aa, A.fumigatus
ETIMFDAEVFLSKEDFCKQARTMQGSRDFGAQLFCALLRSAAVEARLVCSLQPLPFSGTTKSMTPNKRDSQYIVISSDDHETSADDRQMPGLSPTPASRSRRLGRPQFTPARSQKTSIPGNMSTSIPLAYSLTSQRPWIHRSSLALPGVLG

SEQ ID NO: 30676 - protein, 60 aa, A.fumigatus
QKDFRVEHNSFLQGCEKGDYCVELCTHTAFCFNFSGSSTQCARFKPGLVTLNLLLKASLA

SEQ ID NO: 30677 - protein, 694 aa, A.fumigatus
WLLYLICEDDPEIVALATKILARLIVIHGDVYSKKFSEKTGGYIIMRHRLRSWWKVPAIWCICLSILLGLDVGGMKLDQPFSRTGLIEILSSNSQPRVAFPEILPVLMEMMQLGLQSVISGDELSSGVHGKSLQKSEVRLESPPASLTIRVTELTKQISLLDAVVGLFADLHQNSTDFRDFAAQSDYVQWLLYVTFPVVVGSDIPSTDFELKSRAAKTNSHDHTLPVRPRSSGTAGLRTTTVEGSSSRERQAGPLRRGSSFILVSSDRTKFSPSFARIHKAFIPFGSPPDMTATDHPLVQAILSLVLSVFCDQLLERKDFAGLGLYLKTPTSTLEQQSYFNSWILRSLLTRLRDVTISKPQVLLEPRALSNMGRFATHIGEAVYEGWFIDGATHALEFAGAILEYLQQSNVSSLKSVRLCSQAVTTIRSTLFRVVLLKLSEVDDREACEFLSRLSYWQVVLLSEGEVQSDYLRLLCYLLYTKLISQDWNVRLAAAGLWRVILVQKPAEMSGILSQAAIPLQKRLSDGFEALVGMEDKAFLQWVDGHQDDLNAMFLGLLSRSWETFVQEESSNIDSTTRARASKRQEKLRHWNQLERLSEEVTRKHETTFPHWVSNISASEFLKHQRALQDQQDNSVFMWTAFSHMTMDLKRFGGVLAEDKDRKWRLDQTEGRSRMRLRMVPDEVPPTGGRKSAI

SEQ ID NO: 30678 - protein, 217 aa, A.fumigatus
SRIANNPMPDLRPLPTVQGRAPGVSKRCPANDAGKQGNLTFFLTRGAMGMTAIGIALWKYCMRYVPTNPNFFNRDRFVLSNGHTCLFQYTFLHLTGYKAMTMDQLKSYHSEREDSLCPGHPEIEIDGVEVTTGPLGQGVANAVGLAMATKHLGAVYNRPGFSLVDNTTWCMVGDACLQEGVALESIQLAGHWRLNNLVIIYDNNQVALAPYFPIWPY

SEQ ID NO: 30679 - protein, 233 aa, A.fumigatus
  UNSURE (228),(229): Identity of amino acid sequences at the above locations are unknown.
RITAALMRARSSKEKPTFINVRTVIGVESKFAGDAKAHGAAFGEDEVANIKRKLGLNPDEHFAVPDEVYQFFSDAGGRGRALEEGWNQLLLNYSTEHPEMYEEFRLRMLGRMTQDWTKLIPSKEEFPASPTASRKSAGLCCNPLAAKLENIMVGTADLTPSVNMAWKGKVDFQHVSHSPVPRNIHPFTNQNCFVQPELKTTCGLNGNYTGRYIVFTTGLEGSDGGVYXXRGFH

SEQ ID NO: 30680 - protein, 240 aa, A.fumigatus
NHGGFRSCGDEHYGTHYSSAMIVCSYLIRLQPFVKSYLLLQGGTFDHADRLFYSIGKAWESASRGNMSDVRELTPEFFYLPEFLVNSNKYDFGLLQNMTTAIDSVELPPWAKGDPKIFIAKHREALESSYVTENLHHWIDLVFGCKQKGEAAIEAVNVFHHLSYQGAKDIDNIDDPVERLATIGIIHNFGQTPHQIFTRPHPPREDTRHKVPRLDRLAESLTQLPLSLLGKSSGLLRLWP

SEQ ID NO: 30681 - protein, 215 aa, A.fumigatus
QAQILGHFEHLHIGQLSCTIFADSRTLVTSGTDCVVSIWTYNSTAKSVDLQPAGSLFGHRNPVNVLAVSRSFSALLSASTDGQIMLWDLNQHTFVRELPASGPVDVSDARKLTKRPCSFRQRLTSAQCARINDVTGEIMVCRGNRISIYTLNGALLLEQDVCESIDDRVMSCVFYEGVDNEWQERELIFTGHRKGVVNVRCPDFFLKTVLSLPSG

SEQ ID NO: 30682 - protein, 107 aa, A.fumigatus
LQLRTITAPSRLTRVHPSPTAVIKTNQSRCSSQILILDIHPTNIPFHGFKLACQLTPEVGTAMGGRDSDREARYDYDYARRRYATDDDDDYDDDELEHDLTERRYRR

SEQ ID NO: 30683 - protein, 197 aa, A.fumigatus
  UNSURE (97): Identity of amino acid sequences at the above locations are unknown.
QLQSMCHPIDFSHPHLILTSTGRNPEDCLPPTTSSAHARHYSQPDTSRNSPTSRTEGCAGHLTQPDNTSHGEAHDSPDNTANAQHPSALPPHPPPAXSPSFSRPLPPPGPNRPRGATRKTSKGGGVQMVLEEGGSWSELADHSSTLPAEGYDNASVKGKSSNSGMLAFLSRKKGRDRSPKPQEPGVLGKEGARQIIS

SEQ ID NO: 30684 - protein, 69 aa, A.fumigatus
ILIPLHLLFSIVCLYHCLSMDFRPDFPQTIRITQSISENHVWRVMLTIYFEPKTTNVALYHQATFALPN

SEQ ID NO: 30685 - protein, 60 aa, A.fumigatus
HLVGPIWRPKQFWTSLKTVQHLSEPKRSAYLLPCITWAMSPRELITLGLQRTLNQPLVGH

SEQ ID NO: 30686 - protein, 120 aa, A.fumigatus
VNPSQVTNSLLQLKEIFADYQPVSAKIALRPIPRFMIKKLQARNERRKGRGFGFVTLGSEELQEKAVKEMNGKEIEGREIAVKVAIDSPGKEDDAVPTGEQTEAAAPAAKEQENTPPAAA

SEQ ID NO: 30687 - protein, 247 aa, A.fumigatus
  UNSURE (80): Identity of amino acid sequences at the above locations are unknown.
FLYSESTSIPVNPRTNRPVGYAFVDLATAHEATAAIEELSGKEILQRKVSVQLARKPEPAEAKAEGAASGGEGASGTEGXKRTGGRARGRGRGRGRGGRFGRGGRVSFPCTFELVSTVLLTIWTQDPTGRLPVTNEAPHQSFPVRVEPQTEVANEGTNAGAAESSKQGGKHGVLCPQKQRGPPEDGIPSKTKVMVANLPYDLTEDKVRISLESTRARLLTLFSSSRKSLPITNLFPPRSPCVPFLVS

SEQ ID NO: 30688 - protein, 67 aa, A.fumigatus
NDIHSFPQTSFTREKTTFAEKSIFTMVTYEYNYPCALAITPAPSLTPTDLHQPRNEKFVLDWNNLDI

SEQ ID NO: 30689 - protein, 61 aa, A.fumigatus
GEMNRILHSGITSNLHIIISVLPQWITMPNILGSEIDHSFPASPAFDKRRQTDHPFTLFFI

SEQ ID NO: 30690 - protein, 505 aa, A.fumigatus
YNVVDRGSHRRGATNGKSPNQQIGAAFRTCGETTRNLRSLGIGPKSWSGRRLLRSTLLSRDSPKQGKSDSDASNPLRLVHVQTRDVLKTEGIETKRYAVISYTWSQFSKEELLEWATSRAMQLGYEYIWIDQYCIDQKNKQEKNKEIKRMRDYYKNAAQVLVLVPDVTSLARFDVASTDQLIHVDAAINASRDVLKQFVSCEWLKRVWTFQEAWVARQCVLCTKEQMLDGTVMDALLGLLKYEAVNRPRVMCITSKSIANPVVANPNTVVWEGVLSNRQTVVGSIDRWILQSGRRVYEPPRLTLVQAWEASQGRNTVNEEDRVYALLSSIEGGDRVTVERGRSLLAVIQDCVEAGIVTADLLAGNDPSTVADRCWMPDLTGSGPQHPLRVASASEKQQQLVWRGGKVSVKGKIFGFADVSVWLRIALVKTQDPIQQSEGSDRPWIQFALSTRQKTWTPKDLIKSDFLLVQPMPGCTQTVLVSGKKLADGSFHRSSPRGWKDHGGQ

SEQ ID NO: 30691 - protein, 128 aa, A.fumigatus
SVWMTRIHRRCGRRLMTTGDYYTGGSLNPARSLGPDVINRSFPGYHWIYWVGPLLGSLLACGFYTFLRMFKYESVNPGQDYDEWEAKRNHGSFDGNGRESTAFSDSTAGAQSQSPRGVNRPVSGAEQV

SEQ ID NO: 30692 - protein, 313 aa, A.fumigatus
TSVFVFSVSSKDTMAFGKRNGEERRVLHRTQSQLPMLGLADSARNNLIAVVGEFVGTFLFLFFSFAGTQVSNTPKPVAGAPPNTSNLLYSALSFGFSLTVNIWAFYRVTGGLFNPVVSPTHELQHNGSALSEQVSLALCLVGGMPPLRGVLVFMAQLVGGIAAAGVVSALFPGDLNVGTRLGGGASISQGLFIEMFLTAQLVFVIIMLAVVKHKSTFLAPVGIGLTFFVTEMIGMDDPNPPSMRTEANDNRRLLYGGIAEPRALAWPGRDQPELPWLSLDLLGWTAARVSAGLRILHLPPDVQIRVRQPGAGL

SEQ ID NO: 30693 - protein, 306 aa, A.fumigatus
GLCRNKPLGLHLFSSSHDRPSGERRYSDSALEVEDNAKSGREDLIDLRESQDQSHHDAHPENSVAVQRTDETPDFDTTIHTPEVFLFDYGTVVIWGMSPAQESRFLSDVSKFANSILSPEDTQVENFNFYYAREYQARIYNDFISLRDPRNHMIKLAISHALSQSVKTSLFEDLVSETISNTAPLPAQIAQTGSVNMTRRQINMQIGELFILRINIHLQGSVLDSPELMWAEPQLEPVYQAVRSYLEMDQRVSLLTERLDVIADLLAVLKDQLTHRHGEYLEWIGKSLTSSRRVNPCLAHQLQSSS

SEQ ID NO: 30694 - protein, 112 aa, A.fumigatus
GAFSVFFFFLFFLFFLFFAHSRLISLSFCFISQAAIPIWKEGLFYIDFSQNGMLALVVTLMISAWMPFSCLLENQSRRCLEFAARQQMEDSLATQCAPLSNYSQASCILGSK

SEQ ID NO: 30695 - protein, 66 aa, A.fumigatus
ERCFIMDVPDDMLNINSLSNGTYKDGCLDISKKDARVPNEDDQLQTQSSTPYANTSGAKYGPQLMQ

SEQ ID NO: 30696 - protein, 104 aa, A.fumigatus
NLCQRTEEQSINDNPDSPHHGHSDKNAYNLPCDKHIDAWGPTSTTSERKSTGWLKNGKATKKSGDYQGYVANFHSEKHLDHPEGAKIPAGRQPRFLNNATDNVQ

SEQ ID NO: 30697 - protein, 297 aa, A.fumigatus
HLAASADRRPVDPPPVVELRIFESDPNDDLHKTDITFAYNANFFLFATLETARPMAQGRLTGPPTCPVLTGVPVAGVAYLDRPQQAGYFIFPDLSVRHEGRYRLSFHLYEEIKDIKDADKDTPMPDLNSSTNLTKPSAPKAHLNFRLEVKSVPFTVYSAKKFPGLATSTSLSRIIAEQGCRVRIRRDVRMRRRGEKRTDDYDFDDERAFATRSDRYTTPDMYAANSAERARSTSISTTADTSFPYGSDAQRRPSAGDYGFQGAQPYQRSMPAASAAPAPAPVHSPATSAQTSSYQVF

SEQ ID NO: 30698 - protein, 320 aa, A.fumigatus
FVVCLRQLNLTSPGSTCVALMPLTQPLRCRAGRPSPPPPSTFVRRPVFSGRSGIISTPGARLLPLKRVFCTSTILQRHKSPLSSNARVRSLPRRSLTPFAKTISTPNLITTSFMATQTREHGGHGGHSHHHHHHHGNVYLTSANKSDAGVRITRIGLVANLAMAIGKFIGGYVFHSQALIADAYHALTDLVSDFLTLGTVAWSLKPPTERFPNGYGKIESIGALGVSGLLLCGGVFMGLNSGQVLLDQFFPEAAEAIAHSGVLGHGHSHAHGVQALGPNINAAWLAGGSIIVKEWLYRASEYPRPEFQIPISASVTVVIS

SEQ ID NO: 30699 - protein, 62 aa, A.fumigatus
ISFFPLCISLQNNMNYTKLSINYFGDTPSQTWVQPRRTQCPELPQPSNRTPANLLPLICRVP

SEQ ID NO: 30700 - protein, 72 aa, A.fumigatus
TVKLNFPGEYVRRPDAADAAPAVQGRSSITTTTINFCPPPRIQWTVWDHFHSWCASLTPEASLLHINDPSAP

SEQ ID NO: 30701 - protein, 101 aa, A.fumigatus
VPTSRIPNSNFCLRYCGYQLTAAGLLFLAMKIANERKSSVLASNAVHHRIDSLTSIVALFTIGGSYMFQDASWLDPVGAFSCLHHGAARIRAKRIEEWEGR

SEQ ID NO: 30702 - protein, 161 aa, A.fumigatus
NPCRYYSVTIYNQIGIAGDETLKYQAINSIIALVAECLCMAFIDRFGRRWTLIGGNLGNMVTFIIACILLARFPPEANNTGAHWGFIIMTWLYNFSFSCTCGPLSWIIPAEVFDTRTRSKGVFHCHNDIVCVQHHDRSSDAHRNDKCALPLLLSLHHLQFH

SEQ ID NO: 30703 - protein, 80 aa, A.fumigatus
LLPCWPDRSTDASPLFKRGNSARRSSYSVIAYCLDLPNYAIPRGSELKTDYKSFFCPLPSMFSPKALVPRRSCIPIQNIS

SEQ ID NO: 30704 - protein, 135 aa, A.fumigatus
PGCTTSPSRAPAAPFRGLYLPKSSTRAHARRGFSIATMTSFAFNTMIGQVTPIAMTNVRYRYYYLFIICNFTNALVFWLLLSETKKLLLEEMNYLFSNAPWIVPVTRTEDYTPHDLERKVEAQQEIQAVFATHHE

SEQ ID NO: 30705 - protein, 101 aa, A.fumigatus
VEHASVHLVIEVLRGLTNRSALAYVNEAEVGQGIRDSGIPREEIWITTKLDNTWHHRVQEGIDSSLKSLGVEYVDLYLMHWPCSTDPNDKSKHLPDWDFIK

SEQ ID NO: 30706 - protein, 241 aa, A.fumigatus
SVVGEPRSQCEKEQGAKTSEENSHDGLFHQVYEWLQQEKVKQKSRRSKLRGTGEGVESDGDDDYYDGIVDKTASHDSESTFALDKLEKILVRYAASRIEGSSSAYPLRGPTRKRSRIKGLRRGSASESDQYDLDTAVPAVDAVLDNSKTLAYTGGTAEEDDRRLKDKEAWLTFKSEIVRLAITLQIKGWRKFPQELAGEIEVIRLSGALTNAVYVVNPPKSLPPPKGEDGSYSLVPRKAPP

SEQ ID NO: 30707 - protein, 171 aa, A.fumigatus
AAIFRRLSRKDIGPKVLGTFNYGRFEEFLEARPLTPKDLRVPETMKQIAKRMRELHEGIELLEEEREGGPMVFKNWDKWVDRCEQVINWLDMEIQSDHNEAKAASEPWRRRGFVCGVPWPIFRKAVENYRKWLVSSCGGIKEIKRQLVFAHNDVSHSFRQIHCLLIVHPLT

SEQ ID NO: 30708 - protein, 124 aa, A.fumigatus
APLPEETRRDYGACSTLLSGVPWGIVQAKVPGMEEGIAAAAAAKASNGNGHSSESNGSAVAAAEQPAQPAVDADVDEGDEFDYLAYAQDRAMFFWADLLALNLVREDELPPQMVEHVKSRMIDY

SEQ ID NO: 30709 - protein, 333 aa, A.fumigatus
RLSKKKQSSYVYMFQAQCRQVFEFTEIDDIYPALLNLRRPTLPFNAKVTHDHLRPLQKLAQDLKAGAQALENAYKLGTGYDDLAVVLLEPSDKADTHCFDDMLNASMALKAVDSSIRHAFNGHRSIQNTIILDIRAFRSDSIRRTQGASDKLEADELAYTAFEQILCNLKPDVILVCQCQTNTNEVGSRFARQACSSIDEATDITVLRLPRTQHESVMVKSFHPMYLEYMREAPNDSATKAVLREYLFDAGFIIASNALAGRSITGFGLHNLKACARDGPAFIATPQGVRISYLWTSGSDIASTELVEALKTLGISSKVGWCVSHCRVRLMDS

SEQ ID NO: 30710 - protein, 374 aa, A.fumigatus
LQEEASRVRSCPTLSQVRLVGKGGKPIYLSPPELQFVAKVNAGAKKATCVDVTHKKRGRPPLKAEDASLRTYTTQAENAVTSGEQQPPLARRTHTHKSTGSREIRPVTDLQIPGTPHGTVGFRAAPGHPHRWSTSVFPQAVDPSISMQSNLGHRRFSSSGSIPQMTAATQSGIMPLTSGFSPVLNLGGSQMGARRAFSSYTHQGLPPTTSPPQYQQPFGVPMPPYTVSPRMVSRLPPGDTREAYPESPVRLPPIFPPAMPHSRPAPQAHRLSDPYPAVWSPRLREELMQPQPQQQTRGSSPHSLMEPTSSAAQTRHAALEHGHGEVAPHQSNSIIQGAQTLSVQSSPTRPRDEQPAGGTDTDDPCPRRCQRWLG

SEQ ID NO: 30711 - protein, 250 aa, A.fumigatus
TLPAVVPLQQQGPSTYQMQSLVLPPSALTSTQFGHPRFSSASERLALKYTLPTNARLCNSRDLPPVHPMSSSVPAEDPLETTRHVKPPPHTTGLPTVTAVPVTAPAVTPASVSETALASGSSGPAAGHTSAFQQYVARTAGEEMRPPFIFNETVPGSQAPLGTTEQRGAQESSTAFPSSSRGTSPTGTTTRALLPKGTRRTKAHVASACVNCKKKHLGCDPARPCRRCVLSGKEVSQSILVHLSCSSLLR

SEQ ID NO: 30712 - protein, 67 aa, A.fumigatus
LIDLLMSKGNISLCPSVYNIPTVTRLQLFLLIIAALFLSFQSTLAARPSLFLDFVPEHTFPVICFDS

SEQ ID NO: 30713 - protein, 195 aa, A.fumigatus
  UNSURE (133),(168): Identity of amino acid sequences at the above locations are unknown.
IYRALCPSAPLPRARVAAVRTLYDPTQEPSANTVLDAGALVLYFPGPKTVTGEDVLELHLHGGPAIVKSVLAAIARSNRPESTVRYAEPGEFTRRAFMNNRLDLPQIEALGDTLTADTEQQRRLAVRGASDTXSRHYESWRQQLLYARGELEALIDSPKISISQKSPXEICPPPYHEQVLRLQTPLENASLKNAS

SEQ ID NO: 30714 - protein, 198 aa, A.fumigatus
SLLSQWNNMPSRASYSFVPLQGGGQERPMDIHNHEDQREILLAAQLSRIVCRMLEVEGFRKLERDFYNIKWKQISQETHLRFLNQLGHILLSLRWRVSWWKRLGDGGREPDPSKQHYEDRVELLCRILYVYYTCVQAKLPSWSTADVPKGVWSTYADSENAVWDDFPLDPSEDGFKRWMERGRELIEQAGVPNRVSKI

SEQ ID NO: 30715 - protein, 139 aa, A.fumigatus
VRLPPLDAFVNPAANILVSEKDVHRTDRTIPLFAGEDIPHPDPDSPFADVGTNVHLEQMKDMLLTYNEYNPDLGYVQGMSDLLAPIYAVMQDDAVAFWAFVGFMDRMVYPTHIRPKSTLLTQTRNGISFAISLACAPSS

SEQ ID NO: 30716 - protein, 259 aa, A.fumigatus
ISQGHDATACPLQPGASAGRDAGMIPLMKALRETRWKVLEQLSKITTFTRRTANELPINTMIPPQVRRLMKSPEIQTLQDEFDSARLYLARWAMSIAEQSERERAQRIWTARDVLEMENSSVGDFEILELETGTMAIQERRRTVTLQEWEDFFDATTGRLNVTVDEVKERIFHGGLDPNDGVRKDAWLFLLGVYPWDSSRDERQALMNSKRDEYIRLKGAWWERMIEGSSTTEQYEWWKEQKNRIGTLASPGRICKSSC

SEQ ID NO: 30717 - protein, 281 aa, A.fumigatus
PLSTNLRSHAGRCSGILGFCWIHGQNGISHTYPSQINTAYTDQERNFLRDQSGMRAQLLTLDHLVQLMDPQLYLHLQSADSTNFFFFFRMLLVWYKREFEWVDILRLWETLWTDYFSSSFHFFVALAILEKHRDVIMDHLKHFDEVLKYGKHVTSTLTHVTSLIFNLIVNELSNTMELVPILTRAESLFRRFERTVEAIDKKNNFPAPSTHQRKPTQESALNKGKSPQRPQSVGYSSGVSAGPASSSAAGDNAESKVISPELRQLLSKEILWKQPHPTSSK

SEQ ID NO: 30718 - protein, 626 aa, A.fumigatus
LKSLPSFQSRGVAELPSQQTTRSTRSASLRQPSDEPTSQPATRSTRSASRQLSAEPATESNTRSTRKARTRQSSAEPSTQTTSRSRSRRAGNGVMASIEEAPTTQTRTRKTSTRRSTRQSTQKTSDDETDPTDAEQASQPGSVVDETSAAQESLELQDSEPIPSIGEHALSEPKASDSELSSIPFPEAVVPEPYPEPYPEPWPSSPSLSPSPPLPHVSLPSSPLLPDTEFPHRSRAAAPSPEAPYPQGAESPKTFVKDVSGAPADTWYLDPLEDMSDIGSPLSERSHTPDLEMEDSPPLRSVLNESLLADIDACLARHMQVELAAAHNTARDDLDSIMADECGSDADVLLLSSEEYNTQPPAVTEASTGSTIAARLFLVAMEGIEFEEERYCRSPMSVCGQSSSELDDSPMVDEEHTAPIDVSWISSGESSREGSLSPLPPVDRDEEVPIPSIVAAVSSPIDNEVAALTRSFSGLCLADTAYGGTPAASATLLLSYMLASTGQVQQDATFDVPTESGTTSTFSDGRLVSVKVSELIPGPSRSRPAAAEVDKSRQVSRSARKNSARWARVALSPIPEESEVMSSRSGLGVGAKESVDPPSLSLSATSHLLELLGCRRVEAGASGTRL

SEQ ID NO: 30719 - protein, 198 aa, A.fumigatus
LGNLYSQPRQCIGCVSPYYLILLVRWSSSSSHESVNSRYEPYARGAKDDVFIKNPDGTLYIGAVWPGFTVFPDWHNPKAFDYWANELVIWSKKVAFDGIWIDMSEVSSFCVGSCGTGKLHLNPVHPPFQLLGEPGNVGYDYPEAFNVTNSTETGSASAASGNQASAASATQAATTFTSTSYLPDNPTRAFATSTTLQM

SEQ ID NO: 30720 - protein, 398 aa, A.fumigatus
LIMFRRAMTLPCTPFLPTPPMWNGVQEYDVHSLWGHQILNATYYGLRQVFTEKRPFIIGRSTFAGSGKWAGHWGGDNNSKWGSMFLSISQGLSFSLFGIPMFGVDTCGFNGNTDEELCSRWMQLSAFFPFYRNHNVLAAIPQEPYRWASVAQASKAAMKIRYSLLPYFYTLFHQAHTTGSTVMRALAWEFPTDPSLAAVDTQFMVGPSIMVVPVLEPLADTVKGVFPGVGKGEVWYDWYTQTAVDAKPGVNATIPAPLGHIPIYVRGGSILPMQEPALTTRDARNTPWSLLVALSGNQTALGSLYLDDGSSLNPSRTLDVDFQATASSIKVSVKGTWEEKNRLDKVTVLGVTEKPSAVTFNGRNVHPGSVHYNTTTKVLSVQGLHSSLHHGAGRSRAI

SEQ ID NO: 30721 - protein, 85 aa, A.fumigatus
DSSGIHLVSRISEFLHIVLVSFIYLPARSDIDYMLGYRDFENDPERFSYDEGEEFLNKLHKSGRHWVPIVDSAIYIPNPDNASDA

SEQ ID NO: 30722 - protein, 135 aa, A.fumigatus
RSAIPSYLTSTLFSTRPTPPALPSCALSPGSSPRTRPSPPSTLSSWSALPSWSSPCLSPSPIPSRACSQASAKAKSGTTGTPRPPWTPNPASTPPFPHRWATFPSMSVEAASCPCRSPPSRPETPVTLPGLYSSL

SEQ ID NO: 30723 - protein, 160 aa, A.fumigatus
CTKSTSLQSALHSNIYGQHPFYLDTRYYTKGANGSYSLVNADEADLSEDHESFSHGVFLRNAHGQEVLLQPRNITWRTIGGSIDLTFYSGPTQADVTKSYQLSTIGLPAMQQYSALGYHQCRWGYQNWSQLEEVVNNFERFEIPLEYIWSVGFLSFYILS

SEQ ID NO: 30724 - protein, 117 aa, A.fumigatus
TWQCRLRLPRGLQRDELYRNGLCLRRLWQSGFGCFCYPSRHDVHIYIVSAGQPHPGVRDVNYPPDVINHVQEGHDLAVHAISPNSTHVERRPGIRCSQSVGPPNPQCYLLRTAPGLH

SEQ ID NO: 30725 - protein, 67 aa, A.fumigatus
PLSCHRCHAHKIKCSGEQPCAKCRMVGKSDECTYTRRDRQVKVSERYSGDIPYLITVSKTLERTACC

SEQ ID NO: 30726 - protein, 61 aa, A.fumigatus
  UNSURE (42),(58),(59): Identity of amino acid sequences at the above locations are unknown.
QESNQPCSTSYTLLLVDPDAPTPDDPKYAFWRHWVISGLKAXEGDSGTALTEYLGPGXXEK

SEQ ID NO: 30727 - protein, 179 aa, A.fumigatus
RLLSYEEPKYTVNGQTKSSLDTPHIVYHQIAQDGASSIFPPVTSSISNPQAFNRLYIIVTLPFTPCPTESTLSLTKMSLESHTQQLTQSLAQANLTPGLLPFLPPDFNPTTQLHVSFNDKPVSLGNLFRASECKTAPSVSFPKEVGRTLPIALSPAPRSLIGITGEQSTMLDKLYPPPS

SEQ ID NO: 30728 - protein, 114 aa, A.fumigatus
HLQPYYYQIYYKTTNGSTTKQIIMPNNNFSSSQDAGVTGAAKFVTSTVGNTVGGVSRTVGGVTGAAARGVGGTITSATGSAGKPVGDALGSVGTGVEDAANRVAKGVEDAGQWR

SEQ ID NO: 30729 - protein, 466 aa, A.fumigatus
GNCKFGAKCALAHILPDGRRVNRPTPGMGMGGGHLNLGGRVNPQAYVNQDSALTNSVLSQQRLGIHDPRYASQLPPQEDFSTLQQQQQQQPHPPPFDAIPTIDAGLASDAGSKYGSPAEDTRFPMSPSHRYLTALDAQLPASFDSQGISHVARYGPVAASVPSKFGLDLASPPAQRMGGPSDVLRNLRDTAYGSDFRKPSSFMGSSPPGISEDGVGPRFLHSARPVKSRMLSASVPRPTALDDWDDSNFPMEEDYLPINLHDDVLTPQEKLRRLSRTDHDLSSSHRDLSGLGMTSTSFSKVGSPLASSPSRFGALFAKQRQQKKDEDSHGTSFSHIGSPLRESSLNLGTSPSLGPIGSRQISGDVSPYVTSPGRQSSTSMISQQLSSMSLHPAPTRHSPAVGSNSRLDRTISSPVSTSKIDEEQSDLVFSMEEEDSTKRNSTSWATNKAESNDGASTPTSNSGFQP

SEQ ID NO: 30730 - protein, 156 aa, A.fumigatus
GEAQGAMMVFFCLPLWLMLVLMRETSEEQPPHDANNGWEEIRLSARSFYLPLRLLFTDYVILSLTVYTSFSYATVFSYFSSLQHVLMLDYGFGTRQASLGLLSLIVGNFCAIILWVVLEKAVTSSEEKLPGKVFQPEKRLYAGVIGGLLMCLAEIW

SEQ ID NO: 30731 - protein, 131 aa, A.fumigatus
LSTIAYIIDIYPAEVVASGKQSLRSSIQKSYKKWLYLAIAANGVSRYTLGAVFPLFTLQMYEKLGTTWASCLFAIISCVLIFIPLFVCKYGVRLRTTMTVGATHGNSINRDAKNVDTTITELCYTELSVAI

SEQ ID NO: 30732 - protein, 78 aa, A.fumigatus
PQIICLCSLNPNHGPEIYQIVHTQKPKPLRPLFVGLVTHQHGHGCGPQGLHSAVLLPDVVCGYGLCQLIEPNTLEDNA

SEQ ID NO: 30733 - protein, 69 aa, A.fumigatus
AAGGSQRHYIITNPDRPQGRQASDTCLRDNVRTFYPLYILSFVYTVYSFWTLFSFETLNIRPEHISAIV

SEQ ID NO: 30734 - protein, 516 aa, A.fumigatus
SLVDAVAGLVEKDIDFVFDALDGKTTEPKDREEEKANMPNGKAVDKKHDINYRDEPVAFFFVLFGLAFEALVDQSTTPSQRLDILQALKRILRPVISGNAIYQDAIFSETMDTFDRLALTEGTPIQTVIVEIARNLSLDHPSAKAGDARSDHLSDDIEQLFELTRSIILVLAGLLPNLGENTSVARFNVTSDDSLSLIRLALSSLVQVASIFPSIIRNDLNACILHIFTTILATGLCQAEVVPQALPTFKHFIHGIIHPKASVSDEAQDLAIVSHQLRGCLTRFLTTLTIAQRRESESSLPCAKNTLLAITILLTTGGHILPPQDPAIPRVLNELLDCLQDVGLANVAAGCIRSILLTSTSRSPTNDLIAKYLLPRLIAFLVGCPLDKGEIPSDPENSRTVIARTLVSYATSATFAASELPTAFSIVMSALLARAKRESYPVYRETAAHLLELARADQATFRALVASMKPDQKGLLEEILRSSDPGTGAGAGRAETNGAQSEASQSMPSIALRLDF

SEQ ID NO: 30735 - protein, 113 aa, A.fumigatus
  UNSURE (13),(37),(53): Identity of amino acid sequences at the above locations are unknown.
TLYQSFNMKNVSXATVLLSLSGSLTAAWNVTAYGNAXCTGYLTSIAGEQGWGXYWLSGVTKPIQAMSVEDLPEGWRFIASSGTACDAFHQAGGNGCYTQSQGFQSFQIIGSSS

SEQ ID NO: 30736 - protein, 546 aa, A.fumigatus
WWTVYKNALLASNSLLSLDQHFTVSPTNTVDFHTNLTRQAPSKTFENHKMDMQEGSVASANNPENAADNFSPLSMLPPECLVNILDHLDTADNLAVSNVSKDLRKWAKPLVFRDILWAYTSTPLRRVLLLLEQIFLNPQCAGYVKHLQLTYTGPAWIMPDPDIDFRQHATRFAFVSRKAIQFVSQIGLFDTVGYAALLYQGDYYAYAAVLMFQLHNLRVLELDYTYTLVGGYPGLFLQIALRSSFEGISRFNRLEKLKYGGDVPQAEKLDDEAEEAVAAIPVLENTDQFAPWFALPKLKHVEMWLRSTFELDKYKDQLAGRELESLVLARSSVDAADIKEILSACPKLRKLHLGVSYNLVSKLALLDSKELADALKPLKDRLETLSIGLDTDPSFVGGFSWEQDNTFGSTLTDPFLMLFSEFTKLQELEVPMPLLLGWFSNENWADFHKYLPPKLRHLVMRNDLSGFDNYTWDPYGMVFAVDQRIVETKKRIPSLERVTLRVWATNPRRPNEDFLAEAADMAQSVGVQCDLVVDELGSGLWVARAS

SEQ ID NO: 30737 - protein, 69 aa, A.fumigatus
LIGAALPPRGEDPLAEFNQSPEEFFNPCQQNWPVAFVFKDDLLLHQPKVADTSGFFSTYHPGSSIVSAT

SEQ ID NO: 30738 - protein, 529 aa, A.fumigatus
SPPRGEDKNYIILKKDKLYVKHNVLSEDIPIVILLRAMGIHTEQEMLLLVAGVDSLYQDDFAINFEESIKLGIYTQQQALDWIGARIKINRKQSSYRRTHIQEAVEAIASVIISHIEVKNMNFRPKAVYVAHMARRVLMAKNDPSLVDDRDYLGNKRLELAGQLLALLFEDLFKKFCFDIKMNIDKVLNKRNRAEQFDAWTVMSMHSNHITQGMNRAISTGNWSLKRFRMERAGVTHVLSRLSYIAALGMMTRISSQFEKTRKVSGPRALQPSQFGMLCPADTPEGEACGLVKNLALMTHITTNDEEGPIKNLVFMLGAEDIMALGGKQLYIPGSYTISINGTPIALTRRPKYFLNAFRRLRRMGRISEFVSIYINHHQCAVHIATDDGRICRPLIVVENGRSLVKDHHLEKLRDGTMQFDDFLAQGLVEYLDVNEENDSLIALYEKDITDTTTHLEIEPFTVLGAVAGLIPYPHHNQSPRNTYQCAMGKQAIGAIASNQFLRIDSILYLMVYPQKPMVKSRTIELVKY

SEQ ID NO: 30739 - protein, 81 aa, A.fumigatus
DRTDLAQELADKLGVKLSQLALAWCLKNENVSSVITGASRPEQIVDNVESLKLLPKLTPEVMSQIDEYLGNKPAQDPARQD

SEQ ID NO: 30740 - protein, 66 aa, A.fumigatus
LRRQLFRHGRKVCLSRLCNDPSSRSSYANGQSEVVMGQAIKKFGWKRSDLVISTKVRPGPIVCNSG

SEQ ID NO: 30741 - protein, 206 aa, A.fumigatus
LNWGMANGEILINNHGLSRKHIIEGTRASLERLQLEYVDIIYAHRPDRLTPMEETVRAFNHVIEKGWAFYWGTSEWSADEIAEACGIARSLGLIGPIVEQPLYNMLDRRKVEGEFQRLYSRCGIGLTTFSPLKMGLLSGKYNDATTQPPPGSRFAESNDRFANKVRQNYGNDEWAATIKKIVGLKAGIHSPLPRTALTWHRSWRIN

SEQ ID NO: 30742 - protein, 133 aa, A.fumigatus
DYIEVTFNCMKQAYDCGVNFFDTAERYASHACAMIQAHEAAMQMDNPKSSWDKPSRNSGGSEATWSSAQRFVLGQLCVTQADRCSSTGAWQMVKSSSTTMVYHVNTSSKAPGRRWNACSWNTSTSSTPTDRTA

SEQ ID NO: 30743 - protein, 202 aa, A.fumigatus
GETVIDLGSGGGIDVILAARKVGPKGKAIGVDMTKVSIHVYRADYTLPASDLLPIYQKMLALAHENVEKAGITNASFVEGFITAIPLEDSTADCIISNCVVNLVPKEQKSLVFHEMFRLLKPGGRVAISDILARRELPPEIANDLALYVGCIAGASQAQQYHAYLKDAGFGGTSTNPLATDRKMLILCAEYSTRAWKVPRMR

SEQ ID NO: 30744 - protein, 376 aa, A.fumigatus
  UNSURE (20): Identity of amino acid sequences at the above locations are unknown.
DIRQFPSLEAKLPKEGEKAXAGGTTLIHDSVTPDDIANVVSRTTGIPVNKLMGGDVEKLIHMEDTLRQSVRGQDEALTAVANAVRMQRAGLSGQNRPLASFMFLGPTGVGKTELCKRMAEFLFSTETAVLRFDMSEFQEKHTISRLIGSPAGYVGYDDAGQLTEAVRRKPYAVLLFDEFEKAHRDISALLLQVLDEGFLTDSQGHKVDFRNTLIVLTSNLGADILVGANPLHSFKDYGNAELSPDIKQAVMEVVQSAYPPEFLNRIDEFIIFRRLSREALRDIVDIRIKELQARLDDRRIVLQVDNEIKDWLCEKGYDPKYGARPLNRLIAKEIGNRLADKIIRGELTSGQTAVISFNEDKTALEVTADGAKEEKA

SEQ ID NO: 30745 - protein, 91 aa, A.fumigatus
  UNSURE (85): Identity of amino acid sequences at the above locations are unknown.
LLRTPKNFRKALKANQRGFAKIPRVWKKKRPEIESLKRTKKELERARFELDRASEGGNFCESWRIEIFDNFQALRRNCPKKARRXPREVRH

SEQ ID NO: 30746 - protein, 62 aa, A.fumigatus
  UNSURE (62): Identity of amino acid sequences at the above locations are unknown.
HLLFCILESNLKKNKLHEQMNCLVVRNCNNQDHMDPGSLRLKTNQQRRQVNASWINIIISIX

SEQ ID NO: 30747 - protein, 157 aa, A.fumigatus
DRVGVKLSPYSQYLGMGTMDELVPQFEYLIAQMRRLDVAYLHLANSRWLDEEKPHPDPNHEVFVRVWGQSSPILLAGGYDAASAEKVTEQMAAATYTNVAIAFGRYFISTPDLPFRVMAGIQLQKYDRASFYSTLSREGYLNYPFSAEYMALHNFPV

SEQ ID NO: 30748 - protein, 503 aa, A.fumigatus
  UNSURE (139): Identity of amino acid sequences at the above locations are unknown.
SSLGLNEGKRNTYRNKLKCCRNLRRSPGRQWAHHGCGRGGFCASLSRCSSLLVLLINCGPRAVYMPEEPPKIIQNITITSGVKCEPDFDVLRRLDVQKLSQYERRDMFVARSSEPELPIRQRLNIPFLQQPSSGDEARXMGLPSQEQCYIEPPVTVEVPPSPASVDASHIDFGVATTLERLNDSLDAFTHWAGYTRTRIFALVEPDERVEEVQAKADSLGINLFVTQSEEEYQTRYFSLVAHLAKNMRPRTRWACVIDDDTFFLSMAALVDALAEYDDTKPMYIGGLSESVSQIGIFGLMGFGGAGVFLSRPLVQQLSNRDVFEACQAMPHTGDRRISLCIYQHTETKLTVDNRLRQLDMRGDASGFFESGREPPLSVHHWKSWFQADMAKLSVITNLCGDKCFLRQWQFSDGWTLTNGFSIAKYSTEIDLDDKTMEVSWVGDNGAVDESFMHALGPLRPKDTGKFSYLLEDSVFLGNQVRQWYVHRDAEKGDQIIELIWKMA

SEQ ID NO: 30749 - protein, 490 aa, A.fumigatus
ITPPRILPTAVVKTAQWKEKKVFEVDAPSLSEVPPSTLSSAELREKYPKFFGTMAYPYMNGTLHAGHSFTASKIEFMTGVARMEGKRALFPLGFHCTGMPIKACADKLADEVQKFGKNFERYSEESEEQDPTAVAAPTQEIKAEQEKFSGKKSKAAAKTVKMKYQFQIMLAIGLPLEEIHKFADANHWLHHFPPLAIRDLDSLGARVDWRRQFVTTDANPYYDSFVRWQMNRLHELGKILYGNRYTIYSPKDGQPCMDHDRTEGEGIGPQEYTAMKLQVKEWAPEIAELVKGKIEDDAKVYFVPATLRPETMYGQTCCFLGPKIKYGIFRVKEKEYYIVTKRAAWNMAFQGIFFDSEHFPKTQDELPLVLEAPGSAFVGTLVNAPLSFHTEGVRILPMEGVSATKGTGVVTSVPSDSPDDYATLVDLAKKPEYYGIKKEWAELEIFPLIETPTYGNLTAPTLVKKLKINSPKDVNQLAQAKELAYGEAYY

SEQ ID NO: 30750 - protein, 139 aa, A.fumigatus
SAAPSTPVVKTGSKTATSRPMLQPGTTPGPPTRAAPTLDRMPPYKLGMTITSNCWGRETACMDALSTIMSLTSRVGYISATLWKVLRNKPSASFMMFALWMQVTFFLLLARANPNANLAMRSDFARVMIFSDSTTPCTD

SEQ ID NO: 30751 - protein, 264 aa, A.fumigatus
CKGDGIGAEVAESVKTIFKADNVPIEWEQVDVSGVDTGNKHSEELFKESIASLRRNKLGLKGILFTPVERSGHQSFNVALRQELDIFASIVLIKNIPGYKTRHENVDLCIIRENTEGEYSGLEHQSVQGVVESLKIITRAKSERIAKFAFGFALANNRKKVTCIHKANIMKLADGLFRSTFHKVAEMYPTLEVNDMIVDNASMQAVSRPQQFDVMVMPNLYGGILSNVGAALVGGPGVVPGCNMGRDVAVFEPVFTTGVEGAAL

SEQ ID NO: 30752 - protein, 140 aa, A.fumigatus
  UNSURE (128),(133),(136): Identity of amino acid sequences at the above locations are unknown.
HIKLTIRVPDYVIGDPFRLRQIILNLVGNAIKFTEHGEVKLTIRKSDREQCAPNEYASEFSVSDTGIGIEEDKLDLIFDTFQQADGSTTRRFGGTGLGLSISKRLVNLMVGDVWVTSEYGSLHLGAGXVPLSXQRXIQCR

SEQ ID NO: 30753 - protein, 861 aa, A.fumigatus
  UNSURE (186): Identity of amino acid sequences at the above locations are unknown.
RVTSSSREQCAKLPGEPSQAKAAFEFELEALIRRVRHLEFQVVSHQPYPRPAPELPLSSTKNSDFLWLFGLSRLSSHEGAASNSSCGMQQETSRRRQRTRRIRREAEDNEADEALDDDDSDDDVNSRTRLVREEDISYLRNHVQKQAEEISFQKDIIAQVRDELLQQEEHTRRALTKVENEDVVLXERELRKQQQANEAFQKALREIGGIITQVANGDLSMKVQIHPLEMDPEIATFKRTINTMMDQLQVFGSEVSRVAREVGTEGILGGQAQITGVHGIWKELTENVNIMAKNLTDQVREIAAVTTAVAHGDLSQKIESRAQGEILELQQTINTMVDQLRTFATEVTRVARDVGTEGVLGGQAQIEGVQGMWNELTVNVNAMANNLTTQVRDIATVTKAVAKGDLTQKVQANCKGEIAELKNIINSMVDQLRQFAQEVTKIAKEVGTDGVLGGQATVNDVEGTWKDLTENVNRMANNLTTQVREIADVTTAVAKGDLTKKVTANVQGEILDLKSTINGMVDRLNTFAFEVSKVAREVGTDGTLGGQAKVDNVEGKWKDLTDNVNTMAQNLTSQVRSISDVTQAIAKGDLSKKIEVHAQGEILTLKVTINHMVDRLAKFATELKKVARDVGVDGKMGGQANVEGIAGTWKEITEDVNTMAENLTSQVRAFGEITDAATDGDFTKLITVNASGEMDELKRKINKMVSNLRDSIQRNTAAREADELANRTKSDFLANMSHEIRSPMNGIIGMTQLTIDTVDLKPHTREMLNVVHNLSNSLLTIIDDILDISKIEANRMVIESIPFTVRGTVFNALKTLAVKANEKFLSLTYQVDNTCTGLCHWRSFPSASDHFELGRQRHQVH

SEQ ID NO: 30754 - protein, 96 aa, A.fumigatus
  UNSURE (4): Identity of amino acid sequences at the above locations are unknown.
LAFXQDYIFILNLGQCPSRVLLLLQKLVANLSDDVFLEAYFLCLFLYMIPQITDVFLANESSSRVNIIITVVVIERLISLIVFRFAADSPCSLTTS

SEQ ID NO: 30755 - protein, 239 aa, A.fumigatus
QLQRIGTVISSLNQTCEEMRQHIVRAKQDTAPVIEEASALMNQKKESETKQQLLDAFVKHFIVTEDDLLVLTSAEEPIDDRFFNVLDRVKQVHHDCEVLLGGENQRLGLELMEKSSRNLNSAYQKLFRWIQKKFKSLNLEDPRISSSIRRALRVLAERPSLFHSCLDFFADARDYALSDAFHYALTDTVSGSGGDRNVKPIEFSAHDPLRYVGDMLAWVHSTTVSEREALEALFVAEGG

SEQ ID NO: 30756 - protein, 83 aa, A.fumigatus
  UNSURE (67),(80): Identity of amino acid sequences at the above locations are unknown.
ASQFISFFCFCFSKNNIICYSSLMTITYYYIVILRLSLILYSLDTSYCRSQSIYISVHLLPMYCVLXSAPGAEGSRISRXPQD

SEQ ID NO: 30757 - protein, 70 aa, A.fumigatus
HETAFSVPGLANLSAFDKAEFKMAVQRTPNAAQGLTNWTLDGVYYSFGVSIQVHQTSLSHILRLSGRDMG

SEQ ID NO: 30758 - protein, 63 aa, A.fumigatus
YLTPVTLDHEFPDIVSGVNFTKCLLEPPYVHSMFKLIPNMFLSSISQAILEDSCPTSKNKCLI

SEQ ID NO: 30759 - protein, 158 aa, A.fumigatus
KLFSIRLAYVFTPIYLHLSCTQLRRNIVFDSSPTMSLAFTNQPPEERVPYAIPQLEGERITIPGSKGTFRILASSKQTNGLMAVFQSGAVLSDVPGFHYHNQAHDVFLVTKGYLKLWNGDKCRIMGPGDFAYVPPVSRNHVFRFASALLTTLFTESHS

SEQ ID NO: 30760 - protein, 251 aa, A.fumigatus
QPSLQKVIHNPEMLGPHTEIYGLITPGDWVDFFRYVSEPYKGILVPEDDNRDLKSILIPKVMAAKEKFDVVFQPNYQPPEVGEFTKDDEKIPDGHEPYFLRSNTGPKWMLGGVMSRPFITTKQSNGVCAISSIESSKVYSEGLLSKYMTFKSVDHCFCVLEGTLTVRLKGSTDTVFREGETVVVPAGQAFALRFDSKYVRVYSFTDGDGIESLVHRLGKPFEGSVLPDKEPEWEHTQVQPVATELNVEIEL

SEQ ID NO: 30761 - protein, 137 aa, A.fumigatus
  UNSURE (11),(13),(19),(20),(21),(22),(28),(29),(30),(31),(32),(33),(34),(35),(53),(63),(69): Identity of amino acid sequences at the above locations are unknown.
LSSEYPGHFLXEXTPQSKXXXXRKRGRXXXXXXXXKINLNERYKYAWMMQHQXQPSFRTPPQXPKRQRXTQACDSVRLKKYKCDELYPCTHCRSKYVTYTGFNMIRGLIMGRKQARMHLSEELPAARKRPVSQVFSQ

SEQ ID NO: 30762 - protein, 283 aa, A.fumigatus
HNTNRLIAIMLGRLKMNVDQCIDAYVRISKQAFSRKNYLPITLQGEFRARFDSKTLEEALKAVVVEQGLDEDALLWDPDTSCRVFVCTLKKITGKVVSFSSYEHWAGQSSLYKVLRIWEAGRATSAAPSFFDPLVIFDPVLRFERVFLDGALGANNSVAQMWFHAKMLWEEDLKSRLGCLVSLGTGMRSETEFTGGFIQELKLRKRTLTDSEFEADTFAYEHYDLVEEHRYFRFNVSNALGDIGLEEVQKMDKIVSETRTYLADDAVREEIALCAATLQKRQV

SEQ ID NO: 30763 - protein, 83 aa, A.fumigatus
RCQNCWYSNIILEVKLDINNLYIMDMEKQTDKEKLNLLCLDGGGVRGLSSLYVLKDMMEAINPSNPPKPCEIFDMIGGTSAGG

SEQ ID NO: 30764 - protein, 195 aa, A.fumigatus
  UNSURE (66): Identity of amino acid sequences at the above locations are unknown.
GFGRRTQSMVLLGKLARIPFEANVRIQVSASNLMVASPVFKKALTGKGKEGSTFVGTGSVVITTEXWDVEAFLILLRILGGQHHKLPKRVSLELAAKIAVLADYYQCNDLVGFIRDAWITCLREELPVTYSRNLILWLWISWYFNMPLKFKKATSVAMSQSKDKIDALELPIPARIICKSVPILSVREIADHESR

SEQ ID NO: 30765 - protein, 517 aa, A.fumigatus
NQTKTTPPLHPSKIGHLQHKHTDTSKESSGNVGPKLPVANLDSHGASGNTCGSLGSLTCAAGAGAASGTGGHGPSASSSGLADQRGARARSISTLLGLGLAIKVTGGRGLVVLLVVLVHDERELLLGAADAVSSVVTAGGVGVDSTAHTGGAEIVEQVAVLLLVHRILHSAGQSLDHAVTQLAVGTRRQLVGGLPLGTDRRAGRDGSVGGSVACTVHTGGRYLLHLNGQVGEIFLGLDIVAADRNQTVVIGLLEVHIDNTTAPDVVHLGTVQSGDIGKLAGLGVNAAVLGEESRDRVLGKFLSAVLVARLLEGRITAPLVNVVAEHVDRALLITADKVVGQVGTDVGVLVGGVSDKQGGAVILRLDVRLHVSHGSLHVGNRIGVVVVIGDLVTREKANDIAVLGKGVNDAGIALVEVGVPGRVRTVDGLRWRGQIRNQVDAGVVQELHTFIMVLRGIDSIGTDDIGAQLLQVGNVTLAVVNIGQRIGVVGVLGRCAVGLVLLCIGLVSGGDRLMGFL

SEQ ID NO: 30766 - protein, 488 aa, A.fumigatus
SNAEEYQANGTSTENSDYTDPLANVDNCKRDIPYLKQLRTNVIRTYAVDPTKDHDECMKLLDDAGIYLITDLSAPSESINRADPAWNTDLYKRYTSVIDAFAKYSNVIGFFAGNEVANDNNNTNSIAYVKAAVRDMKSYIKSKDYRSSLLVGYATDEDAHIGADLADYLVCGDKESSIDMFGYNIYEWCGDSSFEKSGYKDRTEEFSKYPVPAFFSEYGCIDPKPRKFTDVAALYGPQMNDVWSGGIVYMYFQEANDYGLVSVSGDNVKTKEDFSYLSVQMQKVTATGVNSASYTASNTAVPTCPSVGAKWEASNKLPPSPNSELCDCMVETLSCTVKDSVDEKEYGDLFDYLCAAGVCGGINSNSTSGDYGAYSVCSAKQKLSFVMNQYYKKNNKAATACDFDGKAQTKKGADASGSCASLISQAGTAGTGSVTAGATGSSGSGSASETSKGAAGVAASPMAVKVGNWQFGAYIATALFAGVGMLVL

SEQ ID NO: 30767 - protein, 381 aa, A.fumigatus
HRYCNSTSRRSFQPRGEDGELTEGVGFFSVSYNPDDGRRSSASVAYIHPILRGEEKRPNLTILTNAWVSRVNVEGDTVTGVDVTLQSGVKHTLRAKKETILCAGAIDTPRLMLLSGLGPREQLSSLGIPVIKDLPGVGENLLDHPETIIIWELNRPVPPNQTTMDSDAGIFLRREAPNAAGSDGRAADIMMHCYQIPFCLNTARLGYETPVDAFCMTPNIPRPRSRGRLYLTSADPSVKPALDFRYFTDPEGYDAATIVAGLKAARRIAQQAPFKDWIKREVAPGPKVQTDEELSEYGRRVAHTVYHPAGTTKMGDISRDPMAVVDHQLKVRGLNNVRIADAGVFPEMTTINPMLTVLAIGERAAELIAEEAGWTREQPKL

SEQ ID NO: 30768 - protein, 114 aa, A.fumigatus
EEHQSRRINSTGTKNSFLLGSQGVFDTGLQSHVNTGDGVSFDIHARHPRVGKNSQVGALFLTAQDRVDVCHTSTAATAIIWIVRDREETNTLRQFTVFTTGLEGSTAGAIAISM

SEQ ID NO: 30769 - protein, 142 aa, A.fumigatus
SRRFSPTPGKSLMTGIPRELSCSRGPSPERSINLGVSIAPAQRIVSFLARKVCLTPDCRVTSTPVTVSPSTFTRDTHALVRIVKLGRFSSPRKIGWMYATLALLRRPSSGLYETEKKPTPSVSSPSSPRGWKDRRLVLLQYR

SEQ ID NO: 30770 - protein, 130 aa, A.fumigatus
QKPMKLCGFPDGVYDWTNGERIVKTGARLTLEGSDKIAGSSATLIECINNFRRWSGASIADAINAATATPARLLGLQGVKGSLDSGADADLVVLSEEDDPESPTLTVYQVWKRGVKIHDSDKEIASTTTV

SEQ ID NO: 30771 - protein, 108 aa, A.fumigatus
VSKDNLRILAGYTDHQLPFNFLPQHKQTSETLHRTRDVDRFVFACLIRIIGSSSDDHMATIGHYMTKSGSNKTMLGIDLWILSLGQSGIRSRGGTGAVRTALVGRLRR

SEQ ID NO: 30772 - protein, 528 aa, A.fumigatus
PRRSPLLFYKLSSSMASRANASSPTRQKNHEDLSETTSGAVGEEGAVTRAPKSGMESSTGFESEDRVYPIRSVISVDPSTVSQSQQQAESNLSSPATGAREWSIINAETWDKMRAQTKTSAGNFSATEPPPPAPDTAGSSSEPPDQGRSHSASPTPTPDSALTKTQDPEVDSEHGLVTARFRHVVTDGGHMVITGRANDSYQACEDEPIHIPGAVQSFGCLLVLREEIEGKLVVRVASENSEVILGHSPKCLFALPNFCDILDEEQKDNLLDHLDLIRDDGFDPSVDGPEVFLLSVKLPSGKPRRFWCATHLSPADSNSIICEFELEDDRINPLSVSGLTTPVTPTDTLGVEPTPEQLEHSTVNISQPLRLLRNARRRRGEAAAMEVFSILSQIQDQLGRTKSLDSLLNTTTGLVKELTGFHRVLIYQFDTEWNGTVVAELVDPKASVDLYKGLCFPASDIPKQARDLYRINKVRLLYDRDQVTSRLVCRTLEDLQTPVDMTHSYLRAMSPIHRLHQGAEGHANALGE

SEQ ID NO: 30773 - protein, 77 aa, A.fumigatus
DISPHWIVSDGQKFQTDSLQLKLDRAKQREQAIRKGQMADPNQPTSLNQAITPVGTCTSMCPVLTTGLEGCALRDSF

SEQ ID NO: 30774 - protein, 282 aa, A.fumigatus
LFQFVLSALFHHIPLPVQSNLRRQTMNTAIITGAAQGVGLCIAEALAQRNYRIVLSDIDTEKGPAAASKLNLTHGEGTAAFFHCDLSNLREIDALLSFTIETMGGFSVLINNAGYLRAPFLALSAQDIQDMITVNLTAPIYATQQAIKYWDGLHQGQAGCVVSVTSSSSFKTYASIAPYGAAKAGAAMFTFAAGAFHPRVRVNAVAPTAIATGFDKNRMRVETDRTGPGYTPEEEMRAMGLKRLQPQEVAEAVVRCVEDKGLYGKVLYLDAVEGIKIHDGYT

SEQ ID NO: 30775 - protein, 149 aa, A.fumigatus
SALPSSPVVKMPRVSFTKGTTLQGHYIPPGTEIAFNLIAMNNREDVWEEPERFLPDRFLKDSDLKRSVFAFSYGTRSCIGRHLAWMEMMTILANLLKDYDWSLPEDSLYGPHHVDEKGIPIRMPSKCHIVFAPTHPDRDCQLVISRPKT

SEQ ID NO: 30776 - protein, 98 aa, A.fumigatus
SSLNITKITKLLYVYPSCILIPSTASKYRTFPYSPLSSTHRTTASATSCGCNLFNPIARISSSGVYPGPVRSVSTRMRFLSKPVAIAVGATAFTLTRG

SEQ ID NO: 30777 - protein, 488 aa, A.fumigatus
  UNSURE (62),(79),(80),(438): Identity of amino acid sequences at the above locations are unknown.
ESSAIRLFLPTSLPSIFRILISLFPFTTLCSSLVGPETQSLHDTMAVATLISILFAVLALRXCYLLIHALFLSPLRHIXXPFMARVTSKRPLWHLLTGKAEIAARQDYSTFGDIYLCKPNTVYLCDPHDACTVLSSHAFRKTDMYRVFEYEGIPNVSTFTDPAQAQRRRRQLHPFFNNAYLTQMEPVMLKYGIQALKARWDAQLARHKKVEVNYRFDTQLAMFDITGALVFGREFHALETSNLVYTKWVNNTLSYMLVSHYFPWVKRVPLSWLVRGLKQSYDDLVAFSQKSIAIRQADLQAGRPKPADLLQALLDAEDPDSKAPMTAREVQAESIAMLVGGSESTSSVISWVIHFLLLYPEHLQAVVAETRANFPADHTITFNESKANLPYLEACIYETLRCIPTASTSFPRVSDQAIILKGYYIPAGTEIATNKCAXHLHQPSWQDPDRFYPPRFLNQGDIPRNPAEYALRCLPDAGFDLAGTWLGP

SEQ ID NO: 30778 - protein, 85 aa, A.fumigatus
SPPPHPSTGPSHTAPCLPHIAPPLPPLLAAATSSTPLPASLPRVYTLGPCGPSLPACDSCQSPLQLRSAPPHSPSRVDETPQPQR

SEQ ID NO: 30779 - protein, 62 aa, A.fumigatus
CRERTLKVYITRINELIQPAGQFLGRKRQCLQIFSDKYSAAFPSPVERDSHNANIGKYQANE

SEQ ID NO: 30780 - protein, 312 aa, A.fumigatus
RGSWENQENPGRGLRGRQRRRALEPKSAHGGRIYTGSGMACIPGQHTVAPSSEFETGSKLLAVRPANRNKKPPPPPPKSHHGKLINPSPHATSSQPQGVPPRPTKRFSYHGTSSETSLSLTPDTPPSRSSQPRIDYFTPLHDNPAPQSAETLRRSQSQHKRPPTPPLSRRHSQMRRSKSTMSRTNLSRLSMPAGKIEVNASPPSSPGPQAQEPRTAPPMADEAEPDPGQREPPLSRRASQVNPLPPPPPPRRDRVSSNHSNSRSQSAQKKQAEDEDFIPRPSNANDILADLSRLQKEVDDLRGHYESRKVSH

SEQ ID NO: 30781 - protein, 351 aa, A.fumigatus
VYASAVPSSRVVKMLLETSAKPLTCHRVPPSFLVGEGATDFAYEQGLVILPPDGLISRFSKERWHRWLQDLEAAELVERKRDPSRFRMEEDRASFLRRPMLNRNPARLIDNTRLRPHLPSSPFTGVDLLNPLPRLQALGSRQTIAPAPPAMPSNQGHGMGPAIGQPMAVAGGQSMASAPEQGMAASANTHADGATFRACPTKAPCAPDTSTTAHPGAADEDEDMISDTVGAIAVDCYGNIAAGSSSGGIGAKHRGRIGPAALVGIGTYVIPVDPSDPEQVSVASVTSGTGEHIATTMAAQTSAARLYYCQKKCKDGTFESVSEDEAMNAIIATEFMGELLYSIFLTTIDRE

SEQ ID NO: 30782 - protein, 75 aa, A.fumigatus
IIEGEEWKIAFRIKFRYFKYLVILFRLINILVLFKRFIKKVLHKVLHYFIVVYLDNILIFLENRSKYIEYIKEVL

SEQ ID NO: 30783 - protein, 227 aa, A.fumigatus
  UNSURE (126): Identity of amino acid sequences at the above locations are unknown.
EDDFPVDVRYNGNNQQFAPPPGTSDGRPPATALSEKEDHDQPGTGTSNRHPSILRKGMNTAAARARGESISRKHVDFSLGMRDVSSMDVMGDVFEGRGRRVDEVVRLANRENDERRIQEVEEEGEXERRSRASLSKTRTSNSGPSVRAATGSDGRRSTDSHGGHSISSISRSRFFHHRTHPVQEQEDMMEQGRSDIGPALSQIRTISPSARSTDDRGSTINRQPTGH

SEQ ID NO: 30784 - protein, 71 aa, A.fumigatus
DRSQVFLTVHYMARHCIPICFTMAHLLCITKDLFQYASSLVKLSSPIKSVTSASPHLIFVSLLLFYLICQG

SEQ ID NO: 30785 - protein, 156 aa, A.fumigatus
LTGKRLTRQDVTCGLLAIFQYGLLTSAREIFNPRFNLTSALVSGLFYLVPGAGFLLGSIIGGRLSDRTVKRYIARRGGLRLPQDRLNSGLAMLCGVLPVAVLVYGWTLEKRAGGMAVPIIAAFWAGVGLMGSFNGLNTYAAGEFSMGKVKVNVKVM

SEQ ID NO: 30786 - protein, 168 aa, A.fumigatus
RSADPSTARGEDSPAQVHDEQFSDPDYQTANIELARIVGETIAKLYSRRKYSETFLQRVQKLLKALKNWVDTLPDHLRLNENDPEMNPKHISSLHLAFNQVLYLASSFFENNTDLDSVLYLPPVRPSSTSSSKSASPRPTPRARTMPSHNPSGRWVKRAYMQLATVTP

SEQ ID NO: 30787 - protein, 466 aa, A.fumigatus
EGLLDRAGGHTKRGHAPTSWRSLHFVSESRVSITERFLGGFRNKGWTGKTGMRAKALFRLTDDWLDITPTLALRSDQVEPNDERAWQRDIAKFLKKAPSRVRDTHRLRETAVARIPAEAGDGYFQVVLCQGPKKKVLCTSPVFRILSTSLEPSSIRGASLATLPLEVGAMVLGLYAQTAAQTVINPATSLVQSTIQPLKPSWVTQTAAETAYGIGMSMRSSDDDSTQGPAAAMARGQQEAISLETGPSPPYPMSFKARAEAIQGESVYDMQRMRLSKVPDLILDRLHGFFFGWARLLFARENGEWTGSQWYQAILAIRNLDLSQQTHVNMSQVMKRVTTVRFLEEVELPVQSRVEVRVLGFLRPDMPPPRGITEEELLEARNAAAEAAMLADACDASYAQNVLDHPAWGPDSQREAGVVGRAKEGIENIWARGQKVVERVPLHWLGVRSPTAEIFTTGLEASALTN

SEQ ID NO: 30788 - protein, 148 aa, A.fumigatus
KRLRRVCATHIACARRPSHGFLLRPATGTFRLYFVRAPKKRFFVRVQCFAFFPPLLNRARFGALVWLPSHWRWVRWCWGYTRRQRRRPLLTRPHRSYNQQFNLLSPPGSHRLLLRQPTGLACPCDQAMTTVLRALRQQWPAVNRKRSL

SEQ ID NO: 30789 - protein, 113 aa, A.fumigatus
QSMQNTNHRLAYLTLNSTGFIVTLGGGHTTSYTNPAIPGLNTSPLGQVFFSLLLSDLNLLLFTTTTKLVRPELVPGLELGATMLGDVAFGHGCLGHKRGENKAHQRKWGANLR

SEQ ID NO: 30790 - protein, 101 aa, A.fumigatus
KSKFNEMVNKSAARHVSITTALSSSGLVSVIGVVVDVFGTPFQSSRSWCITFTLKDTDFGNGHVWDGLKIKYFKANQSQLPPVRVHDVILLRNITVSDLAL

SEQ ID NO: 30791 - protein, 85 aa, A.fumigatus
LNVELPEMVKGVFSDQIESQIQATTKFRKLLSKERNPPIERVIETGVVSRFVEFLRSPHTLVQFEAAWALTNVFTSGVPDRASLQ

SEQ ID NO: 30792 - protein, 182 aa, A.fumigatus
RLFCQELISKRLFSFPPFSEIFPSSQIRSPLSLVRFVFTPLVSQATMAERYIPEHRRTQFKARNQFRPDELRRRREEQQVEIRKQKREENLAKRRGIQTRDGGIGVGGGMAATESDDEASAIESEVCQPMICVLHALLSVSSFLRPQTHPWSLFVFVHYTLHNSLFHRPPPVAGLSGIRRLS

SEQ ID NO: 30793 - protein, 95 aa, A.fumigatus
NAQRWIFRPAWSKTTFTGDGSAKDPDFQGSKFKVSPHVDQTAVYQAVFGRLNAGGCVGIFPEGGSHDRPNLLPLKGIVLSFDLPHYLRKPRLIEL

SEQ ID NO: 30794 - protein, 397 aa, A.fumigatus
VIQAARRLYNTKGKNLPLPMVVELNRRLVKGYTHYKDDPRVIHLRKAVADYNKQLRLLGIRDHQVEYAKFSWIQVIATLIYRLGKLALLTIGTLPGLILFAPVFIATKYISKKKSQEALAASTVKLQGRDVMATWKLLVALAFAPAVYAFYTATFTWWAYYNRIQGLVPVWMPLWLIVPIGMILFPTITFAALRIGEVGMDIVKSLRPLVLSLNPSSANTLVKLRERRAALAQQVTEVINTLGPELFPDFDAARIVTDPFREDHRPAGKTGVDHSAVPEIRRTSATDTEVESPTREPLPRNESFHNLANIGFFSTRPSSRSRSRSGSFGGRPGSSGQQLKPLSQVTTKDGFEEVSSKIRDAMRERGERRRRRSEDGSWDMASSGPGTPSSEGSRKDL

SEQ ID NO: 30795 - protein, 119 aa, A.fumigatus
TLAGVALMALGTLADNPDCGLKIVPCGMNYFHAHKFRSRAVIEFGNPIEVPREVVDQFKRGEKREAVGALLDTIYQGLVSVTVTSPDYETLMVGEPAFFGPWYLWTDVFLGDSSRSSPI

SEQ ID NO: 30796 - protein, 179 aa, A.fumigatus
SAFPSSPVVKTVYPENSQYPLQGESASAKPGDHITMHCKQQRHISSRPWTCRSNHPSDKYDDSSRNYTQTLSVNGQVVSTLSTSDGYAQGWGSAVECAATDCGTVGAHCKLTRQLAVQNHGLTCTVLLAWIDTKIILDSPDPNYKNTNYKGQGVTGEMSTSDGGKTWTVSTINIPQFTF

SEQ ID NO: 30797 - protein, 66 aa, A.fumigatus
RETATSQSIRGILRRLSDGQEGIGALLFQGQVKDYEAFLNATSSYDIVIHGAAKIRGRHRYRYQHT

SEQ ID NO: 30798 - protein, 64 aa, A.fumigatus
LRFLMNSIGYHSVFYLASQLSGFCSGDHFLREHILLRIKKYSKGGLDVRYTDKCSKSSLLMLEY

SEQ ID NO: 30799 - protein, 265 aa, A.fumigatus
SFIDYSSICCFVGTNRGNLATFKILPGDDGAYMGQFAGVTQLDDKVLNIIPIDADQGTPALATASIVAGLRTGAKLNGVVIAVTVSGCRIFKPATSKGAHKSWDDYLCDAAAVVKTEGRGYSLVGLFGDGNARAFSIPGLKEIGCTSIHQIADMRRLSDSTVCPDGSVLTWTGPSEVAVFSVWGSGTGLYGPLSLDPVFVQRKERPANKHDRRSSDCRLFNPQAAIPARPTITNLQWISGTQYVSPADMDLLSMCIRCSCDNKSR

SEQ ID NO: 30800 - protein, 99 aa, A.fumigatus
ICNRGPGTAVKHSHVGFVAAGFQNGSFVIMDLRGPAVIHTAQVSDFAKTSKRGSFLKHRATESTAPEWPTSIEFGVLTLEGEGKIYPLELWVQADTDRL

SEQ ID NO: 30801 - protein, 276 aa, A.fumigatus
SMSCGGVVKTESDGLYKRNIKALILQTYRHEQDGQGQAASEKSHAEAEFGFDGRVELLITRTRSRKITFIEPVARLGFGLAVRSALRVVETPYVWVQQHDWALEADIPLEPLLEIMQGSEADDAVPVKYVSFPSVRMKRYAVSPHVTDHAALRELTTSLKRDFVVRSPSRPERKIALTPLFFWFDKPHVASTAHYLARVFPTPLAMRRGEFIEDKIGQRARAQMKEGQWAKWATWLYYPDEGDLLCLRHLMGRTWRGFGGPINVKDGFHIATDDES

SEQ ID NO: 30802 - protein, 89 aa, A.fumigatus
ICRGYSAHEHTVLYSNVRLSSASTALPHDIVIEALVSLVIVSAGLVLGAEKLKPISWSEWAGEIEREGGARNPYLRLEERYSFWDIRVS

SEQ ID NO: 30803 - protein, 66 aa, A.fumigatus
TYTSWLARVYAVGELFAYGAINDSRRTTNLAGKSEKWTVRVSHESDLDNLCSAQPCASGKPPAKGT

SEQ ID NO: 30804 - protein, 184 aa, A.fumigatus
NLACCHSRPSVLQLPPSVITPEPRSTINTHLLGVIIYFRDAMNSREHSDMPPATSYPSPNAAQMAQGSMPYYGNRQLTADELLSAELSRETSGPGLNDGSSNGVHHGQSMVMGSSNPGATDMGRPSSPDQHQQHMLQFTPGQQVGVDPNHDLSYGDQSARRKRSKISRACDECRRKKVGVLYLI

SEQ ID NO: 30805 - protein, 141 aa, A.fumigatus
  UNSURE (52): Identity of amino acid sequences at the above locations are unknown.
HQLFLAYSSFLVEMVTLAAMEHNVCQSNTGLGRMIGANLVASLERLGQIEDXRKPYDAARETPSHGFFESPANQLYWDCPLLIKRHIFVYSPYEDNYWPGEVNNELLKATMESRPATPFDLHSLTVAFMTLVKATCLTGHN

SEQ ID NO: 30806 - protein, 208 aa, A.fumigatus
LTIGSYYAKIHTIFPILPHSKDRLLEILHQCSREVQEVFLYALYTVTRTNLDRVLSTFERVTSFDNAQDLLLYYTRQPALVRPTAVNLVWLQATLLMILDCDSRGPENIVLKDGVPKHSLIQSATKLGSDMAKSLDQLKAKRSSDADVDSDANLVRRSWVSLAILARWYAISVADLSVLVNQEIGGREDERVLGSVTAGIGGTSYHII

SEQ ID NO: 30807 - protein, 195 aa, A.fumigatus
QRVRSAAPSATRHVGTKLLTWVISYIKELAERLHTLESQMQPAMVHPDMQYQAMNEVSPPRPYQEFSPPMDAGSIGRKKTYSVFEGLPAGLPNTSYSQPQFNPRSSQNAFGLSALPAQGDVTKLTLIDAGETSTDPMNSSVMGNTAPKPGNLFWSTNEHEIPHGLDIPDVSKHGIEEDMTPLDVDGGALNAYVYS

SEQ ID NO: 30808 - protein, 128 aa, A.fumigatus
CILTSFSTIHAFLDNFSLFFLPPFTYTIKMKQFFFGSDSKSRKPRPVEDKWIVEERSIDKARPLRVVIIGSGISGIIASIRFRQRIPNVDLCVYEKNEDIGGTWLENRYPGCACGKAHHFVARVVWRQ

SEQ ID NO: 30809 - protein, 81 aa, A.fumigatus
RPTFTMFADIPAHTYQATFEPNKEWSTFYAAAPEIHAYWKRVAEKYGCMKYIKLKQAVVEAVWDDSKSKWQLKVGTPSPVC

SEQ ID NO: 30810 - protein, 69 aa, A.fumigatus
GKRAAVIGNGSSGIQIVPGMLPKVAHIDHYIRGRTWLSPTFARQHVDKRGGAELENCLSTHPVMQLKEY

SEQ ID NO: 30811 - protein, 251 aa, A.fumigatus
VLLVEDAVSIGSNARAEIELELQSVHGVTLLGTPEQIGAREVFLQNMKRRLSRKPEMCEDLIPSFPPVCRRLTPGPGYLEALTDDKVDVITSKIIRVDAEGIITADGQHHPTDVLVCATGFDTTFNPRFPVIGRNGVTLANRWQKTPETYLSLAVDGFPNYFICLGPNAALGEGNLLLLIEKEIDYFTLCVQKMQRDNIRAMSVKKEAVEMFTRYCDQYFSRTVFSEKCRSWYKGGTEDGRVIALWPGTLS

SEQ ID NO: 30812 - protein, 69 aa, A.fumigatus
PAIGSSLHSMKALAHPRWEDYTYDYVNDNPNGWLGDGWTENEKLKKINVDYLNDDEIDFPTNVIAVLDQ

SEQ ID NO: 30813 - protein, 84 aa, A.fumigatus
  UNSURE (44),(52): Identity of amino acid sequences at the above locations are unknown.
MLSRQPQESFYHLSKRATVFLSSAWAALVPVDVSDSEDVPYPLXTSPGLLPXLELWFPLVPSCLASSQRKILPPPVGMPWSSSF

SEQ ID NO: 30814 - protein, 143 aa, A.fumigatus
SSSNILGMKARDDANGTCTGPRMRLYVTMSFAETESYQLTCNQQLLYMNYTGVVTMGPAEQAVFSGNAEDGATPFGNSFTHFTFEVRSHPAYYLTFQNLTGLQTGDERYKEFENRVFVGQGRFRVEKGKPVVVEYKVSQVVKG

SEQ ID NO: 30815 - protein, 62 aa, A.fumigatus
PKPMTGGTVKSDPGYPLALDAEFVGTGNDYIHADPDNKHLRLNAHGVIKLVFFEYSGNESTR

SEQ ID NO: 30816 - protein, 66 aa, A.fumigatus
MFKNKLQFQGTYPEVNLKVPATTKLPVADLESNGHLINPMQCLMGPFSPMCPELDVVNRPRLGTNQ

SEQ ID NO: 30817 - protein, 85 aa, A.fumigatus
LHVPGRRRIFTALTDAACIQESSNGSTFELGVFEYIKCMAKVALTLDDLADLIFDNNGLTLLDSESALADEYSVLELLVALITGL

SEQ ID NO: 30818 - protein, 108 aa, A.fumigatus
IGPRSPGGGRYEHCIWALGTGWAVSANSFFAVRKLSEALAQVKDEQSYIVVRERVHRNTAESTNARVKWWSIFQLAVLIGEGIFQVWWLKRFFEVGVTIPNRPVKSCN

SEQ ID NO: 30819 - protein, 107 aa, A.fumigatus
LSAALQVEDPLKNRQYFRQAVSSEDYSFTAHADGKYVYCFSNEGWTSNSKEVSFNVHGIVYVPEHELAQDPLEVEGMSIAYGHWVRAGRCQLTASLQCVNSPRLWLR

SEQ ID NO: 30820 - protein, 213 aa, A.fumigatus
LSSGRTRTDLRLCITNTCRFVVHTLEKTDLPAKHCPPSSPIRPTGVYFTRPFSSVSLAQSPISDLSTMADSSTPSQPSAPPSSQPPPSSQIGSQELPSSSTQATVPGELSGTSEPPVVPKEEPNTTDVEALDASIEQDIDMNPGGITNAAGASDGDNTIGNPVQDAMPTSVDAIAAAVAPSKKETSLREFLGKMDDYAPIVGLTFVIFLLPYF

SEQ ID NO: 30821 - protein, 73 aa, A.fumigatus
AVPITLPCHNVARRKRQMSIQQQQNTIERKPHTPIRITYMFLDWLYVNRLRVLPNANGQLLRLLLCNCWDISQ

SEQ ID NO: 30822 - protein, 157 aa, A.fumigatus
IPDAVTAHYLTLAGLPPPGNGPNQTPPHLARLLALATQKFIADIAADSYQYARIRASNSTSASNPMGSLNAASGLNMPGGAGSGASRRRSRRWWRRRRQRQSEHTSGHSASWFWRWWLRWLWARSDGAHHGRLGHGCCRVWSQRQERGVLPVEKAGS

SEQ ID NO: 30823 - protein, 76 aa, A.fumigatus
ICPAVLDPAPAGGAAGVGGGDAGKGKANTHLGIQRPGFGGGGSGGSGQGRTVLTMEDLGMAVAEYGVSVKRGEFYR

SEQ ID NO: 30824 - protein, 206 aa, A.fumigatus
LRHHEPNNIKPHTPRTLTSHISFKTTVANLTMKVFSSILVLLFAIFHLCLAEDHPDRFPDQKQVDKDNYEAVTLAAAQKGVQLEHGKRYAFREKWAPAYGEYMCLPDYSHVRLIVGQFFNSNTRSGRQAFSAKAFEMISDEAETKLGQTPVGGKVESQVTENWWANHYYNYKKKEWVRVSKDSKYEFLGETTATDAYIENQGMWFD

SEQ ID NO: 30825 - protein, 362 aa, A.fumigatus
SDGQSQLVICGLAVPCRRGSPYVVKMSDNASITPQTIPASRSIFPKGPNFTLSDFSSRDYIVKEFVEALSDSTTSNRRSTVGPGPGNQLFDPKPLIRAFEHAQQRLGELSGDLEIKENELSAAARRAEAQHAQNLGTLGRKLKQTIDSFQQLDTSLNGAALSGGELPGATGSMAVETGRRLEELDRQRRRALDAHFLIQCWDGVSNRGEITLLENLRKSGTGEAKVRSAHIARQLLRISQRLDPRSWDELRAKKNDLYRNDDDSVDEGTRGNTNGIHRNTREIIEKFSETLEKDLLKQFDDFYRKANFEGMRDCATVLQDFSGGASVTALFVNQHQFFIDRSQLVTEELGGDLDSWEQIGGS

SEQ ID NO: 30826 - protein, 267 aa, A.fumigatus
RWSCRKNQPSSNEHSLFMSRCWANSQQRVFQQSIQQRLEMVLEKANGISSLAFLRSLQSSRSYISGLVDDLKAHGLTEHPDPVSSQTALILDQQLEDLFVPYFVGSSYIEREKKSLEELYTSLLFRFTTFHARRKRAATTFMASISKSGTELLSSARDAYVNRLESSEFTPTQKKMLLQLAGLKEQSDSMKPTEIKLMEKDGLPNISYAKRMLKWLAEAVGRGLELGSTSETPKDVSALLSLLLSLMGEGYVEVCLDAVFEAAISQG

SEQ ID NO: 30827 - protein, 471 aa, A.fumigatus
  UNSURE (252),(463),(465),(469): Identity of amino acid sequences at the above locations are unknown.
APPAKILPLCMGIIYIIHVKLLCPRNNLIDLFYKTRQSTMRTSRTSKETASFLQALSPPTRRQTRSSSRTNVLQRFAFNASANGQAETAPTTTGAQFQQSDGDDTSSLSSVDTVDIEDILEPPLKKRKSSPGSPSTKRTTRAPGRTITKREAIKVEPAKPKSRRVPARKIKGENGSIKIEPPSNWETIYSMVKKMRENNPTAPVDTMGCAELYWRSSSPRDKRFQTLMALMLSSQTKDTVTAVAMQRLHTEXGNGRALAEDPIVKKEEQEDIDLKSSQPLKDSTLNLENILAVSPEKLNELIRTVGFHNNKTKYIKAAAEILRDQYNSDIPSTAEELMKLPGVGPKMAYLCMSAAWGKDEGIGVDVHVHRITNLWGWHKTKTPEETRMALESWLPRDKWHEINKLLVGLGQTVCLPVGRRCGECDLAGTKLCKSEVRGLLSKKNAGVKPKDEVLKDDGLASGXAXVKVXGR

SEQ ID NO: 30828 - protein, 75 aa, A.fumigatus
VTQVSRRSPSANRHYSTLALHSHIPSLRHNVIVVSGSTMLTYTDISGGLWGLKITIPPNYPLAPPNIRFTTRISH

SEQ ID NO: 30829 - protein, 234 aa, A.fumigatus
  UNSURE (135): Identity of amino acid sequences at the above locations are unknown.
AATFDHQEVSCSGTDVFQLDEDVITISSPSLRSALVLSTADRRWIDLLTQIINDTWDESHPQRPKDHGYMGSEEFIRLQFEEYLLALLSSMKYHEELHSCSSGESGQRSRAQLEAYNIEGDPALDFNPDFLAHWXNYFQLCLILKRLTSDALLFSNRWSLRQSLPRGGSPPLGGTGSAGGLFRQQGWREPFHPGTESGVAMEKARRKGFFQPRTNPSAKPGFKENKSSSAWQFP

SEQ ID NO: 30830 - protein, 116 aa, A.fumigatus
LYTIGNIKLFLTVIKYTPQAWMNYCRQSTKGFCMIAVLMDFTGGMLSLIQLIIDTSLQADWSGAQGNATKLVLGNLTIFFDIILLVQHYCLYSRKSRSTGAQLSEHDPLLRTGNDS

SEQ ID NO: 30831 - protein, 275 aa, A.fumigatus
GDIGFADLHWVMKGSVLAYFLCMCSNHLACRIYALGSAVLFGTSFPAEMRSNVAPIGFILGSILIAVGLGGVQASAQPFIGRGCPSLVFAQFKEDPTHFLLSRPIYRANLADKGCKERQASSRNSRSDYPVYLQCVLLVCRVDSTFQNRRLSLLTGMDHHSRMVNVGSLGSIATTLMERYIGFWSAYLLDLCAVMIAVVVVHLAKPKFGMIQASSSQLLSTIADPERINSSSCRTSVRPSPCRSLPMVCCSGWFQPRCCTSRVSVGEPPRNGTMG

SEQ ID NO: 30832 - protein, 149 aa, A.fumigatus
RHKISFSPVNRISLGFIIMSVAMAYSAVVQAIIYRSAPCYSHPLSCPASSGGHTPNHVHVLLQLPTFVIIALAEVFCWPTGSEYTYSHAPKSMKSVLQACYISTAGVGYLLGMTLSPLAKDPLLVVLWSATAAMMFVTACAFRVAFRNF

SEQ ID NO: 30833 - protein, 171 aa, A.fumigatus
SHWRKKKDVVGTSVRTILANVFMQTVIFLYLMDNSENTSWMILASQGFGILLEAWKITKTVNVRLRAPPAGSFYSFLPYVVVFEDKHKLSETEKKTKEYDEIAFRWLYIIAVPLLGAYAAYSLIYNTHKSWYSYIIETLVGSVYAYGFLMMVPSLYINYRLKVGAPQFKPL

SEQ ID NO: 30834 - protein, 110 aa, A.fumigatus
YRQQSVAHMPGKALTYKFLNTFIDDLFAFTVKMPWLHRLATLRDDVIFFIWLYQSYKYKVDYKRVNEFGQGGDSDEEAEEPAAAESEKKLEAVSEASGRDNAEKSARKRK

SEQ ID NO: 30835 - protein, 337 aa, A.fumigatus
LLIAVAYVPSKKRYTDAGQLAKTIASHAYESGIAPSALERLIHILTLKNLLDQGTITTLIKNLYPIDMISSKVVTQVVCCLGPSKNKPSPATQASLLRWLILVYEFCEDRSHLAKLYAVLFNHLDMISLRKPLCHLLSIITRRKHVKPFRIQALMELVNAAGAEEKELIGLLNVFKNYYPDIIVGDLGALRRRGLVFKHPDPEWTSHAKLLQDRNMEQVQAAQSSSFQVVHRGAAKRGKMEVIVPVLQTSRVSSNRTSLEELRSVDHLIGKLDRIELPNQIISAMADNIAQKYLFLVQPESARLRLDDWLSSFFDEQLEHAQDEERGSSESLGYILS

SEQ ID NO: 30836 - protein, 93 aa, A.fumigatus
RLKLMKIKVDFADGKIYLSFHSRVMVYSSSGISQKEKKDVSSHSYFLFRADFSALSLPDASDTASNFFSDSAAAGSSASSSLSPPCPNSLTRL

SEQ ID NO: 30837 - protein, 166 aa, A.fumigatus
QFARLNEQGYPLGLRLLDLLFYRSMSSSTSTSLSSSSTSASPPNRPLRILPLLHLIHGPLWRLLFQRPADALEHSVSPETPNEYMITDNDPLVNTYISVPKEMNMLNCAAFVAGIIEGVCDGCGFEAKVTAHNQPTEMWPGRTIFLLRFGESVMEREKVLERAGVK

SEQ ID NO: 30838 - protein, 136 aa, A.fumigatus
RQDTGRFGEGFNDRPRRRDGAPLGIRDERFLPDRPEDRPKGPTGANASAVRERRRSRSRSYSPRRDRHRDRRDDRHDSRRDRYGGDDLYADRDRRDRSRNRDRSKDRYRPETNSRRKRSPSPCDDRDKRRRTDDAT

SEQ ID NO: 30839 - protein, 66 aa, A.fumigatus
YAIRHLPESSQGSCIPAVVTPSDNGSAGRKPPTYFTPALSNTFSLSMTLSPNRNRKIVRPGHISVG

SEQ ID NO: 30840 - protein, 76 aa, A.fumigatus
LCAVTLASKPQPSQTPSMIPATKAAQLSMFISFGTLMYVFTSGSLSVIMYSLGVSGDTECSRASAGRWKSRRQSGP

SEQ ID NO: 30841 - protein, 62 aa, A.fumigatus
PELTREIRRQMCGRAGRKGKDNTGETYLICGKADIQAVCDLLEADMPAIESCLAPEKRGLKR

SEQ ID NO: 30842 - protein, 169 aa, A.fumigatus
IVLIPFVKSMAALTVCRVQSGGSLKEDNPEQIKQATIYRRAYTAFQLRDLSNEVPLSTIASRYNIPRGAVQTLAQQCHGFAAGMVKFCQRMDWGMLAAVLDHMRDRLEAGARADLLEMAQVTYVKGWTARLLRENGFRNLRDLAGADAKDLVPVLMMVCQLVVFKHAWG

SEQ ID NO: 30843 - protein, 158 aa, A.fumigatus
WMIRALLEAIATGLVSGCEAIKEYVKCTLLYRTVDKKIASSIMQSSLQELIDEGLLVFKEDESYAATKLGQAVVASAFAPEDGLFVYEELKRALRAFVMDGDMHVFYMFTPIQVAMNTQIDWLIFREQLDNLDESGLRALQFVGVQPYFVNLMCAELF

SEQ ID NO: 30844 - protein, 85 aa, A.fumigatus
RTPSSRALDFIVGAHIACLCRRPNSATDAGMTTEERELIAQAYDQGVLKVIVATCSLAAGVNLPARRVIINGARMGRELVGPAML

SEQ ID NO: 30845 - protein, 181 aa, A.fumigatus
RRNVQSSIEDSTFRAYLKDPYFLKSILPLSDDLVCILSRIFECDPSKRITIPELRQLILDCPQFTLNPVIPWVAPHGPLPYDVISGPQVPVSVPVHAFNPQPSTSSSDSSHYSNYSESAASDSSCYTEVFTDMDSVPSMSSVEYEPETDCRGDLSLDSLTCKDISEAIVVHQSDPQTLCVC

SEQ ID NO: 30846 - protein, 195 aa, A.fumigatus
ITDKQWDTMLAVHNTAPFKLIRAAAPYFRVKDGEDRVIINISSTSGIHGNAYVYISPSAVDISCADGCWVTRGQANYALAKAGLVGLTKTITKEWGPAYGVRANTIAFGFVKTRLTAAKEEGAFITTPDGTKVALGIPGKQLAGRKGDEKQAYPDIPLGRPASPEEAARAILGVCSPYFSYVSGETIRVTGGRNT

SEQ ID NO: 30847 - protein, 82 aa, A.fumigatus
IAGYTTHLMKRIQRGPVRGISFKLQEEERERKDQYVPEVSALDVSQTESGQLDVDADTKDLLKSMGVSSVLNAVVRGFKAVR

SEQ ID NO: 30848 - protein, 169 aa, A.fumigatus
SCHESRVAGAMTEHDPPGNERPCQSCIRRGCADSCRDGERKKPKYLEEGSYRVFTIQYNVPCYKHCASTTLNHTFSSRDAGFQLRTPSPNSGQTACSYQDFSPWTISAEDPFIGLDLDDAQFELEDAFLLESPQSDGIEADSQRDTLLAFAIGSGWSSTFLQSEYEDPV

SEQ ID NO: 30849 - protein, 65 aa, A.fumigatus
EAGGQVHFSSRNMRTLYSMAVDLSAFIPYDDTYMYFLQSALITLGGRLGFHNDIVCFEKDTHMLA

SEQ ID NO: 30850 - protein, 86 aa, A.fumigatus
RPSRQYSPVPKRVMDGSEPGDTVAAAVLSGAPTDLQARTVRYIFRFSSITRRFLTMQLGFTSLRSLQRSPVPGTAITGEWTGTFCI

SEQ ID NO: 30851 - protein, 116 aa, A.fumigatus
IFLNHPPLSDHATRIYKPSKPATQSGTWHSHHWRMDWDILHIGHRWENPLMGWQSSGDFMQGTHLNFKTKEDAILFAQKQGYEYFVQEPNERRFVPKAYANNFIHEPKKLKHIRTK

SEQ ID NO: 30852 - protein, 64 aa, A.fumigatus
SFIDCTVHSPVFKVSRSATWCSYSHILIIIQKSYRNINAVSKLDKMSYIAPPRSLDLDSPQGKE

SEQ ID NO: 30853 - protein, 96 aa, A.fumigatus
YSDPEGGYFVLANMSSVKLPEDYPFPPHVASRPRDFKLCWFLIHEVGVAAIPPTEFYTDANAHIAEDYLRFAVCKNDDVLETAKERLRGLKKYISK

SEQ ID NO: 30854 - protein, 532 aa, A.fumigatus
  UNSURE (400): Identity of amino acid sequences at the above locations are unknown.
NISPEQLITRLSAINLIRARTITRLSPTESLSSGDTFSPFSDRFHSSSGHSAESNPSPVVVMQPVPTLRKRKKKKKKKKKTRNRNRGVNSQDSMAEGPSGSRNETHICRTPHVRPSVDSYIQAQGEKDNQQMRSPEPPEPAMFQSNWTSADCAPSHNELQQGDADLQPGPGTVGKPSSAMLNLGENPGSSVTSLHDKVISAGEASPVPSSSQHPGANKDSRRPANSAKKMLPSIEEAASEATQDSLSNDASTFMMRSKSLSARTQIRDTSPYKTASTILTADEHAPSKPESEKDSSSVTNLDIEQSSQQTPYSKDHESPHFSNSHSHPSPPAESDISTLSTPKAYRNVSSQRPDAFFWQLDSHGFPCAKQSCDKRCNLWDGRTVICPKCGPFSEVRYCCXEHLLQDIKWHWVYCGQMTFTEPCRENSVPRDVRDGPPLLPCLHPYDTPERHRQAVYFNVNIREGDYFVFSDYADWAQAGVPEINLEMRCSHRVLYTIKFEDREKKDRFRRILAACLFSKPWSSTKRASEIAC

SEQ ID NO: 30855 - protein, 626 aa, A.fumigatus
SSTGKPKGTVIPHSAMFAAWDGILYATTQDNSRRIMWSLNYTFDGSFYPLFPTLATGRTLCVAPQHTIVGNLADVITKLRVDQINLTPTMASLLHPDDVPTLEILATGGEPVTHHMLNVWAPRIKVYTSYGPTEATICVTTRQVTPDMNIRNVGRPFPNTTALILDPDTMEELPSGSVGELCIAGPQLARGYLNRPEATNKAFQGTADQRFYRTGDLARLLPNGEIELFGRKDDQVKINGHRMELGEIESVIKQTNVFRQCAVIAATVLKKKQLVAFCSSSVQTPGEATGEDLLLAPTELPEVDQIKAQLTTLPQYMVPTIWLPVSKLPSLTSGKIDRKRLTALVEGMADNVLKSYLPHSETSEICSEAERELQSLWSALFDTPAEDIHANSTFHALGGDSISALNLGSMLRRRGYKIQINDILSRSTLREQAALMVQGQPNGDSTAAEAVPQPVFQPPEAVYERLVELGVSRNDVEDIYPCSPGQIEFFTQGEKPDRFWQLMAVRTLPDDLDFDRWIYLTTQLTKTNQILRALYLQTDAENPQTLVQVVLKHPVLNLAYRSYRTEEEKQSILEAEWQRPFDPAKPFVRYTLLEDSQGTRSLVINLHHSSYDVFTAGLEGGRSIKR

SEQ ID NO: 30856 - protein, 87 aa, A.fumigatus
VRLLIEAPCSWETYYARTLAHLSSKHQPNARPTPTADADADSAESESETESVDDDDDPGTSWFSEHNAPEKVLRFLTDESFPASSPT

SEQ ID NO: 30857 - protein, 320 aa, A.fumigatus
LHALQPLVKTAFEYLPSETESPVTPCSDSSRPEYIHVGWDHNSEILDDLLPLCQLIDSRVSQGKKVLIHCQLGASRSASLVIAYGLYKNRHLDFNSMYEIVKGRSRWVGPNMSLIYQLTDFRSRLQQLSGTSKPAPEEWFVNGPRRGSEPQSSRSERTTEASLTPPSSSSCNSGYSRIATPASWSQTSSGTLSVPSTERATPPSVSPWRIPKSLSHKRSLSPRPLPLRQRFETAQTAAKDVGTRSLAPADAIEKDTVEDPLNLFSPRTSQFLAPSLAPPFPDGLEDRLPGGPHFRTETADPRSPPPGNERLIMRNIDEFL

SEQ ID NO: 30858 - protein, 70 aa, A.fumigatus
SSFLFILFAIHFRFHLIFQYLPLCLLYFDDSMTKAGFDVVICILIPNLYLHFFFLFDKWVTGRLEALLLH

SEQ ID NO: 30859 - protein, 171 aa, A.fumigatus
VPVRQSHILSPGILTIFSFRESSWALSDISNGSRETETPLAMAEPTHQTEAKKTMTGFKPLSNAEDYSLPATASDLSPRAEAAVANGLSLETADEDHEEVDEDYVAVDPDEISDFSYWLRRPPVHHRTKLDELHPFVQTLTVSNVDDCVEVENAFPENERCSREKVCDLVN

SEQ ID NO: 30860 - protein, 61 aa, A.fumigatus
AAPQVHSLTFSRLSRRTGNPSNFQPFPVISAIAVTTVYLGTRAPVSHPESWYSYHLFFPRV

SEQ ID NO: 30861 - protein, 104 aa, A.fumigatus
CDPVASRTTWQSPTYIKVPRLTPFPFKSVHKTKATPTPTHILRTMAPVLKKYKAAAVNAEPGWFDLEESVRRTIHWIDEAGKAGCKFIAFPELCKSPLRVPRRH

SEQ ID NO: 30862 - protein, 104 aa, A.fumigatus
AMCTSGYSVSGLTATQLVTPAYAIETGTFTLAPWQTITAEGLKLNTPPGKELEDPHIYNGHGRIFGPDGQNLVAHPDKDFQGLLLVDVSRAVHGGVFAFSGLTG

SEQ ID NO: 30863 - protein, 89 aa, A.fumigatus
IDLDECHLPKALADFVSLTDPAPMSEANTSQGGHYMRPDLIRLLVDTNRKDLVVHEDRVNGGVAYTRTVDRVGLSAPLDAMNQGPEDEK

SEQ ID NO: 30864 - protein, 229 aa, A.fumigatus
VTPSCSSAALITDSTGIPGYPYWAWKVNYQESLPLLKKYRENSLPSDSEEMRRIRNAARTNKIYVSLGYSEVDLASLYTTQVLISPSGDILNHRRKIRATHVERLVFGDGTGDTTESVTQTEIGRVGHLNCWENMNPFMKAYAAALGEQVHVAAWPLYPGKETLKYPDPFTNVAEANADVSNVHIWVFRLWTNSDPAGHARVCHRNRDFHSGPMADHHRRGAQAQHAPG

SEQ ID NO: 30865 - protein, 79 aa, A.fumigatus
YQSPWRLAGMWSDATIKDVILIFMVQTWLDDSTPPPGDFANCKVCNSPMLLLLELHGDLPDHFPDDERRLYISGSSPRD

SEQ ID NO: 30866 - protein, 526 aa, A.fumigatus
PFLPRSSVRKNNHLAHLTTAQNGLQLSVNNSKSSFSSRRLISIQELGLQDHQLRTLCASLQIPCNCPVDITVYERNSYIGGRSTTVNALDDPKYPVELGASIFVSVNYNLVNASKELGLAVRSADQARPRESDDTIGVWDGEQFVLVLQDTYSWWNIAKLLWRYGLSPIRTQNLMRSTVNKFLRLYDSPYFPFRSLTSAAAAVDLLNTTAVPGEAFLQDGGISAEFSRDVIQASTRVNYGQNLPLIHGLETMVCMATDGAVSIEGGNWQIFDGMLRSSEANVRLNHSVTSIQRNADGTLAVGFKATEVEENSVFEEVVIAGPLQYSGIAIEPPLQHTPDQIPYVKLHVTLFSSPHLLSPRFFNLPSNKRAPETVLTTLPRGVDLGSNKAGVGPAGFWSISTLRTVQAPRSDGTHEKQYVYKVFSPERLNASFVGAILGLENKEYSVDAPIGDLPKDDVSWHYEKIWNPYPFLYPRVTFEDTMIAPNLWYTGGIESFISTMETSALMGKNVASLISQVYTLGRKHRV

SEQ ID NO: 30867 - protein, 239 aa, A.fumigatus
PRGGTAAALICRDPWNLQPPGAGAHGPLHGTRPNPGYSRRDYIRAGWCGIDPGRFVPAQTDGQRVEGKPTAGAEQIVYVPFPAAPSGMAEINLRVSLTVSMGRIAQSDMHLSDGLRIPRGTTLMVSAHAMWEPEIYPDPRRYDGYRFYKLRQVPGQEGQHQLVSATEKHMGFGYGKHACPGRFFAAAEIKVALCHILLKYDLEHRGGGPPPRVWSQGIHLFPDPTARIRVRRRKEEISL

SEQ ID NO: 30868 - protein, 217 aa, A.fumigatus
DQPLSNGSQTRRADGIQSLYWTRECGDPKWHNVIITYTHNVYRAAQALHFWPKFLRPIVARFLPACQTLQAQIAEAREILEPLVAQRRADRACRAAQGKPVPSRADVIDWLEDSHGDQPYDPVAAQLLLSFAAIHGTSNLLAQALMDLCTAPDLIRDIRAEITSVLGGAGLTRAALYRLKLMDSALKESQRLAPNRLCTSPSLPPRLEWPRLISGFL

SEQ ID NO: 30869 - protein, 70 aa, A.fumigatus
DDHIESVGNAYSFAKPCKPAKISPALVPLLMGSNTGGIYGTVPPSAALVILSSGAYNGCSSRTHLDKMNE

SEQ ID NO: 30870 - protein, 227 aa, A.fumigatus
LCPTELTVCRLLPESPRYLISKDRHEEAFDILTKYHAEGDRSSVIVRAEIAQIQRTIKLELEEAKQTWWDMFRTAGMRRRLFITAFLGLFTQWSGNTLISFVPLFCLLDMFLLINARYYLSDLLDMVNITDGVVKSKINIGIACWGLVCGTTLALTVPRFKRRTMYITCACSLLCVYIAWTISMERFLATHAKAAAILTILFIFCYSPAYNLGYNALTYSKPSPCAR

SEQ ID NO: 30871 - protein, 92 aa, A.fumigatus
YIPTDWSAYLIEIFPYFGRSRGLSWFQFYGRGSTFFATYVNPVGLKNIGWKWLLVYCCWLAFELVFIYLFFPETYGRTLEELSFSKFHLWGG

SEQ ID NO: 30872 - protein, 134 aa, A.fumigatus
IAAIAYFAIYGPTNLSMSLTVLHSDSSKDETFLGFDGLCRRASSSIIISESIPRASSSTSGLTEVIWAPHVSAIMDAISSLYAGVAGVIGIATESTVSASEIGVAPDWPISSLHSCSMSSTVSHSSRADMSIEV

SEQ ID NO: 30873 - protein, 714 aa, A.fumigatus
RRSRKSWTFPRAYQTKAMDPILDQWTEVAKTLEISCPRISIVSNVFGRLIRPGERAFTFEYFAMHCRQTVAFNAGIDELSLSDMEPELSRWVEIGPHPSLLPMVSTKLDRDITDLLPSLRKGTPASAAIARLLCHFYQTTTALNWRKAFDEASLTTLPAMPFSGQEFGIYYPHERTQKNLGEGDQNTESHTGHTFLSRIIQRPSEANREAIFETPIAVFKDYILGHRVCESALCPASVYHEIVLAASKWAQLDQGEDVIRTLSNVLYSAPLLYSEDSSAIVRVSIKPSGDHKAGYSFTVASYNAGSDPQQQVIHCQGQLKIRSTAHAQKYARLVPLMERQRERFQRIDQSSTQVFLRKAMYEKVFTRVVTYSELYQMVQSVRIDQGEALAVCRFPNSQREPSGASTVLMDVLLHVAGFVANLNIENEEVCICKEVKSATMTRGFPFADTAFEVYCNNLEIAASNVVIADAYAVDSRGVIAVFKGMVFQRVKLTRMAQALRMTAVRSGHTHQSVPLKRAKLVAPETSARDSKPPDLLADKQRAIREIIANTCNLEASSLAADTSLHAIGFDSLMMIELSSNLSAKLHTSIDISALEECETVEDIEQLCSDDIGQSGATPISEAETVDSVAMPITPATPAYKLLIASIIAETCGAHITSVKPDVELDALGIDSLMMIELEARLQSPSNPKKVSSLELSECRTVRDIERLVGPYIAK

SEQ ID NO: 30874 - protein, 68 aa, A.fumigatus
GSFLRGFWPLWEYPALIGKLFYIYHIGQSSKAYWVPFQHGGLSSEYVSFYLPGSYLIAACFRGKWPRD

SEQ ID NO: 30875 - protein, 118 aa, A.fumigatus
CERTNRKIPWRLSRHQKARQRKRLRAVDRVVDTLSAALRRNGQSTKAIDRWYAEMPREEEMLPKDKYTLFDKKEKTYRKGIHSTFVSTLSLTCSQGGCMRMLTIFFKNCPSGQESASA

SEQ ID NO: 30876 - protein, 110 aa, A.fumigatus
REFWCHFQRVRQLWAWTAAAIAATERQERWAGPAPLFVCTYSKITVTMRRQDITDFIFIKTNMLVSCHIIYMMAWDSARKISSSFSFVWPKYQETVCSYADILLPSDVLL

SEQ ID NO: 30877 - protein, 150 aa, A.fumigatus
RDGLAVWNQVHVKDLARGYLTLLHWLEQTSCEEVAENPYFFCENGEELSWGQCAAEIGRILYKAGKVADPTPKTIPTELYNDLFGKYSGLVIGSNARHRANRLRKLGWEPREKRTFASLAEDEIPLILQETGEFTGYAAPVASGKFEGKK

SEQ ID NO: 30878 - protein, 313 aa, A.fumigatus
  UNSURE (270): Identity of amino acid sequences at the above locations are unknown.
TSLDGNMHECLLIQPRTLTRSTGSVGLINFEVINPLYSRCTRALVLWTPTTENAGTPEQRIKASSHSPVLALFSTRRALVSRQTWRRNQSTKHIPGTPDAETIPIRHQQLLRKLGWRLLPLCALIYLLNHLDCSNIGNAKVLDAETGEQTGMTDTGYSITLTQFAVAYALFDVPSNWILKRYARPAYWLGTLMLCWGAVTLGFARVDNRFTVMVLRVVIGVLEAGNLPWNGLPHHLLVPTGRAFHPHCLHSRNRATLAGAFGRCIACGVXFLNGKGGLEEFRWLFIIEGGSTVLIAPLVFLGFCLTTHPRRSG

SEQ ID NO: 30879 - protein, 444 aa, A.fumigatus
LVLTISMHYCQSSAKVFGAKGEKRWRHSAKLLVSSLACIESKQRSVNMAYPFRRAGEKLKTVAKMDTWVRDQSREQSTTTKPPTRCYLLELPTELLLEIISHLSVIPETCLALTCKRLFAISGAIFTSVRYRNCLISFAHGLKSTSLIWPSRFSQDFAPLFHHYRNGHNFVTTRWQLISILENSRWWACSKCLKLHPRDAFSSRELKRKPEDRACLLGNFAGIVDLCPCKKLTFRDKMDLVELLKVRQRSVADLQSQFGASIQQRFCWHSCTKDYGPTQLQIEIYPELDDQDQLRIKTEYRLTTESGKLGKEEYITPRFGCAHRSVDLWLSSVCQTTVCQSLDSICASCKRISICNSCKSVLKCPRRQPSRVDQDSGKATYHFWTERCLGGTTSTPDQMWASQRIHPAENSVEVDNCSEACPWTVREHPPSVFTTGLEGSTGAL

SEQ ID NO: 30880 - protein, 456 aa, A.fumigatus
LLTWPSSSLLGYSASLRFQPTKRPQLAAQKPKPKPALPKSTPGAASAPAPPVKTTLADWAATEEDDVNGFYIGEKRQRGGRKKRKKNREAQAFVQNWDDIYDPSRPNIYEEYKHSDEQIAEVREWKDRLYAHRMARSPSRSSHSADESRPMNSKLFFAWRSTVKNAHEFFAEQFAPPQSFAPPPNLNDIPPAPLDEATGDDAFARRARMTAGQSDALMSGRTPPAPPPPPEEAPAPIPDDPTGEDAYLRRVQMAAAAQPTLQAPTRPPPRPLDALQPASATISRAPVRYTLPPPPEDIPATEAELEEVFAKEEPAGDAPDEEDGQRSLRPGQKGFAERLLAKYGWTKGSGLGATGSGIVKPLQVKVEKQKKRPDSEGGGFVTPAGRGKIIGGKRKAEEEEGKFGRMSEVIILKGMLDGMDVDAELEGDQDGGLIQEIGEECSEKVRFSIHDWVATI

SEQ ID NO: 30881 - protein, 110 aa, A.fumigatus
SKRLVRNAQKRCASLSMTGLLPSNTDQYGRVERVFISRESGPPVPVFVKFTNQLSALRVSISEFRSHPSLDTDKICQAVNALEGRVFNGNTITARFYDTQKFEEGIYDDR

SEQ ID NO: 30882 - protein, 170 aa, A.fumigatus
SPSSSASTSIPSSIPLRMMTSLIRPNLPSSSSAFLLPPMILPLPAGVTKPPPSESGRFFCFSTLTCNGLTIPDPVAPKPDPLVHPYFASNLSANPFCPGRSERWPSSSSGASPAGSSFAKTSSSSASVAGISSGGGGRVYRTGAREIVAEAGCSASKGRGGGRVGACSVG

SEQ ID NO: 30883 - protein, 527 aa, A.fumigatus
AGNIIINLIDLLLWLLCPNSCNEIASGRKGRAAPLEVYNILLYLQRDLLLLILLPSLHSVMAAQTRSLDQLVKGSPAPGSLPESLSRPSGQLNTLQPPFSQDASDPSSPPRSSTPDLLSTLPSSPPQIYLNLLILESSLRAQYLALRERRRQNTFFLLLLAAWIAYFAYALFLRPREDGSGVGGSIYWMVEMGEKVALLGGIVTALLVWGTGQWERGVRWPRRWLAVANRGLRTMNTKIVIIRGPWWQELLSYLSFLFPFTLPFFPAPTGNFHYIERPSSDKRGSRQHYQQYYNNVDSESGLVEEDLSPGGDYIRLLLLPKSFSPEFRENWDDYRTEFWEKENERRAQLRQKLRQKERQLARQEGGWFWWLGLGLGWKASQRRRLVAATLKSSDGDKHRHHHHHLSSISKHAHDLKSPTRRGPRSESHSRTPSRSTTPVDIDDRPPSRSSASSRPRRGSTTPSSTASEQSMQLRKKKGTKSLSRGLSPLTQAQIREGIYNTSSLSSDDSFLGESRETTQSREASPSV

SEQ ID NO: 30884 - protein, 135 aa, A.fumigatus
TPRSSSSGAPGGRNCCPTFPFSSHSPYLSSLLQPGISTTSSARRRTSVVVGSTTSSTTTTSTANRALWRKISAPEVITSVSFFSPNPSRPNSARTGMITEPSSGKRRTSDALSCARSCARRSANSLDKKVAGSGG

SEQ ID NO: 30885 - protein, 124 aa, A.fumigatus
YCAALPPRGEDVIDTDDMGFGDQRKLPNGPESAATLTVPAGGSPDRIGGSWQLRRISSVVVNGNTSNVETLYQRDTHKSIILSTPLLLTLEKGSHNTITVGGLYNGFDYKGADLDKIVVYPPEP

SEQ ID NO: 30886 - protein, 265 aa, A.fumigatus
NHIHAIAIRPPHHPRHYFHQLPASKMGERIYELDRQGDITFVVYDVPDSLPQTLDQLQPFLLDGSTPVITSPAAAAAAAEEEQTTENEQPQAVLKIRASSKHLSLACPQFTRTLHSGFQESHSLHEKGHLTLEIDNWDPAAFLVLMLILHGRTRPVPRRLSLSKLVDFAILVDYYECYEAVEVFTDMWITALKKPSPAMRLTSLAQAEEWLFISWVFQHQQMFAQAGGYLLRTLTGRFCSELPVPRRVCGIVFEFFLSAGSWAGS

SEQ ID NO: 30887 - protein, 61 aa, A.fumigatus
SPPLQQQQQQQKKNKPLRTNNPKQSLKSAPPPSTSALRAPNSPAPCTAASRNPTPSMKKAI

SEQ ID NO: 30888 - protein, 630 aa, A.fumigatus
  UNSURE (606): Identity of amino acid sequences at the above locations are unknown.
KLTSASKKLQKIAAPFPRPYTSGKSPVPFTAGTKGKEKGAHTRHNANDLISITRESDTWDEWGHVRLIYYPSAPAEPAKLASENAQGGLLSQPPTTPTPLRRSHTHPTPQLGRTPVVEDSPGSITNSPSGKPEEALRGGKVLDIPYSRVSASKAEDLLAGHLDELPDESKYELLHRIRTAQGVASSNFTREQILAIRILAITNLAYVYPESLFQQRILQYDNEQPKRLQLAYQLGELVHLGASGDLPVSRTLQTLALNALDALAKHKSRAIDVCAALSVNVNHGVLMFLTRKAVNELASDERDKDEAYQDEWRDALLALLRTLPGSSTRTPETLVSAGLIPMFVDILNLRTEKARRVYSRVMEFLDTFVHAVRDALATLTNAKGFDAISDLIDYETKTSFENVSRGAGLPPQHKTPSIDYQIPYFQQQTLRWMFRFVNHIMQHNGGGFDRVLRNLIDSPQLLTSLRLVFENARVFGSHVWSNAVNILSSFIHNEPTSYAVIAEAGLSKSFLEAVTSSELKAPEKPPVVETESAAPETQPGDQPTPLPSDAVSSPSPHGEQKDREYNMARSKDARLAPGIMPAAEALSCIPSAFGAICLNSSGLELXPGFPFFPGKNALESFFEIFENPQH

SEQ ID NO: 30889 - protein, 780 aa, A.fumigatus
  UNSURE (754): Identity of amino acid sequences at the above locations are unknown.
DKSTSIMPKNRPATSGYARLAQEEEDRSNDAYYYSEDEDDLHGPSGTISQSASRYAPISARAQMTPAFSSPPGHRRRSSGHYPRGRRNSGVYIKAINARLERWAEDFASKFKINRVKGKTLEQEKLEIYHSVFQPPDGVRPISAEALESEEVERAQRQAREEFEAVVESVRTAIELGVHPRMISQGSSGSYFARNSEGKIVGVFKPKDEEPYASRNPKWTKWLHRNLFPCFFGRACLIPNLSYVSEAAAYVLDSRLRTNLVPYTDIVYLSSKSFYYDFWDRRKAWMGKKPLPPKAGSFQVFLKGYKDANLFLRDHPWPEQTNTGFRAEDAPKRKKRPWNEACRPSGIHSDDEDEDDENNYASSPAPRDESGERRFYWTEQLKQSFREELEKLVILDYIMRNTDRGLDNWMIKIDWKTEDVSIVAEPPKSNGRQQDDDDDEHMPPARPVSTSPGRTGTASASYPYRRHETMVAVSRTGTPLNSTEPQATIQIGAIDNSLSWPWKHPDAVSYIVFPRLQLRFANLTQWRSFPFGWLFLPVSLIGQPFSQKTRDHFLPLLTSTAWWSGTQMALRRVFSQDADFKESMFARQIAVMKGQAWNVVETLKHPDHGPLELTRRTRVCVWDDLVDVPVAIPLRGQPSTDAQKRKMRRYDSDDRHDDYDPDNEEMDIGAAMSLPSQPQHDLLGLHSPPSELPNPNRFELSRGREHEEGPTQDRSPVTLGRDSVDGLGLGRDTDRNWAPLPSRPDHKRHRKQSXMSSAHGHAQFVLGSDHLQRPPRLCNC

SEQ ID NO: 30890 - protein, 68 aa, A.fumigatus
KNQKLDSRGIEPRTSRNLGLKTCIYKCKASATTTELQAHSLVKFTINILCSGKTVDGCSLISGRWITG

SEQ ID NO: 30891 - protein, 60 aa, A.fumigatus
RQQLRTSYLRNSHHVEGKAKVGISDAALCGSAEYGERCLFVLYAGVIILFPKKLSQTQES

SEQ ID NO: 30892 - protein, 135 aa, A.fumigatus
SLLHYSIHSFIHSFILSHSLTMRYTSLFTAVTAALASTAAAVGVSGAAEGFAKGVTGGGNASPVYPKTNDELVSYLGDRQDRVIVLTKTYLTLSPHRMKMNGKTLTCGHSFDFRGTEGYTSGTGCATWGINARMS

SEQ ID NO: 30893 - protein, 209 aa, A.fumigatus
VRSTPSHERGSKLTEVDGGAVRGYSMLIILQELMYRIYVETEGKPPRRDQIPKPCDHFDLIVGTGTGGLIALMLGRLRLDLETCKEVYVRMTRRVFETDKTIAGIPYRSTLFKASKLEEAIRECVREHTVFEAEGNDMPNASSRNSIASAPYSPAAIPQRSVSRGSFSTSGASHPSTPISQRHSAIINGLRWGNPDALLYDNRENRTKT

SEQ ID NO: 30894 - protein, 157 aa, A.fumigatus
IVLTGFSAVTALYKGTPRNGSAVLLRSYDSRKEPPPEFNCTIWQAGRATSATGLAFKPIQIGQHVFIDEGAGTYNPAPQVLDEAAVNEWAWAGNRGVYQRGYRASVRRAPTVGSMSGGKKYFGGCSRHICPGPDERLIPQESEGGFAPKGKKNFPNF

SEQ ID NO: 30895 - protein, 166 aa, A.fumigatus
LSSVIIRLTSSNSPQAAKSAVRALADTLRLEVLRHNSARTTYTIHIAFPADFISPGFVLEQDTKPDLTKRIQGTNVATFAQLEEKFPSSEKVAQGIVARVDRGDFIICEDSLAASLLFTNMVGLSPKRGLGIVDSLWSVVMGWFVVPVLRRRWEKMCREDAINRLR

SEQ ID NO: 30896 - protein, 115 aa, A.fumigatus
HHPTPHKPPKAQSEPWQTPCAWKSSGTTPPGPPTQSTSPFQPTSSRLGSSSNKTPNRTSRSGSRAPTSPLSRSWRRNSRPRRKWPRGSLRGSTEGILLSARIHWLRVFCLRTWLG

SEQ ID NO: 30897 - protein, 664 aa, A.fumigatus
VLSHLKVPANSVLRPPPHISPSKKPQFLATGGSALKDLGMTRLKATRDGILQAGHHPQNDHGLRDPSQNSSKTWRPYQGRWDPNNPGWRSATAIPSRSDNAVSSGSRKNGTRRNARFFDRMSKGEPSPYTPHLSGSQQAQVPHIQLQQPFNAPSATPQLDPNVNSFPVLPMNSNTSDTSNNTTMQLPFLPLHVPHSQSAQSQILPNNLSFTPYGFPPMPDLNSPEKILPFMPSVAPFPPLNLSVFSPALAPPVFGGFPFCPFDPMYPTTVGPTGGSSQGPTLQPLLPIPPRDRRSKTPEPPVPTKEYLTQSLLAPKLNPSRQPLLVILDLNGTLIFRKHRRLPPSFAKRTGLDQFLDTLLKNYKVMIWSSSQPETVNAVCEKLFPGEKRKSLVAEWGRDKLNLSRSQYRSKVQVYKTLETVWSNQEIQASYPISHQNGRFKTKKKAAQGKSRWDQTNTVLIDDSKLKALSEPYNILEIPEFTNAPGIDESHIFPKVLECLDSLAQHDDVSKLLHLWNSKLATNITTNSTILDLDIGVIQSPQRQNGSSLITPSTPQEIAQARKERRRARKQEKKAARRAAAAIGNAPANVPTSAAVSAITAEGINDGVTAVDSTPATSGDDSAILTATAVPQSHTRHSPSPVSSVQSENYLLDRLEESLNVRRD

SEQ ID NO: 30898 - protein, 77 aa, A.fumigatus
LDTVQFGPSEACHLTFMATFKSTIYTDGVRQAYYWIHKMNIKLLGSRSAFGFFMARLTTIIPHLKISLAWIYNIHAF

SEQ ID NO: 30899 - protein, 97 aa, A.fumigatus
  UNSURE (60): Identity of amino acid sequences at the above locations are unknown.
VYNRHHNFQSGWHQAIPFTKINYNDRFKTDTRKCKLQNFDFKCLRHSTSGIIESTIETNXEWWYKGRTKESATDNNFRRKIRDQRPAAYYDFPAVCV

SEQ ID NO: 30900 - protein, 260 aa, A.fumigatus
RYVVLFDITSLALLLTRFGADDLPVIRENIRKGFLETQSKVNSWVQNLKKRLDGEDVDEGPSNQRYGEGQGYSRPRRSGDMGRRSGDRERYDADPQLLSDDFSALELRDSEGLSSPVKRILPATIANLTAAPPPQPPRRPLANPNLYKSASPSPDRRKVSFQEGPPSEIGNLYDTSDPAKRTSTGSKSSKWQPLATVEPSPVAENDPFSLGDSEDERDTKGREQNHADEADRIKRATAEAMAGELGTTKVNDQTQTAGKS

SEQ ID NO: 30901 - protein, 477 aa, A.fumigatus
STQDWTSRIAWLKISLPCVIITCLESLKVCHPLNPRQCPEVDVPMQGGCQAKIKAMPRLDTLISHLVAAKRSLSSINHVWRANEIVTAARAALEECVVVSARTAFLRRGLNNQLRLLYSVRTEVEEISLRGRSEFAAVLKDLDDADTRLRRTLELLRETIVHPAFRPEGEDPKSLHDFVDERGVEELHAALKSSIDRTTAAQAQLDSSNHAFDDELLSIKEALGTYRTAAKLASSRSSSSASSSSTSNSSLPSISTMPSMLHSLEMHAQEMANLLESLVRHFDLCVTAVKHTEGGGAAAKSITGDMPVGVPVSGRMGSNIEEEINNNLNAPLDPLSNSEYQEMVNVLFKDAAEAEDVVMEIQDRIGEMESVLENVLAQRDALRSIYNATTDIYQHLSSLGSTRLPGYIAQAHNFTQVWHEENDRISGGLADLSDLNSLYNGFLDAYDGLIVEVPRQKHVRQRVEKVSVIQAQTGSTL

SEQ ID NO: 30902 - protein, 357 aa, A.fumigatus
GPAPLHSFNTRQQAQQALVSHVLMKLVQKLSGYPRLLLAGNPSKIDLGRLLLGIISAVASGVPFPLIGILFGQLLDDFNAVTCGESESSDSDSAYQHDINGKILIIVYLAIAQFVLIYVHLSCWSLNGARLAQRLRETYLQNVLRQEPSYFDKLPPGEIASRLNGDIQAIRSGTSEKVGICLSSLSFFITAYIVAFIKDAKLAGMLVSLIPAYFLMSFVGSHYIEKYTGRMSDYAASAASIASEALSNTVVVQAFGANARLEEKFSKALKAAETEGLKKATAVGIQSGVLYFIAYSANGLAFWQGSRSIAESVSGNTHGATVGATFTVIFILVEGEFDSILGSERLHRGAGTDHRST

SEQ ID NO: 30903 - protein, 66 aa, A.fumigatus
PTYRLIILPFYIKVSSSLIGMASSGFYYPLASFIKYLASYYLSRSYYYSSFTSSIVLLDLVIKYLK

SEQ ID NO: 30904 - protein, 82 aa, A.fumigatus
NSMVSLRLGIGVVVVVTRVMALIICSCLVIICYNTSNFTLNSLIYYFNIITSLTFTYIAYLYFYLIFITSSLYKELLLYIIS

SEQ ID NO: 30905 - protein, 94 aa, A.fumigatus
WNNEPPASVCFHTLFLIRSSSMHLMSNVQRLVLFVHQVGLFRLRRLSAPAANSMTLTRKSRLISYPHPLSTLQGCRRPGQHYGVRPLNYPKHAS

SEQ ID NO: 30906 - protein, 72 aa, A.fumigatus
WCSIIRVQKPTVDNSLPPGSRDQTSGESPLATGDNGSWNGEGAKVIHPFASMISYWLSFYVIPDTLCIRIPS

SEQ ID NO: 30907 - protein, 88 aa, A.fumigatus
VATIARAHDLRVHLRSYRPPGIGIMPSADGSSSARPNGTSSRSDQLAWYKSQYEQLEAELADFQASSRELEAELEKDIFTTGLEASAL

SEQ ID NO: 30908 - protein, 194 aa, A.fumigatus
KRHSPTFTRARLVTIPKRLPPALPLRNPHRDPVPMSQSTPTSPTSSTSSSLNGRRSVASHPDNSTVNGFAQLPLHPNNYSSSSLLSKETPQSHNHVSAEKDEFHSVTSAQASDDDEAEPDTATVNGFHRESSNEDIISDSAQSEHAALPAAEAVANTATQEPASKPESNDATFEETKSVAESGSHRTSEPAQPA

SEQ ID NO: 30909 - protein, 589 aa, A.fumigatus
LRSSFSSRLVPLQASTSDKLTTGSRAAAIAFVSYHSSDTLLRSRGIAVHPIPSQANPFALSLSTCQMTSILLAASIAGLVALYLYHVNRAMTKVPEEARLLSPRRWTAEEIKEAYRKAIESPVDVSKSLPPKQHRRYIVVGGSGMSTLPIDARQLLITSGLVGNWIVTHLLARGEDPTAIRVLDLQSPRQQILDQGVGFVKVDITDAEAVQAAFTQPWPQQDTSLPLTVFHNAAVIRPGERHKAFLQFCTRVNVDGTRNILAAAKKHGASCFISTSSGSVLLRRPSFWITPWTNWPKRVVQIISDAAETPKEHDQFFGNYAVSKAEAERIIRAADSLESNFRTGCIRPANGIYGVGDTTITGMYLIKGGVPRYVSSLPQGRDLHTSLTPSNSWTYPVIQSFVNAENVSIAHLLYEQRLLDHTASPTKLPNICGQAFTVPDPNPAIAFSDLYLLMTTLAKTPIRFPRVAPVPMLLLSYLLEWYALLQHLYLPRLLPRITGDLEQLQPGLFAISDVHTFADDSRARKSPAEGGLGYVAPMTTLDGMCKQVLEWNRSAGAETVAAAADRGKGVVGVSEEGLDVNLVVPSKKL

SEQ ID NO: 30910 - protein, 185 aa, A.fumigatus
PILRQLRRVQSRGRAHHPRCRQPRIQLPHGLYPTRQWHLRSWRHHHHGNVSDQGRSSQVRFLPPSGKRLAYKPNSIKQLDLPRHPKLRQRRKRLHRSPPLRTASPRSHRIPDQTPQHLRPGLHRPGPQPRHRLQRPLPPHDHPRKDPHPLPARRSCPYAASFVSSRMVCPPPASLLAPSPTKDHG

SEQ ID NO: 30911 - protein, 72 aa, A.fumigatus
  UNSURE (20),(21),(23),(24),(31),(32),(33),(35),(36),(37),(38),(65),(66),(71): Identity of amino acid sequences at the above locations are unknown.
LQEVGLVPWAGQTHPSPSLXXDXXRRAPGWXXXKXXXXLPNVGDLPDWYSDARFAQVFTTGLEGXXGGTIXH

SEQ ID NO: 30912 - protein, 122 aa, A.fumigatus
NSIPDPLGWASRLVNLTETIQFKARLLQLECSIMDCLVKVAPVVPYLNKALPDFAQAKLECSLVEYSTVSPPQMYNVDMSIRPGRFGSRRARGEMIKSQDMGTTYCPGQVAGAPGIADGIQR

SEQ ID NO: 30913 - protein, 350 aa, A.fumigatus
HVTPEMLESVQIHLEADKVGMTPAEKSKLVNAATAVYIDMAVEEMRSRGLAPKADYRVHWWKVMQDFVDSGEGQRVLQETSLTNQELERVIAKLGIEGEVIARMGPEIVNILTGKTHALAHIMRDDLLFRVYLSDEGRRANRYMAEYARLLTSQRRDIRILEIGAGTGGTTSEVLNLCSPNGESFCAEYMYTDLSPGFFNAAKTTLKKWESHLAFQVLNIADDPAGQGFKEHTYDLIIAANVIHATARLTNTLSNVHKLLKPGGVFGLVELTRLTPFYNLTFGSLSGWWAGVDEGRTESPLQSPQQWNSLLKQTGFSGVDLAAYDLPGPERHSCLLLSTALSNSVTTNGH

SEQ ID NO: 30914 - protein, 72 aa, A.fumigatus
THLSMTETLQKKRLLRMTVAHYRQPNVSEEEFYQWVTEQHAARAAKLHAKNGIEGFCIVSRRPIWRRVMNAK

SEQ ID NO: 30915 - protein, 103 aa, A.fumigatus
  UNSURE (88): Identity of amino acid sequences at the above locations are unknown.
YFTPQSFRDFTSELNNARGNPWRVRDFDAQVDFFFRDMETFYKGAADADFQAIQAEEGPFVSGERAEISFGWVETYVREGQVVNVDEXGKHTFLPFKDMSQAP

SEQ ID NO: 30916 - protein, 77 aa, A.fumigatus
  UNSURE (19),(20),(21),(22),(23),(24),(25),(26),(27),(28),(29),(30),(31),(32): Identity of amino acid sequences at the above locations are unknown.
ASKFTLIHCVHVKTCLHHXXXXXXXXXXXXXXTLLNWGKPPGVSPTFIPPWQQLPPFSPSWAFIFPKKAPPQIPPSP

SEQ ID NO: 30917 - protein, 136 aa, A.fumigatus
NLPQLTTYPGQSGIDPVPLVWGAPDAKSRGPVIVTRSAGMLKRRNAIGAHGGSYSIYNALAIAAGDLDVNFRPDFRNSEPTFNFPWQPSWADKTKIVSMDSVWGLDIVQPISLKGPGKAGWGIPGPTDGLFTPGQI

SEQ ID NO: 30918 - protein, 206 aa, A.fumigatus
FLLTVLTGLWAGHVGTPRLLKLFDKYNIKATWFIPGHSLETFPEECAQVRDAGHEIGLHGYSHENPSDMTPEQQKDVLDKTYRMLTDFCGRPPRGIVAPWWETSKEMADLLLAYGIEYDHSMSHHDCQMYWLRTGDTWTKIDYSQKAETWMKPLVRGQDTGLVEIPGNWYIDDLPPMMFIKNAPNSHGWVNPRDIEDIWKVCYLGP

SEQ ID NO: 30919 - protein, 132 aa, A.fumigatus
SSAVPASRVVKTEHVPSSIGPMARDLSSLAYVCRIFANAKPWKLDPKCAPLPWNEDSFGDALSRPLVVGLILDDGVVKIHPPVERALRELSAKLESRGHEVVVWDASDHFDYIKLMDQYYTADGCEDIRRDV

SEQ ID NO: 30920 - protein, 162 aa, A.fumigatus
VAGEPYIPHVEALINRGKAISVYEYWQLNKQKTTLQKRYLDKWNTVRSQSGKQVDILLGPTMPHAAVPHRSVRWVGYTKIWNLLDYPALTFPADQVRADRDRLPDELYRPRNELDGWNWGLYDPLTMNGHPINLQIVGRKLEEEKVLGAATVIEKIWRTAKT

SEQ ID NO: 30921 - protein, 290 aa, A.fumigatus
TRWIREPPTVENVQDRGCLTENVTLTACALKKGCEGDDCKNRVCIGDDCTPTGCTGDDCTDGHCSGSDCQDHGCIGPDCDSSGSGRCFGLQCLSWGCIGLDCSSIDFTCTGSCCRIVTCSGRDCVNGICTGQDCRSEDNDCEAEKADSCTDWISSTLVTPASTYSTTTITTRCDTITACSAKATTTTSTVDEDGLIEGTITDFQWATTSDDADLTSYLESDYSSFWSAFDSTSTTTTTTTKPTTTTTTTSSRPTETSYDCKGSIRCGSFANLHSFCNMAKGFLTEDTLYG

SEQ ID NO: 30922 - protein, 71 aa, A.fumigatus
RPAPTYLIFLLETAVWHLLYITDLDEFLCLLDYFDCMSGECTGDCRGKTTKASTGNDNVEMSLFRNLFGLS

SEQ ID NO: 30923 - protein, 215 aa, A.fumigatus
VGAGLQITPNASRLFEYWQLPNSIWQAAAEPTALTVHRYTGPILANEPVFHKNIRAKYGAPFIDLHRVDLQQALFTRAKELGVTFHLNERVDSIDFATTTVQTLAGNRYTGDLIIAADGLWSRCRECFLGKKDAPLPTGDLAYRIVLTADQISDPELRAWVENPECHFWIGPGAHAVAYSLRNGRMFNIVLLVPDNLPPRVSRQSGSALRNAEAL

SEQ ID NO: 30924 - protein, 81 aa, A.fumigatus
SAPPSLPAVWFRSKKCGSTLKAGIQCLLPAFLLPLLPLPAPLKLNINSPESVPGTMFHCGGTIENEVPGSYPLYNQLALPG

SEQ ID NO: 30925 - protein, 76 aa, A.fumigatus
GSVSPPSATSKGFRIFTTDPFAKSYETKEGNIAIIEMLFSTSLVALILSPRRLQITNTKVCSSSLDNCTFLNSVPR

SEQ ID NO: 30926 - protein, 68 aa, A.fumigatus
RQSTICELTFPTTVLAVRLNRKRLVIVLEDQIYLYDIQTMKLLYTIQTSPNPNGKRCNPLLAFESSAF

SEQ ID NO: 30927 - protein, 165 aa, A.fumigatus
CQTAICALSPSSDNCYLAYPLPQKAPPSSFNPPSHTPPGTTHVSPTSGEVLIFDTLKLEAINVIEAHRSPLACITLNSDGTLLATASDKGTIIRVFSVPDGHKLYQFRRGSMPSRIFSMSFNTTSTLLCVSSSTETIHLFKLSHPTSSPDIRLHQGAEGTANGYP

SEQ ID NO: 30928 - protein, 281 aa, A.fumigatus
LFYSVPGRGLPDLYGCQVRQCCVGLGLKAQQWLIPPIYHIISIKLTGYSDSQFCILEQFFPDGPNHPFASTMMKHFNKLGAPLYSIHEYRSLSEQEQRFRNAGWAHAQARSLWDLWSDNEFVGSSLRAWLDTVEPFDEWEEFALFASHYFLLVAFTKPQTMVQELQKTPALTTEPDISSQYVLLAGNNPRGGQRRFGALIPDSENSMGHHSGLGRQTRDVSTDLYSTCKGMTTPQLPFPPREVSARMCHTVTSLRGGDCLLVGGRASPANAFQDCWLRQGV

SEQ ID NO: 30929 - protein, 73 aa, A.fumigatus
TNNSSIVSKRSVELLYYPKPHFFRYFVKRPPRRSPLINRGYWLRMHAMAESVRQFMKQPSDKPKFVLNLGCGL

SEQ ID NO: 30930 - protein, 149 aa, A.fumigatus
VVENYRCAGRTEGRCSLQSYAKLGCRSDPLPFILLSTDKSLCSTTRFVDIDYEKLMVNKKTAIRRTDEITRLLENVEFLSDESPIQIRSEQYLAIGCDLKNLKKLDDVLKTELLPSDCSILFLAEVSLTYMDVKSANAVLAWASKLNNG

SEQ ID NO: 30931 - protein, 166 aa, A.fumigatus
DRLLSGAGICRWTLADAHDRCGSVLCISTVGFHSQTVLFEARADCNRLMDHYDLRTCYQPDLSGLHLRVYQFQNLLARHRPSLFAHLESLNVEPIYVSQWFLSFFAVSCPLPMLLRIYDVIFLEGACETLMRVALSLMQRNEKKIMAYTEFEDVMQFLLSRSLWDT

SEQ ID NO: 30932 - protein, 259 aa, A.fumigatus
LMFNRYACHADDFVNDFVSLTSLVTKESLQALEASYNQSQGVPTGITFPQMQAAASRFLGRFWAGSGSQAKSFNLNPNNGSMSTRASVRRSASKQSMTSTLNSIESTSDASTAPTELSAEPPKPRAKSAMSHNKDRDLHSQIEDLLMALSDLQRQHADLTRELQQEREEREEDQQLAQSMLKYIKEIEADDPPAELIRKAEERFVASGSAKRVSIPQTKQQLREDLNRWKEMHEIEAGRCLDLTRRSSPGAASAAPFKI

SEQ ID NO: 30933 - protein, 232 aa, A.fumigatus
HHCADPSAAGGEDESTALLLARLEQENNALATNPKSVSRHRLQTRASRAQSLHQIKRLINEDPRSSLRYSQLPPPPMTELEFWAALVADYPQTAQRLPTLTSNKIRGGIPPPLRGVVWPSLAGARDSSLLVEYERLCGESSPYEGLIGKDIGRSFPNVEMFRDPHGEGQQMLAKVLKCFSLYDTKIGYCQGLGFVVGPLLMHMTDAEAFCVLVRWVSTHRLFFSRPELIATG

SEQ ID NO: 30934 - protein, 132 aa, A.fumigatus
  UNSURE (125),(130): Identity of amino acid sequences at the above locations are unknown.
LSPLCQYSADDGHMTPWHMAHLGGIAQRGPGFLMVEATAVEPEGRITPQDLGLWKDSQIEPLSRVIEFVHSQNQLIGVQIAHAGRKASTVAPWLSANDTASEKMGGWPGRVSSPRGWKEPLYLQXGRSIXES

SEQ ID NO: 30935 - protein, 66 aa, A.fumigatus
RYPGEGSEARGRQVRDCRPPPYVYSRDLPGCLAMESNGDVGEFIEQLCFPAIACNAMYENVYLLGM

SEQ ID NO: 30936 - protein, 185 aa, A.fumigatus
DLQTYIVPDTMPRPNPRIPANPRTCSDLKEFLRPLHTEVDTLYKLSYRLSLSYQKLASTSLDEFFPTAITCLPTGHETGRYLAVYVGLSYLRIAFIDLLGDQQVEGHSRVRRTLEKAWPIEEHLRRDHAPDLFTWIGDCIAEVVADGLANPSEKMPCELITGISLCFPVKYMIIPPSGPMHHISN

SEQ ID NO: 30937 - protein, 437 aa, A.fumigatus
SSLRLVQCTIYLIRYDRQKSLDEAVLMPTGKGFALNSDLNLRQALLSGYERHTRRLDEHQGPMPAKKRKLYYLPSLRIAVMTNDTVATLASLAYFIPSLPNTRVVMGLIVGAGCNATVPFRITDLHELKTRHIRAREPDALETLVSTEWTLSSAAAPLHELGITTSWDTELDMHSQRPGFQPFEYMVGGRYIGELVRIICYDWFNRSLGMARSALPLKLVKEYSLTTDFLSLFVASNYSNERLASDLSKRLPPPPTSSWRWTPNLAGDVRAIASAVQDRAASLVAAAVVGLLACTREIQLRSPDSLSAKIDQHAHIAPKGTEPYDLHSRFSSKSGWRNGPEELAVAVSGGVIQHYPHYKETVQRYIDRLILCAGPQEGGRSVFLREVSDGGIIGIGVLAGTASGEIGEIIGSSLQKENTSHGDPKTADNEASPRNQS

SEQ ID NO: 30938 - protein, 78 aa, A.fumigatus
SDSDSACTHRYLMLDDFTATDTLSALDAELHLRASLCRQRDVMKFSILNEDHDYVKFDGIGDESTAVYSLVYSISFDR

SEQ ID NO: 30939 - protein, 155 aa, A.fumigatus
TIATYGYLDGEYIFSAALLLVMVNAAFPHNETNARTMDMALNLLRSMADRGNTYLGSRHSLLLELQASIGSNQVAQGRVDFNAPVTPISTQQRSPPQTIGIGEDARVGPSDWPSQQHITFNLDINDDPGLWEEVLGQIDIDMDTDWIENTLRKQD

SEQ ID NO: 30940 - protein, 152 aa, A.fumigatus
HFPFPGNCLYYALSDQLYGSPDHADQIRLQLADHIAAHRDYFINFIVASGGERRAPRRAAASRYSSSSRYSSSSSSSSSSASPAPPTSEDIERSFESKLEGCRKNGTWGGSEDIQAFCQSFKVDVRVYSTKGIQTFRDVYARGSEESPSNIA

SEQ ID NO: 30941 - protein, 496 aa, A.fumigatus
SSSPAVKTELGQVFDVIIEEIEKTVSETATNIDQGPASRDACALYRSLVQYTTEHLTFEDPIDRLGFVKRVQSLIAKLNEQLTVALSDERHRDYLTQLASYNLVFASQAFQVACHPLVDRKIAHESSDMVKFAARRVLGFVGSRMAQLQMRTFLQNNKSPTKREAGIRADQSALEAYVIVRHVLQSMDELKGCFGELIAEAYLSAGGDLSNSSDIDGFENGWLSLFISLPLNEFDSCGLVRIGARFQEAHDNWLMVKRLLSPVLDNYDTNAETQPISCNNYCRALFRRCYHLINGWGWRDCRPIMQLLYDFFAKRHLYDLKLEESFKSPSFLDELDRNPSFDVQPGDPSFHIFLKILATGLRFLPLFCDKKQIRNFAWRLLPNHDGRYPKEKPISQSDLDAVRNHHDLLCTLFFAVPDGCRPRLEIIKTLVDPAISHRETCNISIRAWSRLVRFKLSTDEDLSGLEPFADWLCYFLGEFLRQHSIARKEIEAQNII

SEQ ID NO: 30942 - protein, 310 aa, A.fumigatus
TTLCPFRRGPWRVILRICPNSKAPGFSRTRRSTPFKEVSVCGRIRPRQVKGTRGLNHTKDKGGASEAKFIVRFLEGKLRLGLAEKTVLVALAQAVVAHEAAVRGEKTPSPEKMAQGEAVLKTVYSELPAYEVIIPAMLEHGLFNLPKVCKLQPGIPIKPMLAKPTKSITEVLNRFEGKNFTCEYKYDGERAQIHYVAPDVVHHYPGAKTTLQKDSKGLSAIFSRNSEDLSKKYPDVLAKLETWVKDGVKSFVLDCETVAWDTVNKKVLPFQQLMTRKRKDVKAEDVKVKVCIFAFDLLFLNGEVSSPIAY

SEQ ID NO: 30943 - protein, 81 aa, A.fumigatus
PTVKQTLRERRELLHKSFEVVVGEFQFAQHGDTNDLEEIQNLLDESVNVSCEGLMVKMLDTEESGYEPSKSKPELAKGILH

SEQ ID NO: 30944 - protein, 182 aa, A.fumigatus
QVKKDYLAGVGDSLDLVVLGAYYGRGKRTSVYGAFLLAAYNSSTQTYETICNIGTGFSEALLEELYKELSPLTIDRPKPFYSHSNVPKDQPDVWFEPRLVWEVKTADLTLSPRYKAAADEFVGTAGGGKGVSLRFPRFIKSRDDKKPEQATTTRAVAEMYRKQEAVLKENTSKGGVDDDFEY

SEQ ID NO: 30945 - protein, 68 aa, A.fumigatus
ESIPIDVINQPSSKTNYLDIHFGETKDHRDRGNHEDDYLDSWSNEFNVAGTKSQDTHTRASLGLSPHQ

SEQ ID NO: 30946 - protein, 60 aa, A.fumigatus
HNPLPLQEGSMEGYFTDLPKFQGPGVLKNQEIYAIQGGFCLRPNPSTPGKGYQGLEPYKG

SEQ ID NO: 30947 - protein, 167 aa, A.fumigatus
DAGFPAPGGRRRGPLIFCLLLNMFLSMRAKDDQSSLVFSGVFSIVWIGEAVVTLQIKLLGGNMYVSPFNVMELRIILTVTSSVTSSFFQSVCIIGYTLFPLVIAAMLSALGLPTIARIPVYLALIAWSLAAGVSILGGSGVIKNRVGIAVYPLFVFYIAIGCLCFIS

SEQ ID NO: 30948 - protein, 60 aa, A.fumigatus
IVRIPGRPYRSSNLLTDKTKAADRDVEYEQRIDRNAYPVLDYTGTTQNAHTCSQGPCNER

SEQ ID NO: 30949 - protein, 68 aa, A.fumigatus
DNLMTTTFAQEDGYHDFDASMTEGLRPSQSSCQPLRCTPINWYDICSQFESFQCNSMLLKIDYFHTPL

SEQ ID NO: 30950 - protein, 85 aa, A.fumigatus
DGIQFCLFPVVSSIIIINSIPILHNQLSSVIRQLTSLTCLGFIHKPALAANLPSYQGSPGVPNSSSGVKVSRSKKQGTIGTYLPI

SEQ ID NO: 30951 - protein, 193 aa, A.fumigatus
FTVDFDTYTWVLSRIPTVFRHIFPTSIKQNNNHNMRLSTLLLPLLPLALANPNPNPVAAPDPQSTGGGLLSELPTILNGVKELLSEDTLNDLQTIVKGGAVLLGGDNPANIAKLLSKDNVNKLQDVIDNAHSLLTPNFVNETSTLIGDATPVCFFFPRSLKLMLTVIAGFGCGEVARWVVGFVDVIGMESGCI

SEQ ID NO: 30952 - protein, 125 aa, A.fumigatus
QRPFTMSLDETLAEKKPQTPTTNSIKSETNFLDALDSLEILPQILQEGILFAGSGTALLLQAATPEIRNDHDKANNGPNVATELGNALQAMLSYVSCLVFATRQEKKTLLDMLNRGQPPLRGSEH

SEQ ID NO: 30953 - protein, 169 aa, A.fumigatus
YAAAPDVQLWIAATLYATATDFYQRIYGRVDYRTAEKAYAEFGLLVHTLGLPSGVWPETRQKSWTYWDDRIERLTVTPDANMFAKDLLHDKAVPRWVQMLKPFLRVVTIEMLPPRLREEYGLKSTMGTRGLYRSTMGFSNAVYPALPVSLRSYPLRYYLNELRKHLNVV

SEQ ID NO: 30954 - protein, 128 aa, A.fumigatus
CHSHASLLTASPGCGIKCVIAKSFAFIFQRNMPNLGLLGITMPNESFYAAAKDGSEVSIDLLAQVIHIEGLRFVFQLSQMEQGLYRHGGITSAFRKFGNRLFEELTAAKNIGTSHMEEKCHAPSALQW

SEQ ID NO: 30955 - protein, 234 aa, A.fumigatus
ARVSPHLSVKRSNNDRIDLNFKPNEYNLLLSIFFIPYVIFATPGAMLGKRYSPARVLPILMFCFGSFTMLSASTKNFGGIFALRWFLGMCEAPFFPLVIYYLTTFYRRGELARRLAILYAASNIANAFSGMIAFGVFQIEGSSIPNWRYLFIIEGGATVLFSIFAFWYLPRSVAEAKFLSEDEKALALHRIQVDSSAIVNDKFHLRDALVIFKHPTTYVFLCIEICPKSSPGVT

SEQ ID NO: 30956 - protein, 199 aa, A.fumigatus
LRVACPRGENGRPRAQRFLVKGESDGSSDLMPGEKEYEIACADQNFLSLNHLHTLSTEDAMTELVKYPGIGPKTAACVILFCLQRPCFAVDTHIFRICKWLGWVPPGKATEVTAFSHLEVRIPDHLKYSLHQLLIRHGKTCPRCRAITGQSSAGWEDGCVIDHLVTRTGKKKEGNTNVPVASKRRTGRKIRAETDGSDE

SEQ ID NO: 30957 - protein, 298 aa, A.fumigatus
EEGSSDIAQVRSPALNTGSSEEVEANNRFEIRRYVLDHQDEILAACCLDSGKTKVDASFGEILVTAEKLKWTIDHGEKALTGESRPTNFVMMYKKNVVTYEPLGVVSACVSWNYPFHNFISPVISAIFAGNGIVVKPSEQTAWCTMFFLEIIRGALSSCGHSRDLVQSVVCLPDVAGALTSHPDISQLTFIGSRPVAHKVCESAAKALTPVTVELGGKDPAVILDDPRTVSEVSSIASVLMRGVFQSAGQNCIGVERVIALPGIYDKLLDTVAPRIQALRLGSVLLDSRPKDARQKPN

SEQ ID NO: 30958 - protein, 134 aa, A.fumigatus
KDGATLLAFLYRVPSRYEPHILRERLWESIELQLIAKMDSLASLVPPALAPLIDTLATNAQLLGVAVISVAAIYLGYAFVLNSKEAAVTFNIPLPAEVRANWTGKKWEDVQGEEKKVLEGQVRGVGLFPLRIDD

SEQ ID NO: 30959 - protein, 170 aa, A.fumigatus
QSGASGFTSIPSYLLPNSHHADHTMRFTTIVTPLLASATLASAFCHNSISCMMGGDSTCNNVCVRQGNPNGGRCLPRDGCPGYDICACYPNNKRSDEVIDADEPLREALKNMGIEEDTVEKLEARDASLDKRSICCSFPDPWGGLCCEDHCSYIGKPGGQCSDKGVCTCN

SEQ ID NO: 30960 - protein, 188 aa, A.fumigatus
LNLASVKARNLKPIEPSLDGTSILPLQRIHTPCNCLVAGANTLVGALSTRLSNVAAVILTAESSPGVGEAAADAALIQGGISSFQLLHGILLDAHVLQGFTQGLVGINHLVAALVVRVAGADVVAGAAVAGEAAAAVGVTLAHADVVAGGVAAHHAGDGVVAEGGGEGGARQEGSDDGGETHCVVCVV

SEQ ID NO: 30961 - protein, 224 aa, A.fumigatus
LAFEACADLANEILEKRNIPDRFTGAQLIQDFVGQNFRGMMISLQAKYKFEMSKEELEEYVIKEEDEVIGKLNEKAQPCAGANEQLKEIFESKKYDLAVVSSSALRRVKASIKKVGQDKYFDDNLIFSAASSLPKPTSKPDPAIYLHALEVCKKKPEEVVAIEDSKSGALSAIRAGIPVIGYVGSYPGDEKKLEMSQRLEELGAKVIMKDWSEFKNCLEEIEKL

SEQ ID NO: 30962 - protein, 67 aa, A.fumigatus
HQGRGPAHTSFYSLNCDLKSIYQFPSGNIAQSIKVQVTSLADLQALLGSFLLSKLFKRPIGRSVLHA

SEQ ID NO: 30963 - protein, 93 aa, A.fumigatus
TTARLLGLNRVPGMIFDFLSLSNAETRVSMHVMTLLPSKHQTLKPSTAPVTKCITQCDLTTDSTGCLYFHYLIKQNHSAVLYFFFFFFSITGT

SEQ ID NO: 30964 - protein, 70 aa, A.fumigatus
FRSTCILTSTHPYLATRDFGCFYNPRENQSVFYFILCIHSTLLSQKDYTEHLARQVIQGTYKKQNSFKST

SEQ ID NO: 30965 - protein, 378 aa, A.fumigatus
RTPLVRAVLFTNNYEKRTFPALLDLLLDTVSFRDWFGATIFHHISETTRSKGKWKSSRYYCEVLLDKLHNTCSQDEIDLLLSCQDSNGDTAALVAARNGAFRLVNLLLGHCPRAGDLVNKKGETATSITQRAHLPEQNIPPPPSSITMGIDHTEGDLTVLETPDQTDALPAEASLATSALLAKISAIMAETNKKLAACYGHTKSNEPVSDDVANPEALYEQLEVDRQKIQEQTAALEAKETEGEPVEAQLERYERLRSTYESLLEQIQQVRLKERLTSMPPPAKENMMPSSSDQNQLLITYQLARQLCSLQKARRAAVRDLAQQTADAGVSTKFDVHRRLVALATGLKEEELDPMAAELAETLEFDRMNGRGPGRRIT

SEQ ID NO: 30966 - protein, 127 aa, A.fumigatus
PAAKVFYSIGFAGIIFSVDVITADTSTLRDRGLAYAFTSSPYIITAFGGPAAAEHFYDSNWRWAYGCFSIVLPVVALPMFCLLRWNRHKAKKSGLLKDKADSGRTWMESIRHYIIEFDSKYLGTFGD

SEQ ID NO: 30967 - protein, 315 aa, A.fumigatus
SVLMVVVLGVFFLAAGLVLFLLPFSIAGSTEDDWKSASIITMLVIGFVCLLVFALVERFVAPVPFLPWALLASRTVLGACMLDVCYQIAYYCWFNYYTSYLQVVYGTSITTAGYITSIFDVVSGVWLFIVGFLIKKTNRFRWLLFIAVPLYILGVGLMIYFRKPSWSVGYMIMCQIFIAFAGGTMIICQQVAVLAASDHDHAASSLAFLNVFGTMGSAVGSSISGAIWTHTLPGALQRLLPDSVKADWQTIYDSLEEQLSYERGTLIRQAIALAYASTQSKMLIAGTAIMALSLVWMFVIRDIKLTKTQTKGVLF

SEQ ID NO: 30968 - protein, 62 aa, A.fumigatus
VPHTKEPLLENQVYSNQSDWLDEMNQMLIQNSSELRTIRELAVIVSHQSYQTFRRPRVLLCS

SEQ ID NO: 30969 - protein, 73 aa, A.fumigatus
SVLSLRFHVREMRASYGSWPTTPMNTCKYNICRSGMDFETDLKCRFFKCYPQLTAFSSSAYIVLTSSTFLVLH

SEQ ID NO: 30970 - protein, 421 aa, A.fumigatus
IATYTSRHAHQPGRRTPLLAKKQETHISVQLYTYPIKSLRGVSLSEATLTRTGFQYDRRFMLLKVIPDQNGAYTLKNMHVPHFPEMALFTTDIIYPDEEKGIPGRIIVMYHPPADDRVDDQDKATKTLTIPLQPDIRGLRQLSIEMHQSPTTGYDMGDPYNAWFSERFGYGVVLAYLGPHSRRVLGSFAPGKSPAHAVDKPVVSTRSLVGLAVLTLVLNGVRVSASASGAVQLTSDELRKHWPGVAATVVAGLLSWILLRGLSAGQDDESITFADTAPYLLTSETSVDELSARFEGGERMDVTKFRPNIVVSGAATPFEEDFWAELRVRQGGRAARLLLTANCVRCQSINVDYATGKMGKGETGSALKKLMKDRRVDKGAKYSPVFGRYVFLDPGSDKAMIQVGDEVDVLRTMDERTVYGQ

SEQ ID NO: 30971 - protein, 164 aa, A.fumigatus
RGSFRAPWVKTGPINNGGLGYNIVSGGTDNHLVLVDLKNRGVDGARVERVLELCGVASNKNTVPGDQSALKPGGLRLGTPAMTTRGFQPEDFRRVADIVDRAVIITQKLDKAAKESAAAKGVKNPNTVKAFFDYVGEGDEISEIVLLRKEVEDWVGTFSLPWDD

SEQ ID NO: 30972 - protein, 137 aa, A.fumigatus
TWHTEKLWPELVSLQKLLLICSHADLIDTTASDETKTDSKASKTDSASDTNTADSTATDSSSGKKTSTGTAKETGTQTESGTSTETATDKSGKNSKTKTSTKSTSIDPRLPAGGTSMLIPTAGATTYYKIGDYVTFA

SEQ ID NO: 30973 - protein, 105 aa, A.fumigatus
NYTSLLVTPSAVNVLATCTMNSATYTLTSNMSVEETGKVVWDTGKYQANATVPLLTATYTLYVVDVDKDIGDTASPGHLGSQNGYLFGMYSPQPYTPLNGMLLFL

SEQ ID NO: 30974 - protein, 118 aa, A.fumigatus
AIFLGNPRSELLGVKERPHGRSESVLARLLRIGAGLAGMCAFPIYFVFQYTDYASGFIPMIGYHHVLMIIIAVAIILLCEFSVCHMCGMSLTCPSLTTGRMFIIITTNTGYLSDIFIL

SEQ ID NO: 30975 - protein, 113 aa, A.fumigatus
LVLALLLAGCSSSSPQIPDIFLISLYYERYNPVFDKAQVDPGVVTATANIVGGAEMEVRVGYFGICVQPAGGAYICNSNATALAEIVTVDQDPLNLIWVASTFKDAVVFPYLL

SEQ ID NO: 30976 - protein, 460 aa, A.fumigatus
RIFLFKLAKPDNRKQLVVDSGFRCHVTQYSRATATAPSPFVTRMRKFLKSRRLTSIEQIGTDRVIDFSFSDGMYHMFLEFFAGGNIIITDREYNILTLFRQVPAGVGEEEMRVGLKYTVTNKQNYHGVPEITFERIKETLEKAKEASAQEGTAPKKSKKKNVDVLRKALSQGFPEYPPLLLDHAFAVKEVDPATPLENVLGDDTLMEQVNGVLKEAQSVTIKLSAKEDHPGYIVAKEDKRPSAESTADAGDPSEKAGLFYEDFHPFRPRQFEGNPEVKILEFSTFNATVDEYFSSLETQKLEARLTEREEAAKRKLDAVRQEHEKRLGALKEAQEIHVRKAAAIEDNVYRVQEAMDAVNGLIAQGMDWVEIARLIEMEQGRGNPVARIIKLPLKLYENTITLVLGEASEEQDAADDLFWDESEEESESEEQEAARKASEMLTIDIDLGLSPWANATQYYE

SEQ ID NO: 30977 - protein, 83 aa, A.fumigatus
IRIFSSEEISIDRSSTVFVLIDLTYRGKVVYVRNSKVDQLRGEFLANDLSSCEILRIQHGGLSCEGRTLTSRDENRCFIFLGN

SEQ ID NO: 30978 - protein, 313 aa, A.fumigatus
RYLSTPKLPPPKNTDFVPSSILVEPTTTTQLSTAETATGTNRPAQLPGSISPANGLTSPPPDSTLIQLGFNGKLRYSFVATTPLSSSQIFLYIPQGLIYALEILGKDIAMFAIQPYDNSASTGYIATVALAYIPTDKVDTLRKLLRSPLSKLYQQPNESVKTLFSMIDPSIPLVVGESGSSSGSGLYSDSGISGSGSSSDGNGSGSNSGNDADAGASRSASARASSVGIGVGVVCGAAAYGAGMFWVARRYRKKRQLHRRSNSTMEQTSEGRGAGSLFAAGGRLSRNSQNSRGSGRGQMISAPVMAENSLGWN

SEQ ID NO: 30979 - protein, 136 aa, A.fumigatus
QLGLAVVPFLPYIFDEPVGEAVEWSFRTALRAYAGEDAVRPFPAPATASAAHPAETGADAPSVSRYLKTQAEKNSSVALGADGSVAASANLSWEEYKAERQKAKEERRRQREAKGWTGPLAWLGLGSDSDSKSKTE

SEQ ID NO: 30980 - protein, 307 aa, A.fumigatus
CRPRRLQSLPAQPARPRPTRRGLQGRQRPLGQRGRHGHGNRRHGQSQRRHRCRARSLADNPHPPHRGLPHGNGQTGRVPEHRKHGAAGVHDPLGGEVLRANDEEQQERLCADMDPYRRMFPSTRAALGKSSTATNVNCNDSWALPSSPSSHTSSTNPSAKQWNGPSGPLSAPTQARTPSGPSPPRPRPQPLTPQRQAQMHLPYRDTSRPKRRRTHPWRSEPTVPSQRARISPGRSTRPSGRRPRRSVGGSARPRAGRDRSLGWGSGRTRTRRVKPSNGSLFSFNTKFGWAGAGRFMGFMRPALELVC

SEQ ID NO: 30981 - protein, 152 aa, A.fumigatus
SLTHIVGFSLSGLLQYSGLVPAQGVLGHDRSTDHLAPATSPAILAVAGKTTASGEERTGPTTFTRLLHSGIGAAMQLTLLAVATSNPEHTRTISCSAAYDTNADANRAGTSRSAATGTGIRIVARVTATAITITAATTAADSTVAIQSAATR

SEQ ID NO: 30982 - protein, 140 aa, A.fumigatus
RTAYGISWTYLFGDVAHEGYKAYLRNRHVLAPPGEAYKDAKDLSANEVVMGMATGDMGSPSAGTDAELAPWPTTRIPLIEDYRMVMVKRAVFQSIASMGLPAFTIHSVVKYSGQMMKNNKNVFVRTWTPIGVCSPPPEQR

SEQ ID NO: 30983 - protein, 339 aa, A.fumigatus
HITRSMSSYDVLVTGSAGHLGTALMLSLPELGFTPFGIDILPSSTTTRVGSITDRAFISSVLMSHPIKHILHAATLHKPHICSHQNEDFVATNILGTLVLLEESAKSPRQIESFIFFSTTSTFGMALSPKPGSPAAWIDETVVPEPKNIYGVTKVAAEDLCALIHKQSGMPVLVLRTSRFFPEEDDDEGRRAAMSDENLKVLELAYRRCDIEDIVRAAVCAMAKARDIRWGKYIISAPPLFKNDARTLDQLDRNPAEVFNELCPELGAVFEKKGWKHLSRIDRVYDSSKAMRELGWEPQYTFAKTVERLAMGKEWRSDLTAKVGRKGYHAVSTGVYTKR

SEQ ID NO: 30984 - protein, 102 aa, A.fumigatus
  UNSURE (90): Identity of amino acid sequences at the above locations are unknown.
DHCLSGTTSGDSPRDLSIIAENEIDFLMEDIEIYSGGTPVSSTPLLGSFLPSLRLATLANSSVKLPGLAQPNLVEEILDRVPLARFQVCXVAFYSTIRPLHS

SEQ ID NO: 30985 - protein, 274 aa, A.fumigatus
  UNSURE (4): Identity of amino acid sequences at the above locations are unknown.
TGTXLGVLDTLKNMPTELPPGTVGNLTAEQEAKLQEFWILLLKVFGVKLDALESAKEASTSASQENKKESKRRFGLFGRGKDSEDGTASEKSAEGITTNLASINISDTDDKYGQSKEFQQTLVDMSPEDIRTTFWTMVKQDNPDSLLLRFLRARKWDVKNALVMFISTIRWRLMDVKVDDDIMKNGEQQALRQSQSSDPIEKKAGEEFLTQMRRGKSFLHGVDKSGRPICVVRVRLHKAGDQSQEVLDRFTVYTIESARMMLAPPVETAVSLKS

SEQ ID NO: 30986 - protein, 64 aa, A.fumigatus
PTSHWRIWYDHDLQSAINIHLPRQDYSPVKFMIKCFEANYPESLGVVLIHKAPWIFSGLSSFLN

SEQ ID NO: 30987 - protein, 170 aa, A.fumigatus
KPYVLKYFCTGIWNIIKGWLDPVVAAKVHFTKNVKDLEQFIPRDRIMKELEGDENWEYKYLECEPDENKPMEDTAKRDKLLAERHELGKEIQNATISWIAASSKGDKDAVATAKDKRKDLIERLREQYWQLDPYVRARSLYDRLNVIQGNGKIDFYSAESMSKGNAASSQ

SEQ ID NO: 30988 - protein, 97 aa, A.fumigatus
  UNSURE (95): Identity of amino acid sequences at the above locations are unknown.
EDICCIRRDAAIASVIYLEQAIAKTPGSAASLLGSLLQGQGSAPLHVIELGSGCGIVGIALAELVPHCSVLLTDLDEVEEIVMKNIAVAGPASLXPG

SEQ ID NO: 30989 - protein, 219 aa, A.fumigatus
PQIREQSVKFFGQNPSTDNNRNSACATLFNLKTRNLTILTIHLWAPCQPPMSIHIPLRRSAVTTARVQTSTTYICSQCRHATLLRRPKRPYTFTQLITLSDGSTFTHRTTSPTPVYRSTRDTRNSLLWNPSSSKLMNVEEDEAGRLAAFRAKFGRSWDANTPAEGDTDTEVAAKGKEAADAHAAAAAEAALAEEEDDNLLDLISSFGQEMEQEPPKKKK

SEQ ID NO: 30990 - protein, 274 aa, A.fumigatus
ILRPFKSLKSRARSILAMASRRSRSPSTPSEGEIIESGSETKATTSQLPLNGTSVDRQTRVSTSSALRSPASVSRSPRQRRSRARTWSRSRSRSRSRSPYRDHRGQKRRHADDYNERRYRNEPSRRGGPRHNDDRHYNRGPASHIRSRPYHDYDRDDYYGGGLRYTDDYDRRGDKRPRTRSRSPYREVRKPKQYSGDEWDSHREGSVASRDTERQRSSTEQLVSERGKPPVVAQDSRQDAEVRKNQVLQVPSHPSSLVEDRYGCPGPLLRFMHR

SEQ ID NO: 30991 - protein, 237 aa, A.fumigatus
  UNSURE (33),(87): Identity of amino acid sequences at the above locations are unknown.
ITGTIQKGYYNVRRGELINERYHVKQNLGKGMXSSVVRATDAKTGGFVAIKIIRQNDTMRKAGLKEIGILEQLREADPEDKKHVIRXERHFDHKGHLCMVFENLSMNLREVLKKFGRDVGLNLRAIRAYAQQIFLGLSLLRKCNILHADLKPDNLLVNEQRNVLKVCDLGSASPATDNEITPYLVSRFYRAPEIILGIPYDHAIDVWSIGCTLFELYTGKILFTGRNNNQMLRSIVF

SEQ ID NO: 30992 - protein, 161 aa, A.fumigatus
TNSALLIASPQLSAAEAPNDSAGDSFPEFGNDTDIANHDAPTDGADKDEPSAADYDPTIDMKAERQKHDAGDSNGDVSSARYDETQTTKQDVLMPDAPQAQQSESKAKDPYDMFAEDDDDMFAEDKEETTQPTHASAVPVPQPQELDISMMNNWDDPEGVL

SEQ ID NO: 30993 - protein, 174 aa, A.fumigatus
SPCSSTANSFLDSHFQVRAVAYPNPNVVISASRDATVRLWKLVSTPPPVYDSTVSSHGSAFVNAVAYYPPTSEFPEGLVLSGGQDTIIEARQPGKTPDDNADAMLLGHGHNVCALDVCPEGGWVISGSWDSTARLWRVGKWECDVVMEGHQGSVWAVLAYDKDTVITGASIASR

SEQ ID NO: 30994 - protein, 345 aa, A.fumigatus
  UNSURE (336): Identity of amino acid sequences at the above locations are unknown.
PGCADKIIRIFNTSGDLVRSIKDSRDVVRALCKLPASHPSGAHFASASNDGIIRLFTLQGELISELLGHESFIYSLDVLPTGELVSSGEDRTVRIWNGTQCVQTITHPAISVWGVAACRENGDIVTGASDRVTRIFSRNEERVASPEVVQQFDKAVKESAIPEQQVGKINKEKLPGPEFLKQKSGTKEGQVQMVREADGSVTAHTWSAASQEWIAVGTVVDSAASSGRKIAYMGQDYDYVFDVDVEDGKPPLKLPYNISQNPYEAATKFIQDNELPMSYLDQVAQFIVQNTQGTTLGQPVQEPAPTGADPWGQERRYRPGDAIATAVDPTPAVYTXDGWKDTSWY

SEQ ID NO: 30995 - protein, 60 aa, A.fumigatus
GLSENASPNTKPAGLGLSPPLPLLYFLDLFNLFHMYLQALTNMLLSSLLLLARCSDQAAE

SEQ ID NO: 30996 - protein, 391 aa, A.fumigatus
LRGPFHPVVKTFAAAISMAGDLLPMMSLLVMFSVVVFFTDRPLRAPVAFTSLSIMETLRSQFVWLSNISRYSAQGAESLRRVDHFFDTAGEIRRHPDGPLELKHATFRRTPIADFRLHDISVSFKQSALNVVAGPTGSGKTSLLLSLLGETVLESGTATCPQDVAYVPQSPWLQNDTIRQNIIFHSSFDEARYNTVIEASGLIQDLQQLPAGDLTLVGERGTSLSGGQKQRVSLARALYSRSSTLLLDDIFSALDTHTTTLVYDKCFRSGLLADRTVVLVTHLPAALKDADQIVQLNHGRASVIKTASESSRAQTRSVLDLVEESEQDAATSGPPTTAEGSSTESEATVNVLPFADQSVQTSRIVKEMSATGRVPRTLCEFIPAEPRSHRC

SEQ ID NO: 30997 - protein, 391 aa, A.fumigatus
TSSKSQNKTQQPAVLQQLQKGLLPNQKPPSMSCLSQTNLYRQVALSKKCRLQVAFHVHYVSLYQLSHVVIDANISLVLRYMLLFGGVSYAMAMMLATVTVQFAYFSITYWLSIWTSAYEKYDHPNSLFYLAVYAAAIVSFLLLQITNNLLYQHGSWTAAKKMHRKLVEAVLSAPISWFDENPIGRAINRFGNDTRSMDTVLIDWLRMSIENGLRFLLRIASIASIMPIFALPAAVVCTIGFLIGEMYTRAQISIKRLCSINYSPIFSHFTDSLAGMTVIRAREGMTGVFQRLLAEKLAVHARSAEAQYNCNRWVSVRSDLCAASVAASAGCVAYFWSGSAGLVGFSLTNAIGLSQTILTLVRTMNDLEVQLNSFPTNKPNTPKSNLKEETE

SEQ ID NO: 30998 - protein, 67 aa, A.fumigatus
SEIASGKLLKILDEATGFNDGIVPGLVKRAVKYYVLSNGIILQPWRLWYIGHILRAGSSSRLKYSLT

SEQ ID NO: 30999 - protein, 240 aa, A.fumigatus
KRWCNSGHYSRRLGRRKVSTSHIPAPQKTSKLTSYGHSSLREVPDHQELFLSPTTLSSFIVEVNQRVTQEQALSTLDAQAAVPGGIPATHETIDKAAVMYHLRDLCDEDDTLQVIIPATAVTPAKIPASARAHAYKGVVQMTTPKRQRRDTNTGRIPVSVGGAAAGSSADGPQTSRVTVHYLLVRLEAQESDLLIFFNVPHDEFDLSGDPRGLSKEEEVATEAIDRLVQTLEIRDWALFA

SEQ ID NO: 31000 - protein, 109 aa, A.fumigatus
TGMHLCLKLIPCAKTSLKSTFTNLRSDGLHQDSATSRESGTSSTRLEKSQYRLREDVEGLEDNALEVYYPLQTGDESDCGRYWLVHKPGYGGYSTIWLARDLQRARYWE

SEQ ID NO: 31001 - protein, 212 aa, A.fumigatus
  UNSURE (57): Identity of amino acid sequences at the above locations are unknown.
TFRKGIEVTCCLSLLKSGHVIDFDNLAMRLPYVFDSPPTSTPEEAEILARVKARRAXGDLLPLDRALLHSFPVADGWNSFIGAIRTKTTLSTIIKELIICRVAVLNGAWFEWEQHAPLLEEGGLGDEGMRVVRDIHADISLNIEEKALSPAEGAVLKYTDAMTKTVTVPDEVFQELKGFFNEREIVEITTTVAAYNCVSRFLVALNVGEKNP

SEQ ID NO: 31002 - protein, 74 aa, A.fumigatus
CERNRQRSCNTDFHSLSFAESPSLSSSKFDYFKYLLDVHEIFRVHIASLQHVSIKCMTNGFGLPLQLRLTSSKL

SEQ ID NO: 31003 - protein, 156 aa, A.fumigatus
GCTMTCQDRPYSRDPHNDIRITLYSNLNWKHNDAHSINCPQYKYTLSASPLIFNYRLRKKRSLPKYPETIMPSGFASNNLYWETEAPLQKGKPTVLFIHASWMSSAMWEETIQLLAPQLPEVNLLRVDLNGHGKTTAGRKEYTLWNQAEDVLTLLV

SEQ ID NO: 31004 - protein, 207 aa, A.fumigatus
  UNSURE (108): Identity of amino acid sequences at the above locations are unknown.
GIRKTDTANSTANIPQRELELSNVLIAAISMGSMIALRLVLLDQARFSGLVLLASNASEATNAQRDAFYQLRDIWVATPAPSEQIMNAAILSWGGNPDVEGPRATRIXQDWIQRHSGAENVEPTLTSMMERDAVLNRLGEFRVPVLLIHGEDDKTYPLQDAVEIKERLVNADVRLEVVKDEGHLLIHLREAKDVAEWIQGFVQKVLK

SEQ ID NO: 31005 - protein, 65 aa, A.fumigatus
NDQLNWLGAETDYTGPNWGIGFAKAKTIVLASPDYQVIHGQPLFGEWPECSPSNPVLGGHQGLSV

SEQ ID NO: 31006 - protein, 224 aa, A.fumigatus
PRQTTRSSMGSRSLENGQNAVQAIQSSEATKGSLSSVQLDVTDPTSTASAAKQIEAQFGRVDVLVNNAGVFSQSHVTKTAMEETFAVNSIGPALVSEVCNPLLMKSARPYSIFISSILGSLSEAADPSSSVHYYDGVAYRMSKAALDTLVVQQHKQFSPKGIRVFAVCPGLVRSNLRGKSEEDVSAGGRAGDPMVPAEMILGIIQGKRDADAGKFLRGDMVLNW

SEQ ID NO: 31007 - protein, 101 aa, A.fumigatus
SDIDRSGWSGLAAIKTYLQVNPSSKVMLLEAASSIGGVWAKHRLYKGLKSNNMLGTYEFSDFPMDPATFGVQPGQHIPGHVIQQYLEPIGGTFQVPGTHSG

SEQ ID NO: 31008 - protein, 620 aa, A.fumigatus
RHRNAFALAVSIPAIAIQAEIVLQAETPPVPQAEPIAVTELPLPPVAPSNHSGACTKSINPHGTGCIGITSDTFQAGDFTPDGNHVLANVEFVGAPTAPDPASVYTGQQLIAVKVDGSLFPNGDPWKCLSCGVPAGQAQSLDPARDYPHAARNGRQALWGHNILDCGDALLVSDECTPNKTHVYPIYWSSGSMRELRMHPDDVHMGWSSFTKGGQNAFFGRLLFNPNPTTGSPVVPRYELIDVNILVDPNGRPSIMAEGTQLRLHDEAIVVGELRGFSGAGDEILYIGPTREANNVDLFAVHVTSGAVRRLTSHPEYADPIAFSHDNQWFVVMDTRGSNRQMWMSGMRYVPPLIDLVTMTAAWSTRNNGARRFFQPILVDRYGDRGSYFGQQVNAAGNGTSGSVNDPNWNGRADPAFSPDGTKIVFWQSLVIPPACGDPNPLPCPVSTAPGGRTYRVILAHLTSRQPAAPAPVYKVPDMIPWARAFSPGASTPPPYQLTAGLYSLPGKVHGIAQVHLTAYPGFGGFKTVAVNYTNYSDDGRHLIHGRETVTLTLSESNPWWNHLDWYSDLTQTGAVQATKRTGPGGFQLSIDAMQNIFEANGTLTTTVGGVVYLQPANGT

SEQ ID NO: 31009 - protein, 61 aa, A.fumigatus
LLSRLMGHSSLMGIHGSASAVASLQGKHKALIPQGITLMLLEMAAKLYGATTYSTVVMLSS

SEQ ID NO: 31010 - protein, 160 aa, A.fumigatus
RVSITIGILVSYWINYGTNYIGGSRCAPDAPFSNGSKFDPYRDVPSGGCDGQSDASWRLPLALQILPAMILGLGMLFFPETPRWLMMKERYDDALRSLSKLRRKARDCPELVNEYLEIKASILLENTFAREHFPNMSGLRLHAAQVGVLNQSSSVSEQFY

SEQ ID NO: 31011 - protein, 91 aa, A.fumigatus
TSLLATGVYGIVNCLSTLPALFLIDKVGRRPLLMFGATGTCISLAIVGGIIGAYGSDLVNHKSAGWAGIAFIYIYDINFSYSFGLCPRLVM

SEQ ID NO: 31012 - protein, 224 aa, A.fumigatus
NKISTLEVIDCTARMIGRTMDNTPRGGFSLIYQNPYLLGVASVSPLSIGKGGQSYPDYYLQFSTLGGLLFGYDQGVISGVITMESFGARFPHIYTDSSFKGWFVSTLLLGTVNVLIFPSKNNTDALLAAWFGSLINGPIADRLGRKLSINLAVVVFVIGSAIQCGAVTIPMLFAGMFHHLQDTSRYLIACRESYRRSGGWSVDHGGAFVHLRGMHPHLTEEGEE

SEQ ID NO: 31013 - protein, 90 aa, A.fumigatus
RTYGNAWILSRVHQSTQSETLICGTPDHVKSIGASELFKVNTRLKSMTQNWFVTSALLHFMDIENCLSPCSLTGIEFAGRLMNSPSTSRQ

SEQ ID NO: 31014 - protein, 66 aa, A.fumigatus
QLFQTRWLKVNVQIDYLPFAGRLLHTFTCEKSDTTSNLPDPATAVHLASVKLARLVQDPAKQLESE

SEQ ID NO: 31015 - protein, 106 aa, A.fumigatus
GSTDAPLFCVRGASSATSYRVSLLGISFSWTMTNSCRLENIEGDWHEFESKALRKEKDKEARRAEYQKDKEKRKAALSAPQSERETKRVRQDVEENLQPSAQPVEQ

SEQ ID NO: 31016 - protein, 134 aa, A.fumigatus
YRPPELLLGETRYGPAVDVWSAGCVFVELFTKKAVFPGEGGEISQLEKLYASLGTPTRAEWPDLVEMPWFELMRPTERKKRVFEDIYREVLSPAALDLVSQIFRYDPTKRPSAEEVLTHPYFVSEEPAPQQAIE

SEQ ID NO: 31017 - protein, 118 aa, A.fumigatus
WEEYPYSIVAQPLLKKCSTPHKSLIYTMSFSNLVSDLAFRDAYDDRSSQISHSRSQATARSYTSTAATSVSISGDISSQLHAGYSHPLTRSWQAERQLTKVRGVRVVSQIIHALKTTT

SEQ ID NO: 31018 - protein, 309 aa, A.fumigatus
LGSFLISMQEMLIYPLFITDNPDEETPIPSLPNQHRRCLNRLVPFLRPLVQKGLRSVILFGVPLHPTAKDALGTAADDPSGPVIQAIRLLRSRFPNLYIVTDVCLCEYTSHGHCGILREDGTLDNAQSVDRISDVALAYATAGAHCVAPSDMNDGRVRAIKLKLIEAGLAHRVLLMSYSAKFSGCLYGPFRDAAGSCPSFGDRRCYQLPPGGRGLARRAIQRDVGEGADIIMVKPASSYLDIIRDAKELAKDMPIAAYQVSGEYAMIHAAAKAGVFDLKSMVFESTEGILRAGAGIIVSYFVPEFLDWL

SEQ ID NO: 31019 - protein, 230 aa, A.fumigatus
  UNSURE (99): Identity of amino acid sequences at the above locations are unknown.
TGTAPRHRVGMFLGMSIQLSHRTVSEESEKDKLIRGELYRPFDIHLVEERERCKAAIWRFNNACNPVSGLSAKEQNRLLKEVLIPPGSVVVSPSSVGPXRPAGFIGQGAVVESPFQCHYGFNIHIGEDVMISENCLFVDDCPITIGAHTWIGPRVTILSSMAHANMQERKGSQSRYQGRPVTIEEDCYVGAGCTIYPGVRLRRGAYVAPGEVVKSDIVAYGFQGLKPSYM

SEQ ID NO: 31020 - protein, 61 aa, A.fumigatus
MRDLWGVEHFLRSGCATMEYGYSSHQSLPLGTHHILPNDIWLCKCALCIMNYKLLYQYRVS

SEQ ID NO: 31021 - protein, 78 aa, A.fumigatus
TSSSRSPIALADCHYHYYYLSNILHSVGVTNKPTLSDTKRVPKRGFTFVLYFSLSSILIICQLIDLSTFQLLRPPFDR

SEQ ID NO: 31022 - protein, 73 aa, A.fumigatus
EYSHYYSSYSSLSCSSTILTKSGATSPTSTIKRGAVHTVLVALQVLALILSNSNILLVPVPFLAFFFKIFLLI

SEQ ID NO: 31023 - protein, 104 aa, A.fumigatus
KPNPCSESSALYIIVADTTMAYCYLVSPQSLVAMVPYIQLSWHYCLSAGLLITYTSFTLRRGAIFSFSLDHLVYSNSIIDPVKALFFFFFFFWQPHFVCTPCWD

SEQ ID NO: 31024 - protein, 145 aa, A.fumigatus
TRSFPPLKLFFLKAEQRHHWRPATTYSSRAGLASQQPQISRCRLSPSGFSSCSPPDHLPHHPSTSNSTWTSSLLPSTPRSTPPMTREPILSTENGAGNSGLSSACWTGPPPASTTPAATSSGQRCTAAHLPRSLASQTTGATPLP

SEQ ID NO: 31025 - protein, 440 aa, A.fumigatus
ISASASLTSFIDVHQLVRDVEEVQHLRQGLDLSSSSALLGHLDIKVSMILACASLAAVDLDPGKAQELGLANTDIDALVRDLWKGSRTLISRSDLDPLLPTSKAVLSEGRAAPSLEASNDLLQQSGARIAAATDIQVQVVSIRILLLLAARSFAAPSEYLKLHLDVISSAIDASLDSPYDEGTHLIDREWRWQLWSFICLLDWTSPGIYHTSSYFIRPEMHRGPPSKVPGLPDHGSYPSAIEKVHWDRLSQTRHYLEYALALAHLSRRAEDCIVRPGPVSPAQAAELCTELDALDNKLSFYQLLGSTAPDGGTFSTGGRPVDATSITGDLATDKASTEHRRFLARAPVIQSMHLSLELGLIRFKLFRHEVFHLMQAPSTSGTLRMICMDACMDACILVLAQCWSIGNRDVPGVQAQAQAQSQMSLDPSEEVFTTGMEGSA

SEQ ID NO: 31026 - protein, 87 aa, A.fumigatus
AQLRVHGPHASVYTTFNYSHPLASNTGVTTFFDISEALFPPQFCTKFNIIQSIGVNYILADEAYERQHLQPILAASLTIGMQICIAP

SEQ ID NO: 31027 - protein, 118 aa, A.fumigatus
QAHYPLHVMRGKNTGKQRRSIKKQQTVAELKHLFDAPGRGSVMPRQVLWGDLCLTAFPHELNSESTAPMHRYILLSIIRIPLPLTLESQRSLTLVKRCFRRSSVLSSTLYSRLGSTTF

SEQ ID NO: 31028 - protein, 96 aa, A.fumigatus
SWGDSAGGVYSLNGPPSIMAANCTITRTFPFPEWRLPPALFGGIAFTMGWFWYGWTGWTRSIHWMAPTASGVFTGFGIYVIFLQCFNYLIDSYLQL

SEQ ID NO: 31029 - protein, 82 aa, A.fumigatus
CVPSAASVFAANTILRSAVGAGFPLFSRQLFTNLGVQWAGTLLGCLALIMIPIPLAFIKFGPRLRRRSRFAPSPVVFEEKSG

SEQ ID NO: 31030 - protein, 144 aa, A.fumigatus
SFGSHDTFFVAPLFSGADDTFSDTERSAYTQKVDFAKLRSELLNADSTEAQLTRSSHEKIAADLAKLNSRLRDEIGRTQASVRLDLNLEKGRIREEANGQEMRIKETETRIEQEVAGLRERVEAVKFSTLQWLMYGSFATFAQI

SEQ ID NO: 31031 - protein, 640 aa, A.fumigatus
  UNSURE (40): Identity of amino acid sequences at the above locations are unknown.
IFPNKARGSPLMGILTKQGGPGFLGANLRQQYTSNPSGHXGGIPGAIRCYAFPFSEHSIALQIGLPLQSQPKLNKETRLAELLFSKEHVGCLAQIIGQDYTSYQAQASIELAASLIGKLCTEEAHKTVLADSGVLDALAVKVASFVVAQGFVLPGAEEHVQEPGALGSLPPPAPPSAKLAPILRAVTVIIEHSKWRAEHFLSSPGIVTVFPRQLPEFAPSDIKKGPWGSTYFSGSAVPRHAGISPLESLLPSVPLSTPTAPANASNFPPLGHQGARRRPSHSFPTSFSLFESTSSDDDENCIVPWLLNMVRAENGMVRLMAARLITVLFRLGLAKKHRVSLLSYLLIPILIRMLDKDYEIPGDNSVEYGGLIPATTHVKEEAPAVLATLVIDDQELQKHAVDGGAIKRLSQLLKETYNPIHENTKPMWHPDADESAPNSDTQPLECRLGPPGFSPTHCHVMRYRENILKALAALVPFKDEYRKLVCENGVVPYIIDSLKPCPDELPVDPSTPKNTATDGNPTPTLLAACGAARMLTRSVSVLRTSLIDAGVAAPLFVLIRHPDIEVQIAATSVICNLALDFSPMKEVSPYPLKDVIDFDLQLTQVGNYLSGYSPGPMRARALAEHKTSYRVVVGTETCVL

SEQ ID NO: 31032 - protein, 118 aa, A.fumigatus
VFKVETYISYPKDNRSPEKAVVILSDIFGIYINAQLLADEFASNGYLAVIPDLFHKDAIKLSDMESGKADLPAWLPKHQTPTVDPVVESTIKYLRQDLGVKRIAGVGYCFGGKVSSML

SEQ ID NO: 31033 - protein, 122 aa, A.fumigatus
SPVRSTSVTQLIPPLSPRRSSLPSLVLFLSLPPVSWSARMCWVNIKIMTHIENLLEIDNIFTTQLRHESEDILIKTGQPWQINLFSGVTHGFAVRADLSNKHFKFCKEQAFYQAVAWLQQYL

SEQ ID NO: 31034 - protein, 138 aa, A.fumigatus
QLEVGMPEARSSPTWCRPRKIGLHSLSPWSSFARLRHSTGLISTGNVCALTARYRIGLTTALIDPVADDRGGRAEDFANYVTFVKELRSAAGRLGISLTLPSSYWYLKGFDVVNLEPYVDWFNFMSYDIHGTWDGNNA

SEQ ID NO: 31035 - protein, 254 aa, A.fumigatus
RSSRYTKQVVNPHTNLTEISQGLDLLWRNNIPSKKVVLGLGFYGRSFTLSDPSCNTPGCPFASGANPGECTGQAGILSNAEINRVIRTHDLTPVMDKAAGVKYITWDNNQWVSYDDADTLKIKMDFANKLGLGGTSRLPRSIFTAEDRTVSDSHVVVWALDLDNADSQSAQYLNSGGNMTNTNGFSIAKKAADTQQAVAAKLAFWTPCMTEKERKVLGCPGGRCLSSPCGFTDSAKFSCPRRVPRAASRAWKGV

SEQ ID NO: 31036 - protein, 110 aa, A.fumigatus
  UNSURE (91): Identity of amino acid sequences at the above locations are unknown.
SKICDQRCPKGYIYLTQNTHPAGDKKDCAHGTYISVCCEDIETIAQVCPNQYSSDIIFSGSFSNMGAVDSSFSLKSATSKRNNPRLTNFVXENDPTFSSVVRFRILFPHI

SEQ ID NO: 31037 - protein, 108 aa, A.fumigatus
TLIQVFIAIGGWDAGGKVFSDMVSTAENRATFIKSVVQFCQTQAFDGIDIDWECMCPYCSLPDWSHHSSHRPCCRRSWWASGRFCQLRHLCQRAQVRGWTAWDLIDSA

SEQ ID NO: 31038 - protein, 70 aa, A.fumigatus
SLVAPLADPSSPVVKTIRSIGLATALLALSNSFANAHGSHASEQNPSSDWATRHMQGSSLHRRHSIENHH

SEQ ID NO: 31039 - protein, 80 aa, A.fumigatus
TVTRSRIRPGHHGDIEYEYEIHHFERFHGEDAKLEDLTHPEDIEHFRRHDEEEDATDRLEQLERMPIVEANIPQKFLRRS

SEQ ID NO: 31040 - protein, 123 aa, A.fumigatus
KPPLTIYLTEEHHIDSFDAGSFFTLHDYDSSGAWTPDEVRKTYGMDDESNSGVTEERKQQALREVFALFDTGSSGVITRDNWMRLISAGKRLPDLGFVPDTMAILNTSMKSIISRDFTGRTPS

SEQ ID NO: 31041 - protein, 460 aa, A.fumigatus
GSQHRPKWQDNMHSDDPTGDHTPDERVKKPTTHKREPKSRNKCSNPLRKGIQNFVTRHIPSDDLAKHGMSLESLESALPKRFTVYEQLLLLPVNALSDPPAWGSLYASLDSQKRRLLFESIATAFGRMGVTRIAMNAPIAPMNTQGGENRMRSPTGLIPLYGDFGLVPILGRRECAADAGRLPACVLGADYAESGDCADLGPAVYDVFSGGISQRSPGFWVKESALKGLMKAPLGKRSTALTVVDLYAGIGYLFFSYLKRGVKRVWGWEINGWSVEGLRRGCTENGWGCKVVGIGNDGTLSESVPDLVDSLQDSDRVVLFHGDNKFAARVMGEIKGHMERRDAWNRIRHVNLGLLPSSRGAWSDACAMIDLQLGGWMHVHENVDVQHIDAKKQEIITEIGRLRAIAFPSAVQQPIECRHIENVKTYAPGVMHCVFDIKLPPSGETPTGLELSRASKQSPS

SEQ ID NO: 31042 - protein, 68 aa, A.fumigatus
FLFMETLAWCPFWDGENAQPTQEDFQRAFWVQTMQNQGIVQIWAPLYTMFSRGEYHREAPDFGSRNLL

SEQ ID NO: 31043 - protein, 103 aa, A.fumigatus
LSHEAFEEAERRPDNHHLTTTPDSSPISPTPPVTRDEFEYYNHEIYSISNNKPYCRYESLNSKPSSSSRPPQKCLSKTSLLTGTELNSFTWPSAIRSQGVQRF

SEQ ID NO: 31044 - protein, 60 aa, A.fumigatus
PHPLTDKSRISQSNGRERPYSSRTVSGIIPSTSILAHEMYLPDHRSSARGLFIYEVIRAP

SEQ ID NO: 31045 - protein, 495 aa, A.fumigatus
  UNSURE (3),(13): Identity of amino acid sequences at the above locations are unknown.
MLXVRLHTMKAWXPAVEVDGYDTDDENVANASQNVELAKQRVGEAERRNEVAITPGYNLHQVPEQTRLDHSSDLIQDYPDDEAEEEERLLDEMTSGYVMDDFAFDLQSKSALPHQSGSSVLSSRTWENSVVPISATATPGVTLAPLEEDEVVLEDQSEKSQSALTPLEFNLASSPHVPSCPPKQSSVLTASPSVRARRMSGQNPTELKVETSSCPKVGDDALTQGSADTATFRPPPVPKNGSQTLSSANSITKTPAPASVHPSAVHLNRRNASIASLAEDGSTIEVLEKVITEEGKPYAKMSKVPSPARLIGKVPSAPDNLGKLNSGLKSFRPRNVSVPAPDVSANSPETPSSGAFPDLHKGAAIGPAPSLPTPIGATFAPSGLTSGGLYLFDSHIHSPTSPGSPNPMAANAPIPLEPCPESFLLRPFWLMRCIYQTIAHPRGGYLSTKLFVPHDVWGVKNVKLRAVEEKVSNCDLLTAALLKLAKVDTYDADAV

SEQ ID NO: 31046 - protein, 94 aa, A.fumigatus
PHTLRTHPNPTLSPTLKVVTALPTSRTVPAPSWPRAIPLCLNSRSVPQRPAWEISTKTSEGWIVRLIVSGMTSPLSEPLKTLNSIVLDIGMALQ

SEQ ID NO: 31047 - protein, 213 aa, A.fumigatus
LPSRSATRLGLDGCARCVVIATSALAVCTFTCLYTLTIDGNVMMQGHDQYCQQREQYGKGNTEIGAFATHAVWHESMLVKLPDDLEPEYAAPLMCGGATVWCALTCYDIKPGERVGIQGIGGLGHMAIQFASKLGCDVVVFSSSAAKKDEAKGLGANEFHTLENGAVGDAVRPVKHLLWCGNEPPDFSKLVPPSLSAGDCNLPLFQSISAHVS

SEQ ID NO: 31048 - protein, 237 aa, A.fumigatus
  UNSURE (153): Identity of amino acid sequences at the above locations are unknown.
RRLCFARERGGYEVCPVMTRLNLEWSASALSDDCSEEEIHQQINTNVYGPMRVIKAALPFMRAQKSGTIVNISSIAGLQAQPSCSLYAASKFALEGTFRRKSEMNPRLTISRFLRSLSKEVAPFNIRVLIVKPGAFRTNFLSAYATLPAGLNXAYEGTTIDQVLQLFQSRSGKQEGDPVKAVERIIDVVQGTGVGAGKTSCLRLPLGRDCIARAKTKLEEVRKNLDEMEEIACSTDM

SEQ ID NO: 31049 - protein, 117 aa, A.fumigatus
VQETVTYLCSRVFPLMSPDSTIYLLTVSMQQPPLPVMPLISNGIRVQGSAVASRVSVRKMLRFVSVHRIRPIIMTWPMTKDGIQAAFQILEQGKMRYRGVIVGQRHLMGKPAVEKMG

SEQ ID NO: 31050 - protein, 109 aa, A.fumigatus
KSETPDTMAAPQTWLITGASSGFGVVLAEAVLKAGHRVVATARNPIKAAQTYPQIESLGGTWLQLDVTRPDTKETVEDAIRKQGRIDVVVNNAGYALLGSVEDMRYALS

SEQ ID NO: 31051 - protein, 141 aa, A.fumigatus
KSYDGLSGREQYHLPINSRVQNLTYHCKAMPMSKTIEFNVFKGSESGDVIPDTIRRTIQPSEVFVEISHAGLCGTDRLFKHKGIALGHEGAGTVRDVGSAVTTFKVGDKVGFGWVRKVCGHCDFCVSGMYFYLPLHPYDRW

SEQ ID NO: 31052 - protein, 114 aa, A.fumigatus
RYRIVNIHTIDGIPNMTDPTPSCLLTNSTDTMPPNRVSNLSPNLLNGIFASLSQPSRRWSLLRTLQSDNPRDINGELRGTASFHPLRHSSAASDHRDVVYREEGELPNTFGPAS

SEQ ID NO: 31053 - protein, 62 aa, A.fumigatus
VLKYYYNGRMGIRTIQILIVVPIFSALDLMVLLYAACDLWYPSSSIKYLDHQIKPVPENTST

SEQ ID NO: 31054 - protein, 70 aa, A.fumigatus
HVMICSTQKSEKVIYSSMRAITVVMQGQFRKMICFPWEHGACISGSSDDPLFPERPVPSFTSANPYLNQT

SEQ ID NO: 31055 - protein, 64 aa, A.fumigatus
ASNWYESSHLGSWVRVEKARAGYVVPTLVWGYLMFTVPLTTEYYRVVYCLDSDDSKTLAVLHWL

SEQ ID NO: 31056 - protein, 78 aa, A.fumigatus
LPPVNFLQYLLQLEPETASNVPEDATSESPLWGYRVGWSISGNGASEYHCERTCPCREHTCTGDHQCLEGEIIWLANA

SEQ ID NO: 31057 - protein, 264 aa, A.fumigatus
SHPLDTGDRPYMCVLCKDTFSRSDILKRHFQKCSIRRGNPTGATHLSHPQAHLKRSQAQAAANTAKSLQEEVSSTVPPSNGIAGATFSEGAVNGNGLGAGRPGFTDQQPLGFTMQSVNGLGRGQPDDAYAHGQAHQRASWMATPKQNPYLVQPGTEAPNQQLNVDRPTLEQAKPSVVDPKRPMMPGPDPNHGGGLDWTSMFQAGASDGYINQVFPQSMASGQEPIQAQVETERKFYPTTTTAGPQEGGMNGLYLASTTLGGDGK

SEQ ID NO: 31058 - protein, 197 aa, A.fumigatus
QEVVDSGNTNIGLRDQRLALQWVQENIAAFGGDPAKVTIWGESAGGMSVGYHLTAYGGRDDGLFRGAIMQSGGSISVSPASYTVFQGSYDDLVSKVQCSDDEDTLQCLRDVPFETLNAALNGTGGSPNYRFAPVVDGDFIPDRGSVLLKKHRYVKVPIIAGTNTDEGTAFGPFGINTTEQFYEYLTGLLECAFTFYH

SEQ ID NO: 31059 - protein, 343 aa, A.fumigatus
  UNSURE (271): Identity of amino acid sequences at the above locations are unknown.
LYQINGPQPSNTTTTINTDNIITSTDKVRESLRMTSPSHRRLLKEAAELASHPSPHFTAHPVSDSNLYDWHFTLAGPPPPSPYAGGIYHGRIVLPPSYPLRPPSFRFLTPSGRFEVNREICLSISGHHEETWQPAWGIRTALLALRSFMDADAKGQVGGLDVDVAVRRRYAVESRGWVCEVCEGGRSNEEVLRAWREVCRAKGVEVEEDEVQGAGAGAGGTAERTPSGEAEPTPERDPEDTTDANANANAETETGTESSQKESEPRPSKHXTPQQQVQVPVPSVPSAPAPTPAPTHTTPVPTTTATTSQPTTTDAPWLDRAILGVLVALAFMIVRRLAKSEEV

SEQ ID NO: 31060 - protein, 92 aa, A.fumigatus
YPPGLVLELAQLPPKASSPRYHQHQHQHPGPHPPQPPPPWHDTPPATPSTPPHCSSLPHKPRTPTPGSQPHTAASQQHQHPTLPPAPSHPHP

SEQ ID NO: 31061 - protein, 256 aa, A.fumigatus
LQEIRSTLEKAASITEPSVDVRQFFAFPPEDIANSEDNKVPALLIYALNIFSKCLISSLITEASINQGQAEPIGIVAAQIFSMDAFIYKGHHMVDILWAKYRVVCPALWGFYGSEKTEAGRKAIGWWREGPDGPFISEQGHADRMTALGAGYAALTLRNFGKTPRRNPFPNTMFWYTMHKILMIPPNEIQETHITLLSAMLKTSVERIVGFFGHMGLALIRRAIVDLPNSLTRQSMGVNQLKLLRDIYKREKHIII

SEQ ID NO: 31062 - protein, 77 aa, A.fumigatus
NENHGIWDNYPGLLILLGMRMPDRPTGRKVTMIHDISGNKHKHICFSTTYVAYLNYNQSRVTSSAYVVLHAVVIDLE

SEQ ID NO: 31063 - protein, 316 aa, A.fumigatus
RQRTAGMKPAPPPTRPPGETLKYASAAAAAAASDKNGVGIAPLPPPPGTSPAYTAAIPVSRASSTASPVVSSVQPVSKAAATATEEPGGHGRSKTPALNPSATATPAAASASNTMPSTPATDKANTTAAKEQSATANGETAKEDEQRDESIYHLPPGLQDLIQSFEITKSRATNSASSSSPSVQRLLAASLATCPEPADAEKPRHYRPSNPYNTPLYYPQEPLAIFDDPRLYDTGRIDTDTLFYLFYYRQGSYQQYLAAKALKNQSWRFHKHYQTWFQRHEEPKNITEDYEQGTYRFFDYESTWYVSFHSSFLCFL

SEQ ID NO: 31064 - protein, 60 aa, A.fumigatus
QDRCLRVSRGTHDSTIRTFASALSLSVPLALPGTSSWAVVLCGDFTLWHPFSRYFSSKWY

SEQ ID NO: 31065 - protein, 199 aa, A.fumigatus
ESGVAPSEESLPPTECHELVCHHLLNLMPCNHSQPLLILGTAAGPACKTCREKCRKCDRGRPKCQRCISKGLECGGYPDLYRFCGIASRGRWKGARVPTPRNIKSKSTVAESQQVSTTATPDSVTSGWTEGVSTQPSSKKSSRSATELPDDIPKILNLTQTELLLSHCKLLLAGFWRAGNTDAREVQTKTSYVRIKLLR

SEQ ID NO: 31066 - protein, 198 aa, A.fumigatus
DMNIGEKARISAAGGFVDFGRVNGNLALSRAIGDFEFKKSPELSPEQQIVTAYPDVTVHEVTDDDEFLVIACDGTSFCIVGLSTITPSCCPLLMDLLVGIWDCQSSQSVVEFVRRGIAAKQELYRICENMMDNCLASNSETGGVGCDNMTMIIIGLLNGKTKEEWYNQISERVANGDGPCAPPEYGKCLEDPMVGEGY

SEQ ID NO: 31067 - protein, 212 aa, A.fumigatus
TSSEGQDECCLYGLSAMQGWRISMEDAHAAVLDLQAKSTGGSEKPTDPDKRLAFFGVYDGHGGDKVALFAGENVHKIVAKQEAFAKGDIEQALKDGFLATDRAILEGKWTPLWGFWNSEFCSLVIVRLGVLKETDLLDPKYEEEVSGCTAAVSVISKNKIWVVCTFNLYPTAITWRSGERLIGMVGKRGRFTLSIGCKGPRKAAFFRPQATE

SEQ ID NO: 31068 - protein, 136 aa, A.fumigatus
EMVVAAEFRGPGIRNQFEETPDNYDLENDRSRGFSVRSGRIILLGDGTELIPEQNDEELFDQREENRDVTNHLQHESPDSSARGDREGTPGPQSKNETTSKAEETSTAANLSESPSSANKNSSGSGTEATEKSASS

SEQ ID NO: 31069 - protein, 66 aa, A.fumigatus
ANAGDSRSVLGVKGRAKPLSFDHKPQNEGPCLIIQPSGLSQLRYEYRRESSYQCRWWLRRLWPSQR

SEQ ID NO: 31070 - protein, 74 aa, A.fumigatus
PTRYSRMHSKGKGISASAIPYSRSAPAWLKTTPEQVVDQICKLARKGATPSQIGVVLRDSHGIAQVKVVTGTFI

SEQ ID NO: 31071 - protein, 170 aa, A.fumigatus
FGYLFYDILFTYVPNVFQTPYQTCPLDLHTDAFYPSRASEINHRLVEITNGAAERIIRDIHERESAKQTCAIGIDWAFELDDLVEIVQCFRGEALATICKVMAQEYQQRGGGIPDLFLWSVEKKEVMFVEVKSENDRLSDTQRLWIHVLTGAGVRVELCNAVAKEVRRSS

SEQ ID NO: 31072 - protein, 196 aa, A.fumigatus
GYVECSAVNSHNVCVIGGYRMRVSCCSWLTLTPSIATTRQENMMNELRDAILRQNEAFLQQEISRADGQCAEIQLSLQQVEASDNGQQNGDLEQSRNELLQEIRQQQASHDAFRITCEGELSRTVYERTGQKIKGVKATNHSSSLAGFINTSGDELTIDQDISDVTADNWSVAAAGVIKNLNFKDLRSTATSRQTP

SEQ ID NO: 31073 - protein, 128 aa, A.fumigatus
  UNSURE (10),(21),(64): Identity of amino acid sequences at the above locations are unknown.
LVVCVPLTAXTHHLFGAEEFXVLSSHIPAGHPKPYLTNIARGKVIDQEALIASLRSGELSGAAXDVTDPEPLPADHPLWDLPNVRISPHISSLGKEYFPRSLDIARENMWRLERGEPLVNEYKRTRGY

SEQ ID NO: 31074 - protein, 113 aa, A.fumigatus
GQLNLRALAICSGDFLLKESFILPQYCISQFIHHILLTSRCDTGSQCQPAATANSHSIPANDTYVVAVNSATFNVPLQSLSCPFKVMILSFPNKPTLHLSIQNVFSSVDLLIQ

SEQ ID NO: 31075 - protein, 66 aa, A.fumigatus
CPRHSAAVFMHSPQTLEVPTRRLPLPQTTGITLDDVAFSNVQRHVFDTNGKEYVEGAPRLWTHKLE

SEQ ID NO: 31076 - protein, 183 aa, A.fumigatus
TVQFLRRRVPLQMPWGCSLAIPPVLARLERQNSMSDMASDQLLYLASQRIIIQDNGKKPDKFMVMQWILTLEGLENAPGTGLEDHSISIESFAIRIPYDALFYKVQNAFTPWSYPSVVLLDYVGDLQQLYDDQPVRKELITFGMAMNLAIASKNCYAGGGLIIRRLYLHHATKRHLALLLLYW

SEQ ID NO: 31077 - protein, 324 aa, A.fumigatus
GYDPHPKGPPGDANPGKRKPSAKPKKGFGHRRKKPYSISGPSQTPCKGHSSNTRPPIASDAISKKTSSPSFSGDLEDVLLSLARGPLEQDVATLRGAMSGLGTNENLLTDVLVGRSNADLRAIKYAYVSKYQKSLVEDIKSDLSGKTEQFFVMLLNATRPEPGTYFDAQSVDADVREIHQATQARKGTDEIGVFAVLLGASDAKLVAIAQAFEAKYHISLEKVIKDEFSGHLEDALLSMLSKAKDPVGHDVEKLLKCLPPVENGKADVKRLIYWVVHLHWNPPHFAAVKARLKQKLGHDVGNHFREAIAPGDFLTAMRQVWNSA

SEQ ID NO: 31078 - protein, 76 aa, A.fumigatus
DKVGPRLHGTTGIASLCLDSNNTDLRSTPIVFMKHSIMMLPTSISLIKVFLSPQIACTLVPATQIIFTYLLKWLCG

SEQ ID NO: 31079 - protein, 82 aa, A.fumigatus
  UNSURE (56): Identity of amino acid sequences at the above locations are unknown.
VKILTEGLAIGYTGMGVRCHDAPSQTSIANDETANSPYVRSNGEWIGRSILSGFFXAPIEALPEVTVTDVVSACGSNVHATY

SEQ ID NO: 31080 - protein, 164 aa, A.fumigatus
YFTHERGTYMGLYAFFLAGSNYFAPVICGFIAQYQGWQWVFYWPAVFCAVTIAFLFFFMEETNYARKCAETTTVEGILESSTTPSKQGDQEKPLPATGQPDQTECGVMYSKKTYIQKLSIIGPRQPRNNMFRRFYQTLYYLSWPVIFYAGYVKRSLIFIGNIRY

SEQ ID NO: 31081 - protein, 123 aa, A.fumigatus
RAIHIQTLLTRSRSLFTGRFSDWLTIKLARRNGGVMEAEQRLWPFLACVIIVPGSLLLWGVGAAHEVHWFGLLVAMCLLALASTCGVTLSVNYLVDSYRELSGDAMASVILVRNTMSFAMGYG

SEQ ID NO: 31082 - protein, 85 aa, A.fumigatus
KQHIAAHRQHLTFCSCFCLVMAPRGDGDSIPGTFTLVDVDGVLATRHLDRGDRDIVLVPEPSNDPDDPLNWSPRRKLLSTICVSV

SEQ ID NO: 31083 - protein, 98 aa, A.fumigatus
VDGRGCFDLEFSTKQLICSLMSRYTLFAGISTSVVYSVLVQLSEETGVAVDTLNQGTGYMFLLAGWGLLFWQPFALQYGKRLTYILSLVGILVSLQSY

SEQ ID NO: 31084 - protein, 409 aa, A.fumigatus
FIVIVQSIVDVSARNYIGGAFNRHVNWLGRAFWRAWFDADRVSLEAARRDYLEYRFGTVISASERNYLLGGIPYYIFVGRHKNLASNLSGQETIEMLDASFTESPYLSPANHTKEMEKAMERNAQEIRSKAYESAVINLSANLPLPSSFYQNHHCRIFYNDLLPKHTQFKNEYIYAFNWEDPRVDHRLLDIKRDDVILAITSAGDNILDYLQKSPRRVHAVDLNPNQNHLLELKVASFMALGHRDVWKIFGEGKHPEFRELLISRLSAHLSSQAFQYWLEHTHIFTSKYGKGLYETGGSRHAIKMVRYLFKVFGLEGQVKKLCEAQTLAEQREIWPKIRAVLMSKPLHWAVVSTEWFAWKAAGVPRNQRNMIVDDYFKRLGLTKDMNQGQDISGRSIWQYVVDTLEPRR

SEQ ID NO: 31085 - protein, 139 aa, A.fumigatus
SENVSVLKPVLECLAGEVSAETRNEEFPEFWVFSLAKDLPDIAMTKGHETSNLEFKQMILVRIQVDCMNSAWTLLKVIQNIVSGAGNGQDNIIPLDVEKTMIHTRIFPVEGINVFILELRVLGQQIIVEDAAVVILVEG

SEQ ID NO: 31086 - protein, 94 aa, A.fumigatus
PQETLGKKIESVIISHIIDEASLGLPDPIPEGQVEAFISNNLPPNATEQTKRIANLFKSLYANSTKKEMLSALYNDILYTCNLHAVLKAYLSPA

SEQ ID NO: 31087 - protein, 73 aa, A.fumigatus
LTNSILKTPYNLKQLKKQETILKKLLREYIYSPPTPTKAVLGQIIKRCEIVINNTALLAKENYNLYTIHKKHL

SEQ ID NO: 31088 - protein, 61 aa, A.fumigatus
NLAAAEIRGYFKPLKHDFITKSSYSCAADIVITYGLEYGSHCSVGVPVKGIVLYLLPTLEG

SEQ ID NO: 31089 - protein, 320 aa, A.fumigatus
PVYGNKQGKLTIKTTDMETIYDMGTKMIDSMTKERVMAGDVISIDKSSGKITKLGRSYARSRDYDAMGADTKFVQCPEGELQVRKEIVHTVSLHEIDVINSRTQGFLALFSGDTGEIRSEVRDQINTKVAEWKEEGKAEIIPGVLFIDEVHMLDIECFSYINRALEAELAPIVIMASNRGQARIRGTTYTSPHGLPLDFLDRVVIVSTQPYSGDEIRQILAIRAQEEEIDLSPDALALLTKIGQESNLRYASNIITTSHLLSQKRKAKEVSIDDVQRSYRLFYDPARSVKFVNAYEQRFIGDQGAVNFSAPANGDAMEIS

SEQ ID NO: 31090 - protein, 158 aa, A.fumigatus
FISQPISTVAETKELRGLNLIAAHSHIRGLGVDADSLQPRTSSQGLVGQEKARKAAAVILQMVKEGKIAGRAVLIAGPPSTGKTAIAMGMAQSLGSDVPFTMLAASEIFSMEMSKTEALTQAFRKSIGVRIKEESEIIEGEVVEIQVDRSVTGVSADS

SEQ ID NO: 31091 - protein, 192 aa, A.fumigatus
THRGSFQPRGEDADALKTLITHLQRGETALEALARIGKGAPKKPKWQAKKKKNRSKQNGAQVEDAEMTEDDPNEASRKQAIETITGAADILMTRGQTDIYDIEREMLTRQYRQETGEDWVDPPLESAAPTSAEEEPAMWQFRWSDARDGGVEHGPYDSQTMESWKSAGYFGDGVEFRKVGDTGDWTSEATFL

SEQ ID NO: 31092 - protein, 138 aa, A.fumigatus
AAGPVVTLITSWSWKVTKPSIGAFINILIITLSVAMAVSGEIRFSWLGFGFQFASLVFDANRLVMVQILLSDSGQKMDPLVSLYYFAPACAVMTSLVAWQTEYASFEWSSVAQAGWTVLSLSAVMGFMLNVSIFLLVS

SEQ ID NO: 31093 - protein, 95 aa, A.fumigatus
SDEKQMLSLLTMKIGKTSGLAMTLISIPKNILLIAISVVLWHTPISLLQILGYSIALWSLLFYSIGWKTVKAYIDALGVWSRKSDENEVLLSDRV

SEQ ID NO: 31094 - protein, 629 aa, A.fumigatus
  UNSURE (86),(138),(145): Identity of amino acid sequences at the above locations are unknown.
GLFPPIRVSFPAWFAEAAFNSWEARQFWLGVLTCPGNPLFFKRPRNNHGRRVVGLSLPLRSLPDVGKSCRPPYDTFVEVFIITSQXEIQYYFSLMNQHLPIESQLMSKLADNMNAEIVLGNIRNRDEGVEWLGYTYLXVRMLRSXGLYSVGADYENDDALEQKRVDLVHSAAVILERAGLVKYEKKTGRLQSTELGRIASHYYIGHNSMLTYSQHIQPSISTIELFRIFALSDEFKYIPVRQDEKLELAKLLGRVPVPVKESIDEPHSKINVLLQAYISRLKLEGLALMADMVYVTQSAGRILRALFEISLKKGWSSVAKTALDLCKMAERRMWPTMTPLRQFPHCPRDILQKAERIDVPWASYFDLDPPRMGELLGMPKAGRTVCDLVSKFPRLEVQAQVQPVTRSLLRVELTITPNFVWDDALHGTAQDFWILVEDCDGEEILFHDQFILRKDYAQAEMNEHLVEFTVPITEPMPPNYFISLVSDRWMHSETKIAVSFQKLILPERFPPHTPLLDMQRAPVKALKREDYQQLYPEWQLFNKIQSQTFKSLYDTDDNVFLGAPTGSGKTVCAELALLRHWATGKGGRTVYIAPFQQLIDHRHADWEKRLGNLGGGKNIVQLTGETLPI

SEQ ID NO: 31095 - protein, 99 aa, A.fumigatus
  UNSURE (6): Identity of amino acid sequences at the above locations are unknown.
RPRSGXEKVRLLEYLRSYIASRLERGEYDSDSDSDDHASAAASPVIKHDGHMDGVESSHKPITAEETSAPPAAKAESNHGVMYPTLHGLDGDEDTKMHH

SEQ ID NO: 31096 - protein, 140 aa, A.fumigatus
SGENDDPLGRRWTLQRLNRSRPRRQAPSSTSGTTSGPAATARTSISRNTPRPPGATSPRTAGTHAQTRCPDRTSACSSRAASAPKATSANTSTACRRCMTSSTPTWTVSVGTSSAITGTTWAVWARSRARTARCMLAGSM

SEQ ID NO: 31097 - protein, 355 aa, A.fumigatus
FHLKASQPLLCSTSTHKQHPQHFKLAIMAETAVIDPPHATEPTSLPTESADPSGPAPSDENALTQPSESAVTATTDADGTQKKTKKIIRRKRRPARPQVDPATLKSEPPPQTGTVFNIWYNKWSGGDREDKYLSKHAAPSRCNIAKDSGYTRADKVPGSYFCLFFARGVCPKGHECEYLHRLPTLHDLFNPNVDCFGRDKFSDYRDDMGGVGSFTRQNRTLYVGRIHVTDDIEEVVSRHFAEWGQIDRIRVLTSRGVAFVTYTNEANAQFAKEAMAHQSLDHNEILNVRWATVDPNPLAQKREARRLEEQAAEAVRRALPAEFVAELEGRDPEARKKKKIEGSFGLSSPGVEIRL

SEQ ID NO: 31098 - protein, 167 aa, A.fumigatus
PACRKLARLRAQLLEPTGGGGGGGTGFDVSKSGDARVALVGFPSVGKSTFLSKITKTRSEAAAYSFTTLTAIPGVLEYGGAEIQILDLPGIIEGAAEGKGRGRQVISAAKVCTKLLPETTLQECSSDHVQTSDLILMVLDATKRAEQRALLEAELDAVGIRLNKEPP

SEQ ID NO: 31099 - protein, 94 aa, A.fumigatus
TPLGSVSTRSLRKGPSNHLPQHFMHTDLDSNIYLKVKKAGGMKITFQTPPKNLDEKMIFNVLRDYKILNCEVLVRDENGTLTPPALCVFVQTAY

SEQ ID NO: 31100 - protein, 715 aa, A.fumigatus
WTLSALCLLVRPLHLGQVLVYYLRKIEQKDSPIVLQTPVDSPFAADSSVRAPSTRQSKRVNFSPWTKYIKPPSFTNSAPRLKSELKELPPSNECKPTKSILKTTNAHPPIDTTDAAPCTPESFAMLLDSITQQLAGESISSRLDAYMQFFGALRAYEGLPSEQELGQKLGLISQFIQRDLSTDLGDDVPLGTNLVIQALKLAAALSWNIEIAAHLPDEFKVFLVEHSINALESAKAPKSVLTHYMSILSTQNFHSKIMTNARIIRLLTVLGDITSRVNGNAIVFQRLSIYQRLLTQSKSIFVSQSGLWVEHLLSGLLHHVKDTRIKAISLGFQTSMICGPNPSLSKSIRDLFDRPLDNGRKLVSEICERMSRMMANVESGVHVPQVWSIIVLLLRSKRLSIDQWEHFKEWVLVLQRCFNCSESSIKAQAILGWNRFVYVVSPSDTTSRSMLRMLSKPIMSQFERKKQERHGSQPGQLALCSYHNLLYYAFRPSATLQHLDIVWEEYVAGPSNVFASFPHLNDRFCHALSNLLWSPQAKIWTENKVNESTKLEPEELPSIDCKWVRSRITIILNVFEAIFRTSLWADDLDKSNIAAAWISLSQALSYASSKEITPSKESMQAVASVLGHLQRLWNAGPSSLNALGDESMDVFFDRFRFLSTTMISSLGGIPFTEKLLLKTANETFQAANTPTHHPVRANTNLDSPILHLLRFISDV

SEQ ID NO: 31101 - protein, 77 aa, A.fumigatus
AHFLRSVGVRTPVFARFSTVTLGREFPDEARNPRGFAVKFYTGEGNYDIVGLNFVCLPKSARKPATNIGDTARVLLS

SEQ ID NO: 31102 - protein, 61 aa, A.fumigatus
TLYACPSLRASQRLTSAIQPVFFCRDPIQGPDVIRSQYRIPQNFLLDHNSLFDLLANTPEG

SEQ ID NO: 31103 - protein, 92 aa, A.fumigatus
HRRYSPCSSVVIPFKAPMLFAPSIGFRRTSCWTTTPCSICSQILPRGERAMAIIETQTLTDNRNHAGMMFFSDHGTPVGWRNLRGYGCHTFK

SEQ ID NO: 31104 - protein, 78 aa, A.fumigatus
VERSYSALYILTTSPGLTKGENLCISNTNFIADRGQKQSTADEAIQMCGEDPDFSKRDLYQAIEKGEKISWTAHVQIM

SEQ ID NO: 31105 - protein, 108 aa, A.fumigatus
DRTLTGASHNETKILSETGHGGQTPDLDGDEEDGYDEVIYPVDFRQAGHIVDDEMHRIMVRPLRPGVRLTAIFDSCHSGSALDLPYIYSTQGILKEPNLAKEGLHPGR

SEQ ID NO: 31106 - protein, 278 aa, A.fumigatus
ESLKVFHWCWKVSLTDRSKDKCRTIITNNLPTAAVTPAKRTVSNILLRILTGMASPPLSLVTARLLHTTVTVYVLISEDNCEQKKMQVWLTLYAATAVRIRPAAAAYWKCGVWWKTAWYVIAFGAGRTAFCFGKCQYAAADICNTGMNQYQNTYSHGHQGGPPPPPTDPVAFGHGAPQGYSFQYSRCTGKRKALLIGINYFGQKGQLRGCINDVKNMSTYLNQNFGYAREDMVLLTDDQQNPMSQPTKANILRAMHWLVKDAQPNDSLFFHYSGETVL

SEQ ID NO: 31107 - protein, 177 aa, A.fumigatus
TQLEVLRLYPPVVTVPKSTSETPSPLTYQGKQYVLPPRVNINLNTNCLHYSEQYWGPDVAIFYPQRWDARNQNSFLAKNASTQGLAGPGLEFPTVHKPVRGAFIPFSDGFRACLGKKFAQVEFIAALSALSRNYKVELADDSPEGRNDAERVLRESTSVLTLSMREDVPIRFQRRKD

SEQ ID NO: 31108 - protein, 73 aa, A.fumigatus
AHLTAGMETNRTEDFPSHWKATLLGEAFWKDAERFNQPINDSIEASKLLLLLAYTCPITATFVLTMNAHVLST

SEQ ID NO: 31109 - protein, 152 aa, A.fumigatus
KRSCCPQVSSCAGFLKLPRQPESVTSTYFRPSIRHHNYIRMSTFFYGHHQQHHHQGATSHMPSSNNHHNGRSRRGPKMASQNAQRQFRGVKSMRELAEAPAVTAFRARFEAGRSFDLDDDLEFCPGLLTEDDVCFDSPVFGPPVPSRYWPSA

SEQ ID NO: 31110 - protein, 62 aa, A.fumigatus
LVLVYEGLAMQEIVPPDFLYVLGATRSNDFQDATLELVARSDADDDQLEEGTSDCIWELRHV

SEQ ID NO: 31111 - protein, 193 aa, A.fumigatus
TGCHRDVLSSLDLIGVFLSSVSPREDFLLSELSVVIKVQLGVHSQNLVVGGLRQRVNLNLSSVLLHEDLVQVLNGCLGILDALLREAKIGSNLAGNVISHANLDVNRSRHDSLRVFLGDCLNIHTALRRGNNDGGLSCAVHEDGKIEFTTSELALANVDSVAKATSSTSLLGDELVSDHLASEHLGLGWAGEK

SEQ ID NO: 31112 - protein, 213 aa, A.fumigatus
VIPLKSSLFSLRHFSLLTLFLSSPTEAKMFASQMIGHKLITKQTGAAGRLCNAVYICERKFARREFYLAVLMDRATQTPVIVASSQGGMDIEAVAKEHPEAIMTTPIDIKVGVTDDIARKIATDLGFSEQCIEDAKTTIQNLYKVFMEKDATQIEINPLSETSDHQVLAMDAKLNFDDNAEFRQKEVFSWRDTTQEDADEVKAAEYVPMAPSL

SEQ ID NO: 31113 - protein, 92 aa, A.fumigatus
QHLRYCPHADRFLVNGAGLAMATMDIIKLNGGNPANFLDVGGGATPAAIKSAFELITSDPKVTAIFVNIFGGIVRCDAIARSSPREAPIRVK

SEQ ID NO: 31114 - protein, 155 aa, A.fumigatus
RVGSVFERRLIEAYIAENGKDPVNGEELSVDELIEVKSQRVVRPRPPTLTSIPSLLSVFQEEWDALALETYTLRQTLAQTRQELSAALYQHDAAVRVIARLTKERDEARDALSKVTVSAGRAGGEEAMQVDSTGLPDAVLARIESTQVSYVTWLS

SEQ ID NO: 31115 - protein, 178 aa, A.fumigatus
FVILWLLTSPRLSKTRRKRPIPEGWATSDALSTYKPTETSKPLCQGGKALAVNAAGEMALVGGADGTVGVYSLSEKRVVGNLHTSGPVTSAVWAGDKAVIASSTGSIQVFEDGKELANFASHAGSATDLALHATGDIVGSVGVDKSYVLYDLTTNSVITQIFTDSCKQGLNRFVCNLC

SEQ ID NO: 31116 - protein, 162 aa, A.fumigatus
FLPSPLALHTVAFHPDGHLIAAGGADGQIKIFDVKSGTAAANYAMSGPVKCLYFSENGTFLAAVADNSTVLSIWDLRSSKEIKVLETGSQIDSICWDYTGQFLLTGGPSGVTVQQYSKASKEWSEPLRSAVPAVAVAWGSAAQSIVVLNSEGGVTVLTAQES

SEQ ID NO: 31117 - protein, 141 aa, A.fumigatus
DKYTDITLNRFRTSLCHIFLSSILLLLLLDSCSVPITKSSRWLFFIGLPQLSLLSRIQYNVNHTLKGMSFSSGALRSSSISTRVQLLSILHPVRSSLGPHHNYHHHHQQPQYHRRPYSSSSSKPDSPPPSSSSSSSASSGV

SEQ ID NO: 31118 - protein, 498 aa, A.fumigatus
VLSVLKLSFLKTLHLLLPLLLPYTLSPFSYHTSPSAYQRLIISTCLNQSGEIQASKETGGSYLVEEEAADPLNPTSIHPIHKTTTPVLQQGDSNLVSVELPSRSKQFRFYSRLLRHLVAEVDTGMFSPEDESAISMYSSAVLTRLSAIQLTKNTEQKPGDSQEPGIMSTGNVNASVSKGLDSKTSNTFSNAYQTGSSNCEGEGNIFTKCENPLVPRLSCGQTASNNYLAYHSSSFKPRLEEGLVLSPQSLQLVPTKKSFYQGQVRNAHAMVKDTRPTKLSAFQRLPGELRWRIYDLVFDVHRVEVLRLRDKNPENNIKRVHYRLYHRQLRPRDPRTHVAPSNEGRFTCAPLPIALLITCRSIYRDTLCLFYSRMQFIFNTTRTVMRFLKITSKEAQMAIQHIELNHTMYSEPALLNFRWYKCMSDMSWYNACDDLTVYCKSLRVLHISMNIRDWPISLQVGERWSLPLLAFARYGPRLDWVDIRPQMFFQKTEEQYLE

SEQ ID NO: 31119 - protein, 514 aa, A.fumigatus
RTREKFANNNPRSAHAQNAFYQTLLRANMPAIIVERYRSGQFASNALSEAIYLKALQRVGGADSATAAPVQSQNQHLTPDQLQAVGQAVAARNHGSQIGLATKQSGTGAKDNPLHVVVEESLGSSVFRWVKFLLVFGFFTYISLVVITILVETTGVLKNIKGPQSNEAQPQQQTVRFSDVHGCDEAKEELQELVEFLLNPERFSSLGGKLPKGVLLVGPPGTGKTLLARAVAGEAGVPFFYMSGSEFDEVYVGVGAKRVRELFAQARSKSPAIIFIDELDAIGAKRNERDAAYVKQTLNQLLTELDGFSQTSGVIIIAATNFPQLLDKALTRPGRFDRKVVVDLPDVRGRMDILKHHLKNIKISTDVDVAVLARGTPGFSGADLENLVNQAAIYASRNKKPKVGPKDLDWAKDKIMMGAEARSRIIQDKDKLLTAYHEAGHALVAYFSPSSTPLYKITIVPRGMALGVTHFLPEMDMVSRNYTEYLSDIDVSMGRKSNEELVSGLTGYKWDFRR

SEQ ID NO: 31120 - protein, 65 aa, A.fumigatus
LLRPSAALTRDNYGFPSPGLKTGKGPHISCASYAIYSDFPFSTESCGRHFRSLAIDVKAIKCALG

SEQ ID NO: 31121 - protein, 245 aa, A.fumigatus
QDFESLRIDLPPKIPLVTCQARNQLFVAFSAHGDVDIGQILRVIPGNHVHLRQKVRHSQRHSAGNDGDFVQWRRRRREISNERMTCLMVGSQKLVLILNNPAASLCAHHDLVFGPVEVLGSNLRLLVSASVNGGLVDQILQIGTRKARSAACKHCNVDICTDLNVLQVMLQYVHPTPDIRKVDDHLAIESARSCQSLVKQLREIGCGDDDDSTGLRESVKLRKQLVQSLLHISCISLIPLGTNGV

SEQ ID NO: 31122 - protein, 416 aa, A.fumigatus
LADSFKNFYMYFTEKRHDTNGIPRDPVGSWPSQDWRMKDRLKTVSAALAICLNIGVDPPDVVKTNPSAKLECWVDPTSTTGGGQNKIMEQIGKKLQEQYETLSLRTRYKQYLDPSVDETKKFCISLRRNAKDERVLFHYNGHGVPLPTQSGEIWVFNKNYTQYIPVSLYDLQSWLAGPSLFVFDVSHAGNIVQNFHIFVEKHEKENLEAKKRDPNAVVQNYGDCILLAACQKNESLPTNPDLPADLFTCCLTTPIEIALRYFILQNPLQTNLSIDEFRVPGRLQDRRSPLGELNWIFTAITDTIAWNTLPRALFKKLFRQDLMVAALFRNFLLSERIMRTYKCHPISSPELPETHHHPLWKSWDLAVEMVLSQLPALIDHEEGRRQYEYQHSTFFAEQLTAFEVYLKSFHQPQKTT

SEQ ID NO: 31123 - protein, 138 aa, A.fumigatus
  UNSURE (69): Identity of amino acid sequences at the above locations are unknown.
TFLELIASPSFSRTVAPILISVGIWKSFTIRLITTVCWTSFCPKYARSAQTILKSFMQTVATPRKKTGXEAPSSFFEMGVIVTNEPSPFTSDDGGNVGYMTLDVGARIAVTRPYFSPWRDNSSFNCSIFATSLSHVRG

SEQ ID NO: 31124 - protein, 186 aa, A.fumigatus
LRLTMPVEKAPMEAPDLEIVGDKVTIHPSGYTGGPQDGPITERNLVSHMARFRENPFDFLREVSLYMSGTGWRAYNDVIGQPIFYPGFSERIKSSILASPILQAKVKELAEMRLAVEEKEGLLQMGQGPVSKKKKQRRAEIESNLKEVVDTMMDNMILQMESKTFIRGAYYLCTQLLTRALSSGLK

SEQ ID NO: 31125 - protein, 131 aa, A.fumigatus
VREMFTWGSRRRAVGLVLYNALKAAEDAYLSGKNNRNEILDAANRMTQKVLGEQQALKPTERALYEVDYISLADPDTLDELEVVDPSRGAILSGAIKMAPLEVSNPGEDCGLGDGKVPVRLIDNLILTPRV

SEQ ID NO: 31126 - protein, 260 aa, A.fumigatus
  UNSURE (171): Identity of amino acid sequences at the above locations are unknown.
PEKRDALSDFCLSLIATTSLFNSTMASRQHSFEVFRDVAPLRKMRRQLLLSNRTVGLVPTMGALHEGHLSLMRQAAADNTDVFVSIYVNPTQFGVNEDLASYPRTWDSDVAKIEQLNEELSRQGEKYGRVTAILAPTSKVMYPTLPPSSEVNGDGSFVTITPISKKLEGAXRPVFFRGVATVCMKLFNIVCADRAYFGQKDVQQTVVIKRMVKDFHIPTEIKIGATVRENDGLAMSSRNVYLGVQTTCRWSCSLQRLESS

SEQ ID NO: 31127 - protein, 209 aa, A.fumigatus
QAAVHSSPTNFLMADDGLLLNFSLGDNNIIQRETKLKGGTWRDRLSAKKIAKHHAKGPRTAGDEDSAPRAPRNPNRIEVPSSRPTKRQRTDGGDSGKQQSHGHPHSNQPRQFISSLFTKNPEPQKAEEVKEEGHVENAKPTNAPLIDGLDTFTNLGLSPNLAAHLLTKLELKAPTAIQKASISQLLKEEGDAFIQAETGSSPGAERASV

SEQ ID NO: 31128 - protein, 288 aa, A.fumigatus
  UNSURE (280): Identity of amino acid sequences at the above locations are unknown.
DGVSIFILLSMEHCLDPEPKMSDTEIEGGLDLQQTRSGWSIAESLSPVRETVFIFVICMAQFMTQAGLGSQLAPLTIIGNSFHITDNGILSWFVAGYSLTVGTFILFFGRCGDCFGYHTMFVIGFVWFGIWSMVAGVSVYSNSVLFIFARTAQGLGPAMLLPNGLAILGATYRPGPKKDMIFAIFGATAPNGAIIGAVFAALFSQLAWWPWTFWATAIVCLVLAALGWAVIPRIHHEREKHGHDSVEWMQELDIVGACLGWGGLIFVTWPGTRRPLSAGXRRKCTCLL

SEQ ID NO: 31129 - protein, 171 aa, A.fumigatus
WLSTSDATYSSRSSSSTTSLSWRCASTSAPAVHGSSEPICASVHAITSSVPYTGPSTVRILSVTSNGTSDYRPPLSSTLSQRFERRPASANVSCGSHPQCPDTIAPSVAVAYGSPGAVASWQDGRHVSQCRRRSDEHWQEFGSQWNARGIWGERQSIVKKSTFVTWGIRLR

SEQ ID NO: 31130 - protein, 297 aa, A.fumigatus
RQNLPQHALPKLNGDYGSVAEGPLYECHKCYLKNAAAQPSPEPRPSPYSAQRPVLPAPRIPEYHGHPYGPHAHPTPPPTNALPRPLNGPLAHGTEWYPAHEQRPTELADGKLRNGLPVPAYHGGPPPVQTHPLNGFQHPTPPTHPAPPPPPPHYPGGAPPPPHQPYTVHQSPYAPVSMPSPHPSHTPGPLPYASSASPPTAQATIVRHSPQHSLSALNGGPPPRMYPVDRILSAPTQSPPVSQSRMDPRGPSPPGKTEDTSLSAAGGAMSTGRSSGVNGTHGGSGASASPSLKNLLS

SEQ ID NO: 31131 - protein, 193 aa, A.fumigatus
WAMPLRITSAPVSGIQKKKRPATFKPRASPFAGHARQKAAVQSSHPSKSDQLDELYTGDFDQGPLPDLGSSHYVSQIAAVEDVIQAIHYIRDRMFEDIPARAGMNSTRIAEVLNLRRSLPPLASVAHVHTLMDAPTKVEKEIVDLITAGRVRRLIVPGRGTDAAGLGDCLVLTEDWERLVRESSVLEASVKGK

SEQ ID NO: 31132 - protein, 76 aa, A.fumigatus
YRDWVWNAFENINKYCRTESGFAGLTNVNAVNGGGRYDNQESFLFAEVMKYAYLTHAPGMSSMPAAAEDKANKSRG

SEQ ID NO: 31133 - protein, 199 aa, A.fumigatus
IEKIFFACFIDRMGSTKPRTSAQASAPKVQSLPEKTFIIDNGAYTLKAGYAPGFPPPEDLGQALSACSTIPNAIAKTRGNRIYIGAQLNSQVTDWNEMVFRRPVEKGYIVNWEAQKEIWDNAFFDEKTVRSKDLRIESPEDTTLVLTEAPNALPTLQKNADEIVMEEWGFGGYVRFVGKIAGFPHCLTWLLMLTSQELC

SEQ ID NO: 31134 - protein, 254 aa, A.fumigatus
DSRIPSLSYLVIDADFAGTVLNAWNEVQSLFGDPIGQDSSSPISPKQCLLVVDSGYSHTTVTPVYKGQPIQRAIRRLDIGGKHLTNYLKEMVSMRQYNMVDETYIMNEVKEAVCFVSNNFAGDLEQTWQGNRKRGLTDAAEGITVDYVLPDPNTGKKGFMRPHDPLSNAKKRKSILSGGNAEALSEDVLILGNERFTVPEILFTPSDIGMKQAGIPDIILQSLSVLPTGLHPSFLANVLVVGGNTLIPGFLERL

SEQ ID NO: 31135 - protein, 60 aa, A.fumigatus
VLIEYNISAGGSQQEFESTTTYHMLQMRKPLRQHNSQRTVTWMQYLTDNSTQSTTQKVFR

SEQ ID NO: 31136 - protein, 235 aa, A.fumigatus
YYTRSGPTHTAVTPLDLVKCRRQVDPSIYTSNLSAWRQIFSKEGLRGVFFGWSPTFIGYSFQGAGKYGLYEYFKYLYGDHLFPSINRTVVFLGASASAEFFADMALCPFEAIKVRMQTTLPPYAHNLREGWSKVVAKEGFGGLYKGLYPLWARQIPYTMTKFATFEESVNMIYRTLGKPKESFNALQQTGVSFLGGYIAGVFCAVVSHPADVMVSKLNADRNGSCAFLGSRLSFC

SEQ ID NO: 31137 - protein, 64 aa, A.fumigatus
MPIGMVRVRFSEAVCRSANRLAAGESAMAAVSRIYGKIGFSGLWNGLPVRIVMLGTLTGFQWLM

SEQ ID NO: 31138 - protein, 193 aa, A.fumigatus
EVMPSPRVRTFTLFILNASWQTSIHRTRACTASFSTTTSALYAASREPTLYEILDVPVTASAAEIKKYDNWPRPTLRPSPPHLPYFSTLCTANVTRIIRKFYSLSLHHHPDRIPGDPKASSRFARISSAYHVLSNSAKRSAYDREHGIYAQHGSSTHSNANPSQHPMGSHSNFRANLHTKGAFYAGSRNAKGL

SEQ ID NO: 31139 - protein, 309 aa, A.fumigatus
SRLIRCAVYNSVKSAYTNETYFFATVNGLNGDAKANATVIGQTEAGEAEDDSDDEKEDGNTAPEAGAGGGAYLHVWVIFDMPVSQALGMLAYNSRIPAAKKKKRKSKKKKKGGAKVQSSPPRVPVSNLFPNNQYPEGEIVEYKNENSYRTTNEEKRYLDRMNNNFLQEYRQAAEVHRQVRQYAQKTIKPGQTLTEIAEGIEDAVRALTGHQGLEEGDNLKGGMGFPCGLSINHCAAHYTPNAGNKMVLQQGDVMKVDFGAHINGRIVDSAFTMTFDPVYDPLLEAVKDATNTGIRVRQSPSFKLSRISY

SEQ ID NO: 31140 - protein, 66 aa, A.fumigatus
ARRNISLEYVNTLPVPVQSPLFYSTDLSLQLNNLVSSGIVQDYPPLCDVKGSYTAQFEHVWERLTP

SEQ ID NO: 31141 - protein, 194 aa, A.fumigatus
LLILSTTLCWKPSRMLPTPVFGFVNPQASSYRGFHTDDSLQEAGIDVRMSDIGAAIQEAMDSYEVELNGTMYPVKCIRNLNGHNIDRHIIHGGKSVPIVKGSDQTKMEEGETFAIETFGSTGKGYVREDVSALRKTPLLAFGICLPHIFSADGNVPLCPDPRCAFGPSQTLFCEELAQCHQQEFRHTALLPSVS

SEQ ID NO: 31142 - protein, 92 aa, A.fumigatus
VLSGRRRCLRSEYAYPIFFLQMETSHYALIPDAPSVPLRLSSAKNLLNVINKNFGTLPFCRRYLDRLGQEKYLLGVRQYSAGSGAISSLLQY

SEQ ID NO: 31143 - protein, 75 aa, A.fumigatus
VAFPSKLCYPTHFIYQAISAKDAASLDKDLMEMGGWSLDQLMELAGLSVSQAGMWSSHGALQAQNKNNQRLTHLR

SEQ ID NO: 31144 - protein, 149 aa, A.fumigatus
LSGNQQRLKTQLHNLSVPFVPDFTEALKSADFLVDAIFGFSFGGPLREPFPSIISQIESSSVPVLSVDAPSSWDIQSGPPKEGPGSKFMPKALISLTAPKPCVKYYRGRHFVGGRFLTKSIVEKYGLNCPDYPGIDQIVEVGVDAEGRL

SEQ ID NO: 31145 - protein, 100 aa, A.fumigatus
RSARDSKPLEVIGTYNPIPQRPTNLSEEEARRAKPFKEVSLDRSRAKYWLGVGAQPSESVWRLLNLVRGGQASENRSSLLTGTSMLGWSCSTQVLMAPKE

SEQ ID NO: 31146 - protein, 97 aa, A.fumigatus
TSVSSASNKVQCFDSALLAGYEGQRFRIVKMVVRIRLSRFGNRHQPFYNIVVAHARYASFLLVLQFFFSLELFYCLPSASRLRLTDNRQPSDCLEKC

SEQ ID NO: 31147 - protein, 155 aa, A.fumigatus
TVHLPTPRGITAHIADRADSADSASSEEPTRDCNAQPPRNRVYVPGPARNPRPAHQAPSGFPARLRRHRALLRRSRLPGPFQLQRLPPRRRARGPPAVRFPRPLHHLPAALPLLRGSPRPHANRAPPHRKAPQMVPDRPHPQHRPHPDPLQFPPV

SEQ ID NO: 31148 - protein, 264 aa, A.fumigatus
LLTFSERSIYLRREGLLRILQTVQTVQTVHLQKSQPGIAMPNRLGIGSMSLGRPGIHDLPTKLHQASRHGYEGIELFFDDLDCLAHSSFNGCHLAAAHEVRRLCDSLGLSIICLQPFLFFEGLLDRTQTEHLLTEKLPKWFQIAHILNTDLIQIPSNFLPSDPTTGAPRTTGDLDVIVSDLQRIADLGAAQSPPFRFVYEALAWGTHVSTWEQAWAAVSRANRPNLGLCLDTFNLAGRVYADPAAPSGKTPHAEADLAASLQRL

SEQ ID NO: 31149 - protein, 219 aa, A.fumigatus
ESGLCPWAGQESTTCPPSSIRLPGTATKASSSSSTISTAWPIPASTAATSPPRTRSAGCAIPSASPSSACSPSSSSRVSSTARKPSTSSPKSSPNGSRSPTSSTPTSSRSPPISSRLTQPPAHPALPATWMSSSPTSSASQTSAPPKARLSASSTRPSHGAPTSPPGSKPGPRCRAPTAPTSASASTHSTSRAGCTRTQQHPPAKHPTQRRISPPRCSV

SEQ ID NO: 31150 - protein, 195 aa, A.fumigatus
EFLEYHAPPNHHRWRRPHRPSPRPIRPLQPIHRAGGPRRPSQQRGPRRLTAADRTLPLCSRHAGGNPQTRRRHHLHPKPLPRPYRNRAALPRHPLPHRETPQRQRLIGPVVASLRPPPRKRPPDCPGWPPPPLQPLCSGSPGDSGILTPSGTVIRSPRPSGPSYKPGGLFSRPRTDWGSCSVPPGGVNPPLTFLP

SEQ ID NO: 31151 - protein, 112 aa, A.fumigatus
GNSEKRENSWNIMPLRIIIVGAGLIGPRHAQSVLSNPSTELVALVDPASSGARVASQLQTEHFPSVPAMLAAIPKPDAAIICTPNHSHVPIATELLSHGIHFLTEKPLSDSV

SEQ ID NO: 31152 - protein, 253 aa, A.fumigatus
ALALWIAHSTMVCRPIITRTLQTNDCAAYNTFVSMQTGEVNRNISRTNDAHRQGNTIFVGLGASNQNLKPYGWARSLTSIGCFVIGCFLFARLNRLLGPRRRVTLVLSFLLQVAMLVITASLVQSGVIAGIPSNPASSETHWSQEAPIVLLSIQSAGQIVASRALGFNEIPTVVITSLLCDLVSDPKLFLLRNEKRDRRMVAFVLTLIGAIAGGWITKATRDISPVLWMAAGLKFIISVSWIFWRENEGASAV

SEQ ID NO: 31153 - protein, 78 aa, A.fumigatus
RTKSVSDRLSSWPGYFICREVHEPMVKYGPDIHCSHIGPTGGDYCVDDLSYEQVVLEKYFRDSFIAYGHGQEQNIWVA

SEQ ID NO: 31154 - protein, 156 aa, A.fumigatus
VRDCVPQDPERPTCYYPNIVLQPPGSLSGSTILYFPLFESFTPARGTLGMKLLIMLLKTWMIYTVRNPKAPKSATYNATKSLNDDRRWAIARPDCRPTSSRAFSSYECVECRRMAFAWPADCMLYHASYDKGVLSQVFYGEGSSSYTAGMESHRSA

SEQ ID NO: 31155 - protein, 99 aa, A.fumigatus
HNYQIIIFAKLFELVNEKGDDGAETASLVPSGLAKRRRRICASEGGFGFGVIRCTRRGQRPPWIAGLIGRAAHLSGSSNNESEIVFRKIQNGQLVTTQT

SEQ ID NO: 31156 - protein, 178 aa, A.fumigatus
GAAPSSPVVKTVIEEQARELPRLPTNLDVSEQDRILNAVNDRLSQCAFDFVAKYQFPIPLEADKREVRIPSDREWTEWVYLLKRLATKRRIPARVLYNGQIKQLVTVLENSLEMRHAAKHQSRPIKDDRNVLQLISAGTQVAKMLKDASAMEYLDKLYVDTEKRIHERRSRRVKFASP

SEQ ID NO: 31157 - protein, 72 aa, A.fumigatus
EYTLHNEITNGAHNRQKRCREAQASVAFLWFAWAGYMASTIISILMARSATVDLRSRTGRAPRVARPSMAQV

SEQ ID NO: 31158 - protein, 101 aa, A.fumigatus
QASTMQFVFSLLVMALIGNIIAMAFAGNPATINYSMFTATFSIISLFYLVPASINLNWAIHPIIMIVLDVLNNIFFLTCAIALAARLECHSCSNDVGLRRL

SEQ ID NO: 31159 - protein, 265 aa, A.fumigatus
RGLISSTTVGPSSPVVKTLTVDPEKRYSIKEFLAHPWIRQTDEATEAADDAPPLATPLASRQTKQQPLDAQAADQAPYAPVSARLLGPASAGLDRPMDFRSPGAINLREVFDVGYAVHRQEEEGKRRKNFRQGYRGANPTTGFQSALNPLNEDNDDDEEDDVTLQHVQNDAYPPAKIPKASQDAGDVAAMEAKLRSTNLGAPSHAAQARQAPQSRQQGYGTHSANVVAAAKQSINRHSRQPFELSLSNATLLEKRGRRQQGQAVV

SEQ ID NO: 31160 - protein, 702 aa, A.fumigatus
LDLVHVVRTCSHPVCSHRPAHGQALHPRRRTADRVTRHIEAFADRLDRFNQKGRTDDLGNYQAAYQLVKSYQVLAQDAIQDITKQNTLKRAKMGWSTSRTNGTASHDPKIEEELQRLQLEANTWQLLLNLISIDDPPSKASCKKAQETVFQKLHRYSSDREVWESFLSADHYALECVIIMKWLERTATTTPQDIDSLISELESQAERGQGHWTHGWLYTKETIKGQKRLRAWPQPLEPKDPGITASLLTSDVSEPLITQLDPDAVTRQKQHLQKQDQFYERATWMTCWKMLRQGENWTKIRDWAEERLENWKAVSLCGSSVDPESGGERTPADDGMTRMMNFRSQESWRAAGSALARNPHIEDFERAVYALLCGETEAALKVCQSWDDYLYVHFNSVVLSRYQGFCKQFRRKLSHSPTAPVNFVPEPVGYSDFNKFVQYTKGNERIGVEARNPYRTIQAAILGKGYDTFFYSLAKAVSQVAKTGSEDSFVPDLSPTHVDDSLLIAAEDDDALRIATHLYIIASSIGYVRSDTQFFETASVNVIGYIANLEDAGIYEAIPLYASLLPAPQTHSVLGRVLIEILDPRERKQQVRLIEKYDINIEAVLEDQWNWISSTVSAVEHTRTVKRYPKVVRRDDGTRELVPVKTDFIGTEISRSDERLIRSLEWLRYVDGQWGRICHLGAFLYRKFYCESPLFCWLRQEY

SEQ ID NO: 31161 - protein, 70 aa, A.fumigatus
IRYLLICLRILFRYICTSYRMSQQLGHNMLYAVAENTLKAMVRDPAPRVKTIQMSHIPKRVSKDLRRVPL

SEQ ID NO: 31162 - protein, 61 aa, A.fumigatus
QYRSLFSPNFACSFQSIFASNFIYDTSSLSSQQAYLPGTTCVADRTTVSSLLADCVTIRFP

SEQ ID NO: 31163 - protein, 390 aa, A.fumigatus
  UNSURE (9): Identity of amino acid sequences at the above locations are unknown.
DHLNLDLDXPFDDDGATARAIQQQRREEANQREFRAWQRRFEVAERQGGSNRFRDTAALLDIEAPRPSRPRVPREPTPEPESLEEMRAWNALERAREIENNPSAARKRKEPTLSPSPEPTEPERKLKRPRTRRPQELAALALQNGESSRAAAQASARINEGSSEPSFLQSLLKEVEEASNPSGSNSHGPSAPVSVAPTDHSSIGPSSPPISPAPSNQSSPRISSTTPPPYPRSRPISPVQLASPTEQPSPPFSPIVSPSGSHSDVRETTPSHVGSSRPRSRIPRAALRLTARSNESSPTRPDLSLTVKSDIQKLVGGALKPYYRSKVVSKDQYTDINRTISRMLYERVGNAQSLDAETKNNFGKIAAEEVKKAIDGLRAKDEDSLADSSS

SEQ ID NO: 31164 - protein, 235 aa, A.fumigatus
FHHPRTTHESEVSWDQLLGDYCQVHRSVWTRSLPWTRWGWQLNFDDPQQYTMAKVKITTIPEADVSTNYSVGDIVKHCYDTGYVSEKPGKHTGSNGNNTSTMAFAAQPTFVVKAENGIQITGDDAIVTDDAFATPEVDFPTPEETDGTQTPNPVEAEPVVNNHPYAFMDVPGVPGGQQLELELFQGNDFDLNNMQLPIIDALPFDLAVADAFPLNYDPLEEPPFGAFDIDQYINV

SEQ ID NO: 31165 - protein, 619 aa, A.fumigatus
MRDPTGPDIYESSDLEDLEPQPGIHTSSPPGDPLPRNSTGEGSDVSEPICMDISESSDSGDPEPQPGVHTSSAPREPSPRTSIGEGCDVSERATIDISESSDSGDPEPQPGAHTSSPPREPSYPTSTGERSDVNEPIRMDIFESSDSEDLGPQPGVQSDVGIKERERTESDEDELGREEQKRREREPLLRGAEEQVENERFECKVVETEQGLLVREELSDGERQRDDAKDDAHVTQQEGNERATVAKALLADHQGLRTEEDLMVPAATAKEVEELLNEMLQGKSGLRAANEDASVPEEQVSLERADALARLESKAEALTVELEDMVEGSNEIVSSVGGRLSPVHSEGTTETAGAAELGPSRQVQERHVASLPGPEQAHKEAVERRAAEESLFDGPLTEDQTIEEAQENEPIGTAAVPSKRKRSSSLRHEQDAQIRVREIKAVRESKRVKQSQVGESGTPGASQVELAFPLRAVNLEERVSEGLESTASGPGSHEQPDNRPEVPAPLAPESRDGELPHDVPPGQRVTLTFHAYDSGRWTRTDTVSVSLDNPTEAQIIADRYARDRSKNARFYDEGLRKVAADECVRAAIVDGSFKILMSFGKDLVVTRFLVASVKQLLQK

SEQ ID NO: 31166 - protein, 145 aa, A.fumigatus
SSVSGPSNSDSSAARLSTASLWACSGPGRDATCLSWTCREGPSSAAPAVSVVPSLCTGLRRPPTEETISLLPSTISSNSTVRASALLSSRARASALSRLTCSSGTLASSLAARNPDFPWSISLRSSSTSFAVAAGTIRSSSVLSP

SEQ ID NO: 31167 - protein, 213 aa, A.fumigatus
RSPSDSSSRTKSPCSVSTTLHSNRSFSTCSSAPLRRGSRSLLFCSSRPSSSSSDSVRSRSFIPTSDCTPGCGPRSSESELSKMSIRIGSFTSDLSPVEVGYEGSLGGDDVCAPGCGSGSPESELSEMSIVARSLTSHPSPMEVRGEGSLGADDVCTPGCGSGSPESELSEMSIHIGSLTSDPSPVEFRGKGSPGGDDVCIPGCGSRSSKSELS

SEQ ID NO: 31168 - protein, 141 aa, A.fumigatus
YRSRSEYKKRVYPLGNVHSTTSLILPSSKTSHTCPRTTVTMKFLAIATLLASASATIVYPYTSASCSGSTVGKITSCGCTNMSGNYKIKGAKLDFQKATASFYKGRNCEGVRISKASDQSCVKLPVGWESFGSVRIHGGTC

SEQ ID NO: 31169 - protein, 184 aa, A.fumigatus
PRPHRAVILLLGLSAISWYTGYIMGQFKLRFPQIHSMGDAGELLMGRFGRELFGIGQLLFLIFLMASHILTFSVVFNTITNHGTCTIVFGVVGLVVSFIGALPRTMGKVYWMSMACTYPFSAIDSQPTDNCTACISIVTATVVTMIAIGVQAPDHVHVNVTTKVSFQDAFLAVTNIIFAYSTRF

SEQ ID NO: 31170 - protein, 157 aa, A.fumigatus
LLFISFPVANSALVAHVAFFGFISEMHDPRDFPKSLTMLQVVDTSLYIVTAMVIYRYAGPDVASPALSSAGPLMKKVAYGLAIPTVVIAGVVFGHVACKYIYVRIFRGSAHMHQNSFLAIGSWVAIALGVWVVAWVIAESIPVFNELLSLIVWSILL

SEQ ID NO: 31171 - protein, 130 aa, A.fumigatus
LASSPLHIIMTDWAAKVKTIGLTQVFCSKDKPLVDIVFVHGLNGHPYNTWSTKDPPVFWPADLLPSLLEPCKVRILTYGYNANVTAFTDGASKDHIHQHAETLASTLAANRNVSYVYSPLYRDLAKTAEL

SEQ ID NO: 31172 - protein, 219 aa, A.fumigatus
LRHCPDRPIIFVCHSLGGLVVKRARINGKTFPIKKMNPFRSILFPHYGILSWGDPPRVKISKWGVLLQNICSAVLPKKFMESSPQLIKALRTNNETLQNINSLFADIMGRFHLYFFHETRSTDVKGTRELIVDESSAAPYFEGVERMGIEADHSHMCKFADEDAPGFEAVAEALLRYSRDAPLTIFDRWVEEEKTRLVIRQTKAKEIFNNGRSVMCNKP

SEQ ID NO: 31173 - protein, 564 aa, A.fumigatus
HDIFLFSRVQSFHIAMAGHATAPAEPSQANGSTGLDPSTTNPYETNPELIPPTDPFLSRSRQYGRYAPHVDDFKPRYDGWYQAEPDAISYWEEIVRTFCTPQNSLNVPGTREVYAAGSVLIKIDQEPAAGAAAERYSNVNTNELSAARRAQDALQELGVAIPIIYFCGTVDGKNVTVESRIPGVSLEVAWKYLTIEQIGAFKQQCRRVIQRLALVEPAPDSASYVCGELNSQSPPGVEDSERDILFQGRKGTEQLHLVHNDMIRSNIVVKDGRIVGILGWRQCGFFGFERAKQIHRQFRIPERPVIDNGGVNVTQVWADLYDDIPDVGGTNGFPDHQTPVAPEVKIEPLQPSLDKYPPSNEAETLPALAQLDGTLLPEEHPTPRKVADLKSELASRASSADRSSPSGSTKAAGKRKPGPSASKKGTAKKQATKKRKIDELASEDAENRRSNTPSSTRASRTPGTKKQGSVSVAGSPAPEGTKRKKNAKKAKVEKAEEEEEPEEDSSEDDGVFCICRKGDDHTWMIACDGGCDDWFHGKCINIDPKDADLIDKYICESRLRQLVL

SEQ ID NO: 31174 - protein, 325 aa, A.fumigatus
CTSGPNCKAEGKGWTTWKPMCRLKGCRKPARVTGKNPSKYCSDEHGREFMRQRVQQLNRSPGDPAKKEWDELGSRGGVLTTGDLHAVVMAVSSAEEFRKLGERIISPPPEEEDPVTGARLSKKLGLDVDPEGLTYSHDEASKLEQLRKQREDLFHRRDVLNARSTFMALVRQRSKSIVEKLKQTDPKGGWKDICGFDTRLAWSDEEFNEWRLSKLGAKALEEGTPEALASSYPDAVDADGDTAMNGTKAEEEDEDELAKLTRGVCTKKRCERHKQWVKVHQSEVLFEENKLKQDLATCEKEAHNVVQRAVLRMWAEKDNADNGTE

SEQ ID NO: 31175 - protein, 239 aa, A.fumigatus
LPQEHKSNLPRHLEYSLSLSCIIYIYIVLVSTARMIRSQPPLSLPVHPLPRGQGLCVLRRLLRVQPSSPQFRNQQLDHILKSPRRRHMADVEPVQIRLHDPPLHLVRHRRRAANRHGAQPTDRRLLRHHPRRPARDVLARGRERVQDTHDPARLCRVGRRDLLVQRDPRDVDACPSAEEDEPPNHGRVFFQLLVLGPGLLVRAAQDGCECRKDLDRPWIPPLLRSQLADPVDFGPQHRW

SEQ ID NO: 31176 - protein, 249 aa, A.fumigatus
SARSPRCPFPYTLSRAVRASASCAGCSGYSPRLLSSGTNSSTTSSKVPGVDTWPMLNPSRSASTIHRSISSATVAALPIATGPSPPIDAFSATTRGVQRGMSLLVVVNASRILTIRPASAESAAVISWSSGIREMSMPVHPLKRTSPPTTDAYFFSSSYLARASSSVRPRMGVNVAKTLIDRGSRPFSAASWRIRSTLGRSTDGEWLETKIASACVAANSEPAADVPAWKRKGSAPEIFHQERQDRDEL

SEQ ID NO: 31177 - protein, 203 aa, A.fumigatus
LIAVLALLVKNLRSGPLSLPGGHVCSRLGVCGHARRGDLRLEPLTIGAAAQSRPDPPAGCGEGAGSTVDQGLCDIHTHPGPHGRGGPGQVRGAEKIRVRGWGARPLQRMDRHRHLADPAGPRDHGGRLGRGGPDREYPGRVHDHEQGHPALDAAGGGGEGVYRWAGPRGDWQRGDGGGRDGAVDRGGGSGRVQHRPCVDAGDF

SEQ ID NO: 31178 - protein, 254 aa, A.fumigatus
KISGADPFLFQAGTSAAGSEFAATHAEAIFVSSHSPSVLRPKVDRIRQLAAEKGRDPRSIKVFATFTPILGRTDEEARAKYEELKKYASVVGGLVLFSGWTGIDISRIPLDQEITAADSAEAGRIVSILDAFTTTSKDIPRWTPRVVAEKASIGGLGPVAIGSAATVADEMERWIVEADLDGFNIGHVSTPGTFEDVVELLVPELRRRGLYPEQPAQDAEALTARERVYGKGQRGLRADHPGSRYKYDVYVDDA

SEQ ID NO: 31179 - protein, 290 aa, A.fumigatus
LTNLLMSGLIGPVEIQLPAEGEGNKISVSNVSEEYLQMARHPAYKNSTLVQKSAMASRLIVTGSSYIGNVLTSGAESFTKKTKPNPKPMTFSETTHARFRKIGTLSQGAAELSAKTVGQVGKVAQNFGASLTRREGKQKGIDKYGNSSDYKPGILNKSLIAFSTLADGIEQGARNVLTSGSVAASTMIAHRYGAEAGAVASNVTGGIKNVGLVYIDASGVSRKAVLKSVAKGMVVGRMRDGKQVVVGTGDGGEVPPSVGGPSQSLLGGRDPVARRPSPSPTPPPAYGASG

SEQ ID NO: 31180 - protein, 66 aa, A.fumigatus
TNHNPCGGAHCVSVVSVNIIPRSAATFCNPYKMALFKALISQQPNIYLDIMLCMTYTIHISNPSYN

SEQ ID NO: 31181 - protein, 118 aa, A.fumigatus
LPFLELATHVWVNSPAMGTFPGSQYDLNTYWGWGAPCGRYLGSQGECSNILSRFCCISTDAYPRMLFVSPSGLEQAKRLISSYKQNHIPVMTPELWRAKKVVDSTLHPGVLVVFGCLI

SEQ ID NO: 31182 - protein, 226 aa, A.fumigatus
TTGTLLWQIANQSLNVAINNANANKSTPLSVSQMAKSYLMAVSASCSVALGLNALVPRLKNISPNTKLILGRLVPFAAVSSASALNVFLMRGEEIRQGIDVYPVLSEEEKKKREETGEPVHSLGKSKKAATIAVGETAISRVLNATPIMVVPPLILVRLEKTAWLKARPRMVTPINLGLILATSLFALPLALGAFPQRQAISAQSLEEEFWGRGGKDGQVEFNRGM

SEQ ID NO: 31183 - protein, 160 aa, A.fumigatus
CRRMLLSDISQVSVGYQLTFHKYSRAPNPPRTYLSETADSTASLVDVDSPHVVSVDSDFLNQEVKTTTQADRLEREAQEKEERKEQRKAEKAKAKAARAGHVAKRNPVILGNAVLYALVGAALGYGAYRKHAEGKLSLKLVGTWTGIVGAFSTVDYFVSK

SEQ ID NO: 31184 - protein, 66 aa, A.fumigatus
HPRTPAIQSRMATTTSRAAFEAVFPTLAEDLLAHAKKYNLPENAVKWFEQVSPGRRAHLRLISEQP

SEQ ID NO: 31185 - protein, 313 aa, A.fumigatus
PILFQKVLDVNVPGGKLNRGLSVPDTGIALLQKPLTDEQFKHLSILCWLTELLQAFFLVSDDMMDSSITRRGQPCWYRHPGVGLIAINDAFMLESGIYVILKKHFRSHPAYVDFLELFHETTWQTELGQLCDLITAPEDKVDLDNFSMEKYMFIVTYKTAYYSFYLPVALALLYLELATPENLQQTHDILIPLGQYFQVQDDYLDAYGDPAVIGKIGTDIQDNKCSWLINQALQRCNTEQRKLLDTAYGRKDSELEAKVKALYKELDLEKVYKEYEEKTVGEIRSKIAAIDESQGLKKEVFEAFLGKIYKRTK

SEQ ID NO: 31186 - protein, 455 aa, A.fumigatus
  UNSURE (179): Identity of amino acid sequences at the above locations are unknown.
YWQDIRPDWYHNMSSVMEAGPVVRTNQLDFDEEVIYKSTQYLYDHVRHRTDQPFCLTVSMTHPHDPYAMTKEFWDLYEDVDIPLPKTPAIPQDQQDPHSQRVLKCIDLWGKEIPEERIKAARRAYYAACTYVDTNVGKLLKVLENCGLRDDTIVVFTGDHGDMLGERGLWYKMVWYENXARLPMIVHAPNRFAPKRVSENVSTMDLLPTFAAMAGAPLVKELPLDGVSLMPYLTGEEGVKTDTVLGEYMAEGTQSPTVMIRRGRWKFVYSLIDPPMLYDLENDPEERVNLVAGLAVPSQSLAVKGAAVDQVKSTALPTPADTPSETPRASPVPQRANSSFPFPTPPRTPSPAKLPVAVPATTDPATLLAHFTEEVHARWDLKAIQEDVLRSQRRRRLVYSALIRGTPTIWDYEPRIDPSTQYVRNQGKGALDDVEFISRWPRVLQQAANAMGAKV

SEQ ID NO: 31187 - protein, 65 aa, A.fumigatus
SVSTPFLSSDCDDNDTTMAAKKPNILYIMADQMAAPLLAFHDKNSPIKTPNLDRLAREGVVFDSA

SEQ ID NO: 31188 - protein, 154 aa, A.fumigatus
RTNHSPRGKCRWSVAAHSHEAGQVHKSAFYQPEQCDSLRGANNGHMWGCRRAIPKAWSYAPIWDGNRTGPLEQTAREPTVGEMALCGIKHHTFPSQTVQIGSFDRRVFVMEGQKGSGHLVRHNVEDVGLLSRHGGVVVVTVTRKERSRDRLDET

SEQ ID NO: 31189 - protein, 442 aa, A.fumigatus
  UNSURE (121): Identity of amino acid sequences at the above locations are unknown.
LRWYSKTRNQVHPFLRVVLEVVKHGWVDQRIDKLPPAATDHDSWRLRALGHVLAQHRVGLDTLLASEVRHQRHTIQRKLLDQRGSSHCGKGRQQVHGRDVLRNALRSKAVRGMHDHGQTCXVFVPDHLVPQASLTQHVAVIARENDDGVVAQTTVLQHLQQLPDIGVDVGAGGVVRAARSFDALLRYLLAPQVNALEDPLRVGILLVLGNGRRLWQRNVHVFVQVPEFLCHRVRVMRMGHRHCQAEGLVGTVADMIIKILCRFVDDFFVKVELVGAHDRTCLHHRRHVVIPVGTNILPILVLCVLQAERNATHRLVPIDGPTIVPGVNVAGQSLLIAMKLVRSTKVHFTSQSSVIAFAAQIMGICGDVGGQFRRLGPTRQFGTGTERVPLNKPRGNPQWGKWPYAESNTTPSRARRSKLGVLIGEFLSWKARRGAAIWSAIM

SEQ ID NO: 31190 - protein, 112 aa, A.fumigatus
  UNSURE (23),(41),(77): Identity of amino acid sequences at the above locations are unknown.
NPHICDLRTYAILSTRGRVLRTXEVDAEGNATDAVPNGEEXNDDGVDGEESQDPSGSNDPKTAWVMALYQDDAGEEXQCRRSITSFGVSEYRINNCFGTGQQYNEAFEAENI

SEQ ID NO: 31191 - protein, 273 aa, A.fumigatus
LTPAILPAPCEDGPQSLPTWRYFSSCAPRTKAVVKPTAPRNPPKPSQETLKFAGRRPEGLGKLERKVAKEGDLLLFKAPSHRFYVLGAYGIAAFCLAYSVYNSSIVFGDPVVALPMWQKSLFGGICVMMSVMGTVFIVKTARLIKAINAIHLNGKTYLRFTVRSMIPFRKPYRFDALPRQIAFSRRLVVSPESLKPQTTPNAQPARVSIYRAPLTKISQVFWKGFRSVRQLFTQEDIILLEVEGQKGVFRMDSAGYISEDFLVIGNPVSIRSY

SEQ ID NO: 31192 - protein, 92 aa, A.fumigatus
VNRRGRLCSHFETSTLLLQSWDSGCLIARWGNLFALSFSVRDNTITRRRIVLTYSLDFKSYKGHHVLLFGDAYFTSIIGPNGSGKSNSCVSL

SEQ ID NO: 31193 - protein, 206 aa, A.fumigatus
NKSKSQDIYKWHTTNAMYNPNPTTLKPQVSDKTPNFASPQRPIGINHSMGLTSSATLNGASVLLRTSSTVTPSASSTNVNPSVKSTSKTQSSVMIRLTQVLPVRGNSHCLTILGLPFLSVCSIVTTTLVAEGLDTRSIAPPKPLILPGSIPTIQSVTAHNEGRKETHSWPGHHGRSPASHPEWSDRCVQSGSYQTTHHCRTQPHRG

SEQ ID NO: 31194 - protein, 421 aa, A.fumigatus
SYRGASLQYSQSQHITREERRLTVGQVTTGAHLHRTQNGQIDASRADHTKRLITAEHSRTGDEGDGLLAGIDQVRVLLALLRVRAQTEDTILRLEHHFHRGVDEVGRQHGHANTQVSIHAVLEFLGGTTNDTLPLRGRVALAQGGRVVPILFGKGVFLDVLRRRALDHTLDINTRQVDSSRLDLTRFNDVLGLDDSHLGISAHRTVEVGCGVPELAVTQLIRFPCLDKGIVTLDRLLHHIALAVEDLDVARLTVLSHRAVGVMLERQLAGLNDRSTGRWGKEGRDAGATGTTPLGQRALWRQLQLDFAGQVHPLEGLVLSNIAGNHFLDLLRLEEQTQASTIDACVIADNGQACDRGIGAHGADQCVGNTGQTESSGKKRGVGLHILDGFLGRSYHLVDLIPAHAARECSCKESLMLESSC

SEQ ID NO: 31195 - protein, 119 aa, A.fumigatus
VSFLPSLCAVTDCIVGMLPGKIKGFGGAMDLVSNPSATKVVVTMEHTDKKGNPKIVKQCEFPLTGKTCVSRIITELCVFDVDFTDGLTLVELADGVTVEEVRSKTDAPFKVADDVKPML

SEQ ID NO: 31196 - protein, 404 aa, A.fumigatus
HQRFLARAFSSSVRRNEINKVVASAEEAIKDMKSNSTLLAGGFGLSGVPDTLIGAVRANPSITGLTVVSNNAGVDGAGLGLLLQSKQIKKMIASYVGENKTFERMYLTGEIELELTPQGTLAERCRAGGAGIPAFFTPAACGTVVQTGELPLKHNPDGTVAQYSQPRDVKVFDGKSYVMEEAIKGDYAFVKAWKADKLGNCQFRYAAANFNGAMGRNAKMTIVEAEHIVEPGEIEPAAIHLPGIYVKRVVQSTAPKNIEKYTFAKEDGDDTAALGKGDTAAKRERIVRRAAKEFKNGMYANLGIGMPMLAPNFVDPSVEVMLQSENGILGLGPYPKKGQEDADLINAGKETVTLIPGAAVFGSDESFGMIRSGRIDLTILGAMQVSARGDLANCESPFFPRYVL

SEQ ID NO: 31197 - protein, 85 aa, A.fumigatus
IAFAQESEPDKTAMIQTPGFGGSPWKTWFIDNMTSSQQAEQVAVAILSRAPSSNTYSMHGKDDIMVELVCIQALSSGGASSSQDG

SEQ ID NO: 31198 - protein, 174 aa, A.fumigatus
  UNSURE (96): Identity of amino acid sequences at the above locations are unknown.
LASLPYSSYYYLPAEPTQQPQPVIQDPVLHTTFPYNLTNPNTIPTENNDPVVFQTPSKKLSDSQQHELIQAVVANVTSIVNGNATHGSCNKCKAAXAATKPAALYAPTLVPDTIISLCKEFNFRSNATCEEDYAASVFGAVWTQVLAYADVEGLDGDYICHALNKSLCGPPATS

SEQ ID NO: 31199 - protein, 355 aa, A.fumigatus
LLARFGTVDEEVLQKTNIAKLLSRFVKKGGPTVKELSQKILDNAAASTKRKQESTKPAAKERQATKSSPSEAAPANNSRPEITGSKRPREGEPSGQGASKRMVVTSNIKPSAKAGNATITGSVKRPQETAQENRSAAAVSRPKANIIAPKPTSLFGSLVSASKRPGTSNAERAAAAAAAAKTRYAECEAPVCGPSEIMLTMISPPAERKETQAPPPRPTFSFGDIMADLNKQKGPESVEPTEDRPPESEEERKRRLRKEARRKLRVRWKPDESLTEVRLFTHDPDEELGPGDRSQGEIGDIKGEGSVLKLHRDLEDLEDDDDGVIREENLMDYTEPSGKPVSTQGMGCLLTESRN

SEQ ID NO: 31200 - protein, 65 aa, A.fumigatus
  UNSURE (11): Identity of amino acid sequences at the above locations are unknown.
HALPSRPGRVXTSMCHRLMFYLFVLSFMISLFYLPLTTWVMTWLEIPNGLPGPQIRSPRDTPING

SEQ ID NO: 31201 - protein, 81 aa, A.fumigatus
SVMPSILSDADKETVKRNVSKPSNKILAVAVARLYVAYPDPQRWTYTGLQGAAVLANDLVGRTFWLKLVDVSVSSYFLEQG

SEQ ID NO: 31202 - protein, 300 aa, A.fumigatus
PAGRGVIWDQEIYDNFAYNQDRTFFHTFELEDCAAGFSFADEKEAKTFIKKMHEREKHASKETRQTPFASTRGQGPAPMANGKPGVGRSLFGSLLGHRSPSGSSVPPPAPAPAAPSAPPTQSALPSGPSRKELPFDTSDPSWKGLLDELLQMGITEDQIAENSDFIKAYIEQRQGSEAEPTASPSEDQRRGKAPPPPPPSAPPALKTTPISPQNTGNSGGSRRGAPPPPPPSRKARPEAEEEPAPAPAREPSPPRPRFRAPPPIADAGKLAHTVGPPVPGRQRAMSGTNPSSPRRMERQT

SEQ ID NO: 31203 - protein, 68 aa, A.fumigatus
WFLVGAGESGKSTIIKQMRIIHSGGFPEDERRQTRAVIYSNLVIAFKVLLDIMRAEQIDFELETTKVN

SEQ ID NO: 31204 - protein, 240 aa, A.fumigatus
QSAIVSLVDGIFLISGYLLSCSFFGSLDRLFKPGWLPDNQDMLQARLRTTGITETLFELGQMNFRMMDVGGQRSERKKWIHCFEGVQCLLFMVALSGYDQCLVEDQNAVSQSSLSASEEACYLTQTQNQMHEAMMLFESLVNGEWFKRKPIILFLNKIDLFKGKLEFSPVSKHFPDYNGSNSDFDAAARYFADRFRGINRIPDREIYIHYTNATDTTLLKATMESVQDMIIQKNLHTLIL

SEQ ID NO: 31205 - protein, 80 aa, A.fumigatus
TEGEPSIFPIQTLVPLLILTVGFAFQQLAEFIDNLEPDVGSDEAFSDYKVRDAMREMWVDAWVQKAVSRGHEFALHDNLQ

SEQ ID NO: 31206 - protein, 82 aa, A.fumigatus
GGVATPADAALMMQLGCDGVFVGSGIFKSGDAKKRAKAIVQAVTHYKDPKVLAEVSEGLGEAMVGINVSQMPEADRLAKRGW

SEQ ID NO: 31207 - protein, 174 aa, A.fumigatus
YYPSVYDCIKITHRMNSLSSFRKCVLSRSARSTSPLMLDFLAPSVLRQSRTRHSSTAASSSPDGAQQSSQNSGAGSSKPTYILSKKQREYLDSALRVYQAGELAATLIYAAPTPQVLRSHPHLRTLMKHMCEPRSRNLLDIQQNSLAKPPGSAPTVLVFRFGKIPTGLSLGMVR

SEQ ID NO: 31208 - protein, 284 aa, A.fumigatus
VCRFLCTPFDLNCVLCVRWLETDNTGPTRSDAGSHHSLESASMSESDAASDSEGASEDAEEDRPIFPYEKLYYSAKDKEEIMALPEIQREQILSERAQEVDRRNQDLALRRLLASRERDEARRVKKSKRKASVADLEEGQRKSSRQKTTLGGRKVGEASEAIEAYKRQREKKGRRDELRRRDMAAGEAAPVKDEAPSDKDAEGESEVEWDNRERSPSPPKDDPPADLRDIQRARVGRTNFAQVCFYPGFDEAISGCYARVNIGPNRDTGINEYRLCLIKSMSPG

SEQ ID NO: 31209 - protein, 89 aa, A.fumigatus
NVSSSTSSLSLRFLTMPQDINSELDELDREEFYRLKKVSNKKQRDSAAADAEIVATREREAADKRAAEVEAVPEVPDVLGENEDADVIF

SEQ ID NO: 31210 - protein, 158 aa, A.fumigatus
PKLRSAVSMCVSSSACYNERTAHLTSLTKQVRNLEERIKVDQLKVALEEIFSEYGNIVEIVAKTNLKAKGQAFIVFDNVESATRAIEEVNGFELFDKPMVLDYAKTKSDATVLREGGTEELEVHKRRRLAEKGAFFLAFSFFPFKSCLLLLVLGCVFH

SEQ ID NO: 31211 - protein, 137 aa, A.fumigatus
LCLFLVERKQAHEALEAQKKLKRPPGPADTARPAKTVKGAGLKPTSGAAAAVIPDEYLPPNKILFLRDLPDTADQESLTAIFGRFEGFQEVRLVPGRKGIAFVEYENESGAISAKEATANMPMGDNGKPIRVTYQRQ

SEQ ID NO: 31212 - protein, 63 aa, A.fumigatus
EMYIAQRNSADTLENDIGVFILPQNVWDLWHRLDFSGPLVRSLPFPSSYNFGISSSTIPLLLV

SEQ ID NO: 31213 - protein, 168 aa, A.fumigatus
TQHAMNGTPRLRSAFPQTPQTLQRTREYNITPTRPKPRDVGLRRSPVKVPQTKADAPLVPTGVIDAPSQRLYVVAFYIALNAWRVYESWTASDELDSTWLFLKWTSIDGVFLFGLQALRIPWLEWAFPTTLAIFLIHVVGNMFLMFQIPVRTLPCRAMVDLLTPRRFQ

SEQ ID NO: 31214 - protein, 574 aa, A.fumigatus
KWHTIGNYPFPSVVSNLEILSIMPLSFLGSRSFTFFRRGRLSLSWVPKTRLLTFFSSAVLNPDQIPFCLDSQRSTVNLPIRVNQTDPVLIELLRLDLSTGENETITISSKQLKQMKRQAGKKLSSSDAPEHRDILYPIRRTGIYRLQRVVDESNLEVRMRSSDALVVSCPRALIKNSHTHKCKGELSNLVLEVEGTPPLKIKYSRQVNKLDRGFSFQNIQPDHLRSPLLGQRSSGILFDAEQPEITWAQSQTIEVPLNESLNVGGEWFYNIEEVHDGCGNIANYSTLLDEADRSSPKSLPHWHQFSVHERPRLSLSGCDDQHFIKVAKGEHVNLPLRFHPVGQGYDYDGPFSLGYSFRGNELDERDSSDKVRQLSLKDLDQKPQIKESGWYMLNSISSQFCSGEILEPSSCYLHNPPEPELALKYEKIFDKCANNSVGLLLDLDLTGSPPFRMRYSIEHSKGVETKSLTVDGLRTQLDFTPSEAGFYRYRFLDIADTVYAPRSLKDKVPVLEQDVKPPASAHFLGSREVRRACFGEPVSIDVSFLGESPWTLHYELPHNGKFFHESVSRNSDWG

SEQ ID NO: 31215 - protein, 77 aa, A.fumigatus
CYTLLSFEVFEGSEERQTEVEECRSWHAGFTEKNPLLIEVSCTYTNGQSIEDVNNRKNNLMIRENRESYTRLLQLAN

SEQ ID NO: 31216 - protein, 70 aa, A.fumigatus
AGRRVLESLPASLNLKFSFVDLDAGFDTFKRTGTALPDKTVETLKKECDGALFGAVRSVVPMTGNFRSSA

SEQ ID NO: 31217 - protein, 71 aa, A.fumigatus
QECQPTGLMNRVQSKHTVPDNRTVVFLYAINTLYAFDGYIISSHQHKMHLIYLLSGHSASERQKIGNAPQV

SEQ ID NO: 31218 - protein, 69 aa, A.fumigatus
RHGSMSLNQTGFTDIIDGGSSGCYVGTSNEQLVPNASWNATPGWDPVTGLGTPIYNTLVKLATSVSSTP

SEQ ID NO: 31219 - protein, 216 aa, A.fumigatus
EDVAIMAHSVDLRSLVSELHNALNRKQLDAANNLLSQAKRTLLLQNALIPTPSTPSDLIALAREVLELGALASIRQTDAQGFTRYYQQLQPFYDLERDGAGSVKVDTKSSQRSKITGLYLMLLLSMGDSTSFHTVLEGLVEEASLQGKRVEDDLYIKYPVDLERSLMEGSYDKVWRETNSERVPSEDFALFSNVSSALFRCILCFCSAVELPLMTL

SEQ ID NO: 31220 - protein, 92 aa, A.fumigatus
VLVGTIRSEIADCSEKAYPSLPISNAKNLLFLDSEGAVIEFAQQRGWVLRDGRIYFPVEPEAAARSEKDILVASSTVIENTIGYARELETIV

SEQ ID NO: 31221 - protein, 211 aa, A.fumigatus
CHHHVAWHCHCCPLLRLLPPDSVHIHPCGFHLDSYFHPQVSNYIHTHSRFFYWRITSYSLLRFLYYKRNTARWYIIGVGNERVRAIMPGKTTTTPRITKFTNCRIVKGSELVEQDVWIDSLSGKILKDQEAFYGLHLSPDEVVDLGGRILAPGLIDVQLNGAQGFDFSVPQASKEEYNEGLRLVNKGLARTGVTSYLPTVVSSTPEVYWKV

SEQ ID NO: 31222 - protein, 144 aa, A.fumigatus
RPLRLRESADLTQMSFQVLPSLGPSGSNHRPEDGAESLGAHVEGPFINPNRNGIHKTEVLRAAQNFEDLEECYGKENLTGSSKSVKMITVAPEVGNMVSTIPSLTSAGIVCSIGHSDATFEQALSATTAGATMVTHMFNAMRPF

SEQ ID NO: 31223 - protein, 102 aa, A.fumigatus
CCEGQSPQLAALLWYQVSFLRNIEIYAIPRHGMHVIIDVHSPGGVNGMPFSEAYGHYRWFNSQTALDCSLAAIDAVLAYVQSLSHPECSPLHPSMSRLIIEP

SEQ ID NO: 31224 - protein, 432 aa, A.fumigatus
STLSLPPILSLAVVFVTQADTTVPGTTIKGTCVPCDSEPHTTSSPLSLVLSARPASGMAVSFRWRPSPRATKALLISAFAILSLCTLWTLWYHVSSTFSAVSTPIGLHDSEGKLSDEQRERPSPSGPETVPEKGPPRQHRYAFATILTGEDATETDIKDPYFTAVRLLAYQLLRSPHTKSSSDIPFLVLVTEEVPQRQRDILSRDGAIVVPVEGFSRDWIHPKWERWKSVLAKLNLWKLTEYEKITFLDADSVIFEPIDGIFTERATMTQITRPSSAALTTPGPVPDSYMMAGMHDRWVEVALPPVPGSEFYAKDNYMNAGFFVLAPSEAMFKYYSFLLDQPGLFDPAYPEQNLLNYAHRVDGRMPWQDIGPLWSQKGSSFEHYDPRLKSLHQKWWKTSYDQTFDERIANAMAELKDYLGKQEEDTVQPRSP

SEQ ID NO: 31225 - protein, 135 aa, A.fumigatus
RGQTRTWNFILPELQLQEQEDQGQSKYSDQIGAEGRVGRYSQDNRGGSKVTSSGMYFPGSPAAPPATNRVIQSAIVRIMKSRKKMKHVQLVQEVIQQVKSRFPPKVQDIKKNIEALMEKDYIERVFNTTGDPQWL

SEQ ID NO: 31226 - protein, 707 aa, A.fumigatus
  UNSURE (604): Identity of amino acid sequences at the above locations are unknown.
LSAVHNFCTSQKAVSNGQGLQAHRGGSSFRPLCEWYVGLCWPCSDDFSSVAHLLGEELYKLLGEYLSRHLEAVYRESLSHTEEALLGFYIREWVRYTTAAKYVNHLFRYLNRHWVKKEIDEGKKNVYDVYTLHLVKWKDDFFMKVHEKVMEAVLNLIEKQRNGETIEQSQIKNIVDSFVSLGLDENDNTKSTLEVYRVYFEKPFIAATRVYYENESRQFVAENSVVEYMKKAEARLDEEKARVGLYLHPDIMKRLTDTCLDVLVTAHSELLRDEFQVLLDNERQDDLARMYRLLSRIKDGLDPLRAKFETHVRKAGLAAVEKVAAEGEAFEPKMYVDALLQVHTRYQNLVNEAFNGESEFVRSLDNACREFVNRNKVCKSSSTKSPELLARYTDSLLKKGSKAAEESELEEMLVQIMTVFKYIEDKDVFQKFYSKMLAKRLVHVSSVSDDAETSMISKLKEACGFEYTNKLQRMFQDIQISKDLNSNYKDWQEKVLDEDDRKKQVDAHFQILGTGFWPLNPPTTGFSAPPEIVKTYERFQSFYYDKHNGRKLTWLWQLCKGEVKANYIKNTKVPYTFQVSTFQMGILLLFNENDTLTYSDIQKXTSLAPEILDPNLAILLKAKVLLPSPEGAKPEPGTSFSLNYNFKNKKIKVNLNIQIKSEQKVESDDTHKTIEEDRKLLLQVCISQDLPLPRPQLIELSSPPSFA

SEQ ID NO: 31227 - protein, 133 aa, A.fumigatus
  UNSURE (31): Identity of amino acid sequences at the above locations are unknown.
CHSSYVFLPNQNPHQLASYRAIPFSSKSLTXNNHNHNRHDTTRHDTTRQGKKTYKMKLQLNPTTLLLATLALTSQLARADLSYYCEMAKDGTNMIQKAYCCDDLVPARYAERFLQGEKCTPLILGSCPCCILR

SEQ ID NO: 31228 - protein, 80 aa, A.fumigatus
IYPFEVQINIRSYHHPPLASLLFPHSPQETARGTYNRITTNRHRPIIGTLIPHRLRIRKRTYTHPITSVIAVCNKDKNQG

SEQ ID NO: 31229 - protein, 552 aa, A.fumigatus
QLVSFQPGGEDRLENLSWRLWTRETFCVEPDKSSDTSVLPLLRSEAGDLPELSASVESAASEQAERIESHIKRSRCDLKPAVVREDSFSYLGRGKEKHITSLGLERMVLNIKEKKNLEPLDPPMTTVAPPVVDLTPRPSTLSPTPPSESTAKRTPSFPPFNNQALHSTASCSTTAPEGNDSDAANVNASDTSVSSSGMLPSRSCLIKSPSVVRGFSPSLVSSSYRSQPRLAADPGPAQQPAQLKPTPFKKKGGMFTLGGSSGDDDESSFEDRIAIQKPQHSSLSNEHSKSANTNPSPSKKVTSFQEQVGIIKPVSERSYDNDEDAIETEDEVSESAIEDDEDSDWEDSVTESGRSSVEERELFKRVDSRPNLVSRRSLLTMMMHQPTKMQGPASRSSPALQRSRLTSPNGPSIPASPPEDEEESLTMRGPDVPRSKPIIVKPSPQSVAHSPRTTRRNMLATELTESLRRHLLWERQQKSATANAFLKRRHTTHDMANLQEYPEPNGALKGQTSQQNAGVPNGTSAKAHAEKDVASFNHYTDFGPWEYHVEGW

SEQ ID NO: 31230 - protein, 138 aa, A.fumigatus
  UNSURE (129),(132),(137),(138): Identity of amino acid sequences at the above locations are unknown.
SSSLQSKGLRRRSTRSPIRPTATVPTTLFSRSNSFLATAATSHSPLRICSWAGTKLRTSARMVMTTCSATETTLQPVTSATVIPPLVLLAALRSTWSEPTPAVTASFNFLALAKRSGLHHGAGKCRSIXKPXRRSQXX

SEQ ID NO: 31231 - protein, 310 aa, A.fumigatus
RPERLAKAKKLKLAVTAGVGSDHVDLNAANKTNGGITVAEVTGCNVVSVAEHVVMTILALVRNFVPAHEQIRNGEWDVAAVAKNEFDLENKVVGTVAVGRIGERVLRRLKPFDCKELLYYDYQPLRPEVEKEIGCRRVENLEEMLAQCDVVTINCPLHESTRGLFNKELISKMKKGGFWLSSFPLANAISANCLSLGSWLVNTARGAIVVKEDVAEAVKSGHLRGYGGDVWFPQPAPKDHPLRYVQGPWGGGNAMVPHMSGTSIDAQIRYAQGTKAILESYFSGRHDYKPEDLIVKDGDYVTKAYGQRQK

SEQ ID NO: 31232 - protein, 86 aa, A.fumigatus
MALIILVIIAIVHEPLLEVSAESATCVCRIAPSFKRFPPRRIHIHPDHDFPLLVKYANVIVLCVGLPPPRRWQEEAHDSIGYTISQ

SEQ ID NO: 31233 - protein, 141 aa, A.fumigatus
ALGSSTLPVVLLLSRRTLPRPSSPATSAVTVVMSGSLSLPPRTTLFGTSRALGAVVTPWFLTCPVPQSTPRSVTPRVPRPSSKATSPVATTTNPRISSSRTVTTSPRLTARDRSKRHNHFMKRMTECIYSYTFLFGFRSSF

SEQ ID NO: 31234 - protein, 74 aa, A.fumigatus
LQSALYRFTFSFSQYLQTFIVLASQTLSDHISHHAAAAAFLASVPRRPSYPPGNKRIQRRREYQEHSGTQDHLP

SEQ ID NO: 31235 - protein, 148 aa, A.fumigatus
  UNSURE (88),(89): Identity of amino acid sequences at the above locations are unknown.
QARGLRGASIPTKARLTYFQDKSLTLDLQYKSEDTWTNCFTLNAPETNIAIPAVSYLGFSAETGELSDNHDIISVNAKNLYSIGGNAXXTFGRGPANNGRQDQAHVKLPKQKGGWGWFLFKFILFLGAIVGAYVGFTMYRTKQRYSRF

SEQ ID NO: 31236 - protein, 61 aa, A.fumigatus
LLRLYPITSVIMLPPRLSSLLYLAGLATLPVTSAYNGDENIKSIPVRKIIFHECANAPRIR

SEQ ID NO: 31237 - protein, 95 aa, A.fumigatus
RVTQIEVEFNIHGQGNLHGDGFAMWLTKQRATQGPVFGSTDNFEGLGIFFDTYKNNRPGTSFPYVMAMMGDGKTSYDQAHDGKANEVAGCSVSLS

SEQ ID NO: 31238 - protein, 61 aa, A.fumigatus
IQSTDTPQSTSLPTPNPFRRPQNQNTSSKMAIWGSSSSNTASSGEADIKTHLMNHVRQEAY

SEQ ID NO: 31239 - protein, 414 aa, A.fumigatus
SLTPKRERDNALSILGRLHIMTSTTTSDNIKAYTVTDPFASSLRQALTGAEQTQSFGVLSQISDKEAVSIADLDEYSRRQWEGVLGYMVGTSGLGMQRDVSLSKGVKELLQAGHLVEIRDRRVEITQDGFAFALQDVGTQVWHILVLYVESAAAIGMDSVEVLSFVFFLSSLELGKSYEKKQLTSNQLRTLTDLADFGIVYQETPDATHFYPTRLATTLTSDSSTLSNPLAGSLSGPTGTSSSKAGSGFIIIETNYRLYAYTSSPLQISLIALFTTLKYRFPNLITGKITRQSVRRAVEMGITADQIISYLSTHAHPQMRKHNVSRSTSNQAGMPVSVLPPTVVDQIRLWQLERDRVKATHGFLFRDFNTLAEYEAPCRYAEEIGVLVWKSDRKRMFFVTRHHQVAAFLKTRRK

SEQ ID NO: 31240 - protein, 337 aa, A.fumigatus
KGRSRRGSGVVGRNSADRGYGAGRRFRRSEVCFPFKSFLKNLNLSWPTDCHRFTGMGVQALDLLQKKAAPSPFMDEAIQRVCDLAISRNVRLLVDAEEQAVQPGIENWTMKYQKYCNSQTPGRAIFYNTYQAYLCSTPATLARHLEIARQEGYTLGVKLVRGAYLKTEPRHLIWSTKEETDACYDGIVEALLTRQYNSMLKPASVEHTTELPPVNVIIATHNRDSVRKAHALRLQQASKGEDKGVDLSYAQLQGMADEVSCELLEGFQSPEPTGKNSFVESPNVYKLLTWGSVKECMGFLLRRAVENTEAVGRTKQSQEAMFAELKRRARQAFRLSN

SEQ ID NO: 31241 - protein, 74 aa, A.fumigatus
LSFHHSGNSILSPEPTTGLVVDPVRWVDPDIIKYHCGWQAAPLCMSSYLRNDIADRPGFQAVSTGCTITFFSTK

SEQ ID NO: 31242 - protein, 230 aa, A.fumigatus
FSSINTSASLSLIVGFIAQVPPPVSTTTMKASRRPLRALSCMPTTYPTPRYVSGTSNAKSSIAATPATSLLHQVPPSPKKEATSPLAKLPLSSVLRSLMILSVSSSSLLLKPCIYTLSVLAHPKTPLLDVAKNPLLNMLVKHTIYKQFNAGENKLEVQQSIRDIKNLGYRGVLLGYAKEVLVGESNVSPRDEKAAREEVQAWLDGTLQTVDMAQEGDFVALKYVSLLSLF

SEQ ID NO: 31243 - protein, 274 aa, A.fumigatus
  UNSURE (18),(44): Identity of amino acid sequences at the above locations are unknown.
LSQCNRFRYRVTFFAPTXITDHAHEPPVTYLNKSQSYSVSIVDXTPPAHATQSVKYRTSVRITFEETAHRSNPARCWRLWKEARGAVEAQQRGGKMRALEFVDLRLGSKKNAPRIKKVDSASFDGFCVTWTSTPEAGSSECVINVRLNFLSTDFSLSKGVKGVPTRLCVKTEMIGLEDGTPASGSDTEAEICYCKVKVFRDHGAERKLSNDVAHVQKAIHKVERQIAQGDIDGHNGLGKRKRRKGVGHGLTKNHAVSMSLSPSRSNSLTGIDDL

SEQ ID NO: 31244 - protein, 368 aa, A.fumigatus
NDARRPVDLWRPISSIRREECTLEADLNRAQSQVTAQGNALKAMAAEMPLEAGGRNTYTEILELIKDLDPHSTTHSSGKPSLSRDADSRDEIMEEYRQDLAKARAELEEASSVRKALELDLKRSQEQAAEAQTLFKSVEDENTRLTKQIDDLRTSLDKVQGELGQMKAEHSEALETINRLQTERKTQQPSPPPSPPTPHNIGQAEKLEESYRAQLKSLHTAHATAISTLRSSHADSTRKLRDLLAAAEKRESKLKAEVQSLLAARAAQDTQLQSLDTEVKRLQSAIAVKEEAAAALDERIARSVEKREKEWERRVDLLLKERERMAKALMWAWGEKEVGEVKENLGEDGRRVRQAYRYKYAQRKGREG

SEQ ID NO: 31245 - protein, 165 aa, A.fumigatus
LSGALCLSAMAPIKRKGNAGEEAVTRQPQKRVRVGGAEQGKDQKKQRTSESTSDLKPTELTVLRDDEPSFPRGGGSVLTPLEKKQIHIQATKDVLFEQKGSKKSSDNFAVGDDDEDIEMDDAEDNATSTKLSRKRKAKSKKRAKEEANEKQGVRIEGLNFKVGPH

SEQ ID NO: 31246 - protein, 64 aa, A.fumigatus
LIGTGSQKNSGYKKFLDLCRQTAFRIKYNPITLIEESTAYWKKQLASRKKHVDTRLICSAARDA

SEQ ID NO: 31247 - protein, 67 aa, A.fumigatus
RTDLVPRSDQLDTYTVEPSLNKKTLSPSSSPSEIVNFTPARLVLSPVKLVVPLFPSPSPLFNGSTTG

SEQ ID NO: 31248 - protein, 442 aa, A.fumigatus
  UNSURE (420),(432): Identity of amino acid sequences at the above locations are unknown.
HRVGVLSDRGTWSCLYEGCGFGSASSQIVVAMAPSIWEKAKVGGKKGFDKAWNTVDKLGAPVNRLSNRVGAEAFWPMTLDKESDKAARILRSFCKDGFYTKEDLEQNGTDSDGKINRPKGKQRVIKKIPAPVIQRAVGLAIFTTMRTGLWLSGSGGSGVLLARIPETGEWSPPSGIMLHTAGIGFLAGVDIYDCVVVINTFEALEAFKKVRCTLGGEVSAAAGPYGVGGVLESEVHKRQAPIWTYMKSRGLYAGVQVDGTIIIERTDENERFYGERISVTDILAGKAKRPPRSIQTLIQTIKAAQGDSDVEESWIPPPGQTPGDVEVQPATLFGVPDPDDPDPFGVKALEAEGLFIREAGTRSRPSYDVFEFKPSPHSPIYSTFRRSLDSSPRSSWRASVQSHASVDRGTQTDVASFTAXTSICRASARSSXSMSQQSRTIA

SEQ ID NO: 31249 - protein, 198 aa, A.fumigatus
KCSEVNSFSPAALETEDIEVSDAPQPGISEPAAPVGAAAAQVKETKPEEESREDEAPGAASPEEEIPEEESPQEESPQEESPQEESPEEEAPGVASPELQPRSGVRTYGKGRRFPAGETAEAFETENIPWTKGDPHDWPWWTYPLPNGGAIMAEKKTKERTGGGRLPLAITLLKFQCSKTKDGGVLRCISITLVRYYD

SEQ ID NO: 31250 - protein, 107 aa, A.fumigatus
VRTPDLGCSSGEATPGASSSGDSSWGDSSWGDSSWGDSSSGISSSGEAAPGASSSRDSSSGFVSFTCAAAAPTGAAGSDIPGCGASLTSMSSVSSAAGLNEFTSEHF

SEQ ID NO: 31251 - protein, 658 aa, A.fumigatus
EVLTAGTAEEGHAERYTVASQYLNLCKTIHGQSSPATRDATLRLAEICEQSDSHLEEALALYRHVLQTKEWVPPTQASRALPDMTDPTAKMVKHKLAQIYLRKKSTSDEAHGLYMEELTLSKQQRGLSSSPTMLWLREVALVYALKDTIEARNQGATLLRDHVNEVIHVTASREAVVERAHRLAEIYLECGYKDAGYDLIDELHKKVILDTSAAQRLALNEYRPAVFVAAFEEKFGKKMTYSQILDALSQESGVYHEYQTSLSRHDLVTTLVAGQKLHVLQTEQRRTTAATKTQGSLYEYFCNSLSVSSSLRSRDVVHQFYNLCRREVLNADYNINIITETTHMVRDLCDSSRFQDAAELTGVFHSFVHLTDGLNSHEAIFTAIKLCLYLNGYQTSKCSDSGKAKHMAFESQMLLQEIMDRARHLKIEFSELPFAELNDLATVLGEHEMFDDLEVYDPYPFCLPDYMHMLIAPGHPHRPLDLASRPKNMVFQHDRLDRPASGGNPFLPRAHRRGNAARQGYLLQPPTGLGQLRPRHAGDDQAAVRPVHGVGEPPGGRGAARDGAARAPQRHRHRPGACGRRRQPASAAAHARAVAAPQGEQSGRGHQRVRRAGAAGWHQVWREAGGSARRRRRCGNVASAEAVQPGYGRGADAFEPPA

SEQ ID NO: 31252 - protein, 207 aa, A.fumigatus
LHQAILTDLWTSRLVQKTWSSNMIVWIGRRLVETRFCRGHTDAATQLGRDICYNLRQVWGNCDPVTLEMTKLLSGLYTASGNHLAAVALHETALHELLNDTDIDQAHAADAASQHLRLLMHAQSRLRKESSQAVDTSAYDELVQQVGTKFGVRPEGLQGAGDDVGMWHRPRRFSLDMGEEQMHSNHLRSSSGSAVLHGYFSASGENH

SEQ ID NO: 31253 - protein, 406 aa, A.fumigatus
TIQQADSDHGGDALQEDLHVLQFVNLAGAHRVVAEGAHRPAKGSALLEETSVQAFVRFLHEFLVGELLGLVGDKGLLVGGDGRRGDGFDLGLGVLAVKLGEGLLGGSGGGLGSVLLVVLVLDDGVVGDFGTVGALRSGTLEQQRTEDKHPPLDAVIPLDHTGVDKGNEEDGGEDGNTTTATHGHRGNIPAGLLAQTETRRTLVDNGQGTDRGGEEEPEGRAVDSPRHGVLAHVDDELDQHEDTGTETGRDGGSHTQAGEDSSQSLSVVPSPLYLGSTDGCNTDTSNGRDEGVGRRDMGRVLGAPHNPGGSSGEGTGKSKHLHTGITAEGRVGDDTVLDGVSRPSTDCDGTEHLEDGAEDHGLSVGNRSGRNTGSPGVGHIIFRQAMSANHLSKRGQRDIDILAPLL

SEQ ID NO: 31254 - protein, 67 aa, A.fumigatus
QHKSPVARSLSESIANQALIHLSHTHTHTHTFTVEMVLSQYDYIFAIGTLFAMLDAYNNGASMSISL

SEQ ID NO: 31255 - protein, 98 aa, A.fumigatus
  UNSURE (9): Identity of amino acid sequences at the above locations are unknown.
AIVMGNKIXYHSPSRGCSMELGAAITVLVFSQYSLPVSTSMCITGATVGVGLCNGTLKAVNFQRVGLLLLAWIMTIPIAGTLGGVLMGLFINAPHFSS

SEQ ID NO: 31256 - protein, 498 aa, A.fumigatus
HCLSKDDVANSWATSVSSRSVTYRQAMIFGTVFEMLGAITVGARTADTIKNGIIPNSAFRGDAGVQMLAFTCALAAASSWVMWCTKHSAHVSSTYSLISAVAGVGVATVGASKVQWGWNHGKGLGAIFAGLGMAPAISAGFGASIFMLIKLIVHMRKNPVPWAVYSSPFWFLLAATVCTLSIVYKGSPSLGLSKKPSWYIASVTMGCGGGVAILSAIFFVPFVHARVIKRDHGVKWWMFILGPLLFKRPAPQGADRAKVPNYAVVQDEDHEEDATQASPAPSEQTLSEFDSKNPKTEIEPITSPAISPNEKTLVTNETKQLTYKELMEESNKRLNARLLKKRGPLGWAMRTLRDNPMGPGEIYELKNMKILLKRIPAMITVGLLYGLHYDIHAAQSGIHGTPEGERMQRVYAHAEKYPNEVEHTYSFVQVLTACTASFAHGANDIGNSVGPWAVIYSAWKTGNAAASKAPVPVWQLAVLSGCISIGLITYGYNIMKGK

SEQ ID NO: 31257 - protein, 69 aa, A.fumigatus
SFESSLLPKYPLNSTSKVMPKVGSEGPKLPNNITGTTAPPSDLEWPWTFRAGTESFPFLFSFIFSSRHC

SEQ ID NO: 31258 - protein, 137 aa, A.fumigatus
VSRQRRLPVRPFPSLIDLANSDRYIPYAEESSDINACGIPINYNASKEWADKKVVLFSVPGLFTSPALPNYESNSTGAFTPTCSANHLPGYIKSLPQLKEKGVQIVAVLASNDPYVMSAWGKANQVTGDDIVRGATT

SEQ ID NO: 31259 - protein, 62 aa, A.fumigatus
EPGPKGLAQMGAISPGGMSSSPPETPKGPKIQTLHTAYQTDLARADSPGPSERLKRRLLWVL

SEQ ID NO: 31260 - protein, 531 aa, A.fumigatus
  UNSURE (336): Identity of amino acid sequences at the above locations are unknown.
LRGSAFPSSPWREDARPKSRSRDSGHRRSRDKGSRSSSLSRHAYSQEANFLASRGRREHSPKRHESEPGFPRDLHGHEAANRGGSKARDSEHNGPHKGSDKNDWVGQHLDEIDSAHWIHRDKLARIESEELQQAAYLFHRRAGLENGKASRARNHDFDNSGFSGLVGAPTASESMEPWPNLRDEQHKHASSPIPFDGDDTGDVTEEERRGWDLRRPEEIAADEVTDSTSSMYRNPGLRKSSSRIPISTASPAPISPEHLGREFSMQRAPDAHKRGGGNLVFGKPRRASEPIAGEGSDSLATPCAGSRPNSRGIQPNQSCSAKRGPASKGSATRKPXAPPSNTRKTSRNRTVSTNSQRPTTRSGEPRPPQPINRPEGDPPWLATMYKPDPRLPPDQQILPTHARRMQQEQWEKEGRTPTTYDREFAPLAIGPDDRPQLPSKAEGTEKVENTPEKTEEQSLSQGQAEKTDHLLASPKSPTSRPSSSTGYSPMPKLQEMPAAAQVGLTPKWNPPVVTAQPPPPKEKGCGCCIVM

SEQ ID NO: 31261 - protein, 70 aa, A.fumigatus
NGNEKRCADVCGDDDDDVDDGREIQNALYEMTQQRTVPNIFIGQKHIGGNSELQAKSAQLPALLKEAGAL

SEQ ID NO: 31262 - protein, 61 aa, A.fumigatus
AGEYSIDNRSTNSVVTFAVCTYVLAYSGLQAEPWAINPLVPTSPGVFNYSNKTTQLLNLQV

SEQ ID NO: 31263 - protein, 74 aa, A.fumigatus
NHTPFRVSSFQALRNRLHVLRHAQKFTAVVQTSTVYADLSLMKPSSYIDAGLNVDVLLHRTARHGLLPPSILEY

SEQ ID NO: 31264 - protein, 77 aa, A.fumigatus
QLSNILLSRDQKAKASFPDQWRLGAATFRPFTVINRTTAQLAIILEAGIYLAPSFSARNQTSISLSEKHAIILSLRS

SEQ ID NO: 31265 - protein, 140 aa, A.fumigatus
NDAYLSFLRKSWSNTRLTQWNAVALWAWDIVVDNCAICRNHIMDLCMSLTPLFCLIDAHLLQTGIECQANQGSSTTEECTVAWGICNVGFASATAFSPSRANKCFTSQHAFHFHCISRWLKTRQVCPLDNRDWEFQKYGR

SEQ ID NO: 31266 - protein, 303 aa, A.fumigatus
  UNSURE (84): Identity of amino acid sequences at the above locations are unknown.
YRLLGSITVIRLYPSLLLFLSVTSLFIDQFHFKFFHESSKAAYLLSHLIAMSSISPTPPTPKGSRSNRRNPKKTTTPSNQKMAXLTTPPSSPPGNSSPGEIVTDTSINLHNPSKRKNPRSNKKPRDAPKSSPANNNGHRHTSSHPAGSTPQVKDSPHYAGPTFHASPAPSALPIPSFFSKSVPESDPAEEIDGDHLEAGLDLDTTPSKPRPRFQTQSEKSHSTPLDFLFKAAVEARNSQLQRSPEANIGTRSPQTDLKVQRHQMPNCKNGAFAGIFPVRDGKFRPTELCLHPQGPEGPALCVY

SEQ ID NO: 31267 - protein, 66 aa, A.fumigatus
PHLMFAWALLVIADPHLKFPNSLQPTSARPSQGSFRPLASLLQLQMSKATNMRLCPVSILSLRSPI

SEQ ID NO: 31268 - protein, 71 aa, A.fumigatus
HYFLKTPSQYNRALINTKLSTEQEVALIKYINILIKLDIPLQLKAISNIVNLILFHRHTNLITPPPLISMH

SEQ ID NO: 31269 - protein, 418 aa, A.fumigatus
EDVQRDLVLLKARRPVYDQNPPSLEYNLTLCDSGYIDWARVLSPPEDFLSTARDCLLNGRASNVPTTVRTTGSEQTQVTGAVNHETPQSFNQPEETNAGRAYKDSTVSFRSDGDSVAIATPVSSNNGQSSRVSIVQAAHTATETDQRFEPSRLRSSQQGKPQHVKSNSELADDKAQAGKQNQDDALVDVSTPPSGSTTIVRTKDLYYDNVQTEGKTGILLDFNSTPPRKSLPGAENSLSMSPALQDLEGINFQVNVAQSILLRPEQRPETQIYSFIEADPVDLKDFSSPRIVESNGDTMTPTPDSTPSDLAALREKLARLCKFVEETLRHHVPEPLRDMDLQALRKYEQELTEILSLHQGTMHETASQTARKRQEFLSSRKSQEKKAETAVERKSPKISSPTPSVCSPPVRAPLEEGN

SEQ ID NO: 31270 - protein, 210 aa, A.fumigatus
GYDVGKTLVSRFSNVRMENNTPQYTIAQISAAGFFSAIPMTLITAPFERVKVLLQIQGQNPPPPGQKPKYSGGLDVVRQLYKEGGIRSVFRGSAMTLARDGPGSAAYFAAYEYIKRSLTPKDEHGNVTGALSMPAVLAAGGAAGIAMWIPVFPVDTIKSRLQSAPGKPTIGGTIRSVYASGGFKAFFPGFGPALARAVPVFTTGLERAAP

SEQ ID NO: 31271 - protein, 113 aa, A.fumigatus
AYPSNTGATTTDTTLTTTTTSFENGSSTGNSSSETGAGSGSSTATGSGSGSGAGSASTTAPNSSSTGNVAPWRRCRWFRCRWSPGPRCLDYPLDFSKITLMGIGSLMSVYVLC

SEQ ID NO: 31272 - protein, 161 aa, A.fumigatus
NIFLIKFLLTSALFLRFLHFATVSRPPSSHPSLCSRDHLTPWPLCAITYLPPLPHYELSRFFPASPCTHSTMSTPGSSTPENLSDELKAIETKAVNQTIAQIRSLAAGAAGGICAVVVGHPFDLVKVRLQTAEKGVYSGAIDVVKKTIAREGLARVSCAVS

SEQ ID NO: 31273 - protein, 400 aa, A.fumigatus
TERTGRPWEDLRKREEAASQKVKEMEQAFAKLEKEKQQMKTEIENTVRREWEVKARLEIDRQVQNELDRLRKRFEFEVQERVNIEVEKQKRNNTSRDDTVLPTGSSQSSVNSGDDTGFPSNTDLSQLSIESPTANANKQPKKESRTPFSRSKTMVESPVDVQMAEPSPISIASLSLSPRRTSVASRNIFAEADKPRAKWEPTLTYSDDEHDIPDLPSPTRQKVKHDPPKGPARPLLRQNTTAFMQKLSSQPPLFPSNSSRLPQMPGGPSETRHGEKSRSPHRRLSKIPSSANLAADAGSPTRKSATKQLPSKANGGGEEMFKAVMQRNMGGRTLVELAQARAGGRPMDEVKRCASDSRASGCSSNLKSSDREPPAVWDPEKDEMPSPFLARGRKVIRNFR

SEQ ID NO: 31274 - protein, 193 aa, A.fumigatus
IGPPLSFQPRVKTVAIGPLLHFDANWWLIIGTYAGLVGMNDGCVLRNLQARLRGFADLEFEKVAVEDDKLFESVCQAMPIKEAAEKPGLTQRVSDAMNRVCAHEITVVAGFLTIVGLIAGASAMKWTMTGQLLCNVPPSLIESFFMIILITGHNSADDRKRMDLRNLYERRLHLLALVNSVQTLREENRSQRD

SEQ ID NO: 31275 - protein, 308 aa, A.fumigatus
AAYGLAVVGSTASHTGVAGTTLGGGFGWLTGRYGLISDNLLSVRMVLADGTIVEASDEDHQDLFWAVRGAGQAFGIVTELVFRAHELAGPVYGGTLVFTVDRLPGILEFASRFDKLQDENSGFFFGLAAPSAADRTGILVLPFYNGSQEKAEEFFAPLMSLGPSINKTSMMSYKELNGIANVDPVPEGRKCFSGTKVSMPLDQHLLCDLWEHFDAIMDKYPRSNNSVLMFELIPYEKTISVPIDATACADRGRYYNVALLLCWYDPEHDAAMHTYMRALLTQIKRSDCYAGKKEPLVQANANFAGGST

SEQ ID NO: 31276 - protein, 111 aa, A.fumigatus
LPIDCFLADHIGGHIHSSTWVPSSSLDYRMPELVRTLKDKEKVVFHCALSQQRGPAAALRYAREREAALGPEESKKQQVYVLEGGFVHWQEKYGKDTRLTEAYVEDIWREY

SEQ ID NO: 31277 - protein, 235 aa, A.fumigatus
RLYSIPHQTCHQFLHIAKMEARSLARCLRLRPTTSLYTRQPIIFRGQDALRYFSTSNSLLQTPPASQDQPSSTTPASPQDQSKVQTSSSNSTASNSDSADFDRILDQLNFNNANRNATEDSQSSDSLSLSRSVSMAAGTESYKQPLRRVELKLGPTLGRQVHVEPEKGLDLTTALRVLQGNVTTNKVRAQWYAQKFHVRRGQMRKNLRMERWRKLFKFSFKQTVNKIQRMRAQGW

SEQ ID NO: 31278 - protein, 139 aa, A.fumigatus
RSCHSSLSISLLVEYIRHIESNSISPLSLRQSASSATAQLPAPILEFPRHTVDDGPSSKRRRLVSSSTAGSPSLRTYSSTFPRLMPSSSSSAASSASSTPAAPHASFSIPGPTDAGPRSHASSETLRTSSAGAAFDKRS

SEQ ID NO: 31279 - protein, 63 aa, A.fumigatus
RTVIQTAETGLLFNCRESKLEDLFLHISKAHAIVVVECRFLRFLYTRSSTRFILHPWSHRRWP

SEQ ID NO: 31280 - protein, 189 aa, A.fumigatus
GTLPEFLPINIQSMSPVALRMSSKALLPLSPLLRLSTASPALARPCSPSPRTSATLAPPTRQAPPPSSLSSSSFSPSFSPQQANLSSPSSSRVRSSVSSASTRAALLSRHFSSYTPPQSPNMSYTVRKIGQANTLEHRVYIEKDGVPISPFHDIPLYANPEQTILNMVVEIPRWTNAKQEVRNSDPRDT

SEQ ID NO: 31281 - protein, 63 aa, A.fumigatus
ISKEEFLNPIKQDVKKGKLRFVRNCFPHKGYLWNYGAFPQVSQLHEHGARPGQSMLTRDFSMV

SEQ ID NO: 31282 - protein, 163 aa, A.fumigatus
TWEDPNVVHPETKAKGDNDPLDVCEIGELVGYPGQVKQVKVLGVMALLDEEETDWKVIVIDINDPLAPKLNDIEDVERHLPGLLRATNEWFRIYKIPDGKPENQFAFSGECKNKKWVPSYCVWYHLSMLTFLISRYALDVIRECADAWEKLITGKSPRGDISL

SEQ ID NO: 31283 - protein, 98 aa, A.fumigatus
YTINVPGGSAHEQQSTTAPVSIAPTVHRLTGPRPPLFAQSSHISNAGSPHSTSPSSLLPLVLLLLSFLLPSTSKFVFAIIVKSSFVCQLRVNSCCSSF

SEQ ID NO: 31284 - protein, 77 aa, A.fumigatus
SELTTFVYISIEQDIFFFSARQASFYGSSQQYLSSKERGFRATCIISFRQFLLDQTNRISTEYEQMREYAKPLEQFF

SEQ ID NO: 31285 - protein, 136 aa, A.fumigatus
HRKMIPDAVRRNPLLVLALAREGKLVLRLSVGDLVDTEPFVGSTEKARKVTLNILNVVELRGKRVVDINDDDLPVGLLLIEQSHHTKNLDLLDLTGIANKLTDFTDIERVVVTLGLGLGVDNVGVFPGLNHREISG

SEQ ID NO: 31286 - protein, 80 aa, A.fumigatus
LFRPLPPIHYPAMAQIRGTAGYNLGHQNPFVGPGRADATSDPSPLDAIREQTSKIEDWLDTISDPVKPYVVQFHLVREKG

SEQ ID NO: 31287 - protein, 241 aa, A.fumigatus
LLAIFLLLAVSLLWSPSSRTAYVLSHNGAISSYTSVNTGKVSVPDSPFQYSSATDLSHDILCPVPWGITHTFLILNVIAMSVCSFLVITRRHTEIAVAGLLGVVVTQGLGYGLIFDLNFFLRNLSVVGGLLMVLSDSWVRKKFVPAGLPQLDEKDRKMYVQFAGRVLLIFLFVGFVFSGQWSLWRVLVSLFGFVACVMVIVGFKAKWSAIILVVLLSVFNVLVNNFWTVRSFPYATDKARN

SEQ ID NO: 31288 - protein, 68 aa, A.fumigatus
LSLSAAPPPPPQGLCQVRLFPDSIHCVGFCFPYPHKYSCPNHYNSGGLLLLVNMGPGQLSMDEKKKVY

SEQ ID NO: 31289 - protein, 628 aa, A.fumigatus
  UNSURE (38),(56): Identity of amino acid sequences at the above locations are unknown.
ASTMWVCSRMPWVGYDELPCGVNKAIHEQLQGTGDQHXGAFLTASKDWREKAMAAXQEAGSVPSNEDDAVKSVAVGEIDPEDFPLDSNRKPYREMILASDISIFDFRTYVFSRQLTLLLRAARAPSLVATETGASQNGKGDKKPEDLMLLSELCERAADFITLAARTLRADLDSGLADVDHPSKTHLINNLVSSWAYAAASQVLVQTYTPKLTLPESSLHAMSKAVAATTPEPKPEVPRRSSSLMSPVTTRPGRSNSHGIPLPDTLANAARPDHESQKPVPAFIPKTGSEQLASGRGELFSLARRLLEEIACRCGWNEKWKDLGLLFDDQDQGEGEMTEVSLDGGTDEKPDEKPDEKPDEKPKGESLVSNPLLGIDLLELRTALRSRKTFRSHYEQLTDLVYRHYVMANRTYSAQTALADMALLRYRQNDYNAAASYFHQIIPFYGTKNWILLEGIMLEMYARCLEQLKRIEEYVRTMLRLLAKFAVHTHSGLTAREKTLDASSIFTEQSLVSRYVEKLFEASGTLQKEVSAPFADFFADLEVKPIIIHYGDKDGFQMQLSLRFLLGKRIEIDSMKVRLVSASGPHSNENWIETATKAIIKSSPTKVLVDSTVSFSDPSKLLTLTEII

SEQ ID NO: 31290 - protein, 94 aa, A.fumigatus
LKSYKATLQGKYFVDRLEMRAGNILFTLAGGTHPALPVGFREVLDAEEADSRPYVYCFPRPEGLQAKITSPHLVNLEQMRTVFTAGIEGSIIIN

SEQ ID NO: 31291 - protein, 235 aa, A.fumigatus
VRSVRSLRIGFVPAQLETDERKPSSDTSRSAPVAHRRHQIPGLRQTPYLKIYFLRCDDNESYKATARKALRDWIKAHASTPQAGASAASNQEKHDAFEWLIVHVVQDGDGKEKAAPASKWGRSTTTVLEKIKADFNGSSKSAVDRVAQLRLPRPGSTQRPTELADQVEDLVEKMKNAILASFDLRVAQYEEDIKDNDSQRTLPGWNFCTFFILNEGLAIGFDNVGLFQDALGRVR

SEQ ID NO: 31292 - protein, 476 aa, A.fumigatus
LERYKGKQLDLSLVFRLSGLASGAKLELVQLSRSPSIVTVALQLPEAEARGVPNGRLLDKFPSTTTLWLVLRKFEAGVAGGGPTRNFTGRGVPVASAGNEGSGRLFYETPVVQIMGRELSTFEDLQKSLAQLGFNSGNVLVRLSFRRTEEPLEVAMVKIQDYFKAFEDAAPEPQETAGVPAQPKTVAESQPGQQVPSAEHAEPLDAVAAAAAAPALSTQEPGPDSHPSIASTEPSAVTQPSSRPVTVFSAPSNTTPQAARMTYNEDDYIPSVDQAQAHQRRLNAASRPVRLPTDAEIAAKAAEEEEKRAAVREVDVKVRLPDQSQIVSKFGQQDTGATLYGFVRSCLSEQFASESFILTSFPAGTPGLGAKKIQSIIPDTDQTFLIKDLGMIGRVLVTFSWDASASPAARSTRASLLKPELRNRAQELKVEQPPELMDTSQDTLPAKVGGLGDRDREKSGRKPGGIPKWLKLPGKK

SEQ ID NO: 31293 - protein, 177 aa, A.fumigatus
LNYHPHSHINPPKYRCPRCSTRTCSLPCSRRHKLWSQCSGVRDPAAYLKRSELATESAFDRDFNFITKIERSLERAEREAEVRGIPLDGTTAADPAVLGLEHELGQDGPDAEAGSKRKRPEQGGYVKGEAGFVRGAQAAGVRVIRAPRGMSRNKANASKWNPKNDFSFWVVRAVSVC

SEQ ID NO: 31294 - protein, 181 aa, A.fumigatus
QTRQASSLRSRKSPSSTLVSLSRQPCSTLPVDSRANPSWSLQRKNSPRGSRTKGEFFLFPTTIVCIQRLNRNRKGAFNFAKSALPLLLQAQGLQHPPTLIFTGATASVKGSANFAAFATGKFALRALAQSLAREFGPKGVHVSHVIIDGVIDIPRTKAWTFEHEDAKLDPDAVRCFFLVWN

SEQ ID NO: 31295 - protein, 102 aa, A.fumigatus
HEQGASIARRFAKAYSVVVLSRNPANFEPLVQEINSSGGQALGISADVTDPTSVKSAFEKIAQQYAGVPLAAAVFNPAGGFTRKPFLELTEEKFSQGFENQG

SEQ ID NO: 31296 - protein, 747 aa, A.fumigatus
RRTPPKPQPEPAPEQTAPDDAWGGWDVPKKEKNNKKGKAAEPEPEPEPIPESELVPEPEPEPEPVPEPAAEPEPEPEPEPEPEKKASGLPDDPLYDNWVNLSSKERKKREKALKKKGLPIPGKDIEIPPPEAEPALEAAPEPPLEPEPEPAAEPEPEPEPVVESQPEPEPVSEPVQEEPVVEDSWGIWTSPKDKKKPKKNKIAVDPPPPAPTPPSLGLDPDPPVPEEVAEDLLFENDTKPSKGTKKGSFGVDETPTKAVRGFWATFGAATMGSRPKATRKRSEEKPKLIEPAKEPGPEQEPPVPAPEPLADLLGDIGHAPMPEAPEPPLIDEPAAPAAPPAKSTSKAKSSTKLSVAERIKALEQAKKERLKEKAKAKETVSPPEPPNQEPAVEIPPEPVEAPKISRESVPGSFPDAFEDDFQEPPPPAPEPEPEPSIDPPPEPEPEPELAPAPAPLSKKAEKKKKKKGKLVEPEPELTPAPEPEPEPESAQPEPEPEPEPAPAPEPEPELAPVPVQLSKTEKKKKTMAKAVEPEPAPPEPEPEPERALGPEPEPEPEPEPEPEPAPEPAAEPVDPPTQEPKATKKTKKSSKSKMSEPAMEVPPARDVPAEEPGADAGGSPTPPPEPAAPGKSAKKERARVERTPGVASWGFWGATPAPRKSAHREVRSSRAEPSSGEVVRSKSTKYSRREEVPYEAEKTSGSDRDKRQGSKEDRATTFSNFILGGPAPTRMKVFTTGLEGSASQLKS

SEQ ID NO: 31297 - protein, 598 aa, A.fumigatus
GTSSRLEYLVDFDRTTSPDEGSARLDLTSLWADFLGAGVAPQKPHEATPGVRSTRARSFFADFPGAAGSGGGVGEPPASAPGSSAGTSLAGGTSMAGSLILDLELFLVFLVAFGSWVGGSTGSAAGSGAGSGSGSGSGSGSGSGPSARSGSGSGSGGAGSGSTALAIVFFFFSVFESCTGTGASSGSGSGAGAGSGSGSGSGCADSGSGSGSGAGVSSGSGSTSLPFFFFFFSAFLDKGAGAGASSGSGSGSGGGSIDGSGSGSGAGGGGSWKSSSKASGKLPGTDSREILGASTGSGGISTAGSWLGGSGGDTVSLAFAFSFSLSFLACSRALMRSATESLVDDLALEVLFAGGAAGAAGSSIRGGSGASGIGACPMSPSRSARGSGAGTGGSCSGPGSFAGSMSFGFSSDLFLVAFGLEPIVAAPNVAQNPLTALVGVSSTPKDPFLVPLEGLVSFSNRRSSATSSGTGGSGSRPSEGGVGAGGGGSTAILFFLGFFLSFGEVQIPQLSSTTGSSCTGSETGSGSGCDSTTGSGSGSGSAAGSGSGSKGGSGAASSAGSASGGGISMSFPGIGRPFFFNAFSRFFRSFDDKFTQLS

SEQ ID NO: 31298 - protein, 139 aa, A.fumigatus
VGLQARQQAQAQAQAQAPAPAPVRAQAQAPALALAQVLVARVQVRQPWPSFSSFSQSSRAVLVQVQAQVQAQAQVLVLVLVPAQAAQIPALVLAQALVSAQARAPLAYPSSFSSSPLFWTKEPGLEQAQAQAQAQAVDQ

SEQ ID NO: 31299 - protein, 240 aa, A.fumigatus
KAWCHSRIGDPPPPLPEQEGRGPGLVREVLGQGAAGQRQSCSSWASSCPLGRSRYPSYPQLQVLPVLVRKLAQALVVIQRPAQVLARAQRLAQVRVPKEVQEPLLAQALLLVVESRCPFQVSEGLSFLMPSRVFSAPLTTNLPNCRKEGHRAIQRLSFQVQAPAPAQVQVRPQARAQARVRVQVQVQVQIQEWVRARAQVQPPSPFYCSSLSWEHPSLPRHHRVPFALVQVPVAVSGAFF

SEQ ID NO: 31300 - protein, 258 aa, A.fumigatus
  UNSURE (72): Identity of amino acid sequences at the above locations are unknown.
PVEGSETPADGTPAEENTEKKEEAEKKDDKPAKPSGPTPAYVSPAEYSSRSLPPTLPQSLDSSVPIPFPHLXGFLNTPIRLYRYLSRRHIADEIGREVAGLVLASSSRPYHDGSFSSDSELSGAMVDAGASTLSSPDDMMPSSSAKYEQQTVLEKEESEWHKSVHKRDEENPDKEREWIDDIVLDPRIASRMQRSLLSADEEARSQRITEGKEYILGEERPAPVSFWQRMWIKYGYGEDEETIRMKPIIGNLDGADGE

SEQ ID NO: 31301 - protein, 572 aa, A.fumigatus
GYVQSRSAMLQARPGFRQNWTALAIAHHLAGDLEEAEKVLTTYEETLKQQPPISDMEHSEAVLYKNMIMAEAGKVQQALDHLETIGYRITDVLAVMEMKADYLLRLDRKAEAEAAYTALLERNPENSIYYDGLIRAKGISESDHAALKAFYDAWADKHPRGDAPRRIPLDFLEGEEFKQAADAYLQRMLKKGVPSLFANIKSLYTNPSKRDTVQELVESYVSGNGTAESNGSAEGAATKDSTEFLASTYYFLAQHYNYHLSRNLSKAMECVDKAIELAPKAVEYQMTKARIWKHYGNLQKAAEEMEKARLLDEKDRYINSKAAKYQLRNNDNEKALDNMSKFTRNETVGGALGDLHEMQCVWYLTEDGESYLRQKKLGLALKRFHGVNNIFDVWQEDQFDFHSFSLRKGMIRAYVDMVRWEDRLREHPFYTRMALSAIKAYILLHDEPDLAHGPLPSGLNGSGDQDDAERKKALKKAKKEQQRLEKIEAEKREARKAAAATAKGADGETKKEDPDPLGNKLVQTQDPLKDATKFLTPLLEHSPKNIEAQCLGFEVYLRQSKYNSLGMPLEIG

SEQ ID NO: 31302 - protein, 101 aa, A.fumigatus
VQFTWDAFGNWLKPLIEKYALALKCLAAAHQIDASNPTLHVQLLRFRKALDSLSEPLAPEVAEVVNTEFEKLLPKSQNLEEWNNSFLSAHKESPLCNTSPV

SEQ ID NO: 31303 - protein, 72 aa, A.fumigatus
GDQCRTIAIKAVAKANGLDLDIRETPRTPDHLSISKLGKVPAFQGADGFKLFECMAIALYSELRYPVGVIEN

SEQ ID NO: 31304 - protein, 105 aa, A.fumigatus
  UNSURE (20),(23),(44): Identity of amino acid sequences at the above locations are unknown.
QPSSVTSQNEQTTLSRKDKXEYXEIIKWMSFFNTEIVILMTPTXTAQLGVNPYDREQVEVFRTMTHDSSIVSRSIAGPTFLGGDSSPLWNCLGRKHLLGFQSSTA

SEQ ID NO: 31305 - protein, 221 aa, A.fumigatus
SDWSWRLPSLLQAICTVVIIAGIWWMPESPRWLMNKGRHEEALEILVKYHAEGDHNDEFVQLEYSEIKAAIALDKEIGHTGWVDFLRSKGNRKRIALITALGLFSQWSGNGLISYYLKYVMDSVGIKDAQTQLGINAGMKTEGLVVNFIFAFFIDILGRRPVYLTSTIGTFVVFNAWTIVSARYEIAPNKALGYAFVFLTFLYGVFYDIKSVSSCHALHFC

SEQ ID NO: 31306 - protein, 126 aa, A.fumigatus
RMDRSGLMANYTTEILPYGLRAKGFTWLNFCVTAALFFNQYINAIALDALAWKYYIVYCVFLGFEVFVIYSFLIETRYTPMEEIAKYFDGEDAVDVGQIAAADLKEQGIIASDDKGTATIHIEKNE

SEQ ID NO: 31307 - protein, 210 aa, A.fumigatus
  UNSURE (34),(42),(71),(78): Identity of amino acid sequences at the above locations are unknown.
KHHGRGRKHMAPSFSSAVVHVFSSMGDDHDSFVXTLLQLQQXTPAQLFHAVKSYRPEVGEKVLTKQAMKFXLDFQRDXDLLAREQLRLQGAAEQGTADEPGPKDGRPETPKQDRPSNAPAPVTPEASTHSMASPGSASASPRPGQPSRPDERNGTNSVFLDPSLTLPFSLPTSTDMLISYGAGWGGTNRERARKYIPTVPPEVLTRFDRD

SEQ ID NO: 31308 - protein, 78 aa, A.fumigatus
PKGKKATKKCPTGKSLDCQTGNSSFLPLFFFSFISFSSISRPSSIISNILPLPFTLFVPFSLSFFVFPLMTQVFACCV

SEQ ID NO: 31309 - protein, 77 aa, A.fumigatus
RRSITAKHLQYLLSLREKETPDLNDNGKEAVSQIQQKVRAENLSKDGDRILQWRKNPTEIALGDNDRGTDQASGCTT

SEQ ID NO: 31310 - protein, 128 aa, A.fumigatus
TQVDSSKLDSFKMEYHGDGNGSGHPSQSQESAYPDIDETLQYPWQGSQPAVAGESSLHSVIDPRLYKDLFSRSASGQQAMEYGDEEDAQEYSQLDGSAEDSTYEFSAEESSTSVCSSEITLPLITDVF

SEQ ID NO: 31311 - protein, 310 aa, A.fumigatus
SLMFSREEEPSDVEENAADEGDDDSVGRRRRRRRGTGPFSGRWGARGGKGIKRGPRKPLEPSAEFKMLHSDATSAFIDGDYETAIDLVKRAIHINPEMFAAHSLLSEIFLAQGQKDKALTALFSGAHTRPRDASVWFKVAQMILDRAGDDRPAALNDVIYCLSRVIDIEPKNYNARFQRAAVYRELGHNGRAVTEYERILKEVPHHPRALRNLAEAYIDLNEVTKAVDQWTESVEYYKSFEPEDAPDFSWSDANIYAELFSYLGRYEEGLKALKSVSRWLLGRRDDTMWENFNEDDRAWEFSPDGARSAR

SEQ ID NO: 31312 - protein, 303 aa, A.fumigatus
GWTGAAPSSPVVKTGPLHNPHFIQKILDMLPDVDRDIYHTVERIEGMLTTALEEDLNLDTISSSTPTGTLAAEKELTEVSTSREYSAIIPRLDPALRDPFPFYFTLSSLAKVLHTSTISADAFRGALRSLGYRSTRSHAKPNTIRTDAPWDVIWEIMREWVRQKAPVKEGAIRPGTPGAAIMAKSRENSRKDKGEDSLNILREELMSAAESGKDISDLVTKVEAAIYRFSHRYPPRIQGAELRQQTEGPQSPQTAPAVKQNLNTLEVVFDEALGREASHSKKRLVRYQINPRANWGPLNRASG

SEQ ID NO: 31313 - protein, 430 aa, A.fumigatus
TTARENPGKFPSPLLDIKYRRRQLDLRRKQIKEWQESELLYLQEEIEAMKAQGLASSDLSDYMQERARHIEREAVRQEKDAQFSLGNNFWKQDSRIAPLRGALATWGLTIDDIGVASFHGTSTVANDKNESDVICQQMKHLGRKKGNAVLGIFQKYLTGHPKGAAGAWMFNGCLQVLDSGLVPGNRNADNVDKVMEKFDYIVYPSRSIQTDGIKAFSVTSFGFGQKGAQVIGIHPKYLYATLDRSQFEAYKAKVESRQKKAYRFFHNGLINNSIFVAKNKAPYEDNIQSNVFLNPDYRVAVDKKTSELKFPPLPPKASDKDAESTRQVVESLAKAHAEDNSRIGVDVENIDAVNIENETFIERNFTASEQEYCRKASSPQSSFAGRWSAKEAVFKSLGVCSKGAGAPLKDIEILSDTSGAPVVNVSLLPF

SEQ ID NO: 31314 - protein, 105 aa, A.fumigatus
TETLHIVLTMQIFVKTLTGKTITLEVESSDTIDNVKSKIQDKEGIPPDQQRLIFAGKQLEDGRTLSDYNIQKESTLHLVLRLRGGMQICKLLCLLPNFATLVATF

SEQ ID NO: 31315 - protein, 251 aa, A.fumigatus
VTLPSAQFCHPGGHILGSPADSLITVVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTPSDYNIQKESTLHLVLRLRGGC

SEQ ID NO: 31316 - protein, 107 aa, A.fumigatus
LTDLHATTKTENQVQSRFLLDVIIGKSAAILELLASENQALLVRRDTLLILNLRLDIVNSVAGLDLQGDGLARESLDENLHGEDDVKSFSLFVERMMTEYSAVGGSY

SEQ ID NO: 31317 - protein, 140 aa, A.fumigatus
KQTFSHLASTTQTQHQVERALLLNIVIGGGPPIFQLLTSEDETLLVRRDALLVLDLALHVVNRVGGLHLQGNGLSGESLDEDLHATTQTEDQMQCGFLLDIVIRQGTAIFKLLSSKDETLLIRRDTLLILDLALDIVDGV

SEQ ID NO: 31318 - protein, 230 aa, A.fumigatus
APFPQRVVITRSGFPKFYSNGLYFELATTTEGFIDKWLWKLFRRFLTYVFLKFSERSICLTWHRFPMPTICLLNGHAFAGGLMLAMYHDYRIQNPTKGFLCINELEFGVPLQSPMMSIFREKLSPSAFRDLILEARRFAGPQSVAVGLVDGVGGLEETLQLIRERGLQTKAATGIYGTMKEEMYRHTLDILDNHAGNLAWREQVEEKKGTREEAALRAVEAFEKQRNAKL

SEQ ID NO: 31319 - protein, 116 aa, A.fumigatus
SPTHFSASIVRLLLTSFIQAPHPPRMMILSAFILLLTLVTALAPAYDFIIVGGGVSGLVVANRLSEDPNVSVLIIEAGPSVLDNENVTDVDAYSRAFGTEIDWQFISESQLFGGEP

SEQ ID NO: 31320 - protein, 237 aa, A.fumigatus
  UNSURE (212): Identity of amino acid sequences at the above locations are unknown.
ILRAGRALGGGSAINGESSPSGYGYEYAEELRLRLGMAYVRAEDVQLDAWQSIGNERWNWTSLFPYYLKSENLTLPTAVQTDAGATYDAFAHGSRGPLKVAFPRMQSGDNDLTPAVNQTLQAAGIPWNVDVNAGRMRGFSIYPWTIDEEAYIRYDAARAYFWPFQSRSNLHAWLNTRVNRIVWRDVPGGENTRASGVDVTSQHGTVSVVMSXREVILSAGALKSPAILELSGIGNPR

SEQ ID NO: 31321 - protein, 282 aa, A.fumigatus
  UNSURE (202),(221): Identity of amino acid sequences at the above locations are unknown.
VASRSYIRDKRAGAEALKLPYSILNQHNIPVHVSLPGVGENLQDQMNTLMTASTHSPITGGRTVTFASATDIFSQDISSLANLTHTKLPSYAALVANMSNGAMQPEHLRAVFQVQHDLIFKNNIPIAEIIFKPGGEKTVNAGFWGLLPFARGNVHIRSSDPAAQPAISPNYGLLDWDIQLQVAIAKFIRRMFRSAPLEGMIXEESRPGLSAVPGDAADEVXGNWLEDNCPWGKFLFFPRDVSNSIAANASNFPAIGPHGPDAPSSRVESSTIGCRCSGRPNF

SEQ ID NO: 31322 - protein, 129 aa, A.fumigatus
LKASHFSASQTPPQLSTQPLLASLSSPPPAPSTQGYPHGYPRCPAYAGTSPPSSCHRSPSPPWSAIRAPESIAASPQARLRRPPIPQQQTVDPRTVSPQELDPGRQTGTISPGRCSSWGSAGAPRTRAR

SEQ ID NO: 31323 - protein, 383 aa, A.fumigatus
HLSCCQPLLVSAFGVEYWSLIRSSVVTPLLLETNSPLRTVTRFVSESSLWCPSRHPIVFRIYCLSFASLGCCVPLQLLQHFQTGLLEDTRYSGKPKSRISVSLVAAQLPLLSSLSPFLIPSICQCWFNPCLSAKLLRTVCSYPFFLVLTSLPSQFDPDFQTPLILDESLDFSDPEESRFAGAFSDGLLAKSEPFLSMSTFQKPPSAALLGKFVPSFFLEHCCSFGKCRQTDRLTLSDYDSARSLHNGASYSTYGQTPYVTATSLVPSPMADQASQISDCGPYLPNQEYASSYEESRSPMLGAESRQLPEVVSYNPQRGSEGTRVFVQIQCPHDLHSSPYATLYLAFGSKKCECLPHFLGLQGSSFQNALSVDTPAFLATGIPV

SEQ ID NO: 31324 - protein, 204 aa, A.fumigatus
PPDQWPEDPQALHALDHPWRHLPEPPWCKSVCPCSYRRKLIPRQLAPLCQYSAQDGHMTDYHIAHLGGIAQRGPGLMLIEATAVQPEGRITPQDVGLWKDSQIAPMRRVIDFVHSQGQKIGVQLAHAGRKATTVAPWISFSAIATEKVGGWPDRVKGPGDIPFAEPFAKPKAMTLDEIEQFKKDWVAATKRAIAAGADFVEIHN

SEQ ID NO: 31325 - protein, 91 aa, A.fumigatus
RSPHRGVSYQPINNHPQSPTTKMTVADIDVPPAEGIPYFTPAQNPPAGTAANPQTNGQKIPKLFTPLTIRGVTFQNRLGVSPFALAHIDES

SEQ ID NO: 31326 - protein, 85 aa, A.fumigatus
LFGYIRYAIGFSDLEVVMKRLVDEGKYADMTIACLGREIQRPRVVKELTNPKSWRVMHFSRWTKVRILLPYVNYKVKSLCTLQKS

SEQ ID NO: 31327 - protein, 95 aa, A.fumigatus
EWFETHCIWVIEWPDHLPNLNLIKHLWNLSKKKPLQLYPELFLGGRSKIDWTCFCNAIIEAWEAKPIPQVINGLIYSMPHRLRADSQARAWSTNY

SEQ ID NO: 31328 - protein, 85 aa, A.fumigatus
YTRIIIINYCMTLQMEAPTRVNLNNGRRSTTAVRLHYIEDDKKRNQAGTTAIQSQNIEQIVAFSIKILIYRRLSEPEPNIVIESG

SEQ ID NO: 31329 - protein, 84 aa, A.fumigatus
VETHSLHGPFQPRGEDAQLLMTQDPFIISGSKVLEGMGTYLVTSVGPHSTYGRIMVSLGTESAPTPLQVKLGKLANWIGWFGLG

SEQ ID NO: 31330 - protein, 160 aa, A.fumigatus
VSITTHTEVGTYRTGDNIHTALSIAISCGIKTEDGIAMEGPDLRQLTEAQLKTIIPRLQVLARSSPSDKQLLVEHLKQLGETVAVTGDGTNDGPALKAADVGFSMGLSGTEVAREASSIILLDDNFRSIVTAIAWGRCVNDAVAKFLQVCCVCFSRRPCG

SEQ ID NO: 31331 - protein, 345 aa, A.fumigatus
CLTEGLPLAVTLALAFATARMLKENNLVRQLRACETMGNATVICSDKTGTLTQNRMTVVAGFLSPSESFGQLPLETASQPQHDDISGVTQRYPAALKALLVKSLVVNSTAFEELRENETVLVGNNTEIALLRFAQTALDVRDVSTERERTDIEQVYPFDSARKAMAVVYRLGTGHRLLVKGAAEVVLGACTESTLPGLSDKTSLARAQMSCEDRRTIHDQIDIFSRASLRTIAIAYRELPAWNSEQAGDNAKVSPDFDALFNNLTWIGAFGIHDPLRPEVPEAIRTCHTAGVQVKMVTGECPLPHTRRSELTAQVTTSTRRYPSPSPAGSRRRTASQWKDPTFGS

SEQ ID NO: 31332 - protein, 157 aa, A.fumigatus
RQLSIDCHGHRLGPVCQRCCRQVSAGVLRLLLSPSMWLTQPVSNHGQHHCRLFDCRDGHLQQLQRKCLQGGPVAMAESNNGHLCRSGLVRPPDCKPPWHESTNIPRGPRATDPPTADILQRPPRPRSAPLFTVTMWKLMLGQSICLHTGLEGSAVAQ

SEQ ID NO: 31333 - protein, 165 aa, A.fumigatus
RRVDVVTCAVSSDLRVCGNGHSPVTILTWTPAVWHVRMASGTSGLSGSWMPNAPIQVRLLNKASKSGETFALSPACSEFQAGSSRYAIAIVRNEAREKISIWSWIVRLSSHDICALANDVLSDSPGSVDSVQAPRTTSAAPLTSSRCPVPKRYTTAIAFRAESNG

SEQ ID NO: 31334 - protein, 168 aa, A.fumigatus
DAVSSGSWPNDSLGLRKPATTVILFCVRVPVLSEHITVAFPIVSQARSCRTRLFSLSIRAVANARARVTARGSPSVRHQQSGSRRDGKRVQTRNCNHDHCHRYYENIHKLLSFYSGRRIVIWKLSQEAEEEHEEEEKSRPALAVSYYPARSSLFKGYLPQSKPADPVR

SEQ ID NO: 31335 - protein, 153 aa, A.fumigatus
NWLCQPHGRREKQTQHTCRNLATASLTHRPQAMAVTIDRKLSSRRIIELASRATSVPLRPIENPTSAALRAGPSLVPSPVTATVSPSCLRCSTRSCLSLGEERARTWSRGMIVFNCASVSCRRSGPSIAMPSSVLIPQEMAMDNAVWMLSPVR

SEQ ID NO: 31336 - protein, 75 aa, A.fumigatus
  UNSURE (7),(12),(24),(40),(41),(49),(51),(58),(59),(75): Identity of amino acid sequences at the above locations are unknown.
PDYPKRXEVVQXAPKASSFPKEPXDRVFPYPAELSSCVSXXDPPETFNXNXPSSTQCXXSHHPPSPLMSTPSPRX

SEQ ID NO: 31337 - protein, 271 aa, A.fumigatus
  UNSURE (3): Identity of amino acid sequences at the above locations are unknown.
PEXQCRTASSRRNAPKIPEPYRSQTNNVETVYTLDLISTDPPSRLHATPPPLDRPVEPHRTNATLLTPHGSSLVAYPPGSESLSPSKTGRPRPTATTGTLLEKAVAHLIATDARLEPLIRRHPCPLFSPEGLAEEIDPFRSLVSSIIGQQVSGAAARSIKDKFVALFNKDNEGQDPAKPPRFPTPEEVVQCDLATLRTAGLSQRKAEYIHGLSQKFATGELSARMLLNASDEELVEKLTAVRGLGRWSVEMFACFALKRIDVFSTGDLGVQ

SEQ ID NO: 31338 - protein, 79 aa, A.fumigatus
  UNSURE (27),(43),(44),(52),(54),(62),(79): Identity of amino acid sequences at the above locations are unknown.
QIRATGLANTLCGELTRPDYGIARSTXLLGLGVLMSGEGGWWXXEHCVDEGXLXLNVSGGSXTETQLESSAGYGKTRSX

SEQ ID NO: 31339 - protein, 314 aa, A.fumigatus
YNMVMLTFGRFLSRSYPHSREGPTILSFRQQLIMEGTGLDDDQDRRTNQMTGVHDSPVLQPASMEDMDAFYDTDEYADSSNRSYSPPASPPRLSRNPSFSYQDDWETFPPLDKLTVFDLLDNFSLSQKLEKWQQAINVQREKVRKQREKLKSTSMNAKDRVVGEWKRRVPTADEQLAKYRRRMSDGVKRLEKQWNATATVTLREKVSFIAGVLNIFVSGYLIGAYPEYFYIWFSVQLAYFMPIRYYGYHKKGYHYFLADLCYFVNMLCMLSIWVFPRSKRLFISTFCLTFGNNAVAIAMWRNSMVFHSMDKVVR

SEQ ID NO: 31340 - protein, 268 aa, A.fumigatus
VPLRNFPAKDHSLTCLMRSLFIHIMPPVTLHCLVHLTPAEVLRERFPAVYDIKFSKPGSSNHYSLLSMMLWATVPYMFWQLTYHFFITVRRAEKIAAGRPTSFTWLRKSYAKTWIGKFVISLPESLQSPAFMMIQYIYALLTMIPCPLWFRFRWASGVFLTALFVLSIHNGATYYIDIFGKRFQKELEELKKDVARWQGSPAGTTSSTLPILNNASSAGAGILEDSASVHKDSDKSSLDKIPPLDSSAASTAIDGSNLAAAANTRERK

SEQ ID NO: 31341 - protein, 82 aa, A.fumigatus
AMHDITLDPLLLGNLTGKTAVLTGGAGGIGTAIAKLLLEHGANVVVADLEHTRPIVETMIVDLPGSCKGRVQFVATNIVKWD

SEQ ID NO: 31342 - protein, 196 aa, A.fumigatus
VTALFQSAKERFGSIELVIANAGVMERTPVLDMDQIDEHGNLEESHEFCKVIDINVKGTMNCLRHAIFSMKGNQPCYPDGSRGAVVLVSSISGYFGGTGVSGYITSKHAVTGMLRGSQLVASQDDIRVNAVAPFVTPTAMAGGFSEAWQAKGLPINTTEGVATVVLTLAVNPAEKGSCYIVWRSIWHRDNGALLDP

SEQ ID NO: 31343 - protein, 102 aa, A.fumigatus
KACPSIPAVRTSYWEDSLRGRWVCYCRTDINITFLLYNGDQLDGWAAAEALGDLNQSALARTYRLHGRNDVICELLLENRTTSTVQLKVLRVKRIITMGISR

SEQ ID NO: 31344 - protein, 107 aa, A.fumigatus
AGAPAGHDGSVDATKYGPISPQPPDNSRESRQHLFVGAPAANPKQSEFDCLRLNIYTPRVVISSEEKVPVLVWIHGGGWAIENGNTDFCESIACSLCYRQFSTNGGR

SEQ ID NO: 31345 - protein, 143 aa, A.fumigatus
GTRHFRVPPPLAKDGKVYCGVQMIRFGHQVNGTWVLSARDQQILNGALSVGVFCAAIITGFLSDAYGRKKAMMIGSIICCAGVMVQYYATSILMLFGGKLVATLGFGIGHSVAPVFVSELAPSSLRGICLALIVSTLLLTAFR

SEQ ID NO: 31346 - protein, 390 aa, A.fumigatus
LSSVNNASSMTKPSIRIPLTGPLPPPIIVPPSASTLSGAINAVLSFFTAPPSPYLSGVDVGRHSQAVLLTGAGISVASGLSDYRGEKGTYVTNKFYRPIYFHEFLSRHESRKRYWARSFVGWPGLLKAEPNSTHWAIRDLAAKGFVSSVVTQNVDSFHSIAHPELPTIELHGHLKSVVCTSCRNQFSRAEFQKSLERLNPAWAEFLARMVEAGALDTNNPEEQRRKGFKLNPDGDVDLAEAPYSTFRYPSCPTCLENPPRLKDGTLARVEVEKDGAWLPSSTAGILKPAVVMFGENIDPGVKTAAEEAIDDAGRLLILGSSLATYSAWRLVERAHRRGMPIAIINLGGVRNESVLFETSSDVSSSHVRCSFPSEAILPPVVSLLPKSIYG

SEQ ID NO: 31347 - protein, 122 aa, A.fumigatus
ATACDLPSQDRPRGGWFKQVAIRSPPSMDYRNSYRTAEDSRSEYNNPASFSEIVSTLVSPKSFLFNNQRPKPSTQQTSITTRGNISSQTMDKSQQPSSFQQLEKVCETASITAWKVVKGGRY

SEQ ID NO: 31348 - protein, 126 aa, A.fumigatus
  UNSURE (113),(119),(122): Identity of amino acid sequences at the above locations are unknown.
SQYPQVFKGRNRQTGELVALKEIHLDSEEGTPSTAIREISLMKELKHESIVSLYDVIHTENKLMLVFEYMDKDLKKYMDTRGDRGQLDHATIKSFMHQLLKGIAFCHVYTPGXCQYSRXNPXAPPP

SEQ ID NO: 31349 - protein, 67 aa, A.fumigatus
GRRQVASANLATVETPSVHVLALNAKGGPLMGGEVSPTEADIDGVFLIYNPCHPPVVRVIHEGYHPG

SEQ ID NO: 31350 - protein, 439 aa, A.fumigatus
SSCRTILIGDEEDPAEFFSMIFGGSAFVDLIGEISLMKDLTATMDITMQEMEEEELAEAAEEKLHIHDEGSKAAAATGEASHAAGTAAPGPGPVPAAAAAAEPSEKPASTSGSSTPRRYLGQQAIMDKSEEEARMEAAGLSQEEKELRKKEKKKGLSREQQERLAAYELERKKAREERVNTLATKLVDKLSVWTETDKGPDVTRAFEEKIRLEVENLKMESFGLEILHAIGATYTSKATSFIKSQKFLGISGFFSRLKDKGTLAKETWTTISTAIDAQMTMEEMAKLEEKGGEDWTDEKKAEYEKKVTGKILAAAWRGSKFEIQSVLRDVCDQVLGDKRVKLEKRLERAHALVIAGNIYSKVSSSRSTVTMSQVAKRNYRQSVIPRKKETTWPLSSSWLRPCRRRARTRRKRRRKSRRMSITTTKQPPRRYLVLFISLP

SEQ ID NO: 31351 - protein, 64 aa, A.fumigatus
LQVSMVADTTYYDALGVPPTATELEIKKAYRKLAIVTHPGAITPMPARILAIDSDFFPRQEPWR

SEQ ID NO: 31352 - protein, 74 aa, A.fumigatus
DCACEISSGVYTSIYAVQYIQSFNSSRHDQIGEAYQVLSNEELRKRYDKYGKEESVPGGGFGKLLSCDRAVELY

SEQ ID NO: 31353 - protein, 217 aa, A.fumigatus
PCIVWTVSDLQEFMISTFPPELASCVREAAPILHRCLVRLGSFPYHNDPQRTLLQDVLRTGMIILLRLNGGKLLEQDDGKASLIYPDRLNAAQRTLLFQSMADMQAANTNTPRNAEDDFHLQRALDLITYGNFSRNPLFPTAVTKGPEYPPAEHFPSSNSTLTNGYIPVKDFRPLLRLMLLTQLHVAGIDPDEFTSCLAQVETVNSCLLPRAATVRE

SEQ ID NO: 31354 - protein, 422 aa, A.fumigatus
PNLNQTGPSFHDLTSFNDTFLRFSLDARSMNLHPLHITQSSVGERCASYITAISDTLAQRIISPLLSSKASSSLRTLNLQPDWALAPADPPTAALTVFACAIALVAMSWRFSDLWRRSPYPAAKTTPTHISDGDYTYLTPEDIVDRPSGYAGAEEDEPDTLLLKHRKNTYALHFPAYAINDGALSVGELRRRAAEVTRTPNPARIKLLYKGKLLDDDSVPCRAEGLKQQSEVLCVVSEVQPGESTPSEGSEAEAGAEKADEAPRLDEVQSGGERRKRNRNRNKKKKGKGRIKTADAAADDADGLAPPAEPPRPSSAGGSSSLPAPSPNLKVLRTPLEQANALITYLRTELLPLCEAYVAHPPTDPKARDFEHKKLSETILAQVILKADGIEPDGDEIARNARKALVKEAQAALNRLDQAARE

SEQ ID NO: 31355 - protein, 187 aa, A.fumigatus
ELNYVPSMGQAEFNARTDASAEISAFAVRAEPDSEPVSEKQGTAETAAETGAGGTEVPAERNGEDDVERTPKKSLSFKLAFIGLAASMFVFQVDATAFGIAFPVSNTTLSHRELNCPRTDLAGRPSLRISRARVWSPSGRTCPTPSVASSCNRCGPVSPPRSVGNRLYTYPWRCSSSDPSSLPWPRI

SEQ ID NO: 31356 - protein, 496 aa, A.fumigatus
  UNSURE (492): Identity of amino acid sequences at the above locations are unknown.
TIAADLKGESLESFWANLSYTLCGLVMQPVWASISTAFGRKPPLYVSMALFFIGSIVFAVAQNMNTIIVGRVLQGFGGGGIDVLAEVILADMTTLEERSKYLGLMAIPMAIGNIMGPSVGALFATYASWRWIGWVNLPLLGIGTPLVFFFLKLRPVPLDASLAKNLNRLDWIGMVLVVVGITIFVLPLSWAGSLSPWGAWQTLVPLFLGVAVLVIFAFYEARPDAPIVPHRLFHSKTGNMTLVGGFLHGAVLVSLLQYLPLIYQAVQLETAILSAVSLLPTVIISVVVAAISMMLVPWFGGYVWILRLAWVILTLGTGLLALFDVGSSSSMRLGLPILWGAGVALLRLNLLPMQASVKNVDDTGLAIGQFLTIRMFGGLVGLTISATIFNSVFSTSISATAVHLTGPLAPLKDVANAVAFIDKLRSIDVPVETRDQVLMVYLKCFHTIFYTMTGLIGLGLVTSLCVDDIDLKSQGLGDPPFQGLLRTERMEXTVAH

SEQ ID NO: 31357 - protein, 132 aa, A.fumigatus
QYPDFLSTGRFRILCLTSSDLLDPKGVSAQVLTSLGSSVLPRFPPNVIEQVVIHPRLGKTFMWQDVPNELKKHSEMRFYSGYALDDVYKIYGVDETRGALAVVRPDGYVGMVAGLADLERVQEYLERCIRTI

SEQ ID NO: 31358 - protein, 62 aa, A.fumigatus
PREPQELAKQEEMGCYYHGFLFTFISPVSSSMVAPALPSIASDFHIEEQVSSQLTLSIFVLA

SEQ ID NO: 31359 - protein, 127 aa, A.fumigatus
AGPLLISNGIILHNSHAFRWHLSSFPLTVANSRKLINQQSVLPISTERETAYSLCDCQHLTIREHNSTMSAPKITLYTNHRCPWAHRAHIALKELGLDYEEVIIDLNTPREPWYLEINPVGRLQPWE

SEQ ID NO: 31360 - protein, 89 aa, A.fumigatus
QPQRGLVPAISYNGTIITESAIVAQFLADAHPSHLLPPSNSVEGALQRARIAFFVDTFFSKGRPALSGFSARHKRPGPRCSGGGYRCGH

SEQ ID NO: 31361 - protein, 95 aa, A.fumigatus
KRDASGNELNSLKTLRIACFKMRAIAFLLLFTWLFTASGTILENGQARLNPYPGQAEIITLDKKTWRNYKPSAKEISYKGRWDDKHISCESNRTT

SEQ ID NO: 31362 - protein, 211 aa, A.fumigatus
AMVSRDQPGRPPSALGMIPYSNSHSAASSPPSPTTAPSSPSRPSSPSSSQTRIHPTSFLPPIASKAPCSAPASPSSSIPSSARVAPHFLASQRATSDQDRVAAGEAIVAAIEKELEPILASQKGPGPFFGGREKLTLAEVLIGSFLLRLLSFHKPEHGLLREDLPQLLEKRTPAFTKWANATVEQESVNFIWDEKSVVELTKKKIASLAKK

SEQ ID NO: 31363 - protein, 60 aa, A.fumigatus
LWSFHLTVVVLSVADIPAKSKSPRQSTVKTAMSALIDREFVNVLFRLALSMLTQINFTWF

SEQ ID NO: 31364 - protein, 190 aa, A.fumigatus
TSKMATLKSRNIILLLTSLLSLLHLATSQRTPNENLVLADCGIGLGVNGGSTSREMIYYPGDVWTGNGADTNKPTMMVNVPWSGSYPWGQNGGVSARMPNGDVFTVHINPKIKDPIAAGDAWHMYEMNLPLKCYSYHKDKVYQLDDGKWCSSAYVCNHRGTPTPHVKPSPAPKPGPVPVNTNSAFRGCDL

SEQ ID NO: 31365 - protein, 300 aa, A.fumigatus
ALAMVSLNLPKLALFISFLGTCLAELLTPFPDTASELAIKFQPVLDFDTDSCYQTAAIGKDYKLNSGIDPTLAPPRPPGPGPIVRAATDDEQVIFAANASDSDSDSQIGIRSGGPFAPSGCRDKARLDHSQTYVRERCNRGWCAYLYGYYFEVDSGFSNAHKHDWEHVIVWTLHDQVFFVSWSAHGDYTTHYYSTVRFEGSHPKIVYHLGSSGTHSLRKAEAKDDKIENDTGRWFRAPLVSLEKMPCKFNRLLLNHNWGSAHSDLSRLGEKLDKWMPWDARNNEKFNPWEPKVPLWAVRE

SEQ ID NO: 31366 - protein, 77 aa, A.fumigatus
HFPVPHQLTTLLQTTPTPSNTNTLFFSKHHKSHPRKAEFVFTGTGPGFGAGDGLTCGVGVPRWLHTYALEHHLPSSS

SEQ ID NO: 31367 - protein, 75 aa, A.fumigatus
AATSIPQALPMPYDTNQPGVPREFSSKDLRTVGNYTLGRLIGKGSFGKVYLASHKLTNGSKVLFTPRPTQEAEPF

SEQ ID NO: 31368 - protein, 62 aa, A.fumigatus
  UNSURE (51): Identity of amino acid sequences at the above locations are unknown.
VVLKSSPREDTNLPREIHHHRQFLHPHIARLYEVIVTEKLVWLVLEYCPGXGTLQRDAIGYR

SEQ ID NO: 31369 - protein, 545 aa, A.fumigatus
PPFSSAHQSSPSLFEPFLAALPLPTPSIAFTALAALRPFVSAVTAFNPSYSLYSALAASYTFTLHGNLVGLSFALSTSGINVRKGLLDISAEPGYRAFDVFYYLVTSSSTPAEREFLALKDPSAYTLLNRSGTYSPPSYLPTADDAAAAEDFRAALKAIGIKGASLRGLLSILAGLLKLGNAAGFLVDQEELEDVCEEVGGLLGLDPEVLLHKCSTEDREVLIAGIYEALVDWVIVKANETIANELRANQEGDSGSGSAGQWSDEDTVGITVVDIPRPAFGKAVALRGVFDDTLGINAEMKEDGVQVPPVGHSVLNDLNNSVAQVEPDLGITTGPAWREREYELDKRQEVLEKVGLEVDMDSFLRQLLFPVEAEGITVGKRGRFDLMTTLGSSRVWHHISIHPTDHTPDSLNAASPTAAWSAGTVSRQIREWRLAEWANRRLKQMDFTADFDVEEFVSRYSRLGCREGRDGVESWLMERGWTNGDAFVGHQRIWMRENAWWEAETMLDLKPDETPGANSYMYASGMLDNGVAHVLTTIWVYASKK

SEQ ID NO: 31370 - protein, 92 aa, A.fumigatus
SDFFENFLPLVELIFPFTPGRTSGNSQIWLDLRYGIVQVIEYRVSDGRNLDAILLHLCIDTKGIIKDSSQCHSFTKGRPRDIHDRDTHGVFV

SEQ ID NO: 31371 - protein, 62 aa, A.fumigatus
AERFISVQLILGSTPGYMYSPFHRTHLRRRCYGTISAFSYPSMTAEGRVDNTMTTFGLISVL

SEQ ID NO: 31372 - protein, 244 aa, A.fumigatus
TFFEMLGNWSFGDYFKEDAIRYSWELLTKVYGLDPQRLYVTYFEGHEEGGLEPDLEAKALWRAAGVPEDHILPGNMKDNFWEMGDQGPCGPCSEIHYDRIGGRNAAHLVNQDDPNVLEIWNNVFIQYNRESDRSLRPLPNKHVDTGMGFERLVSVLQDKSSNYDTDVFSPLFNAIKNITGAREYRGRFGADDSDGIDTAYRVVADHVRTLTFAISDGVTPNSDGRGYVVRRSSPRGRKDPRNAN

SEQ ID NO: 31373 - protein, 144 aa, A.fumigatus
VCSSVAFESSSINISAQISIYSLGLKLSSHLEPRLFGTPQICGGGTSSIQSNSFDTTERMMLDDTKHTIYIHDLDSELADSDAQEYSITFLPDIGAKLGTLPKLLTVDTQPQNKELVLYRDPKSLTLPEEDDYVRRAILESRRS

SEQ ID NO: 31374 - protein, 279 aa, A.fumigatus
  UNSURE (8): Identity of amino acid sequences at the above locations are unknown.
SCRRPSVXISNRSIAIDFADDGHYEADDDKRRNEPRSIDFGPRSIGDQETRKKDRKAKKRTSKKHKARKEDNANTLDTDASTQRPCLPSPQPVPGPDGINSSQQAEVAAALPKRRSPFRPAIPSLLSNTVFSNTAASNNLAPGEPGLRRTRSLPSHMNRPPPVGNAVQFARGAARMPTTLDVTANNAPPEHKEPEISRTAAVVMLLVSTALVAVCAEFLVDAIPEMIESSSVSEAFIGLIILPIVGNAAEHVTAVSVATKNKMDLSIGVSVGSSIQIGE

SEQ ID NO: 31375 - protein, 103 aa, A.fumigatus
ISLSELALTTTYYYTYIASSMSYYGERDTYYGGPPQPTYGRPPYDRPPYEQQQQQQPPYNRPPYDIPPQDSPSYNRPPYERTPYERPPPERSPSSFDPSRPRY

SEQ ID NO: 31376 - protein, 100 aa, A.fumigatus
  UNSURE (32): Identity of amino acid sequences at the above locations are unknown.
RVPCCQNADTVQAAVTSGKPPLPIAQEYCLRXDGVLPMTYNAKWKRLHAFLKQLLNAKASAAFILSQEFEIKQLLWDLSHDAGKNSTDFYMHIRRMTFSM

SEQ ID NO: 31377 - protein, 187 aa, A.fumigatus
  UNSURE (181): Identity of amino acid sequences at the above locations are unknown.
YVAAHYSPIKSAPYFSYWNRCRVKYSEPDMDSFKAIDLPLPPHFVAALGRPTVLVGFACVFLFSQLLVWTAKYSRKKSKGLADIPGPSGWPIIGIGLDLPARPRKLLNSWANQFGDTFKVRVGWYNWVFFNHPDAVKEVFDRQVIQPPTSESLAVRMLIQYRRLSRPVNHRSPSPKNTVFXAMVCCR

SEQ ID NO: 31378 - protein, 365 aa, A.fumigatus
RPRTGFASLSGTARKVRDVYGNMRMLSIILSPGVFWIDVFPPLNWLPRFLFPSWPKAKFMAQRMHANKMRHWNNLKERIALGNAPDCFAKDLMESNYRDYGLEEETVSWLASAVPEAGAETTASALNGMIRYLAMFPEAQARAHEEVTRILGDGRMATLADEPQMPYIKAVIKETLRLCPVATTGLRRMADGDVKYRDYVIPKGTILLANLNALHWDPERFPDPFSFKPERYLNHPHRSAVYAAGGDIMARDHFTFGAGRRICPGIHLAENGLFLAVSNLIWAYEFKLPLDEKGNEIPLDISDEGFMEGAIRVPKQYTVRILERNPARSRLIRESWEQAQKDGYILRGVHVDADGGVRGSAKVKV

SEQ ID NO: 31379 - protein, 78 aa, A.fumigatus
RNTNSCFLGIPRQGVMPYASMSNLLWKWKRQSSFSPYWIRSFLSLSTITACCLDNHALAVDGEAYMTKWLNWHDQEGR

SEQ ID NO: 31380 - protein, 334 aa, A.fumigatus
KDEFPGQQRTVHLPTSPKSTTSNEALLSDSSPLQLEKSNILLLGPSGVGKTLMAKTLARVLSVPFSISDCTPFTQAGYIGEDAEVSVHRLLGVAKYDVEQAERGIIVLDEVDKIAAAKVSHGKDVSGEGVQQALLKIIEGTTVQVQAKQERNAHRTSGTPSSYPSNNPFGNSPFSQSPTGNAPQKGEIYNVRTDNILFIFSGAFVGLHKVIMDRISHGSMGFGQPVRSQSSPTHRPGDPLATTPNQPVPILPGSEEEALYKKHLPFFTAASPTSPDGEPPYFNALDLLNPTDLQNYGFIPELIGRIPVTAALSTLSQPLLVRILTEPRNSLLAQ

SEQ ID NO: 31381 - protein, 225 aa, A.fumigatus
IFWCLVMLRLPIRAHGLKCASRAHHSSLLRYRHVAICQTCWANRGFTSTAKSFPTYSEFNRSDFTNQPWSSIYEAGLPTAGPLGSTPAFGAPRITPKTLKQYLDQFVVGQDRAKKILSVAVFNHYQRVQELQRREEEKAELLARQARREALEHHPAEGKPYVPWNSSQSTLNIEKTSFQDSNAPFIYPLVPSRRRPMKHFLAIRLHFNWRNPTSSYWDHRGWARH

SEQ ID NO: 31382 - protein, 63 aa, A.fumigatus
LNISILTTIILLGLNYIRIRAIINIFFSSLKAFIYSSPYIKGALFYINTIKGHAIFKKFYINY

SEQ ID NO: 31383 - protein, 150 aa, A.fumigatus
KSWPIVKSFVGAVRQNEGAQLPIGAAGFCWGGKHTVNLAHGFEVDGKPLINAGFTRHPSLLNIPGEIEKITIPVSFALGDLDVIVKKPQIEQIKKIMEGGEKVGEVKVYYGASHGFCVRADRLLKDAEQQATEAEDQALDWFNRHFANVQ

SEQ ID NO: 31384 - protein, 308 aa, A.fumigatus
KISPVRFLIIAFQVPQISASQDMATQLLRLTNLPVGQSHEHKGDKRPLKAAPVKIRSLTFRYPSRLDAPALRNVTLAIAENSCTAIVGGSGSGKSTIASLILSLYETPLSMCKTPTISIGGLDIRRLHTPSLRSLISIVSQQPTVFPGTIHHNICYGLRDESPLRELHNVRTAAQAAGIDDFIVSLPDGYSTIIGDGGVGLSGGQAQRLAIARALVRRPQVLILDEATSNLDPESAKVIRQTVQRLVSARLGLTVIIITHAREMMEIADNIVVLQQGSIVEQGPYEVLARRRGGKLKALIEDSEGVDS

SEQ ID NO: 31385 - protein, 205 aa, A.fumigatus
FPEIAAPSGPCGEEIDGTASYFMHYLLEASGQAWVDQLRKEAFRRVSDQPRQWFDEESNSPSRITACLDQNGEDMRNLVGRFGGYVLVAVAITMTAVIWCLVVCWKLTLVALSCGPVIYAITRGFEGTSGLWQGRCNEVARNASDVFVETFSEIRTVRTLTLEPFFHKKYLMAASKCMKICLKRAACTGILFGLVESTIIFVSGE

SEQ ID NO: 31386 - protein, 61 aa, A.fumigatus
RESTYTHSRTISNGPYMSYSNKKYTTQAKYDPCRGLTGYSVAHSTIAPVSFLGSRFPGPEW

SEQ ID NO: 31387 - protein, 85 aa, A.fumigatus
TGHVAKEDEIEQNLDLLSGAASRLNGLARATGRELDEQNRHLERIMGKVSVPACFSSACGLTDLLQSDFVDDQIAMNRAKLDRIH

SEQ ID NO: 31388 - protein, 66 aa, A.fumigatus
AHLYSTHISICLISTRAAYSGTALAFRDRLIIEWNKTQQRQSFADQKRVYCRCYCLDVPIYLVKFC

SEQ ID NO: 31389 - protein, 593 aa, A.fumigatus
FRKKEGLKDLGFRIEDVINQEHDAALGNGGLGRLAACFLDSMATLNYPAWGYGLRYRYGIFKQEIVDGYQVEIPDYWLDFNPWEFPRHDITVDIQFYGWVRTYQDENGKTIHSWQDGEAVQAVAYDVPIPGYGTRTTNNLRLWSSKAASGEFDFQKFNAGDYESAVADQQRAETISAVLYPNDNLERGKELRLKQQYFWCAASLYDIVRRFKKTKRAWSKFPEQVAIQLNDTHPTLAIVELQRILIDQEGLEWDEAWTIVTKTFGYTNHTVLPEALEKWSVPLMQNLLPRHLQIIYDINLFFLQSVEKRFPSDREMLSRVSIIEESHPKMVRMAHIAIIGSHKVNGVAELHSDLIKTTIFKDFVKIYGPDKFTNVTNGITPRRWLHQANPRLSDLIASKLGGYDFLKDLTLLDQLEAYVDDKAFRAEWSEIKTANKLRLAKHIKDTTGYSVNPNALFDVQVKRIHEYKRQQLNIFGVIHRYLIIKAMSREEKEKLVPRVSIFGGKAAPGYWMAKTIIHLINRVAAVVNNDADVGDLLKVIFIEDYNVSKAEIICPASDISEHISTAGTEASGNSNMKFVLNGGLIIGTCDGAN

SEQ ID NO: 31390 - protein, 205 aa, A.fumigatus
DSLCTLLVRDCTLVVTGIELLEIELPTGCLARPQSEVVRRASPISWDRDIVGHSLNSFTVLPGVDGLAVLILVRSYPTVELDINSDIVSREFPGVEIKPVVRNLNLIAIHNLLFEDTVSVPQSVAPGWIVQCRHTIKEARGQTPQASVSQSGIMLLVDDVLNSKTKVLQTLFFPKSATTFEFDGPARRRPTSGSILHPNIKHRIV

SEQ ID NO: 31391 - protein, 68 aa, A.fumigatus
RNAPVNLNHHFRVYSQNVYGGFGKGLYEGSWATGPEKNVFGNVSLGSLVAGTSRKLKHVCYILPIGSA

SEQ ID NO: 31392 - protein, 157 aa, A.fumigatus
  UNSURE (20): Identity of amino acid sequences at the above locations are unknown.
SMYVISCLLALLKTDDMKIXVYTLTEGNTLQEFAYDSGTGWYNGGLGGAKFQVAPYSRIAAVFLAGTDALQLRIYAQKPDNTIQEYMWNGASNHKSLDVLSNLHLRRWLEGGHQPGRCSPRHWNRSHLLPLYRLQWPKHPVRHCHIHILNTGTLTNI

SEQ ID NO: 31393 - protein, 84 aa, A.fumigatus
PEQMHCSCESMHRSQITQSRSICGTVRRIISLLMCFLTCILGDGWKEGTNLGGALPGTGIGATSFRYTDYNGPSIRYGTAIYTS

SEQ ID NO: 31394 - protein, 150 aa, A.fumigatus
IRERLLIFDIHRIWFQTDDLKLVQRAYDPHKGWYPDLVTIFDRAPPRTAIAATSFGAGNSSIYMRIYFVNSDNTIWQVCWDHGKGYHDKGTITPVIQGSEVAIISWGSFANNGPDLRLYFQNGTYISAVSEWVWNRAHGSQLGNSALPPA

SEQ ID NO: 31395 - protein, 207 aa, A.fumigatus
NMTSKAAAFHDEGDMAKPTGLDAIHMVRIPLTEEDSKRICRKTDRVILAILVWVYFLQILDKSVLGYGATFGLQADTHLTGNQYSLVGSIAPIAQLAWQPFSSFLIVKVPHRILMPSLVLGWGIAQTCMAACHSFGGLMATRFFLGLFEAGCLPLFSIITSQWYRRAEQPIRVAAWYSTNGLATIVAAALSYGLAHIKSDLLKEWQM

SEQ ID NO: 31396 - protein, 76 aa, A.fumigatus
CWNSTANQTSIFLFVGLITVISAPIVYWKLDNDIASARFLTEQEKLQAMERLRANQTGAGSREFKLSHVVEAGLEP

SEQ ID NO: 31397 - protein, 77 aa, A.fumigatus
LAWLIACIASIISDIKTDYPNYSWWAVAYMFCCIMGVTIVFGSDTGLVYGVAVCFTPFVVGFSALMGNRLWAIFQQA

SEQ ID NO: 31398 - protein, 177 aa, A.fumigatus
ANLKQVVWIFYFGSSPQATHRGFIDSFALNKESSGAYGNRPMSTAYGPRPDTMSTSAPQMYTSAQLNGFETSSPVSGYPGGGPGSENRSSSQARFGNPSASNVAGNNSGQDEVPPPTEYPYKAKAIYSYDANPEDANEISFSKHEILEVSDVSGRWWQARKSNGETGIAPSNYLILL

SEQ ID NO: 31399 - protein, 71 aa, A.fumigatus
YLALLLIIKQLSRPQTVKRLWQYIREHNLQDPNDRRHIRCDDAMRAVFKQDRIHMFTMTKILNQNLYSPDE

SEQ ID NO: 31400 - protein, 170 aa, A.fumigatus
RALLSQAAIKQLIMKRFDIFAEQSGIGGSSDAAASSTAPTSNGQLQNHDSVTPAEPSPPAPSSSPQKRQAESDDQSDPPRKTPPAKKKKPDHDIDADALYAAKLQAEENMRARPTRGASARRSAPVKKKAKAKTSKKVKAEDDSDLDSGSETKKEVNRSGGFHVSFQHFL

SEQ ID NO: 31401 - protein, 76 aa, A.fumigatus
LACDDFPILTCLKRRTHANVPETPAGVLENVRNKLRGLLPGESVPLSVDGHVDELITQATDKRNLTAMYIGWCAFF

SEQ ID NO: 31402 - protein, 137 aa, A.fumigatus
RRDPRLSVPSASCLFHVMSSRSPQGRSPRRSMHEMDLEGRSRRSMSPRGGPRSVSRSPSAQYDNGRRNKHRSRSWSRSPSRSRTSSLSRSRSPSRDSRWYRNRSYSRTPSPSSGPPRSSKVCSYSTYLFHLHLSKSY

SEQ ID NO: 31403 - protein, 72 aa, A.fumigatus
LSGQKASEFIANILEHPSGGLWNICMGATLETRQYRKIIAGELLTFFPNEICGWIMQESLQHVFTTGWKIRV

SEQ ID NO: 31404 - protein, 82 aa, A.fumigatus
VKLTIMLCRRHFLQAGLPVSFYSFRLICGDVWLTAADGFSALFWLYLNKGRFFSTPMKTALTILNVVIMGVACCIVSPCWTF

SEQ ID NO: 31405 - protein, 165 aa, A.fumigatus
LIKSSHGCRDSIAGYSLPPSGCSRLRPCPVSQSIPSADNSNEPRAIILLVALGLMSTYTGYTIGQFKWAYPHIHSMGDAGEVIMGRFGRELFGTGQLLLVVFIMASHILTFTVAMNSITDHGTCSIVFGVVGLVISFVLCLPRTLAKVSFLSVACACFSDDVECH

SEQ ID NO: 31406 - protein, 151 aa, A.fumigatus
HLAAFISVFSAVLIVMIAVGVQRPWHGGLNATVDTNLYKAFLAVCNIVFSFCRLFLHFSSFMDRTNKTAGHVAFFGFMAELRNPRDYPKSLFLLQGIDTCLYIIAAVVIYCYAGDDVTSPALGSASTIVKKVAYGIALPTVSLWSSSQEAI

SEQ ID NO: 31407 - protein, 143 aa, A.fumigatus
PEHPGGQKIILKYAGKDATEEFDPIHPRDTLDKYLDRSKHLGEVDMATVEQEEKAHDPDETERQERIKQMPPLQACYNLMDFETVARSVMKKTAWAYYSSGADDEIVRGLTCWKPDKSVSLTSSRLCARTTMPSTRFGSVHEY

SEQ ID NO: 31408 - protein, 93 aa, A.fumigatus
ALNVGLVRISKRSSIVAFNPHKNRSIVPGSFSRLFSFVPDSFPFNRQKIVVTMKQGKLTGAEVAKHSSKDSCWVIVHGKAYDVTEFLPGTVSV

SEQ ID NO: 31409 - protein, 359 aa, A.fumigatus
TMRENHYAFHKIWFRPRVLVNVENVDFSTTMLGTKVSVPFYVTATALGKLGNPEGEVVLTRAAYKHNVIQMIPTLASCSFDEIVDAKQGDQVQWLQLYVNKDRNITKRIVQHAEARGCKGLFITVDAPQLGRREKDMRSKFSDVGASVQASGGDEVDRSQGAARAISSFIDPSLSWKDIPWFQSITKMPIILKGVQCVEDVLRAVEMGVDGVVLSNHGGRQLEFARSAIEVLAEVMPALRERGWENKIEVYIDGGVRRATDILKALCLGAKGVGIGRPFLFAMSAYGQPGVERAMQLLKDEMEMNMRLIGVSKIEELNPSLIDVRGLTGGHHAPVPSDTLTLGAYDPLHAPRFSEKSKL

SEQ ID NO: 31410 - protein, 193 aa, A.fumigatus
LQLGFLAEPRSVQRIVCTKSQCVGRHRSMVAAGKTADVNQARVQLLDLADTNQAHIHLHFILEELHGAFHAGLAIRGHGKEEGPSDTDTLGTEAQSFEDIGGATDTTVDVDLNLVLPAALAERRHNLGQDFDGRAGELELATTVVGEDDTIHAHLHGTQDILHALYSLEDDGHLGNGLEPWDILPGKRRIDER

SEQ ID NO: 31411 - protein, 279 aa, A.fumigatus
PAVEGLQRMHHPHKVVIWGNHDRCFDIRSRRDEDRDASSSSFVAISSSTASIRSLDDDPDGLNRINWGDIHYLQHSSITLSFPPPSPAHAAARPRSLTIYGAPQVPAIVPFTSEHAFTYHPQHDAWSGTIPPDTDILITHTPPQAHLDLSPVYSTGCPFLLAETWRVRPALHVFGHVHEAYGCEPVYWDEAQRAWERLCASRRPRARYGRLMSVFGLLRDLFDVHGWLDAMRVVTYGVLGVVWAKVWGGENRGCGWMVNAACMYRNTGRLGNKPQVVVL

SEQ ID NO: 31412 - protein, 90 aa, A.fumigatus
TSILFSQPRSRSAGITSARTSMAERANSSWRPPWLERTTPSTPISTARRTSSTHCTPLRMMGILVMDWNHGISFQEREGSMNDEIARAAP

SEQ ID NO: 31413 - protein, 312 aa, A.fumigatus
  UNSURE (306): Identity of amino acid sequences at the above locations are unknown.
DPAELDQITTLPNGIRVATESLPGPFAGVGVYVDAGSRYEDESLRGVSHIMDRLAFKSTKSRTSDEMLETLESLGGNIQCASSRESLMYQSASFNSAVPATLGLLAETIRDPLITDEEVLQQLATAEYEINEIWAKPELILPELVHMAAYKDNTLGNPLLCPRERLEEINKAVVERYREVFFKPERMVVAFAGVPHEEAVKLTEQYFGDMKAANQAKGPVLSGTGIETTLSDSETAAQEGQVPTVPQFTPSSTITTTPTSKTQSVLSRLPFLKNLSTTASKPASVAPLDPSLVQPSSLDLTRPSQXTRRDGS

SEQ ID NO: 31414 - protein, 126 aa, A.fumigatus
RASLELIIGVISNYNYAISVALTTGNILAEYIYILCYVFDSCAKDNYLKKPCLIVADKHQRRLLYRTSYPRHLPYNIYLRIEGAYRTAAITQRLKLGLLLGTYLSLLHPTFLNLNYIGKTYITNNI

SEQ ID NO: 31415 - protein, 68 aa, A.fumigatus
DIYTTEINKELLITSTLKRAKVLILTGLASLGKYYFPTLEIYDLVNTMSTLLHINFTKLLETWGPGSE

SEQ ID NO: 31416 - protein, 63 aa, A.fumigatus
TKASRYASFAHFDGLMLTVVYQEVNIQNMNVELVAQMFKNYQSNVLFHLEGRVVLPLRRLQPC

SEQ ID NO: 31417 - protein, 336 aa, A.fumigatus
TTLDEVSKCLFQKECALTPVVMNEILFECYSAPSVAYGIDSLFSYRFNKGTDGLIISSSHTSTHVIPVLNSKALLSNCSRLNWGGMHASEYMLKLMKLKYPTFPARMTESQMEDLVHKHCYVSTDYDRELSSYLEWTGLEDRDHIIQYPFTEHVVPEKTEEELARIAERKKESGRRLQEQAAKMRLEKLMKKEQELEYWKDLQRGLASETKKEARRILDSEDLKDEAHLDRLIRDLERSIKRSRNRDLGVEETEEPPEDMSFPLLDVPDEELDEAGLKEKRHQRLMKSNIEARQRAKAEKERERARKEEEERLDREKRENDFENWVAERRAARQVC

SEQ ID NO: 31418 - protein, 188 aa, A.fumigatus
  UNSURE (186): Identity of amino acid sequences at the above locations are unknown.
NILQRIKERDRMKADLGNRKSLASQMRMKTLANLAADGPKKRRRGGDDDDFGANDEDWGVYRTVATGEQSDEEEEEDLGEMLTNIENELLQYDPEFTENHTLAAQSDWTKSLVHVFLRGPWPFDPESQREAHQIHLNVERIRVPEVVFKPSIAGIDQAGLLEIAAGIVNQRFVFTTGLQGAVDFNXTP

SEQ ID NO: 31419 - protein, 212 aa, A.fumigatus
RSSFSMLVSISPRSSSSSSSLCSPVATVRYTPQSSSLAPKSSSSPPLLRFFGPSAARFARVFIRIWLASDFRLPRSAFILSRSLILCKIFYEQLVILPNSSKNQHTCRAALRSATQFSKSFSRFSRSSRSSSSFRALSRSFSALARWRASMFDFMSRWWRFSFKPASSSSSSGTSSSGKDISSGGSSVSSTPRSRFLERLMDRSRSRISRSR

SEQ ID NO: 31420 - protein, 75 aa, A.fumigatus
LGGALAPRSQPVLADEVQTFKALITIHKVLQEGHPIVVREAQQHVNWIDSLMRGVGGDGIRGMRQKWLGCRGALG

SEQ ID NO: 31421 - protein, 377 aa, A.fumigatus
MLTLLSHIATGDNEALEPLRGRYDAQHYRLVRFYYECSNLRYLTSLITVPKLPQDPPSLLAEDEDRPALPKRPTKEVEKQPSPPPKPVAAEPEPINDFWTNEAKRQQEEFEAEQRRLQQQWEEQQRQQLLAQQQAQREFEEQQRLQAEQQRLAQEQLLREQYQTQTQGRLAELERENLNARAQYERDQLMLQQYDRRVKDLEEQMAQLTTNLNMQNASKDEQIRALQEQVNTWRSKYEALAKLYSQLRQEHLDLLQTTKSLKLKAASAQEAIEKREKLERELKTKNLELADMIRERDRALHDRDRLTGTNKEELEKLKRELRLAIERAENAERSKGTEISTLLSKYNREMADLEEALRVSLLTWKFSLTSLLTLLPE

SEQ ID NO: 31422 - protein, 92 aa, A.fumigatus
LCPSRPTVMTSADHCSRYETITDLMTLQDHIDTFQKLIFSHFQSGTNNECRISALVPLVQESYGIYKFITSMLRAMHTSKHPLVRSRMLFEC

SEQ ID NO: 31423 - protein, 134 aa, A.fumigatus
LAPAKRESVRLSKRFACSSSWSAAPSAPPNPSRGDHIAAASAGHARTAPGHSGFPVQAQPIDPESGSDTAHAGVVPEPVAAALPADAAVPQTHVAPAAAQEVADAAVLPTVAEGVAALLQTPPVDASPRWSRSR

SEQ ID NO: 31424 - protein, 88 aa, A.fumigatus
RHMHKSAECSPAAKPFLPHTSDPIPSNAPHQAVNPIDMLLRFSHHNRVTFLQNFMYRNQGLERLNFVGKHRLTTRSQSATKSVIISTT

SEQ ID NO: 31425 - protein, 73 aa, A.fumigatus
ITLDSLKKWDGGHLEEKDIDWATPAHLADRRMVFVARELLKAALAIAQDPFAESPYMEKAIEEGLAIEGGRFL

SEQ ID NO: 31426 - protein, 153 aa, A.fumigatus
LLPLQRASIILRFCRKEKAMSIGKDDDYVVSYRGEVVENRHKVHASVVDATGKQHFHVGDPSRITLARSAAKPAQALAILETGAFEQFDLDDADLALMCASHSSEERHITRARNMLAKAQVKEDDLRCGGHPALSATVNIELSLHPGAGRNRV

SEQ ID NO: 31427 - protein, 105 aa, A.fumigatus
LTYFTYLVLGTVAHTFRLADGYWIWRPALLQRKTNCWSYCSLPIIIISSFFCFPCPPLSLFVYRSLRQSTSTRPPTAASSTSECNLSLLLTTITITHSSARVKYF

SEQ ID NO: 31428 - protein, 151 aa, A.fumigatus
SRQVTGKANRPDTTPPTVPVRKPEFLPSRETSKLRATWLGHACYYVEFPDGLRVLFDPVFEDRCSPFSWLGPKRYTEVPCQIKDIPFIDAVVISHNHYEHLSHPTVKEIAKLHPNCHFFAPLGNKEWFSSSGIKYMTEMDCWEECDVVLSP

SEQ ID NO: 31429 - protein, 62 aa, A.fumigatus
VLLFRRVLHTPRLRGKINTAQPPPYSHATNPLRMMGSVSFAKERVGSEIAGLVTDMQVFASD

SEQ ID NO: 31430 - protein, 131 aa, A.fumigatus
LGIVLRDIGYRAVPELPDGVDDHAPEYDYLSCPAFKQVGEFRGPFDLGLIPIGAYAPRFIMSPMHADPHDAVEIFRDTKCKRATAMHWGTWVLTEEDVLEPAKKLKEALKKHSIPEEGVFDVCDIGESREY

SEQ ID NO: 31431 - protein, 89 aa, A.fumigatus
LGEIGQAGNILAETGAAEPESGFEELSSNARIQTDSLSYLVDLSSCFLANSTDRVDAADSLGEHGVGYKLCEFGRPCVDLEDARRGHPR

SEQ ID NO: 31432 - protein, 199 aa, A.fumigatus
RTSALWALDTSVCLCYSVSVVQSLIVTGGPTAAVMALHNPSISVEVLDRDPVRIRQWNSPHLPVHEPGLIDVVRVTRDGAEIVNQETTSLVSATRLKRRANLFFTSDSVTSISRADVIMLAVNTPTKTFGLGAGRATNMSAIDEAVRQIAIYAKPGAIIVEKSTVPCGTAQRIRHLVRTIDLMCLLFIDRKVTIYSWPL

SEQ ID NO: 31433 - protein, 401 aa, A.fumigatus
LATLRPGVPFEVLSNPEFLSEGSAIENLISPDRVLIGSSGTPSGRHAARTLAQIYSSWVPSSRILEVNTWSSELAKLVANAMLAQRISSINSISAICEKTGAEVDQVAQAIGLDARIGAQFLKAGLGFGGSCFRKDIASLTYLAESLGLEDVAHYWSQVNVMNEMQRDRFARKVIERFDGNLTGRKIAMLGFAFKKNTGDTRESLAADVIRLLLEEKPMEIAIFDPYCLEKDIMREVERACGTLDGRIVKVFPDPYQACSQADAVLIISDCDQFRNMPTRSKPNPFASQTEAKAANTLSKAIISKDPEEDIWSCNSLSYRLSPQKPCDDCEVCRLTVNYPTATEPVEWARIAYNMKAPKLVIDGRGILDVHEMEKLGVHVDAVGRRPPVISTGIDPLNCDI

SEQ ID NO: 31434 - protein, 136 aa, A.fumigatus
HSTIEQIKRLQQNGNVEHEFFIFWLPRRTFVSNKILEDAGIIGDVNIFEFPLYFVPLEQDVLSLELDDSFGDLYLVRTRNIVSLQPICLSSRSIKIQVVSSSPQRLSWIFSKDMVIFLESLGREITRADSQTFCCG

SEQ ID NO: 31435 - protein, 311 aa, A.fumigatus
SLLGKNQKYCLTATHLLIITQHKDPGCIFLAAKALMDIQQRHGYFPRIIGKGDHARRLADLLLRMRKELDAEESSGLRGPSARGLLPSASTESLIIIDRMVDFGTPLLTQLTYEGLIDEFVGIKNNQADVDTAIVGANSVPQAQESSKAPQQTLKQGQKRKIQLDSSDQLFSQVRDANFAIVGDILNKVARRLESEYETRHAAKTASELREFVNKLPAYQLEHQSLRVHTNLAQEIMRNTRSDIFRKVLEVQQNNAAGTDPTYQHDTIEELIARDVPLKTVLRLLCLESCMSGGLRSRDLENFKKQIVHAY

SEQ ID NO: 31436 - protein, 159 aa, A.fumigatus
HQHILTFSALEKMELLQPRSSDATMLIQTAGAQPGSKTNYNYLRKNLRVLVEEVSEKDPNDIAYVYSGFAPLSISLVLCVLQKPYIFSLVKGGAASATSTPASTASPGWLGFEDVVKSARGATFSIVQKGDDKAVRARQTLSGNNATKIVYVFFLGGAC

SEQ ID NO: 31437 - protein, 272 aa, A.fumigatus
  UNSURE (201): Identity of amino acid sequences at the above locations are unknown.
MIYWYINLQTPTATSLTIRYLVLSTNNDEMPSIKNSTIVIFGGSSGIGYGVADKCLSEGAVVHISSSNPTRITQAVSSLKEKYPEGQVTGHTCDLSLPDVEQGLVKLFEEIASCDHIVYTAGDALAVRPLKDLDLQFIQKAGHIRFDVPLLVAKLALRVLKPGYTSSLILTGGAVGDRPQPDWAVVAGYAAGLYGMVRGLXLDMKPLRVNFVSPGPVKTGLFTDELAEMFAKKTTLGKVGSVKEAAEAYVYLMKDTNATGICVSTNAGSLLV

SEQ ID NO: 31438 - protein, 143 aa, A.fumigatus
RDFGPDKYHLIPPHGRWQHFEVGGVSRPESLLKQWKSDGANPLEQTRGLLDLFFVSVLLDAGAGDRWRFTEPDTDIVVGRSEGTALASYNMFVNGDFSTVDSERRDVVMGSSHTLPSDKSRTKYQQGKPSRTLTLQLCNAVSR

SEQ ID NO: 31439 - protein, 69 aa, A.fumigatus
  UNSURE (45),(47),(53),(56),(58): Identity of amino acid sequences at the above locations are unknown.
TRIEKRALPITGKGFPEASYRKIAVYTLMQGLFHHSSRIPRSGSXPXVRGLAXTAXKXYPSNGKTPKLL

SEQ ID NO: 31440 - protein, 62 aa, A.fumigatus
PANHPRSETLQFAPQPATDFHVRFPKDYLDGNGPNSIGFEYALCHERTYGFRSSSRHTSGPY

SEQ ID NO: 31441 - protein, 96 aa, A.fumigatus
SLLARERTSVPRGVYMATLSGCFSCRTFRDRQLLLHKGADINSSGSEYDNAVYAASARGHQETVQLLVENGAEVNGQGEKYDNAFQAASDRPSREC

SEQ ID NO: 31442 - protein, 446 aa, A.fumigatus
TLSADPSSPVGEEHHHLPFLHQESFKPTMASPPLLLAVLSIGALYTFEREHAFMLHVGSKMLVNQFLQHKENFDSRKCPLWSMQSTLLNMIFESWSGDPKGLEWTCSIKSLLANMVAGNRYQLKVRTEAREGRQPTRDEWIEDESCRRTYYAVYIFFGMLTLTFNHTPAMSFDEFDNLELPSSESMWNLDVNDDEAWRRSLSSASTLTVREAHDCLFQGERTRYSAFATRVLINALFLQVWNHKRTFEALQDVVTEYKLRLALETWESSLEVCEPETIVVPLSTPQNGHPLIFNSMAVYRNTRARLEVDLKSIQEALRYHSSYEVAAAMTVAREKVKRSGEMNKVIQSCFECIEIAAVQGINWVAKTSATNWSVEHPLCGLDLMVILSLWLYRLEHDEEPATEAELAIYNKVRNLFDDDAVDAFGKLSSTVARVWGNILDGVVVWG

SEQ ID NO: 31443 - protein, 74 aa, A.fumigatus
VSLYPSRIARLKKQMERKGRASLHYAAEDGHWEAVKLLSKHDCVSVQARDNSSRRDMDLALDNDFYDVFKALQD

SEQ ID NO: 31444 - protein, 82 aa, A.fumigatus
NLPSSGLVSGVNMFFFHGSRSKPSTTTSPCGSPMALSFLFIIFFEIQPLFTRIVLSPSPLSSGVTTMKPSWPSRMRGPINIS

SEQ ID NO: 31445 - protein, 106 aa, A.fumigatus
ATIPGSQKREDIKTVMFYSGGLQEGISLAVTERKAVVCFVRGLSVIPRTITYDATITQSRMLIDGESVDDEENSNIWEEEYFKDDEVNPSMMAIAVVWLLTPMPST

SEQ ID NO: 31446 - protein, 235 aa, A.fumigatus
PPCADCTHGTQAWAWPNNSRYSAPHTARDVSGSIFVNKSLLTNYNWPDAALIPVTAFILGTWQVQRLDWKTKLIAKFEDRLLKPPLPLPPRIDPTAISEFDYRRVYATGHFRHDQEMLIGPRMREGQEGFIVVTPLERGEGESTILVNRGWISKKMMNKKDRAIGLPQGEVVVEGLLREPWKKNMFTPETKPEEGKFYFPDVHQMAELTGSQPIWIEQTMGKQIPSRASRRSRHD

SEQ ID NO: 31447 - protein, 490 aa, A.fumigatus
IYLALEMLLNVPLRTLGTCLSRAPSIPLRSIRNASLTSAIGRGIRKTRSVEGRNEPQKSSTGDSDQSRGGRHFGRSDSRRDVGIKAFDEEEFIKTGRLRELRSEQGADLPEPKRPRIQTHERAKTIKEHRKERDLQDRSRLKRGEIRFTEGEPEQQKKHVLVPDSVPYTTPASEFIYGTSAVDAALRSGRRQLYKLYIYQGDNEELGPTRSMLRKLALSKNIKVKMAYAGWDRLFDQMSSGRPHNGCILDASPLPQLPVKSFCATQTLGADEFRVVLAPQSKEEAMVNSTNNRVPVRHLPGQSRYPVVLLLDGITDTGNLGGIIRSAYYLGIDAIVFAGRNCAPLSPITIKASAGAAENMPLIKVSNEVDFIQQSKANGWRFFAADAPLPGTRYPDTTGDIDLTRNAVTQAPSVIMLGSEGSGLSGHIKSHADSIVSIPGARNATEWGYEKDPARVDSLNVSVAAAILMEQFLRIPILITEAPPRKAVNK

SEQ ID NO: 31448 - protein, 74 aa, A.fumigatus
LNSMARIRRTLNGKDLNLRFNEHPSQGLSKHLNKSNPSRRMRCLVKCDLLQLKYLRSPTQKSMNFFLAISGSAM

SEQ ID NO: 31449 - protein, 140 aa, A.fumigatus
VTFSHLQTLENGPEALLHFQSTDYRSSSPTTSHITLHSSDKEDVESETRGRRSRRTKNATFTDFFGPLSSDDEPMGDASSDDIISSSAITARTRPLKRDVRNQVPRRSRQQSSSENEFPDPRCNRFSNSAAGRPCGGILP

SEQ ID NO: 31450 - protein, 188 aa, A.fumigatus
TLLQALKFIPNHRVLPEGFPTSFLEYLSPRSTLAPPHPSPLAANLFNVDGVTSVFYGPDFITVNKSSDANWAHIKPEVFSLITQAVTSGEAIVNTVEKTGEHAQESGEQESLSFSEDDDQVVNMIQELPGTDKSCLPIPERPWLIFETPGAFQETGLWLNFKSSPWVRFPATLPNSKLPGELLKKWAF

SEQ ID NO: 31451 - protein, 169 aa, A.fumigatus
  UNSURE (154): Identity of amino acid sequences at the above locations are unknown.
PAVHSCSLACTQSHKIYCAPKPQGPEPKSATDTTQTTPNVHGEQEVTESSNALANRNAYSVEALASSPQVKDLLAQSPQLRDCLRDIYKITLEEEWIEQGPPGRSRPYHRGRGGYRNRGSWTREKGFNRGLGKLRKLRERCEGGSETGKHAEAXMNFMALVNGENQHQQ

SEQ ID NO: 31452 - protein, 337 aa, A.fumigatus
WECICAVQTLLDAPGQYDPRGTAPLYHHSFHGGELQKSRSSELHSSIPQCCCRGPTSAGKTSMIEYLAKVSGNKFVRINNHEHTDLQEYLGSYVSGDDGTLRYQEGVLVEALRNGYWIVLDELNLAPSDVLEALNRLLDDNRELFIPETQEVVHPHPNFMLFATQNPAGLYGGRKVLSRAFRNRFLELHFDDIPESELEFILKERSQIAPSFCTRIVSVYRKLSLLRQANRLFEQKNSFATLRDLFRWALRRADDREQLAVNGFMLLAERVRNPQERAAVKAVIEEVMKVPIDEDTIYSAAELEKRAPNLKELAPGIVWTKAMRRLFVLVSVALENN

SEQ ID NO: 31453 - protein, 192 aa, A.fumigatus
PVLLVGETGCGKTQLCQAVAEICRKQLFIVNAHVNLETGDLIGAQRPVRNRAAIETQLLNDLRTVVNTGDAEPISLDELTSTFSAMTVEQLEACDTEIVQRIQKNIARLNALFKWSDGSLITAMKTGQFFLLDEITLADDSVLERLNNVLEPHSSILLAEKGPNDSMVVAHQGFHSLLTLNPGRRLPKAPSF

SEQ ID NO: 31454 - protein, 307 aa, A.fumigatus
YVYADPSGLRGEEVTPSSLSPSSRGKIVRALRNGEWVLLDEVNLASPDTLENIASLLHHGSEGSPSVLLSEAGDVERVFGHPDFRIFGAMNPATDAGKKDLPPGLRSRFTEIYVQSPDTDLDDLLALIQKYLGDLAIGDSRVVSDLAQLYMETKKLNNENKLTDGAGQRPHFSIRTLVRALIYVLENAHIYGLRRAVFEGYCMSFLTVLSQESERLLLPLLERYVFGNAKNARALLGQTPRPPNDGNAYVQFKHYWMRQGSMIPEAQPHYIITPFMEENFKNLVRASSTRRFPSAVAGVPHQRVKQA

SEQ ID NO: 31455 - protein, 60 aa, A.fumigatus
KLGHLIEEVREGLHVRDVGIKAETVENGNVKTKAAEADIYDFAVVHILAFRLSKVFMSDL

SEQ ID NO: 31456 - protein, 347 aa, A.fumigatus
  UNSURE (5),(17),(18): Identity of amino acid sequences at the above locations are unknown.
ERPPXIYMRTARLLEKXXWPRPFWMKISELLLKSTGRKYSWQSCRRRMQQYVEKRKTYWAAFDADKTLPDLGDMDEDLASDIDDWMGRCELRLQNEEKERRDKAQKTELEQAELARALKLQRTFEWAKNLPPPEEMERQPTHWGMPPHRFVTMNGRLLQGLDLAFHLSKVRPDESRQLALDAVLLHGQFGYPAHDQKPKPDPSGPCLGIFNPGNRKRPFDAIDGAASERPARQPRMDLDPHTQSQSQPQPPTQAQPASGDKPSEKRETPAAMLARKNVDRIVNHLWLQFAKGIAPYYEEHRDQPQTNKQFGLVLYDLYRDLGRAFTKAVNRLVDLEWDSECESASQY

SEQ ID NO: 31457 - protein, 198 aa, A.fumigatus
  UNSURE (1),(38),(39),(110): Identity of amino acid sequences at the above locations are unknown.
XCLNHFVETYDPTIEDSYRKQVVIDQQSCMLEVLDTAXXEEYTSLRDQWIRDGEGSCLSTASHHALRSLAYKSSTPGTRLAKSQPNSGRHSEPAIWESPMNRAFGSALPXPVMLVGNKSRQTRGTSVLNARKAKPWQKELGLQILQGLPPEMDSSLEKPFYKVVRNVRKKGKKGRGGDKPKNFYPMGLGPFAQREPGP

SEQ ID NO: 31458 - protein, 453 aa, A.fumigatus
  UNSURE (100): Identity of amino acid sequences at the above locations are unknown.
LPPVQRGTFQPRGVKTNIPTAQASASSATAASIAVSHSAAACASKAITKTRVQTVMSQATKPSSLLNGPKVFERSKPQYAEYAASSFVSVKSAGAKGDGXTDDTAAIQKVLNSVTEDQIVYFDHGAYIITDTIKVPKNIKITGEVWPLLMAHGEKFADEKNPIPLLQIGQPGEKGSVEITDLAIQTKGPAPGAILMEWNVAEASQGSVGMWDVHFRIGGSAGTELQSDKCSKTPKMTTTPNPQCIGAFMLLHLTEQASAYIENAWFWTADHELDLADHNQINIYNGRGVLIESNGPVWLYGTASEHHQLYNYQVANAQNVFMALIQTETPYYQSNPDALTPFTPQTTWNDPTFSHCTTASCRKAWGLRVMNTSDLFVYGAGLYSFFENYGQTCLDTESCQENMVEVDCSNVHLYGLSTKASVNMITSSNGAGIVPQDENESNFCSTIALFEQS

SEQ ID NO: 31459 - protein, 153 aa, A.fumigatus
FLKTAVSLIFIAFSIRDWLEGSDAGTGLFSSHLSSRSSSPFARNSPSSCIGGPSATRSPRSESSGKTTATTSSSTASVSSPPSAAVNCAGGSTPWALLSFRCLSASSGCIPPTMSSSCSSVSPPIPRCSSSSLISVCFFHCLDREVKNEREAN

SEQ ID NO: 31460 - protein, 90 aa, A.fumigatus
KMRERLIDLPAMTHSPYITAIDTVRAYTSGPRLLVEVDIVMDPEESLRATHDVAEELQMKLESLPDVERAYVHVDYETTHKPEHFLKKEL

SEQ ID NO: 31461 - protein, 151 aa, A.fumigatus
  UNSURE (9): Identity of amino acid sequences at the above locations are unknown.
TSRQHWVMXPQDRRIFNLHRLFHPRLVGGFRRRDGSFFLPSVIAVVVAFCTKFTFFLYWWALRNQVSQIRILWEDHRNDLFINGFGILTSVGGSKLRWWIDPMGAIILSVLISVLWLHTAYHEFQLLIGVTADTKMQQLITYICMFLPLSG

SEQ ID NO: 31462 - protein, 146 aa, A.fumigatus
DCPHDTSSESHVSPAFVKVFGETLTLVRKLFQSTKPSAQPFVISGSGTLGWDVVASYLIEKGENALVLHTGYFADSFAACLETYGAHATQLKAPIGDRPSFEQIEQALKEKPYKIITITHVVPPPRAERLKRVPKIVAGLPQTPVG

SEQ ID NO: 31463 - protein, 275 aa, A.fumigatus
ARSSRNGLCWVSSVILFASLFCRDKVLPSPFYRRIPHGFYEHQMRAYFSQFGDITRLRLSRNRITGRSKHYAFVEFASSTVAKIVAETMDNYLMYGHILKCKYVPSDQLHPEVWKGANRRFKRTPWNRIEKKRLEKGKTREQWSERIEREQKRRLAKAEKLKALGYEYELPQLKSVDEVPVQEETKAIEAADTTADEPKKAIEAPSAQESKEETTVDEIPKKLKKEKKASQSTPKQGTPKQDGEKASTKKGVNGAAASPATKAGTKDKKAKKVKA

SEQ ID NO: 31464 - protein, 209 aa, A.fumigatus
LTSVERASFQPRGEDSILKKNKKDGPATEQNSTSKVKVNGEPARQVKPRKRAADFLSDDESEPEVVASEPKADTEEKKQPSKKKSKKEDGTPAPATKAKTSATAAKPKATKAKKPEPVVEESDDEDNQQVPVVSDDSSEDEEDDTLDDQTAALIKGFESSGDEDESGDEGFDPDQPVPKIPDSKKAKRKILKKQKKHDEPEVPGTVYVG

SEQ ID NO: 31465 - protein, 465 aa, A.fumigatus
RRTPRGVMESERDPGNPGNPAVNPSETKVLLSGVVPPPLLTGTQHRDRYGFRKKTNYITLEQYEAWNGPYSEFVASRRVKWAELLKENGLPTSEPTVFPAKSSKMKRFVRKGIPSEFRGAAWFWYAGGFDLLKRNPGLYDRLVKEAMDSPNNDDKEHIERDLHRTFPDNVHFKPEFVDEAMTSGTSSGSSNPKYSSVTVETQMIQSLRRVLYAFSLYNPRVGYTQSLNFITGMLLLFLPEEKAFWMLHIVTSVYLPGTHEISLEGANIDLWILMVLLKETLPHIYNKIAGNPGRSKTPALTVDSRLPDITLGLTNWLMSLFIGSLPLETTLRVWDVFFFEGSKTFFRVSLAIFKACEKDILAVSDPMEVFQVVQTVPKKLLDANALLEDCFVRRHRVGQGRIEELRASRRAAVRQEKLRRSLAISKGQLQAATDEWPTTRSRTPIPGLERKVADSWRQMRQHAFR

SEQ ID NO: 31466 - protein, 94 aa, A.fumigatus
QSTARIAGPRGRRTAMLPMQNIWQRNETWTKYLYFLLNERQNIAIRILPIISQKQNGQISIFRLQPTRISAFKELRPLDLIMRPPRGRCTRRKA

SEQ ID NO: 31467 - protein, 60 aa, A.fumigatus
RPRLEQCHCMLADFDLRFGCEFPKDGDEGVEKRSRRYDANFFAEYRVKIVDEVLAKLMFG

SEQ ID NO: 31468 - protein, 427 aa, A.fumigatus
  UNSURE (396),(402): Identity of amino acid sequences at the above locations are unknown.
ACTLLKRTSLMASQRIASALAEIESSTNPQTKLQQYNNLLSEITSTSSEHELGQDLIYYLDSVLSEEISIVAARPLLDSFIAVLRKLTPETQIKVGQHAVTLLQSRSSSVEEQDSQIREILADAYESQEEYAAAARALQGIHIDSSQRLVSDAAKVRLWIRIVRLYLEEDDTTSAEGFLNKIKNLPSKIEDHELKLHFKLSQARILDARRRFLDASQEYFNVSLAGGVDESDRLQALAAAIRCAVLAPAGPQRSRILATLYKDDRATSVEEFGILEKMFLDRLLDPAEIAAFSERLAPHQLARTADGTTVLDKAVVEHNLVAASKLYENITTDALGAILGLKESGDMTAGEKAEAYAARMVEQGRLNGSIDQIAGMIYFDSSEGGSATATGRHIRXWDAGVXGLSENVERVAASIKDAFPVCAHSVW

SEQ ID NO: 31469 - protein, 122 aa, A.fumigatus
PPARPLALLSCAGRFWLKTTSRPRNILGVIGYWFLTKNSHLPLIVHVLDYEYGKTALLAAKNVAGENAMTTTSEEASDFIQTANAVNKMVTVYQSKPLASWLRGHRGRTFRWSLLCDLDKHF

SEQ ID NO: 31470 - protein, 62 aa, A.fumigatus
SDNFSTHHTGFILLPSALFHYGIAGGGQGKPDNRFITGKRVLARIACGKFAVIASVKQTCLT

SEQ ID NO: 31471 - protein, 245 aa, A.fumigatus
ENRRATPNIRHDDRTTISRSQLITTSIVRPVKMLFLSHVVFGLSLLTAVAYGTLYIFFTTVTDVFASRYGIITNVGLIYLGCGCGQFAGLPILGLVSDAIVRRAARGGEMKPEYRLPPTILGGSMIPIGLLIYGWTAEYRVFWFVPVLGTFLIGFGMITVFTPVGTYLVDAFPMYAASATAANTVFRSVGGAFLPLAGPRMYSSLGQGWGNTLLAGISLLMMGMIFMSLKYGERLRTHPKYQIKL

SEQ ID NO: 31472 - protein, 378 aa, A.fumigatus
PAFQMARNPTMDPNGTLSRPLDESLYRELPQLQSLRIAPLRQPVSSRLLSAPSPLEPNATGISEPNASSKPNTPGANQPANLPTLTEFLNAAQSKKNGRAVDTLLSLEPPPKTILPAFVNLRALERFPYSSFDDDSLARKRRRLDVQTDSFGEHLQLPIPQAQKEHRPPPFGPFAILNGLNEPPPNAALLPPIEPGSITQLLTKPSRDVAVVESVTLTATTTAAAQTAERREGRIKDILDSPIDDKTASADQDPVEANHSVNGATVDRPGGDSDKSESDKTPPRADDVEPLSPKTRGRSRKNVRKWTEEETTALLRGVVKCGIGNWTAILAQPELKFNKRSASNLKDRYDLRAVPEKPRTNIGFHVVRFRVCCPWAYR

SEQ ID NO: 31473 - protein, 275 aa, A.fumigatus
  UNSURE (261): Identity of amino acid sequences at the above locations are unknown.
VLILTLFGCSSLTFYSAADPNEATKQLHDTLANALLRAETEGSDGTAGKILLPQPRPTNSESHTSNGGSMANVNESASASSSSEADTKISKSPSKYGPSFKATPTLSNRSKSTLASLGIPEPHFAMKSRRRSRRPFTVAEDEALLKGYAVHGFQWTLIQQDKRLNLSHRKATDLRDRFRTKFPHAYRDGGSVNGRSLHIQSQGVDLADTEKAPPIKPNTQPTRQSTSSARSGRTEWAESVSLGTIESGLSPPAPPQGLLEXATNAPQEITSTFPG

SEQ ID NO: 31474 - protein, 117 aa, A.fumigatus
LTDTCVKNGGSHFLAEIASREFMDNLVSLLTTEGAPLNTDVKEKMLELIQDWAMAAQGRMDLNYLGETYRKLQNEGFRFPPKNEISGSMLESSAVCLRPSHGADLLLKLTFKIPAET

SEQ ID NO: 31475 - protein, 237 aa, A.fumigatus
  UNSURE (206): Identity of amino acid sequences at the above locations are unknown.
PPEWIDSDVCMRCRTPFSFMNRKHHCRNCGNVFDAQCSSKTLPLPHLGILQPVRVDDGCYVKLTSKSSLPSNLSDRSAFKNHSITKANAMEPRGARAEGGFDDDLRRALQLSLEKAQSKGSSGYVPSTRINDEPAKTTTQTNHEEEEDADLKAAIEASLRDMEEHKKKHAAALKSNAAATDSSTRDSAAATPLPKNPYELSPVEVXNIHLFAALVDRLQHQPPGTILREPQIQELYE

SEQ ID NO: 31476 - protein, 236 aa, A.fumigatus
PALLCSTPDSVQHRPELTDGNQLPNLIIGDLDSIRPSVRSHYEGLGVSVIKDPDQYSTDFTKCLKYLRAHAAEIITKRVISTQSRSARLEILIMGGLGGRVDQALSQIHHLYMMTREVAGESAAGDLYLISEESITFLLQSGRHTIRTPRTNRPGVCPEQGEDEYYLLEENVGIIPLSGPARITTRGFQWDVEDWLTEIGGQLSTSNHIRADEVMVETGVPVLFTLELAERFKRMR

SEQ ID NO: 31477 - protein, 151 aa, A.fumigatus
KGLLPHPFSAPLSCWAQPSITLRFAFKGTHPLHVGGWGLLGPRSPCGCLRATLLPWFFAYFFNISCKASGSSVLKTRKAPKTRPEFDPLSFNIAKAVIAYVVYAQHFNFMGLYSNFSIERVNVSVPFHWPGMLTTAAIGTVGTLYEAILRK

SEQ ID NO: 31478 - protein, 69 aa, A.fumigatus
CLPCLHAAATRKPLGISPIVGTAIAAFGNQLATTTFITYAVDNYPQDSGSVGVFITFVRQMWGFIVPFW

SEQ ID NO: 31479 - protein, 69 aa, A.fumigatus
FSACLLSAVVIMSNGTAQSAEEALYKPYDQFILFGDSITQMSSDQSMGFGFQPALQDGKIPLSIGHATT

SEQ ID NO: 31480 - protein, 143 aa, A.fumigatus
TIFFGANDAAVPGHYQHVPVETYKENLKKIIQHPATVAQNPRILILTPPPVNEYQLEEFDIAKNTPHPSRTVKQTKLYAEAAREVAASLGVAVVDLWTTFMTAAGWKEGEPLIGSRDAPNNEKLQSFFTDGSIPLFVHMGASC

SEQ ID NO: 31481 - protein, 64 aa, A.fumigatus
  UNSURE (32),(42),(54),(56): Identity of amino acid sequences at the above locations are unknown.
ERYPMAFEWLLRANKEDITPTIVRIDPGYVTXKQSRVRVLSXYNKPVVHPKFRXKXSNLFSKNQ

SEQ ID NO: 31482 - protein, 294 aa, A.fumigatus
CGGSDDPRLYTLIAIRRRGIPPGAILSFVNNLGVTKATAIVQTAKLDQIVRQYLETTVPRLMVVLEPLKVVISNLPDGYEEMVEVPFSKDPAFGSHLVPFTKTVYIERSDFREEDSPDYFRLAPGKTVGLLKVPFPITATAFDKDPQTGAVTCVYAHYEKPEEGSDGPAKKAKTYIHWVGESAAHKSPVKAEVRAFNSLFKSNDPSAHPDGFLADINPDSEEIYEGAYIDIGFHDVSKSAPWPKTSGETGGEVNPYSIRFQGMRTAYFCVDTDSTADNVVLNRIVTLKDTQGKT

SEQ ID NO: 31483 - protein, 150 aa, A.fumigatus
LISPLPNQSTTLSPNQVQAKAKKKKNEPSQTPNSPPYPRRLRHSLPPPPPRPRPIRRGRARLRPPPLNQHHPRPPQNSLPINLQETVADTPKLRPGGGPARPVWRPTAVVGGGYPGEFCAGVDIWGTGRRRRGRRRARCAGVASAGSLCG

SEQ ID NO: 31484 - protein, 290 aa, A.fumigatus
IRISPSAKEVSQHTWCLTESVWPSVIYIFVNGVELYVRRKFHNGKDIPLDISGHLKEGLNTISLHFLRSAAESRDVVYALAVEVMDILSFAQVKKLAQTLPAPQSRERICRRLSSSAADDELSIISDYLAVNLVDPFMARIFNIPARGITCEHVECFDLETYILTRASKAGKAVLKENWRCPICGADARPQHLIIDGFLSEVRAELVRTGCLEGARAIRIKADGSWELKSDGDVTSSERELARVQESSSLKRKREGVVSPLATQRPKTEGAGRESLASRESSASLVIELD

SEQ ID NO: 31485 - protein, 1073 aa, A.fumigatus
RRDLACRLLCVLMLDRFGDYISDNVVAPIRETVGQTLGALLSQLPSRSVISVYKCLYRIIMQTDLGLERPIWEVCHGGMIGLRYLVAVRKDLLIKDSKLMDGVLEAVMKGLGDYDDDVRAVSAATLVPIAEEFVKTRQSTLGTLMTIVWDCLSNLQDDLSASTGSVMDLLAKLCTFQEVLDAMKANAAVNPESSFGKLVPRLYPFLRHTITSVRSAVLRALMTFLQLEGEGTDEWVDGKTVRLIFQNLLVERNEGVLKQSLQVWSELLNSLETRGSFKSESDLLSHIKPLITLSMGPFGVPRYPVPMDASLFIKPSGLPFPSSAAAPARSSPASNTPEGTKGRRRKSEKKEAPPPSAHNVDGHMLQGDIDLVGADTMLRSKIYAARALGQLLFVWDQNQLPSLWQSILEGLNHSASTSQLASAMIVEEYAKLSGPSGRYASTLCENLRPIIEGERPPWYSDIACYLHVARAQCHSLLNTFRDHAHVPGSRLPVLAVIVQGDPEAGPNAFSLSDAEKVIGPDFERLKKGLTPAQRITALQVLNDTRATAESAVNEARNVREQRDLRVRAAAAGALVALSDIPKKPSHIIKGMMDSIKKEENAELQQRSATAITSLVEYYTTSAKRGPVDKVIGNLVKYCCVDTSETPEFHHNAMLEKSILSLRKEEDRRDHPDAAKFEREAKEARIMRRGAKEALEQLAVKFGSELMAKVPNLASLIERPLKEALAADELPANIRDPENELGQEVVDGLSTLRAILPKFHSGLYPWVVDLLPLVVKALQCKLSVIRYAAAKCFATICSVITVEGMTMLVEKVLPMINDALDVHHRQGAVECIYHLIHVMEDGILPYVIFLVVPVLGRMSDSDNEVRLLATTSFATLVKLVPLEAGIPDPPGLSEELLKGRDRERQFMAQMLDVRKVEEFKIPVAIKAELRPYQQEGVNWLAFLNRYNLHGILCDDMGLGKTLQTICIVASDHHMRAEEFARTQKPEVRKLPSLIVCPPSLSGHWQQELKQYAPFLNCVAYVGPPAERSRLQSALPNADIVVTSYDICRNDNEVLNPINWNYCVLDEGHLIKNPK

SEQ ID NO: 31486 - protein, 251 aa, A.fumigatus
RDLYSRPTVRQTHHQRPGLQSSPCNSPRHPTRSLPGLLHSFRHLPLLAIQEYPHNHHDHLPLPHPDRRLSTLAAAPNESLRSPLRLLHRMSTTPFFGCILTKQIASYVTSLVLCLQMPSSNTGGYTKRVTATALVFIAYCLGNIVGPHAFLAREAPVYETGCKLILACALGQMACTVALRVLLSRRNKRRDAEGVAPAEGDADEQILADLTDFEVCVLCCAVLHASGGAVADGGRILAFDMFCRLGQDGLW

SEQ ID NO: 31487 - protein, 139 aa, A.fumigatus
SGTKSERLSLIPKSGSSSFLSCSTRRLTEVWLMYVSLLHSEISTHALQFGKLIIKGLVSSPLLATALGIPQGAFQVFFILSGTYLSSRFKNIRTIIMIIYLFPTLIGVCLLWQLPRTNRYGVLFGYYIVCQQPLFLGAY

SEQ ID NO: 31488 - protein, 92 aa, A.fumigatus
RRQDRRHPRNRPGKEDDIENGHISSLDEAELFLREHGISHSQLQEMLDDPAKSRKIRRRVDLILLPLLCGTYVLQYIDKQVKVSCTSEQTTY

SEQ ID NO: 31489 - protein, 114 aa, A.fumigatus
YSWIFHDISDNLKLGGLISFAIGQLNGFPVWRAVFLICGGVTVLWGGILLLYLPNSILSAKRFTIEEKILLIGRGKQNQTVCHFPQCQCTECSLILPGYSQPLNKVVPNPRGFP

SEQ ID NO: 31490 - protein, 61 aa, A.fumigatus
  UNSURE (21): Identity of amino acid sequences at the above locations are unknown.
GDCYSVPDYNTKHSARISPQXEAFLPLNATFASTSTALMRTSELYSSPDFTRGLSYLIAYR

SEQ ID NO: 31491 - protein, 213 aa, A.fumigatus
  UNSURE (2),(11): Identity of amino acid sequences at the above locations are unknown.
QXQQSTPGLLXASGLLHGPHNLHPQQHHGSGPGHFEDHHRMQMSASTSQIFPSPRLQHGYPSPMAPHAQLAFGQPVPQFYVNQGGPQPAHLRPFPGAPQFVNPQTGMGAPMMVQQPSSGPYMGGPQGMTPYAPQMQMYSPNPGHAYPQHAPPPQPHSGYPSPSRGAPMMMHQNSQPGQLPQPVMFMSPGQHGQPVYAAQQPGHSMFFTVVGPS

SEQ ID NO: 31492 - protein, 444 aa, A.fumigatus
TDFGVAYSRLWGNPSHLDYLTASLRERYGEDRLYILAAKGNSGNFTYDGIELGGERLAHEIEDTLGALDAEGTHIKKLSVIGYSLGGLVARYALGLLHARGWFDKLEPVNFTTFVSPHVGVRMPLKGIRDHIFNGLGARTLSMSGRQMFMVDEFRDTGRPLLSILADPDSIFMKALAKFRNRSVYANIVNDRSTAFFTTALSTTNPFQDLENVNVNYVKGYEPVVIDPDDYFLPPKKQEPPSFFSRLWQNIKGTLTQVAISLLVVVFVPIGVVLYLVNAAVQTYRSHRRIRLHEDGKAGVLISNYRVPVIVKDMQSAVEDAFESATAMQDPAYLSNARTRAGKKESLPQTPAVSKTGALENQTCTLDETSSALPDQKRDATLALTPAQFSIIESLNSVGFRKYPVWIHNHSHSHAAIIVRMAKKGFEEGKVVVKHWLDNEFDIE

SEQ ID NO: 31493 - protein, 60 aa, A.fumigatus
KSLAARSRFSYLGLWVQFVEDFSLKSKFTDVYWAASHTKLHMPHSLGLMNELLECSYCSS

SEQ ID NO: 31494 - protein, 290 aa, A.fumigatus
RHQDTQVNWAFLTPSTARSLNPADVPLLTTLVLGGEAVTHESVEVWAKGRSLINGYGPAEATICGVGNIPEAGWKSGVVGRIIGGLGWVTVPSDPNRLAAVGAVGELLLEGPFLARGYLNLPEVTKAAFIDPPSWRTRIPAPSPYSFLYRTGDLVRYQPDGSIQYVGRKDSRVKLRGQLVDLGAVEASVMRVYPAAGQVVADVLVSENTARLTAMVKLGPSVTENHDGPMFAAPDLVFNEAAASIQARLRAIVPAYMVPSMFISLRDIPGTLTGKNGSASASQTKYFIIT

SEQ ID NO: 31495 - protein, 541 aa, A.fumigatus
  UNSURE (19): Identity of amino acid sequences at the above locations are unknown.
ASRTKKPMFDDNERGFQEXGAELFKLPCEAIGREDSFYSLGGESLATMKMVALARRVGFMFAVTDVMNNTSLSTLARSRHLITEQAILTSSPSLSLPTIEGESLQEILRPLLNAGHIQGGNDIAAIHPVTAAQAFLVQRYPWSHFQFDLSGAVSPSKLQTACTALMARFTILRTVFVEHAGCLLQLVLREVPNRVHEITTNEPLDDFCNSVCQQQQDVCVVNSTTLPTLFTLVSNRQLNRHRLLLRLAHAQYDLTTIPLIVQSLADEYNRTLRSGFSADFGYYLSHHKRQNNDDRSHNFWKRYLSGSSMMSTNQTADPTTVQERVFHVTGSCIIIPTSHPPDITIATAVKAAVCLVLAARTGCKDIVIGQTVDARCSSADSTLDQIVGPCTNYIPYRLSVCCSKTALEYLRSAQAQHTTCLRYSSLDFDQIVAKCTSWPSSTQFGYIVQHQDTGAELALTLGGDTTSLPMTSYGRVFPQGEVWIGSTPCSTGLRIDVIALSAVLSQKDAQTMAEEVGAALEKLLGCGYRRLSHLIGNTFAT

SEQ ID NO: 31496 - protein, 524 aa, A.fumigatus
  UNSURE (521): Identity of amino acid sequences at the above locations are unknown.
KDLGRRDMDLQSVQDLKGVLRRDFFHGYATAAAQVEGAWNKDGKGQSIWDTFAHTPGKVKDGSTGDDAVRSYDLYKEDVALMKSYGVNAYRFSLSWSRIIPLGGCDDLVNEKGIEYYSNLVDELLRNGITPFVTLFHWDTPQSLEDRYGGMLNQEKFVPDFVNYARVCFERLGDRVKHWITFNEPGVYTLAGYAAGVHAPGRSSFRDRNEEGDSSTEPFIVAHTELVAHGHVSRLYKQEFQPHQQGTIGITLHGNWSEPWDEADPLDQAAAERAREFEIAWFADPLYKTGDYPASMRAQLGDRLPKFTPEESKLVLGSSEFYGMNSYTTFFVKHKTTPADINDHKGNVEIHDFNKHGIPRGEESDTEWLRAAPWGFRKLLNWIWSRYQMPIYVTENGTTAKGETAPSPSVLNDQFRIRFFEGYVGWALARAVKEDGIDIRSYFAWTFTDNWGKFFFRLSSKCNAEDGTEWAAGYTDRFGCTFIDFDSPEKTRYPKQSAYYLDNLFKHLIKGSSPGVEGRAXLIS

SEQ ID NO: 31497 - protein, 143 aa, A.fumigatus
TRKSLCRTLSITLVFASRDSAIASSIGSRSTNLVSIRWLDMQRASTHRAGLHSGTATRRATRPPSHSSLRTRSWSPTGTCPVSTSKSSSPISKGPSASRFTGTGPSHGMKPTRWIKRPLSARASSRLPGSRTRSTRRVTIRPR

SEQ ID NO: 31498 - protein, 341 aa, A.fumigatus
  UNSURE (46),(50),(87),(147): Identity of amino acid sequences at the above locations are unknown.
FGIRGRNWEQRQRRPRKGQLAGEAMGKTDNKGEWQPEEGGSFRAIXVTFXKQYIFIDWVKVLMMHDPYFWGLVESAPARPFPFTYFXLPTIPDIVVRLYREILSGLGVYAALSFVCPLNPIIFLGLSLAFPSASRTLTRVPLDAPWXYSDPFGPFLGPYLDHGLVGCWSKWWHQLFRFGFTSTGNFLLSLLPKHMAARPGIRRTVMTVTAFFLSGLIHASGSYTQFAETKPHTHFVFFCLQPVGVMIQNQLARSINARYRFSRPIRRAANAIFALWWLMLSGASIADDFARGGLWLTEPLPISPLRGLGLGAKGEGWWCWGEPWFRSWDGGKYWERGLRVL

SEQ ID NO: 31499 - protein, 224 aa, A.fumigatus
SIHYQPSIVTSSSSSSSSSSVSGSMFSVGISSSLSSSPASAATTAVPDIGASAPDVAACAMLIGIGSEVAVTEAAGIEIAAVAVNEVGEAVPRAGWDKTASVSSRTFFVCTSSSFLSVRLAAGAIGIPGLISSGRLRLCMDGAGSSIASVMPRLLWIIGVAVGLRNPVSSGAACCTAAVVRSSCSSSSSSSLSSTMLPYPLIPGACIRTGILGLISPSTSISVE

SEQ ID NO: 31500 - protein, 236 aa, A.fumigatus
KGRGTGSSIMPFLARRYSTEMEVEGLIRPRMPVLMHAPGISGYGSMVDDNDDEEDEEQEERTTAAVQHAAPELTGFLRPTATPIIQSRRGITEAMEEPAPSMHKRSLPEEINPGMPIAPAASLTDKKLDDVQTKKVRLDTEAVLSQPALGTASPTSFTATAAISIPAASVTATSEPMPMSIAQAATSGADAPMSGTAVVAAEAGDDDSDDEIPTLNIEPDTDEDDEDDEEDVTMDG

SEQ ID NO: 31501 - protein, 70 aa, A.fumigatus
LNKMVHISRVQKRPKGHRARKAEVTDYVYGTHFAAQDLPHHEMAECEMPAAVAYRLIKDELSLDGNPLLK

SEQ ID NO: 31502 - protein, 203 aa, A.fumigatus
TQPSHTFQPTNSIVTPVMSSPRQNGVQTSCEPCRRSKLRCDYSTPTCQRCLRRGKSDVCVYHPSPMTRSWYSDPVSSPHTPASSDNNWDKKIQSVPPPGSSRLTSYSGVSSEIDEHLNEIFAPLATLEHGGTGSSPKQVQLGARLLLTLFGNLSLYETITENRSDNSPEGCVVGQQLVRMIFRALKDNHKLPGKWPGCRRSVL

SEQ ID NO: 31503 - protein, 78 aa, A.fumigatus
YTRARLELMTAESWQGTPHRSKTTMFFGMTRKIEQRSVNYVKSIYYRVSYYGYINPAKDHRRHNRQGQQRHLSHFRYL

SEQ ID NO: 31504 - protein, 100 aa, A.fumigatus
  UNSURE (46),(61): Identity of amino acid sequences at the above locations are unknown.
GKNRGRGVKGYGYWAPQPPFTVVITGEPIRAPSNRSEDWNSTPWVXVPKGHVIPVPCGGSXNAPLYSISSVVFDYKQAAYPEWGSPPAGQSGIANVPSRK

SEQ ID NO: 31505 - protein, 190 aa, A.fumigatus
  UNSURE (18): Identity of amino acid sequences at the above locations are unknown.
YSVNNGLTLKTATVTTDXYAARNTLTHRILGPDSTATIELTISNMKPGDRSGIAMLRDSSAYVAVINNNGAFRVSMVAGLTMDANWNTLSTGSEVAGVNLSGSPSKIWLRAYANIQPGSGRTASFYYSTDGSSFHSIGAPYTLNNTWQFFMGYRYGIFNYATVSLGGSVLVSSFEMERGAPSSGATTTAS

SEQ ID NO: 31506 - protein, 98 aa, A.fumigatus
QETSADFEIELCNGDGEDCDLSRGPEVYGFVSIRLGFLRLIVDIIVLLLKSSQDMFSAADEWLYAKSGSSFLERMKPESFKLSCISQPVKSSVYKACS

SEQ ID NO: 31507 - protein, 65 aa, A.fumigatus
INEKVSSRVAHEIVQPKAGRYRKVTQVTFTTYVMDDNTMRMMISYNKYQILDVPWYIFSCYEYVS

SEQ ID NO: 31508 - protein, 669 aa, A.fumigatus
  UNSURE (29): Identity of amino acid sequences at the above locations are unknown.
LIAFPPGGASRTKLASKSRGKLTDSRPVXGDHGWKPLPLFQAYPQAIKHDCFWAPALSADSILRIQATAKSHSSSNDVDPQGNQPPNEEASAERKKKEERVKKHMRTVSDTIGKTEWSQKIYVLVTSGYILQYSASGKHDRLPEKMLQVGPRSVAFASDAIPGKRYVLQISQSSEEDSTATVDTHRPLFSRLGFHRSYSRRWTRTFLLVFCNAEEMSSWLLAVRAQIEARGGKKYISENLYDEDLEHQLRPKPSIRQMVQRDPNRFSKIYLQPHQSAGSDEKDQAPSDQSRRSSYISVQRRSIVYQSGAESRSNSMSTTQTDVTPPVNGFGRLYPSASPPSGPYTLPNGLTVPGTSEPGVPPSSTTASMTKRLSTYVAGSLSTEGHEPGSSPPTVPEPILRSTSPPAPNFSVPSFSKRFAAKTVQAKLVQDPRLDCDQSNGIRHQESDEQLDALSAFPSPPQSPARNMSKMSLNDIHEDPSTVRNASPRRQLRVSNSEDSLADLQQRNNDHRSLPNQRLPITYTMPSHSRPQSIAIDPLSKLPSEPQPTRPTTNHGNQPHLELQRDRMYPTDRSGRPPSMARRKSMPGLSVGPPAAPPPNCPLPKIPYPIDPHRPILLPSASLTSRSSQLPPSKSLRDRQRSFASINPPTSHIDLPTAPSIDTPVSSGL

SEQ ID NO: 31509 - protein, 62 aa, A.fumigatus
SKKKKKKSKKAVAGAVTAEPQTASGKGEDSTPSATTTATPAADASGVVKRDLAPKVEEATEE

SEQ ID NO: 31510 - protein, 79 aa, A.fumigatus
SVPVHELTTHRKSHNVQCSITARLRLHFEAKNPTMQQSSLYTHSVTQMSTWKKYQIITSETIATTILLITKYPSSIPTS

SEQ ID NO: 31511 - protein, 242 aa, A.fumigatus
CSGTGSDEKLYTYTIITTSSNSYLKFLHDRMPVILEPNSEAMKMWLDPERTTWSSELQSILKPYEGELECYPVTKEVGKVGNNSPDFIIPINSKDNKSNIANFFANAKKQKGGADSFARDEDAKEALPSAEQKVVKDSDEPRKTQDSQWSESNAPLPEPGVKREYPLDGNDISNETPKRQKTEPAPSLSPRGKAHEPKAKSDRKTTTSTRKTRSATHNDKSLKKPNRKTTDGSQRITNFFQK

SEQ ID NO: 31512 - protein, 841 aa, A.fumigatus
  UNSURE (1),(2): Identity of amino acid sequences at the above locations are unknown.
XXPRGVEWWKTNEFGSYHPKRKDDIPALVVPDLAYIEFTRAPTGDMRGVVMSHRTIMHQMACLSAIIATVPGSGKSVRPHGETLISYLDPRQGIGMILGVLLTVYGGHTTVWLEDRAVETPGLYAHLVTKYRATLMAADYPGLKITAYNYQQDPMATRHFKKNSEPNFENVKLCLIDTLTVDAEFHEILADRWLRPMRNPRAREIVAPMLCLPEHGGMVISVRDWLGGEERLGCPLTHEMDPAERSEAADAKKEERKSENNSGFGSSLLGGGVRASPAPKEQNKNELGEVLLDKEALKSNEVVVLAMGEDARKYAATMPNAVRVGSFGYPIPDATLAVVDPETNLLCTPNVIGEIWVDSPSLSGGFWALPKHTEAIFHARPYKFEEGNPTPVLVEPEFLRTGLLGCVIEGKIFVLGLYEDRLRQKVEWVEHGQEIVEHRYFFVQHMIVSILKNLPKIHDCTAFDVFVNDEHLPIVVLESYAASTAPTTSGGPPRQLDSVLLESLAERCMEVLYQEHHLRVYCVLLTAPNTLPRVTKNGRREIGNMLCRREFDAGTLPCVHVKFGIERSVMNLPVGVDPVGGIWSPLASATRQEMLAMQEKQYSGVDYRDVVMDDRTSTPLNNFATIVDLLQWRVSRQAEELAYCTIDGRGKEGKGITWKKFDLKVAAVAMYLKNKVKVRPGDHLILMYTHSEDYVYAVHACFCLGVVVIPIAPIDQNRLAEDAPAFLHVINDFKVKAILVNSDVDHVMRQKVVSQHIKQSAQVLKIGVPAIYNTSKPSKQSHGCRDLGFTVKETWLQSDQPALVWTYWTPDQRRISVQIGHDTILGMCSLHHGAKRTTVVY

SEQ ID NO: 31513 - protein, 79 aa, A.fumigatus
YALSSLLPSLALSVCHFRFLEPFPRVMCIPAIPKMGQTNYTFPFWPSAFNTYRKQASENSLQMPNYPGSQATIPSSQPH

SEQ ID NO: 31514 - protein, 123 aa, A.fumigatus
QMASTSTPASRSRSTSTSTSKFSTTVTASTPSTLQLSANFAGAHTKSHAGNSNAVGYDHETYLQLTAGEKAKEKTPNQVYREVSDPYQKRRNAIDVIAGASSEAHDEGIGSSYPRTSGRSEPD

SEQ ID NO: 31515 - protein, 134 aa, A.fumigatus
PHGSLVLYAATPPPRPCSDISGSLSRSPSISATNLSQVFITPWKKSMCFSARAPSVSRNSTAFIRSKSATSRTTSSSNISDVVLADSTSRVSSSMRSSSFRTRSRRDCSWSTPRMSSILERMNEAGDEVKGLEA

SEQ ID NO: 31516 - protein, 135 aa, A.fumigatus
AKTPPDGSPSMDQHDDFDSVSWRQDPESDISRPTTSGTDADESLEYNRDTNGKRRMSSVHEDPPQAGPLADAVDLAGIGDGVLECRVDSPLKENDGTKDAYISYLVTTHVSYFFLISGLVSVCWLPGWRCMQMKY

SEQ ID NO: 31517 - protein, 400 aa, A.fumigatus
MQTDFKSFQKPDFAVRRRFTDFYFLYKTLYREYPACAVPPLPEKHKMEYVTGDRFGPEFTSRRAWSLHRFLKRLTLHPVLRRAPLLAIFLESPDWNAHMRLHSTRTSTGNSDGSGTEIFDNFTDTFVNAFTKVHKPDRRFIEVKEKADKLDEDLNHVEKIVARVARRESDLDADYNDLATQFRKLVPLEPDVEVPLQIFAASVEETARGFKMLKDHTDQNYLGSLRDMEAYIVSVKALLKTREQKQLDFEALVDYRNKAVAERDSLAANPSSYYASNPLTSSPASFIRSKMEDMRGVDHEQSRRERVRKLELRIDELTREVESAKTTSEMFDEEVVREVADFERIKAVEFRDTLGALAEKHIDFFQGVINTWERFVAEMEGDLDNDPEMSEHGRGGGVAA

SEQ ID NO: 31518 - protein, 365 aa, A.fumigatus
LRFDAYAHPVVKMRICVENGMFTYSFLKEASQKFRGWIDDLLSSAWASCQDSDLLIESPSAMAGIHIAEALRIPYFRAFTMPWSRTRAYPHAFAVPEHRMGGAYNYITYVMFDNVFWKAIAGQVNRWRKNELGLKATTLDKMQPNKVPFLYNYSPSVVPPPLDYPDWIRITGYWFLNEGSDWTPPTALSEFIHRAREDGKKIVYIGFGSIVVSDPSALTKTVIESVLKADVRCILSKGWSDRLGDPASAKPEVPLPSEIHQIQAAPHDWLFSHIDAAVHHGGAGTTGASLRAGVPTIIKPFFGDQFFFGSRVEDLGVGICMKKLNVSVFSRALWEATHSERMIIRAQDLGARIRSVSDILTIKFL

SEQ ID NO: 31519 - protein, 280 aa, A.fumigatus
  UNSURE (33): Identity of amino acid sequences at the above locations are unknown.
KSKRAPVLVTFGQCEVEDPKADLQHGVDDSYPXDVKKGSDTIQITAKTVWGALHAFTTPQQIIISDGKGGLIIEQPVSIQDAPLYPYRGIMIDTGRNFISVKKILEQLDAMSLSKLNVLHWHLDDTQSWPVQINAHPEMVKDAYSVRETYSHADIRQIIAYARARGIRVIPEVDMPSHSSSGWKQADPKMVTCADSWWSNDVWQYHTAVQPNPGQLDIIYDKTYDIVRDVYNELSGVFTDNWFHVGADEIQPNCFNFSTYVQSWFAEDPSSSRRGWNDLQ

SEQ ID NO: 31520 - protein, 61 aa, A.fumigatus
ETQESVLTLSFWSSKQGWKRAAVNTLRCLAGCTLGDFLALWVLQSFYGHWDMSAIMGVSSM

SEQ ID NO: 31521 - protein, 325 aa, A.fumigatus
YSCQLLFLYTNQLPLTSVQQHERDAVSYDPFSVGLQLQAQGIEAKHPIVMIPGVISTGLESWGTGPASRQYFRRRLWGSWSMMRALVMDKAEWKNHIMLDRETGLDPPGIKLRAAQGFDATDFFITGYWIWNKILENLATIGYDPTNAFTAAYDWRLSYLNLEVRDQYFSRLKSYIETAVLVKGEKVTLASHSMGSQVVLYFFKWVEHPDHGKGGRDWVNKHIANWINISGCMLGAVKGLTAVLSGEMRDTAQLNAFAVYGLEKFLSKEERAEIFRAMPGISSMLPNVGRSSLVQLYLGTRRSTLASHDLWRPSSLSRNQFLPVP

SEQ ID NO: 31522 - protein, 111 aa, A.fumigatus
  UNSURE (30),(36),(46): Identity of amino acid sequences at the above locations are unknown.
KLTTTEKLDYLLDQSEDWYPHQVLSNYSHXGAHTTXEVQANETNPXTWFNPLETPVALAPGIEELLALPGGQTRRTPLLLLRKTEPLVKLKRWIWNPRNPPKGVNPGVSLG

SEQ ID NO: 31523 - protein, 162 aa, A.fumigatus
LLTFNSFYLLSCRPILWALGVIVFELHSQSEFGVTSIAAFCFPLRPFLAVAHMLRRRLAKDDDVQQTKDKSRDDKGKSSPDTKTVVIQEKPQSGSFFSRPKSKRRNGLIFALGGIFGIFVALFFANQQDVISLESLMDLNLDTLIDVIPQGIIRDAREFTVC

SEQ ID NO: 31524 - protein, 176 aa, A.fumigatus
KKVPKNSDGRRNHMGNRNPNVMRDPQNSCLLGPPTTIIRHSAITSCSHSSFYRLLQQSTEIKLHRPSPYPTTTPAPIPLDDSVMSQDDSSPAEPTAAGAAAPSDLRYVRYDGSRESEFVSAMRQLISKDLSEPYSIYVYRYFLYQWGDLCFMAMDDTKEKDFMVGVVAFPTGENPR

SEQ ID NO: 31525 - protein, 73 aa, A.fumigatus
  UNSURE (55): Identity of amino acid sequences at the above locations are unknown.
PVLMNNEALAEDPPTPLWELVLEQFKDQLVLILLGSAAVSFVLALFEEGDDWTAXVDPVVVRSAKPRCTKVIS

SEQ ID NO: 31526 - protein, 167 aa, A.fumigatus
ILTILILNAVVGVTQESSAEKAIAALQEYSANEATVVRDGKTQRIKAEDLVPGDIIHIGVGDRVPADCRLLAIQSNSFRVDQAVLTGESESVSKDTRSIKDEQAVKQDQTNILFSGTSVVNGHATAIVVLTGASTAIGGIHESITSQISEPTPLKQKLNDFGKCLLK

SEQ ID NO: 31527 - protein, 94 aa, A.fumigatus
KYCYPRTTYLTWSTTTGNLLFIRPLGIHDSVATFSLYISSHSFFLSLLFVSLSLGLFDCSRCDWQWSDLFSILQQKCWSTLESQSVLVCPRIRS

SEQ ID NO: 31528 - protein, 200 aa, A.fumigatus
SIVRPTGLRMHLPLPRGSRICCNLSRLQVPPSLSSSTHSSSSSSFSSNRAGRCACGCRNSASCSCSCCVHPSSLSPLTKATRSLTTTTSRALFRTSPSRMAQEYKLKDISSLADIKNMDKVESEVEGVEGGKVLVLRFNGQVHAMSPKCTHYGAPLKLGVVAPDGRITCPWHGGKSVLVREWAVYMLIIVSGSLFQYWER

SEQ ID NO: 31529 - protein, 69 aa, A.fumigatus
SSFLVACFNIGSGDVEDAPAPNALNKFELVEKNGAVYIKGEEAAIKSGQRDPVFKCSPSTGEKVVVVGG

SEQ ID NO: 31530 - protein, 99 aa, A.fumigatus
APSSSFSILFYSFILILILFFQSRRPLCLWLSQFRLVLLLLLCSSILSVPFNQSYQIIDYHYFARTIPHITIQNGAGIQTQGHLVPSGHQEHGQGRVRG

SEQ ID NO: 31531 - protein, 403 aa, A.fumigatus
HYKPGKPLVAESQAKAAIGPLWMTQIKMARTRMMTIQFSLRIPQAGRRKRALDPTYIPGKNDVGEEEDDDDEYIPTGLGRKKRRILDPAFVPDKGDEDQDIFLDSSKKGKGRTTENRTTTRKANSEIGAGNLPTPSKETPRPAKTMKTEPTSPPRVPVLPALTDPQHDTSDGKAAIKNSWELVNARTQPNHPLKVKAMKILNKIAEDRNRAFFALVKAHQRSRKSYAAHLAGNTNDEAHTQGMADSSRRRNKTSDAVARHSDSTAQVNDTSLTQEDEADTSVPDLSQERAKRWANAVNVPKGLWSEVEKQLFYRIAMRGFEPLLPKQWHYDFSTLPNPLFAVSGENPASLINAIRGSEFYGKLDLSHAICLDSPLNICSNQVAFRFILSRRLCQRLQSGASST

SEQ ID NO: 31532 - protein, 121 aa, A.fumigatus
ALMDHLSLRRDSSQMAENNPDVMNELATKLGLSSELQFYDVYSLDEPEQLAHIPRPAMALLAIIPRTPAWERDREAEDANKEPYTGSGPNEPVTWFKQTIGHACGSIGLLHNLVNGPAADY

SEQ ID NO: 31533 - protein, 314 aa, A.fumigatus
QAVDTLLDLHAKLSTVVRYYDRMLEERLSSAYSQHSLGYATAPGGSPYPNIYPTMPSHIPEGKTGAENFYYGNPVADRAPPVRNTYGYPHSSRDIREPTAAPSGPISSGVYYQPGQAVPLNPPWNGKAPSVASPQPSDPSTPFPNISSDNLEPSAWRQYYASAPHQKQDSNAYSGPRPGETDVSHQSSPNMRRDSYYQSAGAPVTARASAPEQSPPTDQGQSPAYMQYGDSHSAQSTGQPTHQHQPTAPPPQSYYFQHQPPQSAPLPTHSQTPGAPYGTYPGGDVSPIGAPAPAVHYQPAAQTKPAVEESLIEL

SEQ ID NO: 31534 - protein, 61 aa, A.fumigatus
YYHPPGDAFCLAPLFLSTSVFYSHSSLFDTHFSTNGVRCIVMAFSLRAFLIKFGISYCVNL

SEQ ID NO: 31535 - protein, 75 aa, A.fumigatus
KLQPSFALDTGELKYSGEVRTATVPDAFFGPLKLIAYRYLWPTYSEDASNHHVLLIALIVSIKQRDHLPIWGAFL

SEQ ID NO: 31536 - protein, 602 aa, A.fumigatus
  UNSURE (533): Identity of amino acid sequences at the above locations are unknown.
IIETFSDRPGDFSNLFHRILSMSVDNSLSTFSRQSILSFIISAFQSLENVLIRKECAPLVSISIWHNLSSEELRDRIFAKVPSLKKAWRAAGKRYEAGDETAKARMRFERSWLFTMLLDFLRRLNGSEQELSDNLRYCERFLEYLVDLESQLPTRRYVNTLLKDLNLLPVIRLSQMYRSPGNALFRDLVELLNHFSGFAIDDYTGEPLDPQAIYESHSRELAHLQRTAMKHFKDKLMILALSNYGSIEQRSELEGQLSTLNDSELQSLCMHLGFRTDYPKQSGVIPTRHLYLEILLSFYERKVPFQETASRLSIVPTEKDLYDPSFLRNETYDGSRPLAIPKLNLQYLSLGDFLWRSFLLYRSEAFFQVRKDMEAIIKRMQPRSSRDGKTLTFDGFSRMAIPISKPAIIEVAPPKVGSSDPAFVRAEIAIEVGRLADHIRKEWDSLRPDDVVFLLAVQPGNANNSVFRDSSVETPSLMHLRTATVVQVLDEQGRPLREPVVGHTNGYQSRPRLRRLLLNLDPSAFKADKDRTXQGKQDIYPLINVIARRKGRENNFRSILENMQRLIVSDVTLPSWIQDIFLGYGDPAGARYTGIAQPTEVS

SEQ ID NO: 31537 - protein, 107 aa, A.fumigatus
ELFNLRNVQETSFSFSGHEMTTMSDKLEPLAIVGMKWRFSGEANSASGFWDVLTNARSAKSRIQADRFNVDAHYHPSADRNGSVSAFNIPWQSDAESLRRSLRKDTS

SEQ ID NO: 31538 - protein, 80 aa, A.fumigatus
FGKGSITICVRVTSSLKTGESATDRSCGMHHEICLLTELTRHSLNLMFTIAAVATNVCALPVGTILDQYGPRVCGIISSI

SEQ ID NO: 31539 - protein, 64 aa, A.fumigatus
HRMLIESGGASSPYMQMYMYEDSWELRDPARLLLTQDSITATFEKTQFCSNKLDPRRNTSSPKP

SEQ ID NO: 31540 - protein, 239 aa, A.fumigatus
NLIKATVCRLQPKLCFCSASHLQCIAMSLNRVSYLESWGQTRPGSLQQQQQGQEDGDSDSVDGRNVDLPESSLSSSFQSTYTYRLNFNPYAGPGWTQTPDEVAPEVLPSGPETPTIKTQPKPLEEGDHGRYDPQHASLRLPNEDYPLQTTGAFEVSSTRRICKNPVKPCLFTTREILMRYLGQVIVAVIYCFLAAGVVFGFAALKPVLIREGVYHNLCSRDELSKNRGVCYGQELRYAP

SEQ ID NO: 31541 - protein, 423 aa, A.fumigatus
  UNSURE (163),(165): Identity of amino acid sequences at the above locations are unknown.
RVKVLDDLCRLVDGEQLHFLRIKSLSQTFTLELIESILTNSGRLFVGHAELTHVLRTRLMPMTVRYLSERHGFALTSRVARILLILLKRYMSLLTAECEMALGLLTHLLEPDGTSPWKRVLCMEIFRGLYAEPGLVRLIYSLYDGENNRKNILRDHMAAFGCXGXGEPFMNGVSSRSTVPMRAVHARSITEEQITLEAVGFAGVIGAIGHSTETNFQGISSQWSTVRTPYIELLDKTDPPPPRETYIYSLVLNCITSFAEGLAKFILPLTVPDSKQKRRSRMTSPDKSNSPKPAHIYQRMDASTTIHRSNSKKLAIPLNPLDLDSHPQLTAIKACAGIMENCWPAILAACSTFLYASLDEDYYHNLVRSFQKLAHVAGLLRLSVPRDAFLTTLAKATMPAEMAGASTAAASDSHSIPAMDEKR

SEQ ID NO: 31542 - protein, 97 aa, A.fumigatus
RHCLQLPRLRYLLVGVKPCHMSPLLLLGKITEYPRDLVRKPKFVDPFILACHSRHAKLAGIGVVCLQRLVASRSLPSERLNDVLGGLKETTSLSMQS

SEQ ID NO: 31543 - protein, 98 aa, A.fumigatus
FLVVVYYYYYYYLACPHTRSSTFFSSVSITHFFPLLSISFPEYRSPVYLTMVLIDKQEYLTQEEQRLKEDRERTRYWKKWGPYVAERQWATGESSLYS

SEQ ID NO: 31544 - protein, 65 aa, A.fumigatus
STYLLRLDFSYDHSRSRTYRWGEDGIAGVSDTHGLENIAFAFWNEKEYAYAFLDMQSERSSDIDC

SEQ ID NO: 31545 - protein, 111 aa, A.fumigatus
  UNSURE (94): Identity of amino acid sequences at the above locations are unknown.
MSYDSAFTPQGAALSDLPWREQLRRGFKDMGARSWSSAKNFGIVGALYAGTECCIEGLRAKNDLTNSVAAGCITGGILGAKAGPQAAAAGCVGXAAFSAAIDAYMRMPSEE

SEQ ID NO: 31546 - protein, 164 aa, A.fumigatus
TFLENIRQATVGEEGINATQSRGVPPARKRDSSSASRSRDRLSVHGGKSSRSPSSARGKAAGTQLSGKDTKSVDIDVSFWSEFGIDTAGQKSTKARGASNTPRGATEQETSNNIDVEENWDDWDTPQPKKTHTPSSSRSTLESKHDQSPITQNSSPRTSGRYAI

SEQ ID NO: 31547 - protein, 402 aa, A.fumigatus
TMMNPYISWALLLVVAGGLGWYYNAPNPKAKPTVKPAAEKIESATGVKKPKKKAKKSHEPTSSATTKKVEEKPAFEDGATEGDDGDEEIDRKEMAKRFTAGESGIPAQGSGSEGKSQKKKKKTTSQLEAEESKRSGSRVSARTSSTAGADADDDLSPAGSPMVKPTASSAGYVSDMLEAPAPGASVLRVTGSMEAPQKKQKAQSFKQVETKKQRQQRAKNEARKQQVQEAEAERRKLLEKQLHTAREAERREAAKTKLVAPQSNAWQAKEVNPTSNGTPNVSQGPNVELLDTFETPSSKQSPATTSSSKKWDQGLPSEEEQMRILGADPSDDWTTVSSKKPKKKGGKADESFSEASASETQLTPAAPAAVPAAPKVTVTPTYIPDILRSKQKGHPLDSDWAA

SEQ ID NO: 31548 - protein, 80 aa, A.fumigatus
IGSLQNFQSINYLRSVTTRGYSLPNLLRRSANFYFKERSIETTTINITTFLYFFLSLLLLFEKPICPRLLRSYTDAPLRS

SEQ ID NO: 31549 - protein, 185 aa, A.fumigatus
SPIRPLCFLPRGEDAPLPPTTILSSKSISQSAAHDFLAAYLDRAATDPALQPNASISEHGPISRTTAAAPNLILHNLKRVQAGLAGEVLGRDLTLAKINAGEALQGESGDNVVWEETKHEQVAADDAMDDDEEEMRGEDDEENEQQPSRVGGEADKHTVDKEERKRKKKERRLAEKRAKAKGADA

SEQ ID NO: 31550 - protein, 253 aa, A.fumigatus
AYGRAKAKFGFISGLYGQIQNLAFIYGDVLPKLWGLSGLLLARYFPSRFQGEISQTLLFIFGFNLISTVLSLPVSYYNTFVLEEKFGFNKQTLKLWVTDMLKGQMLGIVLGTPIISAVLKIVQKTGNSFFYYLWLFGVFVQIFAITIYPIVILPLFNKLSPLEPGELKTGVERLARELKFLLHELYVIDGSKRSAHSNAYFYALPWKKHIVIYDTLIEKSETEEVVAVLSHELGHWSLGHTTKLFAIAQVRVY

SEQ ID NO: 31551 - protein, 78 aa, A.fumigatus
SHMFYIFALFSVFVNNKSLYQSFGFHQEMPIMIGFLLFSDALAPMDAVVKLLMNVLSRKFEFEAGMISVPSEISTDRS

SEQ ID NO: 31552 - protein, 145 aa, A.fumigatus
ASAPLALALFSANRRSFFFLFRSSLSTVCLSASPPTLLGCCSFSSSSSPRISSSSSSIASSAATCSCLVSSHTTLSPLSPCSASPALIFARVKSRPRTSPANPAWTRFRLCRMRFGAAAVVREMGPCSLMLALGCRAGSVAARSR

SEQ ID NO: 31553 - protein, 93 aa, A.fumigatus
FLSPRKSLQTEADCATDAFAVKLGYSEQLAASLLKLQIQNLSTMDADWMYASYHYSHPILTERLKALGWQGGKVTDAKTEYSERPVKAADREL

SEQ ID NO: 31554 - protein, 269 aa, A.fumigatus
ITIHPAGVLVSVNTTRQRTTGQQHSALFKPPVVCAEFPAMYILEVSSQKYCSCCTSLKLTERFCPRQQLARLLDRPFFPWKNVLVGFSLGQFILEGFLSFRQYKVLQRTKPPKVLENEVSQKVFDQSQVSRDDYIAIVKIAGLIFLPFSIGVWSRKSQVWFHLGSLRSNPESCIYLRRCPPQALGIERSLASPVLSLSVSRRDFPDSSVHLRFQPDQHRSVPASFILQHLRSRGEVWLQQADAQALGHRHAQGSDARNCVGNPDHQRGA

SEQ ID NO: 31555 - protein, 139 aa, A.fumigatus
GQPSIKPNPEPWQPRLCTTASRTPPTPPKSSTSSNPLSAPQTPDQTGQATKLSPQLSASTPPTSYPGSPRRTAHSSSRPTPPARRSPASESRGPSLTTASLASSCSLSMKRTSALRSGGRSSLPRRCTPRGNGELNAGG

SEQ ID NO: 31556 - protein, 76 aa, A.fumigatus
VDAVMYCEDKVHYLQVHIAELQFLQACIYSSGDVRNIRNYLGCHKKLLPWDATLFDGQAYLWFCTIDFRAIQVVIS

SEQ ID NO: 31557 - protein, 196 aa, A.fumigatus
LRRPTRLIRSIAPCRYLIHSPFFAKSDNELQEAWAAMEKVKAAGKARSIGVSNFLQSHLEAILKSAKVTPSINQIEYHPYIQHGGLVQFQGDKGIKTASYGPLTPITRAKDGPLGEVLQTLAYKYGVSEGEILLRWSIDRGDVSITTSSKESRLSSYLRALRFRLTPKELDEISAIGRQKHYRAFWRDKFADDDRQ

SEQ ID NO: 31558 - protein, 99 aa, A.fumigatus
FSLCQLGYGTGTAWFKKGGATGIDRELVESIKTAIKLGYHHLDGAEVYGTEPEIGLAIKESGVPREQLFVTTKVITNIADIPRAIDASLEKLQLSYVDL

SEQ ID NO: 31559 - protein, 245 aa, A.fumigatus
  UNSURE (206): Identity of amino acid sequences at the above locations are unknown.
AVGMLSTSCLQQASLTEESSPKMGLLVHSLGHLMANEYVLIALAMLFFLVTLSSRSHSRERSSTSASPSLNSTRKECKAPNTPSWGRRTPRPIQWYQDMYFQIHNLEQYPTVLEPARDELLAMIADGVSLALEAPEKGILRVESYDAERLRSFINGEHEKTMNEWARYHDRRKLGLGPTLFGNIAEAKKWLTQRAPAKLVDGAWLXHIHKINTPFALRRVTKDAWQILSEELGRRRCQPKTCIHL

SEQ ID NO: 31560 - protein, 311 aa, A.fumigatus
HESYSVESVHIIRHFADQCSNRKLPILYSLIACFFGTGMVAGETSLPVLFTGRVMQGIAGSSVWIIGLATVADTVGGDNMGKVEGIMMSFLYGGLIGGPCIAGWLLAYVGYWQTWLLPLVLLIIEFIARLVMVENCAVPTSSSGPETSSKADGSTKPLLSPCEDTPTNYPSENFWRIILTDVRAVVAICVAISANTVGTSFHATLPLHVQETFGWGSGRSGSLFACLIMPTVVLSPVAGWLRDCFGVRYPASAAAVFQAVMFGILGLAGTDLLPWTSAQSGGGALYTGCILAIGAARPFTANVGPVELSCE

SEQ ID NO: 31561 - protein, 115 aa, A.fumigatus
PSSNMVKTRKRLALACDTCRSRRVKCDGERPFCAPCRTRGLNCFYQQLPERPATKYASSSPTALGELVVGTDSVQSRNRTSQCQPALRLPHHAVVQGVSTDSGAATAVDQCTGVA

SEQ ID NO: 31562 - protein, 223 aa, A.fumigatus
VFLDARFIRLKHTFGNRLLRTANMSSALGSHLLADVTKRKAARSARVASWDQSGLNEDAFVVLPGETAVLADLQGPGAITHLWFVQTCRKILGPGLIPYTKSGVAMMEIHNALGLNFEVNDPDYYRKVLIKMYWDESESPNVLAPIGDFFCLGHSMAANFQSLPFTVSVKPSEEKQYGGAAAFNCYLTMPFNKRARIEIENQNDEAYIQYFYIDYELYAEPLS

SEQ ID NO: 31563 - protein, 107 aa, A.fumigatus
YYSASYGVMLIDSSQPQRPPRQSRPRNVPTTRAHPVRTFSALCSYNNKHAPSNTKAEPQTFAVFVTDHQYDSSHGAPYGTCKAYTCTAPTDSQMTDVNEDCWTFFWK

SEQ ID NO: 31564 - protein, 287 aa, A.fumigatus
  UNSURE (49): Identity of amino acid sequences at the above locations are unknown.
SNNGEYGRQQYKGEASGEKWTEKDYPIANASRFHEAAMMQTHPSMVAFXMGSDFWPNDRATKIYLDALHRMDWPVPIIASASKRGYPKVLGPSGMKMDGPYDWVPPNYFYGDQLGAAFGFGSEEGAGVGTPELTSLRKFLSPKDLDSLWKNPDQNQYHMSRYDSSFYNRALYNKALFARYGAPGSLEDYLLKVQMMDYEATRAEFEAFSVRQNASRPATGVIYWMLNSAWPNLHWQLFEYYFSSCRGHISEPRSVEEWNTWRMTNEERAVYLINRSLEKKGASHRLC

SEQ ID NO: 31565 - protein, 91 aa, A.fumigatus
  UNSURE (83): Identity of amino acid sequences at the above locations are unknown.
ILVDHIIVLPFLSSRWLYVLVMHYGCAPSPHIYEIVPLKLIDNPGQGYQTQDTELTIVCTNSDSSMASTLTVYFQSPWRAASXPRPSAFCR

SEQ ID NO: 31566 - protein, 198 aa, A.fumigatus
EERGLASSLLTLLIGMANALFNQEVTIDTTPTASKRVIPVKAVTQIKDVAFLRLVLKNPSTGAILSRNVYWLSAKNDVLDWENSDWYYTPVTKYVDYKALISMPTAAVTASLKRLPAKDGLSQVQVVLKNPSATPAVFMHLSAINMDTQEEITPVFWSDNYVTVFKGESVTLTAAFPGGRSNWEVILSGANVKRTLLS

SEQ ID NO: 31567 - protein, 63 aa, A.fumigatus
NISTASKGFVVPELFFSFASFPTLSILIFPSLASPLGHLPNQFDIILLTLAWLWKSTYSLQPL

SEQ ID NO: 31568 - protein, 186 aa, A.fumigatus
RGSLTRSMQSLLRRITTVSSSEDGEIAVLEATKDTGLGIVLRVPLLYGTAQNNSESAVNILIDAIWKAQDENAGVKMDDWAQRYPTNTEDVARVCRDIVIKYVKERPRIHELPKVLHFSSEDRMTKYEMCEKLAEVLGLSLAGMIRNKQGNDPNASVQRPYDTHLSTKVLKDLGIDVQTTDFVAWW

SEQ ID NO: 31569 - protein, 145 aa, A.fumigatus
REQGDFPHPIIVDESSWTLETTSQPPGKEVSVHLDKVNKMEWWAHVVTTAPKIDVSKITPENSSLSDLDGETRAMVEKMMYDQRQKEMGGLTSDEQRKMDILKKFQAEHPGMLSSRLGVVYGLMSCRDGLLECKDWLRWCGSTAC

SEQ ID NO: 31570 - protein, 146 aa, A.fumigatus
  UNSURE (106): Identity of amino acid sequences at the above locations are unknown.
QTQTPLLMHTIIAVATSHLRYVVPDNTAYKMAEAYHWQQAISQYSKELGCAVGPHNMDALFSTCLLMTVHAFQLEEYNPRKSFVFSNDPQTLSWLTLQGGLPHLLXAYQNLAVHQHVVGRLHGDSTGESNFRGSPTRTGGSPPGAG

SEQ ID NO: 31571 - protein, 81 aa, A.fumigatus
  UNSURE (27): Identity of amino acid sequences at the above locations are unknown.
TSIAATVSTGFFAEYLFSDDSAYATAXLASSNMNRAIICGIPIKGMACNESHAPVDMCKSEYLSSGQESATKIVNSIITQS

SEQ ID NO: 31572 - protein, 124 aa, A.fumigatus
SLVRVCAMLSIKRTLLLLGAVLPAVFGAPVHETRRAAQKIPGKYIVTFKPGTDTATIESHTLWATDLHKRNLERRDTTSGEPPVGIEKSYQIKDFAAYAGSFDDAPIDEIRKSADVSTLQNPST

SEQ ID NO: 31573 - protein, 154 aa, A.fumigatus
ALSSEKRYSAKKPVLTVAAIEVYFARCLGFSLLTIATLTIMLTGSIPLSSAVSETVSTEDSDPKAPYAVPTLVVTSIYHAISAFYAYTWYTTTDQGVFAVAMVGYFAVGSLGLWCTLFASSQGKISRKTGADKRTTGYPFGNRVAERKHVEKSD

SEQ ID NO: 31574 - protein, 107 aa, A.fumigatus
RAGDISRERNSIYALYRASIPRLSATSQHGCLSDWRLPGLQSNANVITICRPVKHGIMYFFPSCQSHATKSRLGGPWLAAIRLVNILVSNACRNAKKKSHEVAKYPV

SEQ ID NO: 31575 - protein, 168 aa, A.fumigatus
  UNSURE (5),(7): Identity of amino acid sequences at the above locations are unknown.
LRPFXGXTLSADPSSARGEDLAKDPTASRVLQQALTAPTSTSQFRRQFTTRFSGHLVELALDSSGSHVVDALWPATKDLFFVKERMAQELLNEELSLRDSFVGRAVWRNWSMDLYKRRRGEWASKAKGLDSIENGQRERPKSRIDLARAKFAAKAAEESSKAPVAAKT

SEQ ID NO: 31576 - protein, 277 aa, A.fumigatus
LLGAVEDLLIPFIQSADENPLGLALQQNGVNGTNDTNGTNGHLKSPRTALVDYKNPEELRDILQLSLPEKGTRQEGLIEVLRKVLKYSVNTWHQGFLDKLYASTNAPGVASELILAALNTNVHVYQVSPALTIIEKFTGEKLASLFGLNGPRAGGISVQGGSASNTTSIVIARNNLYPDTKKNGNGDYKFVVFTSDHGHYSIEKAAQMLGLGSSSVWVVPVDKQGRMIPEELEKLVRKALQENRTPFYVNATAGTTVMGSFDPFNEIAAICQKYNLW

SEQ ID NO: 31577 - protein, 139 aa, A.fumigatus
GRETSVLARLSSRIVPRASGLSLAIRFYQPLLYYQAMADLFGENFLSITSSSSQLRPTTTDHDAPPASTGHGDADNLHLPRTKRIACVVCRRRKLRCDGKRPSCGTCSRLGHECAYDEVRKKSGPKRGYVKQLEARLGT

SEQ ID NO: 31578 - protein, 92 aa, A.fumigatus
YYHGGRDGMHVSMLCKNFRLIPSQALNILFALCGITGSLYGMGRKLEHVEQFSTALFVCLLKPPSLSPVRHSVYIAYARVFHSGGGSVRQAT

SEQ ID NO: 31579 - protein, 124 aa, A.fumigatus
PMLRAKLVDDPQIKYASLHNPLPTQLHAYVWPFLIIWPAFFAVYLSPERYDTYIQGQEWTFVWSGSIITAQSLLWLMTKWNINIQTLFTANKGRSLNSAQLNKIIPGCNACSAENLPLHCEKIG

SEQ ID NO: 31580 - protein, 67 aa, A.fumigatus
TVFEIKYKGMGSAYMQIYLMHLAQHEPCATLYLAPDSLLRTDGWRSDNFPYQTMLTITKASASLPTS

SEQ ID NO: 31581 - protein, 327 aa, A.fumigatus
NCANSCSNGNLRALPSGLLRPLQYLTKLPSVREPPISEEGYSSLKPFLRLFLAGNALTAVSGEIFELDSLRVLSLRNNKLTEIPPAIRKLTMLQEINLAVNRLRCLPWELLWLIRKGDLKHLMVRPNPLLQTNDVEVTRWYTPDGSDAASPEEALKACHYEGPPPEEAWAPIQVAISPIRRFNMEGIPITDGQSGALPLRSSDDTPSHVPSLREVSLLAFSKSAYCDQISESEMIGYPELMVRLLRQAKGVRNAGGRSCSICHRSFVIPRTEWIEWWDCSTYENGLKRPRCPGEQLRPLPFRRFGCSWACVPEAEESMLQAETGQQG

SEQ ID NO: 31582 - protein, 66 aa, A.fumigatus
RGRSKPDGSALRLPLLQELAQFHITQTEIFSPQVDAILPFFKTVIDNRPSELMFPRLLHLPGTPRL

SEQ ID NO: 31583 - protein, 174 aa, A.fumigatus
PFLTLVFITSICFTSAKVGADFDHWKIGLEHGRILSQQIQDQIKVYEAMFLEASKMSWDAVRNLAEEFRESLEKKLPDVYAEMQGIAEGAGLDLLDIVALNCRSEIAMGNFSDGCTSLSWKKHDNGRVLAQNWDWAPAAGKNIAIMSVEQPGKPKVFMVTEVSLLSQFVLDNTD

SEQ ID NO: 31584 - protein, 237 aa, A.fumigatus
STLAVCIGQYGLTLIITTQAGIVGKIGFNSAGVGVCLNAIRAKPCISSKIPIHVALRLCLESPSAQMAVERVSELGGIACSVHILLADSTTALGLELSPLGDVYLKEDVLGTVTHTNHFIENRNVIEPPWLSGSPIRLNRVRQLLRELISGGIAGSQITPGLLRDKIFSDTSNAPQAICCSEDPARGPAVRSTTIFNIIMNLEQDNVSAELVVGRPGSGEETAVIRMPWAYRPRIVV

SEQ ID NO: 31585 - protein, 73 aa, A.fumigatus
FLSPSGRIDPSTSVSYTLNQNITFPSTMASKEGAAGPAFGPVLAAVATMQGNVSRSEKTQAHEFLEKFQKSVS

SEQ ID NO: 31586 - protein, 140 aa, A.fumigatus
QRHCRIAPTQFQCQLRSFNNFPRHVSIMSGRAGGGGARKTLLAPIHFIFKLLQQRTTVSIWLYEQLAFRIEGKIRVPFIPFLATRYQANNMRQGFDEFMNLVIDDAVEVKMATKTDEEKRRPLGMIYYHCIFDIASECYY

SEQ ID NO: 31587 - protein, 134 aa, A.fumigatus
LNPTATIADSVGPFELAKNVVQTSVLVAHRSQASPDAVRDPSLRTRPRLGTIEAIRQIVRRYGFRGLYTGFHLHAMRDTIGSGLYFSVYETVKQLAAKELGPDKSPFGGPMIAGAICSTVPWFCVRHFFSNETV

SEQ ID NO: 31588 - protein, 91 aa, A.fumigatus
VANLCQTYPLDTRKTRAQSVLLGKSKEVGEASAAVSKSSMYKGLSVILIRTGVNNMILLSMFEYIKMRINQLEGLAGIAWLIFLANNGAGL

SEQ ID NO: 31589 - protein, 96 aa, A.fumigatus
VDIALEFYAIDGSNIQNTGALPPLASVTAVRVVNFSTYNVAKHRISEFVERITGESPLATYNTPGSSPTVSTLFTFTTAGFIAGLITSPLACKFRN

SEQ ID NO: 31590 - protein, 376 aa, A.fumigatus
GTSLLYYLFKGQASLQANLRQLKMTSSNMSIRSLAPPTAVTSSQVQVFPTAWPKPSPTSTARTPTALRQMAAVSLVSRACTTPARGVIPRWAISPSSRSTVRTMCWITAVFRKLRGACTMSTSRLLRGPGYFALALENGIQAKMTVSEHAALYRFTFPPSTAQDGSELSPLILVDLTNAWDSRQNASIMVDAENGRITANGTFLPSFGAGSYVSYFCADFGSGAVKDSGIWVNDRAGTEPQELFVTRGFNLFYLQAGGFMRFKRPEDGTVTVRVGVSFISSEKACKNAEIEIPHPEDDFVTLRQRAESAWREKLSPVSVQTGGVTDDFLESFWSGVYRTMLSPQDLTGENPLWRSDEPYYDSFYWYVSRDDMVFHR

SEQ ID NO: 31591 - protein, 133 aa, A.fumigatus
LMIGSIWDSFRAQHPFLTIIDPVSQSRMVRSLLDTYRHEGWLPDCRMSLCKGWTQGGSNADVVLADAFVKNLTGIDWDLAYEAMVNDAENEPLEWSYEGRGGLQSWKRLNYIPYLDFDYLGFGTNSRSISRTL

SEQ ID NO: 31592 - protein, 244 aa, A.fumigatus
YSYNDFSLATVGRGLRKRDYTKYLSRANNWQNLYKPDQQSLINGTDTGFVGFFQPKYLNGTWGYQDPIACSALASWCSLTSNPSETFESSVWEYQLYVTPSQTEATVNKEPQLRSSRHGHPNPPPRRAGHLHLPPRLLPHLRPSRHRQRACLPNRLPIPLRRPAGPLRRACSHLHPLRLQRLHSRPPRQRRLGRHGRLHRLHDDGPLPQPRAERVPYHPPVLRSREYHSPRDKQDRNDPECQFR

SEQ ID NO: 31593 - protein, 229 aa, A.fumigatus
HPIPPRPLSPASGNTNCTLPPPRPKPPLTRNRSYVPHDMATLIHLLGGPDTFISRLDFFHTSGLADIGNEPVFLTVFQYHYAGRPALSAARAHTYIPSAFNASTAGLPGNDDSGAMGAFTVFTMMGLFPNPGQNVYLIIPPFFEAVSITHPVTNKTATIRNVNFDSSYRRIYIQSARLNGEPYTKNWIGHEFFTEGWTLELTLGEEESDWGTGVGDLPPSLGESMHLWT

SEQ ID NO: 31594 - protein, 413 aa, A.fumigatus
LSARRAYDVVVIGGGHAGSEASAAAARSGARTALVTPSLSNIGVCSCNPSFGGIGKGTMIREIDAMDGVAGRIIDKAGIMFRILNRSKGPAVWGPRAQIDRDLYKRYMQEELLATEGLSIVEGKVADIVVSKEGVENIPGSQGKIVGVRLESGEVIPTGRVVITTGTFLGGEIHIGLEAYPSGRMGEAATFGLSKSLREAGFQLGRLKTGTPPRLDMKTIDFAPLEVQRGDSPPQPFSYLNTTVDVGDEGQLTCWMTHTNEASHEIVRANLDKSIHIRETVRGPRYCPSLESKIIRFTDKKQHQIWLEPEGCAPNEVIYPNGISMTIPADAQYALLRTVRGLENVRMLQSGYGVEYDYIDPRNLRPTLETKLISGLLLAGHIYGTPGYEESAGTEIIAGTKPPSVLPPKKGGA

SEQ ID NO: 31595 - protein, 68 aa, A.fumigatus
FARSLGAGLFFHAPQAFTSVFYLLYLRADRIKEYSVKFIDLLPPIRTQNILCWRSCREEASHHEGLLV

SEQ ID NO: 31596 - protein, 97 aa, A.fumigatus
ARGPHTAGPLDRLRMRNMIPALSMIRPATPSMASISRIIVPFPIPPKLGLHEQTPMFESEGVTNAVRAPDRAAAAEASEPAWPPPITTTSYALRAES

SEQ ID NO: 31597 - protein, 135 aa, A.fumigatus
GDQREPHDSGRPVTVDYLASIGVQYYHFPSLESVNELAKERGYKNRDEIVVSPQAMGDVYEEKVKMFFNEHLHEDEEIRYIRDGEGYFDVRGQEDEWVRIKLAKDDLIILPAGIYHRFTTDDKNVGFHELIQSTL

SEQ ID NO: 31598 - protein, 77 aa, A.fumigatus
EGRCEITDHLFSLVRKPNICGDAVRMGQDGTTLSEQKYHHHEDLVPLPTSSTLFMQPTYCTWDDNLYGIHSVDFVSL

SEQ ID NO: 31599 - protein, 71 aa, A.fumigatus
PRTPLQCHCQEMKRLLPVYLPNRLPIAPYQRTSKTCLISRHRLFLVGSKRPNNIHYSGSVGENSRDSKAKD

SEQ ID NO: 31600 - protein, 189 aa, A.fumigatus
LLYVQSKPPSQSESVESPEKGRNRWIQADCCAQEMIADLKADSARWEADVMRRADQGYPRGSYIHDYNVRQAPNVVPAPYAASSIHEVRHQGSPSPPQPPSQPYVDPYTQAPYGATQSPPYTAPSSYPSSHSPFAAGQNPYPPQVPYSAPGQPPVSADMHPSYTYTNNTGYPYENGRSNAPRYTGPGYD

SEQ ID NO: 31601 - protein, 135 aa, A.fumigatus
YSSLGLRLTISLHTQLVAMMMPFLQVMTFILPGAIATTAATSIPATLNITVVGARNNQSILECWSLEPGFESSTQPGIAGSASLSLGPVGGNATYTIVPAQFDGGIHNAPVRQYVSLPVYPTHVVHKNNVGAERC

SEQ ID NO: 31602 - protein, 161 aa, A.fumigatus
MVSRTMVRSPVWKHDSSIPLSFVLSDCVRTVDNVTPEVICCTAALGFPGTRDPIRTSSSSSASTSISSEALARKSSPKDGSPVSSSSTSSSTPASDRISMSLSASFFCFRCRVSFFSTGFFASSSPSSESSSLSATVVSALVSCISTSVYRQRLESTRRGH

SEQ ID NO: 31603 - protein, 67 aa, A.fumigatus
SSAYETRRVVNYLIMTSSANTTDLHDWNDKYLTDPFPGIETNQPSEINLRRFASTLIQHSMRWFLIP

SEQ ID NO: 31604 - protein, 402 aa, A.fumigatus
TDVEMQDTRADTTVADSEEDSEDGDDDAKKPVEKKETRQRKQKKDADSDIEMRSEAGVEEDVEEDETGEPSFGELLRANASEEIDVEAELEDDVRIGSLVPGKPSAAVQQITSGVTLSTVLTQSLKTNDNGMLESCFHTGDLTIVRETIQRLDSSLAATLLQKLAERLSSRPGRYGHLLVWVQWTCVAHGGALAGKPELLKRMSTLFKVMDQRSSSLSSLLLLKGKLDMLHAQLGLRQSLRSGAEGMDSEDEDNVIYVEGQEELEDEDSDADTAKNAVTPRTKSIRDQTYDEDESMIDGDQSGRDESDDEEDDGSDEEEENEEDVFDVEAEESVGSSDAEESLDDEDDEEDDDAESAGSMADFIADTEDDESDEDALSAQPPPSKKAKFGGSGGKEKKSGRR

SEQ ID NO: 31605 - protein, 319 aa, A.fumigatus
RKGGNTILGEAGAAGEVATAGEPSDEDNFNVGIDFDAGGTTKNSSQLGTSVKRQGGHALAGDQDRNNATENRAESCLESASNEGGKIAKETCGHADGDIGLESERKPEENNSLELSAERAAGAGEPGDESGTNFNIKGNGGTALGAGLEGGLNVGVETGGNAGFEEGGERSLSAGGEDASLLNQGDDGSTGRDRCQTIAGQRPNGDDVGTNLTLQPSQHGNLQRSGQGAFGTGEPGFQGGLHIGGEVDEDTAASTKAETSPNLGIESSLNRRREECGQRSLGGSAQDNICGDLGGGEDTLNGNKKVALGGDVSASGDQH

SEQ ID NO: 31606 - protein, 304 aa, A.fumigatus
YSQAETMTVLVTVITLGPLEGTAVGAAVMVAAPLVTAPVLVAMGTTVSETKVSQGVSAASGPAGESPEGAGTASETMGGTLPFDAPLGEAPEGTEPLGTLGAGTLAASEGEAPLGTGTGTLGTEPEGTEPLGMPEGVGTETEGTPVAEPVGVEGRVGIRSLVKLEPLGRWPQPVSHPMRIISMLESISMPAAPPRIAASWARASRDREAMLSPEIRIEITPRKTEPRVASRVPVMKEVRSPRRPVDTLTETSASRANESQKRTIALSSAPSEQLELVSQATRAVRTSTSRETAAPPLAQASRAA

SEQ ID NO: 31607 - protein, 195 aa, A.fumigatus
ALAERMPVSSTRATTEAPAEIVARPLLGRDPMAMTSAPTLPSNQANTATFREADRVHSELASQAFRAACTSAARSTKTPPPAQRLRPALTLASRAVSTDAERNADREAWAEALRTTFAATSAEEKIPSMVTKRSPLAAMSAQVGISTDSPAQTSAERVTEASPSHHSRREALMDASRKAAASARSQAASSALAAA

SEQ ID NO: 31608 - protein, 630 aa, A.fumigatus
YLPRHSFNISYCAPTMRSNKLFLLASLVSYVLALPTDVETRHLKLGADLDIGDLSIGAGISIDGGLDLSALINAILGGHASTTTLLAGLSAQAAAALQGGVLGCKAGAIHAAARAELAAWLRAEAAAFLDASIKASLLEWCEGDASVTLSADVCAGLSVLIPTCADIAAKGDLFVTIEGIFSSAEVAANVVLSASAQASLSAFLSASVETALDAKVRAGLSLCAGGGVFVDLAADVQAALKAWLASSECTLSASLKVAVLAWLEGKVGADVIAIGSLPSNGLATISAGASVVALVEETGILSASAQASLAAFLEAGISAGLDAHVQAALEACAKGGAAVSLDVEVRTALVAWLTSSSCSLGAELKAIVLFWLSFALEADVSVSVSTGLLGDLTSFITGTLEATLGSVFRGVISILISGESMASLSLDARAQLAAILGGAAGIEIDSNIEIILIGWLTGCGHLPSGSSFTKDRIPTLPSTPTGSATGVPSVSVPTPSGIPSGSVPSGSVPNVPVPVPSGASPSDAANVPAPSVPSGSVPSGASPSGASNGNVPPIVSEAVPAPSGDSPAGPDAAETPCETLVSETVVPIATKTGAVTNGAATITAAPTAVPSKGPKVITVTKTVIVSACEY

SEQ ID NO: 31609 - protein, 70 aa, A.fumigatus
VLRQPLPCREAYLVARPVRFMPPPELNWPPGFVLRPPPSSMHPSRLPFSSGVKVTPPSPFPPMSAPDCQC

SEQ ID NO: 31610 - protein, 159 aa, A.fumigatus
RLPCWLGWRVRLVPTSSPLGLCPAMVWQRSLPVLPSSPWLRRLASSPPALRLLSPPSSKPAFPPVSTPTFRPPSRPAPRAVPPFPLMLKFVPLSSPGSPAPAARSALSSRLLFSSGFRSLSRPMSPSACPQVSLAILPPSLLALSRQLSALFSVALFRS

SEQ ID NO: 31611 - protein, 200 aa, A.fumigatus
SPARAWPPCLLTLVPSWLLFLVVPPASKSIPTLKLSSSDGSPAVATSPAAPASPRIVFPPFLQLPPALPPVFLLSLCPLLPASPAAPFPPAPSLTCPSPSPAVLPPLMPPTFLPPASPAAPFLLVPPLAEHQTAMFPPLFPRQSLLPPVILLLALTPPRRLARLWFLRLLSPLLPRPGPLLTVLRPSPLPLPRCLLRVPR

SEQ ID NO: 31612 - protein, 270 aa, A.fumigatus
  UNSURE (141),(147),(203),(217),(259): Identity of amino acid sequences at the above locations are unknown.
ENVDVWSLGIILYALLAGELPFDEYDYQVTNKKILTEEPVFNDKFPDDAKALINLLLSKRPLIRPSLADILAHPFLAEHAPEQQAILKIARPAPFSTPLERTTLQRMKSAGVNVDEVMESVLAQRCDPLAGWWALLIEKEXRKEVRXERKRREREAEAKNLRRLSAASSRLEKISAALLEVDEEGHASPSTLLQERRKRDRRXSSSQLAVPEFAMLXEPVPVQPLDLNTPVAPPPPPPTDKDSVRSGSSTKTSAKYSPXRQYATAKHPAC

SEQ ID NO: 31613 - protein, 117 aa, A.fumigatus
PCAKQRLLLQPSSFISATAPAAEYWLSEPSQFSISVSNHAKGLVQTILHGATRSQIHLVLCILHTKHSSYAHSLQGVFCFLKQHWIRIDPDGSAFEIPTCVDKSSPYDTQCLRTLSE

SEQ ID NO: 31614 - protein, 277 aa, A.fumigatus
  UNSURE (19): Identity of amino acid sequences at the above locations are unknown.
QGLGPIWQLNQDVGQVLPXKTIRDREAPCMLVRSHPDLAQHNGILRRRTGRRQYPIISQLASLKHWLMESAKRAKSPHPKSAGGGHRKFFSDRLSPGKGQEVGKKPAPTSPNIPPAGDLATPTQIKRASNASSLAPSSASYSNHRHSYPRQPRPLSTGYPSHRNSLSPSPITPRGSYRRSSTGLRGRKSTSSSVSSIRSIHHTHTHSKASSVSSNSIGSASTPTARPSRSPHASIKVLPTTPSASARFPSNIRLVRNAGNGFRDTHDANGRMQSVFN

SEQ ID NO: 31615 - protein, 140 aa, A.fumigatus
SPHRVTFQPRRCKNVTMFFESVCFPTIVALGIRGLGRHYKRGSGFIVGGVCGGAVVPPLLGHVADMHNSTGFAMIVPTMFMVAAWTYAVAVNFVPAYRDTVDKVGDSQIGLTEGGGAGVMKDIEARGMEKSAEGSVQIEH

SEQ ID NO: 31616 - protein, 442 aa, A.fumigatus
EFSYFRTEVLQLDQIAQRLGFPSVVPVIDGSIDDGPASPVLTQLSVTVLEIALARFWSHLGIRISAVIGHSLGEYAAFAVAGVISATEALYLVGRRAQLTEERCTQGSHSMLSVRASEDDIEELIAGSPDTAELAYEVCCRNTPQDTVIGGTQESIDSIRQALEKNTIKCTQLDVPFAFHTAQMDPILDSLETLATPITFKAPSIPVLSPLLGSVVFDRKSIHAQYLRRATRETVDFVAAIEAAQDFGLVDAKTIWIDVGPHPICAGLVRGIDSSASVISSCRRNEDNLATMSKSLVTLHLAGLTPCWAEYFRPREQEYSLLKLPTYSWNETDYWIPYIGTWTLDKALLKYGEKKAPLSLSMSRPSALRTSLVHQITTETVEATTATLHVLSDMQHPDFLEALHGHRMNNCGVATSVCHLFYTLRTSGVYACKQSCHCLGHS

SEQ ID NO: 31617 - protein, 65 aa, A.fumigatus
TLRLAAWCYRCRLLIATGDIINMILWLLPGSLDWGRHFRQRIVLIVRVLNYSIKGHFVKGMYLAL

SEQ ID NO: 31618 - protein, 444 aa, A.fumigatus
WLWWINVGSVMTEIGLAQQRLFDDAPHSAIREAQTAACGNQPDNCSALAESSVPLNMAVSNYDDYNHHEGSPVALQLGSFDTPTSQDMALLNGKNHGHGYSNNDITGFYGDHIRQVGPLNCSSTHDLAQSSTSYNFFESSLNQAAQLNDDLQSHLRSSGTVQTEAIHKTPGRSHSMQATSYSPHDTEPISSLVTPKVNRVQSDSTYRFAPSQSQRSECDELAAPVTVEIPAVKLKRGRKRKQDIPEGDEDDELAPSNDRAIPEGGETVKRKPSRPPKVVRTLNESDDAGLANNQPKDQPVPNTEEIQDLGDTPLTPDAIESNPNANGISHVPEKDYFRVEVANGSKDNGTEVLNDQPAEISTPPAKPSKKAKEIKKKKLKRGKTTSVTLKKSYESDIEDDVIWVDERPSNHILQDEQPAQKPSNDQTSVDTKDTELFHIQIPIP

SEQ ID NO: 31619 - protein, 169 aa, A.fumigatus
SLPTLVLNPISKIAEDIARAAPSGRSILVDAFAGAGGNTIAFARTGKWKRVYAIEKNPAVLQCAKHNAQVYGVADKITWFEGDCFSILKNQLKELAPYSVIFASPPWGGMFFAFSFVLAVQLSNPSCRPWVSFGRSLQSTDHGTLLPQNAAHRVLPIHKIHRPLPSSNV

SEQ ID NO: 31620 - protein, 89 aa, A.fumigatus
WTSIGTWDLTHCRSFGLPNMASNSTDEAPPEVHHYNYIGEVPWDIQKYVLPTDPRLGSSADFLVTGRNDTRYFRDTMKASGSPTTPGLV

SEQ ID NO: 31621 - protein, 134 aa, A.fumigatus
RTRSHGSRVIVSLFSRINSRNSLLIASSLQVRHGVVCSLLFPSFWPCSCLTRPVGPGYRSDEVFNLRTMEPYSLKTLHTEYSLFTKYIVLYLPRTSDVRQLAKLVRDGEKAPVVHYCMERASKALCIYYGGFDL

SEQ ID NO: 31622 - protein, 156 aa, A.fumigatus
DGAGGLSGPYADIANRACWSFHARRAAGSMSSAVGVTVPSSSKGSSSSSSIVIGSGSGASVSAGLTGTGGLVSSSSKNKSRVVSICAGPGEDGPSPKRSSSSSPPGACWSSRSPKRSSSASNNPFCSSSATAATSSVASPPVRSSSSGRSSSSMSS

SEQ ID NO: 31623 - protein, 68 aa, A.fumigatus
NSTASLLVSFPALSGGDGVFEQFASSSDFFSWSNEFSNIFGCVSQLDVFDCFPERGSIRLIGPSSASN

SEQ ID NO: 31624 - protein, 718 aa, A.fumigatus
  UNSURE (21): Identity of amino acid sequences at the above locations are unknown.
SGCSAFHLSISLLSSLESKLXCLFNLLENSSGHAWLIRCHHVCRVMPLLNRSQSSPDAGIRPLQAPDTYFSRNSRSMPVSDTSSSSYNASVKRLGYRRIRPSVASIADIFVNSLVMASFCRDHSPRNRGLSTVAVKTSLQNMARMKGKCSTTIRRLTSGKRPVPSSNSPVECFGFDRWRTRRTFNSGVVQKVKDDDHGEGYGTQKNVTGLDQRAEDLEAGRSQGYTSQSALLRSKRKPFFRDNGPSNEPHPSGSEELISNQTRGQFDALEGPINLIDPLSGKQSNTSSWETHPKMLENSLDQEKKSEEDANCSKTPSPPLKAGKDTNRDAVEFQAVQRFLEAVGDPKKTNQYIFRLYRDLPSPGVAHLSKRTRGLLLRRMSQPPNRRWADARRYLAIVEDMIAAKLPLSPALWTSAIHLAGRAMGQVKKQDLVRSIGIWQQMEHLAGIESDPVVFTILFDIAIKASQFTVADRLLEEMSKRGIEFRRAGKVSKIYYYGMLRDVNGIHRAFDEFLAAGEIVDTAVLNCLMTSFIRAGKIRIAESLYQRMMQAQAAARPAGDTNHKGVSTHQPALASELVLYRKAAKELNRAFEMAARIKNTLPAHHRALQESIPMSPDTRTFHIFLSYHAIHSGNLQAFSKIVEDMEKTFTIPPRGMIYLMLFEGFARHGRKKKGWTADKLQIAWRSYVRALYESRTKNEWRLLAFIDPALTWENPIKG

SEQ ID NO: 31625 - protein, 67 aa, A.fumigatus
KMQVLQEQSSKRGIINYSLAGESFNSSLNYSKDINCICLFSPRLLELDAVPNLAVLPSTFPSRYSLP

SEQ ID NO: 31626 - protein, 439 aa, A.fumigatus
CERAAKEQAKQEAFERAYALAGLTEELEVLKGRLRNVEANRRSDRLEARAKEMSNENIGRLSLEEGDLAFMLTPAPRRPKRPADDSTQSPLAESTDQPTAQDTPPKRLRLSDVTPRQGDQNTLSTNTQQEIIDSLEEMLKHERKMRLDAEDMIEFLRMECEFKRCSCRLAEEEEQAHLVHAPAREDVVAKDEVQNIIEERRDIRGPEAQHHSRFDNPLQGSGPTEQERPQEQPEELLITFSPVTGTFKSVPSPVRSPPKQPQGTAFSGLESSISHENLSAEQLLISPFEERHINRHEPSFDPTVQVKEDPFQPFAPGLQPSPARISVPWDSPSPRYSIEDNHNAPTGSDGALAHHSVPLPGTSIDREQALAQIRARRGKTSTLKRSVSANEATLRSGGGGVTPGRGAQRIPGVQNSAVRTDGDKAVRRDLSAPVRMLRR

SEQ ID NO: 31627 - protein, 312 aa, A.fumigatus
  UNSURE (70),(114): Identity of amino acid sequences at the above locations are unknown.
PGSVWIACSTDSVVSMKSELLKFLVTLRAPHSRNAAQKVFRKISVLLNRSAQHNASQAIYLKATQRDARXYTILRKGLHHISHDNTASGEDEDSDAASTYSSSPVVEPLSWTRXAYTSFIWWASAGEKRDGLTEEEEEERQIEQDTRLLASLEAIPTPPSGSLGRHSMQAEDASQPPEIALVSYFRRLTTQLFVTLSDVIARQDGRDGEQDADIGAPYEDESEEADAEPSISVGREVSQGDDSRRPLLPSGAKSSPEDDELVTITSEDMTEMGLDVWSASDRIFVEELVRSWWGRKAYVDTARIKCCGISII

SEQ ID NO: 31628 - protein, 107 aa, A.fumigatus
RGTFHRVVKILATVAFYFAKTRFMPRVQNDKMFRWDYDYVEYGDSALDYGYGPASFEGEFNLDSDEWTVGSSSSISSGSLSPVDDHYSWEGETLASPATDIESGRHF

SEQ ID NO: 31629 - protein, 69 aa, A.fumigatus
  UNSURE (6): Identity of amino acid sequences at the above locations are unknown.
SEKSFXMRTTYPVLGPKIHHEVHVQNCQASMAKSDLAYLNTFRRLQVLPRINQTTVRLEPSFKLRPFRK

SEQ ID NO: 31630 - protein, 129 aa, A.fumigatus
PSMSGSILALTLYLFKGYWMPYEAAKAVAATFCWKIRHALTPLFGLDFPSMCIHPQDRGRFGRMVIDPAIVRKATETANYYRILELQSPSYSSLHLTRTGGKFRPNSTGSSGFVKRLIPRSHEHRYSGE

SEQ ID NO: 31631 - protein, 187 aa, A.fumigatus
NAVYMASIASLLNPLPGPSQLSSPTRTLASSAASMASNTPRPKRPKVAKDAAIFTKAKPRGEVRYPPCEERDEELARMHREFRIHPMGDISEYARHIPYNSDKKSFQERTGRESFEGESHSEQHTTYPRGVYAYKISIVFQYTFKLPGDEKEWIVMWDYNIGLVRTTHLFKCNDYSKVYSTTSAASS

SEQ ID NO: 31632 - protein, 203 aa, A.fumigatus
SDSYPDLMSTDTQESRTGYGSSSPECHGDVYCVSPVSPFRNSFTPVNTPRSSEVIGSKLLSPRAIAATTAPMPDREHTAGSEEDSGSDETGSSTMYTESTSTTTEVLSVDLDADDDDDDEDYREKSDRSDRGSVNSSIPDHNRKIETRSRGKHSSALFAREVKAAHALLSLHMQEAMGSDGDEEPLLMASRGLNSRKRRRASA

SEQ ID NO: 31633 - protein, 126 aa, A.fumigatus
VTASQLINFSVVTFTYTRFRKAMIAQGIPRESLPYKSWWQPYTAYVALVSTTVMTFVGGYTVFLPGNWDIPTFLFSYTMIGVFPVLYFGWKIVHRTQVKKPEEVDLLTGLDEIDEYERHYVPEKPR

SEQ ID NO: 31634 - protein, 105 aa, A.fumigatus
SVLNTGCLLGLAEMVIYLPISSPFIRFAGRYVDEAFGVAAGYNFFVFEAALVPFEITACNMIINYWSDVIPVSGVIVIVLVLYMYVTSSERQKALPIWSRLNIDF

SEQ ID NO: 31635 - protein, 273 aa, A.fumigatus
IDRLLNVFAVQWYGESEFWLALSKVLLSIGLILFTFIVMLGGNPKGDRFGFRYWNEPGAFAEYYKTGDLGRWLGFLACLIQASFTIAGPDYVSMAAGEAANPRGVLPRTYNVILYRLTAFFLLGVLCIGILVPYNDRTLAEAFAKGLPGAAASPYVVAMDRLGILILPHIVDAMLLLAAFSAGNSYVYCASRSFYGLVVVGKAPRLFTKCTKRGVPIYCVTVVMLIALLAFLQVSNSASVVLDWFVNLVRADSETSITLTSISKKTKSLTVGR

SEQ ID NO: 31636 - protein, 120 aa, A.fumigatus
IMSRPDPDTSVHQTSLPTAISSDRSSHLADDFNLATANLTKRNGCPITYSEKATVVEDGEESIGGTLSKPTFDHTHRKLKPRHIQLIGIGGTIGTALYVQVGKSLMKGGPGSLFLAFSIW

SEQ ID NO: 31637 - protein, 142 aa, A.fumigatus
VSLYSAPVSWHSALYTPPMHSTRQIYLPTEIVVQIVRFVATDEAHRQEALYACCLVSRQWYSAAVSLLYEKPRLHIGNSFQQFVSTCSGVGGRRNKLNLGSFVRRLDLSRLVHHSSNSVTARLLGRVKENLEVFVAPRVSFA

SEQ ID NO: 31638 - protein, 266 aa, A.fumigatus
  UNSURE (200),(255),(256),(263),(264): Identity of amino acid sequences at the above locations are unknown.
PSIDGVLLRSSKPIPGAAESLALLKDQGIPFILLTNGGGKHETERVAEISEKLKVPLDASVIIQSHSPFAELVKGPDEHSSLEDKRVLVVGGDGDGCRRVAEQYGFKNVLTPGDIFMANPSIWPFSKGFKDYYEKFARPIPNPLDPRDPTRRLKIDAIFVFNDSRDWGLDAHLIIDLLLSSQGVLGTISDKNGRADLPNXGFLQDGQPHLYFSNPHLWWAAAYHLPRLGQGGFREALESNCGANYRRAIKCVKLXXKIFGNHXXEL

SEQ ID NO: 31639 - protein, 95 aa, A.fumigatus
ISNIFRSDHQAIQASQAMSERGSFRGGRSRGGGHDRSGGRGGGHSSQHRGGGAGGGAQQQQEKPKKENILDLSKYMDKEVKVKFNGGREGEFVTN

SEQ ID NO: 31640 - protein, 86 aa, A.fumigatus
SLMEDERVSLSPTDCASCLLKSILVSGMLKGYDQLMNLVLDDVKESMRGKSLNDITKLDEVSNSAIQMMKEMKLPAPLVSSSPAAL

SEQ ID NO: 31641 - protein, 140 aa, A.fumigatus
QICFCSDAYRNEDYDRKILEEMGELGLLGASIEGYGCAGASTVASGLITKEVERVDSGYRSGMSVQSSLAMTGINEFGTQEQKDRFLPQLAKGKLAGCFGLTEPNHGSDPGSMETTAREHPTKKGYYLSSSRRWQDPRLG

SEQ ID NO: 31642 - protein, 140 aa, A.fumigatus
NRYSVLICFGLLHSPSLLSRCFLSFLSVMNRSIFRAASRHLRSANRLYKAPVVSHNTSVRAYSTVFNWEDPLAASELYTDEELAIRDTARQYCQERLLPRVLGKPYFGTICENSADRFAFVQMPIETKTMTVKSWRKWGS

SEQ ID NO: 31643 - protein, 72 aa, A.fumigatus
FRRRDDYPGSSRRFTTYYDMLSENRVARYSTRHSGSGWLDRMVFQMHWDLDFTGVSFTEFLDMGFTMVVTRF

SEQ ID NO: 31644 - protein, 191 aa, A.fumigatus
QAIQAAGATSLLFVYSLDYARTRLANDAKSAKGGGERQFNGLIDVYRKTLASDGIAGLYRGFGPSVLGIVVYRGLYFGMYDSIKPVVLVGSLEGSFLASFLLGWTVTTGAGIASYPLDTIRRRMMMTSGEAVKYKSSLDAARQIIAKEGVKSLFKGAGANILRGVAGAGVLSIYDQVQLILFGKKFKGGSG

SEQ ID NO: 31645 - protein, 291 aa, A.fumigatus
RRSALLSINTRNSSPVEIAGILDYNTHLNMTTTAPPDATAPSTSSEQDEPAPSETASVSATATALPYSPVHATAQAQPGGTTVMPARSGSDGPPLPTPTKSIATPATKTSTSPPPPQPGARPDPGIPAPTTLPVLAASSAPAPVPSPGPAPQAQPEPPPTPSATATGATTTTTPANPMPGHGYGYSPAAGRYSSEFTHPAQGQQFHPRAHPHAQPHPNSTSTPYASLYQPPDTSSQLPLYQTQGPGADEFDSAHGDGGFLASAKSWMASAGTKLAEVEAEVWKRINEAHDK

SEQ ID NO: 31646 - protein, 405 aa, A.fumigatus
RPAFLGSNVVYDCPNSKLMEQKKFIKYGLTQSALESHVPLIEKEVLDYLRDSPNFQGSSGRMDISAAMAEITIFTAARALQGQEVRSKLTAEFADLYHDLDKGFTPINFMLPWAPLPHNKKRDAAHARMRSIYVDIINQRRLDGDKDSQKSDMIWNLMNCTYKNGQQVPDKEIAHMMITLLMAGQHSSSSISAWIMLRLASQPKVLEELYQEQLANLGPAGPDGSLPPLQYKDLDKLPFHQHVIRETLRIHSSIHSIMRKVKSPLPVPGTPYMIPPGRVLLASPGVTALSDEHFPNAGCWDPHRWENQATKEQENDEVVDYGYGAVSKGTSSPYLPFGAGRHRCIGEKFAYVNLGVILATIVRHLRLFNVDGKKGVPETDYSSLFSGPMKPSIIGWEKRSKNTSK

SEQ ID NO: 31647 - protein, 351 aa, A.fumigatus
STPTGPPMNPNPGTMSPVSVDGSDWSGINQYQKSDPPFSPTSSTRNNLATPPTSGTPSGLGPNNAGAPNGSTNGVSDPGNPSPPSSVAARSSSGTLAEDRSKRTKQMEEVLGQHYFALRRFLNASYRDERANSKSNKARDKLLRLSATQFQELSTDVYDELLRRQQAMPSPGRPGPPRPDVPPFLPPREDFHEKRNQARQKLASLQHQRFRDLATDVFCELERRFPQFPARESRRASPAPSLRGRPSNGYPPNGFGPNGYPPPPGSRRSQSRGPPNRMGRGYPSGGPPGSPMGGYPPRQGSLGGPPSVNGDVGPQAKSFQSNTIVPNKSIMVEDDDDLHHEAAGIRAKNGG

SEQ ID NO: 31648 - protein, 94 aa, A.fumigatus
LRTSSANWNDASPSFRHGNLAEPAPPPACVDAHQMATLQMVSVLTVILRLPAVGALSLEALQTAWEGAIPPAVLQAVQWVGILPAKGPWAGRRR

SEQ ID NO: 31649 - protein, 245 aa, A.fumigatus
VVVDDKRDLLNVDTTSPNVGRDEDTRVALAEVLHDTVTLLLGHFAVHAGYCEVGFAHLISKPVDLPAGVAEDHGLRDGQGIVEVAKGIELPLFFLNSDEVLFDAFQGQLVTLDQNADGVSHEFRRHVQDVIGESGGNDNDLCSGREVAVDVVDLFTKTAVQKFVSLIKNQHLDMPGAQVASTDHVRNSTRCTRNNVLAIVQLSNVLANICASNASVALYIHVISQGHNDRLNLSRKFASRRKDQS

SEQ ID NO: 31650 - protein, 174 aa, A.fumigatus
ALRRVLSRDSSSGTRAANSSCAHKLSHLQTKISQADRILYKLPGTDKMADGIDRRTDGMRIMELFEEIWANGANSDRLEFSTSKEVTVAPTFEDMHLKESLLRGIYAYGYESPSAVQSRAIVQICKGRDTIAQAQSGTGKTATFSISILQVIDTVVRETQGMSLNTPPVLVKRS

SEQ ID NO: 31651 - protein, 286 aa, A.fumigatus
  UNSURE (285): Identity of amino acid sequences at the above locations are unknown.
LVSALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSVFVRMLXD

SEQ ID NO: 31652 - protein, 133 aa, A.fumigatus
  UNSURE (19),(37): Identity of amino acid sequences at the above locations are unknown.
CSKCNTSAATPTTSRKQHXSVEPSSTSLQSTSAAARXCPSTPSDTKPAPATVAAGSATRPAAPPAATAATAAAAPATAITTGATARPAATNDPSGSSNEGPADSESSRHNDAAEDGHERHFDSGLAHFCGALE

SEQ ID NO: 31653 - protein, 268 aa, A.fumigatus
  UNSURE (115),(133): Identity of amino acid sequences at the above locations are unknown.
RLLNKPQCKRIRGMRPVNVQMHLQQMLHGHQNIQQQQQQFFVMQQAQQALQAHQAQQAQQAQQDQQAAAAAAAAAAQPGQHTPQQRHAAHPQNMHDAQSVTPQPQPPPHQGSSTXQSNHPQPPSSQPQQQPGXAPQPHLTPNPPPQQLPQAQQPGQQPHQQPQQPPQQQPQQQQSQQGQPQGQQQQMTPQEAQMKAQQTQNQAAIMMQQRMGMKGTSILALLTFAEHLSNFTVRRTLSQHANAYRDCANLITEPRRGSGFAVLASICR

SEQ ID NO: 31654 - protein, 129 aa, A.fumigatus
QSRGEAQDLLYWQAFVDKFYSPVGVLRQGVYNPQAGSKQFEISTPALARYYLTQFTSGIRQIQMLVEGARERDSPNGGRIVESRRTSFIYWFTNESQVRLLFVRLDVRHFANFPKAIHQRDTYRSLRSQ

SEQ ID NO: 31655 - protein, 179 aa, A.fumigatus
  UNSURE (89),(107): Identity of amino acid sequences at the above locations are unknown.
ARPESKCLSCPSSAASLWRLDSESAGPSFELPEGSFVAAGLAVAPVVIAVAGAAAAVAAVAAGGAAGRVAEPAATVAGAGLVSDGVEGXHLAAAEVDWREVEDGSTXGCCFLDVVGVAAEVLHFEHHAYSGDVLHDAAAVYADPVAPRLQRRPLRLVDLAGLVGLAAPDVPVALVGPAA

SEQ ID NO: 31656 - protein, 98 aa, A.fumigatus
LLLGDKQPADRISTNSGFTASYAIIIIQITGQNSADLLVYIIHSITQKSPFSDYIIPASMLGMPEQGNICRCLLLGLSITLTPVGQCWRADAPVFTTE

SEQ ID NO: 31657 - protein, 83 aa, A.fumigatus
DDPSQMAAMLSYLGVTSHDSRMLGIENRNMEGQIPLIPTFLGFSYALDEHTIEIDDETLLDSNLVYQPPVFPTHGCSTSGQTG

SEQ ID NO: 31658 - protein, 110 aa, A.fumigatus
AVLFALCVTRSVSATLFVNFTNYAAEDCAIRYGSSMLVPTYCVNIEDFPIKSYGASVSSGECDDSSTSPVLNVFTEAGCNTGLFNTVALSTEPICINDETTVLSVSVACV

SEQ ID NO: 31659 - protein, 61 aa, A.fumigatus
DDCVKCQRGLRLSLKLWGAGLQSSFLTAQSHVYIEAFKQYPKDLQSRTTDLNMDTEFLPRL

SEQ ID NO: 31660 - protein, 138 aa, A.fumigatus
  UNSURE (3): Identity of amino acid sequences at the above locations are unknown.
IAXINFFKDWGISPSAVVVNSSGEVIAAYAANALSLRTAIIFAYLRGRCVSKVYLQAAWWPLGWMKRLSSLFFPKGWLSRASIAPRALTSLGTRQGWPRWLTGSRRTSQKPLYDIFQYLWRTIRVSLTLFLSPFVTSQ

SEQ ID NO: 31661 - protein, 168 aa, A.fumigatus
LMKLTADLQPAAAILKSEVAPFLQHNESMLPMYSTVTGKAIPNPAALDAEHWQKNLELPVLFSTAVDGVLAERPERRKIFLEIGTHSILSGPLRQIFTYKSSDCVYLPTLIKSESETFCLLKTAGQLYLHGHPVDFQAVNGNGHIVTNLPAYPWDRKRVNWQGKPFKP

SEQ ID NO: 31662 - protein, 617 aa, A.fumigatus
TGRESRLSHNWRFRVYPNHELLGSRMLEASDLEPGWRNVLESRHVPWLSDHRVSGEVVFPCAGYIAMIHEAMRQLSNNNECTIQNLSMQVPLIVPRVEPIEILTTAKRIRVNDRVESDWFEFAIMSYNGTEWIRHAFGRAKSGVDKVDSEPRVPRDFPRRVSSELWYRTLEKVGLSYGPTFRGLQEITADPSRHVAAASMRGRQDSKAVHPTVIDECLQLFTVAACKGRAVNMTRLYVPVFVGEVQLGLGQEIMRAEATISNWTAELGSGNVRLIAMDQQDASIKRVLSMAGVTVAPLDSNIRAVSEADFPLASHAEWRPDIDLLNEQRLTRHYSQSTEAGFALIAKLSALSVIQVHRRIADVTPFSPSLAKYQKFISTQIAEIQGGSFCGVPEAASWLKFSDESLQRQRAALDEGLRTSKLACVSSLSNWIVETVRNVIDGSLLPSDFPAAIQEQIWQCESLVASMTDLSHWFGLLRHSNPLLRILHIAEGKGVVSHQVLEHLDSEDLPFYSKYTYTSTNDISPAVQEHLKEYKEVNFKSLDITKDPRQQGFEEGAHDLIIVSNFCDVDFSAIWHSRLLTAFPDERSTFSVANCSSKHQNAPCAGRPSSASYTKCR

SEQ ID NO: 31663 - protein, 194 aa, A.fumigatus
  UNSURE (2): Identity of amino acid sequences at the above locations are unknown.
CXDQLFQGLGNLPISRCSQLERRGDCGVCGERPFTSYGYHLRIPAWTMRVQGLSSGGMVAIGLDEASLKPILSEGVVVACVNSPQSVNLSGDKTRLAAVVDRIKADKPETFIRYIPVPVAYHSRELNPVFVTFCYLAIANEINSRSATSGSHSQVRSCPLSPAQRINAAHVLHCHRQGDTKPGCPRRRALAEKP

SEQ ID NO: 31664 - protein, 76 aa, A.fumigatus
SLRLQRVSPSFKMATEDLITLTYKERIAIITFNRPEKLNALNADLYYLLGERLREIEKRDDIFITILTGTGRYFSA

SEQ ID NO: 31665 - protein, 215 aa, A.fumigatus
RPISGADVNSTRPGGGLNSDTRREITRTFVVNNLDLTRTVYNHPKILVAALNGPAVGLSAALVAFADFVYAAPHTFLLTPFSSLGLVAEGGASRAFVERLGISKANEALIMSKRITCEELVATGFVNKVISAPSGKPDDSEGFLKKVLEEVEDRLGTHLNQSSLLKIKELIRRPERELLDRQNTYEVFAGMERFVKGYPQEEFRKLASGEKRHKL

SEQ ID NO: 31666 - protein, 157 aa, A.fumigatus
IPEAAPACVGYRTSTLGRNRTDPLLFSCLEILQMKNPIGIKEEDTDAPEESFVRLSLNGATPTVVEVNRDEDSESEKDVGSADDGDDSPFLPEFRLVKRDDPEAYSFSTPQYSAHKLPKEVVDASLAGSGGMSEFLGKWQDILAKQTQEDTDSDDGR

SEQ ID NO: 31667 - protein, 277 aa, A.fumigatus
PVTTMTLFTTNHQTAFAMSSHQYTLPGMHDVPETYPYHMRVDSEEDMDSLYLSSAPEPSYTRLDFEPTIPAMPTSQAYNTTMRAPMSGSYLPYSDQWTSQVPPTAAAAPTTTLYHPTDIYPSSTMTYTPQRTAPTALNPNPQTYFYPDPSTNTNLDLDLKLPSSDLDTKDLTNYGIPNPDGSWSCAYPGCTSTATFHRGCDLRKHFNRHRKHLFCRHEGCPQAVTGGFSSKKDRSRHEAKHNPGVVCEWPDCGRVFSRVDNMKDHVRRIHKRGEVYS

SEQ ID NO: 31668 - protein, 83 aa, A.fumigatus
SLVWFCLFTPTIGMLILFIRVNKSNPDLTNTIVISLAEVSKHPSIQSYYLLSITVVRQDLKSNLLLTYIINQGTVVLGWIVRR

SEQ ID NO: 31669 - protein, 348 aa, A.fumigatus
  UNSURE (124),(290): Identity of amino acid sequences at the above locations are unknown.
IDRGSFQPRGEDPPLSLWHGFMPTFTTTSSNPGLDHRLSSPILEHYVYPTFIAVAWCNAIDLIVLCFNTFKRYSGPYFWSLLVSSFCIIPFGLGYVLKIYSITFTNYFLEIAILDAGWSGMVTXQSLVLWSRLNLVLDNRRVLKALLYLIIVDGAVLHTACTALEFATNALPSNGVAIAFDVMERVQLVGFCLQELLLSGLYIYKAVPLLKMDADRRSRGVLVQLIVINAVIMALDVSVVIVQYLGLFTLQVTSKALVYSIKLKLEYVILGRLVDVSRVRSPAAARMRLXFVIFLVYIYRFLLVHIILSIYNIVYIRLSTPTSRSWSSCSSTSSSETPSHSLKRKRAP

SEQ ID NO: 31670 - protein, 179 aa, A.fumigatus
NAKERRNPGLRRQYRSCYSQRGKTYISPRVIPLLQVKRPRIVRPSRILTELTSRRIPINQISRLLSQERSHVLPTRLSQRRTKSHQLRRVTAHLHIPEDLTQQPANQVRERIEVVQPVAPERLHLRKGHHHAAEADQPRADQHGVHHRREVLVGRVRCDPLSDRRVQELVEDHLQIHVS

SEQ ID NO: 31671 - protein, 233 aa, A.fumigatus
RSAYNIIRFLRKLVDGGQAVLCTIHQPSAVLFEAFDSLLLLARGGKMAYFGETGKDSQTVLDYFARHGAPCPPDENPAEHIVEVIQGNTDKPIDWVQVWNESEEKQRALAQLQTLNARGKADADYVEDTADYATSKWFQFTMVTKRLMVQLWRSPDYVWNKVILHVFAALFSGFTFWKIGDGTFDLQLRLFAIFNFIFVAPGCINQMQPFFLHNRDIFEAREKKVLSYPLYTP

SEQ ID NO: 31672 - protein, 63 aa, A.fumigatus
PEGAVLLLERCKSSPVASNKTDTDGVDRDYGALLRFKLCDGVSDDEVEEQEDQEREVGVDNLI

SEQ ID NO: 31673 - protein, 214 aa, A.fumigatus
SKIYHWLAFIGAQTVSEIPYLILCATLYFACWYFTAGFPTTASISGHMYLQMIFYEFLYTSIGQGIAAYAPNEYFAAVMNPVLIGAGLVSFCGVVVPFSQMQPFWRDWLYYLDPFTYLVGGLLGEVLWDVEVRCDPSELVRFRAPLGQTCGEYMAAFLAEKPGYLVDGNATACEFCQYSTGADYARTFNLKERYYSWRDVSLPPLRVTRPILTA

SEQ ID NO: 31674 - protein, 78 aa, A.fumigatus
AACAFVGLMVHSPSPIRHAFYETFLHLHIAMAIVSMVGLWIHLDGLPAQTYLLVAIIFWGVEVGHRNPFPVKLEQARS

SEQ ID NO: 31675 - protein, 294 aa, A.fumigatus
LCPQRATRVAIIVYRNCGRRATTAVVEAMPGEAMRITLKMARPWTFKPGQHIYLYIPSIGLWTSHPFSVGWSESEEVVTDEKGMPMTRQDVFGMQKTTVSLLVRRRTGFTNKLYQRALSAPDSRVTLKAFAEGPYGGIHSMDSYGTVVLFAGGVGITHQVPFVRHLVKGYAEGTVAARRVTLVWIIQSPEHLEWIRPWMTSILAMDRRREVLRIMLFITRPRNTKEIQSPSATVQMFPGRPNIDTLIGMEVENQIGAMGVLVCGNGSLSDDVRRVCRKRQDQTNVDFVEESFTW

SEQ ID NO: 31676 - protein, 137 aa, A.fumigatus
LSYALKYSSSRAGRDLPGSTQVFFAHQPFADPSETLDLRPWMDQTPITLNSGTTFLIVRRMFQRLGLRYVLFANKGVLQGLLTKKDVWSIIDGAESRRVEDLVTDSFRQRNTAEEVGLLESDDGTSLASSLDRRPSL

SEQ ID NO: 31677 - protein, 84 aa, A.fumigatus
LLFEAIGLVEHSENSRTATMMADPFEVRMRFTAQLQHLNASVTSSQKAAHYALKYRDMDEDLHSCILEQLERVCMSLLPYRRLL

SEQ ID NO: 31678 - protein, 214 aa, A.fumigatus
FSMFSHIVTAAKGLFARQEVDETKLDNSNTTSTSSTGPIGRNTKMVTATRRRTLETSSTASGDSKGMPTSANGKRKPESTSAVKPESQHNKRRKRSSVEAAEEQKRELSTDGVVAEPDSKRSEAQAASSKTKHFRFDSEEPELPVEMETEAPEPQQKEQDNEDSSDDDEAPEAIDNSTQMSKIRLEAKRQERARQMLVSPLPLKNFFVSNSNLQ

SEQ ID NO: 31679 - protein, 187 aa, A.fumigatus
NNMNNRANIMYFIEQFCEMATKENHTPYVRMMQRDILRVVDAVVPPDGSGAANIKHVRRVLNGLQSKDILSAETVAEIDAGLKEREAQVAHLDLDAEEEGNNGSKAKGGTPRGSRPSGMRVDKRQIEQRIEEDRERNKRLRESMWTVSGDDGDEHGKFWDEVSDIGEDDFLGAQEELMERNQMVAAQ

SEQ ID NO: 31680 - protein, 217 aa, A.fumigatus
VPFFATASDSEHLILFCFISKDPSALPKMHFSPAAILFISVLGTQAVPLAFPGLESNTLVRRQEETYSVVNVGGTSPNGVDTSSVVETQTQTVTAPSIPQAPVTVTVTDMPTSTSTPVITPSSWATPSSSSYIPSSKCLTAWPTPSPEDDHRKPPLPPRSFRRALSSTNSTGRHVFNVRSDNATVTVPISARTLLNSTIAARGGVFARALNQTGHVY

SEQ ID NO: 31681 - protein, 73 aa, A.fumigatus
LPKITFYLLTPIYVTNLFSFNTNMCRNPIDTMDNLSTENIPESKSKSVPYVRSKYTIARARRRSSNSPYGHIK

SEQ ID NO: 31682 - protein, 532 aa, A.fumigatus
ISRERVTMPGRLLSSFVRPAALHSSLLSHSNSSSTSSVNEITTTTVAPKKPHAHSDRARSPERRLSFNMDHLIHPHRDHSKEKKRSHGRSARSKERSGKEDITAAPAKLDVIVESPPLVCYGTPANSTGALFSGRLRITVSEQANAVTLDKFDMKLLTKITTKKPVSRECPNCASRTEELTSWNFLTESLTLKHGEHDFPFSYLFPGHLPACCNGSLGQVEYYLSARAHDTNGEEYTYRMPLHIKRAILPGNDKSSIRIFPPTNLTGRIVLPSVVHPIGTFPVQMTLSGVVDKGEETQTRWRLRKMMWRIEEHQKIISAACSKHAHKIGGEGKGVLHQETRIIGHKEEKDGWKTDFDTAGGEISMQFEASINPTCNPVCDLEVPNGLEVKHNLVIELIVAEEFCPNRNTRSITPTGAARVLRMQFHLHVTERSGLGISWDEEMPPVYEDVPASPPGYTMLDGNSIMEDYSGSPLSLPDYEELERMESLHLDSDSAGSVRGRSRLTTEDLTAEPMEPGSRSRGLSADSGASEH

SEQ ID NO: 31683 - protein, 62 aa, A.fumigatus
SALTAGKLSACTAYYSEGGLSLAHTSVIQKLGDSCVVLASDLFDKRAFFASSPRGCHIIGGL

SEQ ID NO: 31684 - protein, 117 aa, A.fumigatus
  UNSURE (6): Identity of amino acid sequences at the above locations are unknown.
AQPGPXRFQFGLICEHFTLERHGKVKPSLFLLWTHGLDGRKDELIPFTYVRGSGPEFWYIDLEDPRTLGAPGQKLQVAALTEFGDRKDCRGISVDEYKANVGRVRMAFSFVAEWALV

SEQ ID NO: 31685 - protein, 73 aa, A.fumigatus
IDRHRYSDDQFEYRHVQLPKNMLKKIPADYFDSSKGTLKLLWEEEWRALGITQVLRSGLRKLASISLWLILML

SEQ ID NO: 31686 - protein, 472 aa, A.fumigatus
RIPELVDHRNTMNETPTATGLPIAFHGTIIHSLSPTHLQILPNTFLLVDIAGNIQALVPNTDPSTINTLIVDNGYAPDVFPVKHLPSSSFLIPGFIDTHNHAPQWAQRGVWRGISLLDWLEKVTFAHEAKFEDAEYAKRTYSAAVDGLLRQGITTASYYASKHLAATKILAEVCRSKGQRALVGRCNMNRHAPGWYRDLNAEVSVKETREFIVWMREFNGTDDRPLVNAVITPRFAISCDEEVLSGLGALAAANPDLRIQTHFNEAQQEMEFTRQLFPDFAHEAELYTRFGLLSERSILAHCIFLREEEMETLARLRCGVAHCPVPNTTMQAFMVAPVREYLRRGIKVGLGTDSGGGHSISMLEVMKQAFVVSTARATETRGADPALSVAECFFLATLGGAQVCGLEERVGNFAVGKEFDALEIRTGEGVEMSVMAPVEEEDSIEVIFEKFLMTGDDRNIAKVYVRGRAVKD

SEQ ID NO: 31687 - protein, 80 aa, A.fumigatus
VRFVSVVLFVLTRSDFVLSAALDSGVAVATVIIFFCIMLPAGPLHWWGNIVYRKTADGMGTPLKPLPSLGYFGPPKGKWE

SEQ ID NO: 31688 - protein, 115 aa, A.fumigatus
VHPCHSKTRADRQGALGPGRNFSPGQIYGNLLWFFLAGPVVIVITFLLGRRWKRFNKISWPVAFGAMSLVPPATGINFSSWWVVNVLFNGIIKRRKPAWWSKYSESGSSLWCCLY

SEQ ID NO: 31689 - protein, 115 aa, A.fumigatus
LSRFVADMKLAHYLHIAPRTLFMAQGLATLVGAIVQCGVTVFMVTRFDNICTPDADGGFTCPHGRVTYSASLIWGKCIHATPKLVLTDKAPWVLDETFLQVKSMVTFSGSFSLDL

SEQ ID NO: 31690 - protein, 201 aa, A.fumigatus
ARALEASRESRARGRRREGEEGEEGEEEEEGEARRRARGGQLAGRVGAAGGAARAGGRVTSWREPLGQAGRRQARARAMDRRWPSDTLAGTGGDQLAGARQGPTPGRETPRRTREAPEVTSWPARARPCRHRRAARRLRGHLQRHAHGRRPRRMPAWPAGGIHPWGYADTHPSIHIYMCICTRIPPRHLHGGRSAWPTGAI

SEQ ID NO: 31691 - protein, 237 aa, A.fumigatus
TARGSPVPTRARARRPTGHLWRLPCPSGCLSTRCRSLARAGQLVTPGACECVARPASVHGARPCLPAAGLPKGLPPTGHPAARPRGAPRRANSASQLAAARSPARLPLLLLLALLALLALPSSPSRARLSARLEGARLPGPQPPSTDSPQPGPSRAPPAALLLHIPTDLARPIIVRANVPGSERRSGGRPTCAGRPRAARAAMCPSQLVTALRHQAAAARGSPARRVLNRPAGRYYL

SEQ ID NO: 31692 - protein, 300 aa, A.fumigatus
MAPVGHADLPPCRCRGGMRVHMHIYIWMDGWVSAYPHGWMPPAGHAGIRRGRRPCACRCKCPRRRRAALRCRQGRARAGQLVTSGASRVRLGVSRPGVGPWRAPANWSPPVPASVSLGQRLSMARALACRRPACPRGSRQLVTLPPARAAPPAAPTRPANWPPRARLRASPSSSSSPSSPSSPSLRRPRARDSLLASRARAYRAPSPPQPTPLNRDPRARRRRPFSYTYPPTSPGPSSCAQTFPGPNVVPGGGPPAPADRAPPVRPCAPANWSLPFVTRRRRRAGPPRAASSTARLEGTT

SEQ ID NO: 31693 - protein, 303 aa, A.fumigatus
LARWHRWAMPTYLRADVGGGCGCICTYIYGWMGGCLRIPTDGCRRRAMPASVEADGHVRVAASVPVDGARLSGADKGARAPANWSPLAPPVSVWVSLDPVSVPGARRPTGHPRCLRVCRSASVCPWRAPLPAGGRPAQGAPANWSPCRPPARRPPPRQLGQPTGRRALACAPPPPPPPRPPRPPRPPFVALARATLCSPRGRAPTGPPAPLNRLPSTGTLARAAGGPSPTHTHRPRPAHHRARKRSRVRTSFRGEAHLRRQTARRPCGHVPQPTGHCPSSPGGGGARVPRAPRPQPPGWKVLP

SEQ ID NO: 31694 - protein, 147 aa, A.fumigatus
WKDGAGGWIWWNTDDDVHDGVPIRGVSGMGWGGRGEEVAECGGCGEAGCGGESGGGGVGAEDVCGWVEVERNAGAVHGEGELGPAREGSQTPVLQGCAQCVYVQAWREEGALLGAFLGVFDLEVGGENDDLVPVAGLDSESVRFWGW

SEQ ID NO: 31695 - protein, 138 aa, A.fumigatus
SSRSTETHHQPQNRTLSLSRPATGTKSSFSPPTSRSNTPRKAPRRAPSSRQAWTYTHCAQPCKTGVWLPSRAGPNSPSPCTAPALRSTSTHPHTSSAPTPPPPLSPPQPASPHPPHSATSSPRPPQPIPETPLMGTPS

SEQ ID NO: 31696 - protein, 185 aa, A.fumigatus
GQSRLHGPSRAVQPRHITSPRTGRSRCRDPRREPNHHSRPRPPDRTHQERHRGEPLPPARPGRTHIAHSPAKRVSGCPRARAPIHLPHAQHPRYAPPRPIHTHLRHRHHPLRSLRRSPPRHIRRTPRPPPLAHPSPYQKPPLWEPRHERHHQCSTKSSLRRRPSTTSPPPAGGQNHSPSEEEPPP

SEQ ID NO: 31697 - protein, 825 aa, A.fumigatus
YSVLVAAPIVRSFPQVVRSNRPRAAVDDARRLGVRTGRTTISDKICVLRSQYEAKGFSTSTSRWQEKILDRTRNIGIIAHIDAGKTTTTERMLYYSGFTRRIGDVDEGSTVTDFLPAERARGITIQSAAITFHWPPTAGESDKQEVQTPRSASSHTINLIDTPGHADFTFEVLRSLRILDGAVCILDGVAGVEAQTERVWHQASTYRIPRIVYVNKLDRDGAAFGRTVREVGSRLGAFPAVCQIPWFENGNGRFVGVADAINLQGLRWEEGDGKVVKMLSLEQLYAEEAQLGKELRRARIALVELLSEHDEAMVEKFLECDENHLAVPPQDILESLRRCLLEESGSNIVPIFAGASFRNIGVQPLLDAVVNLLPSPLEAPDPEVSIGGVQGGLQRLLSGELLVESGEKSQSPKGKQRKSVAHAESQNVMKNLQGCALAFKVVNDAKRGVLVYVRVYSGSLDRNCVLFNTNLNVSERAPRLLKMYANDAVEVDSIPEGHIGVVVGLKHARTGDTLVSYAGNKPTPPKPLNTLQLRPINVPPPVFFASVEPHSLSEEKKVQECLALLLREDPSLHVAVDEDSGQTLLSGMGELHLEIARDRLINDLKAKATMGRIEIGYRETPLGPSPAVTKIFDKEIAGRKGKAGCTALVEPFNRDTSPAPEPDALAVETRDGNQIIILAPDLQIEHTKKGTEESPFLPPGLDVHTLRTALQNGCLAALARGPQFTFPMHSTRVTLHLDPSTHIFGTDTTPSALSAAARLATSAALRDLLPSPTPAHTRNPPYGNPVMNVIISVPPNPASGAVLPLHLRLPRAGKIILPPKRNLPL

SEQ ID NO: 31698 - protein, 190 aa, A.fumigatus
NSGSLSWASLGMLKITMANPMPKDQGYGHGLCNKNKCLVQKRASVKGKREINPLEGPPRNEANPPATHQKKQPTKQAKKAAGTAPQLIIFKMKFIAVANALIVALCSHVALASTIGHPSLMPREDALSDNNNNSTVATPYGNVVSTVLDDGKKKVEFFDVDGTLEVTAIEAADGSTPLAPSITPFKIHVN

SEQ ID NO: 31699 - protein, 170 aa, A.fumigatus
RKYAFGSLHHSFQDTRKLTDPAAIFYDAEGREVNLADMDEDDDDEDLEKRVPKWRLAIKFAKLIAKYGKRAWSYIYCVGTAPFWKCGDEVSTPAQGERLWLMRYRSSLTVLLLAALPGTATREPSVLDGKFTSTASRCVQVRRILSRGLETWPQTVYTECCLFLNSDMAL

SEQ ID NO: 31700 - protein, 83 aa, A.fumigatus
KRFSTFAVLGASDFYHSGLGPQPSKLENRNSRGETLNLRQALKGFVHTRTVYRMAADLDTGKIKNWRSIVTLIVFIITSMSAR

SEQ ID NO: 31701 - protein, 229 aa, A.fumigatus
MWTASDPKRLTLADIIVLFPFHIPIYVPRAFSNAVLDFLSKLRIIPPRENRFQPDDQEDANGKLKPYVRMNFPLNFVTAPLIADLFLLAIMAIGREEVRGGTLGADNIIPIDIMAFFLTLAYIAISIDASGLIRYLAFKVLQKGGRVGHRLFFYLYAFFFGLGSFIGNDPIILSGTAFLAYMTRVSSNIVHPRAWIHSQFAVANIASAILVSSNPTNLVANGGLPGQIH

SEQ ID NO: 31702 - protein, 336 aa, A.fumigatus
LEYQATSSIQEPGFTVSLLLPISPPRSLSPRTQPISLLTGAFQVKFIEYTANMIVPVVVPAIVLFPFLLYIIFADESLIPPSIKMHELTEEEKEKKPVNPNIPHARGRADEQEDLADDEQKLSLEEIMNPFLDKGGAAFGALIMAATLITLLALNASSQKGHPKPVYWVTLPAAGVMLCWDLAFGWYHRRETREIARKGRAEIEQARAERALRDEETMRAQQIAEAYEFAESTDARLQKEPHPEAGTDKGNTAYVTNIRPSDRASTGFSSQMSDGQSQTLASPLESSISTLAPKDDPLQNGQFTTDAMSTLNEKQELPTSASSPRGWKDPRLALLN

SEQ ID NO: 31703 - protein, 230 aa, A.fumigatus
VIATYLATKYLLLLATTGADMARTNKRKRREADCSDDEDPVGHPSGNTNGFGVARTLSLLHDAKPQAADDSAIATAGSDATPTEGAHDQAKDGVSVQRPTKKKRVDGEKTKYPVLTYVEGRLQSSIRISDLQNLLLYCFADGIAPQWISIKHSGHIRKIVVLMVPGLEMGMFDGTVPLKPQPEDEDSRSSQASNAEQKDPDANKSAEEDEDKANFLRWKQGLPLEDRSHR

SEQ ID NO: 31704 - protein, 327 aa, A.fumigatus
  UNSURE (2),(6),(23),(57),(104),(263): Identity of amino acid sequences at the above locations are unknown.
NXLKRXKANPPESDTGTMRRRFXWDNKTMEERQYWFSYEDYMNNETAFIKSMRHLAXMGIIFVKNIPDSREMVEKIATKMGPLRNTFYGPTWDVRSVPKAPNVXYTNVFLGFHMDLMYMNEPPGFQLLHCLENSCEGGESLFVDGFRVAELIRWKYPEQFEDLTKLRLNYEYNHKEHIYNNSWPVVETEDGDPKKRILHVNYSPPFQAPLLSDDNHQMPWIEYSRALRAFAREIERPYNVFQLKLNPGECVIFEIRRILHARXQFNTDKGKRWLSGTYVDEDDVLSTFRKCRNTQYHTWHWTRVTGPKHATEAAAKGEAIAANHRTE

SEQ ID NO: 31705 - protein, 213 aa, A.fumigatus
LPVNQKVCSVRQSNPTTCAPRHSLSSTMSTLNEITSDADFSAHTSSLPPSTLLVLYFHAPWAAPCAQMRAVLSALASQHPVTTPPTISFVSVNAEELPDISEEYNVTAVPYVVLIRNGQILESISGSDAVKVRDAVERHAGAGSGAGADGANKTAIPPPLTATPRENAPAAAAQPAAPSTQALTPEQSKEALFARLAELVKGRAGYALHEGYT

SEQ ID NO: 31706 - protein, 108 aa, A.fumigatus
KAAPVMLFMKGTPSAPQCGFSRQLVAILREKSVKYGFFNILADEDVRQGLKEFADWPTFPQLWVEGELVGGLDIVRSSIVAPAARKSLLTDMFLPHRSRKRSTTTLIS

SEQ ID NO: 31707 - protein, 279 aa, A.fumigatus
RCVAKAVSTPKNPPKFFPSSTLSDHFTSGRCSIGLRFPSSAVFCRLSTLDFLLSCHCSCSFYNLIIKMAGLQSRSAMTLPSSLSAAFRNLSLSVPTRSFSTTLAAQKTKQLPDYIPPYPYGPNYIFKQSNSGLYGGAMIQFGNKISKGRNEGKTRRFWKPNVRRKKLWSEALGEYLFIKVTRKALRTIWKSGGLDNYLLDDRPGRIKELGIFGWELRWKVMQTPKIQEQFRQERKRLGLPEPPSFEEWVKQKEAEVKAKVEEEINIKEATKPTYNEKQY

SEQ ID NO: 31708 - protein, 88 aa, A.fumigatus
QACGVFVDLIKAKKMAGRAIMLAGGPGTGKTALALAVSQELGTKVPFCPIVGSEIYSAEVKKTEALMENFRRAIGMLFQTRLSGWGCD

SEQ ID NO: 31709 - protein, 78 aa, A.fumigatus
EDPFSFQARPQYFAMVQISEVKGSSRENRTAAHTHIKGLGLRPDGTAEPSADGFVGQAAAREVGSIQFFSSFGKMSLG

SEQ ID NO: 31710 - protein, 162 aa, A.fumigatus
WKIFEGRLVCCFRRVFRAGVAINKILGLRVRETKEVYEGEVTELTPEEAENPLGGYGRTISHLIIGLKSAKGTKKLRLDPSIYEAIQKERVTVGDVIYIEANTGACKRVGRSDAYATEFDLEAEEYVPVPKGEVHKKKEIVQDVTLHDLDMANARPQVDRTS

SEQ ID NO: 31711 - protein, 226 aa, A.fumigatus
RRETCTNLLYQPKLTEEELTRRIAAAKENAAKKAAAYARAEADQASFLEREKIAEEKRLQERQNRRAMDSERERNRLRKLEALGGREWDATKREEDYNPRGGRGQFRRGMHGGVSGYVRRDFDDARTEEDQEGRHHLNHRGRGRGGRGGRGRGASRAAPFDGASDEAAAAASPAPPVLNNEQEFPALPGGHKPTDKTVSDLADKLETSLSPVSGATWAEQVESQRD

SEQ ID NO: 31712 - protein, 64 aa, A.fumigatus
ATNPKSSMGEFLGLSSQKGAASSNFEQRAQGASEMSAKDTSCDTEDHSFMEHGPGFQLALPTSQ

SEQ ID NO: 31713 - protein, 62 aa, A.fumigatus
PPTTMGDRTADNAVNHERTSTQGGASSKPTPANNAGGGSGWGDKGFFKGGTGTEGPGHQAVS

SEQ ID NO: 31714 - protein, 232 aa, A.fumigatus
LANRRCTVCFNSESIKNVEILPCQHIYCDYCFSRLALTAMANEQLFPPRCCSQMIPTDQVLSKLTEKEKALFKLKAREYATSARERRYCPAMKCGKWIPLEKLEGQSTAQLCPYCGTAICPGCKDKAHAPGKCSFDPGLTEFLELARTQGWQRCFHCGAMVELNEGCPRITCRCGADLWFVLTLTSSLAVRDTDAAKLQLWWTMAYLPSQRLRERNRRMPNRRASRRRSGNT

SEQ ID NO: 31715 - protein, 132 aa, A.fumigatus
RISFFRTLERQLPSSLAMFSSSVRGVARVCSSITSRTFNTSTAAYAAEVKSLGVIGAGQMVSMLPYCNFLSSLMLSDLHGLGIALVDASKAHVPVTLIDNTQAALDKGLSFAGMLDTAQLSSTLLWLLGYSN

SEQ ID NO: 31716 - protein, 249 aa, A.fumigatus
PTFPTSDKLLQKDVSKERLTQEAADAVRARITPSLNMDDLSSVDFVIEAVPEIPDLKTSIFSKLAQIAPKHAILATNTSSIPITKIAAATSTDPTDLQAPSRVISTHFMNPVPVQKGVEIIAGLQTSKETMDTAIAFVQRMGKIAAVSADSPGFLANRILMPYINEAIICLETGVGAREDIDSIMKNGTNVPMGPLTLADFIGLDTCLAIMNVLHQETGDSKYRPSGLLKRMVDAGWLGKKSGKGFYDY

SEQ ID NO: 31717 - protein, 184 aa, A.fumigatus
VANACAVLQAVVKTNKTNVPSPSTEEADIISESLPYPVKFALEVHFTKRAYEAEKDILNGLKAAGFELDFGVDGAGISRAYMTRGGGYYIDVGCSQLIADGKIKIKRSPEGIAGFNDRGLLLRDGSALDADIVVLATGYDNMRTTVRKILGNRVADRCKDVWDLDEEGEVNAVGQPFLDYCQQC

SEQ ID NO: 31718 - protein, 69 aa, A.fumigatus
GQCGRSTLSGLLPTMLIKDGQMWRPSGHPGFWFMGGNLALCRIYSKFLALQIKAIEVGLASQDTVHAKL

SEQ ID NO: 31719 - protein, 70 aa, A.fumigatus
RKSTGGKSSHTRSAPSRWPSMPAPTPPFLTLYPKPYGPRRPNRSKQTSSLIPSIVFDPITASGNPRGTPG

SEQ ID NO: 31720 - protein, 738 aa, A.fumigatus
  UNSURE (36),(38): Identity of amino acid sequences at the above locations are unknown.
ARRSRAQVGYYRVQNRIMRYLCLALFSALVLFILAXFXFTITSDEKQVALGLPKVAPKPLQWESFPFLKRYHGGIRTLIPRNESVPEYPSDGMEEMAMGSDNNKGQANIETRGQEALMSSLVFNPYPDYDSDEYKKKYGEKRECFLDEQETIRIPPVQHYPGVPRGFPDAVMGSNTMLGIKDDVCFERFGRLGPYGFGYSVRKGGVGAGMEGHREGAERVWDDLPPVDFRHVDWAAAQNRCVALNSHRFKDLPQPRLNRFLSLPVGVPKSSQSQEKDEASQSKADRLPRTAVVIRTWHDFHFTPDDILYLRSLISELSLLSGGEYTIHFLVHVKDGNLQIWSDDETYERVLNDALPAEFRGMGTLWSEQQMALIYPGLEETWTRGLPVHGVYRSTFMPMQYFAYQHPEYDFYWNWEMDVRYTGHWYHLFDKVGSWAREQPRKLLWERNARINVPSVHGSWEDFRHTVRVQTESGTNSPNNLWSAATKYGSDPSSGDRQALHRQGDKPIWGPERPDERDILEVDGEGIPQTTMEKDQNEWGVGEEADLIVFNPLYDPEGTTWLLRDDVTGYNKENGMPPRRTAIITASRLSRKLLLTMHKETSLKRHTMFSEMWPATTALHHGFKAVFVPHSVYIDRRWPTKYLESVFNAGRNGASGGARTSVFGDREHNFRGTTWFYSAGFSPNLWRRWLGYKVDNDGGEQEELAGEGRMCLPPMLLHPIKDVQMVIDDGASDMLGAS

SEQ ID NO: 31721 - protein, 182 aa, A.fumigatus
  UNSURE (18),(38): Identity of amino acid sequences at the above locations are unknown.
WPKANSQGAVFLQFGFGXGEFLALPIKFKFQFSRGEGXGATKSKLPWNGLKGSCTLITVRTIYRTVEYFTAASLNIYNVSDLSPILKDEWFFWVFETAVMFTNTTLLNVLHPMQWLPRSNKIYLTKDGVTEIEGPGFEDGRPFLQTLIDPFDVIGLIANKGRKEKYWDALDANEKRSPPAQV

SEQ ID NO: 31722 - protein, 223 aa, A.fumigatus
HASVYGASPQFCAGPVHSVHAVEGPLRVHVSTSLGRTGFNRLTVSSNFYRASSSPIVVVLSGSMEPAFQRGDLLFLWNRSPRAELGEIVVYNVRGKDIPIVHRVVRTFPQIEGKAKKVKEVNECVLHSASICCEQLLTRRICHRASSVPPNMLLTKGDNNIADDTELYAKNQDFLHREEDIVGSVRGYMPMVGYVTIMLSEHPWLKTVLLGIMGLMVILQREQ

SEQ ID NO: 31723 - protein, 71 aa, A.fumigatus
RAANMGSQKRIAKVRHWDQVASNFLVFYLLANGINVLQELAELTESPPAGITVELVDESNLYEWKVYLGGP

SEQ ID NO: 31724 - protein, 293 aa, A.fumigatus
QRVSFQPRSVNTGAVFIEDSGLIWDATLNQTNSAHNNNKFYRIQLLVDTSGTTYKTWTRWGRVGEFGSSALLGDGTLQRAKFEFEKKFKDKTGLKWEDRLSTPKSNKYTFIERNYEESDDEDDSEDKMDVDKREKIESTLPQAVQELLTFIFNQQHFLSTMASMSYDAQKLPLGKLSKRTLTTGFQILKDLSELVADPSLASSRYNTSFQQAALDLSNRYFTTIPHVFGRNTPPILTKDHQIKTEVDLLEALTDMGVANGIMKNSRDAEMMNQLDRQYQGLGMQEMTPRQSAI

SEQ ID NO: 31725 - protein, 221 aa, A.fumigatus
SIPEQFSRLDAPSSIQREYFPRNLKFQDTQHKQVINIFRIERKGEEDRFKSSCFANLTNSNRRLLWHGSRSTNFGGILSQGLRIAPPEAPVSGYMFGKGVYFADMSSKSANYCVPYNSANMGLLLLCDVELGNPMLEQFRANFNAGTDAKAQGKIATLGKGRTIPAGWKDAGCLHPALSGVQMPDVSKSTMSDNGSLLYNEYIVYDVAQIRQRYLFHVHMS

SEQ ID NO: 31726 - protein, 104 aa, A.fumigatus
  UNSURE (62),(65),(77): Identity of amino acid sequences at the above locations are unknown.
KRLKARVPSGPTCTRASASPPIPYLQMGRIGLNRFKAAMARFLNERLHPATPLEPHHLILTXGVXAAVEHLSWALAXKGEGILLGDRTTAPLSRISPCGSARRL

SEQ ID NO: 31727 - protein, 298 aa, A.fumigatus
RRGHPPGRPYYGTFVADISMRFGTEVVTVPFGGADPLGEACVEAYRQALTSFEQRTGKKCRALLLCHPHNPLGRCYSRNVLVALMRLCQEQGMHFISDEIYALSVWGGEEFVSALSIDTSGIIDADRVHVLWGMSKDFGANGLRLGALISQGNKDVRAAVDSVALYSYVSGPADHLAANVLEDDAYTDEYIRLNCEKLKQAYEYTVGLLTQNEIPYMAGANAGFFVWVDLGTPYLKHHPEAKHEDVGEIVMQRLLKNKVFLASGALFGSETPGWFRIVFAHPQAYLDEALRRIVAALQ

SEQ ID NO: 31728 - protein, 142 aa, A.fumigatus
PGRPGTRGPSCQPTKPKPRATMTRRSGLSQPCPLRSGTSPTQTRTTGPGGWRWRRRCSTRRRRGGTKTPAAGDCGGRSSASTMDGITRIPFPTGVFSTWPPGWRGTRGTARTLSGQSGSGTGRWTWASSRTTGCSTTGRTSC

SEQ ID NO: 31729 - protein, 197 aa, A.fumigatus
CVANQYKTEGDSRWEARTKHILQATDAFFAEDPAMVMYERACELVDTCQVDQRAFKGSSRDGWRRPRRLPPSRMTGSWPRLRASAAAAARTCTGGPDGAACGLKWTTGVWDGSEDVGLQMSALEVIQNLLVDRVDPPVTDATGGTSVGDPSGGMEQPDPRPPVLTMTITGADRAGAGLLTAMLGVLMIGTTGWLLYE

SEQ ID NO: 31730 - protein, 281 aa, A.fumigatus
SPKSATMHCMQLLWLLTLSPAYSIPLDPNDPTSIKQAAHHVAANMLSHYTGMKPGDNPGNLPPPYYWWEAGAMFNALIDYWYLTGDSTWNAITTQALTWQAGHTGTFMPTNQTKTEGNDDQAFWAFAAMSAAERNFPDPDPDHGPGWLAMAQAVFNTQAARWDEDTCGGGLRWQIFSFNNGWNYKNTISNGCFFHLAARLARYTGNRTYAEWAERVWDWTVDVGFITDDWLFYDGADVLLNCSDLNRIEWTYNSGVYLLGAANMYNCVCLCLWLLALLMRG

SEQ ID NO: 31731 - protein, 63 aa, A.fumigatus
LGRDLSRKGKQERTTLKKATYVLSYCLSLYLNMESKELSKMSMLRSKICNVQASRQAGVLKCD

SEQ ID NO: 31732 - protein, 224 aa, A.fumigatus
LKFSICLSYVFVHNLDACHQSQLDTGLLTRACICMRTYAIRPVSNRLPGPIEPKKHRRDRDNSTTGSLYNALIHPVQREKTITSTMIRVAEFQPFLNTISVLQVLAAIFIGALTYRLIDAFFLSPLRSIPGPLLARLTTKRANVDTFSGKVTQTVDKDVARYGDVYVYKPRAVCINHPDDIRAVLGSQEFRKAAFFDIFNDGNTPNIVSLREPELANRRSSPRG

SEQ ID NO: 31733 - protein, 254 aa, A.fumigatus
  UNSURE (233): Identity of amino acid sequences at the above locations are unknown.
DTMALPIILCLAVILWTSWRLLDALFLSPLHRVPGPVLARLTPLRAIYARLPSRVIPAALADFHSYGDIYLSKPRTITISHPRDVRAILASSEFQKIDVYHGLNDPVMANIVTFSDPKLASRRRRQIGPYFNPSYLAKMEELILWCGCRAVADKWDRLIAQQGHGPQKSVKVNYRHDLQMATFDIMSALAFGRRLDSLKEEGESVAIVEWIMATAVYIGVRINFRLLMVFPFXPLVPRWTTPMPNLFILPATTG

SEQ ID NO: 31734 - protein, 246 aa, A.fumigatus
  UNSURE (29): Identity of amino acid sequences at the above locations are unknown.
AELFKDLLVLPRRLSLRSQGIRSFGSPAXEYGFPSTHSTNAVSVAVYVLTLLNSPDSTVSSHINLIFQCMTYLYVSSIVLGRLYCGMHGFLDVIVGCLLGASITFVQNLFGPLLDDYVFSASGKQIALVVLVIIILVRIHPEPADDCPCFDDSVAFAGVIIGVQLGCWHFAKSSIAWSDPSPATIPFRYKDLGLVKTVLRFVLGVFLIFTWREVMKPLLLRTLPPIFRALEKLGLLLPRRFFTRAS

SEQ ID NO: 31735 - protein, 238 aa, A.fumigatus
SFQAPVVKTESRTQSPVALNRRQSNLDTTGASLSDYRPTSRRSSTLLTTSSDVGTPPRQNSLPVPVLSPPMSTGLSNPPIMESPVITFEPDDFFSGSATPATPSAYGFPPSHHSRGINDIISESTVGAGPSVQLVERMSATVRRLESERAAAKDELARITRQRDEARKQVVDLMRESEEKKASDARVQELETRLEDLDQRYQTTLELLGEKSEQVEELQADIADLKKIYRELVDSTMK

SEQ ID NO: 31736 - protein, 179 aa, A.fumigatus
KMQKAIPSSTCYYGKVQMSASRVSQARYVSMTTDPATSFSFPHARFNQNALHFATSKGNLSTVRTLLANKCSARVKDRRGQLPLHRAAAIGSIPIIKLLLEEGKSPVNATDIDGLTALHHAISEGHGDAAITLLKAGAEADKKDSEGRLAIETAPDAKVSCPRFSWLMYKRADCRSLLG

SEQ ID NO: 31737 - protein, 526 aa, A.fumigatus
ADPASRVVKILKDLLGHDREHANLPLAVLFAKSFSWDILGANMVDENRKTVDVDGTTTSVAPPETVSGGDDATAPENEPPLVSEKTQLRFKSILSRYLEDVKAHVVRDQRALAAQSRRNAEAYVKSGEIFEDRQANFDKQSKSLEKLVANTQVLCEVLGVEMPVLAEQEAADSASSGGIGLVKTSEYLRGQGEGPGIWEDEEERRFYENLVDLKGKVPPVLLEDGKKKKSDSDDAAKKRTDGEATPDSSVEKPENASQTPTSEEKSAAEAEDQSTAIASKTVGAQVDALLARLPELQTKDQVDQLALEFCFLNSKASRNRLIKAVSDVPKGRVDLLPLYSRLVATLGQYLQDIPQGLITYLDEEFRSLQRRKSKEFLGQVRMTNIRYFAELTKFGVVPEHIIFHCFKVSLDDFSRMNIEIIGHLLENCGRYLLRNPETSPRMASFLEKLGRKKAVQHLGQQERMIIENAMYYVDPPPRPAIQQKERTPMESYIRKLIYLDMNKRNYTKVLKSIRKLHWEEQDVSPL

SEQ ID NO: 31738 - protein, 126 aa, A.fumigatus
SSSRYLFFPLSLREECGLTFSQYYYLTKDPLPMDVEFLIQDTFAMARPQWKLMTDLQEATRLFSEAVAQNYKTSDSERPVEPDEDDAESSSSDDGLEDDAIPEAEEEQESSDEAEVSFTSIRAKSP

SEQ ID NO: 31739 - protein, 83 aa, A.fumigatus
VVDIMERVFSKPVKVKYGNIHLLAILVSALYRYHQDFVISVVDNILEQITLGLEQNDFKFNQKRVAEVKYLGELYNYKMIDSP

SEQ ID NO: 31740 - protein, 133 aa, A.fumigatus
SLIRCTGLSLLATVSIFGFIIVFYYSQYYVEGGTPIPGKLNPLDLPDDFFRIRLVCTLLDTCGHCFDRGSAKKKLDFFLIFFQVSLLPAQSSRGVWSDIFTVLLSYKGSFAYGRRILDPGHLRYGSSSMEVDD

SEQ ID NO: 31741 - protein, 83 aa, A.fumigatus
ANFHSFSVTVIIIIIIIIIIIIIIIIIYALECNQNPRTPHPLHSFCDRPPQLSGGSPPLLNHSAIRIVSPRLRSISPCLSSPV

SEQ ID NO: 31742 - protein, 201 aa, A.fumigatus
MWSLPVTTSGPPPRSPASTAGTMSIPLPRLSLPRRGDPADSDAAKPEESSVRKGRRTKIPYESILLLTSTSTFPKSQVPEGTSEGLPTNGQQRSPDPTLDDDLDLNLPVYSLPDETIEGQHGLIKHFMLNDRKRTLTQDSAGEVDLWDLLKVIFLSRHPSIRFLLTLAVQTNTIFRQAPYGRRRIGDQYYREHRSLVHDRH

SEQ ID NO: 31743 - protein, 84 aa, A.fumigatus
SQFITPLLCIFPLFPSFELCYLTIELTFILSLSLLSSSSSSSSSSSSSSSSSMPLNAIKILVPHILCTPFVIVPPSCPADHHHY

SEQ ID NO: 31744 - protein, 75 aa, A.fumigatus
PLQCKPIQSFGKRHMDDVASEINTTESIAHWCTIDIRTGRLSVILELNRCFDAEVYADEADLHDYSQILGDQRSG

SEQ ID NO: 31745 - protein, 320 aa, A.fumigatus
LTAAFPRYSAGRDGVICAWDLNLPLSASKSSPALGAQKSGPTTFRHQVQAHSHWINDIVLTQNNTALVSASSDTTVRLWRPHSESTELPSPIGKHADYVKALATPGGHSSWVASGGLDHKLHLWDLNGGGELLSIDACGGESTAKGSVYALGAVSSVLASGGPESVVRVWDPKSGKPITKFVGHTDNIRDILITRDGDRIMTASSDQTIKIWSLTAGRCMHTLTMHNDSVWSLYSSHPQLSVFYSSDRSGLVAKTDTRHCSDVDQGICVAALQENDGVVNVVAAGDYIWTATPKSSINRWYDVDTTAEIESPSSRGPRRL

SEQ ID NO: 31746 - protein, 94 aa, A.fumigatus
  UNSURE (61),(85),(89): Identity of amino acid sequences at the above locations are unknown.
YAETDRHPLAIPNPHNTDQNDTRSLSSSIYYHLNPDSQPASSPETAAHNHALHRGLARYVXIHPDSANDNGTAPVTSFVVGPDLXQGEXNHCVV

SEQ ID NO: 31747 - protein, 166 aa, A.fumigatus
  UNSURE (143),(166): Identity of amino acid sequences at the above locations are unknown.
YNFILYLLGRNEQTPRYTSLSTTIHLRRIQVPEIPWTSPSPPFNHSITHLPPAPNPSPNPNPHPSKQSSKPSISSLTQKEVSTPKQTVTRSPSPIHTTQTKTTPAPSPHQSTTISTPTPNLRLHLKPQRTITPSIVVWRGMSXSTPIRRTTMARRPLRPSWSVRIX

SEQ ID NO: 31748 - protein, 225 aa, A.fumigatus
QCVKVYHPRVKAQAIYVPTMASTSQSRFHEDLRDDGSILDDDLIEADDGEYISFSRFSLDCIRPALVCLPELLRCTDTCYLSIMPAIEADDPLHTSDTAPLRGNIQSEPSSSSRGGFGSNLSSNYLTSTIPGEDRRATQNTIDETVWETLSRDLRAVWEKMRQVLWPKYLMGGMLQRGGGGIGAAERGEATGFGGGLRGLVGRWPDADVVLQGGMSEGLRDWDLW

SEQ ID NO: 31749 - protein, 429 aa, A.fumigatus
  UNSURE (55): Identity of amino acid sequences at the above locations are unknown.
CCSPVNRGQLDIDTQLGGPMARLLLEGGSDRDCYDVFALLNQTTGLPILAKKPSXERQRESEVARRRKSRSAENKEMEDVPFVDEGNRPYKPAETEMEEREEKTEQTEEEEDDEEFENLFDPVVSTGSSSKTKKGNIGPSYVVLGDQELTILIETCYTMTQGVGTGKAYWKYLTLEDHEYTIKPGMPSLHAYLRLLRVYRASRATVDVVRDQVPEPGWKTFHIAMSCCLRDRRNINILKNANELLGIMDKSMVLPHPRALDKYLNLVQTLQDNPQRLISLNGLKIARKPSDSLDVVGRKLRLSLQTVALENLRPHIDKLHEALKNGKTSFISHVERRQAGAADTVCGATARTVMDRTRGLIDELLKPENAPFLSKSDREQLEQESQKLRVYSDVEMVRKFESTRLHPTFEQVMAFQEKHDPKQNTDEAD

SEQ ID NO: 31750 - protein, 85 aa, A.fumigatus
VRALRKMQILSKLASYNLPSVKEMTRYTGESLATRKSIKAYLPNHAIIHVSSLYKNVSGWKFFMQINSKPKNVPGRCHLPTATSS

SEQ ID NO: 31751 - protein, 78 aa, A.fumigatus
AIRGKGHLSCSFLLRRIGFYVDALTQFDMKFSIYYNTINENYGSQQINFATDTGISLSMAYRASQVRLYVAYTVFDSL

SEQ ID NO: 31752 - protein, 400 aa, A.fumigatus
STSVFRQLRVKTSDGAANTAPYSRLDSRQRKKLHTEKLEEEKKHFTQVISELEEALQNMKLREAELLREKSEWMAAQQQINQYIEGLHMDKDEMLRVHTLETAELRKKNNILKETVEKLERQMGSSATNNLNTDFSDFENFTMDNAPWEDFTISNSLPLEAESTPATSTMQSSAMVMSASDRVTEKSTNTACDYPFSWNAFYMCLLFGAFLASNGPSLSSRSIPQLSEEYRAESANVLKAVLAASPPELAQANTQQAVASSSSAAPMPTTISGAEMAQMTTGTAQSSNLDELHNNLAMPTKEQEREQVFSLNADQYNALTTFDESHVDYKSQPSNLQQALAAMRNNAAFNKLPNKATSDVYTRSLMWDRVPEKVIRDFQRMVQEFGASPIKEEQSGFSQA

SEQ ID NO: 31753 - protein, 82 aa, A.fumigatus
YSGHLFLTAYFSHLVSFSSGIPSQSHLKLACPSRKHFAQTLRSAASFLAFINDFLFSQTSLALLALYAIELRDSLLATFSQT

SEQ ID NO: 31754 - protein, 122 aa, A.fumigatus
IESLHYATLQSISRLRSSGPTQLIIDDPGIDLFMQCGNKHNWRMEILTYGTFHTLSHIKGKVSEWSKEHGSGTEPTNCFVSFRVSQGAWVRIPPLSFHVSFCLFIIVCLIISSLSNDTVIHE

SEQ ID NO: 31755 - protein, 92 aa, A.fumigatus
ATSAFSQQHYTSNAELFIQAAVEALHALYSRSNFEIEDFQPLVHLMYETEYLTLLRKLYEWSIVGPDDIDDTRYTISKKLSEVGTSRPRCLP

SEQ ID NO: 31756 - protein, 299 aa, A.fumigatus
VSTPVDGMAAQDELSEGGMADLVRALELIHNPSSTNDLRRQALTFVESQKESKLAARNGFLLASRVENAPLVRYFGLTLLDHVLRHTSFTAADQVAILRDFVLKLAESIRPEDPAYYRNKIPQLWVEIAKRSWGLDWLAMDEILVQFWGASLVHKELVLSILETLSEDIFYREDTVSSLRGTDLNRALVEICTPLSVFEEIYPKREHHVELRCGTEGWLARTCEFLIYCVENLQASIQARDAALKALATLKSILVWAIPKAIMSTNCVSSIVRPLTCSDEQVLLVSHLGLFPAALHEQC

SEQ ID NO: 31757 - protein, 438 aa, A.fumigatus
WGLPRPVLLAHVVEDEGDKEARGQKVVVDEEKEAKKKKKAKDAKAVKLDDALVKEYEEILAQIDNFDGTQLEEIIAKHDIRNPTTDGNLLPPVAFNLMFQTSIGPSSNMPGYLRPETAQGQFLNFQKLLEFNQQSMPFASASIGKSFRNEISPRAGLLRVREFLMAEIEHYVDPEGGKKHHRFEEVKDIEMAFLNRNVQLSGCTKTEKMTIGKAVETGMVDNETLGYFIARIQLFLLKLGVDPNKLRFRQHMANEMAHYAADCWDAELLTSYGWIECVGCADRSAYDLTVHKNKTGAPLVVREPRAEPLKIEEWQVDLDKKKFGPRFKKDGKAVAAAVEALSQELREKLAIDLEKNGKIEVDVEGVGSGKVELDQDIVKIEKRTRVENVREYTPNVIEPSFGIGRILYSMIEHVYWAREEDEARGVRIPISSRCVGHR

SEQ ID NO: 31758 - protein, 127 aa, A.fumigatus
VLSFPPAIAPTKVLIVPLSTHASFRPLLQQLMTKLRRMGISNRVDDSSASIGKRYARNDELGTPFGITVDFQSVKDNTFTLRDRDTTKQVRASEDEILQAIKSLVDGEKTWEDIRKELPEFTGQEVD

SEQ ID NO: 31759 - protein, 285 aa, A.fumigatus
CERQLYTLQRYQPSQMPSDWVSSALLCLFTTETLTARPFREDITTCQKKGKTILLSIGGATYSEGGFSSEPAAKAGAELVWQTFGPPSINATAHRPFGNASVDGFDFDFEASVSNVAPFANRLRELMDADHRRDYFLTAAPQCPYPDAADKDILNGPVSVDAVFVQFYNNWCGLNSFEAGESKQNSFNFDVWDNWAKTVSLNKKAKVFLGVPANTGAAGSGYVPVDTLKPIIEYSKKFSSFGGVMMWDVTQAYGNTGFLDGVAQALGKTASHVRRSCRYRPYGWF

SEQ ID NO: 31760 - protein, 103 aa, A.fumigatus
VEVSQVAVPPPSLLYRIVRMVPKSLLYTIFSSLAVALAASVPHTDYEVMIIGGGPSGLSAASGLSRVRRKNIVFDSGEYRNGPTRNMHDVIGNDGSCPHFPAF

SEQ ID NO: 31761 - protein, 115 aa, A.fumigatus
RLCKLTSVFAGAVPSDFRALARNQISKYNQTTWVNEKVDSVRVITDEEAKHPPTFRGLGSRGKPKQAGRAIPWDRAGRAILPGDTPAWNKTWGKRGGPGAPGGKGGETTGNKPFG

SEQ ID NO: 31762 - protein, 484 aa, A.fumigatus
TMAYLQAGVNTSRGEGGKTGRDANAVALEQQADVDEDTLKEIYGEKKEHVNIVFIGHVDAGKSTLGGSILYVTGNVDERTLEKYKREAKEAGRETWYLSWALDLTNEERAKGKTVEVGRGHFKLTVQSPDGPIERHFSILDAPGHKSYVHHMIGGASQADVGVLVISARRGEYETGFEKGGQTREHALLARNTGVKKLIVAVNKMDDPTVEWSKARFDECTVKVSKFLEALGYKKDDLTFMPISAQQTTGIKDRVPKELAPWYNGPSLLEYLAEMKTPERNINAPFMMPVSTKYRDMGTMVEGRIEAGVIKKNATCIMMPNRTKVEIAALYGETEDEIATATCGDQVRMRLRGVEEEDLLPGFVLCSPKRLVHCVSAFEAKIRILELKNILTAGYNCVMHVHSAVEEVTFAALLHKCEPGTGRRSKRPPPFASKGQTIIARLEVISSAGAVCVERFEDYNQMGRFTLRDQVSDVLSVPYLGSHH

SEQ ID NO: 31763 - protein, 184 aa, A.fumigatus
  UNSURE (4): Identity of amino acid sequences at the above locations are unknown.
TTAXSYLDVGITLTINNWPALTMAVQSNWGGPTSADKRDWLCGAISDMINERPETDALDLEDVLIQVMNDEFDVVVDDDSAAPVAAQIMAIREQTARGEFGFVQELWEAWQRKAQQKGNNVAAAFKQVKALDDEDTDEEDEVEEDEDEDVDMDEAPAIVRAPRERVELEVDEDGFTKVVGKKRR

SEQ ID NO: 31764 - protein, 271 aa, A.fumigatus
SLGRAEHESREEVFFFYASETHTDLITTGCSGNFVFSLTVESSNFDLGAIRHHDAGGVLLDNTSFDTTLNHRSHITVLRAHGHHEGGINVTFGSLHFSKILQERRSIVPWCKFLGDTILNTRSLLGGYGHEGKIVLLVAESLQELGDLNCTLIETSLAPFDSRVVHLVNGNNELFDTSVPGQQSVLASLATLLETSLVFTPTSRDDKHTDIGLRGATNHVVDVGFVTRSIEDGEVSLNGTIGRLHGELEVATADLDSLSLSSFFVGQIESP

SEQ ID NO: 31765 - protein, 475 aa, A.fumigatus
  UNSURE (10): Identity of amino acid sequences at the above locations are unknown.
IIVSLDPLDXGEPAGHSKRALLESVAAGLDVAIYTMDQVEELGTASNRPCVPPSPSDIVTINYTSGTTGPPKGVVLTHENAVAAASSALVNIRQAPGDTSLSYLPLAHIYARLAEHTAFWAGARIGYFHGNIVELVDDIKALKPTAFFSVPRLYSRFGNVIRGATVEQPGFKGALSRHIVAAKTANLKNPDPSKATVKHALYDRIWAKKVSAAIGLERCRFMVSGSAPLDPSLHNFLRVAFGVDFIQGYGLTETYAIASSQSAKDLTAGNCGRIAPSTEACLMSLPDMDYSVDDKPFPRGELLLRGTNIFREYFKNPEETSKAMTEDGWFRTGDVCTIDEMGRFIIIDRRKNVLKLAQGEYISPERLEGVYLSELSYFAQGYVHGDSVQTFLVGIFGVQPDTFAPFASKVLGRTIDATDIEGLKSVLGDDKVRKAVLRDLEKIAKKHKLAGYERVKNCALLIEPFSVENNLLTPT

SEQ ID NO: 31766 - protein, 85 aa, A.fumigatus
RRTLPQSLAFFFFFFFFWNVSAHLRSICRLCDLTWYVACIISTLGKNWTCWLLDKCEIIQNFVFVSNAPYCITCKMMEIPVHSAE

SEQ ID NO: 31767 - protein, 526 aa, A.fumigatus
  UNSURE (34): Identity of amino acid sequences at the above locations are unknown.
PPADTASTWGRRRSSCPRDRTPIRIVYARFSANXRDKVDKTLLFYGHYDVVSADANRTKWNTDPYQLASIDGFLYGRGVSTTKGPILAALYAAADLARQKALPCDVVFLIEGEEESGSQGFHETVRQHKPEIGSVDWILLANSYWLDDYNPCLTYGLRGVVHANLIVTSDHPDLHSGIDGSALLDEPLKDLSMLLASLVGPKGRINIPGFHDLVLPLTEAEKQRFADVARILLPQHPEITDRDALINSLMHRWREPSLTIHSVEVPGSSKAATTTISRKAKASLSIRVVPNQEADEVAANLTMYAQEQFDKLESQNDLTVEITGKSDPWLGDPDNEIFATLSEAITAAWSRDQTSQKHQYPPLQRFPKGKDTPGLARTDSSDSLASHIDRIIMSTTTSSASKSKARQRSALSSTVPTSSTLTSKSGVIVSPDASGDSSDEKPAAPAQEPVATRSTVQPIFIREGGSIPTIRFLEKEFSAPAANLPCGQASDNAHLYNERLRVENLYKSREIFQYVFSRLPRRHRPS

SEQ ID NO: 31768 - protein, 133 aa, A.fumigatus
LLIFHTRPDQNDESLNRWKASLGLNTGKPIGDPNDPRKCIIRSLSLEVEGRPDVVIELSAPGALEALKDKPFTIKEGATFRIKCKFEVHHEVLSGLKYLQVVKRKGIRVSKDYEMLVSIIDSGSVTCCVRRLT

SEQ ID NO: 31769 - protein, 137 aa, A.fumigatus
VLRILLGSFSCILLDLYLFSPTSVRYTLHIYIYIDTLPLLSLPPSLVPPSLVQVPRQKRSRQQTTATLTMTEHDDDLVASKTEGFKVGEKKTIEEYTKLGMSRLLRLPYASHAGNSSLHSGLPVSPLPQARLLQADY

SEQ ID NO: 31770 - protein, 69 aa, A.fumigatus
  UNSURE (60): Identity of amino acid sequences at the above locations are unknown.
SHLDPPSQWHKTWFQRLYTLLGSSHKSTCLSLSDDYDLRLDSRPHPHRPSHDLEAIGIFXYAPHQTVSD

SEQ ID NO: 31771 - protein, 210 aa, A.fumigatus
DLSHLVPQHRLEDDKVRKQLVNNSAMSGNGSSSNAATSLLAGGNGRRATAGNITMGLPIEEKEKGPNKGDILNGAVGWMRDLMWALHVKLQQESELAELITSLGGTWPFEQTEEEKRMRSEILDALEKNDPSTFTYSRGPGSGLRVPKHTNLAGEPISQNGALSPQSLSPSYNSGGSSNGGNSGQAQYWNSSGHAGMSFKEEDEYAMEMQ

SEQ ID NO: 31772 - protein, 165 aa, A.fumigatus
AGQDPSAGSRFRRQVQRYAGRCAQDHRHGGSSCHVQRPRVDAVASHPLERRLLRLHLPSPRAAPRCRTRQQVPADPQRPDRGYHRWYRGYRPQHPHGRRQVAHPKLPQGRRSGAQVQLGLACRWHRHEGRRLRRPLQGFHPQGAPSRSRWWYSARCFHGCHGLFP

SEQ ID NO: 31773 - protein, 247 aa, A.fumigatus
MSEANRGTLSRFSRLYRGISAPILMEAPKRATKFAANDSWGSFYRGLFGAQKQTQSLAVLTGATAGATEAFVVVPFELVKIRLQDRASAGKYNGMLDVVRKIIATEGPLAMYNGLESTLWRHILWNGGYFGCIFQVRAQLPAAEPGNKSQQTRNDLIAGTIGGIAGTVLNTPMDVVKSRIQNSPKVAGQVPKYNWAWPAVGTVMKEEGFGALYKGFIPKVLRLGPGGGILLVVFTGVMDFFRKIRGE

SEQ ID NO: 31774 - protein, 334 aa, A.fumigatus
VLISLALNIQRYAHIRIEREWEQSKLQREIQWKRANSGRNAAGAYGTTVAEEDDREFRRGGRLFPRYRDESPDSGPELPEDFLRRSDEFSDGESGPRGRLRESFLSDQTIRAGDKDSRHGRRKSYLRSPYWWAGLVLMCLGEIGNFMAYGFAPASIVSPLGVVALISNCVIAPIMLKEKFRQRDAWGVLIAIAGAVVVVLSASSSEEKIGPHDIWVMITRWEFELYLGLTACLIIALMWVSHKYGSRTILIDVGLVALFGKSQSLLMRLVDRVIQVLIQISRWIYRIVDQRCLVTAVIYAMACYYLSGHLSTGVCPCFQRSDANPVHQPGFATF

SEQ ID NO: 31775 - protein, 422 aa, A.fumigatus
SKCSFRYQGGYTALSTKGVSSLLSFTLWHVITFPVTYLLVFVLVFSALMQIRYINRALQRFDSTQVIPTQFVLFTLSVIVGSAVLYRDFENYTVERASKFVSGCLMTFLGVYFITSGRLRADDESSFSIDDEEEAIGLLGGEQYQDNFDIARPAHQPRTAKRGQRQSIPDENDLQSPLGSFLGSGIEDVDEDQLTPKGALSAAPSSPVGSITAESPTQPSPGHPSLHSHSHSLLTNPWADHLEQHVQASNSEPQLHRPATPPEQSETGNADSAVLLQFPPAPGIEDRGYRPSSPSKPDHVEPADRASTVPQTPPARNLRNSISKHFSPGPLLPTLSAGFSAVVAESLRRGETSPVKDRKSHKRSARRKQLSTTVFDGYTRNRDRGPSDEVDAGVDQHLPLQLATARLRSVFTTGAEGSALCV

SEQ ID NO: 31776 - protein, 63 aa, A.fumigatus
KNSDQFQHLCKLPLWSDKLQLSRDCIEFAIVIDSPYMEKGGGWCLKKLMKAAETFPLEAANCR

SEQ ID NO: 31777 - protein, 435 aa, A.fumigatus
AYSPPPSCFPTVLFEILAWLFFFCLVYANDAFSIKSSQPDRQISQIEKSVTHLLVATKQLLETLTQWSRRQASENEVSDVYVRLGYEFNLACRAFNAIGVDTSDLGPVPDLLRTILEDTLSQDASPQSLDRYLPRIRDIIINLLHGLKKKQARLRSRQQREESRPLPGRQASSGSAVTNQMYEEATASSPKRPGSRRHGSNGSLEDQSSGAHSGSTVQTSNDTRGTSYSEREASRREAQQILSQPSQPETAISNVAMPSPDFSGYPTPPPPPPPPKQDDALGALQRSGELERRASRRFSAYQIQKHLGASNGVPVLPTQNSPVPNRGRDVRESLNAVRLRGSYAHGRQRSTNRPQDAVTPSKTAKPLPSSHLAQGGESELAKARTASPTESQANASVTSQIRPDKVPLRSEDGTIDSPTVAGKQPGAPQSAEERL

SEQ ID NO: 31778 - protein, 77 aa, A.fumigatus
GDVNKLGLSSVEGLGWNCMDANSLVFSFTAARIKRNRATQQIKFKVRCHRFIYTLVLKDSDKADKLKQSLPPGALPT

SEQ ID NO: 31779 - protein, 62 aa, A.fumigatus
  UNSURE (46): Identity of amino acid sequences at the above locations are unknown.
ILDCRRDAEMASQCTFRSSHQGFPQLTGGDLQRALLPTEQATRDDXLERVRADLRVPPRSTT

SEQ ID NO: 31780 - protein, 390 aa, A.fumigatus
GYLQAWLEGQGTFASLILISTSHSVLKCRCHRSSHTSDVTWTTPELLSRLVLTECKWPYQRWQSRLDSDFLYSDVVIGTSSYLREHSHGKDMTYIKNTAIEVIEFVKSKGIEIRFSSEDSFRSDLVDLLSIYSAVDKVGVNRVGIADTVGCASPRQVYELVRVLRGVVSCDIETHFHNDTGCAIANAYCALEAGATHIDTSVLGIGERNGITPLGGLMARMMVADPEYVKSKYKLEKLKDIEDLVAAAVEVDIPFNNYITGFCAFTHKAGIHAKAILNNPSTYEIINPADFGMTRYVHFASRLTGWNAIKSRAQQLNIEMTDAQYKECTAKIKALADIRPIAVDDADSIIRAYYRNLKSGENKPLLDLTAEEQAQFAAKEKELAGSGVIA

SEQ ID NO: 31781 - protein, 98 aa, A.fumigatus
SPFFLVPHPGFTAVETRQNPHPSASRNPYGHNVGVTDFLSNVSRFKIIESTLREGEQFANAFFDTEKKIEIAKALDDFGVDYVSHSQLLSTCYWEDVH

SEQ ID NO: 31782 - protein, 287 aa, A.fumigatus
LEVAVVGTDNAVSVVNGNGTDISKSLDFGSALLVLSIGHLNVELLSTRLDSVPTRQARSKVNVSGHTKIGRVDNLVCAGVVEDGLGVDTGFVGEGAETSDVVVEGNVDFNGSGNKILNVLELLELVLALDVFRVGDHHTGHETTKGSDAVTLPDTKDRGIDVSGTSLQGAVSVSDGTPGVIVEVSFNITANDTSQHTDEFVNLTRRSAADSVSNTNTINADLVDSGVNGQQVNEVRTEGVLAGEPDFNALGLDEFDDFNGGVLDVGHVLAVRVLPEIGRGPNNDVTI

SEQ ID NO: 31783 - protein, 94 aa, A.fumigatus
IQYFHVCLDPSTHELMMIVDDTLHRYSFYSSSPEIHCSSSAGAVHYEADKRTGGESMFRNHIPAISNYDRPATSPRSITGDISGDNVEPSGRDY

SEQ ID NO: 31784 - protein, 61 aa, A.fumigatus
NLAAAEIGGYFEPLKHDFITKSSYSCATDIVITYGLEYDSHCSMGVPIKGVILYLLPTLEG

SEQ ID NO: 31785 - protein, 94 aa, A.fumigatus
KGPMVDGPLDHYSSVVDIDLNGTFYCAKYAAAHWRRQKEEGTDIYGNKLSNFTYGSFVATASMSGHIVNFPQMQAAYNAAKAAVIHLCKFGWLE

SEQ ID NO: 31786 - protein, 89 aa, A.fumigatus
NRCSYSPGKSLAVEWVKFARANTVSPGYIATEISNFVPQETKDIWKDKIPMGREGRAEELKGAYLYLASDAASYTTGADLVVDGGYCAP

SEQ ID NO: 31787 - protein, 334 aa, A.fumigatus
LLPGCCSCQEGVALPQWYLLRSPPNPNPQTKHTDESATEVEFTGIKRRLLTEGLSDDALTTLAPGATFEDEFDVASTADLTEGGTVTIRTDGFVPITTDRKVSGYIPYQSNELEIEVDAAKAAAVPQAIKLLDRRTKVASCSGSRASALSTALRNAASLANAAASAASSGSSTRFQEYFKTTSSSTRNTVAARFRAVASEASSQSSGKTTYYCTDPYGYCDSNTLAYTLPSSNLIANCDIYYSYLPALTSSCHAQDQATTTLHEFTHAPAVYSPGTDDYAYGYRASTALSASQALLNADTYALFANGTPPLLPLSTSTSKCSTLTMVIAVNLNC

SEQ ID NO: 31788 - protein, 172 aa, A.fumigatus
PPVLVISPFVPGLVRDIYTAIISLGGVVYKYGVDPRSARRISKSTASVKQLSPIQFIMKVTILASAILALINGALALPANTPTLDVTLTQVDNTRIKATVKNTGNEKVTFVHLNFFQDAAPVKKVSLFRNGISSEVPPTPTPRPNILTSQPPRSSSPESSVVSSLKASLTMP

SEQ ID NO: 31789 - protein, 151 aa, A.fumigatus
PQTAKSPATSPTSQTSSRSRSTPQRPPPCPRPSSSSTAAQRSPPAPAAVPRPSPRLCATRLPSPTPLPALPPPARLLASRSTSRPPPAAPATPSPHASAPSPARPPPSLPARRPTTAPTPTATATPTPSPTLSPPATSSPTATSTTRISRR

SEQ ID NO: 31790 - protein, 110 aa, A.fumigatus
TLTASQYEIYEKRENEIVTSLVLHNPINSLYFLAYYSHPFNQSHNRNYKHTRTLRRGTAVNPSGKSLRDIYFHYSNSPRHSHTAGNPRRSPATSDSWAGISSRRSSPSSR

SEQ ID NO: 31791 - protein, 213 aa, A.fumigatus
CRAFGSGCGEGKEGGGTVSEQGIGIRVEQRLASTQGSGGPISVGIVVSTGRVDSRGVGELVQGGGGLVLGVAGAGQRREIRVVDVAVGDEVAGGESVGEGVGVAVAVGVGAVVGRLAGRLGGGLAGDGAEACGDGVAGAAGGGLEVLLEASRRAGGGSAGSGVGEGSRVAQSRGEGRGTAAGAGGDLCAAVEELDGLGHGGGLCGVDLDLELV

SEQ ID NO: 31792 - protein, 69 aa, A.fumigatus
PYLTRWQLTLQIESAMNEDNSSTTDPAKIQQANKTFSRNHAMSIHLNAIALVATVWYGFTLSSSLLNGL

SEQ ID NO: 31793 - protein, 145 aa, A.fumigatus
TNAMSTQHGPKSTRTNDLYELAVNISSTVEAFVGRLDAIGAERPNLDNPFPEIIQDEGAQLARLKILRLCERLMALVQGPVQWLMFQNMAFLDAACVGAILDMGIHDIIAPGPEPTSLDQIVEATGASKDILSTRRRLSSMQRSS

SEQ ID NO: 31794 - protein, 142 aa, A.fumigatus
ILAANKGLFDYFYTEDLARGQRFALGMAGSEIMKTLTEDMFPFESLPQGAKVVDVGGGRGHVSVRIAEKVPGLNFVVQDDESMLEAGQAEGVPKAVKDRIEFMPHDFFNEQPVKGADVYLLRFILHDHSDRLVLPTGRKKYG

SEQ ID NO: 31795 - protein, 110 aa, A.fumigatus
FCQQEGRSMANSPSRCAKILSNIVDAMEPGKSRILIDDAIVPSFLGPESSRFYNLLDLYMLAGLNGKERTLEQWNYLIQMVSPKLVLEKVWKTPNGGPESGTILELRLQE

SEQ ID NO: 31796 - protein, 163 aa, A.fumigatus
  UNSURE (1): Identity of amino acid sequences at the above locations are unknown.
XHIHFQYNGFLYGILVLSIVLARKPSTLLYSGILFAVLLCFKHIYLYLSLAYFVYLLRAYCLDPKSVFRPRFGNTLKLGLSVIGVFGIAFGPFAHWNQLLQLKDRLFPFSRGLCHAYWAPNIWAMYSFADRVLILREYNNLRLHLCRFTHHNSCSAPGPSDQP

SEQ ID NO: 31797 - protein, 174 aa, A.fumigatus
LPLIKLWLHPDWNTFVGAITLCGYASFLFGWHVHEKAVLLIIVPFSLIALKDRRYFSAFRPLAVAGHVSLFPLLFTAAEFPLKTVYTVWWLVLFLFVFDQVAPVSERPRMFVFDRLSLVYLTVAIPLIIYCSLVHQLIFGWDRYEFLPLMFMSSYSALGVVGSWVGFMVVYFTT

SEQ ID NO: 31798 - protein, 370 aa, A.fumigatus
FYSFAQYRDIQTNMSGVFGLLFSRLTLPAPSAIQGKTILITGANTGLGREAARHALALGAGTVILGVRSLSKGEDAKANIDASTGCTDKGKVLVWPIDLESFASVQGFAARVRKYVTEGGRLDMAIMNAGIASVTYAVTRDGWERGIQVNVLSTALLSLELLPLLLRTKERDSSSQPHLTIVTSDIHKSIKFPERNEQNILSALNDEKQWRESQAVGGATERYGVTKLMDLFITFEIAQLVPRDKSGNPLVIVNAVAPGFCKSDLLSREKVPLILKLIQALIAMTAEKGSKTLLHAASHGAETHGKWLDNQIITEYVVTLIGDVIVRAADMCFRPGNIITSPEAVVLRKKLWAEILSVLHDVNPEIQTES

SEQ ID NO: 31799 - protein, 79 aa, A.fumigatus
FEVDWPNKYLSLVCAAGTCVDVGFGVFALAQASNAQNDRTGAQGERMSGSFTTEASVRTGDEDSFPLDCRGSWESQPAK

SEQ ID NO: 31800 - protein, 143 aa, A.fumigatus
ALFELVTGNLCTANYYGSAAARMIYMLGGHTYPGPINSFSASPAEHLEQRKKRHLRNLFWLCYTIEKDVALRTGQPQVLSDENCDLTLPPGYVEHLYRSLGIHHHSRELPDHPMFPVDLRLSIIKSRAYSALYSFRGLQKTDA

SEQ ID NO: 31801 - protein, 101 aa, A.fumigatus
FAVHRLPVTSSKSAYESVSFVEERYSKVTQLARQFARCQASMTTHHNDKRLQTLQARILPEDLRDETLSLEGKSLAVDRREAKRSILVFRNLENGTKGKKG

SEQ ID NO: 31802 - protein, 374 aa, A.fumigatus
RRLDSLGDMGGPTLHLYLLSDNVTEKEDFYFGMLQNQTRMGDSPNCPPKHQQFDVKHIVTIVQRIHSSEEQLQTRWINAVLGRLFLALYKTPEVEDFIRQKITKKISRVNKPNFISKLCLQRIGMGEGAPFITNPRLKDLTVDGNCCVETDIQYTGNFRLEISATVRIDLSPRFKAREVDIVLAVVLKKLEGHMLIRFKPPPSNRVWVSFETMPNMVMDIEPIVSSKQITYGIILRTIESRIREVVAESVVQPYWDDIPFLDTASQPYRGGIWQREVPGQDSKAEIPDESISQPQTLTTKDSTEALKTKDDRAMSMPVLLETTAGLKSRKSSKLVTTDSETSISSAVDKTGGLCSAARYSISNVFECGRSCRHC

SEQ ID NO: 31803 - protein, 386 aa, A.fumigatus
NHAKAPSWLQQTRKRVYHQPLIKLAVCAPPRAIRSQTFSNVADPVVTADNVKIEKATSDIKGEEKSSAASAMIEISNRSPPGSPNKTPNGSPPSISQMNPEKLSSSRGSSFMESIESVSEFASSSPTRPTSAHLASESSNALRGANGSSNASINSDRSRRRSTLETVGTLTRSVTSSTASEEKPKLSISLGTATAAAKKWSWSVFGKGDSNSQEISRPAGTPDEPIGRGHPLPPPGTPLPRPDKFGIKSNPIPRRKPVPPPLPGRSKGDAKRPVPKPPLPKRKPPARPEGDESSPDELLVVEAPYDSTPNSPAPDSSSEIGIVLPIATQANTRDLSRSGSDDVVASRRWDDGTEQKSSEHDSFGHGMPGVTKHGMEILSATDGILP

SEQ ID NO: 31804 - protein, 69 aa, A.fumigatus
RFGRLSGKLAPAVRPSQVLATRSPPDSSISLTEGMKPNIVITYVKLLPSDGSKYVISLRTQVTAVCSIC

SEQ ID NO: 31805 - protein, 174 aa, A.fumigatus
MGTIPGGMTNGTRNWVFRKALSPSSAAASTNLPDPITPSGPAFSKTSTIGNVHTRTMKQTAVTLFRFSALTFNPHKIHYSLPWARDVEGHRDIVVHGPLNLINILDLWRDTRTATLASEAPELILPQSISYRATSPLYAEEEYRIILEDEDSIAKVQVIGPDGKTVAMKADIKS

SEQ ID NO: 31806 - protein, 205 aa, A.fumigatus
FADLALLLLRDWSERPTANWWSISGSSASAASARRRKAKALVTKTTRRWWPTTPAKPLTATLSTRPSTTQISPTLRTTPVRSRSTSKATPMFAAARARRASRTSSTSVRCLRRTTRWISWLPTRWPAFLPPSPASASSIPARAPGKSMPPNSAQMAASSSAMRRTTTSTCPVHLEATPTQARAASTPTWPLSADRTPSAAVKRAV

SEQ ID NO: 31807 - protein, 261 aa, A.fumigatus
DVSGGQPAGSPGSRRAGQHFYHQAQRPLPQYRPGLPEKACRQIRPRWPPPHRRCGERRHRHVRCTWRRRRPRRERHQRLPGRCQRTGRHPPRSKGPSEDVSGPEEEEQRRRRHGPRRQRGRRRSPGLRIQPWQGPTVHPSRARSAQDTWPQRQRQDPETEKSSQGGKTERTRRHPCWEETVKVEMKRAVCFLRGNWQLFSMPMYGVWAMTTQYIGTWDLNMTIWHYSILHTEKILAIFFSVPFPFLSQGVRPLRYLHSMFF

SEQ ID NO: 31808 - protein, 582 aa, A.fumigatus
RRSGDKRPPTSHTLIDLVIAMSIYLPRSSFASLFALAAAILNGQTTDQQLIKKAYKLIPRLATTETGRTALLERSAELQSLMLATADKTPASARRDRSLAIYELITYLPTSDLHFIPSILSEVVLGCKESNEKARTASFDLLIHLAKRTIDSDRNPPGTKIRNSLVPHMPNDAPDAPATIEEFFTMVSAGLAGSSPHMVAASVTALSRLFFDFHTQLEPSVRIDLVQTVELFLTSNNREIVRSVLGFVKVAVVVLPEDALRPRLNTLVPNLMVWNKEHKGRVRSKVKGILDRLIRRFGAPLIEGLVGEADRKLVVNIRKQRERRKRKKKEGEGAGDEDDEEVVADNAGKAAYSNAFDKAVYDSDFSDSEDDASEIEVDEQGNTHVRGRKGKKGKQNEQYIREMSPEDNPLDLLAPDALASISTTKPSVRFLNTGPGSRKKHAAKFGPDGRLLIGDAENDDIDMSGAPGGDADPGESGINAYLAAVSGPDAIRRGQKGRLKMSQAQKKKNSGGDGMDLDDNEDDDEAPASASNHGKGPQSTRRGLGVPKTHGPSGNGRIQKRRNPPKGGRQSGRGGIRVGKRR

SEQ ID NO: 31809 - protein, 340 aa, A.fumigatus
AVHTMSPLRPLLRSPQTPGKRVAQHIRHFHATRPSPFINEVLDVSSGFIHAVHSISGLPWALSIPLTALIVRTTVAMPLQMYTKIQARKERDLAPLLHSWRKHFQAQIKKRVDAENHNPILPREAIRELATKVKAKRKELHKRWNVPRFWKPVSFLQIPIWISVMESLRAMSGNNKGLVPYLLSLVEPSSVEPSTAVHLAVEPSLATEGALWFPDLLAGDSTGILPAALTLSIILNIRTGWKSPALSDMADLPRIEIAKNLTVRGIRVLIQALALNIGVSSYLYEMPSALMIYWISSTNIATLQTFLLERFMLSKPLLEPWRQIHIGYPQKGEKTPPSKK

SEQ ID NO: 31810 - protein, 637 aa, A.fumigatus
KGTIVPADGRIVSANLIQVDQSSITGESLAIDKHKGDTCYASSAVKRGRAIIVVTATGDYTFVGQAAALVNAASSGSGHFTEVLNGIGAVLLVLVIITLLVVWVSSFYRSNGITTILEFTLAITIIGVPVGLPAVVTTTMAVGAAYLAKKQAIVQRLSAIESLAGVEILCSDKTGTLTKNKLSLSEPYTVAGVEPDDLMLTACLAASRKKKGMDAIDKAFFKALRHYPRAKAALTKYKVLEFHPFDPVSKKVTAVVQSPQGRRMTCVKGAPLFVLKTVEEDHPIPEEIDTAYKNKVAEFATRGFRSLGVARRRDQGSWEILGIMPCSDPPRHDTAKTISEAKSLGLSIKMLTGDAVGIARETSRQLGLGTNVYNAERLGLGGGGTMPGSEVYDFVEAADGFAEVFPQHKYNVVEILQQRGYLVAMTGDGVNDAPSLKRADTGIAVEGSSDAARSAADIVFLAPGLSAIIDALKTSRQIFHRMYAYVVYRIALSLHLEVFLGLWIAILNESLNLQLVVFIAIFADIATLAIAYDNAPYSKTPVKWNLPKLWGMSILLGLVLAAGTWVALTTIMNSGEEGGIIQNFGERDDVLSLEISLTENWLIFITRANGPFWSSIPSWQLTGAILVVHLVATSFCI

SEQ ID NO: 31811 - protein, 89 aa, A.fumigatus
AQGAAFLAAGLRDWVDFGVICALLLLNASVGFIQEFQAGSIVDELKKTLALQAIVCREGEFNEIDASEIVPGDIVRIEEVTYHQSSNFR

SEQ ID NO: 31812 - protein, 303 aa, A.fumigatus
ADDKPGRYLDYKNITKVIQPGKLIYVDDGILSFEVLEIVDDQTLRVRCLNNGNISSRKGVNLPGTDVDLPALSEKDINDLKFGVKNRVDMIFASFIRRGSDIRHIREVLGEEGKEIQIIAKIENQQGVNNFDEILEETDGVMFARGDLGIEIPAPKVFLAQKMMIAKCNMKGKPVICATQMLESMTYNPRPTCAEVSDVANAVLDGADCVMLSGETAKGNYPTEAVKMMSETCLLAEVAIPHFQVFDELRNLAPRPTDTVESIAMAAVSASLELNAGAIVVLTTRYVISLSSAVDRIPLTVDP

SEQ ID NO: 31813 - protein, 119 aa, A.fumigatus
NCSSSFQVSPCLPNHHGHSQPHGRPGKFDLVVIVGQMSVANRAIKYSHLYRGVWPSTFPDTKPDFNVKIWPEDVDRRLKWGISHALKLGLTNYGDNILCFPSLCRWHGNPYTRSVLVPV

SEQ ID NO: 31814 - protein, 83 aa, A.fumigatus
SNSFFSSFLSNPSEESFKMAASNSLDHLSNRMKLEWHAKLNTEMVPAKNFRRTSIICTIGMSELLNLILEYPHPYELFGLTRY

SEQ ID NO: 31815 - protein, 258 aa, A.fumigatus
QRYYIPSGQDNNGSSVELKTGADGSHGDRLNGVSGAGSKVTQFVKDLEVRNSDLCKQAGLRHHLDSLGGVIALGSLSGQHDTVSAVENSVGNVRYLRTGGAGVVCHGLEHLSGTDDGLALHVTLGNHHLLGQEDLGRRYLDTQVTTGEHDTVSLLENLIEVVNTLLVLDLGNNLNLLALLAKDFTNVTNVASATDKRGEDHVNPILNTELEIVDILFRKSGKINVSAGQVDTLSRRDVAIVQAPDTKGLIVNNLEHLK

SEQ ID NO: 31816 - protein, 92 aa, A.fumigatus
CPSPSPQPQPPATSLTGYWLPPDIASKTDLVVGSGAAKATKTDLLDPSRVLRTSVHSPPSLTSTGLPYKVLLCFLTTGINVAEWLYRLSPRY

SEQ ID NO: 31817 - protein, 64 aa, A.fumigatus
SARLAGINVGAPARPLPSADFGLIGLAVMGQNLILNVADHGFTVCAYNRTTSKVDRFLANEGQG

SEQ ID NO: 31818 - protein, 66 aa, A.fumigatus
IITPSIKIKVLLAVIAKAWLLCTFNTISEGTFVGILVCTLYSAFSTLDHPPPGFCRIWSSTLVAVA

SEQ ID NO: 31819 - protein, 61 aa, A.fumigatus
FNFLNTSGDNGRNDALFMLHALFQISAKQGCYKVSFIVRGISKCRHIPVGARSARAGTLSV

SEQ ID NO: 31820 - protein, 375 aa, A.fumigatus
  UNSURE (3),(4),(5): Identity of amino acid sequences at the above locations are unknown.
PYXXXSARFASLATVVEDDSPVNGTTPVPDAGSPSGSPGPSHSDEVAWLTSELRKERQRVLDKEQKIAEMEAVLNATADVKQVNTELNEKRSTMVVLDAKKEIVMRELSVLTDHLEAEKRGASGPLDLGKITNKVLRDFVESLHKLKESFTPQIEELVQKRNDAAEELANLNRMKDKSFQEFEQLSSKNAQLAELNNQLVHQIQELYKANSTEGNRGANGLGIYSHGKEKSLSAIDALKAANNDLSASVSATNLSEEAEPATVVPGPQVVSIRKGQPRKFNWKKGGQNVAKGVTKGIKGAFMSSDSNAAQDANPGLPRSQTQDPSRQGFGFFGNQKSKQAGTRMPQTDSVPALADLAPTGMCRHFDMPLTIKLTL

SEQ ID NO: 31821 - protein, 170 aa, A.fumigatus
PHWIGMDMEGIYRKSGASSAVQSIREGFERFPQDYDISDPDLDIHAVTSALKQYFRKLPTPLITYEVYEKIIDTGEITSAEARISVLQKSLAELPRVHQDVLEFLVFHLKRVVEREKENLMTSQNIAVVFAPTIMRPESLAREMTDVQKKNEVLKFLVDNCQEVFMGMQS

SEQ ID NO: 31822 - protein, 70 aa, A.fumigatus
YASDNKANLIAALFGTDLEQRMEHEKSIIPAIVTRCIQEVELRGEILGACCSEVTKLTTLDRNGYGRNLS

SEQ ID NO: 31823 - protein, 637 aa, A.fumigatus
KAIKWRNNLQPDSNTQRTGRKASTKTQVGDALSHFLYCWFGKIITKSMKMTDRPSSAGLEEPVNLVAQNGQAVDSVPSRRSSSRSTEAPEASLPAPTESADVKQAVAKPPSAKLSLPNGEVADAQTSLRHTFPHLYHSSSASRSPWTGNSSSSIQALNEDTVVDARSDHGLWTKASLGRRMSHRSATDAQPADYPVYPDQSYAVLQSQIHPTYHPPFLRSRRSYPARTESLGRLVTPRTARTAGNTPVSSPGLFSVNSPNSTPPANSDNEGRISSPYLHPTHLQPPKETHTAEVDRDLVTGNKLINQYEILEELGRGEHGKVKLGRHVTTRQKVAIKIVQRYSKRRRLGKLGNPEDKVKKEVAILKKARHPNVVSLLEVIDDPNRQKVYIVLEFVENGEIIWRKKGLREIVQVDKRRLEREKAGIPETPSFWEECRQYVKTAQRLRRQREKARERRQMKAVHAQQAPIPAWSLEHGAESDEEEEADPAMTRTISRSIASHDETQESPSHSLASAHDSALAAIEGTMYGPYADYSLDRRFSTASSSMGYAPSEPEWFSDDDDMSYVPCLTVNEARNAFRDSLLGLEYLHYQGIIHRDIKPANLLVTSNHRVKISDFGVSYLGRPMVSPRGWKDPRWRH

SEQ ID NO: 31824 - protein, 195 aa, A.fumigatus
LRIARILRPPWVKTSLQWREHQINRFKPGKSIVGAHSVEEFCAKLKRPRRIMLLVMAGKPVDDFIESLLPHLEEGDIIIDGGNSHFPDSNRRTKYLKEKGIRFVGSGVSGGEEGARYGPSLMPGGNEEAWPFIKDIFQSIAANSDGEACCDWVGDEGAGHFVKMVHNGIEYGDMQLICEVRRVLAPIICRNSPLT

SEQ ID NO: 31825 - protein, 158 aa, A.fumigatus
QQAYDIMKRGLGMPVNEIADVFAKWNKGVLDSFLIEITRDVLYFNDNDGTPLVEKILDKAGQKGTGKWTAINALDLGMPVTLIGEAVFARCLSAIKDERIRASSLLDGPTPQFTGDKQAFIDDLEQALYASKIISYAQGFMLIQEVRCCSSHSAACNG

SEQ ID NO: 31826 - protein, 103 aa, A.fumigatus
AAREYGWKLNKPSIALMWRGGCIIRSVFLKDITNAYRNNPDLENLLFDDFFKAAIQKAQQGWRNVVSKGALWGIPTPAFSTALSFYDGYRTRHLPANLLQAQA

SEQ ID NO: 31827 - protein, 151 aa, A.fumigatus
AASYLLDEHEALSVGDDLGGIQSLLEVVDESLLVPGELGSRAIEEAAGTDTLVLDGAQATGEDGLTDQGNGHAKVESVDGGPLAGTLLARLVKDLLDEGSAIVVVEVENVTSDLNQERVQHTLVPLSEDIGDLVDGHAQTTLHDVISLLSC

SEQ ID NO: 31828 - protein, 192 aa, A.fumigatus
WAVAADYRSKNASYLADQLHVTVLDTVVDHLDEVTSAFVTHPVTASLAVAIGGNALEDVLDEGPGLFVATGHQRGTVAGTLLTTGNTAADEADALLLQVLGAAVAVGEVGVTTIDDDVTLLKVGEERLNEVVDRLASHNQQHDTARALQLGAEFLDGVSTDNGLAWFKSVNLVFPPLQTCLHPRGSKDPRYA

SEQ ID NO: 31829 - protein, 252 aa, A.fumigatus
DCISSHGKWWSTEVLTCHSLISRWWSPCHQVLENRRSQERNLQRRYRCHYSYGEIISQSPLRTLGTHFRIPWIETPIIYDVRAKPRNIASLTGTKDLQMVNITCRVLSRPRVDALPQIYRTLGTDFDERVLPSIVNEVLKSVVAQFNASQLITQRENVARLVRDNLARRAARFNIALDDVSLTVRTLLTRASPIVAYITNLFNCGFVAPDFLPRIYRRCRSQASSSAGGPARCLPRRQGPPGEAGLHCPCPG

SEQ ID NO: 31830 - protein, 108 aa, A.fumigatus
HLTFSPEFTAAVEAKQVAQQEAQRAAFLVDKARQEKQAFIVRAQGEARSAELIGDAIKNSKSYIELRRIENARQIAQILHESGGKNKLYLDTQGLGLNVNASRGDESK

SEQ ID NO: 31831 - protein, 297 aa, A.fumigatus
YVRVHSPLLSSLANEFISDLTEEQVKDILSSAGTVTKFRLMMNPETGKPKGYGFADFADADAAASAVRNLNDFEIMGRKIRVDWPHNNEKDSVPPDYSQTSQMPSQDVQAGQQPSAPLPPLPPGVEVPPHLDCPNAISQTLSSLPPNQLLDVLSQMKSLAMTDPARATELLRQAPQLAYAIFQALLLMNLVDYSTLGAVVEQATQPTAAAAPSAPPAAQAFQPFSAVPGQISTPPMVNTPFAPQPAAQAAPQQQVPSQEELLQQVLSMPQSAIDALPPMERNQIMLLRQQLMQGAMR

SEQ ID NO: 31832 - protein, 65 aa, A.fumigatus
LTIQRLAKICCIRKESKGNNTIIFTKLQEFNSEMRAIAIKYKYLFLPLLYILIYYINKALKLLNS

SEQ ID NO: 31833 - protein, 467 aa, A.fumigatus
  UNSURE (341),(346): Identity of amino acid sequences at the above locations are unknown.
PVMKTRYRTLKHVAQYSPLLPESVKRTIAQTPPQQSIKQRFTPDQLPLSELPMLLDKRLTLDVPVYTVWGACEDVRVLEKFRSGEYKVNNLHIIDEANSRLLDIGGVKLRLLGLGGAVVMHKLFDNGEGKTTIAGGQGTMWTTLLQMGELIDTANRVYDPSETRIFVTHASPAREGMLNQLSVTLKADFSISAGLHFRYGSSYNEFSVNPSLDHYRGKLAASKASFNDVWETVRGEVEAAISSNEAQKTLLDNALDVVQRMPTVANGGNPFGGPTAPGNAAGQVDESAFKNMWNFNLADAAFGFLVLEIEGGRIATEMRAQGFNFAHRTGKPQVAAGQTVXGGLPXSPATTARVPNATPPQFGQAPPAPARAAGTAQQQIQGKGPAAGSNSASPVPVIPNPATPHALCWAPHLNPMLLPRKKAGTSNPTELANQKNPRNPLCPQGKKNPTTEWFLSKFNKQTGGSGI

SEQ ID NO: 31834 - protein, 106 aa, A.fumigatus
  UNSURE (32): Identity of amino acid sequences at the above locations are unknown.
PGLGPGLIVSRWCRETSSKGMTYQKRDIKDPXLSASYVAHTKKKIGTTAAKDLNRFETECCNAVAPPGSQVTLSGKRKDLSKPLYRCNNWLDDVISLAFQKGIFEP

SEQ ID NO: 31835 - protein, 70 aa, A.fumigatus
VEVLKSKLNHMIKEATTSQDYEFGPNLSKKPGTTSKIGMNNMFNSTKVFPLPRVPIYYTLAARILVHPTA

SEQ ID NO: 31836 - protein, 439 aa, A.fumigatus
ADIPQNLVWSGWGNSGPGNAHGMHVCKYKGANHLCFFQGIQQNGYCRGHGVIMDNRYRIVKTVTPGGGIASSDMHEFRLVNDGKTALMTVYQQRQFDMSLWNLRMGMGWLMESIFQEIDVETNQVLFEWRSLDHVDPSVSYTYPSSTDTSGTGFEPRSPWDYFHINSVDKNKDGDYLISSRHTSCIYKISGKDGSILWRLHGANPSFKNINFSFSQQHDARWLGENATHTLLSLYNNGYNGYNQTHPYSSGMIILIDHVNNTATQIREYKPLNDDMLSSSQGNMQVLPNRNVFIGWGNNAYISEHDEQGKLVFWGYIDKDKIMNYRALKFEWEGNPTDVPALWTYAKTNDGFSPTTFYVSWNGATRVKHWRFYGAANSTGPYELLSQVAKQGIQTTYTNATFYPWSYVEAVDGQGTVLGKSRNQFTFTPSPELPRLLRE

SEQ ID NO: 31837 - protein, 74 aa, A.fumigatus
LLFVLSIPSSSLPSLLFSSSAHSPPFLFFLYITLFFFSYFATFLLLPLVSLLLPLPFYFCFVLTNLLSKISFSP

SEQ ID NO: 31838 - protein, 207 aa, A.fumigatus
  UNSURE (207): Identity of amino acid sequences at the above locations are unknown.
VIPPRISYLVLANLFCATGIVGSDPYLAPEVYDEKKYDPRPTDIWSLAIIFCCMTLRRFPWKQPRVSDNSYRIFVSTPTPGTPVPDADPKRHRAIKSAPDVSSFDNEGKPAQPAEEKNGLSEPSAQSDSEKKQAPTTSTTSDENRPPESPKDKVSGNLSKPTRTTSKEAPPLPASAQSSSQRQEVIKGHWRLLRIRPREVFTTGRRX

SEQ ID NO: 31839 - protein, 316 aa, A.fumigatus
HLWGEPNDPYARSKRPPQAKNLAQIDQRFIFGGRDSKRRNHTTPTFGRPGTPRSSSAGDLKSSDKRGGIFGSKKDLRQSDSGENKHHHGHMAELKRFFKMGHHKHKRGDSPSSLPKRSSRSSGKSTQSETVPFADDHGLNTKYGKLGKVLGSGAGGSVRLLKRNSDGVTFAVKQFRDRHSWETMKEYSKKVTAEFCIGSTLHHGNIIETLDIIQEGDHWYEVMEYAPYDLFAIVMTGKMSKDEIACSFKQILSGVAYLHGMGLAHRDLKLDNVVVNEHGIMKLIDFGSAVVFRYPFENDIVPASGELFHRGSRTWS

SEQ ID NO: 31840 - protein, 71 aa, A.fumigatus
CICRRPVSDGSSGRRDDHLNAYGQYGLQLKQWGEHCPSPGTSGAFDAYLCPEPQLPASGSACKHANNASTE

SEQ ID NO: 31841 - protein, 321 aa, A.fumigatus
CNLGRAFTNSISGESSHTRSTYPSIAIILERKTAEEIHSSLPFPVYSTFPDNDPSALHDKVDMTVTLGGDGTILRASSLFATCVDVPPMLSFSMGTLGFLSEWKFAEYKRAFREVFMSGAGAGDRAPILEDQMEDGTGPTGWSSVRGKSMGSSRGARILMRNRLKVGLFTADGKPIQVRGNIPAAQDQLGTQGVYVMNEVLLHRGKEPHLAVVDVYVGGRFLTEAVADGMIISTPTGSTAYSLSSGGSIVHPLVPAVLLTPICARSLSFRPLVLPASTPITLRLSEKNRGRELEVSIDGVNLGQGMTVGTEARVWNEEMRS

SEQ ID NO: 31842 - protein, 286 aa, A.fumigatus
VVARLRPARCGERRKCRGSNLPCSRFFVNLHTGKSQWERPEGPAQKEEQHAPPSGPPPSYDDSGPANPSVQAAATDDKKTLGSNNPYNQADPSNDTLESDARLAAQLQAEEDARAQSRSPVHPGAAADYYSGSSRPLSSAGYQPSQGPAPAPEPKRSRGFLSKLMGKSSSSSGSPHFGRPPIAQQQSYGYQQGGYYGGGYPPQPHPAGYGYPQYQPQGGHYPGAVPPRRGGGMGTAGAAALGVGGGLLGGALLAEAFDDDHGDTIINNYGDNYSGDFGGGDDFGDF

SEQ ID NO: 31843 - protein, 157 aa, A.fumigatus
  UNSURE (8): Identity of amino acid sequences at the above locations are unknown.
PNRNTFPXGTHATLTSLPSLKDREDASSHVLHPLTAPLTRSVSFVFRNLKATKPESYLLEIRSAEYVFAPYRVDVSADGTVLGVWETYRGNPWDNRGREKFVVDAAGGNGAKAAEVMVEAKILARRGFYEERARCEMDRIQPPRSRGGECFTLARFK

SEQ ID NO: 31844 - protein, 82 aa, A.fumigatus
WWKLRFWLEEDSMKNELDVRWTESNPRAPVVENALPLRASNDMSTDKMRRASLSSFALQKPYDLVGVGSPGLHLWDAETYGE

SEQ ID NO: 31845 - protein, 95 aa, A.fumigatus
  UNSURE (4): Identity of amino acid sequences at the above locations are unknown.
VVLXLLIHAYTRLPCVLTYLSVDPEMRAEFEKQSRTSPISGATRNAMAGGGGPGNFDLAGWMAGATPRQATGTDSEAARGTATGRETGGTTRRRG

SEQ ID NO: 31846 - protein, 94 aa, A.fumigatus
YRSLFRTNILNNYNLFIVSLDNYIRSLTVFYYSNNLRYYIEPYYKASFIKILDIIFIYTMFLDSFIYCYKLLFNNLRILLFYPLVYNSLIISYI

SEQ ID NO: 31847 - protein, 84 aa, A.fumigatus
ELVNLLDPKRVLWIDLVGRSIFPVRWIPTSSLPINNTNNIVSTNKNVETTKVTMRKYQRPSLALLFDKVLNFRVKSQIKFHAPT

SEQ ID NO: 31848 - protein, 61 aa, A.fumigatus
PPNNTKETLKKFRYIRDFPALQRLGMVCALYLYRPLYIVTAVGGNTALRIIYVYATMALQS

SEQ ID NO: 31849 - protein, 250 aa, A.fumigatus
PPYVPGWTVVYNLPFTTLHRRVCHSIPVITKCLHPTTIAAIYNERSTTYDAAIFHHRLAEEYIRAAAPQPGAQVLDLACGTGLVTFLAEAQVGPTGTVVGVDISEGMLEVARGKAQRTGSRVTFYQHDISNLSDLDLNPNPGGQDDGAGQFDLITCAAALVLLPDPLGAIRSWAELLRNGGKLVTDVAARDVHVPARIFEWIGPQLGLSLQWDQSWVKGEESLAGLLTEGRLEVEKGIVTPVFQVKEYRV

SEQ ID NO: 31850 - protein, 145 aa, A.fumigatus
RPNAPAGSPAAGAEPTAPLLPAAAAADCHWPRRRSRHDQPASWHPIREPRSPFHSPLRTVCADASRPDQSPASAPALPQPRPCAGWADPKAPNPCGFGRRPPTSRRPASPALPSGPTTNPARSHPVPPAGLACPPAARSSLGLIG

SEQ ID NO: 31851 - protein, 102 aa, A.fumigatus
HPRHNQMPPSHHHRSHLQRTEHHLRCRHLPPPPRRGVHPRRSPPAWRSGPRSRLRHGPSHLPRRSAGRTDRDRRRRRYQRGDAGGCAGKGTADRLAGYLLPA

SEQ ID NO: 31852 - protein, 91 aa, A.fumigatus
PISPREDRAAGGQARPAGGTGCERAGFVVGPDGRAGLAGRREVGGLLPKPQGFGAFGSAQPAHGRGCGSAGADAGLWSGRDASAQTVRRGE

SEQ ID NO: 31853 - protein, 155 aa, A.fumigatus
SSQMRLYTEVCVPRDPQPDRLANGELDLLKIPDADAFAYHQELKKLAASLGLTHLEFVRPGTLAGIVPEEAKTLEEYSDHVSKTRNLLDGTLAQAVDPNEDENMRATSKQYDTALPQAEDHEAFKAAMLKRGKVGLESHTAVRHDVADRFRPMLS

SEQ ID NO: 31854 - protein, 79 aa, A.fumigatus
LILINNNNNNNYYYYYYYYYYYYYYYYYIYIKAKHHIESCHAQIDQDALRWQPSHSNGEQGLPDHLHHLSLSSPLRRCS

SEQ ID NO: 31855 - protein, 135 aa, A.fumigatus
IKMPYAGNLPTPTENKVSQIISIISAYRHRSAAVPDRFSEFAPALEKQLTETVSKGEPVRFILPSFPFKAPAEGDKRKTLGSLPDKAEEIALQTLDAFADSIAEIHQPGATVVIVSDASVYGGMCPEGSPARQTG

SEQ ID NO: 31856 - protein, 407 aa, A.fumigatus
PLQAYAKLIASSAESTIRLSIHESNNVGKITMNLFPPPTNPDFITPWHGAVAVLADASVRIVDASTVDRDRFEVITNHEGRPWLLREKSDLFDWFGMELDFEPLFPCGMQVRPKEGYGPYRFEDVNMKLVRRLALSTAPLLLRGFTMQVEKEVFRSKARELGEIQMWPFGDILEVRENADFNMNNVLTREAMPFHYDGVFKTVQDEKTGEWISVPPLFQMFRNRAASQSKGGLTLFASSRNLIPLLGPDSIPLEELRKLQWETFTAANEAFGGHKLQLPFIITHPESGVDTFRFHEPWPESKCVPGSSEPTLVRVVGWPLAESDALCEKLTRLLYDRRVAYRHQWRAGDFIFNDNAMTHHTRTAFEDGHREHWRVHVNKMVLFLKSMRIFPVRDRNQNEIGSMIVCL

SEQ ID NO: 31857 - protein, 191 aa, A.fumigatus
AKRLLSCFSKLTFGAQHVPDKASIVSKATKKALEWLSAMSNFDKASGRAFRLCDGFSRRLAPHVGADIEKFPAAGDTARDATPDAHFDDAEDTAVGKTSADNLTTELDAIACSPMNESNSPLPGQIPFELASSDPFDFLKTDKSVSGHNTFDDLFPYDADTGQITGSFFPPENNIDFDLGCFWGDPIFWKE

SEQ ID NO: 31858 - protein, 72 aa, A.fumigatus
GRAYSSAIAQKPDSSEGQYKASGDIVGANSLGPFEGKCRDSHGGRAQPGYSKPAKTSYNISWESVDRTCGNG

SEQ ID NO: 31859 - protein, 142 aa, A.fumigatus
IERELEAVKHVLRGGQVCCPSFARVWIWHHYWIGFRFCVGDDLHYLGFEEVRASHIRPHRATPNIGCNASTLTCSHANKESTYRYQHEVQTSEMFSTAGRSVKSGLVAAAVVSSWTWAATLLQSSAVAYQYGVSGPFFYASG

SEQ ID NO: 31860 - protein, 173 aa, A.fumigatus
LISAIAASPVHAFPGYVIGGLCWFAIPWLCATTMGISALALEGAQRISSDDVTAGLVLPFAAVRLLGYSGAVCTTLMVFMAVTSAFSAQLIAVSSIVTYDVYQAYINPAAKGKRLVWVSHMSCIVFALIMAAFATGLYYAGIGMGYLYLLMGVIISSAVFLGAMTLVWKQQNW

SEQ ID NO: 31861 - protein, 241 aa, A.fumigatus
PGIGACVQIILFATLAIELKRRAPNAHTFLEALRARYGTAVHLVFIVFCLMTNILVTAMLLTGGSAVLTSLTGVHTAAACFLLPIGVVLYTLFGGIKATFITDYMHTVVIIVVIFIFAFSAYATNAELGSPGKVYDALVAASELHPVEGNAQGSYLTMRSKEGGIFWVINLVGMYPRAAQYNNTSSDRCFAGNFGLVTYIIRTSRQIADDCNSTVFLDNGYYNKGASTLFLKEQLGEEDTN

SEQ ID NO: 31862 - protein, 101 aa, A.fumigatus
  UNSURE (18),(39): Identity of amino acid sequences at the above locations are unknown.
WLRWNVVLQLCLTFLGFXLFLAYLLLGYPEAYMGLFDSXMLPLLYSQDNVSYHISYLLQMKKINISYSSLGDTRSTFLFINRVDRKQSLAGSLPMYDFAYS

SEQ ID NO: 31863 - protein, 176 aa, A.fumigatus
  UNSURE (139): Identity of amino acid sequences at the above locations are unknown.
YRDWMKSRGKVIWYRRSHTAYTSAVRDMGIPGLTQSFVINSFLKPFNTVSSYIEITPTLDESICLSQDFPTRKMAFPYSQSPPYDAPAPDLNPSGGSYYTPQDAPHGYGAQQPYGQPGQLEQYTSVHTTQHDLSPQAQXYQPPPPRDFLSPSDALGYQHAPRNYEARGRQGSNAEY

SEQ ID NO: 31864 - protein, 186 aa, A.fumigatus
ARLMRWGTSMRPETTKLEVARAAMLSISMTPSSSIWFHLRLTPYSNQHTDEHRNISRSRRSRSRASSSAMKDRSGSRSRSRSGSSGQDRSLAGTLMGGASGYYLGHKQSHGLLGALGGALLGNFLEHQVEEHKEHGEDHHKRHRHRHRHHHHHHHHNHDHGHLDQHHHDHRHHRSRSRHSRHSDYS

SEQ ID NO: 31865 - protein, 78 aa, A.fumigatus
GIFWSTRWRNTRSMVRIITSAIAIAIVITTTTIIIIMIMGISINTTMTIGIIGAVRDIVDTVIILEVWDRCGMCSVWH

SEQ ID NO: 31866 - protein, 203 aa, A.fumigatus
ASKRAFVNCLDSLSMPPPLLYNVLPAALPAHCEPSSPFLAAVSSHLHICLPTPLALLSSILGTLSIISWLFAQLPQIYKNYQLQSTSGLSLFFLVEWCLGDTGNLVGALFTRQAAWQVIIAAYYVLVDVTLVFQFFWYTHYKGRRVAYGGHSHSHHGEDAGSFLEGVPLSEEDSITDIPPRKPATEGSASIDHEAPKSAYRLY

SEQ ID NO: 31867 - protein, 103 aa, A.fumigatus
RAAHPVVPAFPFFFPLPFSHFSQFVNMDNVTEKQTSALELEEQPVSKGGPVYDVNEKVGLDRAGAINAEDVEHKMTVVEAVKAYPAASWWAFVMSCTIVSSCA

SEQ ID NO: 31868 - protein, 227 aa, A.fumigatus
ELQRRRCCRCSGLLGQSLLAVSLTTTNPGMTPQRTGSSAPIYAIEEHCTNSHARIPIALQWMFPTPLAILLYLAPESPWWLVRKGRLADAEKAVRRLGRASANDDPADAVAMMRRTIELEKTEKKPSLVELWKGTDLYRTLIVCGVYASQNLTGNLIANQAVYFFKRESNPFLHTHSRLTPAQRPVWQTTPHLHSVSSLLLSSGSWSCSLGSSPHTSADAPSMSMAN

SEQ ID NO: 31869 - protein, 173 aa, A.fumigatus
IMESYCVFLMGQFIATKRFARDYGVWSDVKQDFIIEASWQSAFQCSGPVGAFIGVFIAGPITSWIGYRWATIGGLMFLNAFIFIFYFGNSQGMFLASQILEGIPWGIFVANAPAYCSEIVPMRLRAPATQMLQMFWAIGSIIVGGITYHYQSRDDPTAYRFVRSHICHRGALY

SEQ ID NO: 31870 - protein, 99 aa, A.fumigatus
VQPFPAHSQQTNTSSEAGMADNTAFALGLITSALQWIMVMLSWILTTYLGRRTIYVYGQLINCVFLVALGIAASVGASKAASNAVFTTGLEGSDGVSTK

SEQ ID NO: 31871 - protein, 77 aa, A.fumigatus
PTSYFPLSFSSIQVILSPAVTYQVDCLSIIAFSFLLFIRFSPSFCLFSLCVRQVTHRTLTDLDKIFSLRIISVQIGC

SEQ ID NO: 31872 - protein, 132 aa, A.fumigatus
PYAQFRNKFLPKDIKIVGYARTKMDHEEFLKRVRSYIKVPTKEIEEQLDSFCGLCTYISGQYDQDDSFINLRKHLEKVEKGHKEQNRVFYMALPPSVFTTVSEQLKRNCYPKNGIARIIVSFPTQPEEKSNI

SEQ ID NO: 31873 - protein, 108 aa, A.fumigatus
EETLAASSHMVRIGSHQLRIATNLVLETKHFIYLLPRTLRHPPLQDTIESYVMFTSYFGDGESTLRSPSAKSGNPELTLREQSQMEGWCAAAGHNRHRLLLDKSNVSC

SEQ ID NO: 31874 - protein, 309 aa, A.fumigatus
  UNSURE (306): Identity of amino acid sequences at the above locations are unknown.
IEVCSGTNIYCQRIVGVRHKCLTCPDWDYCSECVGNAAQTHPGHRFAPLYEAISEPIQHHEVHYGIYCDGPLCKDKPFPRYITGVRYKCSVCHDTDFCAKCEALPTNPHNRTHPLLMLKTPVRGVTISNSVTENGFGGPVILTGDQVNRSTSAQANIPAEAEKSSEAPHHEEEATVKQKEVVEPSPGAAEKAQSKVYEMPTTDPASSYQAFFIRDTVHDGTVMLPNKVFQQTWTLYNPGPLAWPAGSSVRFVGGDSMFNVDTNRPMSLDAVSAAMESNQLLEPLEPGQSADFTVSSPRGCKGPLQXLSN

SEQ ID NO: 31875 - protein, 306 aa, A.fumigatus
LRQLIGVPPDSNIIFERYSDSAGCYVRLDSENLAVYKQLYRAAKAKLKLRIRATLVNEVNEPVAQPALSENAPEEQGPARYSYLETVLSSPPPVMGSEVVPSGSSESVPGLLGALEKPASVGPQSAQWTKDNTAPAQPGYRDFVLNTDNVDVPIVSHRSPTGVFCIDCNNCGRSIRNEHYHCSICEDGDFDLCSQCVNSGVSCQSEDHWLIKRIVEDGIVTNSTTERVAPRKVEEPRQSKTGSETLPELAPEEVQKPTPAPEEVQEPTPATAEKYPLQPAERICNSCLKGALPVVTHEVSVVAHSR

SEQ ID NO: 31876 - protein, 63 aa, A.fumigatus
NKVIEQILWLNTIESLPTVVGKDSMVLDGEWFKLRPELTRVEYHPTYLLKEEPEHPVSLRGNL

SEQ ID NO: 31877 - protein, 393 aa, A.fumigatus
ARGIFQPIQCCLCEGEDLQTSPGFPINKRKVTWSGGPCASGSINCGYLPFKELGGSLFWPGSSCCPLLTMASISLPLPPQSPAALSQHFDSPSQSPSRHSRRNLSMAAPLPNPPFVFPARDPEPSNMRPSAPPEQRSRIPHPLPAFSFNPGSSHTTQSPVSAVPPARVSGHRRRPSEFIGGDQLVTKGVTETGQSNDENSLPAPAKLPTPGPGFSAGGPGRRHHAHRRSAAVSGVDLAEITKALALKPAVSTPSTPADPKIGAFEEQHRPVSYSAISLSRPTPPASPRIPFAGSSPHRAATESPVQSPASGRPVLPVKPNSPGPNGSHQSQLGARNSGKSGKDGFLAVNDATPSAPEKAFPIPRTADALLMCDLGGNGVSGDVSHMKRPSSAT

SEQ ID NO: 31878 - protein, 66 aa, A.fumigatus
  UNSURE (6): Identity of amino acid sequences at the above locations are unknown.
VSTKCXVRIFMTTIAKSHGTNQAVSCCLFNHSGQPETNTGTANGSPLSQNGSFNYRTWKIFTLKIN

SEQ ID NO: 31879 - protein, 223 aa, A.fumigatus
LAKNVLTFNILFDGIPIIYQGQEQHFNGAYYANNSNREAVWLSGYNTDAELYKLAAKLNRLRKHVYNLDNNYLDIETYPIYQGSSELAFRKGVEGRQTIMLLSTQGANQKEPYDLYMPVSFNPGVVAMDVLNCVNYTVNRAGQLVVPMDKGEPRVFFPANLMPGSGLCGFSDTNISYVELKTGKPASSGSAKVFSMTPAGIPVTILFSVLVSLGFGLGFGLGC

SEQ ID NO: 31880 - protein, 150 aa, A.fumigatus
  UNSURE (128): Identity of amino acid sequences at the above locations are unknown.
IVSLNCQCDLSARLHNETRRAKSKIKHCINYYGDRIDSDKDRHSLIMRMADPHIHTEQYGVYVQYAVGGCPIYQRRFPGARTGSFVSEMTKGSRLQSQGDQTKQERSSGDGERAGTVGGGGGGAGAGXGSAAGFAAGGGGSLGSCRGGEY

SEQ ID NO: 31881 - protein, 95 aa, A.fumigatus
RRNTSSLANIVEVMKNSCHDVTSMTTFTESHDVNRFANMTSDMAVGTDPFPPTKAIPPPLPADTLNPFLARKECTYVQHPLRRHPHHIPGAGAAL

SEQ ID NO: 31882 - protein, 100 aa, A.fumigatus
  UNSURE (21),(44),(50),(82),(88): Identity of amino acid sequences at the above locations are unknown.
HGSQILQHIRNWIRSGYPDQXGFPGIPRTRESLAQWQQFKVGSXGSLTTXDLISSASATGSASTSFSSTVRFFSTASAYATXFASATXFSTLSKSASGTG

SEQ ID NO: 31883 - protein, 94 aa, A.fumigatus
  UNSURE (8),(14),(62): Identity of amino acid sequences at the above locations are unknown.
HCICICHXFCICHXFFHLEQVRLWHRLVACSGFFKSRVLIFSASAASKTASATGSETSGASXSSTSSPTTTPNGAGSLTVPAGSLLLGLVALAL

SEQ ID NO: 31884 - protein, 153 aa, A.fumigatus
SYSLGPDEYVMAVKNMDLEVSENTHERRNMIVVGTAFARGEDIPSRGCIYVFEVIKVVPDPEKPETDRKLKLIGKELVKGAVTALSQIGGQGFLIAAQGQKCMVRGLKEDGSLLPVAFMDMQCYVNVLKELKGTGMCIMGDAVKGLWFAGYSV

SEQ ID NO: 31885 - protein, 163 aa, A.fumigatus
FQIDPKSSNGDRLLARSKFHMGHFATTMTLLPRTMVSSEKAMANPDSMEIDSQTISQQVLITSQSGSVGIVTSVPEESYRRLSALQSQLANSLEHPCGLNPRAYRAVESDGTAGRGMLDGNLLYQWLDMGQHRKMEIAARVGAHEWEIKADLEAIGAEGLGYL

SEQ ID NO: 31886 - protein, 118 aa, A.fumigatus
NLGQRIRRLLLSFFNLISLILSYLISFSRSGFLLVSLRYRVQGSSTSIASCALSSIHLMSYSLNRAPTYSCPSQGGFTPYHFLKCLTIEFSPNLLLCYMTLLKSLFQDGQVASLNTRS

SEQ ID NO: 31887 - protein, 69 aa, A.fumigatus
  UNSURE (46): Identity of amino acid sequences at the above locations are unknown.
IFLFTFAVLGISLLLGKTKSDFRGCYMIILMPMHNIVEGRLAAVFXFFFSFLSAPFFSLYYILCQIDSF

SEQ ID NO: 31888 - protein, 273 aa, A.fumigatus
LERGYTISFDFPQKFANFLIGKRGENINKLREEFDVDIKVDNGKVEVKGPKAKADAAKTRIINLGKKLEDETTHVLKIPAQYHRELIGQKGSQVNRLQDRYSVRVQFPRAAVATPSFDDQSVADTSSEVGGSRPIRPNQAPDEVIVKGPSKGADAARDEILSLLQWVIDHSHSATVSVAQSQIPSLIGQRGREMDKLRADTGAQIDVPGANDAPDASGRVQIKIKGTKQQVEEAKKILLQRSSEFDAIVTKTIDVDKKYHKALIGAGGKFVLI

SEQ ID NO: 31889 - protein, 340 aa, A.fumigatus
VSRPPWKLTQCPGANIRKIVTEAGGPTDGSASRIVRFPRPDSSESTIKLEGNGKVVDNIIAAIEAFVREREDQVTVTVDIPPVQHRLLIGRGGETRRGIESQFNVTLDIPKQGSGRTDIKLKGPSNAVESAKEHILAMLKDQQGETVEVPRHLHHVVADNGAFFRRLRNDYRVTVDHAGQQVPLKPASEESRATTNGASSLPLITDEPSDSVDAHSWKVVDHSDASQDATQPATIPWVLIGSSDNVARAKSALEKAIASASQQTSTGYLILPDPKTYRFVIGQGGSQINTIRKQTGCRINVPKDQARGEAIEIKGSKDGLEKAKEMILDAVRAGLNGGSR

SEQ ID NO: 31890 - protein, 77 aa, A.fumigatus
ASEVVPISPCHPELNPDTLLTNFQELKFGVEARAQLLKGVDTLAKAVTSTLGPKGRNVLIESPYGSPKITKGTFDSS

SEQ ID NO: 31891 - protein, 518 aa, A.fumigatus
  UNSURE (49),(287): Identity of amino acid sequences at the above locations are unknown.
LKIDGVSVAKAITLQDKFENLGARFLQDVASKTNEIAGDGTTTVTVLAXAIFFETVKNVAAGCNPMDLRRGIQAAVDAVVDYLQKNKRDITTGEEIAQVATISANGDTHIGKLISTAMERVGKEGVITVKEGKTIEDELEVTEGMRFDRGYTSPYFITDTKSQKVEFEKPLILLSEKKISAVQDIIPALEASTTLRRPLVIIAEDIEGEALAVCILNKLRGQLQVAAVKAPGFGDNRKSILGDLAVLTNGTVFTDELDIKLEKLTPDMLGSTGAITITKEDTIILNXEGSKDAIAQRCEQIRGVMADPSTSEYEKEKLQERLAKLSGGVAVIKVGGASEVEVGEKKDRVVDALNATRAAVEEGILPGGGTALLKAAANGLDNVKPENFDQQLGVSIIKNAITRPARTIVENTGLEGSVIVCKLTDEFAKDFNRGFDSSKGEYVYMISSGILDPLKVVRTALLDTSGVASLLGTTEVAIVEAPDEKGPAAPAWVVWVVWAAWVAACSNWFHWPWYHSLS

SEQ ID NO: 31892 - protein, 195 aa, A.fumigatus
KAMVPRPMEPVRTCRHPCRPYHPYHPCRSSGAFLVRGLNNSDLSGTEQGGDTAGVEQSGANNLEGIEDTAGDHVDVLALGAVETAVEVLGELVGQLADNDAALEAGVLNNGASGAGDGILDDAHTELLVEVLGLDIVKAVGGGLEKGGTTTGEDTLLNSSTGSIESIDNTVFFLTDLNLGGTTDLDDGNTARELS

SEQ ID NO: 31893 - protein, 320 aa, A.fumigatus
  UNSURE (35),(273): Identity of amino acid sequences at the above locations are unknown.
TLLELLLLVFGGAGVRHDTANLLAALGNGVLAALXVQDDGVLLGDGDGAGGTKHIGGKLLEFDVELISEDGTVGKDGKIAQDALAVVTESRSLDSSDLQLATKLVQNADGESLTLNVLCDNNQGAAEGGGGLKGGDDVLNGRDLLLRQQNQRLLELNLLGLGIGDEVGGGVSTVEAHTLSDLELILNGLALLDSDDTLLANTLHGGGDQLTDVGVTVSGDSSNLSDLLTGGDVTLVLLEVVDDSINSSLDTAAQIHGVAASSNILHGLKKNGXGKDGNGGGTVTSNLVGLRSDILEEASTEVLELVLESDGLGNRDTIYF

SEQ ID NO: 31894 - protein, 260 aa, A.fumigatus
  UNSURE (156): Identity of amino acid sequences at the above locations are unknown.
TYSPLELSKPRLKSLANSSVSLQTMTLPSRPVFSTMVRAGRVMAFLMMLTPSCWSKFSGLTLSRPLAAALRRAVPPPGRIPSSTAARVALRASTTRSFFSPTSTSEAPPTLMTATPPESLARRSWSFSFSYSEVLGSAMTPRICSQRWAMASLLPXPFRMMVSSLVMVMAPVEPSISGVSFSSLMSSSSVKTVPLVRTARSPRMLLRLSPNPGALTAATCSWPRSLFRMQTARASPSMSSAIITRGRRRVVEASRAGMMS

SEQ ID NO: 31895 - protein, 71 aa, A.fumigatus
FWEEKSGKVIHSPRIREAGSAIVFMPVIGMYVLKKVVKIHALLAWGNAHLLTLLGIQMIQGVRNKVELLVL

SEQ ID NO: 31896 - protein, 137 aa, A.fumigatus
PDKRRGITNPVIAIAGTGWGSVSLLKKLDTENYNVVVISPRNYFLFTPLLPSCTTGQVEHRSIMEPIRNILRQKKAHVKFYEAEATKIDYEKRVVYISDDSEIKGDISHTEVPFDMLVVGVGAENATFGESRALSAN

SEQ ID NO: 31897 - protein, 79 aa, A.fumigatus
LFSPFSPFSLRLGAIKTFNGWKFHVPLQHGFPNCHAVNVAVAQVAFDAIASPRSPVVTPSEIRYFLSAVCPAHLPSLLC

SEQ ID NO: 31898 - protein, 384 aa, A.fumigatus
VQIDRKTPVNGVITGIKGVKEHSCFLKEVGDAQKIRKRIMDCVETAMFKDQPEEEVKRLLHMVVVGGGPTGVEFAGELQDFFNEDLKKWIPEIKDNFHVTLVEALPNVLPMFSKQLIDYTESTFKEEAITIRTKTMVKNVTDKYIEAEVTKPDGTKELETIPYGLLVWATGNAVRNVVRDLMNQIPAQKNSRRGLAVNEYLVVNGTENVWAVGDCAVTNYAPTAQVASQEGAFLARLFNTMAKTEAIEKELKRLSEAQAVAKNEEERNKIFDEIRERQKQLRRTKQIGPFQYSHQGSLAYIGKERAVADISWLSGNIASGGTVTYLFWRSAYLSMCFSSKCLLRPTNHKIVPFPFLTISIARNRVLVAADWLKAKIFGRDVSRE

SEQ ID NO: 31899 - protein, 145 aa, A.fumigatus
VRSRPSMVGSSMFRSNMASPTVMQLTSLSRRSLSTRSPALGLRLSRPLRSATSSQQCVQRTFRRSYADAAPTPKPKKRFRFLRWAWRLTWLSGVGLTGALIYSIYEQRHPIEQIEPDPTKKTLVILGMLGSLPCLPPIDRVANVT

SEQ ID NO: 31900 - protein, 60 aa, A.fumigatus
FSVDKTTTINRAPKYEVSLGPWRWPNSSQILMTFHIHHEYNTQLTETNILFPDTNIDSFT

SEQ ID NO: 31901 - protein, 127 aa, A.fumigatus
YLVRRMPVLRVLCKDYPQRTLILATTDDALVFKAIATEVDHSTGKKERDNIHCLVEFCSLSSVDLTGYRRLCDGHGTLGLIALDGDVFLCVVTGASKAATVRPGEAVWRIDNVHFRNSSHSLVYLIF

SEQ ID NO: 31902 - protein, 79 aa, A.fumigatus
FPLPRLSYILTEAVCLNHSCNEDGLNYESESEFAAEESNRGEDKEIVTDHPFLALKKLLSDGSFYYSLDFDLTNRLQNR

SEQ ID NO: 31903 - protein, 375 aa, A.fumigatus
  UNSURE (360),(372),(373),(374): Identity of amino acid sequences at the above locations are unknown.
HIVSSNKADAFDMGSLDEDMLWNSYMINPLLSLRSHLSRLGKLHLDMSRMLTYVIRGFCSTLTIPTSRPIVQQAPTRLPPTLTVISRQSSRRAGTRFNSRGIDDDGNVANFVETETVLWIPPCFTFSYVQIRGSVPVFWEQAPGFFPGQQKIEVIRSCEATKHAFDKHFESLESRYGAVHIVNLLSSLKPGEVELSTRFNELVSRSPLNQKANADASSNHMLLEMTEFDFHAEARGPLGYGASDQIKDVILHSVDGFGYFLSESTCYGNEAKTSSVVLQQEGVFRTNCLDCLDRTNLVQTIISTMALESFFRQQGAHIDPELWLRHSTLWADNGDALSRIYAGTGALKSSFSRHGSSLSXFPLAPRINKYVXXXN

SEQ ID NO: 31904 - protein, 451 aa, A.fumigatus
IANHRGQFAIALGPLFVLFLLAAAYYRASARNLKRHDSVLRSTVFSRFGEAITGVASIQAYRMEGYFQRNLHESIDSMNGAYFLTFSNQRWLSIRLDAIGSLMILVVGILVVTSRFNVGPSISGLVLSYVLNITLSLQFTIRQFAEVGNNMNAAERIHYYGTSLDQEAPLQLAEVPPGWPEKGRITFSDVQMRYRDGLPLVLKGLTMDVRGGERIGIVGRTGAGKSSIMAALFRLTELSGGSIKIDDIDIATVGLRDLRTRLAIIPQDPTLFRGTIRSNLDPFNEHTDLELWAALRKAHLVGQELPEDESQDGTLTPSSMNEKQQTVQRLHLDTIVEEEGHNFSLGQRQLMALARALVRDARIIICDEATSSVDFETDQKVQETMAQGFQGKTLLCIAHRLRTIINYDRICVMDQGQIAEFDTPLALWEKPDGIFRSMCDQSGITREDFEG

SEQ ID NO: 31905 - protein, 195 aa, A.fumigatus
RCVSTYYEIQWRRVTGRTSTQQQTERIRATTPVSSNSWSCCTSTRHERTPGNVTALQAAVSRWNIDIVRLLLEWGADVNAPANKHKHGGKPALQTAAPENHRVMTDLLVHQGAGVNGVPSPVRGRTALQEAASSGYVQLSEYLLAHGADADALARTFGWCYSLARGRNTRQHSHCDDAASGRGRCPWSCSREWQA

SEQ ID NO: 31906 - protein, 238 aa, A.fumigatus
AMQSSVLPWNPCAIVSWTFWSVSKSTDEVASSQMMMRASRTRARAKAISCRWPSEKLCPSSSTMVSRCSRCTVCCFSFIDDGVRVPSWDSSSGSSWPTRCALRNAAHSSRSVCSLKGSRFERIVPRKSVGSCGIIARRVRRSRSPTVAISMSSILILPPESSVRRNSAAMMLDLPAPVRPTMPIRSPPRTSIVSPLSTRGSPSRYRICTSENVILPFSGQPGGTSANWRGASWSKLVP

SEQ ID NO: 31907 - protein, 123 aa, A.fumigatus
SGFIQRDEPLLTVRRRKIALYIACQALGVAATVAISQTIAAIGFPILIIALIPFRVWIMPRWFSVEELDVMDDLTANNSAVLASLGGPPQFPGQPDNEMFGLERRYSEQRFGSTRQRAGSIHR

SEQ ID NO: 31908 - protein, 81 aa, A.fumigatus
VLSPKLSRNLSRTHGAYAYVDHPQPRVFRKVKWTSTEYLHSVSNFFKNNNNNIIIIIVIWITHDRSNPASCLPFQRTRLLS

SEQ ID NO: 31909 - protein, 383 aa, A.fumigatus
AITITSEVKMDRTPLAGDRCLDSDLIFSSSPGFGTPVRPLRKSNLNAPVARSSVLPILLPPSTLRPVAFRTFTRKHNLTISSSALQTLASFVGKHCGSGWREEGLAERVLDEVAKGWKKAGGGVIVEEGRGASLKAILKALEGNMSGGRVVAAKPSAIREGPIDVNAPNCDARRLNPHLSPDPAINNEELDDLDLSLHPRNWIKIVEAFDMPRLTYNVDKKYFELTKSKATLFPQASHKTSMFRDRYNIIHQRLLRNETFQSSLSYLTGHSMKRSSSSFAPTQCYRLTPIANLLGRSGTSHLLLGLLSISPAGDLSLVDLTGSVALDLSHARTIPDDGAWFAPGMVVIVDGVYEEEGSVRGSVLGGHSGVGGAVGGRFVGVSI

SEQ ID NO: 31910 - protein, 699 aa, A.fumigatus
  UNSURE (689): Identity of amino acid sequences at the above locations are unknown.
VVFKGDLNEDLRCLHRFVTSMDNRGSFFFLLIVFYLLLSSQSRPPLLDQDRERQREVARERGALRLLNESKYGDFDPPGDKWLPFAGTRKNDSYAWGILPEAQGRARHQLRSAISNAGLEPPRSLEDPDALPSLNLTQLLLPVYRNATGKLRGDWVRRKLNKEYPKLNTTAIALEHGYFTHEFGLNITGSSGTFYLDLREGGGEELRVDSGQVREIRATLAVESNDFWGNTWYISLFGVHFPETGAIILSSNSEKFEGLFVLPHLAFSSDAYELSHQLLLNSLSDTLSEKENRPPTLFPWSSLIGSEQVEFPAPKCEHIIYLQQHPVTIHDYLADKPVVDQIEEELRFPIGAPVPPAPLMVMSAVVFSPDCGYILETKGTPDFPPSEGLYLTGPKIEEYDKYSARLVFIICGVFAAQITLLLRQIKEASTPSTRSRISFYTIALMAFGDAFVLIFILLELYPAVSFLVMATAAFLTFLSVSYIGMKFMMEIWAVQAPERREQERRSNPPASTPRSTGLPLPATSAPVRDSGATPIILTPDQDPPAEEDDQPTNRGTTSAAQETRNDVGAMYARFYFVLFVMLIISIWSFLWPNRLGALYARALAFVYLSFWTPQIGRNIIRNCRKALRWDFVIGQSILRLFPFVYFLTVRGNVLYIHPDNTTAFALAGWVWIQVWVLATQDILRPRFFXPRGWAPAAYD

SEQ ID NO: 31911 - protein, 338 aa, A.fumigatus
DFRVSGTFSNGFPGPVEQILEHGRETMDDETKRVVTKLHTILRPYILRRLKADVEKQMPAKYEHVVYCRLSKRQRFLYDGFMSMAQTKETLASGNYLSIINCLMQLRKVCNHPDLFETRQISTSFVMHHSVATEYASKEQLVRRRLLYEHPLTKLDLDFLNLVPISREDISRRLADDSTRLMAYGPFNILRERQYKRTNWQMMFDGSTVQSTLEALENDARKRRMAELERCLYFESKRHGRRPVYGTSLVEFLTADSKQKPTLGGRPQTQSLAEWLSNRSSILASMILSIEERSQAMDGYVRRFACVTPAAVASGITEAALTPIETRYLTEKERFPSL

SEQ ID NO: 31912 - protein, 351 aa, A.fumigatus
PKRSVSPPYDPFHEAQMRLSIAFPDKRLLQYDCGKLQRLDKLLRDLKAGGHRALIFTQMTKMLDILEQFLNIHGHRYLRLDGTTKVEQRQILTDRFNNDDRILVFILSSRSGGLGINLTGADTVIFYDLDWNPAMDKQCQDRCHRIGQTRDVHIYRFVSEHTIESNILRKANQKRMLDDVVIQEGEFTTDYFTKLDVRDMIGEEAEAQDEASAAMDRVLSSRVATGGSRVFEQAEDKEDIDAAKNAQKEMEQADNDDFGDRSISHTPGQVGTPLATGPQEGETPGAQLITTPQIHGVDETVDVEPQPGHIDDYLLRFMEWNMKDEPLVLPPDKTKKKSKKGKEHRLSKRRR

SEQ ID NO: 31913 - protein, 1025 aa, A.fumigatus
  UNSURE (3),(6),(7),(8),(9),(10),(12),(787),(790): Identity of amino acid sequences at the above locations are unknown.
ALXTLXXXXXWXAPSSPVVKTMPADANDISSDHLSRCKSASSQVSDRSSADAESTAAQPCRLERTTSFNTNTRPPSREPVSPASENSKDGQNGGSRAATGNASVKEDKVAETKAVEQSQTPQRSTPRSITGRRNSWISSISSKFSSGSTPPSQASMKSPSPKATSPMSKLDMPNPFGAAYSPKDKEEERRDEHTPLVSTSPKGPSFLHSALRKFSSSGKVVPNGGICERRVMNIDHDRDRCKIPDLDQKKLRRVAFCVDVEIAGISRRESDEESPTGASNQKAKRSNSKSKDRDDSKRPQPDIADKEKGRQENGTSRQHPKPSETPSNEAKPNGEIKEPTRKQEKKKRSEEERRERKERKRRQAEANGTIPLQLRAEDHEDDARPAVPGNPRSRTQSHPTTDPVRIYRRCCQLRETPVLKKIVDEISSPSSTLAESPGTVAVLDLTNFPMTSQDMATFCDWLAIVPVRKLILEKCALNDVSVRAILAALLSTKTIEQMRQRRRRAKKTDADPVKKEDRFCVVEKLSLKDNPRIGLEGWRHISVFVHLANSLKAIDMSGIPFPRMPLSANDFATSLSTSPNPLKPVNDVATIFANSLAQRFGGDHLEELLLSECNPTTEDVGRICEAATTLGLRRLGFANNKLTREGLEHVVRYLEAGKCEGLDLGGNPIRDHLDLITSALEGEFPLYALSLADCSLTPSVIHPLLQRLTCLYNLRFIDFSHNPDLFSSKPDALATFRRFLPKMKSLKRIHLADVNLSADHAIALAEILPECPSLCHLNILENPCIAXLAXATDPATQEEACAVYASLMAAVRVSRTIIAVDIEVPSAENNEVVKALASQIVAYCLQNLERGAIEEELSDPADPSSARAAVPVPVPEILQHIVGHGGLGDDICEDEDEPAPDEDYVIGGTGVVKALEVCLGTLHHRDMLGDQSGPPSGTTTPRHRKSRSFVPQRPRDMSKNLLESARNIRTRIQSALVREDRAGNDANYREYLIRIVFLFSHDHISNKRSTAGSSPRGWKGRANGM

SEQ ID NO: 31914 - protein, 90 aa, A.fumigatus
RMHNLFFRRCRVQCATDPVLTFHSYNRYLAVAARAVRRSLKDGPRLAAERRGQSELRFAKWEVRIYTIFVLDCGGDGYNDWLYSANGFLA

SEQ ID NO: 31915 - protein, 88 aa, A.fumigatus
WVLTRVGHEDEEMADVPEPPMEEEKTIDQPPTKEEPREEITVSGGRRRGRRKVMKKKTVKDEEGYLGENLRALSYDALNPANLPFSRQ

SEQ ID NO: 31916 - protein, 68 aa, A.fumigatus
YITVVLGDASDEEEPEELFPDSGKSSTASYRETRKEREEKLRKMMEDEDDDGTLIGSNFHTTLRSDGY

SEQ ID NO: 31917 - protein, 128 aa, A.fumigatus
CLVFQRRTGVRPPPPAPTPAQEAAAPSKRPSQDEATQKVKSESKKAEHAAMTSQTKAEEKPPVKPSEKTAPLKREKSDLFSSFAKAKSKQKKDGSATPAVSGAESVSASQPNIVAARSQLLMKLPGRA

SEQ ID NO: 31918 - protein, 563 aa, A.fumigatus
  UNSURE (40),(51): Identity of amino acid sequences at the above locations are unknown.
RDRHCGARKYATYRSVNIRQTPIRKRGFPESCSPITFGDXEEWETLQNLVXFMLHCRYGSLITSNGMPLRMQGLLTTTDDIYRFSLFILIIYCVKKYYAPFRDRWLPLSPAGWHYVVAGLLRENQFELALDHIAHMERKEIMVENWLHSLLIYNLCDIGDFDEVLRQMRKRTSQGHDMTTELWLYVLDVAVAASHLETTRYVWTQMVQLGYLQPSRVLCSDTLTVAAEKGDTKLASLVIRFLSESDIPLILQDYEKTVEAHVKSGKLSSAFEILCKMHKAGIKLEHSSTRAIFNYMVQTRTSPRQAWAILKKLKSLKYPVPMECAHVVIELCDYESFNDPFAVDEGISLYQELYTLCPGKADVSIYNTLLGMARRAKNIQAGMFAVKEMSSLGVIPNDKTFEHLIMMCLDAGNFESAYRYYQDLVARGFRPDAYTRQQIKSVCSESNDEFAIQLRNDPQMQDDPADDLIQRNEGASDQSASIRKIGSETHSRYAKRSERRMWEPPMRILLSKEARRAASKERRKRKRRRLAMAKAQEEEGWMDYEPGGLVPEDQLKPDETQTS

SEQ ID NO: 31919 - protein, 156 aa, A.fumigatus
MAWLTMRAEILNYLLATLTAQSAAPLSAEQIAAVVNHRNHSGNTPLHWAALNTHLGCVKALVEAGADIGVKNDAGLDAIFLAERTAWSTEEEGKEVPAEEEGAGKMSKGRQVVEWLLSSDKAGDLEEGLSVSAGVGAEGSASGSGSGETMDVDEKN

SEQ ID NO: 31920 - protein, 108 aa, A.fumigatus
QHQGNLVLRSCSYSKPREAQCKMSTSTPVKLSFEAIDDLIYDARAGDLEALKADLATQSKEHNCPEAWIIASAIDAEPEAEGGTGSCLLHFPAANGNAGTLTLDSTRL

SEQ ID NO: 31921 - protein, 519 aa, A.fumigatus
TNVRYVDRWRHFSRRPRISYAASSSNAPHVTVIRPVKGLEPYLYDCLAATFYQDYPHDKLTIYFCVSSRADPAYPTLRKLLSDFPHADAHIYVEEEDPLLQPNNAVNYNLGPNPKIRNMSRAYREAKGDIVWILDCNVWVGRGVCGRMVDRLCGLGDTPGRKHKFVHHLPIAVDVTGTSGLREERQALLQACAQGDSASARRDAFAMIEQQHREVGWLATGGGRLEELFLASSHAKMYTAINTVLIAPCIVGKSNMFRRSHLDYLTKPSPTEAQPRRPGIDYFSDNICEDHLVGDLLWKQQIREERELGESWGKHGMVFGDLAIQPVASMSVRGYMARRVRWLRVRKFTVLLATLVEPGTESILCSLYGAWGVTTSLAQFLQRQGFGFADHLTSWTAFFSIFFLSIAAWILVDWTLYIKLHSAKTVELNDDTPCFAQPPERRRTRRPFSHWLAAWLGREMLALPIWIWAFYGGVTVQWRDRRFRVGLNMKVREIKDGKGVQIEGSYSSPASRLSSSGQG

SEQ ID NO: 31922 - protein, 483 aa, A.fumigatus
TWVCPICSFTNPVPSNFDPATATASTPLSPCLACGIKPPFTTVLKAAITAAASREAAQVHPASHEPGQPESNDDETVRKPNASTPCPRCTFVNHPYLLECEICGAPLAPAVARGASVDGSRRSESPAPVFGQGNIANTETFEVVKLSFRGGGEKTFYERLKGALVQRKWLLYDAPPVPQQPSQSPATPNLTASGAVAANVSTPAQPRSPAVGIAGLEQRGLEARRNNEVVIGSSFEDLEALMASAKRIINLAETLARESGMAGDENTAATNAVLSESAAALGMTTTKDMLGSGAENLYLSELSRDLAEYLTDDNKGILQKEGGIMSLVDLWAMFNRSRNGVELVSPSDFQKAAELWEKLKLPVRLRRFKSGLLVVQRYDWNDEKTIRQLQEWMAELRQIPPADPVPWDWRQFGRAVTAQEAAQRFKWSVGVAAEELEMAEDKGVLCREEGIEGLRFWSNYITSDLSSMNSIDSIDLRVSSLAI

SEQ ID NO: 31923 - protein, 228 aa, A.fumigatus
RISVAFYFSVQPYFYSYLQVVQGYDVATAGRVTQTFAFTSTIAAFAVSILIKYTRRYRAFVIAGCVVYIIGMVLMMVTRHEGSTPAQILVTQVVVGIGGGLLNVPVQLGVQASASHQEVAAATAMFLTSMEMGGAVGAALSGAVWTHNIPRKLRLYLPEENKGDADAIFGKITKALSYPLGSPVRVAINQAYQETFKKLLILALIAIIPLVPLSLAMEDYKLDKVYDS

SEQ ID NO: 31924 - protein, 159 aa, A.fumigatus
NPSPRSRALVYRRCRFVLMPSFPLSNLHAELTADSGAQPLVNDDGTIALAVNGEIYNHRILRKGLKKQYNFKTHSDCEVVIPLVCPKTFHKIAGFQRLISFSIWNMVLMLLSILMACSLGFSMTRRKTGWSPLVTPSVSPVSISDGPLRPLELFTSPPS

SEQ ID NO: 31925 - protein, 321 aa, A.fumigatus
SGHSFGMPQDISQNCRLPEANQLQYMEHGLDAPKHLDGMFSWVLYDKKEDRVVAARDPIGITSFYIGWSSETPGAVYFASELKSLHPVCDKIEAFPPGHVYDSKTESMTRYFQPKWWDPTNVPTAPVDYKVIRATLEKSVRKRLMAEVPYGVLLSGGLDSSLVASIAQRETLRMQEAAKNALVDQTGASDLVGIDDTNELSVFTTFQQLHSFSIGLPGAPDTEAALEVARFLGTKHHAFTFTIEEGLDALSDVIYHLETYDVTTIRASTPMYLLSRKIKAMGVKMVLSGEGSDEIFGGYLYFHAAPNKEEFGLHARGGDTR

SEQ ID NO: 31926 - protein, 303 aa, A.fumigatus
FTPAVLTSFRYGAKNEDFAEIARINHEHSKRNPYSQFQDEYTLEQILKAPMIHEPLTKLQCCPTSDGGAAAVIVSQAFLDARPHLKDQAILVAGQQIATDTSTLYNRSSIDLMGFGMTRYACRAATAEAGVNVKDIKVCELHDCFSANEMITIDALELCEPGKAHEMVRKGDITYGGKMVINPSGGLISKGHPLGATGLAQCSELVWHLRGWANNRLVQGTDVALQHNLGLGGAVVVTVYKRADGKVAAAVPSDVVAKITGLGYNPAVEAKGFTAEQAKSVLSRKHNDQWALGDTQERVLARF

SEQ ID NO: 31927 - protein, 193 aa, A.fumigatus
SISSTFYLTKIQHLHTSRAQLISMGKKQVAPAYVLGVGMTKFIKPRGKVDYHELGFEAGVKAMLDAHINYDDVDQGIACYVYGDSTCGQRVFYQFGLTNIPIYNVNNNCSTGSTGLAMARTMVSHGAADCVLVIGFEKMSPGSLQSVYNDRANPTGLFGMMMAETRGITNAPGAAQMFGNAGREYMEKYVEPC

SEQ ID NO: 31928 - protein, 421 aa, A.fumigatus
RMSHISRKSTTSTGIYETNMEVYKTRLSPHVLPSSPISTPLSILDATVARFAPAGAIWLWDRFSGNLPETDFIDCLQSLFAQTLSDYPQWAGQLQWAPVREGGNHTERFNRPMIVYGAPDDPGDEWRVVKRDGISVGTLVPSAMERISAGAWDGANFPQRDFLSEPPLALHDLREYQGLPSMQVQITLLKSGAFAIGIRMAHVLADAQTLMVFVHQWAATSRATFGSHNSKSLMDAPVFNPALLDAHAAGDVDGPAPDRGLVATARELPLHRFDWWKTDDPGYPKVLVPNTLNSMPSCEQLDSVELSPSTSAPWTSWDLSRRIRYTQIHSSGNQLADLKRTALAQSQEDISRLDALLAHLGISINRARNLTNCPDSVFLDLSIGTRTRLSPPLPDTFLGSPLFLTHVSSAAKALCAAFIRQ

SEQ ID NO: 31929 - protein, 62 aa, A.fumigatus
WRLRWSANSGTPGTAEFGDQNSFVYSQFYVESPQTSTDWFDQLRGDLLHELDHPMSQRDRNA

SEQ ID NO: 31930 - protein, 810 aa, A.fumigatus
DSGHQGTAAATSQGAVSRGRQSEAGESSVRMPSPSEFQRAPDTRPKPNRYSAPAEDLLAQRFAKLRASPYPVNGQNHPNKGQNGATTTPSPPKYSNDYPPRPFSYIQQSSQSSANLTSPSRRPLGPRNMGTNHDLPNPPPKIPLNTSLPRAPDPAYSPIWTVPSQPPSNPPRTSTESSRPVNPRYSQLANSPRGSPSRGGLDDNPYRSTTPNGVHHVKEARSSSADLPHSTTITAQALLEYLRKYHVLLIDVRPREEFDGGHIYAKSIICIEPVALKENVSAEELEERLVVSPEHEQSLFERRNEFDLVVYYDQKTDSVSYLAGSPVGTTAPHLRALHDTLYEFNEYKPLKDARPPALLLGGLDAWIDLFGQQSLATSTTAAVMGSIQAKRPAMRPGRPLGRVPTMASANSSLEVRKRRLREYKPLNPEELTAWMEKSKNEEIDTSTYIEEEVLTEEPEDASEQQEPPVTPFVHTYEDFLRRFPEPHAIQESMIVPHSQPSIPSSTPNYAAPVPVVPSRPPPAVPRPSYSGVSDGRQIQAPLERQNSATKTALYTPSSMLSRLKLPRTGLTNFGVTCYMNSTIQCLSATVMLSKFFIDNRFRFYVQKNWKGSQGIMPGLFANLIRSLWKNDVEVIMPTSFRNFCGRLNQEWAIDRQQDAKEFFDFVVDCLHEDLNINWQRTPLRPLTFEEEMQRERMPVPKVSKIEWDRYCHREESFISSLFAGQHASRLRCTTCKRTSTTYEAFYSISVEIPHTGTGDIYQCLRSYCQEELLSGDEVWKCPYCKCQRVATKQIIITRAPEHTRVFSHKR

SEQ ID NO: 31931 - protein, 419 aa, A.fumigatus
LLRTLSYIYTEPVTFQGPMNLTGVHCSPPAGTLQQERSPGNFSRLTFVMEDGIRPARHRESRVQTKEESGERREKNKRLKEMGGVCLWCYRLKKTCEPQLPCPRCQDSKSNCIRRPAELSLLPCQDMNQGSISFQTKSEDILSPLQKISQCASSQAVVSFCQCNGEVIDYWVMHAANLGATNMNTSSGLGQQLILKLLKCVQSAEMDKFETEFPGSSLVQTAVTMHKLLSAILCLSKTQVYLRASDVEQTRIVVSFMLALCRQCLCELSDDLGSEAYSLIKQKSDYDGEPAGMKNDCSGASCVNPVWVAVGLYHRVLEALSSFELPPPIADIFDKVKIRSNMVLSNIYCVKEKIAHVFGSKLEKEKLEAEKVSFEQYIPPVSCRRYFNVAICFGPFDQSQPSTAIHRQSLHAGAGRKRI

SEQ ID NO: 31932 - protein, 154 aa, A.fumigatus
FPHHGLHWHSTHWTDMCSLCHTSQYPCPLSPVAAILSAVPLTINSVFVFICPMQRHLYMVLFAAVQIWTILIHDGDMISGHWTEKIINSPAHHTLHHMYFTVNYGQYFTWADAYFGSHRAPEPALDPLHDALKVMRAKGLVDEHGNPIKKPKGE

SEQ ID NO: 31933 - protein, 271 aa, A.fumigatus
LLSNSGNCFAPTSPRSLPQSLLYVAQRPSPRRRGRPLTYSPDQPAMDVALEFLDPLILDKAYAWLLPSEPNVPDPTSRWDRDNVYRQVISILVLTQLGATSLYLFFSALSYYFVFDRRLEYHPRFLPNQVRQEIKSSLSAIPFINILTLPWFLAEVRGKSMLYRSVSDYGWPWLVVSSILYMAFNDIGIYWIHRLEHHPSVYKYIHKPHHKWIGWSLQNSHVPRCMLTRYSSHTMGCTGIPPTGRICAVSAIPVSIPVHCPLSQQSLAPSL

SEQ ID NO: 31934 - protein, 560 aa, A.fumigatus
  UNSURE (188),(499): Identity of amino acid sequences at the above locations are unknown.
MSWSFQQRGPSPAPDEEPDVEMRFLTFFVLAAAACAAVPYEEYILAPATRDLVPERVYQVSGSISDPSAVTHAEGGKATFHGVSSVTYDFGRNIAGIVSVAVSRVSSPDAFIGVTFSESSAWISHEACDATADTGLDSPLWFPVGHGPGRYTAEKKHNRGAFRYLTLFTNTSATVVVDSVRFNFTAVXTQNLRAYKGYFHCDDELLNRIWYAGAYTNQLCTIDHSMGNALPLLGTVTSRDNITLPETVPWWSNYTIANGSSVLTDGAKRDRLVWPGDMSIALESVAVSTYDLYSVRMALESLFAMQQADGRLPYAGKPFYDTVSYTYHLHSLIGVAYYYRFAGDLNWLAAHWTQYKRALQWSLSSIDHTGLANVTASADWLRFGMGGHVRPAPHAPTRILTKHKAEHRSKLHPLLRPPGIPPPGNNPQRHRLLLVLVPHRKHPQSLRQRPTLGPSRRPLPRQRNHHPPPTGRQRLGPQSQPHLVRNPIRRHLRRPLGPXGAIRRPRPRGRIHRLPLLHRLRAAGPLPCGPAAARSGFDAPAVGVHAGRSADDPVDVHRGV

SEQ ID NO: 31935 - protein, 293 aa, A.fumigatus
  UNSURE (98): Identity of amino acid sequences at the above locations are unknown.
LNTKQNIEANSILYFVLRESLLLATTLNDTASSSSWSRIASTLKASANARLWDPAVGLYRDNETTTLHPQDGNAWALKANLTLSATQSAAISAALSAXWGPYGAPAPEAGSTVSPFSTGFELQAHFLAGQPQRALDLMRRQWGFMLDDPRMTQSTFIEGYSTDGSLHYAPYRNDARISHAHGWATGPTAALMFYAAGLQIAGAGGERWLFAPMPGDLQAVEAGFETRLGRFATEFTRGEEGYTKLVFTTPEGTSGEVRLEAEGVLVSGNGTRVKLVEGVSTGLHGGTWRLTRV

SEQ ID NO: 31936 - protein, 135 aa, A.fumigatus
  UNSURE (97): Identity of amino acid sequences at the above locations are unknown.
TQSRTSKQTPSSTSSSGNPSSWQQPSTTPPPPRPGPASQAPSKPPPTPDSGTQPSASTATTKPPPSTHRTATPGPSKPTSPCPQPNPPPSPPPSRPXGGHTAPPPQRQDPPSPPSPPASSCRPTSLRASRSALWI

SEQ ID NO: 31937 - protein, 350 aa, A.fumigatus
  UNSURE (254): Identity of amino acid sequences at the above locations are unknown.
PRLVLQAVKRSRKWNAFFFSCCWHKHRTSTHTHTHSTLSIPVQHLSDCMGSRHMKNTLHPRQPPSPTMQPRRNPLNKLNPRPIPRDQHALRLQPHLPTRPLRRRKHQLRISLLPPRELRCKPPQTRLEPGLNSLQIPRHGREQPPLPTRPRNLQSGRIEHQRRRRARSPPVRMRDPCIIPIRRIVQRPIRTIPLDERRLGHPRIVQHEPPLPAHQIQSALRLARKEVGLQLEAGGEGGDGGSCLWGGGAVWPPXGREGGGDGGGLGCGQGEVGFEGPGVAVLWVEGGGFVVAVEADGWVPESGVGGGFEGACDAGPGRGGGGVVEGCCQEEGFPEDEVEDGVCFDVLLCV

SEQ ID NO: 31938 - protein, 591 aa, A.fumigatus
GRMSPDEVSLPSPYKSTAASLVDVFKTLGVARSRSQTPLSLEDDSSHSLSHTTDARRNNFLVLGFESMHRGSVVSSSSDTPRAPDFETSLRNLSQTQNLAHAIDEAEHVSRSLQWFTSDQSIALWEAGSYLIHNPDSPDARRSGSMLIEAVAARQDLSPSGRRIVFEAISCSSEPDVIPARVQSLISLSDHGRKLDFTSSSILPILSSCAVPLYELISSSRLKARKAKVGKVNGLGYDETALDDLLQFAVDLITLQRKRPSAEEVESLLDQIFTICKKTSVAADIKNSLAVFDAVILYADVPDGSFVPMLEVLCSIHASVKSLSGPTSRAVRNLAKSRWQTEMINTLDSFLMDSSGEESRNINVLRGTVYIFTDLVRAHGQDGIPQLRFEHLMDCLEVVIRKDDSRLEADVLELCLNILDGDFAHVALESSWSGFVRVLNSCSLRAIGECEERAASISSSQSPFSKTSTSEDAKSNILANAVQIAATVESLWDRLSREQKLEATRFLMNLCEHIEPSQAELVINTMRSENLCLPSRSDWVNYCQRLIRCFIRSRNKPSDIRISALDLLKEAFSTYDALVFFKGRRVAPPYA

SEQ ID NO: 31939 - protein, 93 aa, A.fumigatus
  UNSURE (39): Identity of amino acid sequences at the above locations are unknown.
SESRCMIESSEWMEELMEEVDRQSIMQGPILGVFVWGIXNMPKYRPTTDPSQALFVLTTVQKIPVELYFMEGLEIGTIVYLALWRQSTNRVFK

SEQ ID NO: 31940 - protein, 617 aa, A.fumigatus
VNTASVSKVSLKMEYFDFDGASFGSHAPDDEVASDRFELDENDAIENYESLLREQPLDFPNDLPEQDALNPQTEAPSVNAQSNNALPIHRAKEPCDFCRHMNLDCFISDRGALQNGCTCCVILFRECSFTHAKKPGKYMETLQSISENADIPTVGPKGRKTLKSLTGMTISEDMEGRGRKSSSRLSRDAVRILKTWLLEHLDHPYPSEQEKDELKKRTGLKRSQISNWLANARRRGKARPLPPSNSSVPGAINIPGQQQQQQPNIALMTPLERWKYSPPENEPASTTDILRALVNNPLDSTRQPGHVRSLSRKGSSNDSSHANSNIFKAPSISSLGESRSVSRSSVSDLSFASAFSHRSSLESFGSMERKERRRRRKPSTALNTFNQQKARNSRIFQCTFCTETFATKYDWQRHEKSLHLALDKWTCSPQGGVVYVNGANRCVFCMASDPDTDHLESHCYSTCQEKTLAERTFYRKDHLNQHLRLMHNVKFNSYMNQWQSTTTELKSRCGFCGTTLTTWKDRVEHLAAHFKNGADMTQWQGDWGFEPFVQGLVENAMPPYLIGQDRKTLNPYTTSKFLGQSCCSPTTASPGLIEPNDVNCFHRLQRELTAYIHKQVA

SEQ ID NO: 31941 - protein, 297 aa, A.fumigatus
RALIFQPRRVRRDVYPRDGQDSTEAHIDSQNPQGPNGTESSQKSTGRKSKKKKGKKGRNGSHAQGDETSTPMSTPSVSMSHPLPPPLSSHLASHNILKPAKNRSIWNTSTQEERENIKTFWLELGEEERRQLVKVEKDAVLKKMKEQQRHSCSCTVCGRKRTAIEEELEVLYDAYYEELEQYANHNQGSFEKGSPMVPPPRLYQPPLRSPGQHTRTQGQFHPSRGRIHELTEDDDLEEDYDEEEDDGDEPYSDEELDEEDEETRAARADFFAFGNSLTVKGKADVPPAFDHSNRILY

SEQ ID NO: 31942 - protein, 503 aa, A.fumigatus
  UNSURE (267),(270),(274),(275),(283),(286): Identity of amino acid sequences at the above locations are unknown.
SKNSWRRRLGTNSEMLRKLGKRKNGKTKKDFRNRPRKRNARVGKRRRLQRKQLPRRNRRRNLRNSERNGRSSGRRKKQNGRPKKRSVRAKRRKSLDVSVRNESDRPKRSESSARRRNDAKRLGGKKKKNANCGKRRQRKSATARLRSNKPRRIQQKAERKPKIRRSVMIKPNGRRNRYLSLFRRIYIIFRAFPRLSLIRRTSHPQHLCYLKLLLLPNPVSHPNKILIPPRHTPKPLAPTGFQGYLFSSFDARVSVIGSCQWEFATRXREXHAMXXQPQLFTPXSPXGRSIPPGFSSVNGIPPNPPGLSGMVARPPVGHDLPSYPSHSGPFISPFRGYPAPTGIPAPPGINGARPMPPGRGFPLEPAQGFAFHGQQIPGAFSTPQGGLPHRHSRQPSGSLERSPLENHAQPMPISRPSPIKRPSSTQQDQQKGDDRTTQRDVDDLSAHLGSSALLDDSDVSLSSNLSQSLPGATVPGTFSGPARASFGGPSLFPDPLSGKFLRL

SEQ ID NO: 31943 - protein, 127 aa, A.fumigatus
CAASFRSFQQNPVLISSFFPSLSEIDGILTVADDLLKNDGKHFIDMMEQLAERRMQREEDTQYGIAAAHESLHSGHNHGPFDDEDYDDEEDEDYDSQEEEDYEEDEMVCPGVVPPLRGIRPLCFVHR

SEQ ID NO: 31944 - protein, 350 aa, A.fumigatus
  UNSURE (315),(318),(322),(323),(331),(334): Identity of amino acid sequences at the above locations are unknown.
PLPQDAMTEEQRMEEGRRMFQIFAARMFEQRVLTAYREKVAEQRQQKLIEELMEEETRNEQRNAKKAREAQKRKDKKRLQKQAKEEERARREAEKAAEEAAAKAEQEKKLEEQRKKREEQRKKKEAERKAQEEERARKEAEKLRRQREERERQAEAERKQREEKKRREEARRKEKEERELREKKAKEERDRKAQEQQAKKDTAKGGEEAKDQEKRDDQAKRSSQQVPVPIPTNLHHLQGLSPTVAHSPHVPSATPVLPKAPTPAKPRQPSQQDSHSSSPHSQAPSTDRFSGLPFFFVRCPGLSHRELPVGIRNKXQGXSCNXXSTSAFYAXVPXRQIHSSWILERQRNTT

SEQ ID NO: 31945 - protein, 64 aa, A.fumigatus
RLRQIRGERNITVIKESTATKMGAQIIHIPLCGAIITLLLVLLGAGWSFDRARSRNWHRLCVIL

SEQ ID NO: 31946 - protein, 231 aa, A.fumigatus
IRRNRDRYLLRRPFGLIITLLLIFGFLSAFCCILLGLLLLSLAVALFLCLLFPQFAFFFFFPPSLFASFLLLALLSLRFGLSLSFLTLTSKLFRLFARTLLFLGLPFCFFLLPLLLPFLSLFLKFLLLFRLGSCFLCSLLRFPTRAFLFLGLFLKSFFVFPFLRFPSFLSISLFVPSLLLHEFFDQLLLPLLGDLFSVCSQDALLEHSGRKYLKHPSAFFHALFFCHGILR

SEQ ID NO: 31947 - protein, 135 aa, A.fumigatus
QSAYYGRTPTTTIIITAGVQKYRASSQIAFCIMRPSHLGLLARRSWICTRCRVANYSSVAPARAGKSKKNLPDAPARTRFAPSPTGYLHLGSLRTALFNYLLAKRTGGQFLLRIEDTDQVRPWSKHGTLECCDQG

SEQ ID NO: 31948 - protein, 189 aa, A.fumigatus
DALLQSERTAIYREHANQLVQNGHAYRCFCSPERLDSLARHRSQAGLPPGYDRQCADISAEESEDRAAKGEAHVVRLKVEGYPMFDDLVYGKTGQNRSSSKLDLIERVYDDPILLKSDGHPTYHLANVVDDHCMKITHVIRGTVSILPRKKQTANIDSYRNGCPRHQCMWPCITPSTGHLRASVMFPSS

SEQ ID NO: 31949 - protein, 121 aa, A.fumigatus
  UNSURE (24),(57),(85),(101): Identity of amino acid sequences at the above locations are unknown.
TPGTIALLTATQFNLKITRGNTVXAFEKLWFLQKAHAQRFAATGGPVFDEMGHQVSXAGEETYPADQLYVHNPSTPLRNNQLTFXQWNHPSIPRPLNGLHXPPSFKGDAKIFTNAPGILPG

SEQ ID NO: 31950 - protein, 91 aa, A.fumigatus
LVQEWMPSTPMHVALYNAFNWTPPRFGHVPLLVDKSGQKLSKRNADIDLSFFKDKQGVFAATLINFAALLGWSHTQKSDVFSLDELELLVG

SEQ ID NO: 31951 - protein, 92 aa, A.fumigatus
WTRFEAQVAPFHEHPRLIWTTGFKQILTRMGQFLTPSTVTCSTCNGQGEFFSPKDKCKKCKGNKTVEEKKMLEIYIPRGAVFTTGLEGAVQR

SEQ ID NO: 31952 - protein, 162 aa, A.fumigatus
QAALASHPDKVPEAEREAAEVRFKAVQEAYDILYDEDKRHLYDTHGMSAFNGSGEPGMAGGPDLDDILAQMFGMGGGMPGMGGMPGGRPPKPRRSPDENTKYEVRLEDLYKGKTVKFASTKNVICSLCQGKGGKERATAKKCSTCDGQGLRHKWLLFMNTLD

SEQ ID NO: 31953 - protein, 101 aa, A.fumigatus
  UNSURE (19),(20),(28): Identity of amino acid sequences at the above locations are unknown.
EEHQLCTLERLTDVIRFAXXIPASFSLXSRGLSNCELGLTGCYPLIYLLQIPITIVSISPILDSSWYKFKDPRDGSGLQPEIYLYDVNPPTIATRIIRSCK

SEQ ID NO: 31954 - protein, 271 aa, A.fumigatus
NRGANNRSQDYSLRAKDYNAKKAKLKRLQELAANRNPDEFAFGMMSAHSQKKGKHGSAARDSAAKRGLSHEAIKLLKTQDAAYLRTTGERLRREIEKVEQEVRLQEGIQEALGEKKKDESESDIEEDDDDFDFDFGPKEKRGQKKARKLIFADDRREQRALKKRKLHEDQDEEEDEDEEQSFGELQKKQLQKKSQKQLEAERLALVEARRVRKMKKRAAEARENKLKALRKQYADITAAERELDWQRGRMDNSVGGTNKDGIKWKIRERKK

SEQ ID NO: 31955 - protein, 193 aa, A.fumigatus
RSSDNVHPGQGPGLGIDLVLDGLQLALVQVDGDQDHLRVNAVLSLAQQIRSHEGRVGVLVGDDQHLTRSGGHIDADTGRGVVGNQHLGCRHELVTGAQDLVHLADTLRSVSHGGHGLRTTGEDNALGSHFVGDVDNLGGDAAIGPRRRSQDNLLAAGNHGGDTEHHGGGRQHGCATGDVQTNTLNRARKARAN

SEQ ID NO: 31956 - protein, 138 aa, A.fumigatus
RIRCSGAYSLLSAIASSMSRTTKVTECARDPRTMSIRGRARAWASTSSSMACSWLSFKSMAIRITCESTPCSAWLSRSEATKAGLASLSAMTNTSLGPAGISMLTPAEVSLETSILAAVTNWLPGPKILSTLLILSVP

SEQ ID NO: 31957 - protein, 112 aa, A.fumigatus
WRRSSTPAASSSDSGPLRVLVITLRVSTTLCVSFRLSRAGIKLTTTATYGYAKQYSGVNLGSFLKHITSSNLTAEGLLGLSRTVEQLAAVEGLDAHKRAVSIRVAAMKKNQA

SEQ ID NO: 31958 - protein, 149 aa, A.fumigatus
ACSPGPQQLSSSSCGLDEPRREPASPPQVASATFSVAASSAIHQTTVLRPRPPPHLDLREVSVSSTRAAPADHPQRSTSSPSSARASPLARNRNQSRHHPPLCRIRSHPSSSPQEPPESPPVTSPPAPPSRSPAVAAPPSSAGTPHPAS

SEQ ID NO: 31959 - protein, 320 aa, A.fumigatus
VCSRFSRPIERVGLYVPGGTAVLPSTAMMLGVPAMVAGCQKIVLASPPRADGSISPEIVYVAHKVGAESIVLAGGAQAVAAMAYGTESISKVDKILGPGNQFVTAAKMLVSNDTSAGVSIDMPAGPSEVLVIADKDANPAFVASDLLSQAEHGVDSQVILIAIDLNESQLQAIEDEVDAQARALPRMDIVRGSLAHSVTFVVRDIDEAMALSNEYAPEHLILQVKNAESVVEKVVNAGSVFIGQWTPESVGDYSAGVNHSLRKFSSFPCRNQANNNSNLRLRQAVLWSQPGLVPQAHHQLELDGRGIAGIVSHGGAVGCR

SEQ ID NO: 31960 - protein, 314 aa, A.fumigatus
QAIHQYGLICVRLPSSYQVWRLLTTNRSNTFSHQLYAAFRPTYSKQLYSAVLAYHQGPSWTALDLGTGHGLVARELSPHFQRVLASDPSAGMIHEARQLSTGFPNMTFYQARAEECPFAADAQVDLVTAAQSAHWFDYAKLWPEMRRIVRSGGTLAFWGYKDHVLVSYPRATSIINEYAYGQDPWLLGSYWQQPGRSIVQQKLRAVQPPVEDWEDVSRDEYEPGVEGGTRFMHARMTLGSMEEYVRTWSSFHAWQRKWPDRIRRAPGNTDQRGDVIDEMMDKIRETEPSFQRDDWKDVEVDVEWGSALILARRR

SEQ ID NO: 31961 - protein, 111 aa, A.fumigatus
  UNSURE (101): Identity of amino acid sequences at the above locations are unknown.
ALHKLLSVIFQMTRTASVPINHITIRTHQPADIEWIISRHGTLYAEEYNFNDKFVALVSKIASDFQQNHDPTSERCWIAERTGKTTNEPVVCIMRLKDVDXIATASRFSCV

SEQ ID NO: 31962 - protein, 60 aa, A.fumigatus
EDNKGWNKVAIYTNYFHNSYIFLISITRRERRLLKLSSNYLLIFTNSNLEACLIKVVEVL

SEQ ID NO: 31963 - protein, 77 aa, A.fumigatus
RKAMNTELLRTLPLLKYLTFPLKALDTSIPFSVPSEAQRRTFILSALATTYSQLKYGTLPWPTSSIPSDYLYLAALK

SEQ ID NO: 31964 - protein, 74 aa, A.fumigatus
YNRALINTKLSTEQEAALIKYINILIKLDIPLWPKVISNVVNLIFFYRYTNLITPPPLISVYWMKYFLKYYLEY

SEQ ID NO: 31965 - protein, 312 aa, A.fumigatus
LADMLGRHECTISESVSALDPTAQEPEYTLVPSTSRDLVRDMTLNMEDAQAHLKEHGWVKIPAVLSKAEAEDALSRLWEAKAASEARGECTFQPILDPNPANVRVFYLPELDAYWRDMLVNPTALDLAKSLLGDQLLVSNFSANIARPGAESMALHSDQSIVLPAPWLDVWAVNVIWCLTRMTKENGATLYIPGSNKWTTWEDVPDNAPDLLVPFEADAGDIVVIDGRLWHTSGSNVTEDEDRAILFAYYSAPHMRPLTNWSAKLPKELQETLSPQLKELLALSHIGYVVKGDLTYMAQKYPSEKGTTAVSA

SEQ ID NO: 31966 - protein, 135 aa, A.fumigatus
GCTQPSLGGESCLGGSWRVHFPADLGSQPGERARLLSPRVGRILARHAGQPDRTRPGQVPPGRPAAGQQLLGQHCSSWRGEHGPALGPEHRSSSAVVGCLGSQRDLVPDEDDQGERCDLVYPRFEQVDHLGGRAR

SEQ ID NO: 31967 - protein, 61 aa, A.fumigatus
FGGLGDLQTSTCITTVRPEAKDRFYNNTLEKSPQAAPTDISMGEPILTIPDPNSDYYFNLP

SEQ ID NO: 31968 - protein, 327 aa, A.fumigatus
SEAVQESFHLAFIYNTMAPVAMSSEPAVFNTKRDGHALEDLSDAIDTVNLLKNEMKKERGLYDESEFDKNKDKTQFRQYEDACDRVKNFYREQHTKQTVAYNLKARNDFHSKTRAEMSIWEAMEKLNTLIDESDPDTSLSQIEHLLQSAEAIRRDGKPRWMQLTGLIHDLGKLLYFFDAQGQWDVVGDTFPVGCAFDDRIIYGKESFKENPDYEHEIYGTKYGIYTPGCGLDNMMLSWGHDEYLYHVVKDQSTLPDEALAMIRYHSFYPWHQAGAYHEFMNEKDQKMLQAVKAFNPYDLYSKSDDVPSVEELKVSFPSSHSTRRVIS

SEQ ID NO: 31969 - protein, 107 aa, A.fumigatus
PFNHPDPSEIAFGYARRSCAARYFADASVYITVVQLLAVFNVRKARDDQGNEIPVTLQAIPGMVNRPAPFQFKVEPRSQHHIDLLRRIESEQIPEVSHASLLKPSTV

SEQ ID NO: 31970 - protein, 531 aa, A.fumigatus
VQSGQVFACVFHLAIHPVVDAILGMDHPYLQDEVLRQSLQNPDEFWSRQAERLHWHRKPDTALRTTQKSLPDGTAHPMWEWFPGGEISTCYNCVDRHVAAGNGHESAIYYNSPVTNTKETITYHTLLREVETLAGVLREAGVKKGDVVMLYMPMIPAALIGMLAVNRLGAVHSVVFGGFAPNALAQRVEACKPDVLLTASCGIVGNRPPIAYQALVEEAIKLSYHKPAHTIVWQRDQLQWDFQESAPTWWRTVWQWIQRVLFRRRIRTAKQSSWQQLVASARARGLKADCVPVPSDQPIYIMHTSGTTGAPKGVLRSSGGHAVGLQFTIQYIFNIHGPRDVMFAASDIGWVVGHSYILYAPLLAGAATVLYEGKPVGTPDASAFWKVVEEYQVNTMFATPTALRAIKQEDPSNTKLAEIGARGGLRSLQALFLAGERSEPTLVSMYQELLDQHGGRNAQVIDNWWSTEAGSPITGRAMAPHFGLTTELSRSFDIPIPPIKPGSAGKPMPGFDVRVVDEHGEESSPRGGDQR

SEQ ID NO: 31971 - protein, 190 aa, A.fumigatus
LVALPDYCVCRLVIGKLDCFFDKCLVRNRGPIPHDPARCSEQHIRFARLDSLGESVGRKAAEHDRVNSSQTIDGKHANQRSRDHGHVQHDHITLLDPCLSQDPGQRLDLPEEGVIRDGLLCIRDRAVVVDGRFMSVSCRDVPVYAIVARRDFSAGEPFPHRVRGAIWQTLLGCPECRVRFSMPVKALGLA

SEQ ID NO: 31972 - protein, 92 aa, A.fumigatus
SSSSWYMETKVGSDRSPARNSACRDRKPPRAPISASLVLLGSSCLIALSAVGVANMVFTWYSSTTFQNADASGVPTGLPSYKTVAAPASNGA

SEQ ID NO: 31973 - protein, 610 aa, A.fumigatus
NRRQAKRLEHQMRNGANIQDASENIEQARPDKPAQEPTTVVSQRKEPEAQVTAPESEEPKDNGKAKRSPKEEQQEQQPDVQTEQRKPEPPAEGSMTDAKAAEQAAESLQQTQPEVSSKESEAIQVAEAGIGSEGSAPSRAPSQPEAEHPVEPVEQAPGSAEAVHGQDSKELPDSVGKAATQVSAETTGLSTPLPVEEMIEDTRKRKRRSQTPIPTPEAVASKRAKAQEESPRVLLPEDRDIMDVEGSPGKKAVAVPAENEQAQNQNGDDRNDAIRRVSISDDVRTRGTASIKQDARFKDLFAPADREQIRPRSPPADTNMEDAEVEPALHVATEALYIDGLMRPLQPAALKNHLVSIATAPGASPDPDVIVDFYLDPIKTHCFVKFANISAASRARTALHGVVWPNESNRKALFVDFIPQQKLQQWVAREEESRGRGGPPPRWEVRYDRTDDGVEAVLQEVDLKSTASRQAPGRASTDFSRPPPLGPRASMGVKDRRPSGPPPLEPRPRPGQGFKALDDLFESTTTKPKLYYLRVPREVADRRLDRFDDLLRKGSFPRRGGDENRRITFEDGDFFVDNGPEYGRGHGRRRGRGRGGGMGDSWRDDRRGRD

SEQ ID NO: 31974 - protein, 94 aa, A.fumigatus
GKVGLSPGLARVVPDFLKLGFSNLPEKKPEGEALNDEQTLKDLHRLLLETHVIEGKLVCGNCGHEYLIKEGIANFLLPSHLGLGLPDRIYIVAC

SEQ ID NO: 31975 - protein, 100 aa, A.fumigatus
RYAIVCLILSHLLKFHFSIILLCDLDTMKLVTANFLTCAVKGCKTSSASFPLHFQDAELELEELDFQPEFIRNIIPRVDWDGLRVTANEVRSDYLLVWHV

SEQ ID NO: 31976 - protein, 167 aa, A.fumigatus
NSEGFVFALDKECNVQVNCEVSRGTLIKEPFATCRAAEAGNSVVTVPFPFEFVVVGQLFICIYVSLCPDVESVGLSVRITSSNVPESIYNNSFATINLDDLCSAIRSTAMVDEASDTSSLGGIYNSVLVDSEKVAATYPALQVLPLPHVCHLLSHLFTNVLYDHIIR

SEQ ID NO: 31977 - protein, 70 aa, A.fumigatus
ISNLGSRLPVQNMAKEAEILLIFDEILPAVQIQDYGFIINNCRTRFIIRHPPFDLRNRVFMALCSSGFVR

SEQ ID NO: 31978 - protein, 403 aa, A.fumigatus
IASVEPGDMFYEESQHSESAELGTVKPENLVGIGGKFLGRVEDRSINEDGEKENMERLHIESAIQGANLGIQQPLPDESTTTKSHEDPITEIEWGVSNDEPRPTVVDDETIILDLDGWQNLVKDEEDLCFLRHVLDGQSRSKVGNLSAWAWRQKEIKALNRAGESGPVHQETRIPDYYVCNPTGAARTEGRKRILESEKSKYLPHRIKVQKAREEREANAKSDPHASSAAEAARISAAKTISKSTSRSTRVNNRTLVADINAQKQALPMQGGGGDVLRFNQLKKRKKPVRFARSAIHNGGLYAEENISANDMIIEYVGEKVRQQVADMRERQYLKSGIGSSYLFRIDENTVIDATKRGGIARFINHSCTPNCTAKIIKVDGSKRIVIYALRDIGRGNSDRQAN

SEQ ID NO: 31979 - protein, 83 aa, A.fumigatus
NLSKCDKIRHTIAYLHTLRKWVTNFISAFLSFIPFKVLFLMYIYILSLFRVNYKIQDGKRLLAEFSPTVYTFWNIQEIASSNT

SEQ ID NO: 31980 - protein, 134 aa, A.fumigatus
THSRILPCLCVKSHPQARTAICSADNIKSSFSATRLIPLNLDQMLSQLNIQLRTPTPPGSRSTNSVPKTPYNLKQLKKQETTLKKLLREHTYSPPTPTKAVLGQIIKGCEMAMNNTALLAKENHDLHAAYEKHL

SEQ ID NO: 31981 - protein, 84 aa, A.fumigatus
LEPPRSRTNGSKRSSPKFFPSLAPSSYNTQPVRVSLAFGAKHKELWSIIIKVAEPVLTSMNPDLWARFGPILEAHKAAYGSVCR

SEQ ID NO: 31982 - protein, 106 aa, A.fumigatus
VLFWECGETIKESSEKHKHVAHKLGEWSDVSQGMHQILVWTALGLEGVGANLQHTNSIPPIEAAIKKFAGVPEHYTWKAHLNYGDKQADHPEKPAKLPMGEILMIL

SEQ ID NO: 31983 - protein, 85 aa, A.fumigatus
ISVSPLGATIGTVRFLTPLPGPSSFGLRRRFFAKMAVLETQPAPQKAPESATAEPRKKLFGREFYESLGSPKYIVAPMVDRSEFV

SEQ ID NO: 31984 - protein, 261 aa, A.fumigatus
EVPSILWHLWSTDRNLYSPCHSYQRIRTNHSISQAWRMLTRSFMPPDDPKPILAYSPMYHARLFREQANVRWQHFQPTRAGLDKNDNSLYLDGNPAFDRPLIVQFCANDPDDFLEAARHVAPYCDAVDLNLGCPQGIARKGHYGAFLQEDWDLIYKLINRLHKELPIPVTAKFRIQESKEKTLEYAKMILSAGASIITLHGRTREQKGHNTGLADWSYIRYLRDNLPPETVIFANGNNLNHDDLERCLEATGADGVMSAEG

SEQ ID NO: 31985 - protein, 138 aa, A.fumigatus
  UNSURE (133): Identity of amino acid sequences at the above locations are unknown.
STTEPPIPPNRRFAANIIEFLEPSNQHIISLPLLLKMPLSKENRMQMAISAYKKGQFKSKAAAAKVFGVSRETLRDRLRGIKPRAETRANSHKLTALEEEALAKRLLDADRRGFSIRPQFLRGMAHIPTYCLXNPGGK

SEQ ID NO: 31986 - protein, 467 aa, A.fumigatus
PPLGSAAVERKPLHRTLTIAQAVKARPSGPKGGRPLMSREARLDSSQARNNKRVRLWAARPSKRRKTLSLLETLPVELIEKIFLYSLNVNLPRASPSLAAAVSSERIYRVLILLGFWNDSASEAEDPDSAISRILRPLDYAPLQDDDRENLQTSVLRCRWCTMPRLLMQLSDMTNLTIQRHWVNAGIEMTRDQQESLDRFLARENDTSTYEGTDKDGNHYTLSITPFVSINIACQETDEQQTHKILSIKHFPEKLLLGASGEGFSDDHATHLEIMRVACGLSRSDHLETDVSVSRESLHQGVHIALVEHNTRALATLLKIDEYIFRSNAAVAGGLPYSIPPEHFRTAVRVARNDPALFQTLLRASAESVPADDPDITEWAMNLGDPFGHWLLDLMLRLPQQIETANANPAEGALFYLGRANGHIELARRYLRDVLNVDELPSWMEASDDLFRQWRVITTTTGIYMFV

SEQ ID NO: 31987 - protein, 193 aa, A.fumigatus
  UNSURE (10): Identity of amino acid sequences at the above locations are unknown.
ICGGKRYNHXRHPYGHYFTPTFFADVTPSMRIAQTELFAPVFVLMRAESVSHAISIANSTMYALGASVFGYNQKDVAACVSQIKAGMVSVNDFASYYAVQLPFGGVKGSGYGRFAGEEGLRSVSNIKAVCVDRFPRLMATRIPPRVDYPIQKGDDDKQNGTGAWELCKGVVETGYQLTLAGRLGGILRLLKNM

SEQ ID NO: 31988 - protein, 62 aa, A.fumigatus
IQGVFRSIGACLMGIVNTIGAVLKAIINGVVSLCNIVISCLTCGYCGNRGRMRSSRHRRSRV

SEQ ID NO: 31989 - protein, 103 aa, A.fumigatus
NYVLRSTFFSPGFYSYAACPFHDIQLSHSWNIPTSYIILRPWRYCDIVPAIYSLTIPLVQPFTMRPFSDTSVHTTASSSTLSNTDNASSSKPQTVIHIKTKIL

SEQ ID NO: 31990 - protein, 264 aa, A.fumigatus
ENIVIATKVWAPVGRGKEYPLFLSNEERDNAGYVNEYGLSRKHIFDSIEASLKRLDLPYVDLLQIHRFDPNTPVKETMEALHDVVKSGKVRYIGASSMWAHQLLEYQYTARMNGWTEFISMQNFHNPIYREEEREMFPACAKFGMGAIPWSPLAMGFLTRPWKAFEETTRGKSLNGKLMGQPFTETDKKISETIEDIANKRGVSMTIVSLAWSLSKPFITAPIVGLSKKERVDEAIQAIDFKLTEEEIKSIDDLYQPKKVIGHH

SEQ ID NO: 31991 - protein, 61 aa, A.fumigatus
MLTPPPFSTTKTTYYSTTSASTDFLDNFFFFLSSIILQRHLFSPHLGAHYSAIFTISRPLI

SEQ ID NO: 31992 - protein, 66 aa, A.fumigatus
ITLRSPLLFPKTGRMIFLALSVLIPSFLSLLAFISIREKGSLNRQLTDYVAFYLLIRSEQYYNQDY

SEQ ID NO: 31993 - protein, 115 aa, A.fumigatus
ISHSRYNHNLSSTVSLPINMFTARRLLTSAPRAISRRALFHSTAPAFVQKGDAIPDLDVLVESSPGNKVNLAKELKGKGIIIGVPAAFSTFAAPRLEPLHLLRIQSDMRSTRGKR

SEQ ID NO: 31994 - protein, 186 aa, A.fumigatus
CATRGSFQPRGEDKILKSPGARKIPIFVKDMEETINTATQFVSQRICPIFQVSNVTGENLELVRTFLNILPHRGQYNTEAPFEFLINDTFSVPHVGTVVSGVAKSGVIHAGDSVLVGPDSLGQFTTTTIKSIERKRIQVNACFAGQSGSFALKRVRRKEVRKGMVVLKKLEQPPKVYREFVAEGTF

SEQ ID NO: 31995 - protein, 96 aa, A.fumigatus
LEPVLILSHATTIKPRYQAMLHVGAVSQTCSVIDIDRPFIRTGDRALVAFRFIQRPEFLAPGDRVLFREGKTKGLGIVKSVGYDPDHPLNPEAKTK

SEQ ID NO: 31996 - protein, 520 aa, A.fumigatus
FYSNSFGSAWRSFWHTMTSYDRHASHDSPYRTGRHVPLSQSRHEPLTSIATSAIESRPDLTDTFEDDQPKGSTNSNSNGWTGSPTGVGSPNRPYSPGLRSLSSQKRRSTERGADGAPEIQMQSFHDGAPPPPPVAHSWRKIDRWLENNYEELYDNLCEGCTQNDINELEHELDCSLPLEVRESLMIHDGQERPGLPTGVIFGCMLLDCEEIVQEWKNWRTVNEEFLSNSTMMNPPPKATASSSSAVPPLQGANPLWRQELLDRQDSQPPGAVQKAYAHPAWIPLARDWGGNNIAIDLAPGPAGKWGQVIIFGRDYDCKYVVARSWAAFLAVLADDICSGKVSVDEETNELKLLEFKGQNVEPPYLEILRWRTDQKYGRRAPRRKAPNGLGLNTNSRPGKESPYGSPTPSEERGRSPHRFPNRGSTQSPKTQFGVSSPLARVTEEATSPVNTSAEVEMPEDAFKEHRKEPETDDLMEVVTPQISGKENQDLTDKHDEWKSPKPEKVQRRESSQGTTAVSET

SEQ ID NO: 31997 - protein, 139 aa, A.fumigatus
  UNSURE (8): Identity of amino acid sequences at the above locations are unknown.
PSAPSGEXATRDHEVRFARVDVRNTPFVVNKLNIRVLPCVIGFKDGIVVERVVGFEGLGAGGRDGADSFDIATLEKRLLWKGILTQTKFKNNEDDSDISEGGSGDEGSNRRRPCTGRRTIRSGNGRHHGGDDDDDDDWG

SEQ ID NO: 31998 - protein, 478 aa, A.fumigatus
AAHYPLKDCGQTLQRPFTSTMPPPKLSYGLNLPSKKAPISKLGPPGSQKRKKTIFDSDSEGDNQNDAGDGGGDGPIEITTIGGLEEPPRPSTNERQTTEPPAKRKPLAGPPTGKPNIKPLSKNSIFADGEETQEPQAMPLGLNPAKNKSSAPPTAELTNLSALRSSKKHAEDAQQLDPTIYSYDAIYDSLHTAKSDKAKAASADAKNDGPRYMTSLLRSAEIRKRDQLRARDRLLAKEREAEGDEFADKEKFVTSAYKAQQEELRRIEQEEAERERQEEERRKQNGGAGMVGFYRDMLSRDEQRHEEVVKAAEEAARRVQAGEIPADEAAAEAEASKEKTEAQIAAELNAKGAHIAINDEGEIVDKRQLLSAGLNVAPKPKPSASASAAAAAARAAANKPRLDSGHHAARTNQRARQTEMIARQLEEKARQEAEAEAARQREIAERTRTRKTETDVLSAKERYLARKREREEAAKKGS

SEQ ID NO: 31999 - protein, 92 aa, A.fumigatus
ARTPSLPTGKRPKNHRQCRWASTPQKTNPARHPPPSSQTFPPSAVARNTPRTPNSLTPPSTPTTPSTTACIPPNLTKPKPLPRTPKTTGRGT

SEQ ID NO: 32000 - protein, 263 aa, A.fumigatus
GRGRRVRRQGEVRDVRVQGAAGGAAADRAGRSRAGTAGGGAAEAERRGGDGRVLPGHAIARRAAARGSRQGCRGGRATGAGGRDPSRRSRRGGGSKQGKDRGADRRGAQRQGRAHRHQRRGRNRRQAAAAVRGAERRAQAQAVRLGERRCGCCSCGCQQAASRLGAPRGADEPARPSDGDDRATARGEGPTGSRGRGRATAGDRGAHAYSQNGDGCAEREGAISGEKAGARRSGQEGVVALLVYFFASALTRCLNRRKGRNSA

SEQ ID NO: 32001 - protein, 80 aa, A.fumigatus
LPVPKMSYYFTILSPTDVPLFNIAFGTSKGGGDGIARFRFPDTAQYMNQFIIHSSLDIVEEAQWMNGNMYGPPYSNLTDI

SEQ ID NO: 32002 - protein, 125 aa, A.fumigatus
TSKATTPSWPLLLAPAFSPDIAPSRSAHPSPFCEYACAPRSPAVARPRPRLPVGPSPLAVARSSPSDGRAGSSAPRGAPSRDAACWQPHEQQPQRRSPRRTAWAWARRSAPRTAAAACRRFRPRR

SEQ ID NO: 32003 - protein, 151 aa, A.fumigatus
RLPRAAARLAIACPGRTRPSPPRRSASAAPPPAVPALLLPARSAAAPPAAPCTRTSRTSPCRRTRRPLPHALWRAACPARAAGPACGSLHCAIARSCTAARRFWRPRKRLWLCQIWRYAGCRRWRRRSRWWGQAVGRPRRVSCYCGGRKGL

SEQ ID NO: 32004 - protein, 84 aa, A.fumigatus
TRVEYMEKGGDIGRRGERKKNEIPYTLSYTQQTSLCLWRGWKRLLADPSLPYIQLGGNTIVGLSWEVSSSICTMTQTACTAEEG

SEQ ID NO: 32005 - protein, 64 aa, A.fumigatus
NCEANAEACTVYYKAGNIHHNWSLTFVFSSVSGSMFLQFLAIGTPDHYSSFLIGRCRGSHGLSV

SEQ ID NO: 32006 - protein, 128 aa, A.fumigatus
VIVDVQPPFSCYVYRGYYGAATGKGRQAAKAELEKLDLASEKLTLLEAVREAARIIYVAHEDSKDKEFELEMSWISSLDGPTKGKHEAVPRELLEEAEKAAKRALEGEDEDEEETTKNDGNGGERMEE

SEQ ID NO: 32007 - protein, 82 aa, A.fumigatus
VPWGYGDLFNGDRFCQIAWEINVESLSNSKPISNKLQRNNVEKSLKAVNGLWDLNLFGLGGRELWVVMVANHNGTTTASNHW

SEQ ID NO: 32008 - protein, 96 aa, A.fumigatus
GPIPISALANRLGSYVQAYTLYSSVRPFGVTAIVGGWDSDTELAVDGQVGTGPAAGSGGKTSHAKVGGPGLYMIEPSGLYWVSDRGRSTSFLVLCL

SEQ ID NO: 32009 - protein, 121 aa, A.fumigatus
RYLPLLIAVRLNNFSFYPVSSLQTKFHGGFTPILTMIVHSLLAKTSSFQALFFRQNSEHSENYWHASIKLNTHQTMRHRIRNVLKMHCLSLDENTDSNDGVKRLSCSRSWRCLTQVCSRGR

SEQ ID NO: 32010 - protein, 89 aa, A.fumigatus
LSLPPAFILHTSNHSPVIARGGRPIVICNHDDPEFSSAQTEKIEVPKTVDCLQGLLNVIPLQLIAYWLAVGEGLNVDFPRNLAKSVTVE

SEQ ID NO: 32011 - protein, 141 aa, A.fumigatus
SEIFTRIYTASQLQAAKGSSSAGGISATDLLSSSTADLSKTSPTSTAAKPFDAIIAIGVLIKGETMHFEYIADAVSHGLMRVQLDTGVPVIFGVLTVLTEEQGLERAGLGKKGMHNHGEDWGKAAVELGLKRRDWVEGKIV

SEQ ID NO: 32012 - protein, 84 aa, A.fumigatus
SLTAGTRSRSGSYLTINSKFGIRIPTSDNSCNPKWSYTGIESVSLDITAKTIGQGGDRDGSLEYASPRGSFVSSSRHEVTTVWD

SEQ ID NO: 32013 - protein, 67 aa, A.fumigatus
RVCLCFISLSKGSGLRVAIVHARWNMAIIQPLVEGAKKSLLAAGVLEEDITLETVPGSYELPFAAQR

SEQ ID NO: 32014 - protein, 493 aa, A.fumigatus
TPKKTRVLPFRDGFDDDEIMAISPSKSAKSKRTTPTGPGKKKRKLDSGSPTPLPLCQPAELVPEPPEDLFDEEMMDDVMVDEPVPRREDRNAELMKSILNHKTYPNEECDIEVLSQMAFPSEPRRKLSTIVLEETARLHSGNYVVEYAQVIASLWSRALKEKFFKPVPMFMEITHHLLALDAPSCVPDMIDHLVPVLQESGDINGIPRFRNSPVSRQNLGQVRQTPLSQLEVLVDSTEALSLLYRMAYLCIHMERTMERFWRHMRYDFVLMMLNCSQPIRDITLMLNLLSTSIRAESFGSVQETQQDQLANENYIVDRVANLLSETPQPDEGQPPYTAADICSMRLQAMYFLTSVAFNPVAPASEHGSSVIAQHPTVLARMIRAMHDELDALYTYPPERDLHATMVNGLMRLVYGVIRRHKNVDLQSKLCRVAGGKQKFLVVLTRLAFSEGPILEGGIDDETVEMAHEILDDAVTPQEAEALLEAFPSAKRDD

SEQ ID NO: 32015 - protein, 173 aa, A.fumigatus
WVMEDKDDDFFSDDGLEDLPPSTLLQLEQNAYLATQAQKPAQSEASIHTAPTSHAQVDRQFAVAESRSIPINATLKPPARLHTGLTNDYDSLDVGEFDAEVLDGDSGFPVALDQPPASAGQAVPLRNESALEPMDIEEGRGNPYQANIYEAYNALEEKVSVVEAYTTAGFWLM

SEQ ID NO: 32016 - protein, 162 aa, A.fumigatus
CYRRWSLTYWTSSDDRVRGGSSYSTLTILPNNTVQFHGHLDITTLGRAGFTSQRTTDDMSWDLSDADGLELDVAGSDGKVYTLVVKDRLLPTRADGREQSTISWEYDFQTVERAIVRVRWEDLRASYRGRKVDAEPLDLRNVKRISIMVRRYVFILQRKSRY

SEQ ID NO: 32017 - protein, 92 aa, A.fumigatus
VTLLRSDIANVIDDGPSHTGPPPTTASGAVPRIPPSPFSQTTQSNSTDIWTLPPSAEQGLPPSAQQMICPGTYPTPTGSSWTSPVRMGKCTL

SEQ ID NO: 32018 - protein, 80 aa, A.fumigatus
WLRTLLIQMLPCYARKRSVSCLRKYTKFIMIMTYCRSTNMLDRRMMSWISAKVILLILGSIGVWSVSGGQAWIGYYPVWS

SEQ ID NO: 32019 - protein, 93 aa, A.fumigatus
LSEYSAGRRFLCCVHIIPDSRIHGWSLKCRFNNSLDTSGEIYYFYYYWKVSTSIIGNVIATAPPPVELVYMKGSLLYHNSHSILFPCSLPLQA

SEQ ID NO: 32020 - protein, 184 aa, A.fumigatus
SRDRPCPAEDAIMPAIHGDLLAAVIPTDRDIPVNITPRQVTLRDRVTVATLVPISSADDVPPSLMRYLSDQLNKEIAKGDTYAMVDPIPLEQFATYWFFNFGAIMLLGDIKSVYEMKAMERAGADWTKTCLGSFNIRPNYPGRSSHVCNGMFLVTDAARNRGVGRLMGEGYLEWAPKLVSMIST

SEQ ID NO: 32021 - protein, 371 aa, A.fumigatus
QGYTYAVFNLVYESNVASCRIWDALGFKRIGKVPNAGKVLSSPGEYVDAIIYGRDLSSEGDDSFTQDRFDKIRYYLKHSKYPRGADRAEKSRLRSAATHYKLIEGKDGDSDKLMLKDKEVVSDPQQQYEIARTIHLKQHAGINKTTAAIAVKYHWVRIKETVSRVIRDCPQCKETLKLPPSNGMLIHDGAVTMEKLSANENETSLSTRSTMETPQLMDNNSLDPHQSHNPFAQTHPQVIQGPVDSITDYTTLPLDPQIIDINQQLSRFHSHDGMSHHPHDGLGHHPHDGIPDPYTHGHHSLSHSNFEDAVRHHTAHDYHMMVEDASDSDAAVLRQEALGLVPPQVHEVHHDHDLLSKYEYVGPPDDELDFS

SEQ ID NO: 32022 - protein, 148 aa, A.fumigatus
RSLASPNGWSYDDPNVSTDSLRRYTLHDPGITAFAPPYPESEAADVRSARMSGYSGIEMDAWQRRQGVKPSALRRYGTRKINLVQGSVLSVDYPVPSAIQNAIQAEYRDAEEAFHEEFTHMRCKYSCRIAIAYSRLRRSRYCRHLRPR

SEQ ID NO: 32023 - protein, 138 aa, A.fumigatus
GGLDTAATCDPDEFTLRNGYNLRPAMYNRHTELLIAITYYNEDKVLTARTLHGVMQNVRDIVNLKKSEFWNKGGPAWQKIVVCLVFDGIEPCDKNTLDVLATIGVYQDGVMKKDVDGRETVAHIVSDTRQRVPFEKHH

SEQ ID NO: 32024 - protein, 344 aa, A.fumigatus
FEYTTQLSVTPTQQLVRPQPNDPSNLPPVQMLFCLKQKNSKKINSHRWLFNAFSRILNPEICILLDAGTKPGSKSLLALWEAFYNDKTLGGACGEIHAMLGRGWRNVLNPLVAAQNFEYKISNILDKPLESAFGYVSVLPGAFSAYRYRAIMGRPLEQYFHGDHTLSKRLGKKGIEGMNIFKKNMFLAEDRILCFELVAKAGYKWHLTYVKASKGETDVPEAAPEYISQRRRWLNGSFAASLYSIMHFGRIYKSGHSFVRMFFLHIQMIYNCCQLIMTWFSLASYWLTSSVIMDLVGTPSSHNKYKAWPFGNDASPIVNFFVKYGYLLVLMLQFVLALGNRPKG

SEQ ID NO: 32025 - protein, 240 aa, A.fumigatus
ADGISCPRRKTADTNRTKLAYTMSFLWFSLVQFYVLILSFYLVANAFMGGMIDFDFDQGVGNFLSSFFSSTGGGIVLIALVSTYGIYIVASILYMDPWHILTSSWAYFLGMTTSINILMVYAFCNWHDVSWGTKGSDKADALPSAQTKKADGSKNNFIEEIDKPQADIDSQFEATVKRALAPYQEPKEDSTISLDDSYRNFRTSLVLLWILSNLLVSLLITSDGIRKMCLTVRLGSPGCA

SEQ ID NO: 32026 - protein, 694 aa, A.fumigatus
  UNSURE (642),(667),(677): Identity of amino acid sequences at the above locations are unknown.
QVLDSEDKGQLQAIVRTLGLARRLYFAPFVEYLLPLLNHADQERELRAMAYTFQMVVGYALPWTRVSELLFRELTRDALIVLGIDALDEEANFEDSVSVDNMEVDRQFSVSYQDWREEPSAEVRMQMMAEYEDVRVVATRERLLSLLRSLQLVGLGGDKAQKVFASVMDMMLTVFIESAYANQWEGPSLVSQHLRQWIENVFARLVVQVLAIINHDETGANASGRLDVSLVDVERWQEMGISRLGSLRTRELFDIIVEWPASSGAIEDLRQFWTHPPARYCLTQAFIKVLNQRLLHPGASTIDILRVYISIIRAFNLIDPKGVLLDRVARPIRRYLRDRDDTVKVIVGGLLADPADTDESNLPSTGETLSELSAELAKAHQNSLRADSGELDWDDMNWMPDPVDAAPDYKKSKSSDVIGSLISLFESKETFVREMQNMLAERLLQKRAEFEQETSVLELLKVRFGDNSLQACEVMLRDIFDSRRVDAVVRNDQGLVQSEDDTRPELHAKILSHFFWPEFPAQQFKVPPEIAALQERYATGFGSLKQSRKLTWLNGMGQVTVELDLEDRVFVDEVTTWQATVIYAFGSEEGATKTVDGLSAELGMSTALVRSACLFWVSKRILSELQRNTFRVLEVLPNDDDXGAVGPAGVSAMESGPANAAAAADSXAAAAAKETAXAAAMENMTCTGHSPLAC

SEQ ID NO: 32027 - protein, 408 aa, A.fumigatus
  UNSURE (131): Identity of amino acid sequences at the above locations are unknown.
GLLYLLSPVTFTLLTRYPRLQGWCIPTGLCITVIGSLLSSISTHVWHLIATQGIMCAIGNALMFSPSSLYMDQWFIHKKGLALGIMWAAKSVTGVVLPFAANFCLHHFGSSTTFRVRTVTTVWSPGSLLRXVANLCRGTNLGGVCRCPNASSTNTESQLLTTLGSLPFMKPRIPVSPSASARRLDLGFLRLAAFWTLQAGNIIQSFGYFLPSTYLPSYSTATVGLSRTMGTMLVSLFNATSIVGGICMGMLCDRFAVSNILLLSSMGSALSVFLLWGMASSPGSDSPRTGIALLTLFSIFYGFFAGGFSSTWSGVIKQIKRDSSTSLETGLVFGLLAGGRGIGNVISGPLSTALIKQGSLGGSQTSNAGTGFSTQYGTLILFTGITAALGAWSSMWGYISSSVRCVSR

SEQ ID NO: 32028 - protein, 67 aa, A.fumigatus
GLVFLIQHLQSRSKLDLQRANPSDCVVLMREPLLLYLCAILGLIISPLSFYLTILRVVDTFEHVGFY

SEQ ID NO: 32029 - protein, 611 aa, A.fumigatus
IIPSMPSISLTAKDRLRRSQSARSMRRSRQSSLPSELFDPSIARQHAAVAATRAMLRSSDRSSADSKHSYDCLGGPENMAVPSKRLTRPPRHTQAPTTDPSVEDASPSRRSIASYIENCDDDLTFSAALPPISEFRGLNGRDSSLPSSYRRLRKARSMFSTRQRASYISHEYSSDVYARRFNDTEQFETPRRYRTLRRSMSFLRSGQSPRFIRHAQSQEAAIQLARSQFQENMVGQCSGQRQSSITMLKPRREHKPFRKTFRTNSGSGMDTDASTSAGQSKRVSSRGKARALSSSIKRGLKRVLGLSKTSAAPGQAEASPLSLQQHNYGPSSTIYAGDSSAEELGHSHETIGQSRPPTVRSVQSNESLSTSRSRVTSWTDSTVASTIATRRAPERDCLSIINEQGDFNGRAGSELPPRPSAIRPDGSIDSKHLYDALLRRIGRGDMPSPSEEVVVGQVKEHRLIPARTSSLRPRRSRQTIRQIPSDASIATSRTFATAYAGSSSPQKQTQRHSRSSMPSQRKSSAPKKASTPLDFSAVDNAKEPAAACAEDAEDDSRSVIVASQADPETLSNSPSIYSRTTSGSSPERKDQAIDLYSRLHHGAGRIRGSAF

SEQ ID NO: 32030 - protein, 230 aa, A.fumigatus
AAIRCTLSVGEIGVPRRYKYKPRVLPGLGPISYSWDIREGHHHICLYICSCSRLRRSISPNRGRCYSLTFFLARTVSSTNMTSQQKYTPPNGALAEQFSRYDGSPLSAQDLTWSYTSFLTAVQARRHALNPSASHIQPLLSNATTATALPQVCTPSSARGPYQPVKRIKWPRPECLSPRSTVAVRFNVLATTVIGEDIFLVGSIPALGEWDARHQALKLEANEYSSITPL

SEQ ID NO: 32031 - protein, 168 aa, A.fumigatus
CIISCMQQEGVSGGSSLSVLECDRSASRFNFPYFPTIIIIIIIIITVIYSRQSSIRACESCACEAVSIRLDEMKDETPRMTEMTRKPFLTIAIGVLTTVSALSDPAQIVIPATITPQTTDPLVSWLAQETSYALDGVLNNVGPNGAKATGASSGIIIASPSQSNPDCE

SEQ ID NO: 32032 - protein, 82 aa, A.fumigatus
  UNSURE (14),(18),(41): Identity of amino acid sequences at the above locations are unknown.
WACAESNNTDFLRXLDDXYVLLFSIKIELPNFVYSNRIMVXSLPLSQASGQSFQNDLFYPTEFWNSSTFGTFVCFSYGRIIQ

SEQ ID NO: 32033 - protein, 222 aa, A.fumigatus
PDPVDLWEEVRGSSFFTTAVQHQALRKGAALAQRLGKTCSNCQSQAPQVLCFLQTYWTGSSILANLYSDRSGKDANSILGIIHTFDPNAGCDGQTFQPCSDRALASHKEVVDSFRSLYPINADIPQGQAVAVGRYPEDVYQGGHPWYLCTLAAAEQLYDALYQWERLGSLAVTNISLAFFQDLVPSATVGTYAKDTITFASISAAVRDYADRFLRIVVGVTL

SEQ ID NO: 32034 - protein, 135 aa, A.fumigatus
PHSRNTHPRMAPSQSNSRAMTAPPSQRKTSLGPTHPFSLQFKPEDMLLILPHHTSNLSSQTRPPPLPSPKSAPLPPHEGPTSPLNESSGPDQSVSPLGVPSPFGSMSWRPPLLARTSSSSGPSPRWANGMRGIRL

SEQ ID NO: 32035 - protein, 60 aa, A.fumigatus
  UNSURE (29): Identity of amino acid sequences at the above locations are unknown.
DYYTWTRDAALTVKYLVGSFAADHESCIXRIIEDYVESQAHLQTVSNPSGNLSSGGLGET

SEQ ID NO: 32036 - protein, 136 aa, A.fumigatus
  UNSURE (4),(6): Identity of amino acid sequences at the above locations are unknown.
TSTXRXAVKTMLTEVATTQLSVSPLELTCNSSLADKWAANGATFYNCCGPTEVTIINTMHRHQFGQQLTIGRPLPNTSVYILDDKQLPVVIGEVGTMWAGGAGITRGYLGQPEKTAERYRYDPFVDDGCVPGSLAD

SEQ ID NO: 32037 - protein, 95 aa, A.fumigatus
LGRSGPCGLVEQGSQEGILDSLRRLLSAIAMILLLTMGASQAVSLIDMLTDRWIAYSHSMMFNTGDLARWLPDGSLETLGRNDDQVKIKVGLHLS

SEQ ID NO: 32038 - protein, 442 aa, A.fumigatus
GFRVELDGVSASLASCPGVLEAAAIMVEGDVVAFVTPQALDLQQLQMHLKARLPYYAVPTQVHRVDEFPLTPNGKIDKRALAQLSRPQKKTSQSDTEMLDEKKHVVLNASRETVSTRSDSSDSLRKPLPLAEKKNRKVVRGLRYRIFIVYRRLFTLIWLANVAALLCILFIPKLGPQWISTIAFINLTIAVLVRQDAVINVLYTICCSVPKSWPLAIRRRCAKIYHLGGVHSGAAMAATAWFAGSIGYNIYNQVDDARALAKASPATLTLSLIVLLLLFSMIGFAYPTFRKKRHNTFERIHRFVGWTILGIIWIQTILSIRDQRGTQPLGRAVISSPNFWMLLVITASIASSWVFLRKVPVDAEVLSNHAVRLHFDYTMPVNGTFTRLSERPLLEWHSFATVPAPTAVNGRPKGYSLVVSRAGDWTGRQISKPPTHLWVRGI

SEQ ID NO: 32039 - protein, 121 aa, A.fumigatus
YPVLSPQSGFISSEVHVTESIRFTVASRTFELLHNMTNPQVTNATVEWIARGAGNKFLFLLDVRFATKAHTLLGQPEVGMDLMPGGGGGQYLPRLIGRGRAWNNIELDRHYYGGCGGNGFD

SEQ ID NO: 32040 - protein, 143 aa, A.fumigatus
SLRRIFSSWPISEIGIAGRANNMYDSRIENLNIQNWPVHCFDIEHTENMIISGITLDISTGDAPRSASGSKPAAQPTASISPLAPTSPVEQLGTQPGRLRRGLKRQPRRRRLHLRRPWAKHRLHRQQERQHRRRGDLQLAGHR

SEQ ID NO: 32041 - protein, 110 aa, A.fumigatus
RIKLNSRTTGEVSNTRYENVTVCGITDYGMDTQQDYLNGGPTDKPTNGVKIENITFVDVTGTMRDGKDYYILCGDGSCSSLSLKMAASPVVVATAVTILPVLVLRLDCTK

SEQ ID NO: 32042 - protein, 455 aa, A.fumigatus
PRCYNISLFLHSLAVILRFKQGSCLPVSSIMAWQRPNCIVQAVQTVRAAQLQSILRTSTVTSGSLLQQRKGTRSYATEAQTTGGNALQVRAASEIDFSQLATRPARVIPASPAYFSGSPKFIDHLLNLERVCAKYASLPTVAPNEAPRMAWLKLAQFRDFVGEPVPTKKYKSLVKILQRLNRIEPALVPGEVRDTLKTFLRPGNPYGNKPAPATVDEMGRARGKGKRKTSSAVGYLVEGKGEVMVNGKTLVEAFPRLHDRESATWPLRCTSRLDKYNVWATVRGVVSLAQAEAITLALARALLVHEPALKPILRKGTLQMRLSEWVVKNIADNFSSWCHYRRCSSRREKETRSRQGSQDANLGQEMKACLFSLGPGVLSALYSVYCSHFPDLYHYLTCHLDSSLNMLSDPPHHRACVMGVCFKTRHLHGRSRRQAMYLSLTLIGRYPQMTMESID

SEQ ID NO: 32043 - protein, 300 aa, A.fumigatus
SVLRGHPRSRLRMEDRIQFDINESLKYYLSDPASVPTNDADPELLDCESDLEHLTPALIDNVLNPIVDAVAESPEALARQSFFDSLQFLLKCAMALSSFSEFPGHGGTLSELLNSCRYSSFLPTKSLSKLLDLIVSGLSLEADIIHGDLEAEEQDAIQHHKQLLEMYGFLLQWALSAVEVKAAEKPAEAAPARRGAGKSGRSKTSNRDGTWDWTAQIQISMETMCKVMKLKLSRIFMTTSDRDTFINLFTRAIYLILESEQRVKSLAIRMHAFKVLCIAVKHHGHAFGRVQEHNEQSCLS

SEQ ID NO: 32044 - protein, 343 aa, A.fumigatus
LLPQSYTLRCAVVEVCGNLIADLSRQEERSENYKTQINAFFDVLEERFLDVNPYCRCRAIQVYMRICDLEQKFPKRRQAVAELAARSLEDKSSNVRRNAIKLLAKLVSTHPFSVMHGGQLSYKEWAARLENVDAELNALRPPETPGFDGGEASHVDSELLDDATQIPEDSPSKAPRMTDAEKAAAIQRAAEQAATSELLARLQLTRKYYNEAIRFIEVLHSASAVVSQLLSSRNKSEVIEAMDFFVVLDAYKVETARSGIRRMLRLIWTKGNSDEGKGVQTHLIDCYKGLFFDAPDSFGPNDAANYVARNIISLTFGSTPAELTCLEQLLSTMMKAGHISDVF

SEQ ID NO: 32045 - protein, 122 aa, A.fumigatus
QRLLQHRLNWTIDYNTGAYRAQFPTPTGNPADPTLTSHGVRQSHEFAAHISSPRFQPKPFRVYCSPFYRCLQTIQPTVEALKAKQQQQQQQQHEESSDIDACADFDVRVENGIGLAPTLPQL

SEQ ID NO: 32046 - protein, 268 aa, A.fumigatus
SASKHCNPTVEGSTHQPLSAPELRNPQSPFFTQSHPPPTPFPPRQSGTFVSARRIFVPGANASTPTPAVPTLFPLLRNVLNPAVKTKKSSVELSSGIAPVNARPMAISGAACEQISSALLVRWSGRCDSSRAAISASTSAIMPASAVARRLCSWAMVSPRGEGMRCGLCFEGSDGRMLGKWVWRVGGVAGEGCSKKEVGPNHSLVSLNQQCIFYNCGKVGANPIPFSTLTSKSAQASMSLLSSCCCCCCCCCFAFSASTVGWIVCRQR

SEQ ID NO: 32047 - protein, 408 aa, A.fumigatus
QTRVSLAKWAFQTVPQTSKFHPTGTPAQESGGSYRCPYSSQVKYPEDQLQLGIAHPAERIIRIRNQLCEMLDDLYSDPRAARNGNIEALLARVFNIYTRADQLRVTQSRLQPTLATNASANAEPAQPPLYLLSSPGGYQALVASPGATNSIQALVASFHVSQTPEFTPIQAPAQPARFRANQEAVVLENVVRQAVLNQRAVNNGPVDLSRYIRRIWLFVRLYFFCYMFSEPGTWLRVLYVTLAVIASLLSETNIPRQLFNLTVAPLQRYLEGLLHVAPDAAGNNGTRAAVNGTGMLNDNRASLPGQLRQGIQRLERSAALFVASLVPGVGERQIEVRNAAEAARNAQLAREEEERRRQQETAGNGENSAERQEPREEADGANERVEPAEQNIMTTNQSEPLIPLEPDE

SEQ ID NO: 32048 - protein, 128 aa, A.fumigatus
PPSDRSRYDTGTISGILAMPYWQELFSTGYRDPTGHPNITSSQSAAIVSILSAGTFFGALGAAPMGDRIGRRWGLIASAQVFNLGVILQTAATGIPLFLAGRFFAGLGVGLISALSMSSLSHGIPGFD

SEQ ID NO: 32049 - protein, 162 aa, A.fumigatus
WTVPLYQSETAPKWIRGTIVGAYQLSITIGLLLASIVNNSTQNRMDTGCYRIPIAVQFAWSIILVGGMLILPDTPRYLIKRGNIDGAARALGRLRRLPADDPAVREELAEIQANHEYELSLGKSTYLDCFKGNLLKRLLTGCGLQALQQLTVYTAGGWKVPS

SEQ ID NO: 32050 - protein, 104 aa, A.fumigatus
IPTEASRPQTPSTKCSSNSSKIQSGPGPPKWSENFFSPPRQPPGKPAGLAPPGIPKGASSYPPKGNLNCPQFNPGTGPTSVKPGNMVWPNSKLPPRKQQNPGEI

SEQ ID NO: 32051 - protein, 85 aa, A.fumigatus
RLLPTTSKDTKRDPFPLVALGVALIMRLVSGYPSSVSDFISDLLTIDIAACVEDVPFKTLVRIRISSLFDSLKKQLHALTIAKIN

SEQ ID NO: 32052 - protein, 205 aa, A.fumigatus
APLLFGLVKLLYSYCIQLGDKSVNYSLPDQMLSYPAHPIYPPIYSGDELSHPPGAMTPSDVSSSISPPNGQLGNIKYSTPVAGESIASALSQEEELRRAAEEDRRRRNTAASARFRMKKKQREQTLERTVRETTEKNASLEARVAQLEMENRWLKNLLTEKHEASASRMAPPPTDSTALNSKTNGLAGSGQKHIQPKKKGVGTDN

SEQ ID NO: 32053 - protein, 204 aa, A.fumigatus
RVSSAGGLGGDGASARGAGLLHEGAAGTGRLGSGGDSGRATKVAGGGSRALLGVVLVEQEVELLLGGAHAIGAVAACGSVAGDAGAVSVAADKTEKVAVLVAADGVLDDTGGGVAHAGAELLVRGRGQGTGAGKPLAVDGRAALQSCVGGGVGGFIGAGGVGVVVDLAGVVLEVGHGADAGAVNSGDKTWMDQLRPMTGSKSLP

SEQ ID NO: 32054 - protein, 246 aa, A.fumigatus
SSHWPQLIHPGLVSAVDSTSVSTMADFKYYSSQINNNANPSGTNKASYTPTNTALQSCPTVNSQWLASASPLPPTPNEQLCTCMSNAASCVVKDSVSSDEYGDLFSLICGYTDCTGIARNATTGSYGAYGMCTPKQQLNFLLNKYYSEQSSASSACNFGGSATVTSATKATGACSSLMKEAGTAGTGTVTSKPTGTADSSGSSASSTSSSGTAVALTRGSAVTVGSFELGVYAITALLTAVGMVML

SEQ ID NO: 32055 - protein, 274 aa, A.fumigatus
MRHMRLTSTEDYSSNGTTDGSSTYIDPLSDATLCKRDVPIFRELNTNTIRVYAIDPTANHTECMQMLADAGIYVISDLSDPSQSIDRSDPSWETTLYNRYTSVIDALAPYNNTLGFFAGNQVSNTVGTTDASAFVKAAVRDMKAYIKEKGYRSMGVGYATNDDSSIRVNMADYFNCEDSDESIDFWGYNIYSWCGDSSYTESGYSVRTEEFRNYSVPVFFAEYGCNEVTPRKFTEIEALFGDKMNDVWSGGIVYMYFQEANNYGKLFDPVIGRN

SEQ ID NO: 32056 - protein, 101 aa, A.fumigatus
RHTSRRRDTAQWESATRPTMTRPSASTWLTTSTAKTVTSRLTSGDTTSTPGVVIRPTLSLGTVFAQKSSGTTPCLSSLPSMVATRSLPASSQKSKPCLETR

SEQ ID NO: 32057 - protein, 133 aa, A.fumigatus
IITITSGILRDNVPDGDMTISNTGHDLNRICLVLDEIIPTWRAHSSILMTHPSASFGMWPCVQCNLENIRVTLQQLRQELEPVAESGQKKRSLFKVYAKAWKLGLHSRAIIAYRGRLEPHRKALRVGATMMNM

SEQ ID NO: 32058 - protein, 160 aa, A.fumigatus
  UNSURE (102): Identity of amino acid sequences at the above locations are unknown.
AMTVRCTCVSVSFFSFFRFTEPNQAEEIKDAAETLPKAMMSAVAVNGVLGFVMVVTLCFTLGDVDSILSTPTGFPFIQIFYNTTNSYAATNTMTAVLVITLXASTITEVATAFPQLWSFARDQGLPFSSFFAYVSLTPPISGRRYWSPKCKSTPGLDIPF

SEQ ID NO: 32059 - protein, 87 aa, A.fumigatus
MINQASSHRDIKLNRGACIARVVGSCNHGVCIEMGLHDLIKPSHSIVEIVSVAGVSILLWAVEYSLIALELLSKKMVGVDQGITMAL

SEQ ID NO: 32060 - protein, 204 aa, A.fumigatus
ECLSALDRALFDDSRAPTSGGQYHWVSEFAPRRAQKFLSYITGRHQDLGVSRAELTLIGWLSATGWQCAIVSIAFLAGTIIQGLVVLNDPTYEFQRWHGTLLVVAITTFSILFNTFLAKNLPMVEGLILIIHVVGLFAIIIPLWVLAPRNSAKAVFTEFNNAGGWDSDGTATLVGLSTTITAMIGYDCSVHMCKCVFFFFFSFY

SEQ ID NO: 32061 - protein, 475 aa, A.fumigatus
NRLAWNRNPETPLGIRTKRIVIFMSDQLFQKLFTRTDSSQESYGIPSLSQGMAGVKTYIKPFPNANIDFFNVQETIMHMLGYARKGKEFEILRNFRGVLHPGEMVLVLGRPGSGCTTFLKTITNQRFGYTSIDGDVLYGIFDADTFAKRFRGEAVYNQEDDVHQPTLTVKQTLGFALDTKTPGKRPLGVSKAEFREKVINMLLKMFNIEHTANTVIGNQFIRGVSGGERRRVSIAEMMITSATVLAWDNSTRGLDASTALDFAKSLRIMTNIYKTTTFVSLYQASENIYKQFDKVLVIDSGRQVFFGPASEARSYFESLGFKERPRQTTPDYLTGCTDPFEREFKEGRSEDDVPSTPDSLVEAFNRSSYSERLAQEMDAYRKKLEQEKHVYEDFEIANQEAKRKFTPKSSVYSIPFHLQIWALMQRQFLIKWQDRFAQTVSWITSTGVAIILGTVWLRLRKTIGRSIYQGWFTLH

SEQ ID NO: 32062 - protein, 493 aa, A.fumigatus
  UNSURE (30): Identity of amino acid sequences at the above locations are unknown.
VQFGCDCEKLLAGAFTRGGLLFISLLFNGXQAFSELVSTMMGRSIVNKHRQFTFYRPSALWIAQILVDTTFAIARILVFSIIVYFMCGLVLDAGAFFTFILIIVLGYLCMTCFFRVIGCMSPDFDYAMKFASVVITLFVLTSGYLIQWSSEQEWLRWLYYINPFGLGFAALMVNEFKDLTMTCTADSLVPSGPGYDDMASRVCTLAGGEPGSVIIPGASYLAKTFSYFPGDLWRNFGIMVALTVGFLTLNLYLGETLQFGAGGRTVTFYQKENKERRALNGALMEKRTNRESKDQSAANLKITSKSVFTWEDVCYDVPVPSGTRRLLQSVYGYVQPGKLTALMGASGAGKTTLLDVLASRKNIGVISGNILVDGAPPPGSFLRTVSYAEQLDIHEPMQTVREALRFSADLRQPYETPQSEKYEYVEGIIQLLELEDLADAIIGTPETGLSVEERKRVTIGVELAAKPELLLFLENLPVASSSPQRADRSELSI

SEQ ID NO: 32063 - protein, 228 aa, A.fumigatus
LLDTYTLKTALSSLLPAPAPASFVKRVNASFSKIETLLKTLQVQPSPPEALVQAYLIHIADRNNANFRKILDLKGIRSRQEQNQLVELFQVHRTSDRYASNLQQSNPVLAAMQTTPALSSSSVSQGLGLGAAASISASNLPTRFDPSMLGSALISAAKDGVDRFGTPSSGTNPSSSTGGVSTPPHSGTTGQGQGQGGEMSSNLNENLKNIGKFFRRDLGGFGGRFGGS

SEQ ID NO: 32064 - protein, 105 aa, A.fumigatus
LFDAFSSAIKTITTVSLALNYPTLPSVMHSLINGYKKVLAVAIETDYSWPEIEELKDRIANPDAYAAAAPVAAAPAAGGAAPAAEEKKEEEAEESDEDMGFGLFD

SEQ ID NO: 32065 - protein, 66 aa, A.fumigatus
GQYRDSLNQSHPVSRHQWLTNMASIQNFLLRRSSDDLLYIDYLWQEIYQPFSVLQSRLLFFRLISD

SEQ ID NO: 32066 - protein, 467 aa, A.fumigatus
LGLLNADLFHTVWFNGGPGCSSLIGLMTGNGPVLLDSNTTHVIENPQSWTKLGHVLYVDQPAGTGFSTASNPYPVRDNDRVTSDFYKWLQSFFSHFPNFRSKRVHMIGESYAGIYIPYFAYAIAENQDNYPIDLRSISLGDGTLGNPAAMTAVTVGTFLKSRKSLLQIPGEILSAFTQADQTCGFTTVLQQGSQFPPKGKFEIVGDPENLNYKHRHRRHRFQQDQRRNLRNVMNETCNNHPTTPEQVSSSILNSTCYGSCATYSTAMNYLNAVSAAGTGKRCFDVYDITNDCTMIDPLGLMASYLSRGDVQAALNLSPAPAGLAFAPCNSTILDTLLLAVPPTPPAYTILPSLVTEHNISVHVYSGDNDLLLNHLGTELVLQNMTWGGAQGFSRKPSRIFYVDDAAPSLHGADACNVSVSHDSTGLSEGAQRCVPAGIWASERGVTYHLFRGAGRLHHGAGRISGGQ

SEQ ID NO: 32067 - protein, 60 aa, A.fumigatus
PSSACGVTFILFLLALQSRQYNSQLIELSVNLCTLRTSLLSYSSLSVHRRGQNVVCQHHH

SEQ ID NO: 32068 - protein, 68 aa, A.fumigatus
LLNPSTTRSAEEAVRNKYYTLFPSHSYIILCTLPIKLDPRKIICSGKGFSNYSNSCFNRLIYTFRVSQ

SEQ ID NO: 32069 - protein, 118 aa, A.fumigatus
WRLCYFILLGTSAIKILSLFLDYRIETFFNFTAACMGYRIITMLLVAHAKLSPLANHTLLASTFIKLVAMNTCRALIYIFQVPERLGELVSSKLLLHCMVVYSVMVLTDNILTPSMDA

SEQ ID NO: 32070 - protein, 234 aa, A.fumigatus
SALSFLSPSVRHIGSASNSGHAELAQRNRKHYKWYYSTASASNEMNLPPGRLHEFLRGYFHLKSGSCARNCPRPLKTWTADELLQLPFYYIMPLDATMPEAIALDMENEPENAQQLSQAWLPDSDLEVYVAEYGRTGFQGGLNWYRVRTAADGRFTQDFDTFAGKKIEVPCAFVSGEMDWGIYQEPGALERMVNGEVCSDFKFLRLIEGVGHWAPQESPEEVSNAILRLVRSVE

SEQ ID NO: 32071 - protein, 198 aa, A.fumigatus
ACTQLMYNRLIFAGGGMPTTTNRTKWPVGGGAIAIQPGWFQGHQTAFIYINLGLGTIPPNMSHPMVPPFQITGPTNDPYPGTICLPQVPLPANTSVKPGDHATIQVIETAKHGAALYNVRSPLFARWLNLTMMQCVDIEFAEPSEVEEVTRDNCFNSSIISFGEVFTTTSLTSAAAPKSSLMSVLPVYMVALLSWAMM

SEQ ID NO: 32072 - protein, 64 aa, A.fumigatus
RTFLLQIYAYDKLISPKLYWYIVYNCSAIVHEASHTWKPSSSALDKEQGCSAEAIQTHARESSL

SEQ ID NO: 32073 - protein, 354 aa, A.fumigatus
SSVSSLPGSNARGEPVKLVSQTLPYPYSAEKPTPHRTHEGVFSSLVQVIQNRLRQGQSPYINVTHAVPEQFSLTNLPTSPPGSPRCMLPNNDYFNATVFSSAAVVSAYHDFRGPIQMKAPQHFPMPIVPPQSVHISVLERYIPPSSAQEYNDLFSPSRPSFLVDRLSELSPDGGSLLFIYPTRRGGSAFKSQYLGPILDPLLRQLVVVNELSADIGRYLGKLSSVSHMEDFDTLKNNLSMLCRALSSSSSQFSIVDARKGSAYLDRDLWTEWYIHQEKARMKEVLSLYCQNGRRFSTHKATSSSIANTYILAADKEVTSAMLLSEIIDGIRRRPYESEPRDGIELGVFVIRRSQ

SEQ ID NO: 32074 - protein, 404 aa, A.fumigatus
EYSPFSFASGACGSLLRKEKPISAWTFCSMNPCFITISVTGAQWCAHTFSVSYVGGCVGLMGSPRRLTRKYKPSGIRASALGSLTINIICSTIYETLWNRLQRVWSYYRDFQANAERGLKPPLSSAPCSPAPGRRIIIIRCDNHITPPSLFVSFDRVVPPAPTELTVGSKGDDFSESQAAPKRRWNLLKAMFGSSSSIRNNDDASPPSTSSEDSDSRSHDTMNGTEKNSDDHLRPQNGTGESSRPKTPHQPYTFKFSLEWMDRPQWPSKNKRLYGPCLPVGAQLHLQLRGYLDRPVDDASEYASAIDFDEREKTDCRLEDAASDKEIQGPAQDAADGGKTLGLRNTRCLAKDGVVASKYAGRALAEWAQIVTECDSFFARRRDEGVPCDRMVETPMLGVEGFRK

SEQ ID NO: 32075 - protein, 428 aa, A.fumigatus
ATHEYSRAASFQPRGEDSDSSGSDFLIESIHHNIRNIFVQNLLSQMAFVVERMSMRHAPASLVAFCGKACAYAFFFCPGVADILVRLWNTPASIFRRILADSGVERCRNIRAFTQDLGLNFPIALRTLCFHSHTPLVRYLRQKPDVPLSTAQIQWQSPWVSRWCGRDTDLFFVFVKYIHILYADALPTDIEKPKRILAPGLLPIHAQVLVVMEDTLYKQSSPQMPESTHTAAAITFDDFIEGADATVSALPLGSANSHRSMAENRLIILLRDFLSESSLEPQRARLLYAESFCNIMKAAAQKTSLFDHNACFLLCDFVEEVLPILTRYSQAVDMELFDWKFWLSACRQMMRSHNSLTEVRVFSFLFCVWGMWITSEERKADLCLDFLLDESLFYHYFSHWSPMVRAYFQRLLCWRVCRFNGEPSPLDS

SEQ ID NO: 32076 - protein, 231 aa, A.fumigatus
DKTSKSSCEFTSGYGVAYKPNVFNWSPSHPAQSPLFDIPGIKLTPGRAFTPTTVTRLADANFVHLEQEIPANGAFRIFIFAGKQANTKKAITDFGANLEKERSFLSSYRRIDEISFFERHLPHSKLFSICLIYAAQKNEVDVEAIPQILRDYHHHIYADDIPDVRVPLAKFAAHEKLGFDPEKGGVVVTRPDSHVACTVQLVEGSGTVDALNAYFNSFSTKPLGQDQQSRL

SEQ ID NO: 32077 - protein, 64 aa, A.fumigatus
VYSRSSSQARFLTMDAQGEWEAKGIDSSTPFTGIDLSEGEWYDYDEKAGEEVSIKEIKWEVGRG

SEQ ID NO: 32078 - protein, 78 aa, A.fumigatus
DDTVSSSNKFTHPIVIILGPRGIVSRCFLSIVAIVAFRSARGVCRVCRVSAIDNSLPAVSNAALIPLSSGALCFPPPG

SEQ ID NO: 32079 - protein, 90 aa, A.fumigatus
DVLCKHNHNCCGFSFLDESKNTDLIRWSDDGNSFIVLDEDEFAKTLIPELFKHNNYASFVRQLNMYGFHKKVGLSDNSMRASERKNLPTG

SEQ ID NO: 32080 - protein, 87 aa, A.fumigatus
SRIGRQSPKALVNDVVSPTEDAQWDVESRISEPDTESGTGEMKLKMKRYLEGFPFPYYLVVRDVRELPAVLATALKQWFAEVVDVSS

SEQ ID NO: 32081 - protein, 753 aa, A.fumigatus
  UNSURE (91): Identity of amino acid sequences at the above locations are unknown.
AQVLGGFFSVPTDESSWSPRLKLYFHAVTQCQARTKNTPLGTVMVTDLSSFPFALTVIPVPDGDILRHKEDFIVNENLKRFSCAGRAGLKXQPPSPATVAKFYQLYRTSERVPVYSAVMELVKQCQIALSMFGLLAPEYVDGLLCDVTETAINDWWTEFGIDLYNIEPSDGVLGPTTVAALLGTFMGARNRLHAFGAPVGKDAFDIRSLKRAIESFQKSQKMERTRRLDRQTLDRLHRVTAKAANAEGWTDAVKSTMAELSGHGGEMVMGMVRGREKGGIADIETLELDDFASLVTGERAKWLWRGKPRKSGLGDGFAHDQPAADMMFNRDEQGNYVWTSRKRHSYEDLAGDRSLQGSDRPWRQPDTGAAPDEKDQNLSRMVRRGVSGKVSDARIGFGRFKEAVGLPSLRSQHKSTKDGAELMGDAAYMPAIESDAEMPVLKTQADAHLTDQESISEPQDQARFHAVKAEQPASTSGPTVSELEPPKITVDSPRDNEKTESARKTSTSQLEEDESDLGRSRTRSTDASVSQDELSRVDLMLLRRPQSFIESSTTDDSERRSNGWPRHLSFSIVEDVVLGWESLGGREALQPKPDATLEQAVALEDTLASDVRIFSSKIEELSHHTVPWVEKQVNSVDELNRKLYESQENINSIYLDQVEKYQQMRERSSELLTEEHNYLVDTMKRVEMMGAKLDYELDILESKVEDVESGLGEFERHVVELETRMKGLIKNEEEKQNNSWLSLLGRFLGLSSR

SEQ ID NO: 32082 - protein, 108 aa, A.fumigatus
RLDEIVNGSADGSFPGLIPLVESYLNSVNVDVETRCSLATYLDLIRKRANGTLWTGARWIREFVASHPSYKQDSVVSEEICYDLVKAVEEMTVKEGRDGSVGWQLLRG

SEQ ID NO: 32083 - protein, 211 aa, A.fumigatus
WNSRGNVDLRSNEGLSPEPAALCHSLAQVHTAQAQKSSFRFYTSTSNQFHKSTMCWTLPNQSQRQSDASTSTACNLTEEVDAIVTVTKGFLSALETKSRDDFDKYCVKAGGMALWPPPPSVPRFCTIGAFVEHISKIKDDIDERMWDPEVKVHESANLAAVWAPFRAKINGVVDHVGVELFVLHKINGGWKVTGLADSCRRPTDDEKISLV

SEQ ID NO: 32084 - protein, 111 aa, A.fumigatus
IRAGAFLTHCLLLQDNVGLTANTSSLVGGVIQIMFVIGRIYLDIFVHKTQNINHIALGSLYPTLYADRLGRLNPMMWGSFGLCSCFLMLAILSSFERIFKSPFRALQRFNV

SEQ ID NO: 32085 - protein, 65 aa, A.fumigatus
SSNSNRQSIGVSANWLWNFFVAMITPILLEKLRWKTYLIFMCLNFSFIPVSGADYPSPLTLTVMY

SEQ ID NO: 32086 - protein, 60 aa, A.fumigatus
IEAIANVVLVFTELVGSKHDISEDPIVTVPSETIYLGGIDLYLTSKDILAEPFFELISTS

SEQ ID NO: 32087 - protein, 71 aa, A.fumigatus
KDDNPLDLSEPFRELCEACRKGDLKVCQEKITEGVNVNARDPYDYTPLIVVSKLSLEDRRNVKPGSLPLSL

SEQ ID NO: 32088 - protein, 321 aa, A.fumigatus
SSRTNTRFHCRCLYNALNDRIRNLLLEYDYSKSTDPLQPLAAHVSSLLTRDQPGTSDIVVTAGDESLYLHKFILAARSPYFRGKLVADPKSTTWKLPSTIPPQAFGTAIKYLYFGEAPRDLRSGPGTGFTESEVFAGIDRISKHLEIPSLLDSILDSGDRRLARQRRSMELSRGRDQLEEWFRKNVLGSKIEVNSSKVDGFRWDRHNGIFADVVLRADELREDEDDICDGFNLNGKQQDRKSVLFPCHRAMLLRSEFFQAMFSSTFREAHLKEHLNVIPVDCSPEVLEIVLMFLYTERADFPLDIAVDVLFAADMLFIQKL

SEQ ID NO: 32089 - protein, 210 aa, A.fumigatus
TKAPVVISTLGSGEMSHAEAAMTRGTNEEYDIDIYANIRAAWLTRVQRLEEFAARYLAYRLEAHIDSPEFAELIQESAARIKASQETDSIELLDDIRFYLGERFRLRFDDAGLEEMMEEEQRQQLADSSGVDKDLVEITDKVDTMGIQSQTLPIGAEAEVTPGEMIREQGPIIRTLDGEIAGDEFSKDAINYQILMEKLDLLLKELNLEA

SEQ ID NO: 32090 - protein, 62 aa, A.fumigatus
AQTNSNYPSHPPTRAAVIRREQTIMLSVLKAVLIHEKVTVEHELEDNAACSLAQSMCLNSSK

SEQ ID NO: 32091 - protein, 108 aa, A.fumigatus
ISCQFFFGVFAYQSEKMIFWRQWLGLKSVYGYWSAPTTNRFLGVKEASQALIGLFPSHTVMIFSPSLIDTLVTSIKGAGMEGLIGAIFYEPNRSFELSTLAEAEHGLF

SEQ ID NO: 32092 - protein, 101 aa, A.fumigatus
RLPRQSKYWLSPGIISYANQFLRFDLFVKYQTKIHKEDVSKWKQKDFKRFLCSGIKRSPADAKSAQRKLGSWHQCYRLDGKLIAVAVLDLMPSGVSSVYIL

SEQ ID NO: 32093 - protein, 121 aa, A.fumigatus
ERNANRIRDPESYTWDPLDGELTMKLNERRYVSLSRDRRLAAQGQPESTELDSAEEEINDEEMSLFDLHMPGVMTLDEVKTLDLDHSLLLVQGSLIHMMVRRSYCRCIQAGLLTWLDSRIL

SEQ ID NO: 32094 - protein, 281 aa, A.fumigatus
RPPHSLPQSPSFRIHRASRSSSSSRPALSLDLSNLPALSQPTPPSNTLLITDLHDLYLFQPASLASIRSQIESIAPLNSFSPLPSLRRIVCSFHSEDDALRVRKLLDGQSLLNRNVCTKIYFGEPTPLLDEGRPKLLEAPHLDKLFFISPPPSPPHGWVMRTEDPPNKEVHASDLAQALAQLKTEQSAPVSGPVDPGTPMSMSDEKRTGSWPIAMSGQRSRSSTLIYNPEDHGGSPGLPAVMVEDTTVDSDDEDIEMMSPIDMSVRKLPPKTARPPVELMH

SEQ ID NO: 32095 - protein, 147 aa, A.fumigatus
TPSPRSPPCGASSAPFTQKTTPSASANSSTANPSSTATSAQRSTSANPPRSSTRVAPNSSRPPTSTSSSSSVRPRARHTAGSCAPRIPPTRRSTPVISPRRLRSSRRNNLLRSQAPLTPGRPCRCLTRSGRGAGPSPCQGSAVGVVR

SEQ ID NO: 32096 - protein, 173 aa, A.fumigatus
KTTTLPSSIALIPHPPCLPLLLFIAPSSLTRPLQSSCSLTANSSLKHATNNRPPRPLPLSTGLPRLHPLPDRVHRPPKLLLPAPLLAAHRLLLSLRRRRPPRPQTPRRPIPPQPQRLHKDLLRRTHPAPRRGSPQTPRGPPPRQALLHQSAPEPATRLGHAHRGSPQQGGPRQ

SEQ ID NO: 32097 - protein, 131 aa, A.fumigatus
  UNSURE (122): Identity of amino acid sequences at the above locations are unknown.
SVSSKFLIGYTMSEKARLKCTVYVGGLDQAVTVQTLAEAFVPFGEVVDITLPKPDVPNSGDLHRGFGYVEFDLPEDAAEAIDNMDGSELYGRTIKVAAGKRKKESTEGLESKPVIGSKVDHXDPILHGRCS

SEQ ID NO: 32098 - protein, 64 aa, A.fumigatus
ISLPGPFSGMNDVTCIRRCFGEVPMELSVTPPVPLQKDTWLLEPKASDRSGLDHLLTYKLLSVY

SEQ ID NO: 32099 - protein, 325 aa, A.fumigatus
EESRVPTQWGDFYWWEKRGSLGASPRFFLWDHLFLWEHSNKYPVCFGGAVRALMPTPFDKGIQVDPLDFEGVAQGGQTIPTDDEDAEGNGHGTHCFGTIAGRKYGVAKKAHLYAVKVLRSSGSGTMSDVVAGVEWAVKSHLKKVKDAKDGKIKGFKGSVANMSLGGGKSRTLEAAVNAGVEAGLHFAVAAGNDNADACNYSPAAAENPITVGASTLQDERAYFSNYGKCTDIFAPGLNILSTWIGSKHAVNTISGTSMASPHIAGLLAYFVSLQPSKDSAFAVDDLTPNKLKKDIIAIATQGALTDIPSDTPNVSYHFGDSALLV

SEQ ID NO: 32100 - protein, 412 aa, A.fumigatus
LCESLLLILQCMRLTLNVSQYANQQSPDGPAMTWAIFAITANDVSPSGCSAYTYHQDSYDPYMRAPFYQLSEQMIDDAGINGGTHPAYPFLTGHGGANQVVLMGYLGLRLLPDDAIHIDPNLPPQVSNLKYRTFYWRGWPISSSSNRTHTTIIRAANLAPLDTADSRFANASIPVLVGDPSNSTAYRLPVTGPLVVPNRQIGFNNTIPGNMVQCRPVYSPNDYAPGQFPIAAVDGATFTKWRPSTANMSSLTVALADVEINSKVSGFHFNWWQAPPVNATVIFHDEMLEDPVAAMSSSHGNSRYRVVTTLTNIEQSQPYDAQSTDNNEVVLNTGNTTDVSLSQTVHTSRYATLLISGNQAGGEEGATVAEWAILGESKGSSSGHGNNKRRLDVRAAAALSALNDRRYRQFNA

SEQ ID NO: 32101 - protein, 286 aa, A.fumigatus
RRESVVLLKNDKNDSTNSPILPLDREKTTLVIGPNADLAAYCGGGSASLLAYYTVTPRQGIADKCGAEQVVFSQGCYGHKELPLLGEHLRTIETGQPGYTFRVYTEPPPASGSFKGSDSRTPVDELHMTNSSAFLMDYSPPQISGDTYYATLEGTFEPPESGVYEFGLTVAGTGLLYIDGVLVVDNKTVQRAGTSFFRDRDGGRTRRALPRGGQETSCLCRVRHGADVEPAAPPRRGLVWAGGPSARWVPEAGYRYSDPAGGAVSRAGGPGRCLCGVERRLGERGL

SEQ ID NO: 32102 - protein, 158 aa, A.fumigatus
RLPARGCCTSTGCWLSTTRRYSARARPFFGIGTVEERGERYLEAGKKHHVFVEFGTAPTSNLQHHHGVVSFGPGGLRLGGCRKLDTDTAIQQAVQSAAQADQVVVCVGLSGDWESEGFDRPHMDLPPGEDDLVNAGAAVHPNAGDCRAEWHPCEDAVG

SEQ ID NO: 32103 - protein, 152 aa, A.fumigatus
RDRPPPAEGPCAAGQSPRSPSRRSTPHRQRPGPPARLTAPPAGSLYLYPASGTHRAEGPPAQTRPRRGGAAGSTSAPCRTLQRHDVSCPPRGNARRVLPPSRSRKKDVPARCTVLLSTTSTPSMYSSPVPATVSPNSYTPLSGGSNVPSSVA

SEQ ID NO: 32104 - protein, 109 aa, A.fumigatus
PTASSQGCHSARQSPALGWTAAPALTRSSSPGGRSMCGRSKPSLSQSPLNPTQTTTWSACAADCTACWIAVSVSSFRHPPSRRPPGPNETTPWWCCRFDVGAVPNSTKT

SEQ ID NO: 32105 - protein, 177 aa, A.fumigatus
QVCLGALKGKLQALKFLSDSDSLYDTTPLVDMGVDSLVAVEVRSWFLKELTVDVPLMKILGGASITDLVEVVVQKVPRELLSRLDPEGRRQDSNGDVPATVGDNDSVETVGSKMNGINSAHENGSSGVNGISGTYTPDMDSTTDLNGTNGAAVIKEMLGHKAIKGVVPILLNAQEVA

SEQ ID NO: 32106 - protein, 403 aa, A.fumigatus
TEGFHYQILTAKISANQNMPMILQKKCIFHLVYRVQHNTTTWNTSKGASPPSGKGSEGVPWRWIKMLHLRIRPLPRLQPASSIPTQSAPPSDFHNEDNSNDDDSAEDLFSAFLPHLFPDDAPSFHGDPGQRLLYTSPRYGDLEIMVPSYPSQSERRSEEIAAGLPSEDGSVNAVDEGRKLFAHFLWSAAMVVAEGVEKADTLATRGELDADTAMWMVRGERVLELGAGTALPSIICARAHAAAVTITDHPSSPALTGAIDFNIRRNLAATETEVMSQPHEWGMLEPDPWAVAHRGAFTRIIAADCYWVRSQHENLVRSMNWFLAPGGKIWVVAGFHTGRAIVAWFFETAMQNGLEIERIYERDLIATSEDGGEVRREWMPEREGEGPENRRRWCVVALLQRRE

SEQ ID NO: 32107 - protein, 67 aa, A.fumigatus
RVLFQSFSMHRRLPKMKDFILMFDNISSLDVLIYRLLKIIKFLFLQVIISLLLSNLRLRIGPLPFIQ

SEQ ID NO: 32108 - protein, 69 aa, A.fumigatus
LHPIADLPGRGQYAKKRKTDMLSEDEEDEETRAASALRAKRAKVLEEKLKRERVRNRALVGVTAVFALA

SEQ ID NO: 32109 - protein, 278 aa, A.fumigatus
LLAGTAELFGTELAASQTYTFSGTKAAIYTWHGCTLEVSAGDTISTIDGLGSGGLNGEGARGYGAGGCQSEYTAEETPMVEYANVHFALEAMRQEAKATGKDGPRVLILGPENAGKTSVAKILTAYATKVGRQPIVVNLDPAEGMLSVPGTLTATAFRTMMNVEEGWGSSPMSGPSAVPVKLPLVYFYPLQNPLEAEGAVYRPIVSRLALSVTGRMAEDEDTRETGIIVDTPGILSAGKPGSLEIINHIVTEFASKAPFLSASRRWSSPRGPKDPRKV

SEQ ID NO: 32110 - protein, 190 aa, A.fumigatus
  UNSURE (178),(179),(181),(186),(187),(188): Identity of amino acid sequences at the above locations are unknown.
ADCQGAKMAEQAHSQGQGQSQGQGQGQGQGDVERGPSRISQQSSRRISRVSYKEDWANLDEYGKLVKYVSTYREPGREEGVEEEKVKRVWYAPWKKRKVKVKHVDKEPGQFPPEWLITDIRQGLPSSEVPIRRRVSGWNELTSEKENPIAKILSYFRGPILYGMTYDFDSSSFKDSDXXFXTGPGXXXVN

SEQ ID NO: 32111 - protein, 142 aa, A.fumigatus
ASLLHLGSPGTDHCPQIIAASPYSPPIYPYNDSIPTVYYEQFAKEAGCGRSASARSKHKTTFDCLVAAPSETLQTASGAVSASGIFGTFAFLPVVDGDMIRARPSVQLLTGQISGRRILVGVGLFPSFFRSASVCCELVDQL

SEQ ID NO: 32112 - protein, 253 aa, A.fumigatus
NNANDGVPLSNPNIVTRAAFDDYISKTFPRLTAKHVTRLNVLYGTADSQASDDGPRFDTLGTSGPTANNQSEIATGLQQTVFNIYGETTFDCPAQWLVEAFGGTSRQAWKYQYSVTPAYHGADLNSYFNMGASWPNAGFNHAFQKMWGNFIMNDSPVIPLGDATANNSQAVVPVGRDGHLHWPRFRPTSPWQMDLNTTGGSVSKVVVTPNLTYYVREGDDIVNHFRLANAYSWEGGRGLRCAFWRAVADRIAV

SEQ ID NO: 32113 - protein, 87 aa, A.fumigatus
LGAFGFLSSAEVHKQGAFNAGLLDQRFALEWVQRYISRFGGDPKRVTIGGESAGAGAVMLQSLAYGGAESNLFQNVSLITPSRLAWN

SEQ ID NO: 32114 - protein, 245 aa, A.fumigatus
QIFNSSCIAHRTTILAEHLSPGTSSTAASSLASIILPKITHDKPQKLTYTHERLFIHYIADSPSGSSDDAGRQEPNSYAPLSYIVVATAEQGRRIPFAFLLEMKRKFLSTYPPSSTDFSSLPAYGCAAFNSELRSLLQTYNTAPPSDSLASARREIDSVRDIMTENIERVLERGERIDLLVDKTDRLGGSAHDFRVRSRGLRRRMWWKNIKLMVLLAVVVVFLIYLFVGMGCGLPAWGKCVGHSA

SEQ ID NO: 32115 - protein, 141 aa, A.fumigatus
LKLHCAPEDGFIIKAVSETASPETSETYGLHSMTVTGPGAEGYSTFFAIVCATAVYRDKTSVRLRAASELRRLLAEIYHTRVTNGQYSQLRGAVAVGQSVQFFNWGEDGFLRVFPWATHPFDIKSDHYAVQGCLDLIVQNH

SEQ ID NO: 32116 - protein, 498 aa, A.fumigatus
SNPVLLLFLFFILIYFLLQQYFLLFLTSVFAFVHVSAIMSSGIPPWRTTASATATTAHFPAHGMCFLTLISLYLISNCDLATPAYIPVQARRSFAHTSTTAMVPQPQPTTTQAPRKRVEWPAPLRSYVQRSFAPENQLPGVNRQEMEVKLKGVITEAAEKGQLEKINWDALPLPQVMIQNERNQILTNPAVSGWSDSLLTAAQKPDTVTEDVSRKRKSAEYGDKDSCPPWRQTNNHHAFGDRTTYPSADKRQRVDHKNPSKSKANLEMRRKRFEEPRARYGSSPSSSRGESPAPSANQGPVVGRCQELEKNYFRLTSAPNPDTVRPLHVLHKTLDLLKKKWKKDNNYGYICDQFKSLRQDLTVQHIRNEFTVSVYEIHARIALEKGDLGEYNQCQTQLRALYAQNLGGHPTEFKAYRILYFIHTRNWTAMNDALADLTAADKRDPAVKHALDVRSALALGNYHRFFQLYLDTPNMGAYLMDMFVDRERLSALAAICKA

SEQ ID NO: 32117 - protein, 217 aa, A.fumigatus
ATLDSSFMSKLDGYLKSLVARRSLVDNVTSGLSTAVDSVGSVGNTASAAQTLTDVAGSAASTVASVGEDITSATNKTLVNAVDAALSRTRADYPDFLIVGLWSYCNGSFDGSHTPIVTNCSTPSTTFSFNFSGALGLDSSWVASIFPSALQDAIDYYHKFTNWMVSAWIITVVSTVLVLLAGLTAFGSRWGSLITSFCAVVTTALFPLTESKRRLTH

SEQ ID NO: 32118 - protein, 255 aa, A.fumigatus
IKQQKESICAAGSPQYTGWLAVGHKHLFFWYFESQNDPSHDPLTLWMSGGPGVSSMVGLFQEIGPCLVNEYGNGTYHNPWGWSRYSSLLFVDQPVDVGFSYVDGGHELPRDSKEAAVDMHRFLQLFVSEVFPHLQDLPVHVSGESFAVWKMLSFPRTNHTDIPGSLYSVPWRSDHTAERAVAQPATGAAQVVFGGQWLHVPEGYILRVLGNALHHESRCGKARVQPDALRSHRLEHASVHGSQCSVCPESRSGFV

SEQ ID NO: 32119 - protein, 171 aa, A.fumigatus
AVPNSVTAPCEIDDMCYIQAVHVEQYLNTPAVWNALSPPKQISEYKMVSEAVIDAFAKSSDGMTSTSDLVAFLLANQVHFLAYQGNLDLACNTAGNLRWAHSLVWKGQAEFASKPLRPWRSPVAATDRNETVGTMKEVWVRVGNADTESRFALVTVDGAGHLVSTCREYNP

SEQ ID NO: 32120 - protein, 91 aa, A.fumigatus
DVVGSVSRSGRFSRTVKREADLIRLTRFIATGVTVPGLFVRAAYWPEKWDWVNNVLMYWLVGAFYCLDIAYGMCLWYFRRLERMSSRVKQG

SEQ ID NO: 32121 - protein, 176 aa, A.fumigatus
TIKMDGLDFDTAPVEFQKVRWIVETPLIIAGMGWTLNYFFTIRKAYQDRMSGVSLIALSNNLAWEIAFALINPPPNPLARVNYPLWLSVNAFVLYATVKCERESGLHSPFMRRHLPFIVLISILGLLSGHLAFSSHVGPLAALFWGGMFCQVTLSASALGLLLQRGHTRGMSYKMW

SEQ ID NO: 32122 - protein, 101 aa, A.fumigatus
KDEEASKAIPSLKQSPSLKGLNHLATDGVYRSFSSSGQVVDYKQLSPADITKVLEFHEKYMDSEIFQKTKKKFDGVDGRNVTDLEQLLHPGPESRPVRFRE

SEQ ID NO: 32123 - protein, 221 aa, A.fumigatus
  UNSURE (5): Identity of amino acid sequences at the above locations are unknown.
RGGFXIVERSFSHPRGEDAIALANTGATLALIDVDVEALEPTKAAARNVQDRQSHVETYGLDITDPGAVQSTFKSIAATLGRVDILVNNAGITRLHLFAEEEGFDDFWRTVEVNFKGTMLCIHAVLPGMVEQKSGCIINMASRAATVDGPKSVGYNASKAALVRATGSLQEDLASMGLGEQVHAYCLHPGSVWGDIITGKLTHTRGAFPGIQVQTPKKWFK

SEQ ID NO: 32124 - protein, 596 aa, A.fumigatus
YVDRYPVNGRLPVKPNIRALSEPWVRSANLSWMSLPSRANLGNARRWMMLVRCLNSGIELTVELNIAVADPIYEEPQSDADYVSSDESSVNSDSLHETPATPISTTSAKYPSELKTHRCPFDGCTKAFNRPARLQEHLRSHNNERIFKCTFEECDKTFLRASHLNHHIKSAHTGVRDYVCDRPGCGKSFVTGSRLRRHLAAHDGRDKYRCTEYPPCNETFRKHSTLQKHIMTAHLKQKPFQCPHTDPSTGQKCTMAFDTAGHLRAHESRIHTEKRFSCTECSQHAEGAEATFPTYALLQAHIRSVHPPQCPNCALTCATSRELRRHLEVAHGDVSLEERKIFPCTVPGCDRSFTKKGNLTVHIRTVHQGEKRFVCGETDLSSSKKVSGWNNDNGCGKRYGSKLALEEHIRTAHLGYQNAKAERRQRLGITRDRQHSTATSPGVSALAALTGEGYAEETGRHIACLVESCPHRFHRDYDLWVHMSGKHHFSEEETRDLFLRRALLAHDFGASASASASSEELFGGIYGLEFDNDHSSYDPYVLDGSETIATSGAAVSKPLPAHGADVMMHDNSSTIPTPGDDMALIDPALAYDMMES

SEQ ID NO: 32125 - protein, 79 aa, A.fumigatus
  UNSURE (66): Identity of amino acid sequences at the above locations are unknown.
TYPDLLVFGSGGKVLAVGTEADAANIQVSILVYTFVLQGSDDLASGHVEDLSGAVAARGEVVPVAXESGSRPYSASIRG

SEQ ID NO: 32126 - protein, 83 aa, A.fumigatus
  UNSURE (14): Identity of amino acid sequences at the above locations are unknown.
TPDTSAVRPTSRLXRDGDHLAAGCNRSAQIFDVTTGQIVATLQDESVDKDGDLYIRSVCFSPDGKYLATGAEDKQIRVCSLFS

SEQ ID NO: 32127 - protein, 180 aa, A.fumigatus
DFVLSVCLTPDGHWVMSGSKDRGVQFWDPITGNAQMMLQGHKNSGQHFFPYLSCHSLWPISSVFQCLTGFYSHLGCSQPYRQFVRHGQWRHAGENLEVCFGVQFLLLIWKLTPGCRWQILHLYRTVMGLMMGSFGANVTSFVCLIHNVVASLNMAWVCFCVQPLQGSVLSHRSFGFSFPR

SEQ ID NO: 32128 - protein, 119 aa, A.fumigatus
VWDIAARTIKHIFTGHEQDIYSLDFAGNGRYIASGSGDKTVRLWDILDGKLVYTLSIDDGVTTVAMSPDGHYVAAGSLDKSVRVWDTTTGYLVERLESPDGHKDTVYSVAFGSQWSGSG

SEQ ID NO: 32129 - protein, 67 aa, A.fumigatus
GGHANVDTVVSNIRPAKTLLGELAKTKTNTKQKNAQQNPTSERVKQEVDSDLSLNHQAKCNLQCSAT

SEQ ID NO: 32130 - protein, 91 aa, A.fumigatus
AFFCLVFVLVFASSPSNVLAGRMLLTTVSTLAWPPYDTWIDASCDKDLDADFIFLSLDKEENSNAGRSDVSDSNAYLQVLDTLASYDLSAG

SEQ ID NO: 32131 - protein, 75 aa, A.fumigatus
TDLVAQIERRLAPFWRGLNDFSESWTEHQLMAAARGLPIPPPDEIPPELEYKNPPKLSGDGKEPSIQHSLHRGMR

SEQ ID NO: 32132 - protein, 313 aa, A.fumigatus
SLRKVSALVSSIPIVIVLMVSTRVGMILSRYKSGPLPKPFKILPSVPNWPTLLSITRPESWTANAVYAGTRIFISSKPAVAQEFISTVLLDRVREEIHETKKLNVHTYNALKKALYKPACFFKGLLFPLVSSGTCTLREAHIVSSVIARVSIPVLHSAAALLRMCDLAAEQSLRSLESTGAVNVFIRVFLEKKYALPYKVIDALVFHFLRFRACDNAEDSMMTDGPSGAATKAYKLPVLWHQSLLVFAQRYRNDITEDQREALLDLLLVRGHKDIGPEVRRELLAGRGRGVVVPDPEKQGALDAGDDTMDVTF

SEQ ID NO: 32133 - protein, 61 aa, A.fumigatus
LCRNVSVLRNGPNTTHKNSSFYSKFNAKDIGHVSISESPGRTDTYQGVAPPILRFPNECQW

SEQ ID NO: 32134 - protein, 240 aa, A.fumigatus
LCSVSSAAEDRRNMPSLWGFILAILGMVLVLSIIILLCYQFVQKRRRLALERRISAGETDTENFGLHHIRVSREVLDQIPTYVYSAVNIPSKVSLRSSPSQTQITLARADDASSIRSVDPKEPRLVYKETEMQASSSTIRLPETAITCQSSRPPSARECSDSASRSQPTCAICLDDFVSGITIVRELPCGHIFHPSCIDVSLTQISSLCPLCKKSVLPAEYYTTPADDMGVHRDYVVTEH

SEQ ID NO: 32135 - protein, 132 aa, A.fumigatus
MQLFSASQSQTQAIDLARFFCQSTNIDISIIQTQKKEEARNLPSKLVMLPLNPHIEHLFMESSFPPRPLQPLHLMLLQPSPHNTLQLLPTNLLPRLGLLVRFDTRLESRLHANPQRRLKTKTTRVAAHLDHA

SEQ ID NO: 32136 - protein, 62 aa, A.fumigatus
CFIASRKRAYMHRVTEGIRPILPLVFDSSDDVRIITLIRLKSPSTKSYLRPSLYNFVRYRVA

SEQ ID NO: 32137 - protein, 505 aa, A.fumigatus
LSDANTPPVRGSSPRSILYLIRSATTYIMSQESQLSQTSLAPPLELSGPATPDRRPSLSASPELDEKVQVQVSQADQRKLVSPPSLASSDMTPPPSSQVPGAPLRRSRSRSTTYLASPPDIEKTLCAAYGASENLPSVGDIDTAGEPELRIIAKELLSVAQEARMSALHFKLQNSLLSFTSNEAIKRAEVEHQLARREVEILQSSEYRNRHGPTEVKPLQPISNAELEAALRRNQELERVNATLDRRLRRAKKLIEQEKEKSELLMEENNLLKKRIRENREHFSRMIERGSMSPSPQIQSGTPQRKPVPHFHDSPSPHMSRGESHPFDALLAADRVLNRGSSDFQSSPQRFSQRQHSNGHVRGTHSLSSLPMTPSQPRTTPREHLFFTPTRNTQYEQRDRDSTISASDIEEAETEEDIPASQPDSPATSMVRPDPVISQQQTRSAAIAPKTSTLLPTKLFGQVRNAGVDRPPSGLKRIASIDESAASKISNAADGVGLGIEAYTS

SEQ ID NO: 32138 - protein, 78 aa, A.fumigatus
LMFNFGALDCFITCERQKAILKFEMQRRHTSFLRNTEELFGDYTQLGLASSVNVTDRWKILRGTVCSAQSLFNIWRRC

SEQ ID NO: 32139 - protein, 221 aa, A.fumigatus
SSTRSSLSLLQSPTMSDSNPDETHKCQSCKKAESKSVPLRNCFRCKSAIYCSRDCQKADRKTHKKVCASNAQANTGSNNQSASDTNATQSTKALEVDDFLKPFYRLHAKTWLHDHTEKETYKLLIDTYRLRLDDDYTFSGDIHEDNIYGGATDDGRAGFRRFLKSVERKPHLLPRWWTPAKAEECIRYGKNSTNWSYLGYTVEKHDVVEHYANNLMPIQLR

SEQ ID NO: 32140 - protein, 116 aa, A.fumigatus
LDSPFERSWLDLPNMEGNTAANAQSLSPEPSARGPRQKSTGKAKSVDPDNGPTSKRRCVSTACIACRRRKSKVMSWHFRLVLYLHHILTKFLPVRWESAELCRMFIRLSYTLYGEP

SEQ ID NO: 32141 - protein, 182 aa, A.fumigatus
  UNSURE (131),(132): Identity of amino acid sequences at the above locations are unknown.
IWIPTAWELVSLPTKNWMHDESHFGAVSSLISLSPLFKSHFFGCISDEDRCWSNYLGRQPQLLTSQVCVPKIDILPNEEAELWSPYTDSGPSQDNTQPSRIRTVALQLAKLSEISGDLLGYFYDPSPTDRXXNKQADLKKLSEIHTRLEAWKKGLPKELETSRRPASSGSCYAVSKQALSPQ

SEQ ID NO: 32142 - protein, 90 aa, A.fumigatus
CLDPSSTIPPPLRVETPWCDHTLFTEYIQFYPQFAICEYTQMNMGTKFACVNLQSQSKRWSSGSESLLTAPRLNMHVLMFLQPFQVRSTP

SEQ ID NO: 32143 - protein, 404 aa, A.fumigatus
  UNSURE (389): Identity of amino acid sequences at the above locations are unknown.
ASKHSVHNETLPLMIVNSMFYQLLFIHLYRPFLRYTKSSSPLPQHVSPRRICTQAAATISKLLRMYKRTYGFKQIVNVAVYIAHTACTIHLLNLPEKNAQRDLIHGLRNLDEMGESWLCARRTLRILDISANNWQIELPTEASSVFEQTHAKWGPWGSWDQAVSPSTSEESPPTVSVQLPSSASAYIPPAPGGASITQPGVSPQNLSTSASYQGNQQYRSEVSFPTSLSAMRAAHRSFTAQISRADGPLPEPTYLRPVPHSYRPVQAFPLTQHDAWYNGQVRTFSTDKNTASATEASPLTGFDESENLVEESHDWWSRNPNALLSMGTENWEQRLNPSFTGPASSMRYDTSVLNSGQSSGPDSTPGAPQAFRYPVGVPPNLTDSEQGPXISGYNNIGLPGDFQR

SEQ ID NO: 32144 - protein, 334 aa, A.fumigatus
PQGVYDPNSDHRRKGVYKKDTANLRTKNSTLHTLIQALLNYDEEDAFDLVRQIRSCDSLEDVAESIVSRDKGPTPGEVFPSGDESSTHEDQFVSTLAGRMGELMLDGSRKYIGGTSNLIFLPSGSDLNEFDSSLKGRPLDRSHEYSVSRWTRVTDDEQLISHLMTMYFTWHYPFFTTIPKDLFYRDYVRGVSSQYCSSLLVNAMLALGCHFSSWKGARADPSNSATAGDHFFKEAKRLVLENDEHENAKLCTVQALALLSVREAGCGREGKGWVYSGMSFRMAFDLGLNLDSNSLGTRKLADEELDARRITFWGCFLFDKFVPPFQITLFRVYL

SEQ ID NO: 32145 - protein, 88 aa, A.fumigatus
ARLSSSLQGPTNKNVLGQWVVGACDAAHVTGAFEHSLIFQHSELPIQYKLQSLLRSISSSIKSNAEIDAANSRGGLILSEYVPNHRKA

SEQ ID NO: 32146 - protein, 73 aa, A.fumigatus
SVVKRLTIGPAGLADGKIGLLWQPNSGKRDSHRNHRAEWGTREDEIAHSGGGHYYPPTSHSTDSLILNHLRQL

SEQ ID NO: 32147 - protein, 300 aa, A.fumigatus
GICLIINLHSYHIPPTYHLPQASRGRCCSAVHQRTIILKSFKMESKWKDIVASYPPQAIEFVGTVLVQVISFWLPSLCYLSLDALFPSFSQRHKLQPALRQPGRRDIWQCFVVVVQNSVLSMGLHLFQIFVLQRGTSAFRIQASLPPLAEFLRDFILCILLREALFYYSHRFLHSPFFYARIHKRHHKFTAPIALAAQYAHPIEHIVANSLPISLPPQILGSHILTFWAFLAYELANTATVHSGYDFFKNKAKMHDLHHEKFNLNYGSIGLLDWLHGTDKLEKKRKDVFTTGGAGSALKY

SEQ ID NO: 32148 - protein, 415 aa, A.fumigatus
SRISIGDPARSVGENDDDRESDILNNSESLLQVGSRRRLGALLVDGLHASSKQLTVLGRDDGVNGRTKDLDTEGFKLILELDTDLKGGLTTKCDIDGIRALVLDDLAHELGVDREEVNLIRKTLGSLDSGNIGIDEDSVDSFFLQGLDSLATRVVEFSSLTNAEATASQDQNLLDRDTWRCLDVLCLRSARERDRLLKSIRRGKSVLDSVDEHIEEVLSVPGTRSAFGMELYTEERAAHMPDTLIAAIVCVDEKFLPALWESRGIDSVTVILGGDVALARQHAGTGDVVTAVTELHLERLGTNGTSNQLVAQANTKDRSSGLLQGLGQIVHSFREHRWVTRTVRHKQTVVVLAGKLGEIVVPRHNENLNTTSKQATQLVELHTNVQAKDTNRAARWVFECDILGGCEKARLTDRN

SEQ ID NO: 32149 - protein, 286 aa, A.fumigatus
SEPLANLSPRGPFPPPSETAMPQSAGNDEVALPSSPLSGGAVSYNQINKELQPLPSMDSGNGAVIPPASARVRGSSGKMFALELEDGTIYQGYSFGADKSVAGELVFQTGMVGYPESITDPSYRGQILVITFPLVGNYGVPSRETMDELLKTLPKYFESTEIHVAALVVATYAGEDYSHFLAESSLGQWLKEQGVPAMHGVDTRALTKRIREKGSMLGRMMLSKSEIADGVVEMTPGDKDSWRSSFEQVEWVDPNKKNLVSEGRVFNTRNALLKGSISDIVLSFDP

SEQ ID NO: 32150 - protein, 413 aa, A.fumigatus
SSVSIREPRLFTPPENVALKHPSGRPVRVLCLDVGMKFNQLRCLLARGVEVLVVPWDYDFPKLAGKDYDGLFVSNGPGDPAMLSETVNNLSKTLKEARTPVFGICLGHQLIARSVGAQTLKMKFGNRGHNIPCTSMLSGKCHITSQNHGYAVDSSTLPEGWEELFVNANDGSNEGIRHVSRPFFSVQFHPESTPGPRDTEYLFDVFINTIKDTLTSSDALQKPVSFPGGTKAENIKTSPRVSVKKVLILGSGGLSIGQAGEFDYSGSQAIKALKEEGIYTILINPNIATIQTSKGLADKVYFLPVNAEFVRKVIKHERPDAIYVTFGGQTALQVGIQLKDEFESLGVKVLGTPIDTIITTEDRELFARSMESINEKCAKSASASNLEEALRVVEDIGFPVIVVFTNRPGRIPD

SEQ ID NO: 32151 - protein, 144 aa, A.fumigatus
RKKESTLSSSIPILPLSRLPRVLRIRFTSSRSTPSSCARSSSTSALMPSMSHLVVRPPFKSVSSSRMSLNPSVSRSLVRPLTPSSRPRTVSCLLEAWSPSTRSAPSLRLLPTWRRLSELLRISDSRSSSFSPTDLAGSPIEIRE

SEQ ID NO: 32152 - protein, 99 aa, A.fumigatus
VLVDGPSTEENKIVPRHALPLAHATLTPFVIPKLPRAAGTGPVKKLWEKNEIDGKWAKSTIAQKTERAERRKNLTDFERFKVLRLKKQVRSVCETMGEL

SEQ ID NO: 32153 - protein, 75 aa, A.fumigatus
EHGPFARQKQSIYRVSARQSPNLKEQELIRRLQILFVINQPDVYRSPSSNTWMYVPYGSFDAVYRLHQRGRRISA

SEQ ID NO: 32154 - protein, 159 aa, A.fumigatus
TAKMADPRVEELPDEEVPKANVEDAGSDSESEAGEESSIPAGAAVTIHSRNEKKARKAIGKLGLKHVPGITRVTLRRPKNVRTRPICATKTVHISGFCKAEPKSERAGANTSSADPLRHQPARCLPLSLQQHLDVCALRFFRCGLSSSPTGPPDQRIEV

SEQ ID NO: 32155 - protein, 262 aa, A.fumigatus
NQSHQNRFQRANTFQFPFKGGTSSIDGNVCVASLVDTKDVILRNFGRPVQAVALSPEYKNDRTFLSGGRAGDLILTTGGRVGVSTNSTTMGGAAAAASSWLGSIGLGANTGKDTILHSGEGAISTIKWSLSGKYVVWVNEEGIKIMRSNLHLDSADSELAWKRISHIDRPNGPGWEEMASVWRARAEWVDEDSLRWEDNVNSQQDEPHLNTPAPPDIVAMKENVERLVVGWGGTVWVINVYPDRPNKNNKDLKIGSVQVSTM

SEQ ID NO: 32156 - protein, 266 aa, A.fumigatus
EFDEISSVIPADFHPSLSQDIYEEILGHYVSRDRHRFSELLDTWPFTLFDVNSVTTAVEEQLDPRTVSPETEDWRILTKCLAKLYLAGGHYNEALHCYIRLQDADTAMALIKEHRLLDALSDDIPAFIMIRVSKQQMKTAPLSELEEITAEPIKLLVSEAYTGIVRPEVVVTQLKDANRLLFLYFYLRALWRGESLPHSAAKPRRGHGARVRDAASKLAADEGKALVDNFADTAVGTFGDYERPWLMGFLEVYHAYSFEHTVAVLR

SEQ ID NO: 32157 - protein, 64 aa, A.fumigatus
RREILISTNCKRISAELFFRININNAKLGFQAPGTAVCARTKNAVLRPLFRNILFLGLNICKNS

SEQ ID NO: 32158 - protein, 131 aa, A.fumigatus
SRHRDCVPLVDLLGIIFQIRDDYQNLQSDLYAKNKGFGEDITEGKFSYPIIHSIRSDPSNFQLMNILKQKTEDEDVKRYAVRIIESTGSFDHCRKKLANLTAEAREILKDFGDLGNTDGLKGILDFLELKG

SEQ ID NO: 32159 - protein, 65 aa, A.fumigatus
AMQQSSESRSPNICDYWTVNGVGTKEFRNSARTYFYALSLTEEAQQKYETRGQSTTASLSSQPSR

SEQ ID NO: 32160 - protein, 60 aa, A.fumigatus
TWDSLHSPFYFFVVVSHSIGAYSMRYPGICTYEPLGNGTLLHVIYIIVFSDSIITRTGPI

SEQ ID NO: 32161 - protein, 75 aa, A.fumigatus
SYVIAAFPFSPHDPDNNLPLLRLQPMSIRRVSTFFDTSLSCYLFFFGQIFAAVFAPALSVAPLHFNSLQIRHDYR

SEQ ID NO: 32162 - protein, 177 aa, A.fumigatus
AFAVSPRSSILLSPAIYSSSVRSSLQFLPQRYQSLPSISILCKFAMTIGDIVSDPSLLPVLRTCAETREQCEKLLSLLDPTTQSTSSDPEQALLAASKQQKQLFALLAQLRGQSRDAILRVRQTKQLTAEARQEIDRLHLQLQNLYYEQRHLTGEIAACESYEYVDRCLTFIQPPCN

SEQ ID NO: 32163 - protein, 465 aa, A.fumigatus
QPRGAAKQHARRVAAKLGVSSGLIYLVGQPTINWGDSDQPRPFRQRRYFYYLSGVEEADCYLTYDIKNDLLTLYVPDFDLHRAIWMGPTLTVKEARERYDVDQVRYHASLKGDIQRWADNYNKTSLLYILHDTQKPQVLSNELRLDDELLLPAMDAARGIKDEHEIRMIREANRVSALAHRKVLENVLRMSTEAEIEGLFLDTCISHGAKNQAYEIIAGSGENAAVLHYVKNNEPLQGRQLVCLDAGAEWNCYASDVTRTFPLAADWPTARARDIYQLVEEMQEECIKRIQKGVRFLDLQVLAHVIAIEGLMRLGILKGGSVEEIRESGASTVFFPHGLGHHVGLEVHDVSAKRLTAVEGDKEYYSSILVPSMSHCPCTLSAPLLEEGMVVTVEPGIYFSRLALANARKLAFAKYINFDEAEKYIPIGGVRIEDDILVTSSGHENLTTAPKGEEMLEIIRRGIDS

SEQ ID NO: 32164 - protein, 87 aa, A.fumigatus
  UNSURE (35),(40),(43),(44),(76): Identity of amino acid sequences at the above locations are unknown.
YNLSSKIVGPYGMITFATLNGISIENWRNWTWHYXAHLVXEFXXLSCSDFPEYPFFFCRSHTTFFNKGGRKNVITXKTLKNFLWIGI

SEQ ID NO: 32165 - protein, 73 aa, A.fumigatus
GGWITIALIFAPGVMTIVSTLQAGCFFGALIASQVADRWGRKPGLISASIMSIVGVIMQVAASGHLEAMYIGR

SEQ ID NO: 32166 - protein, 462 aa, A.fumigatus
  UNSURE (119),(126),(132): Identity of amino acid sequences at the above locations are unknown.
PRAPLPPCVPLMWNHALNAPSLQTYHRLRCRFRLDDQPPLRVGERSSCHPWHADRAVPALHHHGHHAGVLDQLRLPAAHQRPGHVPRAAGHAGPPRHPPPGRYAPVQRVPTLARPPGPXGSRARHXSPSAPXAPHPPIRRARIPGHRRAARARAPAHRRLGPLGPHARDVDDPGQPQARPHQHLPHDLPADDRHQRHQLLRTPDLQEPGRHRQRDRPLRHRRLRHRQGRRLRRLPRFRRRLPRPPPLPPVDLRRPGPDNALHRPVRPHRAPRSRRARHPRRLRRPRLHLPLRRLLPVWLGARLLDLRLRDPHRPPARPERLLRCRYPVALQLCCRPRRPQYACYRRCEWLWVPLSLSLPGNPLRYQTRANGLTERTSFSPASVSPWVCTYGSSSLRPRVTLPSPANQQFMLMRIGLSLEKMDELFGVTTPQDSKVADAERAMSSTDKEAEAETAVETRVERL

SEQ ID NO: 32167 - protein, 345 aa, A.fumigatus
  UNSURE (101),(109),(115): Identity of amino acid sequences at the above locations are unknown.
TLRRCRLITGFGVGFASMINPLYVSENAPRAIRGMLTGLYQLFITMGIMLAFWINYGSLLHISGPAMYLVPLAMQALPAILLLVGMLLCNESPRWLARQDXWEAARATXARVRHXPPTHPYVEREFQDIVAQLEHERQLIGGSGPWDLMREMWTIPGNRKRALISIFLMICQQMTGTNAINYYAPQIFKNLGVTGNATGLFATGVYGIVKVVGCAVFLVFVADSLGRRRSLLWTSVAQGLTMLYIGLYVRIAPPVAGEPVIPAGYVALVCIFLFAACFQFGWGPVCWIYVSEIPTARLRGLNVSFAAATQWLFNFVVARAVPNMLATVGANGYGYLSLSLSPEIP

SEQ ID NO: 32168 - protein, 243 aa, A.fumigatus
  UNSURE (237),(243): Identity of amino acid sequences at the above locations are unknown.
HASDISGDFRGEREREVPITIRTDGSKHIGDGAGDNKVEEPLGSGSEGDVQASQAGGGDLGDVDPADGPPAKLEAGGEEEDADEGDVAGGDDGLAGYGGRDADVQADVEHCQALGDGGPQEGAAAAEGVGDENEEDGAADDLDDAVDAGGEEAGRVAGDAQVLEDLGCVVVDGVGAGHLLADHEEDADEGALAVARDRPHLSHEVPGARAADELALVLELRDDVLEFALDVWVGGGXVAHSGX

SEQ ID NO: 32169 - protein, 262 aa, A.fumigatus
SASLIAGFALLDALKQPIAQWNGMEILVYFAELMAAVHLGGHLPHVSFERHYFDRYGKLLLIFMTVQEALGLLSLYRITTTSDTSSQARQPGQSPDASAPGSPSLGSVRPEQPSSSFSSSEPPVPPLSFSSTAAGSSFMTQPPEAQYQLAFPNQNQGLKRDHSFTLNSLKDNESDFSDAYDRDSDTETTVTTATTATSNTVRNIRYGRNPTDAFFSPRRSELGPGIGGLSLDDKPTRRVTRSQSQRLAGNEGIRKYSMRGLK

SEQ ID NO: 32170 - protein, 74 aa, A.fumigatus
PCSCLGVTVKHLYNERNGSIERWRSSRNLRKQRDFIARGFSAFLFLSSPQLTLASFISSLAATYRAVGDAFDLL

SEQ ID NO: 32171 - protein, 82 aa, A.fumigatus
DLAIGSHFTMVELQPIFKKAYWTLAAGGLVYVSFICALTWPNVQRLYALLIHISTNATTNDSGAMRIAPCMRTKSTLLCGRM

SEQ ID NO: 32172 - protein, 391 aa, A.fumigatus
VRGKAQLSMEWSLLTWPETQVQPFNLVTPDNDTIYGWHLLPLHLCREHEEELNANEPSGPADDYTQTPAFKFLAHDPNARVVVNCKRTGYFACDTIMMCTLTNLCSTAVHGNAAHLGSAQRPEIYRMLLGLSSPSNPVHVFTIDYHGYGVSTGSPTEEGLITDGVSLINFLTAGPLNIPPSRIVIAGQSLGTAVSAAVAERYAFGSPDPAAVQPAINDPEPFAGVVLLASFSNMRNLIESYSFKGLTPPMLSPLIGYPRVQRWVRSHIVDHWDTAARLARLTGVGPSAEEDAKAGYNSKNLDLAIIHAFNDVEIPWYEGRSVWIAATGENQKDAPGTLAYQKKEEGGPTEVKIWENRSGKHAVKTVRWERVGYGGMSQIRFNVLVHRERYN

SEQ ID NO: 32173 - protein, 67 aa, A.fumigatus
YLWEVGGGRRSVTHSRTHNLLMIRISFFLPLNFYTLKILGHFDIVNTVPTPIPFPFISSMAPPVVVA

SEQ ID NO: 32174 - protein, 276 aa, A.fumigatus
LFDVKDTGSKPFVCKECRRPFARQDALTRHEKLHTRATSSTPTIKVTQGDTAIHLPPQTTASDAHTWDSTRAVTDDAALNPAPSHTWNTPPSGQQSGFQQAASDLDFSLIWPDSENLFHSIMSSDTTEHWQMPLGTLPFPPVVQDVSTINFGSPNSFDDRSSSIGAIPSGGSHQAVRDVTEMVTSSVSILTVFLVFAEDLIVLQSSSVTAAIKATSITSVFLDECLHMFFVRFIPTFPILHRATFVFRECTHPLLLNAMALGSLYLGPKDSVAKVT

SEQ ID NO: 32175 - protein, 93 aa, A.fumigatus
CGASCCSVDSKPSTAETGFFSALSFLDKVMIGSSASCWKPQWSQMHVAKIRLEARSCSVQTYSGNQGTPLCKEIYVQIFDTNLTDEGLFLERV

SEQ ID NO: 32176 - protein, 186 aa, A.fumigatus
PTPSFDAVYAIEATVHAPDLEGVYKEIFRVLKPGGVFGVYEWLMTDAYDNDNPEHRRIRLGIELGDGISNMVKVSEGLTAFKNAGFELLHNEDLADRPDAIPWYYPLAGSFKHMTSPWDFFTIARMTWWGRGIAHRFCGAMETIGLFPKGTQKTADSLAIAGDCLVAGGEKKLFTPMYLMVGRKPE

SEQ ID NO: 32177 - protein, 68 aa, A.fumigatus
STGTMDLMRSRGMNIRRWMDLSLPSQGNVSVSYITHDPAPTYIPSSVGDEGKFAHPITSFPSLLSSSH

SEQ ID NO: 32178 - protein, 277 aa, A.fumigatus
  UNSURE (216): Identity of amino acid sequences at the above locations are unknown.
LVATMTHESEVTPPVPISDEYYDLGAFGRKITTSSADTQAWFDRGLSWAYAFNHVEGAYCFEQAIAHDPSCAIAYWGLAYAVGPNYNKPWERFDKDDLKICMKRAYEASRKAKEHASNATPIEQGLIEAIQSRFQSASPPQTAEEQSALNHAYATAMKPVYQAFGDDLDVAALYADALMNQTPWALWNLFTGEPNPKAATMEVEEVLERALTQKEXENTRGCCTSISTTLKCRQIPKFGVNVAEQLRDLMPDASHIHHMPSHLHFLIRDGGPSIGFQ

SEQ ID NO: 32179 - protein, 215 aa, A.fumigatus
LSAYHCLCAVMPRIDTVAIIGAGPSGLALALALHKQSIACTLYEARASALDIGGAMMLCPNGLRILDSLGVYSRIRPEGYEFDKLYFRSPDDQPMDTYEFGGVEQYGYRAMRIYRHVLIRELSAMVREAGIPIEYHKKFVRVLAETEKDITWEFSDGSTATATCVVGADGIHSRVRHYLYPGLEPSFTKMVIVAAAVPTSQLQVPSSYNLPVTIL

SEQ ID NO: 32180 - protein, 139 aa, A.fumigatus
AADHSITHQNEPSLATGLLNSPLPYTVFSTARTLLSSMTVVRPMSRMMKRMLSLRTKPLQFPPAQCAPPIPQHELVDEEASPAYNPKYFYPAKPGELLANHYQLLVKIGWGTRSTTWLAKDITRYTPDFVSVMPTAIIV

SEQ ID NO: 32181 - protein, 120 aa, A.fumigatus
EVVFRYRWQPERFVTLKIINNRSLDEAYRERDIEEHISRQNPSHRGRAIIRTHLDSFEVTSSEGSHLCLAYEPMREPLWILQKRFVDQRLPLPIAKAYLLILLAGLDYLHSECGVVHTGR

SEQ ID NO: 32182 - protein, 126 aa, A.fumigatus
SFWFMLDLKLDNILMTFENEDVLPNFLKVQINSMPMQYKTESVTRRTIYRCHNDFGPLDWRELRKMVPKIVDFGLATSLKSDSQGQGGKSELGLHPIQPDQYRAPEVILGCGWSFSADIWNFGVLV

SEQ ID NO: 32183 - protein, 138 aa, A.fumigatus
TVSSSPIEMSRIQVIFFILSQQTISMLSLYRCTSCNELIQPTKARLSCASCAPRLTLCANCYVVQNYPLQHQENPSHSILLHAKSGFIPIPPPPPPPQSQSVRSPYVPAQRRPIPISNRDSNTPPRKPPRPTNPEQRN

SEQ ID NO: 32184 - protein, 82 aa, A.fumigatus
QARSYNVILQRGLKSTYLIRWVADMEGAILASVNCIGPYFFFCILSDPAMLRYVLVVDREFNFGPQLLQSTNASSGVSIQIS

SEQ ID NO: 32185 - protein, 337 aa, A.fumigatus
ASIMSLDPSVVPSSTSSPSLISVPDTPTDPSSGPFTHSTTPPSEAPLRNPPRPQINEAQATQSATMADPNDNSNAGLDTKHEVEPSIDNNGVKTEAKPSVSVTESTSVKIACKKHSGKESNAAGRKRDSKKKSHKSISTPDEDTSSASTSSSGSCSVSESGSQDDETSSSSCESETSRKNRSNRSKNKAKKILKGNRKRKSRSHQQVASDTDTTSDDIGDDDEPLDEKTLRRLLARLQTKRGAKKLRTKGESSEDQPEEDVEANSEELALLLAKELAALSLKLGDGRKLNDGRRGKTRGKRHAADGLTDGQKGNLQKSKHKLKAASKMAFKRVDQCE

SEQ ID NO: 32186 - protein, 360 aa, A.fumigatus
  UNSURE (355): Identity of amino acid sequences at the above locations are unknown.
GRDMLTFSSLLVWDNTIHNYKLTETVDDTGANEWDQYIFTVRRKFDWENKYLETVVDIKSKHLRDALAKIMDGVKGVSLVQETAVVDPNMLFLYLEETRAYMKELKQQAKKETKKKAKKLADLKAAQLKVLVKYLDTDYAETKKTLYPLLEANMITFDLLWALYKPNTIAYTSTYGNQDEPRAFKIEYATKESSFMKGQWYSIEGRYLEYDGKSFGMGTMAAEVEFFKGVRKITSLGCYPLKYHREAEEVNAKLIERGKKFVALCGMNYRFHKGMAFYKKKRTIIKVNINGRVMVDPAIHRRINPNYPISTVRPKDPDILGASDDKPSEDGCKCGMSDSDVDQQQPKSRDSDNPXILYKV

SEQ ID NO: 32187 - protein, 141 aa, A.fumigatus
TSKFSRSTLVSLRIRLRIRSRCAAGGRVTGNFLGIRLRIASSISWIRFVAPRTTTRCGSPREFAEVRPSQWVMNSALTMPLASCSPLRRVPSTASISSMKTIEGCSLRANEKTALTSLFESPYHFSVKVEIWRFMKHAPLS

SEQ ID NO: 32188 - protein, 179 aa, A.fumigatus
LAEYNIIFVLPEMPKRKATGRLSGQAGSDGANAMQVNGNDAGQRENERPAKRARGRPRSKSVESKPPAETKRNSTVAQAQAPDSGPKKASKRGRPKGSRNSAHGATQEGPERKGGNEKIKDEVGVEEFESLAASDDELDGAPVATKTNQKAKSAKPAATRGRKKVSAGKQVQTDGEFEY

SEQ ID NO: 32189 - protein, 377 aa, A.fumigatus
SASAYFLIRYLLSRLDFDPESQKKEEQRRKSAAILRKLDGGEESDGDSPRRGAKKARRQRRGDLVLNQYEQAIAMDVVAPDDIHVSFEDIGGLDDIIEELKESVIYPLTMPHLYSSTSSLLNAPSGVLLYGPPGCGKTMLAKALAHESGACFINLHISTLTEKWYGDSNKLVNAVFSLARKLQPSIVFIDEIDAVLGTRRSGEHEASGMVKAEFMTHWDGLTSANSLGEPQRVVVLGATNRIQDIDEAILRRMPKKFPVTLPPAAQRLRILSLILKDTKVDRENFDVHYLVKAMAGMSGSDIKEACRDAAMVPVRELDPQKKAEGIRMTSVNPTEVRGLDTGDFFSRAGGRQVHFATLSAPDRTYQLSQFGERVEHC

SEQ ID NO: 32190 - protein, 211 aa, A.fumigatus
SCPGWEMRLQSTRTSCFETETRTELDWAISEQSWDVRPGNISIPCWLGIQKTRRKSNRKHYARLSSSLRDFILGAFFVVDLTKDLSEADSWTSGECASHFQGHLKKYPPQVSSRNAAAGWGCFIHNEVNTMLGKPEFDCNNIGDFYDCGCAEDEKAAGHKDKSQAASRGVPQKKDHEGDATTPVEIHKEPSVAPQYFTFQLLTDHRRTTRG

SEQ ID NO: 32191 - protein, 69 aa, A.fumigatus
YSLICKALGANTSFSMSISVGGAYDSLHKATHEFLSGRVTLIGNLQAFVTHTTDRGHSKEAVPSYCRHY

SEQ ID NO: 32192 - protein, 187 aa, A.fumigatus
VQVAWVSGDEVLSTIKKSLQSGKSTFSNVYTGEKLSEWSFEPIYGQCYLGGLGIAAALAQGADIVLCGRVSHASPVIGAAYWYHGWDRNDLDQLANAFVAGHLIECNNYVCGRNFTGFKMLENAGGDGWTNIGYPIAEISAQRHVVHPKQSYSSGGAVPVPHMFLPNCCYQNQRPLVLSPPNVECQY

SEQ ID NO: 32193 - protein, 85 aa, A.fumigatus
KVLANKVLHEALISESSLLSRFWIPMIACRVSVHWFQATSKIPDSKLHSLSLFTAPTEPCIHLPIATLYHMQTLYETTQTFNNHK

SEQ ID NO: 32194 - protein, 84 aa, A.fumigatus
  UNSURE (74): Identity of amino acid sequences at the above locations are unknown.
HLFNFSFVPLDKIKVTPAHKLLDGPTPDMGRSSANGVVDHRISAFVVRFDGLEVVRYTFARQGSHIDDKSSVEXGQVDCFFTVW

SEQ ID NO: 32195 - protein, 229 aa, A.fumigatus
  UNSURE (175): Identity of amino acid sequences at the above locations are unknown.
LASKTNTKHILGTAGTQAILDAISDSSRNVGTVAIGGIKLSNVQRVIYQSKAPRKGLDGVAIVSAIMAADDPRAAAEEFVKRINNPPSFAWEPKAPRANEAAALAEEVAQIVQKMVKAHPLVHNMINYVVANFVANVALAMYVCIWIIIDLSNWLAEALPRSCHHTVKKQSTWPXSTELLSSIWEPCRAKVYRTTSKPSNLTTNAEILWSTTPLALLRPISGVGPSRSL

SEQ ID NO: 32196 - protein, 65 aa, A.fumigatus
PEESVRYTVLASGIELLTLSGNVVLLTGAVDYLSDGERVIAVENGHEFLGQVTGVRLLLSSSSAC

SEQ ID NO: 32197 - protein, 88 aa, A.fumigatus
LNVQTGCAVGMVSGCFLAVHPSDKLLAVLSGLLMYEIAAENAASKEYVRGPGSFVPAFLDELYAIRQAALKGDDSWFSGRAKIQEIKL

SEQ ID NO: 32198 - protein, 65 aa, A.fumigatus
TMCPVYLLIKSCDICNMVQLTGLLGEQYLELFLLKPDFSGEKLPRTGPTVFTTGLEGSDAGSMSI

SEQ ID NO: 32199 - protein, 70 aa, A.fumigatus
CVTSGVTIVQYRDKTSDTGALIQTAKELHKITKAYGVPLLINDRVDVALAVGAEGVHLGQDDMCTSHGLR

SEQ ID NO: 32200 - protein, 171 aa, A.fumigatus
  UNSURE (22): Identity of amino acid sequences at the above locations are unknown.
LACRGASPIMSPYGEEAVDLAXFDGALVINMGTLSRESIPNYLQAIKSYNERGNPVVYDPVGAAATHIRRGAVKELMSGGYFDLIKGNEGEIKQVSGSRNAVQRGVDSGPSTLDGQEKARLARDLARRERTLHRPCKWDRVANSVRKRRPFDRRRRLSKRRRACDRCREWS

SEQ ID NO: 32201 - protein, 174 aa, A.fumigatus
SGSVIQVGFGKNMWDVIPMDNITEVNKVGGRLSLSPTASALTYHSQRFFAFVVLYKTQISLAKISVCLFLLRIFQTLAFRYTTYAIIGLNAAIGVTWVLVDSLRCNPVHLAWDGWTGETPGTCINFTSATFANAFVNIAVDTVMVLMPVYEISKLNLSGRKKLGVSVMFAMGLV

SEQ ID NO: 32202 - protein, 167 aa, A.fumigatus
  UNSURE (56),(152): Identity of amino acid sequences at the above locations are unknown.
RLYPEWQWRRAHQLMLQSKFIITKQCMERHPSQPPCPPTDHQTTKRWCPWSLWDWXWELAACVVAILTLIGMIAVLRIYDGKTQPNWPAGINLNAIIALLTTLMKAAMATYIAEALSQLKYSWFKDTRRLSDLAALDSASRGAWGAAQLLVXYVPRCATSLPSLASR

SEQ ID NO: 32203 - protein, 76 aa, A.fumigatus
SGVPGRTVSVVKRLGARACNVPVHQGRPEGEAATLFPLILASVLFFNRMAAKSMGLAGGWGSDEYTIIGAYVRYPL

SEQ ID NO: 32204 - protein, 166 aa, A.fumigatus
LCFWWARIPVNVGFGHKIVAQLPMLTPARCRFLSGQMHVFRPRADLWRCILALIPMLCALMIAISRLEDYRHDVYDVTCGSILGLIIAHFSYRRYYPPLRSVACDVPHEAYEIVGPNGFSKLPGDEEQQIQERGLGSRGWEAQTYQLEDLPSHHDRLHYTSSATPA

SEQ ID NO: 32205 - protein, 143 aa, A.fumigatus
AFSESDTSLPYAHKLPVWSIIYAGVVPLLILVCWAAIFRPKPYQVQVTILGLLVALMLTSLITDIIKNAVGRPRPDLISRCMPKKGTPANTLVAWTVCTQSNNHILQEGWRSFPSGHSSFAFGGLGYLSMLVSAIRLLPSSQC

SEQ ID NO: 32206 - protein, 118 aa, A.fumigatus
EGFFFEPDEERGEIKICDEHPGYTNMVQSADGTMMSIPFEKTQIPKEAETRVRALLKETMPQLADRPFSFARICWCADTANREFLIDRHPQYHSLVLGCGASGRGKTFTSRDVKRNNR

SEQ ID NO: 32207 - protein, 115 aa, A.fumigatus
LPLLRGRVVTLIFENNDVKGAVTADGKIWRAERTFFCAGASAGQFLDFKNQLRPTAWTLVHIALKPEERALHKNIPVIFNIERGSSSNQMRSAVRLRSATNIRGIPIWYSLPTAR

SEQ ID NO: 32208 - protein, 73 aa, A.fumigatus
GFKYLPSIGNLIVDAMEGKVPQKIHELIKWNPEIAANRNWRDTLGRFGGPNRVMDFHDVKEWTNVQYRDISKL

SEQ ID NO: 32209 - protein, 70 aa, A.fumigatus
PLGKLLHPSWSMWLFDCVQTVQATNVLAGVPFLGIHREIRSGRGLPTAFLMMSVIREVNISATSSPRIVT

SEQ ID NO: 32210 - protein, 626 aa, A.fumigatus
GSATNYDTKAFFPSLPPLFPNSGKLDRKKLRATVETLPKDQLKSYATLTAGSRQASDEGVEGTLRSLWEEALGLASGSVSAEDSFFSLGGDSFSAMKLVGAANSQGISLTFADVYEDPVFMNMAKRCGMLQGRSGRQTVTPFSLLPASVDREQLLEEVAEQCGVPRASIVDLYPCSPVQEGLLTLSVKQNGAYIAQPIFRLSEGIDLDMFKAAWQQVVDELDILRTRIVHTESLNFLQAVIDKEEISWASATTLDELTAESPELPRHNGGRLTGYAIAASQTGRYFCWTIHHALYDGWSIPLVLRRVEEVYTNSTASARTVPYNLFINYLLERSMADSDEYWKSQLANLSCSPFPQSRNPLPDSVRVGNRHHSSMKISRAASGVDLTIPELIRAAWAIVVSAHTGSSDVCFGETLMGRNIDLAGVTDIAGPVLTTVPTRIQVDNELPITQYLENMHHLTTTMLPHQHSGLQQIRKLNSDTASACEFQNLLVIQTGEGQLNKALWVAEPIQTSGDFFTHPLVVECKVDTSEVSITMHHDEIVLNSWQTEKLIGQFSFVLEQLLSINKGETRKLSELEIFSPLDSKEVALWNKKAPEGVEKCAHDIISERCSTHPDAPAVCAWDGEVS

SEQ ID NO: 32211 - protein, 482 aa, A.fumigatus
KEMYTLASSFASYLTCRGVGPETLGPICLDKSLWAIITILGILIAGGAYVPLDPVHPTSRHEEIFTEVDARILICSPQYQSRYSSIVKTIIPVSKETIRAYFALNYQAKGLRRVTPFNMAYAIFTSGSTGRAKGIIIDHRALASSAMAFGPIVHLNETSRAFQFASLTFDAAVMEILATLMHGGCICIPSEDERLNDVAGAIRRMNVTWTFLTPSIASIIEPSTVPSLEVLACGGEKLSREVVTKWAHRVKLINGYGPTETTIFAVLNNVSPTTDPACIGYGIPCTLTWVVDPENHDRLTPLGAIGELALEGPALAREYLKNPKKTAEAFVDEPAWMKHFQSTLPSPRRIYKTGDLVRYNPDGSVEYISRKDYQVKLHGQRMELGEIEHRLHEDDRVRHAIVILPKEGLLKGRLVTILSLNSLKSGSSIISDNACELISREDLARVAYSELITIQKNLEAQLPIYMGPQTSSPQGPATAQAQ

SEQ ID NO: 32212 - protein, 280 aa, A.fumigatus
VVLYRSKEYDTNRDPRGPLSAGAEVLYGIMSDFVTALATAPVDIAEAISRHHHHHKKHGWRHSHDEEVTCGCEARIGRSVKSKDGIPPEDQVRSQLGAVASIRRSSSDSPTSSPSGSADEEEDDDEGEQVGSESTSFVSAPDRISRNSVPAPRSRISDQSTMQSDSTETHVESDEDSGELDLEKTISRRATREARGGVHVVLTETGYHGKRFGKRLLNWLITIPTDVTLSLSKGFHNAPKLYHDRTVAETPTVMGVRSGFRAAGKVGIPRYSLSSQMGCN

SEQ ID NO: 32213 - protein, 251 aa, A.fumigatus
ALKQGKKYDDPASAAQIRDFINFHQLDLSEVLLPLDQFKTFNEFFYRQLKPGARLCSAPNEPRIIVSPADCRSVVFDRIDEATSIWVKGREFSVERLLGNAYPEDAPRYKNGALGIFRLAPQDYHRFHIPVDGVMGTPKTIEGEYYTVNPMAIRSALDVYGENVRILVPIDSIAHGRVMVVCVGAMMVGSTVITRKAGEKVTRGEELGYFKFGGSTVLLLFEEGVMKFDKDLVDNSRGALETLVSTINPLC

SEQ ID NO: 32214 - protein, 201 aa, A.fumigatus
RIKVDLSSFVPAMMLEAGDMAEEQTCLDQESREVRGEETGEGNDDKWQEQTHGEFVVESVAERGSGERDSLASNNSLSKEELVEEGEPADKESVDEQSGAIELADEKSADKEADEEECSEEESDKEDLAPVSAAYYSGIKVYGYGLSDRPWITRDGQDFIWLPPEFRPECSAVQGDTIAIGCRSGRVLIFGFAPDGCSTGA

SEQ ID NO: 32215 - protein, 214 aa, A.fumigatus
WLSLSDHAVGVHPKPAEVEHLKSSLHFPQGHLFLSKLDDSNSSVSANMTITQELVKDKTAEDSDRPSAEQPPGYDQIDEQPSTIPPLDLSHNAGPPASTTVTRDQCVAHLKFIAALADLRDSVAGNDGLFGLHDPPPTEFPDHINEVRARMREKRWAVYTARAVDRYTKWWVKCVPNDRPRARLTDLMDESYDHITQDIRLISWSKDSLPPLGE

SEQ ID NO: 32216 - protein, 178 aa, A.fumigatus
WRRVVLTGADVLMVWHAHMLNPRAFLEDCIRSGKMCCWASGFPWETINDCIDNRTLEYDAGDRARVHFNRMTRFAWENLDDPLNKLIECPACENTVSVPWTQGRISLPLQTAFDKFNGYADKNFHVKCPKCGSTVDHELLRVRKFRRDVANWLKEKMPMPGTLYNMRGIPQSTRSQTR

SEQ ID NO: 32217 - protein, 76 aa, A.fumigatus
WKASRNTFFHHTTTVWPIYFILFYFSFILLFLSRLFNNYLVSMCVLIAMIIINSKYSARFIISIINHLFSRVNIIS

SEQ ID NO: 32218 - protein, 60 aa, A.fumigatus
PAERKKSNQRQVDNTPNTITILGLTTCDLRGTFWPAYHSPTARLFAIVRHMEPYKCRRTI

SEQ ID NO: 32219 - protein, 95 aa, A.fumigatus
SLANPGVGGGSGFGAAISRRFGEEGAKVIVADIDVENGEKIAAQNPENLVFYKMDVTSASDWDEVMDLAFAKFGRLDVLVNNAGTTYRNKVRTIR

SEQ ID NO: 32220 - protein, 80 aa, A.fumigatus
GAPLADVRALQPTLEVTEEEWERVFNVNVRSIFLGSKALMGRLIQQGQGGSMINISSTGASRPRPGLVWYNASKGAVSNV

SEQ ID NO: 32221 - protein, 88 aa, A.fumigatus
ATKGLAAEYGPHNIRVNTVSPLLSGTGLFSMFTGMEDTPENREKFIGNVPLGRLTDPNDVANMCLYLASDEGSFINGAEMIVDGGKCI

SEQ ID NO: 32222 - protein, 77 aa, A.fumigatus
NATTDEIRRTEMIHSRSYTLATIDDHLRAVDETALITGKVQTHIRHIIWVGQPAEGHIPDKLLTVLRRVLHASEHGK

SEQ ID NO: 32223 - protein, 312 aa, A.fumigatus
DDRSKFLPRMLAGILIEVERIVDCWQFTLRGSYDNHVTKISPFLLLGTAEERQSNNVTNRPIMSSPTVSAKLEGSKEQSKSAPDSKIDHAASLKYWNDVPATSNGMLAMLGDYPWYSRIDLRGSRAFLAKVRRLLPSCSTEGKLKLGVDCGAGVGRITEGFLSHVCEVVDVVEPVAKFTEVVRNSSLKKDGIVGDIYTVGLENWYPEKKYDLIWTQWCVGHLTDAQLLEYVKRCRAALTETGIMVVKENQSTDINGEDMFDEVDSSVTRTDEKFKKIFKEAGMTVFLSEIQTGFPKNFRLLPVRSYALRPNS

SEQ ID NO: 32224 - protein, 350 aa, A.fumigatus
LAIEINPSSSIYLSNRAAAYLSANRYLEALEDAERALELDPDNSKIMYRLARILTALGRPSEALEVLSRVQPPASATDRAAPEKMQRFIKQAEETLAEDRGVSMVLFCIEQARQLLGRGVKEPRKWTLLTAEAQLKMGSENSFRKAQDIAISMLRENNQDPDALMIRARAYYGLGESEQALKTLKMCLGLDPDMKPAIKMLRTVQKLTRTKEEGNNAFKAKDYRKAIELWSEALEVDPQNKDMNSKILQNRAQAYINLKEYENAINDCNEALKLDPSYVKAQKMRAKAYGGAGNWEEAIRDYNAVADANPGEIGIQEDIRRAECELKKAQRKDYYKILGVSKDASESEIK

SEQ ID NO: 32225 - protein, 305 aa, A.fumigatus
  UNSURE (193),(220),(228): Identity of amino acid sequences at the above locations are unknown.
IDFGHPIFFWISSSHLCIVHDRLLSPVYGRKNTKINISTAFADIRYPQPIRDCNSDNQKKTRTGKRRKEEKDMVLPHLFARHKSKRSTSSKEDSKKTSSPKSPPPSTETLPSRSSSTSTSSSRHTPSHHPHHLRSPSHPPPTPVPLPHHLFIHRPLIPRDRPNSKSRSHTSAKSKSSSSKDAAAAARFSFPAXRLSSTFDRYSHDPDFHPLNLHPDELRXLSAMASAXDRSSMDIDSPGSSSQNINGVNGVQTDRVLPRRRTSPMARSPKPTHSNWRAINFSRTEITIAQLKSSPKVSMQFSSLK

SEQ ID NO: 32226 - protein, 175 aa, A.fumigatus
  UNSURE (158): Identity of amino acid sequences at the above locations are unknown.
TFPPPSPTFDTLSQSGTAILITRKRPEQENAVKKKKIWFFLTSLPVTNPSDPLHPKRIRRRLHRQKVLLHRRRPFLLGRPRLRRLRLATPPVIILIIFALPHTHRRLPFLFLIIYSSTVLSFLEIVQIPSRDPTPPLNPNLPRPRTPPPPRGSVSLLXGSPPPSIVTRTIPTFIL

SEQ ID NO: 32227 - protein, 103 aa, A.fumigatus
SILLTAALGMPKALIRVQLLWVNLVTDGLPATALSFNPPDHDVMRRAPRKRDEPLVGGWLLFRYLAIGTYVGAATVFGYIWWFVYNPEGPQISFWQLVSKLSQ

SEQ ID NO: 32228 - protein, 125 aa, A.fumigatus
ANCLSETFSCLSNSYLQSHFHKCSAQFPEIGCEMFSNEMSRSASTVSLSILVVIEMLNAMNALSSSESLLAFPLWNNMMLVYAIILSMTLHFAILYIPFLQTLFSILPLNWTEWKAVLAISAPVV

SEQ ID NO: 32229 - protein, 67 aa, A.fumigatus
LVVRAYPLASLGYANWILRHYGYKAVSIFGLTLYGIGALCMWPAGLNRSFGGFCAATFLIWSGLGSL

SEQ ID NO: 32230 - protein, 81 aa, A.fumigatus
QPIGKSLHMDHDQHMFVDFKFDQSIQVSTHPHKEENRDQGEGPQALTQGERSCRGGTLIVHPERRAGSENLSDPHFGNCGG

SEQ ID NO: 32231 - protein, 77 aa, A.fumigatus
FNMRNKVITRYPYYSGPYFQVYRDSTALDDFDISLRLQMQGMGCGSTQSSIRASGCTHSGRAGVGAPYCNCRFQAEL

SEQ ID NO: 32232 - protein, 677 aa, A.fumigatus
TENTILTIFRIGRDFARRGTCSFKNGKFQHVNDTGRRDDNRPKRDVRPKRPELSDSEKQFRSWKDTLNTDFRASRPGRAKLNNFFRDARQLIEVDAGLMQGVIRELSEETGLEHIRDLVENKFPKAESKAKEEVFRSQVLPMLETVSHPKVLSSLILEQAVGTIYNVLYGINGRRAALFLSSVCDVLSKISEEETAVEWLEISLLVFAKIVDLNSTAFVQDALKDQAKRFQQLFLRMAEGGLASSLHHSRNLLDHLLCRLEIGSSLPSAPANDKLESEPKSTATFMVHREPPGGRHDNDHADIVNIAIMPTLDEIQSSRIEYLPVNDPRQWHVGGLDGLLDRNFRLLREDTIGQLRDAIHQELKGSQEPGRQISQVRTHVYPRAKIRQIYFDKFLGFHFKVQFPQPPRVSEMSVKDRENWWQLSKRLLPGALVCLIMNGRNGRTVVFCTIVDEQVRSPKKQTDNANKESENVASLWEDAKEASVKIMLVDTKPGMVRTILNKVLSKRDFSIVEFPGILLAGFEPTLRALKKIKENRELPFLEILVASGNVGPVDVPPPLYALRPGFRFNLRCLMNNNADLYVQADKPVDIEYLQRNSTLDWAQARALVNSLQHRIGLIQGPPGTGKSYTGVALIQVLLANKKQGKTNLGPMLCVTYTNHALDQLLEALIDKGVTSQS

SEQ ID NO: 32233 - protein, 161 aa, A.fumigatus
DWQRGTGTILYNPAVRASVGGSTSMNTSSVGNGYSSRPYNRTGNGADFSDGQSGGYGRRSNPDTSNRGYPLVTEDGEEIQTQNISIPADMVGCIIGRGGSKITEIRRSSGARISIAKAPHDETGERMFTIMGSAQANEKALYLLYENLEAEKTRRSQLPQE

SEQ ID NO: 32234 - protein, 212 aa, A.fumigatus
  UNSURE (86): Identity of amino acid sequences at the above locations are unknown.
PTAALSGRMVFSEENQLDLGLGALFKAQVSENGAAVAVESDGHALSYADLHSKALYLAYQIQRLCPCDGTPVGILIPRGINHILGXVAVLYLGRSCVPLDFKLPDDHLNNMLHDIGTNLVICDQETTHRLPTFTHVLADHTIEAPGPSFEPLLKGPKSCSHILHTSGTTGKPKAIEIFAEGAYQHPSRSFVPCKRKVTVSVIYRVCLFPLRW

SEQ ID NO: 32235 - protein, 599 aa, A.fumigatus
  UNSURE (494),(543): Identity of amino acid sequences at the above locations are unknown.
KKGDRFGHIPSVPFSASLVDLWGSLVTGATIVCIPKETVLDPLELSRQIKSLKLNVMQITTSLLNITAYASPSAFSSLETLITGGEAINVQTIRTIFEGGPPRRIINGYGPTECSVYTLWHPVSREEAQRGEIPVGKPFCNVQTCLVDENLIPVKAGVIGELLIAGAGVAGGYIGEPEKTAKSFVSLPHLPLHSNRGPGHIYRTGDLMRMDEDGVYYYIGRKDSQIKIRGQRVEIEALESNLVQLKAVSAAAVIKITPKGAGRNPFLVAFCVPISPCITAAAITKEYVEGKTIKLVLRIEVVVSLPLKTNGKTDRKELEHRYLAKITDSCMTSRYAGKDIGNVEAKLKALCVDILSLPTEDIDPTDDFMAMGTNSLMVAILLARINRTFGVSLGASKIYENPTLRSLTNLLETTQGHSTELTNEAEQELWLQDTQLGQHLRPLPGTVVDWEDVSEGRVFLTGATGFVGAFFLAELLRMPTVKKVACLIRAKNQXAGRLRLENVLRKYQIYSDLDKVVVLPGSFSEANLGLNRKDYDYYAEWAXVVFHLGAKVSYVAPYSSHRMDNVVGTCNILEFASPKPSKGHSLHLHHPRYMGLPGS

SEQ ID NO: 32236 - protein, 466 aa, A.fumigatus
KPAGVNTGFGGSADSRTDRVVALQSGLLQLLQAGVLVRSDKGLQCQQQQSLESHAMPASWVRGTMLVRCNSNARGHSAVSLPVIESLLRLIENHITPVVPLRGSISASGDLMPLSYIAGAIEGSPDVYVQVQDADKTRIMNSRDALLSTGLEAQTLGPKEGLGLVNGTSASAALASLVMYEAHQLAVLVQALSAVTVEALMGNAESFHPFISAIRPHDGQIECARNVLSFLQGSQLAQNVERDLKDRNRPGLIQDRYALRTVPQWIGPQLEDLLLAHHQVTVELNSSCDNPLVDMQSGDIFYGGNFQAVSITSAMEKTRTCLQMFGRLLFAQATELIDPNLNNGLPTNLVADDPSLSFTMKGVDISMASYMAELAYLANPVSSHVQTAEMHNQSVNSMAFVSSRYTMQAVEIVSLMCACSVYIGCQALDLRVPNSTSWTAQRKNFQRFTPHMFLRKPPETELRNPQ

SEQ ID NO: 32237 - protein, 67 aa, A.fumigatus
LVILLIHSGLNRKIRKFWRPFCPYNSINLDSEEGCEGSVSVGRHVVPYGHHTYDKKEVKYGISNYLL

SEQ ID NO: 32238 - protein, 601 aa, A.fumigatus
  UNSURE (1),(3),(4): Identity of amino acid sequences at the above locations are unknown.
XHXXGLALRNNLTGYVPLTAVSKKLDEKIEKILNDNDNEDSDAEEEDGDDDSLDLTDYFYLGQYLRASVVSVGSNAADAPSKNKKRIELSVDPRQANAGLSKSDLEVNTAIQASVVSVEDHGLVMDLGIEGADVKGFMSKKEIDPKTDYSSIKEGSVFLCMVTGQNANGSVVKLSANLQSAGSIKKSHYLSTASTINSFLPGTAAEILLTEVSSSGLIGKIMGMLDATVDLVQSGGNSGKDDLTKKFQMGAKIKGRIVCTFPASEPFKVGFSILDHVLKFATEGHGPGTSEDAPAISAIIPETKVVMVDPGMGVYVQMGSTKHVGFVHVSRLADGKVEHIAPEHGPFRIDSVHEARVVGYSAFDGLYLLSFERKVIEQPFLRLEDVTVGTVVKGKIEKLLIGPAGVDGLIVTLADGITGLVPSMHFADTALQFPEKKFREGMTITARILSVNLQKRQIRLTLKKSLLNSESAIWKDYQDIVPGSQSPGTIVNIQPHGAVVQFYGPVRGFLPVSEMSEAYIKDPSQHFRQGQVVNVHALSVDPALGKLAVSCKDPSTFTETYRKAFEKIQPGLRVTGTVFEKSVDDVLLKLESSPRGWKDTR

SEQ ID NO: 32239 - protein, 597 aa, A.fumigatus
HNEFSILVPTNHAPSNEMSADSSSPLVVKEPKDGGMPTEGEKLRLVIIGGARGGMSAAVRARRLNENASIIVIERGSYISYTNCFAPFSLGGAIERDTWIAVQTPAGLKARFNVDVRVCTELVSISRERHSITVRCRKTDTTYDLPYDKMILAQGADPAGRPMADIEKDKVFPLQTPADLQAIRSFVVKNDCREVVILGGAFTGLKAVESLHSFGLHVRVVEAGDRLCPEFDPDFATIIQKELVKRGVGIHLGRGECQTIAETEDSDRCRIEFHDGSSLSADLVVVATEPEPRVQHAKNAGLTVRKGIVVNAFMQTSDPDIYAVGSVAEVVNSISHMPQVSSSMSGASNRQGRLAADHIFTRATAYPGTAGTHVYHVFHLTAAITGLSVSELRQIGYDPQSVTIHQPDHAGYFPSAQQLTLRVAFERASGVLLGAQIIGHSGVDGRIDVLATAMQAGMTVFDLEHLELSYMPQYGSVRDPVNLAGSVGSNLLRGDLHIVHPQDLQGHLHEWPIIDVRSAEHFAQGHLPLARNIPIDSLRSRLAEIGKDRPVLVYSRVGYHGYLAYRNLVQSGYRAANLDGGLKLFTDGGYQPQLTVD

SEQ ID NO: 32240 - protein, 178 aa, A.fumigatus
CIVAWRKVLKDLIIFFKEVQKSYETRSKLYLSASNVVNNASLPPTFLKSGGLADATDILRDFHRQGYLEANKAAEVESEVVNQLMGLRNDLQKKTKEIKSLQGDFRNSVDKEVENTRKTVRQLHEALGLVDTDPSATSGKGDPFIIRLSVDRQIEKQIEEENYLHRVSLSEASYRLNH

SEQ ID NO: 32241 - protein, 83 aa, A.fumigatus
TIDTAVRLVTELDYPDSYSDRVLRSDSFYDYYMISFTIPFAPPVLLITANSRSISNASGQTDNALIGALPYLTTGIALPDYPG

SEQ ID NO: 32242 - protein, 113 aa, A.fumigatus
AFLNLENSGRELESIVVSEIQKAYNAYASILKREADEAYDTVEKLRTGPISMPHDHEWNHFIANTDELVDPRVSLRNVENITYPGKDHPAAAEVRSGMLERKSKYLKSYTPGW

SEQ ID NO: 32243 - protein, 132 aa, A.fumigatus
LDIRYVLSPTHLHEFKSADRVAWQTPVMSLYLPEQKLGSHSQPDSTSHKFMLKGRQTGPMHRGHSWVFRAESHETMMAWYEDIESLISKTGEARYAYVRRHVRTVNRASASTTLIWMKTKPIAHRMQRRPVG

SEQ ID NO: 32244 - protein, 354 aa, A.fumigatus
QSSWELITTHLSSQQLGEPFNSILWRRAEKMCLIEKYTDVYPMEIRTRTVIRRCLFSDGRGTCDRARVYDRGEFYHVRQSQQGGPRRMTSPRIKTIVPRNLSETRCQEEHRHPSPTWRLSQARSRSYSFRIPISRRSSETSDRETLCERRGRQRSPHPIVVDSPEVEERTPRNDRPDSVRIRCISPQAGRAPTTTDREQANDVVEIPRQARSQQPSREQRPPRERTPVTEREPVQRRPRRSLNCVVDIHNDAAASQDRQRQSAEPRQVRFSSDVEYEMNVNSTRARNRSAAFHQEESIDARAPTHRSLFTQQPFCKRRRQQEQRGRAISRESNPYPRVHSSQSRKGEDSRIQED

SEQ ID NO: 32245 - protein, 70 aa, A.fumigatus
  UNSURE (41): Identity of amino acid sequences at the above locations are unknown.
RDMENSPLCPARFISSEDGTRREFKKSKHDDKRKAITLCPXFHELFSAPITLVEHVQVEPFDPLLKSTQL

SEQ ID NO: 32246 - protein, 86 aa, A.fumigatus
GHDIGYPTWHQKMALHQFDYLFALGTIFAFLDAYNIGANDVANSWATSVSSRSLQYWQAMVLASIMEFSGRYVCSGTGIAFPFGGY

SEQ ID NO: 32247 - protein, 178 aa, A.fumigatus
LFCNSIGVGARVADTIRTKIVDVKAFEENPALLMLGMVCAVTASSIYLTVATRLGMPVSTTHSIMGGVIGMGIAALGSDGIQWWGGDINSGVVQVFLAWIIAPVLSGAFGAIIFLLTRYGVMERKNSVLKAFISIPIYFGITSALLTSMVPGPSTMLDDTDWHSAYRVEGWFQQNQAH

SEQ ID NO: 32248 - protein, 393 aa, A.fumigatus
RLSSPSLSTLASPPLCSPVWSPALARCLMILTGTVLIVWKGGSSRIKLTDSETTGVIIGVGAAVALLVAVFFLPWLYRRLIKEDWQLKWYHLFMGPLVLRRGEVPPPPEGYKTVQDYYKGHKTLEELERERANIERAGPSDEESEPAVDKEGKEGQAAAASVEIEEPKFTLIGPRPDGAAFSPAVLFWQFRRFFFRGIEQDVVSLQKKRNILTGDLEMVHAHARHYDNKAEYMYSFLQVMTASTASFTHGANDVSKYVSSRLCVLKPADRFIQRCWSLCHHLLCLVNQPAQVQESRSVLDPVSSHFDIHRHILINLRAFGGAAIVIGLWTYGYNIMRNLGNRITLHSPSRGFSMELGSAITVIMATKLSMLHPLCFTDHNRVFTTGLEGAALI

SEQ ID NO: 32249 - protein, 115 aa, A.fumigatus
RTLAGPRACNKKDPVTHHHFGFCYTSLAFSEVLIHSVMSPINPIIPGFAPDPSVVKVGEWFFLINSSFHLFPGLPIYASQDLVSWRHIGSRSSRDEITSAKLMQHQETQLIANLS

SEQ ID NO: 32250 - protein, 472 aa, A.fumigatus
NHQCKTNATPGNAINRQSQLSLSRSKTELHPLPTGEVLVATGGLYAPTIRYHDGTFYVVCTNVVRTVTGDSTQNFIISSKDIWADSWSDPVYFEFDGIDPSLFFDDDGKTYIQGSAAPGPFTTINMFEIDLGSGRKLSEERTIWRGTGGIYPEGPHLYKQKGYYYVVIAEGGTHEGHMVTMARSTDIWGPYEGCPDNPVLTARDTDEYIQYTGHCDVFQDDRDQWWCTCLGVRKDKNGRYVMGRETFLTQGRWDGDWLSLDQVKPMPSGLLSRGEGKKLVANPSVDYVYIRDAILSNYTLPSSASDGLTLTASSADLSHPEKSPSFIGKRQRHLDGCSGVELDIVEATWMATKLRAGMACYKDEHRFLRIYYDATELAIVTETINKPKGICRQERLTLESLPKSIAFRIQYTEQEYRLFHTVGNAGQANWKCVSTIDTLNLTGPDFTGPVIGVFAVAESTDTEVRFRNLTIC

SEQ ID NO: 32251 - protein, 111 aa, A.fumigatus
VVTAAPSSRSCTALLTTCQPGLCIPIQVPYNSILQLSVSMESVRQSCRPKHQVLVLKCYPQYQKGVQDVKPNSSELSYLLYYVSTRRSKLTKVGAFLEKRAARDVWRNKLG

SEQ ID NO: 32252 - protein, 445 aa, A.fumigatus
  UNSURE (444): Identity of amino acid sequences at the above locations are unknown.
VPSEPARSHQPSRWQSPLTYLGILHRNVQVTLQILTALIEKVPRDLPIYARSVMNVLETVLRSGDLSMVEESISTFETFCQHQDMAALSAEQDFASQYREVVRTYADFADQTKSVSQLKTAPSSPMVIRWRTAGLRAIKGVVSSEAGLAADGGDSLRILLPVILECLYNGDDSLLASLELRLHESEKNEPALGRRRRISTATVQTVDAMDGDPALASQSAADVDRQAEMDMRLLALRCLERIVVTGSSRGQIRVTTKVVLQFILGNSPLSEDGKPMHMDSTGGWATSLVELVAKWCPVQVRFIILVSAMEMLLENQPSEETLQRSHALIYLIDWLLKSPVNMIGLSVIDILLGLMQFMSTLLSRPASARSAEQGLDEKLGDHDLVLSPERLKMLALLQRTIGDLTTHIYYGDQVVDMVRTILTRVKPSSSPRGWKVPKRLAQGXF

SEQ ID NO: 32253 - protein, 181 aa, A.fumigatus
DLWTFQPAVVKTNYWAIKALNASRSAWMSAWSFRVWRSASSLQTVSYLVFTPVIETRTGQIVVRPPRFGPGSSDRPPPPSPYLHLAGASPAPSPASRVSASGSPRPAGSPCHWSSCPGGASARQMVSWAALATTPPGCESRSSHASAARCGWPRGCGSPPRVAPFPPRNAAAPAAAPLPFP

SEQ ID NO: 32254 - protein, 282 aa, A.fumigatus
GRQTMAFRLSSSRPPPLHIESNGRTASASSSDSKHPKTPGNKISSFFGWKAVTTSPSAESSSTEISDSGRSPLPSPMPPSMPTTSFSITPSTTVPFDPTRVPARNPSLSGASILEAASASKLADLENELREISSELAGSIRREMELEDLVERLQSEIPQDANRRTSDYFSDSGTSSIRYIYDASGKIDDLDKYRRAAEQERAQLKVELSQKWQEERARRAATESHVQILESQVNQVWFPPLVLSALAQLMWSVTTRESRVLRPIIQGSGARDCSGRYPQKTG

SEQ ID NO: 32255 - protein, 111 aa, A.fumigatus
PRAEDAKRWHSVYHPAAHRLCTSSPTVEPHRPAPRTRNIPRPLGTKSAPFSAGKPSPHRPARSPRAPRSRIRAGPLSHLRCLLQCPPPPSPSPPRPQSHLIPLGSRPATPP

SEQ ID NO: 32256 - protein, 523 aa, A.fumigatus
CGQLRRERVESSDLSSKARELEIALEDTRRKLAEERQIKDNFEDLLTAMRVELEQLRNERDHLRDNVIPQLQQQQQQPPQSTPAPESSEIQRLLGEIEALKIENASLAQLQGSRFASIAEEGGLPQRRPAGLGLSRSNSLARHSKSSGVGGLSRSNSLSRSNSVSTKDRPDRETLADRMEDVEAQRDALHQALRYLLMRQEQQAREYEKRLKLMELELARAQELGSPRRLGYEREVRNLREEVNHLRQRAEDALEQKWQCEKGLAGLKMDLDRAEQETTSLRVLLQEHDIAFPEGTESERDGFAEVIATSSYLEMAYKQLQAEREVVEASAAHSPLVESEAFAASISRTEALANHVQQQLQRNNSLRNRLAKAIGKGEKDQQLSAARINELQARLKEMEEALLLAQQHSEEEMARHEEEIRNLEASHNAQLMRVKNGSRSPAALSPKPPSSPFGARSPRLDKTTSGKGIPLDEAIQRQTLEKRVKELEKLLRDADTEMEEVVGRMNRAQIEVAELQSDRYVFL

SEQ ID NO: 32257 - protein, 193 aa, A.fumigatus
LNAMELWTWILFQAHQMPIHTTGLSGRYQCLCPYLSVVQKMTDLCLLFQKVLNLVLVAFHACMATLTAASITPAYEDIAIEFGKSVQSASYLTSLQIAILGGAPLFWKPLSNRFGRRPIFLLSLIISLICNVGCAKSPTYGSMAACRALVAFFISPAAAIGSAVVTETFFKKERAKYMGVFTTGMGGSMGVSI

SEQ ID NO: 32258 - protein, 422 aa, A.fumigatus
RNPSEALSSSFDPSFSVSLLGNVSREIGSALADGLNRLDLSQLSESSASSSSESASFDMSSSEGAPESWISSFCSLMGHEFFAEVSEDFIEDDFNLTGLQSQVPMYKEALEMILDVEPEEDEDEEEEEEEEEEDDDEILGDERPPGYRRAGDRRHARVASDLSVIESSAELLYGLIHQRYITSRPGIQQMLEKYEMQHFGVCPRTYCNGSKVLPVGCSDTPGQETVKLFCPSCQDLYTPPNSRFHSVDGAFFGTTFGYLFFMTFPDLDIGPRLDPSMLTAAPTNANNQSRSSSLTSGVNRATPDLPPPPPNQPTEINGVRTSNFCPGLGPGRIYESKIYGFRVSERSRVGPRMKWLRMKPADIRELDELAQYEAIHGSANDGGDTEMNIEAQNAAAIAARKKAPMRRRRHHPDQMSINGAEG

SEQ ID NO: 32259 - protein, 501 aa, A.fumigatus
  UNSURE (491): Identity of amino acid sequences at the above locations are unknown.
FEASAASKTPRTRMPRSVPPNISPLPQKDDSSLSASEYPNIASRTAPPSPSAVRRTHSLLSETHTGYQSLESQMEAGETTSLLGKTRENHRGTPRRSYTSISAIPTPDNYLRHSLTSGSLRRSRHHSRANSQSLRFSRRSSIDDEQDEDLPPSAKDGMTASFLDERNWYDQFTSTDWVHDSIADGARLRELRKRKDFRGRLLAAFDGAQGWILVALIGCITAAIAYFVDVTEDFVFDLKEGFCTTRWFHNRESCCADTLDCSRWRSWSQILSPSGSDNGWVDHSMFVLWVVILSVISCYLTLFTKTVVPSSVSLTTLDENLGAGTSRGTNHDASEDNSPASLINPKAHYPTISTRPAMTYYSAAGSGVAEVKVINSGFVLHGYLGFKTLVIKTIALVFSVSSGLSLGKEGPYVHIGACVGNIACRLFSKYNDNDGKRREVLSASAASGVAVAFGAPIGGVLFSLEKISYYFPPKTLFRTFFCCIAAALSLXIPQPLRHYQR

SEQ ID NO: 32260 - protein, 750 aa, A.fumigatus
FLSPPAALGCYDFLSVLLTKIPFSFFLSLLINRRSRLALHNMSAHTAKRRKLSPRPENGSTQKFSSDGRDAELSKSIRSNRKVQDDRAGELALASGLYKSSFFKLQLDELLSSSKPNYDKQVSRVQDTLHRVKEAIEQLHERPPMLPCEAERELRTTHGIVVPFPDPRPSRETKYSVSYVPPTNINVVGSFASKTGIKQTEKYTIDLAVTMPRSLFQEKDYVNYRFFHKRAYYIACLAAGLREAQDLGLDVKFATQEGDSLRPVLILEPSSATSALALARSQIRVITAIEDDLFPISRTLPTKNNVRHVSSENTGNSEPTPFYNSALRSEATVGSYHKHLHSTIRQCDAYQDACLLGRIWLRQRGFASSFHMGGFGGFEWALLMSLLLEGGGANGKPVLLKSYSCYQLFKATIQFLAGRDFTKPLLFSTVDEVSVPGDGPVVYDGKRGINILYKMTPWSYAFLRHEAGMTLKMLNESRDDNFEKVFIVKVNEPMLRFDRIIVLPSFDNRNILQAIRNQRAIYGVLLRALGDRVKLIHISSRSIEPWSVLASPSSKKLKERISVGLLMNPENVSRVVDHGPSAEQKEEAASFRSFWGEKAELRRFKDGSILESLVWSDHPSSKSIVFQILSYILRRHFNFVDEDIHYIGDEFEERLNSYGSGIISYTSPSFQLIADAFSSLEKSIQDMEGVPLTVRHLAPASPLLRYAALRVQHPSSISGERVDVVLQFESSARWPDDLVGFHSAGRRSMY

SEQ ID NO: 32261 - protein, 273 aa, A.fumigatus
  UNSURE (239): Identity of amino acid sequences at the above locations are unknown.
VMAQDHTPDAVPVNEKDPPNQQLDDTTSDRFVPLAGFPRDEESGVNNGVDPRSKSLSRTATNTSHIGTLAARTLSLVRTRESGKDIGPPPDGGLFAWTQVLLAHFVIFNTWGYINGFGVFQTYYTEHLGRPPSDISWVGSIQIFLLFFIGTLSGRATDAGFFKVTLATGALLEVFCIFMTSLCTEYWQLFLTQGVGQGIGCGLMFCPTVALMATYFTTKRALAIGIVACGSATGGLVFXRGRRAPAATSWIRLDNARAGLHHPGHAPPPRWFF

SEQ ID NO: 32262 - protein, 212 aa, A.fumigatus
NNGCRPGRAARWWNGPPSRSCRTCFLPSGCSSISGGSTSASSTSVALARNIIGVSETTSVYILLVMNGIGILGRLMPNTMADWYTGPLNMLIPFSLVTGLVSFCWAGVDEIHGLYAWSAFYGLAAAGIQSLFPATLTSLTTDLKKAGVRMGMVLSVVAVAALIGSPIAGALVQTAGGQYLYAQMFMGSAILAGTLTLIAARVAKLGFTWHRM

SEQ ID NO: 32263 - protein, 73 aa, A.fumigatus
PTVYLSQEDVSVPSLVLSLSSSTPPYDTTLSRLQQLQDSVFYLLIGGVNSFSSLQPLHSWSFYAICATSCIST

SEQ ID NO: 32264 - protein, 193 aa, A.fumigatus
RARYLPARVVKIPASSPLRSKSQDWTTWLNVWAIAIASDIRVGAVAMLTAMTAPLAMAFLLYHTYLIWAGMTTNESAKWSDWKEDVADGLVFKSTRSEIYGNQSHSDEDTPAQRTWPVSSDQILVITDGEPPKEGFQLCSRSNEILQKDDPQAPVDTRWTEVNSMREIDNIYDLGFWDNLREVFHMPIRRCVR

SEQ ID NO: 32265 - protein, 693 aa, A.fumigatus
LMINAWSICYLLGNRSFTKHIRRATSGMLYLVISDCETLSDCFTYNRHNLGLSPDIWQGFTDVLTKAIPVLESQSFAWKSPPSANYEHSSSNLIAYNYFSLVKDIERLNDLCTIARNLLATTKKAQNIAAEKGFDQRILALVDTCVRVTARGFDGETNARNEERWQKVVNLYKRLLITCLQFLHNFIMHNEQRKMVLWLDLFGYHSTGDSNIIQPREPLDQANAQAEGVAPVVKIGERIVNPPIRALYDQTAEDLLLETISNFPREPATIKEEAAMLLLANIKDHMEKLLGRDLTAIQEMGKDPEQVKEIRAALTAILGAKVDGWSDLQDRARDLPPALPEDEPPRKKAILTIDRSQTAGFPRICWADLPDLNEYGALAAGDAPITEEDTSMPRSAQSAAETLQEAKDELMARLQESSQIADHGDQDYDAGDAGTIGDDDSHSLEAVADGSMEEEEEEDDEDDEDYRGRPGDQQRGLLTDIPLVLGPAEIEALPMIIQAGIVDSFGLKGGERTGSRNMQALRCHILLTQETGRNLLRELLIFIAAWDLPDDELYFKMMVQIMDAVLKNGLMSHAYSDFGQPKDIISPAQAVVVKILTHIFRAKYSPASVTGAAQQSATKNPAPLSRVDILTVRYIFTIFRGNIIPETCALIYLQGQIRAGRALPEDFPLNLWDMERDLRRCLPVFGVALLWLQ

SEQ ID NO: 32266 - protein, 114 aa, A.fumigatus
HADSPIHPKSFVCNCKMAADEVNGAPVLEGHDTKAFPKSVAAEASTSSLSSDEPRRYKNADSAFDTSEDPRYYKPIPTYEGIHRWDPDFEWTEEEEKRLIRKVLQTQFSLYKQY

SEQ ID NO: 32267 - protein, 81 aa, A.fumigatus
LVLSRVQSCQEYLKMAPSLVENVALRTAPVTKLKTDAGFNKENVLGYGEAYSHENEVKGTEKQPPASFPHYLPVWDNETER

SEQ ID NO: 32268 - protein, 63 aa, A.fumigatus
ACSLTSFSLEIHNNNYHPVESDNGNIRKRSMLVEYLLSASYKDWLFLFNLHVSSKLSRLQSIL

SEQ ID NO: 32269 - protein, 77 aa, A.fumigatus
HTSMHTDELEGNGKGDVILFEPSTSEHVSTRTIFDPITALAPASDCRTYAIGYVNNLHWNKEDGKDDGVMGMYIVVD

SEQ ID NO: 32270 - protein, 374 aa, A.fumigatus
TAVVLSAVEDTLRDQKADFSATAYFAALLALLAQSVSATQGIVNKDLATSVVYLLDITTEYVPAPILRSKFSQILTSLAPALSLPEVDAPLLRPSIGCLESLLIAQDAASWNLPHTQIGPRRAIAGLLSLAVDHRPKVRKRAQEALIKVLKNPPPSPSLDHPAADMCAETGLRTLGDSIAAAAKHKRGRHDANSRENHDPLVIHSLQLVKTIATASGGWPSKKIEPLCELLMNASRSSNEFITMGAFEVFEVIFSSMADEFSSSKLPRLLDAISELKPAQNDSQLLPPWIAVLSRGYDVSAQISPEDTFEKLPALFNMISGYLASPSMNIRVSASECLISFLANCIPKNVILEPSVYDEKTVEKVPSFHHANGA

SEQ ID NO: 32271 - protein, 62 aa, A.fumigatus
QMTLPHTHESSLIDVDATLQSLLEREDTDRNMQITIEDAGPKVCGLVWLLARNGASHISSDG

SEQ ID NO: 32272 - protein, 93 aa, A.fumigatus
QGHAHLLVQNYAGDIKGKVIFTTGVSPGSLGSHFAQSIAAAGPRCLNLAGRNRSKIQQAADEIKASHPSVETHLEIDLAALDSFRRAASQIHS

SEQ ID NO: 32273 - protein, 612 aa, A.fumigatus
GCWTEGMWLGLAIGPERCKSYFERRLIGAIQVLSVGTAASSGYNRFDVRGTYMLSNLLQELTIAKDYGRKHIILDEARLSENPVARLSRLIKNSFWDALTRRIDGSNIEVAGRDPKDWTEDPRPRIYVPHGAPEQFEYYKGIAKEHPELRLDVQMLEENITPDYVRDLNSKPGLLALAMQKKYNESTQKTECVGVPFVVPGGRFNELYGWDSYMESLGLLVSNRVDLAKAMVINFCFCIKQYGKILNANRSYYLTRSQPPFLTDMALRVYERIKNEPDAMDFLRNATLAAIKEYYSVWTAAPRYDELSGLSRYRPEGRGVPPETEPTHFTHILTPYAEKHGMTFKEFVQAYNEGRVQEPELDEYFLHDRAVRESGHDTSYRLERVCANLATVDLNSLLYKYEVDIARIIRTYFKDRLEIPPEFRTESTKDIESESSSVWDRRARRRKVRMDTYLWDEEKGMYFDYDTVLQKRTTYESATTFWAMWAGLATPHQAAELVRKALPRFEVYGGLVSGTEESRGAVGLDRPNRQWDYPYGWAPQQMLAWTGLLRYGYQEEAERLAYKWLFMITKAFVDFNGVVVEKYDVTRPIDPHRVDAEYGNQGVDFKGAPREG

SEQ ID NO: 32274 - protein, 62 aa, A.fumigatus
  UNSURE (27): Identity of amino acid sequences at the above locations are unknown.
AFGKPTLSTDSYLNYFTLTFGATPKRXKKGKIFFLKNPQNPPPPLFFWGPPLLTPPAPNLGF

SEQ ID NO: 32275 - protein, 238 aa, A.fumigatus
PISQQNPDKEQFSGQRTATPSPALRLSDAARVSSPIFSLGALDYTSEDFNRDEKIQAMGFVGEHSEIAWIYRLKRLLEQVSVGSKEIDTDRQSVASASFFLDDSDITVLDDIDLSQRPAQTVADQLVDEYFQVVHPSFPIIGKLVFLRQYRSFYSSPHVRPGKRWLAVLNLVFAIGARCSRYSQGDNGGVTDDETLYFSRAWRLSMSDIALLDHPNLQQVQVEGLTSFYLLSVGQVNR

SEQ ID NO: 32276 - protein, 100 aa, A.fumigatus
VVFGIRWCDGSLRLSYALNRLEGQCNHRRGKFFAVGATASHIALSKNVFEALFSSVRVITYNYHDTWLDAAETFTTVMWLIAGPNCAQNARLRIPIDHCQ

SEQ ID NO: 32277 - protein, 384 aa, A.fumigatus
TGKCSMQRRQFLVSCLTGGVLTIPRSWRICGISLRSAVTMGLNLRSESNTIAHVSKETRYRVWWSLFMLDISLCVMTGRPSSSSDEFCTTPPPLPFKEEDFSDDRVVQLIADHEARGLFTEALGKTTATAETALTPDLSDHPSNMNRDCEQVASSAIESLTPNISLYFLYNVELDLILREAVVTLYAPGAARKSWHEIELSIVTLNSKADVWLSRLPAAFHFETGARVFERQRLNLAFCFYSTKIIIAQPCFSRLTRQAPGSEPPGVACETMATMCVDFAAQMLNLLPTIPQASWVYRVSPWWCFLHYLMQSTTVLLTQILLLSEAGTVKYNRVLEQLSKATRWLSELSTNDPSSARAWLFCRDLISQHAPELDLGASIENHRN

SEQ ID NO: 32278 - protein, 147 aa, A.fumigatus
  UNSURE (17): Identity of amino acid sequences at the above locations are unknown.
FVPELLYTNLWRHPQKXKKGENFFFKKPPKPPPPPFFLGPPPFNPPRPKFGVLKNFGPQKRPRGGFSPGKFGAPPGGLKFFPKKFGGFFLGGGGGGRKKKGKKGAPGFFPQKYFSPKNFFKNPPKKGGALPPKKPPQKFFFFLKKYF

SEQ ID NO: 32279 - protein, 164 aa, A.fumigatus
LLVFWRIRKMMLLLMLLLFTLCDIATAGSVSVEDLTLNLDLDRRGIALSTEPPVDQSLLAIQIGGIVGAYVIFVAILLTLLLFVGRRLRRAVQASNYTLQVEMMKPSKQAVSMDPSPVTPVSARLPSPIAQNGFNRSWGSLANGPRPHVSGNGSAATIDESVVA

SEQ ID NO: 32280 - protein, 63 aa, A.fumigatus
VLSHTQILRNASECITVKYADLVTIDLSEFDQPGGKEKLAAQLKDVVHEVGNFFFPRCLLPDY

SEQ ID NO: 32281 - protein, 91 aa, A.fumigatus
FCWGPLAFFIAYCIAVQHPLRHALQLIMSTGQVYGDVLYYATSLFDLYFHGVIFCRPERYYFWFYYFFMNFIWIAIPSCSSALNYVPAVSC

SEQ ID NO: 32282 - protein, 204 aa, A.fumigatus
  UNSURE (175),(194): Identity of amino acid sequences at the above locations are unknown.
RMWFMKLVISSFLGVSYLTTDSPGFFYVTNFGLTQEQVDRQFAIAKEFFSLPEEERRSFRAPLEEGIYNGYRPLGSIEILPGLRDNIEFYNIMKFLPQYERTHPDVIRRHWAEIEKFHRHVHEHIAYRLFRLLAIVLEIPEDELEKGHLYDSNCDSGLRNMCLRARSAEENEKYXSLYSRSHTDNGTITFVFQXPVAGVTGQKT

SEQ ID NO: 32283 - protein, 101 aa, A.fumigatus
VMKHLHPTSVHTCGLYFYPLSVRPITSCLDYRFRFQKEYSGLTSTRCETYFISAPELDVSGEILLDTHASPRFVSCRWRTESLWFADFANKFVIEDNFREN

SEQ ID NO: 32284 - protein, 84 aa, A.fumigatus
THALSFGPALMSFLDISIGNLLSKRKTYLRNRTRLTSNNRGESPMLCRMISAVKTTLLGLETAIAIAEPAIRTDQPRLALSERP

SEQ ID NO: 32285 - protein, 93 aa, A.fumigatus
SINLNSESITMKANTMQSLSVGHTRIAIAEVTIFSFIQLVQFITRFMQEWQYWHHRRERNVRRCVLYSWFGMLGILAQRKCEFTCPLWSLGQG

SEQ ID NO: 32286 - protein, 220 aa, A.fumigatus
SHGLTNDLLAGWLIPFPADLLNAHAQYVELYINQLAYSVSQNSLPLNLTGQLGFERLQCLWQSVENIKSWLGHFYQIPCSDLVGQPFHFWSQMILTVTLLKYLSTLHDPEWDCQAVRGTVHLITTMDSMVQKLDLSSKVPEYQCDDHLLKFLSKLLTRCRRWAEARWHDEETWPGRSASSDTTGHNHPIPELDQMVWMQSMDLGDDQWFENVLGMPSAFY

SEQ ID NO: 32287 - protein, 524 aa, A.fumigatus
KLGADSSSPVVKTYCGSYGVEYIHIPDRKPCDWIRDRFEIPEPYKYSVDDKRRILDRLIWSHSFEAFLATKFPNDKRFGLEGCETLVPGMKALIDRSVEHGIKDIVIGMPHRGRLNVLSNVVRKPNESIFSEFSGSAEPSDEGFGDVKYHLGMNFERPTPSGKRVQLSLVANPSHLEAEDPVVLGKTRSILHYNNDEKDFNSAMGVLLHGDAAFAGQGVVYETMGFHSLPAYSTGGTIHIIVNNQIGFTTDPRYSRSTPYCSDIAKSIDAPVFHVNADDVEAVNYVCQVAADWRAEFKRDVVIDIVCYRKQGHNETDQPSFTQPLMYKRIAEQKAQLDKYVEKLIAEGTFTKEDIDEHKKWVWGMLNDSFDRSKDYQPTGKEWLTSAWNGFKTPKELATEVLPHLPTAVDASLLSHIADKISGAPEGFTVHRNLKRILANRKKAVDEGKNIDWATAEALAFGSLVKEGYHVRVSGQDVERGTFSQRHAVLHDQENEATYTPLKHIAEDQGSFVISNSSLSEFGA

SEQ ID NO: 32288 - protein, 187 aa, A.fumigatus
LFINSIAIALVIFFSKSLLRHPIARSDIEEFTGDSHFRWIIPDPAHGSTIDEPEKIERVILCSGQVYATLVKHREANGIRNTAITRVEQLHPFPWAQLKENLDSYPNAKDIVWAQEEPLNAGAWSYTQPRIETLLNETEHHNRRHVLYAGRPPSASVATGLKSVHAKEEQDFLQEAFTVHQHRLKGE

SEQ ID NO: 32289 - protein, 184 aa, A.fumigatus
STSLRIRAASSSPTLPLANSERKLTSTLTSLPLLSQANLFSSLGFEYGYSLTSPNALVMWEAQFGDFANNAQCIIDQFIASGESKWLQRSGLVVSLPHGYDGQGPEHSSGRMERWLQLCNEEPRQFPTQDKLDRQHQDCNMQIAYMTSPANLFHILRRQIHRQFRKRKSWFPASLNDSSLTQLP

SEQ ID NO: 32290 - protein, 137 aa, A.fumigatus
RVIQGGREPRLTLAELAVDLATQDVEKIGRRGHVGNLHIAVLVLTVQLVLSGELARFLVAKLQPTLHSTRRVLRTLAIITVRQGDNETGALQPLGLSRGDELVNNALSIIGEVTELGLPHDQGIRGGQRVTVFKTKA

SEQ ID NO: 32291 - protein, 202 aa, A.fumigatus
LLQIKAPKTIIQQWLQRPHLLALQTMLVDSECFLKEVLFLLGVDGLETSRDGGAWGPTSVEDVATVVVLSLVQQGLNTGLGVTPSTGVQRLFLSPDNVLGVRVAVQVLLQLSPREGVQLLNTGDGSVADTIGFAVLDQGSIDLATAQNDALDLLGLVNGATVGRVRDDPPEVRVTGEFLDIGASNRMTEEGLGEEDHEGYGN

SEQ ID NO: 32292 - protein, 535 aa, A.fumigatus
ESKGKLVNVEVNLRSEFAKGRVGDDEAALILSDVLQGGIRSLVLLVVQNGVTLGEGTTFNVLTGNTDMVALFHQRTKGEGLRGGPVDVLTLINGLLAVGQNTLEVAVDGEALGGAANLVGNVAQQRSINSGRQMRQNLGGQLLRSLEAVPSRGQPFLAGGLVILAAVEAVVEHTPNPLFVLVNVLFGEGALSNQLLDILVKLSLLLGDALVHQGLSERGLVGFVVTLLTVADDVNDDVALELGTPVGSNLTNVVHGLDIISVHVEHRGVDGLGDIRAVRGGTRVTGVGSETNLVVHDDVDSTTGRVGGERVEAHGLVDDTLAGEGSITVQQNTHGAVEVLLIIVVVQNRARLAKNNGVLGFQMGGVGDQRELHTLTRGRGTFEVHTQVVLDITEPFIRRLGGSREFTEDGLVGLTNNVGQYIETTTVRHTNDNVLDAVLDAAVNQRLHTRHKGLATLQTETLVIGELGGQEGLEAVTPDQTVKDTALVVNRVLVGLRNFEAITDPVAGLTIRNVNVLHTIGATISLHHGAGRIRA

SEQ ID NO: 32293 - protein, 375 aa, A.fumigatus
LVDTFSVGHRRNAEHDVKPKEQVIVWVDHAGHTIGIEHKHQTPTATFKSVCLFATDQCITRLNIKLTPRQSPTELPLLPNTDNIIPDNPLPKLTVEVPELNTNRGPRFGITYSPYTSHGTCKTFDQINQDIEHLRHHAFIRIYGIDCDQTKLVTQAARQHGLKVFAGVFDLHNFPDSLHYIRDAATAAGGDWSIFHTIAIGNELVNKGQNKPADVVNAVNTARGILRGAGYQGPVVTVDTFSVMLQHPELCAASDYCAANCHAFFDNNQLPETAGEYALDKARRISAAAGGKKTVITESGWPHAGQPNGRAVPSPENQKKAIASLRKAFADDPDLVLFTAFDDLWKSDNQWTFGAERFWGIQDMGREREREQDRE

SEQ ID NO: 32294 - protein, 82 aa, A.fumigatus
QHRIQQYQQDIFNELRGEDELVILARGLGLLRLVTNLLHFYDAAGNNLVLVVGADDRENEWIGEGTEYADFNTLQVSQKLRD

SEQ ID NO: 32295 - protein, 159 aa, A.fumigatus
ATSAMSHSSLVLIHHYQSMAVTLTHDKSQEDPQEQFLRTVNTRIAGGGRLAATASPPRVVVDVREFRSALPSLLHGNNMIIVPCQLTVGDYILTPDICVERKSVRDLITSLRNGRLYNQAETMLQHYKNPLLLIEFDQNKSFTCDGLQHVDGRIRRGLS

SEQ ID NO: 32296 - protein, 165 aa, A.fumigatus
RHPRIVATSTEAFIIRIYRQINKSGFLKAFSDSPEPFTTGFAPLANYMRNLFLRKTSLWPRFHVTVAESLEGHRKAEVIELEVPMTDKMREIQNAVLECVEISIAELKKANTGLDMADWTLDSALHRSFDIAIRRQLDPMWHRVSFRTRQIVSDLSDLRAILQYV

SEQ ID NO: 32297 - protein, 428 aa, A.fumigatus
VLGPGRLSATCLIFARFFSTFDCPKHALSGVRIGTHYWYSALLTYDAVSFVKYLDTIVTAHSPPPGSTRHNYSPWLFLDAAHVLFQTAKSRVYEGKITRDAANTLDSTLQPVLEEQPKWAVLAEVLEEIEQDAYLNPVSTDGSNSTVLIMCTDQRTCRQIREYLGTMHARIGKDKAEDPGDLDAMSEKKFSAEVMLRRRLREYLDWKTSLANVNRNLSAKSGDDTQNAKGQESPKPTSQQGRAPPNKRRRVRGGGTVTSAAARVPNASVQTDTELPGQVSSLLEELQPTDIEETQKGEIISDDLEDMEDFFELYDMDDLVIVHPYDGDMDEHILEEVRPRYIIMYEPDAAFIRRVEVYRSSHVGRNIRVYFIYYGGSVEEQRYLSAVRREKDSFTKLIKEKGVSDFGHVSLFPCINSSLPEHGCHPHP

SEQ ID NO: 32298 - protein, 286 aa, A.fumigatus
LLQRTDGSTSSSAAKNQASRTSSNTWKSHRNQPRKTYDKDTFPRPLLRNRSASRSASTSSSKWSDRGGDVQPFIALGMAHQENGAPGVRLATHLGVPGTWSRDHGLQLFSMGGDPAELRGFMVKNPGLLPGMKTLRSGAIRRRRREMAAIFSGCWRSCFETGDGTGLHHVPEDLWSETVDYREQPFVADAIIANPPSFAHISCAEKLGVPLTLMFTMPWTPTQAFPHPLANVRPTRTKRSVANFASYAIVEMMLYEGLGDLLNKFRKRELGLDPLEPFYFTPGWKI

SEQ ID NO: 32299 - protein, 70 aa, A.fumigatus
GGRWGGPLGTTIATPLCTSPSSDTVRFTGETGQVSAQRLQATVLDPEGIGHVCCRCFHDCHDNYWLKSEY

SEQ ID NO: 32300 - protein, 90 aa, A.fumigatus
CLKSQDTSCALLSHEVPQCISLYTWDLDSPKDAMPPQQPTGGITTADWPQQALSDLVAADRHHNPLLDHGMNTGVRITGMMAVSAEKQQS

SEQ ID NO: 32301 - protein, 223 aa, A.fumigatus
SSSVRTIKAPIPVPIAKETKTRFDQISTLFQNVIPDVTGLNSWRYQRQLSGAIQEFIEALSFNHYLQTQSLISHAEVSKHLPAEILVTEEDYLLGMFDLTGEMMRFAITSLSTGTMGQEDSGGDDLAARDISGAGAHHSLPKLPATQAGIVVDLREMRSSFELLSVPRRHANNMLRDMGKKVEVMQNSVEKVERAAYGILVRGSERPSGWTPDLSAPVDMEVY

SEQ ID NO: 32302 - protein, 134 aa, A.fumigatus
MQILSDNNHPKTVKPSGGMTTMTVNQSQFVLSPQKQSKLQQHHPMAGNKRSWEGNPVRVEKTQTNMAVAPVDQPSTHILSMFETFRDELDQHHDRRERVIKTSRDITALSKKMLVPCPVRPVCIHSHSSSIRGR

SEQ ID NO: 32303 - protein, 63 aa, A.fumigatus
LLMTGNILPHINAAPALQANAKELEKHMLADNLDQKLQRRPQPEELISQGILTEDEDPRCPAV

SEQ ID NO: 32304 - protein, 186 aa, A.fumigatus
REPRTAMVLARDRELLRDTLRTQRTALTAADRENILKPYLPDPSELARRPHRLKKPPRKAPIRTFLKSRLHQLTYTFIHIVYGIILRLVQSYHALVDQVLAIVYYHHRTPKLIRKDVKGLRRLPGHLTVVLSLRKEDDALAILMDEVAELAAWSVSAGIPMLSVYEKSGMSRHFTLGILASSSALR

SEQ ID NO: 32305 - protein, 204 aa, A.fumigatus
VVDHSLGILKSCIPMLHHVVASKFASYYGSIPQQPTLRLFAPHHSVYEPALDHDKARRVNTDSLTLLLLSATDGRETIVDLTQTLAEMSQNGKLSPGDITMELVDAEISEITTQPLQPASLSIGDRQTTAVHPTIAVKPEPDLLLVFAPFLKLDGYPPWHIRLTEMFCTGGKGSGVTSYGDAVEYQGFLRGLWHYAGAQMRFGR

SEQ ID NO: 32306 - protein, 365 aa, A.fumigatus
  UNSURE (34): Identity of amino acid sequences at the above locations are unknown.
RGERPTASQSRKKRSQVSVNHKPSTRLDCIGRGXSSRVYRVMAENYKFFALKRVNLEDVDPVTLAGYKGEIDLLKRLENIDRVVRLFDWELNSDKHTLSVLMEIGESDLEKILTYRLNAEDAVFDINFTRYYWKEMLECVQAVHNCNIVHSDLKPANFLLVQGRLKLIDFGIANAIQDNTVNVHREQQVGTPNYMSPEALIDSNASLGLPASVGKMMKLGKPSDVWSLGCILYKMVYGQPPFAKIAKYYERIMAIPNPKVQIDFPAFGVGGVAIPPGLIRTLKRCLQRDQTLRPTVEELLSQRDSFLYPDAQLEGTVPVNQDMLGRILMNVVHHCRTRGIPKDEEIAAWPAGFYAKIKAALEENT

SEQ ID NO: 32307 - protein, 292 aa, A.fumigatus
HDSVLGDTLVKGHIRIDRAIVLRSIGDLRIFTPYDLSACRDETQFGDVDFDDGSLGQDSQLGVQRVLRVLLDAQDGQLHGDAELRADKLSVGLQRKKLRGKEGSILRDIGLLVTQTHRPDETLVLDRSPGEVATDKCGLGDHPLPRLLVRLLARVDDLEHLLLTDTLHLGQGHRELGRLLSTLILDSTGQSLGVGRLPTVEQVLGQRGLGPLVGGGGLDLLSLPCLDAPAPLDLPGLTLLLVLLGPQAPPVPGHPGDRLVRFPGLGVLRKPPLLGSDLPYRGGFWPPAPIFP

SEQ ID NO: 32308 - protein, 202 aa, A.fumigatus
REYGGGWPKAATVREVGTKEGGLPQDAKAGESHQPVSRMPRNRRGLRAKQYQQKRQARKIQRGRGIKAREGKKVKSSAPDERSKTPLPQYLFDRWQATNAKALSSAIKDKRAEKAAKFAVPLPKVKGISEEEMFKVVNTGKKTHKKSWKRMITKPTFVGSDFTRRPVKYERFIRPMGLRYKKANVTQYAAFLPSKLFALQPN

SEQ ID NO: 32309 - protein, 99 aa, A.fumigatus
QFISPELGVTVQLPILGVKKNPQNPLYTQLGVLTKGTIIEVNVSELGLVTTSGKVVWGKYAQITNTPENDGTVNAYVTFHQCISQDRVMLIFVRRVLLV

SEQ ID NO: 32310 - protein, 66 aa, A.fumigatus
AFCVATQLTIYQPGARRHRATAHPGRQEEPAEPSVHPTGSPDQGNHHRSQRLRIGSRHDKRKGRMG

SEQ ID NO: 32311 - protein, 73 aa, A.fumigatus
FSSLYSWEAFKARTVIPTIKSMHLVHRSDLQVSRNRHHDFDEQIFTSAVDYLVYIHIRRSPSYGIYSVNIRIL

SEQ ID NO: 32312 - protein, 101 aa, A.fumigatus
  UNSURE (13),(29),(35),(39): Identity of amino acid sequences at the above locations are unknown.
LHYNLYQLDLPFXCILFFLGPHCEEKKKXMTFGTXRGRXALSLSIAFTTLATVFTIIRVYTRIFLVKQMGADDWAIIVALVRLSQEFHSRGRICRLTLAGL

SEQ ID NO: 32313 - protein, 145 aa, A.fumigatus
SNLCVFPTSTSIYRKNQTNSQLLDDNPGAAKWSAIECNVAIICACLPGIRAFITKLLPRFLSSYKSKSNTRTRTQRSHVTHFSNFHSSIADRQSKFHMQSVSHGPEGGDYKASGFEEGTSNKIKVTTIVSQESVSNDASSVRQLL

SEQ ID NO: 32314 - protein, 60 aa, A.fumigatus
FNSWGVWSLAQTLDQHGNISSSSHINSGYYYSITLLGIDYFRLSFNYLSAHEPKDVSQRI

SEQ ID NO: 32315 - protein, 135 aa, A.fumigatus
MITQALPSGPPLNATSPLSAPASLASVPLSPSSSLASSPATRARATPARGPNAAMLPTSPTSILPSLTASPNSTCSLSATARRAATTRLAVSRKALRIRSKSPPLCHRNPCRMMLRVCGSYYKGCYPWTGSFCHA

SEQ ID NO: 32316 - protein, 76 aa, A.fumigatus
SHPARNRSPGEAGSIRPQGRQRVVLRVPRRHDPGGPVVAPHTAPESGATGPAQPRRLPGRSPRARRHWPCTPRQCR

SEQ ID NO: 32317 - protein, 95 aa, A.fumigatus
TSQITLNMHFIYQALSALAASLLFSSATAGIAHCKVGEAWPDSSDCHNFYECASEGAPVLKTCGPGTAYCPTTGVCVHEENVPSCFHRGHHSEDE

SEQ ID NO: 32318 - protein, 338 aa, A.fumigatus
TVTMPRTRPRRLNHLQGINVDQMAQIADAANNDYLRLENLDVNIPPEPEALAYMQQAVADEACNSYLPFTGKARLKDIAARHVSQVSGMAYTGQRHCVISAGGLSGILNVLLATIEEGDEVILTDPTYRGLLNRVLLAGGVPKLVPFTFQPGQEWRLDQAALRAAITEKTTAILLMSPSMPSGGYLTRDDWTLVAEICVQNDLLLILDTAMERLLFDARPVIHPAGFPGMFERTVTVGSSAKELRMIGWRVGWIVGPEELISDIAAVCMANVVVPVGIAQEAVAVALDRSPQTLAPYVAQLQARRDRVVAELEGLPVGVPAGGWSLLLRVSDFGLDGS

SEQ ID NO: 32319 - protein, 275 aa, A.fumigatus
  UNSURE (207),(217),(224): Identity of amino acid sequences at the above locations are unknown.
GHDLELSINHPFKRSIENQVSISRYWLASSLLLSVAYSGISTYSNHPAVTKLPRSPSTCTSSTRPCLPWRPLSSSHPPPQGSRTARSERHGPIPPTATTSTSARPKAPPSSRPAAPVLPTARRRVFVSTRKTSPAASTEVITLRMSSCTLMRGDWYTARCIIHALETGLHVFLFWVLYHVLIEGDRLVPVIRIVWMLRLIIENSCHXYQYLSIACPXRFLQFCXYTNLTNLLRSNQTNMDHVHENRTTSSIQEDQAYSISGAPPHSSQIASLLDR

SEQ ID NO: 32320 - protein, 322 aa, A.fumigatus
VMIYGCVVMSLTSIQITELLLERWKSKRKHYLILSAAGKPIWTRHGDGGLISGYIGVILTIISFYEDANDRLTSFCAGDTKFVIVTKGPLYLVAISRLLESDTQLKLQLEALYMQILSTLTLPSLTHLFSVRPSTDLKRPLQGSETLLSTLADSFTKGSPSTFLSALECLKIRKSHRQAINNALLKTKVSSLLYGLVVAGGRLVSVVRPKKHSLHPGDLQLLFNMIFEAEGIKAGGGESWIPVCLPGFNSSGYLYMYVSFLDLRENSGTSASETTTTEQSVAIILISPNKEGFFEMQEMRNSLVEVCKSSSPRGWKDRRESI

SEQ ID NO: 32321 - protein, 91 aa, A.fumigatus
  UNSURE (57): Identity of amino acid sequences at the above locations are unknown.
PNASPGAEEVSRNAGFFVYLTPSAALGSITACNGHPQTCTSNSLKEKSDNEWEMGNXAFTLTNRRHGEKTIAYAESHDQALVPSRDLQCRP

SEQ ID NO: 32322 - protein, 66 aa, A.fumigatus
RRRSAPHRRYGGRAYETWSREGRQQGRYPTQRYHGTRQWWRPSERRWWRGQGQSDRQRARRRPGRR

SEQ ID NO: 32323 - protein, 293 aa, A.fumigatus
SSVSPLPRSAMSSVATNFFSLVGDKTLMMWLCDKEMYTHMSVLTEFTPTIERGMALHKMIRLVTHGLGGEGYLNFEGNEFGHPEWLDFPRAGNNNSFWYARRQLNLTEDHLLRYKFLNEFDRSMQLTEEKYGWLHSPQAYVSLKHEIDKVLAFERAGLLWIFNFHPTESFTDYRVGVEQAGTYRIVLDTDDPEFGGFGRNLKETRFFTTDMPWNGRSNYLQVYLPTRTALVCTPSTFPFVGDLRANKKLQCRSSPWKKHCSHLNGFMPRLGRGQCESLHIDIKYVALPNNLPQ

SEQ ID NO: 32324 - protein, 302 aa, A.fumigatus
  UNSURE (176): Identity of amino acid sequences at the above locations are unknown.
IMFKLTLRKIITFTVDDGLETADGVLEVDQLTLDTSEDLGDSERLAQETLELTSTLDGELVSFRKFVHTQNGNDILEGLVLLEHLLDTGSDGVVLLTDDTGVEHTRLGVERVDSRVDTQLRDTTGQDSGGVQVSEGGGGGRVSQIVSGHVDGLDGGNRTLLGGGDTLLHTTHVDGXGGLVTDGRGDTTEKGRHLRTGLGETENVVNEEQHVLTLLVTEVLGNGQTGKGDTGTGTGGLVHLSEHQCDLGFTLELNDTSLLHFVVQIVTLTSTPPNTSEDGVTTVGLGNVGSTWFALLKRSSEN

SEQ ID NO: 32325 - protein, 315 aa, A.fumigatus
  UNSURE (119): Identity of amino acid sequences at the above locations are unknown.
RKPCRTNIAKAHGGYSVFTGVGGRTREGNDLYHEMQETGVIQLEGESKVALVFGQMNEPPGARARVALTGLTIAEYFRDEEGQDVLLFIDNIFRFTQAGSEVSALLGRIPSAVGYQPTXAVDMGGMQERITTTKKGSITSVQAVYVPADDLTDPAPATTFAHLDATTVLSRGISELGIYPAVDPLDSKSRMLDPRIVGEEHYAVATRVQQMLQEYKSLQDIIAILGMDELSEADKLTVERARKLQRFLSQPFTVAQVFTGIEGKLVDLKDTIRSFKAIINGEGDDLPEGKFEHDLSSIIRNKVLMTFFSCLLHGW

SEQ ID NO: 32326 - protein, 235 aa, A.fumigatus
SSIVSRSSLSSICTRCCRSLLPGFPALRAASSSASSRFLVFKSSSSFWIAGLAATSAARWALLPYAPSSSALAIVSSVCTLTTSPSISVSSACRRLALCSAFARPSTASLTRDSMSTRSFSIASCSRETSLTISLNSACSRVALSSAATRESKASLIRASASLRTCCIVCSSCSTCCSARSPGLDSFLSSGVGLLTKLINQILQACDFTISLQASGSEFLCLRDAFGSKLFELGF

SEQ ID NO: 32327 - protein, 87 aa, A.fumigatus
SFELLDCQVEFILCTLSPLLRQFEVFPEMSDLLHQIGYVRISFRVRFGVQFSLLLNLSGQDALLFEELLDLAMKVINAKIQVFEMCL

SEQ ID NO: 32328 - protein, 286 aa, A.fumigatus
TAKSAETPRTLESNHGAENHLVEINARLHHIVGQSGSSRSQALSPPPASSGNGLQAHFEYLNLGIDDLHSQIEKLLEQKSILTTQIQQQRELNSKSDAERDAHIADLVEQIAHLRKDLELSEQGAQSAKDELDLAIKQLEALRQELNDLQQHKSAAEDHASALASEKEARVHVEAELSRLQTVIQELKQERDAQMEADEARVRAEREVARLESQLEQLRSESVSQTEELTAARLKADSEVTRLQNLVDQLRQEANTRAEEAVEARGPSRTTSTAAGADDAAGSQRC

SEQ ID NO: 32329 - protein, 324 aa, A.fumigatus
RLIVKSHACRIWLINFVRRPTPELRKLSRPGDRAEQQVLQLEQTMQQVRNDADARIKEAFDSRVAAEESATRLQAELSEMVSEVSRLQDAMEKLRVDMESRVREAVEGRANAEQSASRLQAELTEMEGEVVRVQTELTMAKAELDGAYGSRAQRAAEVAANPAIQKELDDLNTRNLELAEELAALKAGKPGSSDLQQRVQMLERELRETIDDYEVMTKASIEFEKERERYEGMIDGLRDRCEQLETQLNEERINWMGINNAMGRDGTYETTSTMVLKNEFKKMMRDTRIENMKILKVSYNVVAFRSHYAKLSYLCRRNKKNEGD

SEQ ID NO: 32330 - protein, 477 aa, A.fumigatus
  UNSURE (279): Identity of amino acid sequences at the above locations are unknown.
LTILRLGTINSLPPDLIYKSATQTALELAPNLRQQGADIIVAVTHQREPNDYKLAQNLPPGTIDLILGGHDHFYGHAVINDTHILRSGTDFKQLSYIEAWRKTDGPGWDFNIVRRDIVRTIPEDPATVALVSRLTSSLKAKLEKPVGYTVRPLDGRFSTVRQKESNLGNFVCDLMRFYYAADCAMMAGGTIRGDQIYPPGLLRLKDLLNCFPFQEPVVLLRIKGSALMDALKNGLSQLPALEDRFPQVSNISLVTTRPNPLARASLGQGSRTPDRVRTXLRPRDKGLHGPRKGRVRIASCEVCRRRGGRDCRRRERRDDQHHPPPILPQPPDLGQVAALEQKSIPALGQSPPESPLRGLAETRLRASLPRLRKGAQPAFRVTTESQTHKALLLRPVRQYRRQRDCGGPRRRGGGHKHGLGLGFGPGDLDLPAANHQLRHPACPLRRGRRTSTAACAPGGPEMDAGRWIRAHNTQYSR

SEQ ID NO: 32331 - protein, 82 aa, A.fumigatus
PCPRAGSAEPVGGVSRFQSVINYYRSHPRFTGLPDVLTFFSGDAFNPSLESTVTKGRHMVPFLNKAGTDVACVGVCERCTKT

SEQ ID NO: 32332 - protein, 249 aa, A.fumigatus
  UNSURE (25): Identity of amino acid sequences at the above locations are unknown.
LQPVRTPWLAPHWGKVAGHPIAFEXSYVLATRGYMARGKDGFASLLVKSAEGEVEEIVDEENGVMISTILRQYFLSLRILGKWQRWSKSLSRHWAKVHQNLHCEGWLKPASAQASPVSEKAPSRLFVSRPSLKRTKHYYYGRFANIEGNGTAGVREDEEEGTSMDSDSDSDPEILTSPQPTTNYVTLPARSAAEEERRLRLARRAVRKWMRAAGFEPTTLNTADDAQGFTPAWTPGIAPRLEGRIVIEK

SEQ ID NO: 32333 - protein, 287 aa, A.fumigatus
PNIALSSSSARLVLAIEFKGPFPTTQLAKASTPSNPSIMAPILTSSPTLRITPEPFTKEAFAPFGTAISCPLPRDLSSAPPLSSLPPHDPAPVIANQSSALKYSPISPLLDHYAQCPSTQPSSARMSMFSCFPRKLRTAKATGGETNVFDVRILERHPFTTQTFTPLDLSNQPRAGDAEEPFYLVIVAPTLKGQTATATTPSGDTVAIRDPPDLNNMRAFVARGGQAVTYGVGTWHAPMVVLGPRRVDFVVVQFVNGVDDEDVQEAAFGEGIVVDLGRSRTSGASKL

SEQ ID NO: 32334 - protein, 239 aa, A.fumigatus
GRHPTVKLGLEEQGRQFVSNDCFLGDSERIWLITGPNMAGKSTFLRQNALITILAQVGSFVPAEYAEIGIVDQIFSRIGAADDLFRDQSTFMVEMLETATILKQATARSFVIMDEVGRGTTPEDGTAVSFACLHHLHYRNKCRTLFATHFHALADMTDDFEALGRYCTDVKESASGSFSFVHRLRKGVNRNSHALKVAQLAGLPKETLEMASRVRESLGNRAPWSSGGSDSHPIVSATV

SEQ ID NO: 32335 - protein, 271 aa, A.fumigatus
  UNSURE (235),(246),(271): Identity of amino acid sequences at the above locations are unknown.
RKKEEFSFQYVPLRLVSHSPLSSNTIAKDYHSLYRWSTDNRASFWDFCWRYFPIISEGTYRTVVDESARIDSVPTWFEGVRLNFAENMLFSAERSSSGHIQITTKGKEDNKIALTEIREGGAEAPRHITWAELRRKTGRMVQALKAAGVVKGDRVAAVASNSVDTLVVLLATTALGAWFSSTSTDTGVKGILDRLLQLKPKYVYVDDFAIYNGKRIDLRTKIQDIADGLREVSEXESIIAFARFPXQPVDVDHVPKTHLLKPFWQGHLCQX

SEQ ID NO: 32336 - protein, 320 aa, A.fumigatus
HAYPSTPGCRFLSFIRTDIGTAYIKSLLDGDFEAENMTFLELLLAFSTLKQREILTQPLNPQYSQVLTLIHALLKAPGYAAVDDLASPLAIEWWTEVADDFQEIIADSDNHFNFEPAKQNLARAALDCFEKLKYPTPEELQEWRDDDRSEFSSFRRDACDFILAVYPILGVDLVRVFQERTRTSLAEQNWRTFEAAVFCIAQLSEAVDDNQHADDCLNAIFFCDEFAHLCRGEGISISDKARQTLVDMLGRYQSYFERTHALLPLARIPLFASLDVASCAPIGFQVYFFILQFVRKCFDFSAPSILDQFDHFVTKRRHQS

SEQ ID NO: 32337 - protein, 428 aa, A.fumigatus
LFSSQHPGSIRSFRHKATPPVMTMEKVLEGIAAIIQALPTDEGKAQVLERILDYLRQQAIVARDEAARDLSDAAYSRSLLVLRCIASIGKGLRTETEIVLESSDSSNGDSHSLTFWNSGRGANAQSLIIQSMQLLMTEVPRDASTIEAACDILKAGFTEKAGPYVFPPMVTVSFVKSIPLGSAGTDMVMGTASAFLASHSAHPEHIREETVALIVHVYESICQMQEMPGFFDPEVANSGIDFLTRLVPKYYSVLFALTSAPPPSGESGTSRRSVLQTILDFTLQSLQGPEPLPLRSASQFWVSVLSLTTDPSEADPVQVVINEYLPSLCRVLILQLAGRCARSDIEHLCDVLRKVIFRHQGQARLHLSAALSSVDIDVSHEGQGHVSPQEKERLVSSLIAARGLRAHTNQLARGFWIKCRGAGFDYIG

SEQ ID NO: 32338 - protein, 165 aa, A.fumigatus
CGPTPAFRKKSNQSYSGPTDAPARLASDFGSDFWARRRISDRGLSSSKETPVSFSTYSRSSIDILGMGTAILTPLVLWRWIFPSCKPINCASTVKDLVRSVHSLVLVGSGSVISFRCGFQSIMGLGKAGERTYSAYWRSCCHVFCAARDCQYSLLPGSLSFDRAA

SEQ ID NO: 32339 - protein, 255 aa, A.fumigatus
SYGARGKKMPTTLGINIATGTIFISPEGDGDMQGWTADRLTHYSIEGKHVFLDLVRPSKSIDFHAGAKDTAREIVSALGEIYGAYRAEGLKEVIAAGAGGGGKKKGQILYDFMAQGDDEVTVAAGDEVVILDDTKSEEWWMVRRMKNGREGVVPSSYIEITGFVSSQPTGVESGLSTVERNRLEETRLAKEAMRKSRTDSIDSRTSEVSCTVKLPYQTTVTLVRENTDNLEQHKKRDSKSASRPSMSFPPLCLTP

SEQ ID NO: 32340 - protein, 168 aa, A.fumigatus
SNLNSPRLRRRPLHRHHRPQHPLATTQAPVQKQLTGAMADLSLLQAPLQPTPAQPAPAPTSQASQAASSPAAIQPQPTAVPAPQMQPQQTGATPGFFTQVAQIAQQPMQTGPQTFSPQQTGFQQASRQRPQPPQNMAQSSLLPPPPQRPLSAPQKSSPRGWKVRGCSG

SEQ ID NO: 32341 - protein, 323 aa, A.fumigatus
APAISHAKALYDYTRQTDEEVSFSEDAELVVYDTSDPDWTLVGVNGDFGFAPANYIEVQEGDTSTARPSLPSPAAVEPSAPALPQRPVEVPTQEPVAPASTSSPIDTIQNPAAAAIADIIHKQHASPVESEPSRDIPPPQTQRPSQRPEDSYQREPSPPPPTLPQRPPSQQISPPVDRYSPPEPSPPLRPQHATVREHDGQGHVRESPPYNRIGQSTPRSPSGYHLYNINEMVEVMGQEGRRCQRHWALTSRLERSLSHQKGTATCKDGLQIDSPITLLKASMSSSIWFGPAKALIFMLEPRTPLERLFPRWVKFMGPTVPRA

SEQ ID NO: 32342 - protein, 306 aa, A.fumigatus
NPHLNEITEPDPTKTRLWTDRTKSFTVEAQFIGLQDGKIHLHKTNGVKIAVPIPKMSIEDLEYVEKLTGVSLDEDKPLSDIRRRAQKSEPKSEANRAGASVGPEYDWFDFFLKAGVGPHQCERYAQNFIKDSMDEAILPDITSENLRTLGLKEGDILRVMRHLDNMFGRTGSKSKLRNVSFGGEEVISNGEAGSPGGLFSGPGGVLRNNTRKGRPAPAVQTGDVVDPKAFEQKEDAPNPQERTGTPPASAAVEKPVQRGFDDDAWEVKQPKQPASSAPPSSSPPPATAPPGYNPSSSAKTTYWGNG

SEQ ID NO: 32343 - protein, 268 aa, A.fumigatus
FLSSVLFARRIADLDRYVSCIFSDPFDGPTEPSAVLHCVQELLDMGCYEVSLGDTLGVGNPGKVRSLLHYLADHHIPLDKMAGHFHDTYGQAVANVWEAYNCGVRVFDSSVGGLGGCPYAPGAKGNVATEDLVYMFETAGINTGVDLRKLVETGVWISRRLSKTNASRAGTALAAKYGLVPFKRSSSSRTTTKNQIFWTVVKDPNGSLAYRSGVNVKPIIDRLKRRNVFTSSGSSKTPRPTPPSSDSSSQEREGSFLQAWISTRTVHL

SEQ ID NO: 32344 - protein, 94 aa, A.fumigatus
SAVPSSPGVKTRDVLGNESIRQLQGTPDLRLPVLVPNVKGLDIAIEHGAKEVAVFVSATEGFSKANINCTVQQGLERAKAVAKKATECGITVRG

SEQ ID NO: 32345 - protein, 184 aa, A.fumigatus
TDSILDVSLQTSIPDIYAIGECASWENQTFGIIAPGIEMADVLSFNLTNPDKEPKSFKRPDLSTKLKLLGVDVASFGDFFADRDGPKFLPGQRPSIVDGSVGNADGDKEPSVKALTYKDPFAGIYKKYLFTMDGKYLLGGMMIGDTKDYVKLNQMVKSQKPLEVPPSQFILGAQKEGEENADDL

SEQ ID NO: 32346 - protein, 60 aa, A.fumigatus
PPVLSNSEKIVKQDAERRKYDIVVIGEEPHIAYNRVGLSSFFEHRKIEDLYLNPKEWVST

SEQ ID NO: 32347 - protein, 104 aa, A.fumigatus
DFVTMPLIDNSRSNDAVQSSICNGISHTTIIESVRDPDYRHNDPNRRQKIVIVGLGMVAISFMYVASLVDKDRSREGLSTNHRYYQIVRKSSNKMQRDASTTLL

SEQ ID NO: 32348 - protein, 184 aa, A.fumigatus
YGSFKDRSFDYHLNTKVTDIFPERKTVRTSTGDVIPYDILVLATGSDAVLPTHTPGYNAKGIFVYRTIQDLERLIEFASKHKGETAVTVGGGLLGLEAAKAMTDLEDFGRVKLIDRNKWVLARQLDGDAGTLVTRKIRELGLDVLHEKRVAKIKTDDDNNVTGITFEDGEEIDCCCICFAVSRS

SEQ ID NO: 32349 - protein, 99 aa, A.fumigatus
  UNSURE (12): Identity of amino acid sequences at the above locations are unknown.
LVSFGLACWTGXGTDTNINRDDDAQICSCHNVTKGDIVENVKSGTCKTIGEIKSCTKAGSGCGGCMPLVQSIFNKAMRDMGQEVSNHRKSSPPGWKVTR

SEQ ID NO: 32350 - protein, 66 aa, A.fumigatus
SLASLEPRHSMPSGELPRGLRAGWIKKMASANGEASSMANIAGYKAVLEASNHFGRFLTGQVTAAG

SEQ ID NO: 32351 - protein, 173 aa, A.fumigatus
VGAQPSPDVSKLMLTISGYTDFPSRLPTQASTLYSNNIAKFLLSMAPQEKSFGIDLSDEVVRGSIVTLNGAILPPAPRPAPPPPKPAAAATPAKEQAELSLTPWQKATRDVATVTAGMGTALALGKATGPIFMSNMMTFGLAGLVGYRAVWGVAPALHSPLMSVTNAISGEQA

SEQ ID NO: 32352 - protein, 61 aa, A.fumigatus
STYRPLGPTDPPEYPWLYAIPAVIFSGGFIAAASTGMAGLVSAGYLVSTLLCISKWNCGIL

SEQ ID NO: 32353 - protein, 88 aa, A.fumigatus
SVSYACVAGLVYGHYMILAHNFTGALIGRRITPTSLPQTVAALHSVVGVAAVLTSIESVMADIGDISTLHMVTAYLGVLIGISSDSGA

SEQ ID NO: 32354 - protein, 88 aa, A.fumigatus
ARRLGAIVRGFDTRSAAREQVQSLGAEFIEVDIQEEGAGQGGYAKEMSKEFYDAEMKLFMEQARDVDIIITTALIPGKAAPKLITKEV

SEQ ID NO: 32355 - protein, 73 aa, A.fumigatus
HPHAWTLGMVGIGGLFIMGGGYTPSTIPEALGAVSVLLASMNVAGGFVITKRMLDMFKRQSFTPIEDEALTVL

SEQ ID NO: 32356 - protein, 61 aa, A.fumigatus
HYVAVVITVLNAYSGFALVAEGFMLNNPLLTSVGSLIGVSGSILSYIMVRVFMCLFADHAD

SEQ ID NO: 32357 - protein, 154 aa, A.fumigatus
RPGTSAPSDVPVVPYSSLTVGVPSETWPNERRVALTPQNVTLLLKKGFSRVLVERGAGEQAQIHDQAYEQVGATLVDRAAVWSESNIVLKVRSPRQEGPIDEVEALRQGSTLISFLYPAQNKLLVEAIASRGVTAFAMDMIPRISRAQTFDALR

SEQ ID NO: 32358 - protein, 103 aa, A.fumigatus
RWTGGVTFTGSIVAFLKLAGRMSSKPTILPGRHVINSTLLGTNMATMGAFVSMGPASPLIAATCLGANTMLSFLKGYTTTAAIGGADMRMSLRLTLEKVTNIM

SEQ ID NO: 32359 - protein, 142 aa, A.fumigatus
PTRPASPKVIMLLMNMGPVAFPRASAVPIPAVTVATSRVAFCQGVSDNSACSLAGVAAAAGFGGGGAGRGAGGSIAPLRVTIEPRTTSSDRSIPKDFSCGAMDRRNLAILFEYRVDACVGRRDGKSVYPEMVSMSLLTSGEG

SEQ ID NO: 32360 - protein, 77 aa, A.fumigatus
RNSLYQKLILGRIQERNQGASLSEGFDFIYGALLSRTTDFQDDITFGPYSSSVDQGSSDLFVGLVMDLGLFAGTALD

SEQ ID NO: 32361 - protein, 580 aa, A.fumigatus
KLIGLLSAVLLQIYIIWSLSLQGERLQVPSTRRFARYHSSLQVHIACLQSGSFLSLIEMDPGHPPTNGNGCFQDASVSSYQAERTINISALSHEAICDRIRQSLVEVSSGLVADKIHFTSTCGQHVSAVRSRVEDALIDALASPYRWAVRPYWVQDHEPGLILLSTRQYNTYESSFNGLLRAVSDMENLVPTADTLYRLANELDNRSLRSILPEKARILEKKLMSISHSNSLLLATLAAEILTYQGIPTLPMKAIMQLQQRAGSSVDLNGYPRHAAATFEKRIKVDDYNFFELVHPAYFRQTVALAQLVTKFIKNPCPRAVDVGPGPGTNLLAFLELLPQTKVLAVEPSDIAFQYLIDHFKGQSNITCVQKDFLCVPVELDEVDYIMSTGSSHHFYTDGFLQRSAQWLRRGSYWFIADEMISPFETRRERHLNLLRHHLAYMVPLCFPWPAGDVDPRTRAEREFVDDFNNTVPLAKFLADTGRVDAAESLCRELLSRAERHGFTTKVSDPHLAFWRLQWLELQALVAGLDYEVEQKTYPWHFIKMAEGAGLKCVAHQRVYGTVGLTDDCAGTHVMAFQKA

SEQ ID NO: 32362 - protein, 240 aa, A.fumigatus
VKSSAHKFIEAKATFPHVVDDAQIISYLMINMIAGADTTAITLNAALYFALKNPAVWKRLQEETASLHCEGSPIVPFKTAQDLPYLNAVIREAMRMHPGVAMCLERYVPDEGLTLPGGQFIPGGCIVGMNPYVLARNQSVWGEDADVFRPERWLRDPTRETEEAYQERLKRMNAADLTFGAGSRVCIGRNLGMMEVYKVVAMLVSRYEIELVDPKGEWKTHNSFFVRQEGIEVRLRRRST

SEQ ID NO: 32363 - protein, 200 aa, A.fumigatus
VHRSKSHVPPCGRRRSDHLLPDDQHDCRRGHHRHHPQRGAVLCAQEPRRVETTAGGDCIAPLRGITHRTIQNGAGPALPQRGHPRGHAHAPRRRHVSGALRAGRRPHPSRRPVHPRRMHRRHEPLRARPQPVGLGRGRRRLPARALASRPHPRDRGGVPGASQADERGGSDLWCGEPGVHWTELGDDGGVQGRGHAGLEV

SEQ ID NO: 32364 - protein, 61 aa, A.fumigatus
QAAGLLVDFLLHVLAILFATTFFLFGASSSQSPSNISRSADTPLYETSSDPRQSETSSPVR

SEQ ID NO: 32365 - protein, 90 aa, A.fumigatus
MDPDYKARKEAFVSGLAGGSILEINAVTLVASVRVTILLWLLRLHCFSTNRVSLRSIRYPFFCGQFYNLAYPFSQPNRPLAFSLISCSMY

SEQ ID NO: 32366 - protein, 391 aa, A.fumigatus
  UNSURE (283): Identity of amino acid sequences at the above locations are unknown.
LSCSQPLFFSSAPLLLNLLLISPALLILLSTKRPRTPVKAKPPRQSARAGKDDSKHATALPESLPIHPFLTTYRAAMMVITCIAILAVDFRIFPRRFAKVENWGTSLMDLGVGSFVFSGGVVSARSLLKSRTNGSKRLPLAKRLIASTRHSIPLLVLGLIRLYSVKGLDYAEHVTEYGVHWNFFFTLGLLPPFVEVFDALATIIPSYEVLSVGIAVLYQVALESTDLKSYILVSPRGPSLLSKNREGVFSFSGYLAIFLAGRAIGIRIIPRGTSFSRSPEQAXRRVLISLGVQALVWTTLFVLNSTYAMGYGANIPVSRRLANMPYVLWVSAFNTAQLFVFCLIETLCFLAVHPTTTQESESERVDFATTRILSAFNKNSLAIFLLANSPE

SEQ ID NO: 32367 - protein, 607 aa, A.fumigatus
SSMMDDSIASSDPTMEEHHIVKADEVDQTGTDITTVSDDQLMEEVAQGLRQEQASKATSAGPNESQEQRPNPSRRPELRRNVSAPPPPLQPPPPAPVQQLPDRPPDSLSLAQLKQIVQDMPKVNQPAYAFEYADSQPLVEEIEEWFQYSEFDRIMLLGMKSTFERKWASFCENQSAVSDRLPWLDAPHDLRKSFMEQIINGLPDRDISSRTEALEVVCYALTGIWGSTAGKAVPDYPEDLPPQAVTDTPKSKSLQIIWMQRNAELVNECSGLGPLLSCLCKALEKNRSSYNPESDGLDSHSDSANVAASEHEVNLVLTALYIVVEIGRRQEKHSQDVSLRDALMGLKPNLSVFLVEVIARLRWDDSANIPLTRIILLFWKCLLLFFGGSDSLKKAKEELEPRMEARENSPNRRTPFLTASPLDYHLFRQEITSKYPAYNPPLPVVPLELENNSILPPLPQHPSRTSSSTGLFSGVGPSVAGGNGSILHQSVHIATPAPSPPPSPIGPGGKAGKKQNYQTNQNFPFMYPPLDDSSNDIGGKGSAERQDALVGKRWEGSDVPASIIEAGKLFSTHVKMTRAMRQLWEERERFMKYDRGWYLDENSPSSD

SEQ ID NO: 32368 - protein, 375 aa, A.fumigatus
SIEFSAGDGDDDEVGDSTGNANGTNSALLKPKDGSSGNSLEGLLLARNKKLTDELTVLRVSHRDLQDQLELLREDLSNTKEELEKSKQLSTTLENDLLRVQQEAANAFPSSAMSVAGTYSSRYPHSTRRGAASPTSSIISGFDQAATSSNAMDAIRAGEPVGGGSGLLPMIQAQRDRFKKKNAELEEELSKMYSTVKSLRQEVASLQKDNLSLYEKTRYVSTYSRGGASSSASAYANKPSNSSVHVSADTPSGLSLDRYQSAYEARLSPFAAFRGRESVRAYKRMSLPERIVFSITRIILANRTSRNLFAGYCFALHVLLFLALYMMSTMEIEKHSSASLGAAAAAAMAGGGGSGSSSGQLHGDDWQQEGFNHAA

SEQ ID NO: 32369 - protein, 313 aa, A.fumigatus
  UNSURE (1): Identity of amino acid sequences at the above locations are unknown.
XAFLQLYSSLSEAPDPYPLLEASVDSLVLSEQTVPKLTSERDQLQRSVSRLTTQLEDTEKRLQEERAARRNLEDSQETKIKEIESSWSAVLAEKSNNWAAKEKSLEEKVENQDRLLKEIKASYEVSQRLGQENDGSDASQHGATAAELELVSADLEKTTLRLAEVEARNEQLRLELAQAVSHSQATQPTSVEDDPAYLRLQSENSSLLRKLDAARFDRESERHSWESKLSQLERQSSKVAAERDELRSRLEKTADYEDIRRELEMIKVGYFLWQDSRTCLLILRSLLNSLPAMGTMMRLEIPQVMLTVPTAPF

SEQ ID NO: 32370 - protein, 79 aa, A.fumigatus
AIQHSETNSVFNFDSLLVKEVYYPKYNNSRVFYEDFRTPSGGYGGLFSITFHSDAEAIAFFDHLEVLKGPSLGTNFTLR

SEQ ID NO: 32371 - protein, 158 aa, A.fumigatus
KAGERFLALFTEFPGNPLLKSPDLKRIYALAQKYDFAVVVDETVGNFLNINVLPYADIVVSSLTKVFSGDSNVMGGSAVINPHGRYYQELRATFSRDYEDNLWAEDAVFLERNSRDFVSRIEKINKTTEDITALLKESPVGEQSNILRQILYSILTLC

SEQ ID NO: 32372 - protein, 87 aa, A.fumigatus
TSSPYTLLAHYNELDWVSIALFAPILLLWLDVSLPSPGSEPPAHCPLQAASFGVESNLVRISVGLEDVSDLRDQVQRALAAAAEAKD

SEQ ID NO: 32373 - protein, 486 aa, A.fumigatus
LHCSFQPRGEDQDPIGRLLNAAQMKHLAKMTDEAVATADEAWETYRGQKEDYRDRYTLHSFFSVFLELHQTHRVQDVLDLAASHPQEFQFTERIGLVEFLASTLTWTRRLVYRVLHHTRTRGDGKLIDLVASAVARAEASEGELTDDLAAAKYFIASLMVENGRFSAGIQAWYQLAALDHPRGDRERAQARSLSRLAAVCLCNPEIPLCDEPPLRLDEKAEYSDICLVISSWLRYHGDLANARTALRGRVKKSIELLSDDDPSNDDDAFLSLFQTLLTAADSDEDLSGALYCTKAWYKDCLREAKSDHRMSEGGVAESLNQVHLVADETQVPDDGVSERRISYTIDYFAECSNCKCEMKSICHWYFCLCCPFMMLCQWCYHEIQSASSQDGTSHPQGICDPQHEFYYTGGPLRAVERVPEGMTVLDGLDGTKRTAWIEEWKHQLSEKWETADFAFAGGLSAWCMRILPEPQRSRWARLFVRPLGSA

SEQ ID NO: 32374 - protein, 218 aa, A.fumigatus
FGRARTVETNVNLVVLWNASSFNCLAELDGMNGGEENSGGVFVIGATNRPDLLDTALLRPGRFDKMLYLGVSDTHEKQATILEALTRKFTLDPEVSLRRVADRLPLTYTGADLYALCSDAMLKAITRKATAVDEKIKQLPGGPVSTAYFFDHLATPDDVAVMVTEEDFNRAQSEMVPSVRYVPSSQYPEKIIERHLLRSLQCQGTGTFRADSAAIRIR

SEQ ID NO: 32375 - protein, 647 aa, A.fumigatus
  UNSURE (305),(341),(346): Identity of amino acid sequences at the above locations are unknown.
VKTKIDGLPGLPSAKPRYSINQSSDRRPSISQRPPQRLTPSVYTSPLLLNNLENTKYVRISPMAFATGNGPSKSAVLHQVKASSARQPPLAKEVNLLKVSTPLSMDRVLQPALFAGLKQYFESKRRILKSGDLVGISVDERLGRAVFSGAAATDASTPDEDLTIRFNQANESAQGVKKVGVAWFRVAHVVPGKSEDQDEDDQWGGVAVIDSATTRMVQAGSDISRVPGILENGWEYWLGVKSVPKSISNAPGLHGLVTEPPQPFIPPLQKRIRELMAVATSPRAIQLGMKPVVILLRSQQRHIGXTTVATRACADIGLHTFPIDAYDILTEGGRNGGDVKXEAYLXARAERAFDRGPHCTALLIKHIEVLTADRIVSAMAEILADARVVIATTTDVEQIPEGIRSMFTHEFEMTAPEEKEREGILRNAVAERSIRLSPDVDLGSVALKTAALVAGDLVDVVERASAIRTARLEKLAETPSKVAPESNVSVRDVLVSGGDAARGVTKADFDAAVEAARKNFADSIGAPKIPNVKWEDVGGLTNVKDALVETIQLPLERPELFAKGMKKRSGILFYGPPGTGKTLLAKAIATEFSLNFFSVKGPELLNMYIGESEANVRRVSQRARDARTCVVIIDELDSDAPEPWKPM

SEQ ID NO: 32376 - protein, 207 aa, A.fumigatus
  UNSURE (206): Identity of amino acid sequences at the above locations are unknown.
IVSTRASLTLVSPPTSSHLTFGILGAPMESAKFFLAASTAASKSALVTPRAASPPETSTSLTLTLDSGATLLGVSASFSRRAVRMADALSTTSTKSPATKAAVFRATDPRSTSGDSLMLRSATAFRRMPSRSFSSGAVISNSWVNMLRIPSGICSTSVVVAITTLASARISAIADTILSAVSTSMCLMRSAVQCGPRSNARSALAXR

SEQ ID NO: 32377 - protein, 469 aa, A.fumigatus
  UNSURE (455): Identity of amino acid sequences at the above locations are unknown.
LAGPVRHAPTMSVTTSLWWPEDRIQATLCPEYVFGHLPSDLLPRLVAPLPWGEGLTSETYLDWILHKAGRLFLILVDIGIPERIFSLVDESFDDADLPIAAHSVERLKLSLDDKNPTLDAKFFHAQWRFLVRGIKQGDHIKYTENEGVPVELIRNEAALAREGIEKVVLAGAVCQVYLRTQVTVGGAPHFFEEQEVLDEIRSLRRLSHDHVFSIYASYFVDDTMCILFSGTYDRSLMSFLTDVPQPFKRLPKNRRREILINWPHCLVDGLAWLHAHNQVHGAIRPSNVLIDSEYRIFLGQFEALDTLLPPAKIDDVESYQYGAPERWVRAVTVQDTGPTRTVLPSGGRTGRRQPSSRPGRLTLFSRGPGSDDAVDHSLSSRAESVTSHGTAIRIGGLPDSPTRFSFALSSSSSGSSGSARKRVVTPVKRRILYTPSITLSNSSGSSSSFSFTVLXPGSTPRHSIENRCG

SEQ ID NO: 32378 - protein, 106 aa, A.fumigatus
PVNNTKALFFQPDWKRLSQEETCRDSNFSPSDSHEAHIRLLNAAGAATLRASPLRQHLKETEHLVANNKNAPPGHHPLRPPRRRLRLRRHRARPRRPYRLHLYRLP

SEQ ID NO: 32379 - protein, 223 aa, A.fumigatus
MQLVQPLCAPHLSVNISKKQSTLLQITKMRLPAIIPSALLGVAFVFAVIELGLGGHIASISTGSRKIPFYDPSSSWGYSYKTIKYSVPGIVAFQIFTSVWTMLVSVAAFLLPWFLRVKAAPGTRLNTIITGALGGAYFVTMVFWLACFADIATKLDELGATSDYYNAVIAFAVLSWLVYFLHTHLIYPPPPAGEVDVANASEQAALCRALRHRCSCHTWDSGV

SEQ ID NO: 32380 - protein, 127 aa, A.fumigatus
  UNSURE (18): Identity of amino acid sequences at the above locations are unknown.
MDWNPFCKATSLNKKAAXLRWMRLKAKIEGALKEDETESADDIAAKSGNGNGNGNGNAEVKPEAAKAPGKAMPKMGVFKPRRSKNINTAESEIAPPSKKRRTSKRNRGDHADSDDANKGASEAIAEK

SEQ ID NO: 32381 - protein, 66 aa, A.fumigatus
FGSIPCSIFWCIVWLDGFVSVTGNYMNTGRGVLNLEDGKIGALLRRLIQLQVKGFMEHVSHHDYRL

SEQ ID NO: 32382 - protein, 147 aa, A.fumigatus
TPRRVPRLGFTLSKQELISLLTTYGVPRPQVQQQSASQAAQHQAQSKTTPATNPQHPSNLLMPLSAFQAVTAVKILERDPRDEILRAFELFDEGGKGYIDLEDLRRVARELGETGLEEEELRAMIEEFDLEGVGGVTRDAFVSICWQ

SEQ ID NO: 32383 - protein, 62 aa, A.fumigatus
HHRHLPNQTPRSSRVAPPPPTPSPPIPSQPAANPQDQCIPSRPRQTAQMPGGSRPADPAPES

SEQ ID NO: 32384 - protein, 66 aa, A.fumigatus
RTRHVILSQPILVQSDDLLGIDVVRSRIKGFAQKKVTLPPGRHKIVILDEADRYETRGFKICATGR

SEQ ID NO: 32385 - protein, 80 aa, A.fumigatus
LFRVEKYRPIFLDDIVGNTETIERLKIIAKDGNMPHVIISGMPGIGKTTSILCLARQLLGEAYKEAVLELNASDERGMSF

SEQ ID NO: 32386 - protein, 224 aa, A.fumigatus
  UNSURE (214): Identity of amino acid sequences at the above locations are unknown.
RIQNMCDWSLIIYSMTPGAQQALRRTMEIYSSTTRFAFACNQSNKIIEPIQSRCAILRYARLTDAQVVKRLKQICDAEKVEHTEDGIAALVFSAEGDMRQAINNLQSTWSGFGLVSGDNVFRVVDSPHPIKVQAMIKACWEGKVDAALETLNELWYAHDAFDYCFVIDILITLRDLGYSSHDIISTMFRVTKTIPTLSEHSKLEFIRETGLTHXVSASIEKYIG

SEQ ID NO: 32387 - protein, 114 aa, A.fumigatus
PTSLQVIQSSKTNCDKLIFITLRDFCRELDMSLIRGIMELTSQRPGIPQLSGPLSKGLLPGGISCDMEFRAGKVLLRNAWASAVRSIHPVLLNISKIDIVSGVIQNRLISRLVM

SEQ ID NO: 32388 - protein, 89 aa, A.fumigatus
HVCGLMQPSSRAIQKQRLWISMMHYGLWKASQHWTPRDCFARPSYIRWDMHTAVWTWLQNQKPATWRHWGSTNDPLGATTLRTLQFCTI

SEQ ID NO: 32389 - protein, 61 aa, A.fumigatus
FRLSGPYSLITKGYRMEKRFLPLNSRPLRFFCEHCEKQFTMDDKDEIVDRQRGETVTRNFL

SEQ ID NO: 32390 - protein, 77 aa, A.fumigatus
LLPAPNDVHIIGSKTSGMALCEEENEHYGSDYVDSQGKFVRNQTQGTPPSPSRRQSFLQRIFGRTVPKGLLDEYNAG

SEQ ID NO: 32391 - protein, 398 aa, A.fumigatus
  UNSURE (398): Identity of amino acid sequences at the above locations are unknown.
RRTGLSRAKSTSNRGRKLLKRVNTVRLSFTQRGSKNESHTSLESEGSSSDVKPAAKTQRRADGVRTAVSEAEYMDLLRNCQNIFIHIQHLSGGAMVHDASGRQRLLQMDEVAQLFLQLKNELSASTAYSKALITRMRADAALKQGNSKAAVVDFHDALRTLESEPALDTERLFRASILHSMGHAYRSLDMAAESEACYLEALGLYKRSFGRDHPTNFAVLHDLGALCEKDGYATEAAALYERSFAGRLKTLGQHAPETLSSMQRLASLKVSLGDLESALLLLERAVPALDTVFGLQNETTLNAMNKLSLLYQKLGLVKESRMICGKTIPHCKTIFGVASAITRDAVIRYIQSSDNFDLPPEILDILDQYRNSSDPEALRVIHRLGRSYMDAGLNRDAX

SEQ ID NO: 32392 - protein, 64 aa, A.fumigatus
SHPSLALGAYSQWLLATTVKVLGGSYGGHNASSRAPIRPKRHQAPSCSLDPRVKHWHYQLSMTC

SEQ ID NO: 32393 - protein, 82 aa, A.fumigatus
MRCLRILLAHVPRDTLLENVEDFCQKFGLMDHIDAFRKGALISQNPAGALELPELQEDEKAILPPGVDSQMVPAMAAVLYGL

SEQ ID NO: 32394 - protein, 65 aa, A.fumigatus
PRSAMCSLAAAVQGMDETVNNGAQAIYLKQFNITNPDHPEDSRFSQSMQRYRLTRPGLEAKRVRR

SEQ ID NO: 32395 - protein, 64 aa, A.fumigatus
RVYIAALVIGKVCYSRLNYNASYIDLSLYYNLLILCVSTFPPPLFFFFLKKDYIILGVLRQGLS

SEQ ID NO: 32396 - protein, 62 aa, A.fumigatus
LLRRDIRYVTLRLSLIYVNSNSDYNSAPDSVNRLLSLLSIYFTGWIRSFLIWLLFIRVWEVK

SEQ ID NO: 32397 - protein, 705 aa, A.fumigatus
  UNSURE (703): Identity of amino acid sequences at the above locations are unknown.
DYDLRARFCDSIYAMYDNVKAREGGGTSDLKILIDLKRCWHGKCAAYWELPTGHIAPGTAIVPGGHDFEAGPKGEGNAEEHEYDSTTPEVNQEHQTGVQQSLPAFQQIQHDRNNSTATAKSMPASTKSGHSVQATSCSLPPKSPKRLSVPVAARKAPHPVPIIPSKLLCSPPESPNVSPVIAKRLPFHGHMHKRSGSFSDSVRDDRAPLCLLKLEQQAFASQEILNLGSLIRGELYPPAESYMTMMAPPSPPLPSSASAGTQDRRNTINETSKPPGSSSGMKTIIGSIRRALHTRHGGQSVSPRAANGQWSPSMRGKTSALPNNVAFGSDLYRDRKTAATSKRPIRIDILSDEALQEYRRAVGEVVSPQTARGPRLEVTEQAMELEGKKIDRPEPGFDRSMAKSQITMGSQSIVIVDGTGLGEPVMSGAVLEHSMGLEQPPGFLNAAYTPTTVKAASLRRLSHRLDLAEDQYSLPIYYEEADSGPPNRISRFLRSSRISDPRRSFSTERFSVSWKRTSPSLRLRKYASFQSGISRQRSAMAREPSLPPTAAMNPSKLTAGAQVGPTLRRRPGGDLRQMQTVGGLRSRPDSGSFTSGSTYRSSFSDSLMSGQHDVSRRQTSLIPPNPRYELIQTHSSQMLRRSFEAAIAQFAQIPDDDDGGIESALLKLEGKWPGSPTSGEPAGLSNGGSCREPGHVQHDQALXLV

SEQ ID NO: 32398 - protein, 247 aa, A.fumigatus
  UNSURE (31),(33),(34),(63),(66): Identity of amino acid sequences at the above locations are unknown.
PYRIFVQGLPAPRPWIQFCFPAEPLTPDLSXRXXNTERNNFRPVNTHQVSGDVLSQTEMDRQXYNXSKNPEPDHVPFILSCESQILAQQLTLVEMAALSEVDWKDLVDMNWSSGSPSTRNWVQFLTEEERRGIDLVVGRFNLMVRWVVSEIVLVRTLEERASTIVKFIHTAAHAKRICNYATMLQIAIALSSTDCSRLQKTWALVPPSERRLLKDMELLIQPVRNFHDLRMEMETANLQEGCIPFVG

SEQ ID NO: 32399 - protein, 132 aa, A.fumigatus
KTWNYSSSLCGTSMIFAWKWKRPICRKAVSRLSVSELSTDGILDILTGFSGLYVHDLTYNAQKPAQVANPNGEPLVNFERYRTAARIVKSLLRLIDASTKYKFEPVPGIIERCLWIASLSEDQIQKRSRMLE

SEQ ID NO: 32400 - protein, 283 aa, A.fumigatus
KVLILLVRLRAISPIMAAPRDALKPQIDRQKTTPFHLKLFYRVNSFHPLSDFAIPSSPSSYSGPTSGPNAIRARSPPPVRLPPHLEIYTWQSCTLRELTQLLTSALPSLLPDPAVGTRICFRLIYPDTKGATTMGGDARGRYLSKDVGSVVVGPKDSPYRGENDEENGGSAATGPRALRLQGNDADKTLQDFRFVIGDYVDCAILPPLEDGSVAPPLVTGRGSVSGPVGGGMRAFRDPGFGRPGRGRGDRGIPSGDWRRGERLPDGGGRNYGGGPGRRGWAPY

SEQ ID NO: 32401 - protein, 256 aa, A.fumigatus
RDFQAENENEEKVPEVPSSDQEQGILPKLIATLVGRRREVKKLMKSKSATPEQLALWDTKQLAFKLTANSMYGCLGYTQSRFYARPLAMLTTFKGREILRSTKELAESKQLRVIYGDTDSVMINTNMDTISDALKVGEEFKKSVNERYRLLEIDIDNIFRRLLLHAKKKYAAINMTEVDGKFVDKLEVKGLDMKRREYCALSKEVSQKLLNEILSGEDQELVLNRVHDYLRDLADKMRGYQIPVQKYVIYTVSFQP

SEQ ID NO: 32402 - protein, 339 aa, A.fumigatus
CSLQKLSKRPEEYPNKETMPPAQVALRELARGKTIRPNDVISYIVTNGDSETSSLPPAKRSYTVHDVMKSDNNLKPDIEFYLLKQIFPPIERLCAPIPGTDAVRLAECLGLDVRKYQINTSSGSNQQNADIFPLESQIPDSVRFENAARLTLTCRSCKEKSIFEGLVASTHMCTANGIVCPNQACQKPFTVLTIIAQLESQIRAQTSKYYEGWLVCDDSACGNRTRQMSVYGHRCLGPRGRAEGCLGRMTYEYSEKQMYNQLLYFAGLWDVDKAKVNAQKEASGEKKDSIAALVEFNRTRFGTIKDVVDGYLKKCGRQWVEMDALFPSSTTGRQGTAIE

SEQ ID NO: 32403 - protein, 171 aa, A.fumigatus
KRLANGAGNSWARTLSGTRAERNEYILLHEFHRNKYICPDKYSSKLQKAEEKYQDGDDDDAGDKKKKDKYKGGLVFEPEKGLYDKFVLVMDFNSLYPSIIQEYNICFTTVDRTATVSTQPLSRQILLTTPTNVIFRLKMRTKKKFPKFLRRIKNRVFFLNSLPRLLVAGAK

SEQ ID NO: 32404 - protein, 226 aa, A.fumigatus
  UNSURE (61),(65): Identity of amino acid sequences at the above locations are unknown.
LQAGTADAAVDEVTELFKGLSKKKKTKKPKDTEAGEGDDAAATADGEFDPTALKKKKKKVXKVNXGDFEAKLAEAGISEKAATEEKEGELPEGDLEAGTGIWAHDATQAIPYSLLVSRFFSLIQSQHPDLLSNGTKSYKIPPPQCLREGNRRTIFAKIADICKRMKRSDDHVMQFLFAELGTSGSVDGSRRLVIKGRFQQKQIENVLRRYIGMFLYVPLGFEYYSS

SEQ ID NO: 32405 - protein, 73 aa, A.fumigatus
QVEPTPQKQRKSVAFSEGAVIMDTNGEVTEAPAPQITTAENEAGMLLLFLSLKPATAAETDFKQAQQTPQSTK

SEQ ID NO: 32406 - protein, 151 aa, A.fumigatus
GVRLRPSQVSAIFSEPEKSTRLMIRSGAMIAMSHTITLRGSIKFSLKKMFAGGEMSLSTYTGPGELLLAPAALGDIIMLRFSGSDQWKVGKDAFLASTSGISKDYQAQGLSKGVFSGEGLFVYKLSGVGLVWLQSFGAIIRKDVSYPSRSF

SEQ ID NO: 32407 - protein, 77 aa, A.fumigatus
QSTAQIADGESYYVDNGHLVAWNCKYKMERVASGGIISNISSGEGLACRFTGPGTVYLQTRNVTAFAAHIGAHTASN

SEQ ID NO: 32408 - protein, 173 aa, A.fumigatus
AQRDTFQPRGEECPFGAIHIINLPTNLETEVTHRYSANSFKLHRLPMPRPGQVLGLVGTNGIGKSTALKILSGKLKPNLGRYDNPPDWEEILRYFRGSELQSTYTAESKKNPRKFSMISNFHRLLYQGPGRQPEGRGQAPVCLPDSSGCEGPGQERRGAHQGPLSDGQHGTHP

SEQ ID NO: 32409 - protein, 63 aa, A.fumigatus
YLTFIDYFTKVLEDNLKAVVKPQYVYQIPRAVKGPVKNVGELIKARSQMDNMERILDALGMAI

SEQ ID NO: 32410 - protein, 435 aa, A.fumigatus
QSRLPTSMLNSVWRAARSIRELLRPDDYVIVVEHDLSVLDYLSDFVCVLYGRPAVYGVVTLPASVREGINIFLDGHIPTENLRFREESLTFRLAEAGDDFMVDKARAFSYPSMEKTLGNFHLKIDAGSFTDSEIIVMMGENGTGKTTFCRMLAGAEKPDGNVTMPRMHISMKPQKITPKFQGTVRQLFFKRIKAAFLSPQFQTDVYKPLKIDDFIDQEVQNLSGGELQRVAIVLALGMPADIYVIDEPSAYLDSEQRIVAARVIKRFIMHTKKTAFIVEHDFIMATYLADRVIVFDGKPSVDAHANAPESLVTGCNTFLRNLDVTFRRDPNSYRPRINKYNSQMDQEQKLAGNFVSHPNPIRAHLFYVILICFTIVLLGGRELKRASQANIIATITGTMVAMLTRGDVVVNGKPFVYGRYSGFPGSRVAALGAGG

SEQ ID NO: 32411 - protein, 152 aa, A.fumigatus
AHRPPQAANTTSPNSSPGASLYPWSQRRLNFSTPQGNPFPRYGAAINAVASKEGDIYMMGGLIDGSTVKGDLWMVESSGGNLSCFPIATVSEGPGPRVGHASLLVGNAFIVFGGDTKVDENDTLDDTLYLLNTCGFPALFGHLQRTFTLLTL

SEQ ID NO: 32412 - protein, 98 aa, A.fumigatus
FPSASRQWSRAIPPNPRPAGRYGHTINILGSKLYVFGGQVEGYFFNDLVAFDLNQLQNPTNKWEFLIHNSHEGGPSPGQIPPARTNHTMVSFNDKLYL

SEQ ID NO: 32413 - protein, 331 aa, A.fumigatus
RFGGTNGLQWFNDVWSYDPRANQWSQLDCVGFIPTPREGHAAALVNDVMYIFGGRTDEGIDLGDLAAFRITTRRWYSFQNMGPAPSPRSGHSMTAFGKQIIVLAGEPSSAPRDPVELSMTYILDTSKIRYPTETQNGDKVGAPPLAMRKGSSDRHGAPTGRTSREAQNTPPADSQQRRGPGQTRESMMVAPNGRPGDHGPGPGSRLPRASIAQAPAGPPPPGQAPTPGPRGSTPQHAMNPRSKTPTDRNYGGPAADTVRTMESERDRESPVARDSSKDPRSANDPRSMSSGHRTPTQTPSRMSAKSHGGWRSCSFSQTALSTSASPTQLHG

SEQ ID NO: 32414 - protein, 127 aa, A.fumigatus
  UNSURE (23): Identity of amino acid sequences at the above locations are unknown.
SFVPCGEDPERIDSLQCLGGPPXESSKGNYGVQGSMRGSMKNPWSWDNTAMVYGGKKNQFTWNNNCGNTTAQNCGNTVSTNCGDTSTYNNTKTIQTGDISSNGGNASNASGTASGGSGGRIIIDGHD

SEQ ID NO: 32415 - protein, 69 aa, A.fumigatus
CILPFDITLVGTKTYVERLNLGMAKTICLPTPLAPQLTLIYHKLVIYHLVSSSPAIYPEDYEIIQFLLA

SEQ ID NO: 32416 - protein, 496 aa, A.fumigatus
CLPSERGSSSPAAKLSKGPSSPKRLDEAIKGSKFMKRLIGFYRPFKYRFSMVPNTKPNQRYIRTGCALMRTLVQVPEGTKYLAENKFLRQVAECLAQVDRMSGLTSSSPLFSREQMATTLSGGYFAMLGTLSGDPNGLAMMERWHMLNMFYHIIELRDRDDLIQTLLGNLDYSQESHLRVLLSKALTTGSKDIRIFATKLLRKYAVGNAHLSAQGGLGRADWVVKLLVTQLYDPDVSVCQIAVKILEEACNHRDYLEYVVKCRPSLDHLGEIGAPLLLRFLSTSVGYHYLDGLDYITQEMDDWFLGRNDAYVGLVEAALSRAYVDQPRRGSFAPEDFVDLQDVGVVPPHFYRELARTKEGCRLLEQSGHFSEFAWTIRDFRLDEEDTEALLKVKGCLWAVGNVGSMELGAPFLETDIVQQIVKIAESAEVLTMRGTAFFVLGLISRSRHGLKVLREAGWDSAVDQKGDSIGLSLPTDFKKLFLVGNTLAVTASKVY

SEQ ID NO: 32417 - protein, 84 aa, A.fumigatus
WTVSWLGHPFWAFVTFSSSYVKTIIVTYLFLPLLSLTVNDDDGYEPPYCIPDFKVRHSTRNATFSSRVPPSVLVWRSGMSSHEQ

SEQ ID NO: 32418 - protein, 403 aa, A.fumigatus
RPGFLEKRRDFWEDLRRGNKTLGCPGDEQFTGDLTWRFPGGKATLPRAEPSQRDISAQQLLNTFLNGDATIGTLTSSPFEISHKYINFLVGGGSNLNETAIRLKVNGQTVHTSTGSNSEGLAWQSWDVSALQGKTAVIEIIDNSTGGWGHINVDQISFSNQPATSTIANWMDWGPDFYAALGFNGLPQDKRTIIAWMNNWQYGGVIPTDPWRSAMSVPRQLALKTINGKATIVQEPAGKWSALTHGGQTFSFPRVEGVRGLGRIGKTLELELTFSSRQSPAAGKAEFGVAVAATKDYSHETRVGYNFATQQVFVDRTHSGDTSFDGTFASVYQAPLAPSADGTVSLRVLVDWSSVEVFGGHGEVTITSQIFPASDAVYGRLFSTDGETKNVKLRVKEVRSTWR

SEQ ID NO: 32419 - protein, 80 aa, A.fumigatus
LGSARGSVAFPPGNRQVKSPVNCSSPGHPSVLFPLRKSSQKSLLFSRNPGRHKIRFGIWGFKLMPLEIPHLISRIPHNPT

SEQ ID NO: 32420 - protein, 180 aa, A.fumigatus
PRLSATSSFLESGWQSTRSSRPSFPHTLTIQIPSRDRKYTQVGWKPRAGNSKKLVIGLDPVPKFLHRLVDGWAPDGSMVVSFKLGNRSQPACLQGADGAEAVLTPSGYWQPSLNTQMGGRLCDARSPIRTLDSGAQVETEQEHLWCGRSGGPGRGRESERIGEPSQWGSPRGQRPETSKC

SEQ ID NO: 32421 - protein, 158 aa, A.fumigatus
SVWTRCPSFCIDWWTAGHLMEVWLSPSSWETDPNLLVYKARTALKRYSHHLVIGNLLSTRKWEVVFVTPDPPYERWIRVPKSRRSKSISGAEDQVGLAEAGRASESANRPSGEAREDNDQKPASVNTAEGVEIESLIIPELVQLHSNMIAKQQAKQRP

SEQ ID NO: 32422 - protein, 275 aa, A.fumigatus
RIGAVSQRRPFTMAAATTEEMTPAEQESVYFNNYPPPKNLPKHEALARAFIEYHAEANRRLVLVTSGGTTVPLENQTVRFIDNFSAGTRGATSAEYFLQEGYAVIFLHRQFSLLPYSRHYSHSTNCFLDFMDEAPPSGSSESANPGHGPIVVRSEYQDQMRDVLRKYRYAKQNNLLLLLPFTTISEYLFELRMLAKLMRPLGPNALFYLAAAVSDFFIPRERMAEHKIQSSELPAHLDNSNSVAGSEIYTGGLETQGRKQQETRDRSGPGAQVSA

SEQ ID NO: 32423 - protein, 61 aa, A.fumigatus
  UNSURE (37),(58): Identity of amino acid sequences at the above locations are unknown.
RAIGGLKASIALNSSVIVWFTFRLGRTYLIKSPPSAXGAPLQFFSTYIIRLTLFQGLXNCS

SEQ ID NO: 32424 - protein, 99 aa, A.fumigatus
TQPTRQVDFPVGPKKGKRGGTKRKEEFRKMLAKQNGNKVDEELQEEVVKKTWDSNVITPGTPFMDILAASLRYWIAYKLNTDPAWEKVRYFGGSNANAC

SEQ ID NO: 32425 - protein, 605 aa, A.fumigatus
DADLIMLGLATHEPHFRVLREDVFFQESRARTCHLCGQQGHKAEECRGQAKEKNGEFDEKQKGSSLKPFIWLHVSILREYLAAELYVPHQPFPFDLERALDDWVFMCFFVGNDFLPHLPSLDIRENGIDTLIAIWRDNIPVMGGYLTEDGHVDLKRAQLILQGLAKQEDAIFRRRRQAEERKLANEKRRKQEAKAREEERARKRRRSSPTYEPMDSPVGHRAPRGGGDAAPPNQLELITPSRGELSRQTRELTHSMVVNRGAVYRANMANKSAAAVLKSKLMQGSQNGQNGEEKSEGATTNNDEPSQDQPDQTEQTSPSVLGKRKADLVEEEDTDAGTPGRDSPAVPVAAKEDELPPDTVRLWEEGYADRYYEQKFGVDPQDKEFRHKVARAYAEGLAWVLLYYFQGCPSWTWYYPYHYAPFAADFVDIGDMEITFDKGVPFKPFEQLMGVLPASSNHAIPKVFHDLMSSPDSEIIDFYPEDFAVDLNGKKFAWQGVILLPFIDEKRLLAAMEKKYPLLTEDEKLRNSVGREVLLISEAHPLYQDLVANFYSKKQGVQKYKLNMRISDGLAGKVERNEAYIPHSSLPSSLEEYGMPSLEDDRSLT

SEQ ID NO: 32426 - protein, 223 aa, A.fumigatus
LTSFHPSVNYEIPKSNHVHKSMLLRGVKFNPPALDNADIQAVKHKAQNSGRSYGGAPLRGGQKGGRINYASDRPNPFAAHLDPGFIPPVPGNVGGGPIMPSGWVPPIPGSAGFSRGPPPPPHGGMSGSHHRPPYGQGPGQYQGNHGQGDHYGQGQQGYYNQSSYYNQSNQYNGRSSDHGGSGGYRGGGGYHRGGNYRGGGYRDQRQYNQDQYSSRNSGGYGRY

SEQ ID NO: 32427 - protein, 75 aa, A.fumigatus
GGRIIDECVQVGFNANTFCSFSVLTNLGCSALASLDDNMATSPPSNPTSPLLTKSQPAVERRPSKAPSTTGEEAS

SEQ ID NO: 32428 - protein, 82 aa, A.fumigatus
LTCVHALLVPLLLCFYATFASTLAWCMPSLFVCVSVYLRFAAIFILDKMPLEKFPSFPPLLRLGIYLSYRRCKLHVYAYVSI

SEQ ID NO: 32429 - protein, 132 aa, A.fumigatus
SLILKAARAQQEAEMERLRQQANRGNRPQMGRGDARSFSGYGNQAPPPDYASSKVGSDDLRRLRTTRNTNQPMSFGPSSMLGSRSSSGRKNLGPGGNLVRGSDDSAASSRSGTPTAGKKEDKEAASSMNAFR

SEQ ID NO: 32430 - protein, 624 aa, A.fumigatus
  UNSURE (356),(381),(386): Identity of amino acid sequences at the above locations are unknown.
RQERERKEREEREAYEANLKQAEAEAEALEEERQRKREAAAETSNKELFAALKKGGLAATEDSTPADSGTATPVSDISMGPPGKPASAQKREKPAALKLETTKAVEPPQPSAAMKSLQSARFVDDLSKINYPPSIVSPNPALNANAPADRKFHYNKEFLLQFQSVFKEKPSIDWDARVRETVGESDTSRPQSARTPMGARNPSRGGVAQPFVMGSFGQPAARTTSEQRFAASNARGPAMPFGQFGRPPVGMGAPSISRPGSNMGIGPGTPRGGGSRSNTRTGSKREKQSAKKEEEMAKAMPLTAGKEVKALQISSTGWKPRSIVQPAAGPTPGGHLPPDMVQRKVKAPLNKMTLRXFDRISVQFLEIVSQSKDESDGRTLXQVIQXTFEKATDEAHWASIYAKFCKRMLESMSPEIKDENIRDKNGNVVTGGSLFRKYLLNRCQEEFERGWKVNLPPKPEGTTEEAAMLSDEYYAAAAAKRRGLGLVKFIGELYKLGMLTERIMHECVKKLVDYEGMPEEAEVESLTSLLRTIGASLDASERGHTFMDAYFARINMMMDIPGLPSRLRFMLMVSLSPFRTCSFGINLTDLQDIVDLRNARWQSKDADKGPKTIQQIREEVCDRS

SEQ ID NO: 32431 - protein, 470 aa, A.fumigatus
LPPRGEDIPFTSPKEVYDEWRKMSFGRPLDCSALTYEKLTGGSGIQWPCTKEHPYGKDRLFDDGKFFTDTDYCESYGHDLETGTPYTRAQYQAMNPAGRAILKSAQYKPSLEIPNEDYPLLLSTGRNVFHFHTRTKTGRARRLQQADQEPIVQISVEDAQALHVTEGEMAVVRSRRGSVELPVRIGGINDGHVFIPFHFGYWDATDGRARAANELTIGRYNVEKTDWLEYRILTNAEQWDPVSKQPMFKSGAVRIEKCVQKEAERQTMAVRSVEMRKPDAASSAGDNSNDKKPIRRMELWLGATDQALEMLRDMYVDMIPRLVHDMEIQSGLQVMRRITCEISDQFKPIIERYHESQQYGRRVAEHLRDSIFPAIGESKDPYEALAALQSLDLFLTDIEGHLTALSPASQALWDCDFIEAVKFAQKGIQRQKGWVSQHIKVKSPQTLLVPSAAAEELSGEDSRMAGQIRC

SEQ ID NO: 32432 - protein, 84 aa, A.fumigatus
  UNSURE (7): Identity of amino acid sequences at the above locations are unknown.
LKTNDAXSSSPVVKTLEELKTHSNQPVSFGCRSSLLLIHIWTKGTNSDITSFFHAEVRKVPDNYRLFEIVVNSLLWAEIGLFMK

SEQ ID NO: 32433 - protein, 73 aa, A.fumigatus
ELKLNVSAPTVRIIALLEGPGYTVPGNLYAASWAIGLHQLIAGLASNFSLFVFTMLSTIYQFHHTLLPLILTE

SEQ ID NO: 32434 - protein, 201 aa, A.fumigatus
TIQLLSHDSTTAQQIPITSQLFSIYTELVRPVYAGSTLHSVRAAFEKAIGDPAHLPHTGTGALTNGVSSSTSTALSSLTLWKLYIMFELSRHEINRAKEVFYRAIRACPWSKELVMLAFTHLRADVVRDRYKDSPRKGEGMGFDELRRVYNVLVEKELRIHVDIEEELDRLAARRLEDAAMSLGPIQMPDDAESEGERMQL

SEQ ID NO: 32435 - protein, 179 aa, A.fumigatus
TRWGCTKSPSRTARKCPSCSSTDLTAPPPRTSLKTKLPSSSAPASVSHPGPPFSRTSGTSAQDRTRPAVYVGSSSSGSAKTPPPSSGSRPFCPRSSPSPPAPPPARAVPSSCASTPTSRSGSTRTLPPTSTSTPSVRRSTRSLSSAVARTSAGLTSIGSSRQCETGCMTRHTCLVSIRP

SEQ ID NO: 32436 - protein, 287 aa, A.fumigatus
DSMKYKAGQWLFIQVPEVSNTQWHPFTITSCPFDPYISIHVRQVGDFTRALGDALGCGPAQARDMEGLDPLGMYEVALQNGQKMPKLLVDGPYGAPAEDVFENEIAVLIGTGIGVTPWASILKNIWHLRTGPNPPRRLRRVEFIWVCKDTSSFEWFQALLSSLESQSASAAASQGSAEFLRIHTYLTQRLDEDTAANIYLNSVGQEVDPLTELRSRTNFGRPDFNRLFTAMRDGLHDQTYMPGFHPAMTTEIGVYFCGPNAAARQIREAAKRASTRDVRFKFWKEHF

SEQ ID NO: 32437 - protein, 605 aa, A.fumigatus
  UNSURE (272): Identity of amino acid sequences at the above locations are unknown.
PPVYLLVKMQKVTRHIPTKDDLGKSFAYLRLLFSLDYTIADVLLIIGGLLFAICAGIPFPLLGIVFGDLINDLNTVTCSSSDRATADLSSAVRAKVLYVIYITIANFCFIYAHSTCWCLVSERLARRYRRRYFESIIKQEAKFIESLPSGDVVSRLVSDIELVQSGTSEKVGLVISTLSYFVAAYVVAFIKVPKIAGMLVSVVPCFFLMALGGGHYIKKFAGRLAEKVNAATSIASSSLSHLTLVHAFNANERLEKRFAGLLFASKKDAVRXATTHAAQLGCLYFIAYSANALAFWEGSQMISKSVADGNSGTSVGAVYTVIFVLIDASFILSQVAPFIHVFASAAGASERLLQVINRPSAIDGTSDSGDKTAAFGEEDIRFRDVHFKYPSRPDVPVLQGVTFNIPPKKHTAIVGPSGGGKSTVVALLERFYDPDSGDVLIGDKNFRDINVRYLRGNIGYVQQEPSLLDRTILENIAYGLLSSAMERHQRLAPFILDSSLPDLAEKIREGLTEKEALREYDSVSTRLWTFSKKRLPMRWRLALLKHWPIVSPPNVGTARNHFSGGQKATIWFLPCSWSRTLAVYIWTKQLSVLILTVEPLYPGPF

SEQ ID NO: 32438 - protein, 89 aa, A.fumigatus
ISFAFNSFILHHCLSTLRLALDTAPGGWRADAGILTYSSRFLSLPLIYSLCTSVVSDTFAPYGQQSFKGPFRRCSAKFGLIKFIGSRRR

SEQ ID NO: 32439 - protein, 288 aa, A.fumigatus
  UNSURE (183): Identity of amino acid sequences at the above locations are unknown.
HTVVASCPSPSFIPCAHRLSQTHSPHMGNNPSKGPSGDAPPSSASSNLSAPAGDKKVNRRPSTNAISGAAKATAADPSASIETATGHSATARQTPVQQRLQSRNITDSSRGNSERHDRHDAKKAEPHYRDIPSPDPSNPVQVPVSRAAARNDATVAPSGPPLNTYYSASTHLQRPPRMPLPIXAMQPLLQVHRSSDRRLPIGFVSGDRSLGEQASQDNAGITNTAIDDEETLDELEPYTPSGVGRAVPTCIEWNGPGEKVYVTGTFVNWEKKYRLHRKYVTLHAYCCV

SEQ ID NO: 32440 - protein, 224 aa, A.fumigatus
  UNSURE (215): Identity of amino acid sequences at the above locations are unknown.
YVNSESNPGVMSTTLNLRPGTHHLKFIVDGEMRASDNLPTAVDFTNHLVNYIEVSADDVNQSRRGSDRTNKSAVPSGVHPPQVIPNLIGDDRNGVENQSDKEEPEEIPLGDFQTIIPQFLVDLDKDEDSPEYQQAANVIGDTPTPPSLPLFLGKSILNGTTPMKDDSSVLNYPNHTVLNHLATSSIKNGVLATSVTTRYKRKVRSPPNSTTFVRXSPPGLEIPR

SEQ ID NO: 32441 - protein, 617 aa, A.fumigatus
  UNSURE (433): Identity of amino acid sequences at the above locations are unknown.
YEIYHLQLPQVRALKFDIHYQDRDRVSPGYWFVAPYGQIEPEAPTHRFEQYQIGPYIYDGDGTLVWAGSPMFDNRNVFDFKAVHSIGDEPHLSLVWQHSWDNEDQGHGVILKNNYEIQKKLPFREDLGAFDIHEFNILDDGKTGLAMTYREQEISLEDFGRPEERTAILSGGFVRLDLNTADILFEWDSLNQVPLHESVHYGPDSPPEGRPGWDYVHANSVDMNAAGDYIVSFRFTNTIYLISGADGRILWRLGGQGHHSDFVQDFTFSKQHDIKFVESNGTHHIISFLNNASDEDTNDEPVSSALIVELDTGAQPMTANAIRRYNRPDGGLTRLRGNPQLLPNNNLFVGWSERGYITEFAPESEVLLSAMFNSTRFSTYRAYKFCVPRRAPTRRPTCSPPVPGTDASDFVTTIYVSWNGATDVARWNFYARXAANAPPVFIGNTTKTNFETIYLAHGYLDWVSAEAVDHAGNVLGVSRVHRSRVPADWAAAGFKGKVTELHPADPHLLYSLNGANKQKGTHSSIPAGVEADTSGNSGITSVGTAEEALRIAQETYELVRDFGALFMSVLVLCLVAGIAACVYTVLRRRRRTKAYQHVPSEEGLPEEQIRLRSTTQE

SEQ ID NO: 32442 - protein, 184 aa, A.fumigatus
  UNSURE (177),(183): Identity of amino acid sequences at the above locations are unknown.
RHIKMLDLSLPTALVLIDNQAAFTHPTYWGTSRSNPAYETNLASLLHAFRTARKTNPTLPLEIIHVFHSSPSPTSPLHPADPSKGAHPLDFAQPAADNSEPVFWKNVNSSFIGTGLEAYLRDKKIRQVVFAGLTTDHCVSTTVRMAANLGVADVYPDGKPEILADGTQTVKVFTTGXEGSTEXQ

SEQ ID NO: 32443 - protein, 359 aa, A.fumigatus
TNKVALSLILVGVVEAGLFPGLITYLTLFYSSHQIALRTGYLFSSAAIAGAFDGILAYGIGYMDGISGLRGWRWIMILEGIPTVILGIITWFVLADEPDTAYYLNEEERALIVRCRNRYVGQTVSAQKFHWADVKEGFLDWKIYAFSIGQFGVDTMLYGYSTFLPTIIKGMGSWSTPEVQALTIPCYALGALAYLAIAWLSDRLQRRALFICIFSVISMVGYGILISDVSSGAHYFGALLIALGLYVTVGLPLAWLPTTLPRYGKRTLATGMQLTFGNVSGVMSPFLYKTTEAPRYVRGNAVTLSLIGFAGMMWVMMWLYYHHENSRRANGLEDEKIAGMTEEEIQELGDNSPRFRYTT

SEQ ID NO: 32444 - protein, 214 aa, A.fumigatus
SLKHLIISISASTPHKNTASAAISCQCHGVTMAAQSKLLPPERSIRQILSSLSSLYLRHRKQISRTVYLALFVALVKRVHNAISEQKAASRSQVDLRKRPGTSSLGDGDEPPRKRVEVNREFFRNLLRLLKIVIPGWKSKEFRLLIGHSVFLVLRTMLSLYVAELDGRLVSSLVRGKGKDFLLGLTWWMIVAVPATFTNSMVSCCWSCRIAIGF

SEQ ID NO: 32445 - protein, 215 aa, A.fumigatus
  UNSURE (120): Identity of amino acid sequences at the above locations are unknown.
LSYHQCKLALSYRKRLTDYIHDKYLSNMTFYAISALDDRVKNPDQLITVDVSRFSDSLAELYSNLAKPILDMVIYNYSLSKSVGGEGLFIMSLLVQLSANIMRALTPPFGKYVADDARLXGQFRFLHSRLIDYREDVALYHRQDADKDSWTQGTSPSLTPSTGFYQDQYFPDSCEDLVLKYFRGSSKLDLVLPAPFSSRLPRPNPPQLWRNAPKL

SEQ ID NO: 32446 - protein, 226 aa, A.fumigatus
  UNSURE (7): Identity of amino acid sequences at the above locations are unknown.
GGGGSFXPSTIVYKTLHGPIQRFEDEYPETRVKPASVVSALQETSSQISGDDAAAAPAGSGQLFGMTIDENAVDDDDTDQYAIRLSRTSSITSLHARAMTSEEGHVHRLGQNLRRDFLSPSLNQGDGHPSSTSLDESHLEALRNKLERLHEEQTRSHFEGANADKAFEEMGSVVEELWAMEKQDTAAFEQWRQTQIAAQINSGKQTASPKPSDAIKEQLEVNQKPS

SEQ ID NO: 32447 - protein, 234 aa, A.fumigatus
TTLKKNTYSVSSAPPPHTSYPEINAPINTTATQNGALQTETPPSPIFTSYERGLLRSTWGTKRGVISRDSFLPFGSCRLCLQPARTPVACATNGDLFCRECAINDLLAQRQEIKRLEREREEARKRLAEDEERALEDARRRELREFELVSMGLEAAKNDHTKGTGGGGGNGDSQRKRKAEETEEALAAFKAREIEVDGKRKKIFELDEKEMARIAREEQERLKRELKREKVLGL

SEQ ID NO: 32448 - protein, 118 aa, A.fumigatus
WAQGDVYVLPYYAPLAGSVRLTKLVAKPCGHVICQPCVTKFMTPHDVPDPHASKEEQERTAKLHGLILCYVCEADITPRDPKAEADEHGTEKGNGKKSKKKDKEQGIPSSPRTGRSAS

SEQ ID NO: 32449 - protein, 123 aa, A.fumigatus
SGRRYLGCSCRGFGVHLANWVQSESSKSALPSLWVPSLTPSTDPNEIAANKAVKMTPICPGSTDENRHAYSLKSLVDVHFTEEKAADGTVSRICPSCNKNLSNGLKAMCMYCPTTRHSRAQFG

SEQ ID NO: 32450 - protein, 538 aa, A.fumigatus
RYKSPLALRASGGSERGRKPRPPENLRRMRGSAAKGGGVPPGFFKVCRIPPAPRVRQGGAANAQIWKRYHMIALQPENAKVLVLGLNLAFVNHACIANASLYYTLRYPRDENGEEDKSLPPKIGRAVVRASRDIRPGEEITVAYFYAKGECGVRQLMSSMYCKFWCVCRFCRDPVRETENALEKLYTLETIFEDADTLYKRPAVVFKNAYELIKLYERLKISDTRQVQVWLYCAVIAGYNCDLGRAMLFLIKARGLVLILHGPNGHLYDRIRVYCQMPPLMPGFGTTTRGRSAVKQCYFMFADQKHSADVLFMLTAKPDEYIRLHRYRRIPDRLAKPGESRYLIRYDAQDARRKKFEDEEPDPVEFIPWWYDAEVRKQIIEEKTAKEAERKEERKKTARKKKREEQKRKETTITNPDCIEPEKDFLDVCRELVAEFEAHDKQKPEPQQRELRERNRDALQHLLGARNEPKKRADEEDKGESKQEHETLGGPWTQVSPHEHEPVPSQPAVHQVAARKRVVLETPPVRPETEKYAPVELC

SEQ ID NO: 32451 - protein, 116 aa, A.fumigatus
DTKMAHSNDLQVLPPSAGYGIVIGIGGIFALFMLGLTWLQNRYTTFSTHQAEEFNTASRSVKPGLISAGIVSSWTWSATLLTSSTFAYSYGVCGPMWYAAMGTLQILLFALIAIKI

SEQ ID NO: 32452 - protein, 105 aa, A.fumigatus
IPAFPSPESIQIIRSNHQNNQHTSISYFNQLKMPANQNPGNFANRPQEEVESIARKGGQSSHQGGFASMDPRKQVRLHNGLCTLTSPTDVFTERHRFQGWPRLQR

SEQ ID NO: 32453 - protein, 67 aa, A.fumigatus
LVLSNDQLFNIKLSSVPGFWNLEFYWWYGLLLPSNSDQHSALAFAGRTLSISTPQYERLSGRAVAVQ

SEQ ID NO: 32454 - protein, 60 aa, A.fumigatus
AFISFGNFYRRFIKDFLRIIAPLVNLTRKDVPFIWTTACKLSFKALKKAFINTPILKLFN

SEQ ID NO: 32455 - protein, 76 aa, A.fumigatus
YNNKGVLHPIAFFSKKLSVTECNYEIYDKELLTIIRCFKEWRPELEGTPSLIKVITNHCNLEYFMSTKLLNRQQAY

SEQ ID NO: 32456 - protein, 69 aa, A.fumigatus
  UNSURE (34): Identity of amino acid sequences at the above locations are unknown.
SEFLSRFNFKIIYQPGKQGVKPDALTRRSEDLPXEEDKRLQHQSQTILKKENLDPEIQNSVKLGAITNS

SEQ ID NO: 32457 - protein, 61 aa, A.fumigatus
WNLAVILPQSQRKMCVSAILGKPRMYWTFVAFLIFSDTNGDSNNNRDIEEHDRLAMDTPLL

SEQ ID NO: 32458 - protein, 84 aa, A.fumigatus
DYPSCTSLCVAPLAVYSCPSCPLTLARFAHQLPFYGLICFACYLGGRLGLAILTFNDCPEAHKELQKEIEQAKADLRSKNVDVD

SEQ ID NO: 32459 - protein, 208 aa, A.fumigatus
FSGDVTASVASNCLVIDFSRFTGCDGSNGTKAAPSLLIASMATIAHEDLQKHTGIRSPGCTPDPRRRYATFKESVSSSLYESARSAAMTAGWCRRSVARSWTTWCIALNLGWTKARSFHFPIWSNCLRLTKQISLRGIPLPALASSTTSSKEDFRCVAWISVSTVVLYARKHFRQLESRSSSRTNSTLQAFIRSGQPFIRGESVRSHH

SEQ ID NO: 32460 - protein, 730 aa, A.fumigatus
PDRMKACNVLLVLELDLDSNWRKCFLAYKTTVLTDIQATHLKSSFEEVVELARAGRGIPLSEICLVSRRQLDQIGKWNERALVQPKFKAMHQVVHDRATDRRHHPAVIAADRALSYSELETLSLKVAYRLRGSGVQPGDLIPVCFCKSSWAIVAMLAINKLGAAFVPLDPSQPVNRLKSITRQLDATLAVTSPENQSLVEDLVTTTVVVSETTVSELVDVHNEIVLPACDPGAPAYCLFTSGSTGKPKGCVVDHAALASVATHSHALHLGPTSRVLQFASFTFGVSLIEVWCTLAAGGTVCLPSDSDRVSRLADAIRSMGVDWCILTPTVLATLEPEAVPNLRTILVAGEPLKKAQFSLWAERARLFQAYGFTEWAGICCVSPQIRSIGDVGIIGTPANARCWLVEPGNPNQLAPIGAVAELAVEGPSLAQGYLHDPEKTAATLIPPPRWRAQYGHADGKRIYTTGDLVYYDSNGMLRYVSRKDRQVKIRGQRIDLAEPEYHIAQACCTIRNVVLDAIVPADSNGDAILVAFVLPSRDESSSNGGHDSPLFAVPDDHFTSSVRQLTSFLEDKLPDYMVPRLFLQLKETPVTITGKIARQKLREAAEALRHDELVALAGLETRVLPPNTHKETLIHQLVVELLHLPPEMVGMNHNFFSLGGDSVSVMKLVSRAKRVGLSFTVKDVFRSPQLGDLARLTDVVNSGAAQHMPPFSLLDRGAQPGLLSMAAKIC

SEQ ID NO: 32461 - protein, 64 aa, A.fumigatus
GKHGAWAGRVSIISKGVYIMDRYATKGKDDYSSETSSEGKLIVDWFRCFCYFPTMRADMCGAAQ

SEQ ID NO: 32462 - protein, 489 aa, A.fumigatus
WLEDERSPVTNLTDTNTQIQAILTRESLEEYSRDYPDQKLKKGGMPGYTINLLDFELVFEYTTAEPKIHLYVKRFSIAWDKSRLRRPPQGKKIRNKREVYALMRSALQMAKSRETATTDSSGNGSHSDESIKSQDGETDEINDSQNQLMSQMPPKQPVELFASAFASAKTLLGSLKPSARPSQDSQQKKDNDTDIVASGRDHHALDEATKEPNINRCAAHIDELSAGPSVVGPRQNGNATVRESDQTDTDTAGEVPAKTRSGKGPSDTKTQERTLTDYNKEPDHAVNIGTVSKEIVQKNHLEQVDPAVETILTEVDNSNADPWDGMTEIRTEDIAIPKDQANLLDEQAKLCWLPPAPGQGYPQPNVPPLLLQQWNEIALQRSIRAEERKIKELETLELQGSRPSSSDASSSTDSAYETPSGDRIEWSQSPPRGRDLPVDSSPPEARPVERPIVYKGNGGNGPSNQPFRDAEEEQRASVHHEISHEQEEL

SEQ ID NO: 32463 - protein, 73 aa, A.fumigatus
WHRNGLAIVFWSQSTIIDSGQYPSYLSMIPFMLDAVPRVGPPTFSGNLNRHKVPQPHPRHWAAPHMSARIVGK

SEQ ID NO: 32464 - protein, 416 aa, A.fumigatus
  UNSURE (416): Identity of amino acid sequences at the above locations are unknown.
MAYQQSQGTSSPSASSIFLPLGRRGSRASVSSQAERESLNAALDQIHTAAYQSDSLTVFNDFTTPPVPASATEEKNLSAELQGGLSGLYSRFRTSVGGMRDIVSGVGKASDKSAPDGPAMKSPPSERSVSKFAADSTGPLAEAQQSNPSSSQGFRLQSPTPGSSQNTHELPTGKASKLSSKAASISSKASVSPSPTLKSPTVPLPKSTSNAATVDPTVTELHVSAVKEPTHYSSNTSVNVSSSSLQTVGSTGAEREENHYVPSMSSSGFSERLTHSPALSAKAHNPPNEGHAALDSSNKSKLTSQPSDSTKRLERRTSHDLEPSLTAPLQMTKNTTQGESEGTSPAQDRIRSNSATSFGLDRASVTASSGATSVSQLPSNKAGTLHDSQGPSTSATSLSLMDGNPKLDASPKGPFX

SEQ ID NO: 32465 - protein, 148 aa, A.fumigatus
LRGRMYMLAIHSDLCLQTLIAWSQTYKAMEKLLSTGKTKAIGVSNFSKAEMERLVQNTSVVPAVHQLEGHPWLQQRSFVDLHKSKGIHVTHYSPFGNQNEIYSSKVQIGKLIDEPVLAEIGKKYNKSSAQVALGKFSCRPIQAGNNVY

SEQ ID NO: 32466 - protein, 187 aa, A.fumigatus
YIYSILAVIGFGFHKVQPNHRPFSLTDPSISFPYTEHETVSTAVLMVVALIAPAVIIVITALLIPMSTKDQNVPRSSLWRYKLWEWNAGWMGLAVACAWAWMATEGLKDLYGRPRPDMLARCNPDLSNIATYAVGGLGENLAGAPTMVTWKICQNKSKVLANDGFASFPSGHSSCKWLMSAPEGLQY

SEQ ID NO: 32467 - protein, 162 aa, A.fumigatus
HLAVSFAGLTYLTLWLCSKLSIAFPYLGHSLLNQNPIGPINGSIRKRGAAPPVYMLVVAFVPIAVASFIGASRWFDYRHHAFDILFGSIMGAIFAWIGFRMYHLPITRGEGWSWAARSRRHAFFKSPRFPSEADERRPIDTHDTQKTTRQDIDVERAAENLV

SEQ ID NO: 32468 - protein, 84 aa, A.fumigatus
TNSSWKQCLLTVIAYSAWGVTQGHSVLPKSKTPSRIKANLEGDFHLSDEDMKKIQGIDKKLRFNDSSADFGRDFFTDLEGKGSV

SEQ ID NO: 32469 - protein, 390 aa, A.fumigatus
CTGPRRTEATTWLDFQLVFELRFQRVNIANIDANLRKALSPLAAKACKIVSKIRARELETVWSKGSTQEQAHGADEILYPGVMFHLARGRMENTDLWKIVQKMPKGSLLHAHMDAMFDIDFLVDQAFSTPGMHIFAPQPLITAKELEEAPFYLRFSSQPLEESEDKPTMWTSSYESSRLVSLQKAASSFPKGGEAGFREWLKSRCVLGPEHSYLHHHGVDAIWDIFRRTFPVINSILNYEPIFRACLRRMFEQLASDGIRYVDFRIAFVFEYRREGRDTPEEGYFEWCRVFKEELERFKNTEQGRRFYGARIIWTTLRNFPNKDIAASMKQCIETKLAFPDVICGFDVVGQEDQGRPLVDLVPVLFWFRKRCVEEGVTIPFFFHAGECLG

SEQ ID NO: 32470 - protein, 60 aa, A.fumigatus
LQNLGWQKWDSHDLAQPEANVLGSRYSVIELAGLEHTFYNKASLELRVMGQRISRDLTAQ

SEQ ID NO: 32471 - protein, 68 aa, A.fumigatus
DNHPQMQAMWTDRNVELEEPEIYVVFRVYYLGKENMGLKVYVDPERLRQEERLIFSPESYSVYPSLVA

SEQ ID NO: 32472 - protein, 103 aa, A.fumigatus
GILDLVSLRKCVWNGHPSLRTKHPLATHPEYSNDPHVACLFRDILSVRDADVSTYVEELQWRKDNADVGLDDLKAIYNCILQNIQNPEDGAMILYELCMWHEG

SEQ ID NO: 32473 - protein, 205 aa, A.fumigatus
GTMPSRRSHSKSHHGCTQCKGRQIKCDEVRPIYGSCRRKQLPCNFQSFAPQTSPQPSIADAILGHRDSFVLPLLDLELLHHWHTVTGNYLPDAKPLQDVIRTVMPQEGLANPFLMHSILAVSALHRAHSAPLSHRHMYSEAATMHHSRSLALCTPLFKNITRQNCHALFALSCLVPVFVFTSRNPSKNPRIQSLTAVVQAFRLVR

SEQ ID NO: 32474 - protein, 409 aa, A.fumigatus
QRGQVAETKMAILSLVILGGLCLSTASGQAPTQPEPFTIVELPLPPVVSSNAVGACTTDVNPRRTGCIGQISEEFQAGDFTSDGKHVIVNVEFVGAPAAPDPASVYTGKQLILVKADGTNFSNGDPWKCLSCGVPAANARSLDSQRDYPHVARSGKRALWGHNIVECSGLLLASDECTPNRTCSYPIYWPVNADGSGPGGAPREMRMHPDDEHMGWSSFTSNGGQFAYFGRLAFNKNPSTGNIRAPRYDLVDVNLLILPNGPAPIMANGDELELHDEAITVGELRGFSGSGDEILYIGSPREANNIDVFAVHLVTGAVRRLTSHPEYTDPVAFSRDDKWFVAMDTRGSDRQMWMSGMRMVPPLIDLVTVTAASSTRNNGPRRFFQPILIDRHGDRGDYFVFTTGLEEST

SEQ ID NO: 32475 - protein, 251 aa, A.fumigatus
LRYIAELPPDGSTCNDILFSLLGLTYDAVIASKMVGLAVEHNIQVNDGPLTSENAAVLRPSDPSLPLDELRARYEQDGYLFLKHLLPRDDVLEARRQYFSLLAPTGVLQEGTDPVQGIFNPTKSPDQYPGIGAGAVGNNGRPGGDQAAEFVDLAIEAHYQDWYADKFCNHPALVRFVAEFTSWGERTLNFRRTLLRNNTPGTKPIGVHYDQIFLRYGEPTSVTAWVPMGDIKINGGGLIYLEDSMLSSCVP

SEQ ID NO: 32476 - protein, 93 aa, A.fumigatus
QCICTLADGPGDPVGLKIEEEFTTKAKQAGLTDEEARSAFNSNMMATGLLSESPIEFARQHGRRWLVSAYEAGDVVLHKPHMVCLRPLPRMLS

SEQ ID NO: 32477 - protein, 191 aa, A.fumigatus
TPPGWVNLQRHPVFTTRTYIRRCDRLKNGRTRSRAQHPSQRWPLDLRKRRCSPSLRPLPPPGRTPRPLRTRRLPLPQTPSPPRRRPRSPQTVLLPARPNRRPPRRHRPRPRHLQPHEIPRSVPRHRRRRSRQQRPSGGRPGCRVCGSSHRGALPGLVCGQVLQPSRFGPLCGRVHELGRAYVEFPPDAAEE

SEQ ID NO: 32478 - protein, 85 aa, A.fumigatus
VDRQRLGHPLLPPRRLHPVCTTELADLAKHQSEFAKRGVKLIGLSANSIESHDGWINDITEIAGCSLTLPVIGDEDRKIAHTYDM

SEQ ID NO: 32479 - protein, 119 aa, A.fumigatus
QSATRNRLDHQDVTNVGARGIAYTIRSVFIIDSNKVIRLIQAYPASTGRSTTELLRVVDSLLVTDKYSVNTPANWEPGDDVVVPAGLTAEEAQVKYPNMETVKPYLRFIPLARHHLYQH

SEQ ID NO: 32480 - protein, 73 aa, A.fumigatus
RSTMLSQCAANHLTILSDYASIYRLRLGFKAPNFQADTTIGRIDFYEWIGNDWVILFSHPEDYTPSAPPNWQT

SEQ ID NO: 32481 - protein, 196 aa, A.fumigatus
HLMLIKMVPGQWYEAQIRLHSFHIWILNLRLLGSETRGNDYIITRLPVGGGVDGVLVGDKQGIHDTEQLSCAATGRGRIRLDEADHLVGIDDKYRPDRVGDAAGADVGDVLVVEPVPRRTLLVSSQQWAADEKGRDPLHIISMGNLAILIANDRQCQRTASDLGNVVDPSIVRLNRIGGQADQLDAALGEFGLVLG

SEQ ID NO: 32482 - protein, 104 aa, A.fumigatus
  UNSURE (85): Identity of amino acid sequences at the above locations are unknown.
VRIAFPSSPGVEDEIRLTKNLNSVNFPEFSSTQSLNSYGDVRTQLIQLAEYEHIHTLSCLNDLTQILENSGRQTISLYLQMYHRXCIIYNETCVKYAVGSTTAM

SEQ ID NO: 32483 - protein, 74 aa, A.fumigatus
VWAILRSSSPMTGNVNEQPAISVMSLIHPSCDSIELADRPISLTPRLANSDWCLARSASSVVQTGCSLRGGRRG

SEQ ID NO: 32484 - protein, 73 aa, A.fumigatus
TSETIRSSLYNICKYLIMCMSNTEFSYKVGKSAIEKYKKVHEAKAVTAQLWQSIYGMEQQKPVFARLLLVSQS

SEQ ID NO: 32485 - protein, 110 aa, A.fumigatus
ACSRCWQGRLNAEQLLPQCFQGESISCRHGDDAHPHARPQRIRAAEQSLNIDRNNYLHIQMMDRLWGSGDPNESLTDTYYAAYDDHRYLKWASVAVSKDSYISTSCSDQL

SEQ ID NO: 32486 - protein, 99 aa, A.fumigatus
IRSSMLPYQPDHPFDSSNPKSGSVSTHRALKIARQQVFLVFSFFFYNSPPIYLLPIHVLQRISTTDGMLAASLSLARHSLPGETRQHTQMIGIFRLRGG

SEQ ID NO: 32487 - protein, 299 aa, A.fumigatus
QECGSHFSLRRYFVKGSSIKMIRRLAAFSALSGLATAWLPEVNKKITSTNGTNLFTSSNGKIRGVNLGSQFVFEPWIAEKAWSDMGCGGQKSEFDCVSRLGQANANSAFASHWGSWITQDDIAEMVSYGLNTIRVPVGYWMREDLVYSDSEHFPQGGLQYLENLCEWASDAGLYIIIDLHGAPGAQAPQNPFTGQYAPIAGFYQDYQFERALKFLEWMTTNIHQNDKFRNVGMLEVVNEPVQDAGKVGSMRSSYYPNAFKVSRSHAGTETMLTLTLDRRESALQSKASTSIGTTTSTSR

SEQ ID NO: 32488 - protein, 69 aa, A.fumigatus
SGHDTDTMSIYSLTPSIVRLSPHNKGGTVLWEYATIDGPRPAVFHPIYFRILYTALRACDGMPARLRCY

SEQ ID NO: 32489 - protein, 436 aa, A.fumigatus
LLLALQTHLSMANVHGMLISSAVFVDSLYNPHYGYFSKHATIFSPGEPFDFNNIEDGPAFHRMLGERYTEFENKLDETQPDVARQLWHTPTELFRPYYGETVARYLVSNYKLTLYPYHDLIIYEMGAGNGTMMINILDFIRDTDYEVYQRTKFKIIEISPALASLQMKNLTDSVNAAGHMDHVEIINRSIFDWDTYVHSPCFFLALEVFDNFSHDAIRYDCKTELPQQGGVLIDADGEFHEYYNAQLDPVASRFLRVRQAAARRPFPSPLGPKAMRQLRGALPFQSPYTLPEYIRTRLMQFFDILDSYFRAHRLVASDFNSLPDAVPGINAPVVQTRYKRRTVPVSTPFVSTFFFLTLRTHSNCAIQVHQGYFDIFFPTDFNVIEDLYRAITGKLTQVMSHEDFVRRWAYIEDTETRSGENPLLTWYKNASMLMTV

SEQ ID NO: 32490 - protein, 131 aa, A.fumigatus
  UNSURE (45),(59),(112),(113),(120): Identity of amino acid sequences at the above locations are unknown.
PRKLINIMTPSPIPHWKSAVQQKRAAQLNAIPPSWRLPSTILTPXLPNTLETIRSCGLXSAEELEWTETNDVTNLLSRLASREVSFVQLTTAFCKRAAIAQQMTKCLTEIFXXRALRERXDWMISMRRLVF

SEQ ID NO: 32491 - protein, 61 aa, A.fumigatus
ASITIQITNCRSLPGASMASITTEYISVGGNRHPAAADWDVQLGVLAFGADNNVALWNPSV

SEQ ID NO: 32492 - protein, 781 aa, A.fumigatus
DASQRGVYALLVGHTDKVSAVRFYTCPATGTKLLLTGSIDQTIRIWRADTVDPTKFAHAHTLTGHTGSVNTIAVADGVAIIASGAADGTVKIWKIDTQETVIRADLFQSLTMKPRFFPLALSLKPLSTPLSTELKDKPVVLAVAGTMNNVQVYVSEDTLAGANFRLSATLSGHEAWVRSLSFTEDKQSKSGDLLLASASQDKYIRLWRLQRGEATKSALSDDADPMLGGLETTLSNKAHQFEAAGSKYSVTFEALLFGNEDWIYTACWNPSTERQQLLSASADNTLTIWEQDPVSGVWLSVERMGEISVQKGSTTATGSTGGFWIGLWSPNGRQVVSLGRTGSWRAWRYDADRDMWLQALGITGHVRSVNGVQWEPTGGYLLSTSADQTTRLHAEWLREGLKSWHEFSRPQIHGYDLNCIDILGPARFVSGADEKLLRVFNEPKPIAQLLEKLAGFKPGTDEELPDTAQIPVLGLSNQAVGDDIPMEVDEESAAGARQVQANQAMISNLWHPPLEDQLARYTLWPEHEKLYGHGYEISAVAVNHDRTLVATACKASSIDHAVIRLYDTSDWREIRPSLKAHSLTITSLCFSSDDRYLLSVGRDRQWAVFLRSGQDPSSFSLLTSNPKGHFRMILDAAWAPQVAKPVFATAGRDKSIKLWEKVQDSFTCKTTISLENSVTAVSILPSILDASFFLAAGEESGKLSIYQVTVDGLEARHIATVDRSVSPSRAITQLSWRPSHRTDVRDTQSRFELAVASEDSSVRVYAISSSPRGSKDPRYAY

SEQ ID NO: 32493 - protein, 158 aa, A.fumigatus
RQIRSNPGGQAWHSFFKNKVMRRGWLEWLQMSMPSNYYPSRISMRVFIVLQSVDVSIVSVTVCVKGCRRAASLSALNASILALSSVSRQTQSAASLSTIKKDKRQELTRGYIFHLERSSVERIMWVTQKMRSKSRTIHGYLGSREDNWIFHQGIDQGI

SEQ ID NO: 32494 - protein, 512 aa, A.fumigatus
  UNSURE (2),(4),(6): Identity of amino acid sequences at the above locations are unknown.
PXLXPXWWTHGEKGTTNFITEISFLTVAAHHYGSESLTSKLDQLEKDLRHMEGTIRRFELERPRWIHNPVQLRVFEQALRKYKDKLDLGLALKYSLQGVLFDDQWQARSMLFMRYVIVWLLRLVSGVNFPKEPIKLPLPEQQPEVFKCLPEYFVDDIVSNFKFIMWCMPQIITATQGDELVMLCITFLESSDYIKNPYLKAGLVSILFRGTWPRPGGARGVLVDLLNSFPFANEYLLHAVMKFYIEAEHTGTHTQFFDKFNIRYEIFQIIKCIWPNTLYRNKLYNQSKQNLDFFVRFVNLLLNDVTYVLDESFGAFITIHDTQVELSRNGNNMDPQERQQKEEHLASAQRNAKSYMQLTNETVAMLKLFTEALADSFTMPEIVQRLADMLDYNLDAMVGPKSSSLRVDNLQEYGFNPRALLSEIVDVYLNLMGKENFILAVARDGRSYKPANFQKAGEILRKWSLKSPEELQQWEQLQAKVRAAKEADEQAEEDLGEIPDEFLGMFGELLTW

SEQ ID NO: 32495 - protein, 123 aa, A.fumigatus
NLRRSSNNGNSCRRRSGRPRRLMNKPRRILAKFLMNSWVCSANYLRGDGQIADGFSLDPLIYTLMEDPVILPGSKVSMDRSTLRSHLLSDPHDPFNRAPLKMEDVTPGKLLSFVFLNRRKRRG

SEQ ID NO: 32496 - protein, 164 aa, A.fumigatus
QSQESNSLNRSIVGAWSTNSKPQKSAEPSASESAPTPAPVPTKRRQHGGESQSSKRRKADVTVDRSPPTHVSLADLGGLDDVIQSLGDLLILPMTRPQVFVSSNVQPPRGVLLHGPPGCGKTMIANAFAAELGVPFIPISAPSIVSGMSGESENLHDEEQETRQ

SEQ ID NO: 32497 - protein, 131 aa, A.fumigatus
RGELLVLRAILDLKNQRDKLRQYQKRITVLTDRETAIARECLARDDRRRALLALRRKKYQETLLSKTDAQLEQLEHLTSQVEFSLVQKDVLFGLQQGTKVLQAINKEMGGIEAVEKLMGETEEARAYQEVK

SEQ ID NO: 32498 - protein, 311 aa, A.fumigatus
EYTVTQVSNPSLLATLEALDHDLDSFGNSFATTVKYAGVGIALDRYAALRNLHRLSRIMQPVKPDNIIARLAKILESVPRPFGKDGHWHALQTHRVQSLGEVGRNVPQVWEREGLECRRGHFSGPGVKHLDELRPGGNLEGEILHADLGNLLQQCLRLLWILVDPHLGLHKQLGSTTFNHVAEQSPWGTAEANQRHAAFQLVPGKRDGLVYIVQLLLHVDLLLHNLLVLSIVRRLQRFREVGSLLVHHFYLHSHGLRDDKDIRKYDCSIDQSCIPIHGLDGQRGCNLRVPAAFEEIAVSFRFMVFGEVAAS

SEQ ID NO: 32499 - protein, 103 aa, A.fumigatus
WDPSKPTSDIDCSVHNLSTIHLSFYQARVLSLFSVTLWIHILKLITMETDAGFIAALEEAKKGAAEGGVPIGAALVSKDGKILGRGHNMRVQKGSATLHVSPN

SEQ ID NO: 32500 - protein, 110 aa, A.fumigatus
AEMSALENSGRLPASAYEGATMYTTLSPCDMCTGACILYKVKRVVIGENKNFMGGEEYLLNRGKEVVVLDNEECKQLMEKFIKEKPELWYVFQSQLWFSCGIIPLLLSCS

SEQ ID NO: 32501 - protein, 139 aa, A.fumigatus
TKLTIHSSSSKLLCFTLESDGSLKAQNSIQASGNVLDLTVPSENSSIVVSVDAVREAGSTQEWRTSPSSPSTLVEAFRLKPASEGPLDWERTSEAITAQINSEGTSDISADLDEKQKKELNDSLYSLGNLRKKNMGEDD

SEQ ID NO: 32502 - protein, 354 aa, A.fumigatus
LDALAGRYLPEYHEAKGNRDFFECCRNPEIASTLTIQPVDRYAGLIDAAIIFSDILVIPQAMGMQVEMVDKKGPHFPEPLKSPDDGQYEKVMQKEVNVKEELDYVYKAITLTRHKLKGRVPLIGFCGAPWTLLCYMVEGGGTKLFVQSKMWIYKYPKESQALLQKIAEICVEYLALQVASGAQLVQVFDSWAGEMSPAAFKTFSLPYLRYISANLPKRLDAMGLERVPMTVFAKGAWYALEDLCESGYNVVGLDWLHDPAEAMQIAKGRVTIQGNADPGILYGSREAITEAVEVMVKGFQGGKQGWIANLGHGIFSSLVRTSSIRALTVTGITPFVKPDDLKFFFEEIHRLTAA

SEQ ID NO: 32503 - protein, 143 aa, A.fumigatus
RSVSSDSGTSTSTPQSSLPSMWSSVMRLIEMGTTMPSARVSDVSPVSMVKTSSVLSKANCLRSSSYGCCNSARIVSSVARFRWLRFFSSCSAYSSRIRSLTLSCASSRKSFRTIAPGPFSSVSALMSSSSSSKASAAIFRAIS

SEQ ID NO: 32504 - protein, 811 aa, A.fumigatus
  UNSURE (49): Identity of amino acid sequences at the above locations are unknown.
VQELLSRPFTMKDFQIVKDYVHFSNACKLRDINLMNGEANGETHRRKAXGRSFFERVRNGKAYGLVRAFGITADAFAQNALKEGRRQYTEDPAERPEEMADSFIDNDFSNASHVLKTAKALFAEEIVMSPKMRKVIRQAYYMNGAVDCFRTEKGLRRIDEQHPYYEFKYLRNQQLSDIARQPELYLRMLKAEEEGLVEVKVRFENFDHFRQRLYPDIESDNYSEIADAWNRTRREVLDMALGKLERLINRSVKENIRQECENHVAKECREAFSQRLDQAPYKPKGMVLGTVPRVLAMSTGTGIVGRDPIHWAYVEEDGRVLENGKFVDLSIGDRDRSIPDGKDVEALIELLERRRPDVIGVSGMSPETRKLYKLLTELVEKKDLRGATYTDERDEEISDPLEVVIVNDEVARLYQHSERAKKDHPSFGPLTHYCVALAKYLQSPLKEYASLGRDIVSIQFKRGQQLVAQELLLKQLETALVDMVNLVGVDINEAVTDPATANLLPYVCGLGPRKAAHLLKIVNMNGGVVNNRVELLGVNAQYPAMGVKVWNNCASFLFIDFENADPDADPLDNTRVHPEDYDIARKMAADALELDEEDIKAETDENGPGAIVRKLFRDEAQDRVNDLILEEYAEQLEKNLNQRKRATLETIRAELQQPYEELRKQFALLSTDDVFTMLTGETSDTLAEGMVVPISIKRITDDHIDGKLDCGVDVLVPESELTDRYDIPVRALYSLHQTLPAKVLFLNKKNFLCNVSLREEQVSRPTPRPRDHMRGEWDDRQEAKDREMLQEKTQSGGRVSLHRGDGKIHSV

SEQ ID NO: 32505 - protein, 67 aa, A.fumigatus
GPALISSHSQIDKSYTSDSRCRPGYDSLMDAFRSAARESYVNSNYQSLLVMQAPQLEQRLRPHLLNR

SEQ ID NO: 32506 - protein, 126 aa, A.fumigatus
RSTQVTMLSAHEFDQKPNQVSISPLLQKLAYPTTQVPVDPAEIASAFALIFEDRLSAIQTAALLTLLHSTGKDRDAQVIALCSLRMREAASQIEKSSLQKAIKARGKKEGNYGGGLVSESKPEPIA

SEQ ID NO: 32507 - protein, 331 aa, A.fumigatus
LSCLFDKFVLVQCDIVGTGGDSHSTFNISTTASIIASPLLMMAKHGNRAQTSFSGSADVLNAISPVPPKISAVTAENLAQVYEATSYAFLFAPNFHPGMMYANPVRRGLGLRTIFNLMGPLANPVDWALEARVVGVAYQSLGPVFAEALRSSGVTKALVVCGAEDLDEISCAGPTNCWKLTGYPNPDYDGPDEDCSCDEDENIPRTLVKIETFQLHPSDFGLPAHPLSAVYGRKMPKENAAKIMSILRNELPPDDPILTFVLINVAALLVISGICEADTSNMGPGDDGKVITERGPGGGRWKEGVRRARWAVESGSALKCLEQFIEVTNRL

SEQ ID NO: 32508 - protein, 190 aa, A.fumigatus
  UNSURE (22): Identity of amino acid sequences at the above locations are unknown.
FGGPTGEDKGEGWQGSLVLTPXSVMDLRRPRLATWSEYLSRRLGWRGKRGNSPPRRPKRAPPELELELVAAVPLVLASALEPVVLEPSPLRPLSPPSPLRPLSPLSPLSPERPEAPEEPELPRLPRLPRPGMEVGKVNPGRLKPLPEEEPPRPGMSEAKAPRPDEVEEPPPPKVGKREARAPSPSVPVPN

SEQ ID NO: 32509 - protein, 88 aa, A.fumigatus
SRRRYLSIKQQVPCQSVSVVESYTTHLNRGSSASPCQNIVHLKHDLSPVVGDLSAAPSPRSQFRNLTIFESRSHLVYSVLHRLDQHPS

SEQ ID NO: 32510 - protein, 273 aa, A.fumigatus
LIEAPRNYFNNIQDPFALSIANSLIYVITKPQDVAEAYRNTDTLSFNEFVQAMMRACGNTESCVKTMYKPLPKDKPGFPNPHGKPLATLARQMHIHQLYPGDNLDFLEKQFLDWVEPRLTLDALRRECPYAIQSGPPAVTKDDGIVLPLMQWCSDYFTRAGQRAYFGPALDGIDPKLPQTFIVFDELSWQVLYQYPEFLAGKMKSARNAIQRALKKYIQLPQESRQGDAWFTKAMENEMRALGISEDDIATMLVTIYWGYGPAILLTDSIEAS

SEQ ID NO: 32511 - protein, 204 aa, A.fumigatus
QLRINTNTRKAAFWLLTYILHYGPEHYVDIIRQETLPAFFPDKSIPDLNYLHDNCPHLDAMWNETIRLSAYSASVRFVTSDTIIGGKILRKGNRLMIPYRQLHFDESIFGVDYPVEEFRHERFMQKGRNLTRSDNWRPFGGGTTQCPGRYVAKRFVLLFVAMLLRRFDVELVTTRIPAAEEGKPVLGIMSIKDGEDVLVRVRPR

SEQ ID NO: 32512 - protein, 223 aa, A.fumigatus
  UNSURE (201): Identity of amino acid sequences at the above locations are unknown.
DNMKISATAVVLLAGLAAGAPTKTIQSKFEKRQFGTGTDGLGALASLFPTLGGGGSSTSSGLGALASLIPGLGGSSSGSGFSLPGFTLPTSIPGLGSLGSLGSSGSSGASGLSGLSGLSGLSGLSGLGGLSGLNGLGSSTTGSNAEASTSGTAATNSNSNSGGALFGLLGGEFPLFPRQPSRLLRYSDHVAKRGLLRSMTXNGVKTKDPCHPSPLSSPVGPPN

SEQ ID NO: 32513 - protein, 770 aa, A.fumigatus
GITDSSFLSIGYSGVSLFVSPNMHIVAVVMLRNNVIPGCHVMEKESFMSQEVASLLNESFIPIKVDREERPDIDDVYMNYVQATTGSGGWPLSVFLTPNLEPVFGGTYWPGPNSSTLSRQDTVGFVDILEKLRDVWKTQQQRCLDSAKEITRQLREFAEEGTHSQQGDRQAGEDLDIELLEEAYQHFASRYDTVNGGFSRAPKFPTPANLSFLLRLKTYPSAVSDIVGQEECDRAAAMAVSTLISMARGGIRDHIGHGFARYSVTADWSLPHFEKMLYDQAQLLDVYVDAFKITHNPELLGAVYDLATYLTTAPIQSPVGAFHSSEDADSLPTPNDTEKREGAFYVWTLKELTQVLGQRDAGVCARHWGVLPDGNIAPEHDPHDEFMNQNVLSIKVTPSKLAREFGLSEEEVVKIIKSAKQKLREYREKTRVRPDLDDKVIVAWNGLAIGALAKCSALFEEIESSKAVQCREAAARAINFIKENLFEKATGQLWRIYRDGSRGETPGFADDYAYLIHGLLDMYEATYDDSYLQFAEQLQSMFHDRGSFGRTILTQAEYLNDNFLAYVGSTPAGYYSTPSTMTPGMPGPLLRLKTGTESATPSINGVIARNLFRLSALLEEKEFRTLARQTCLSFSLEILQHPFLFVGLLDVIVGLQPTPRSVTGVFCTANLPQSVTLEGTDRLINKPEEPVSVRDMIIKKIRSEAGSTMVTSATVTSLVDIRPSHLGDFVGNQSFWLRTRNPLLKELKPSGTVKNYLMVCESGRCTMVDV

SEQ ID NO: 32514 - protein, 141 aa, A.fumigatus
AHCDICISLYQKSVPLTKLMLGLGRPRLKARPSLLDLIASRGVVDLSESKPSSPPATDELPPLPVSPTSTTSSSSSSNSNIELASSPPSSSIHTPVVRIMAPSGKDKTGEDQHGIIFSISGPVVVAEHMIGCAMYELVGHY

SEQ ID NO: 32515 - protein, 267 aa, A.fumigatus
GYHSGIRGDRYSSASTLGRTVTGNYDSNVFLFHPLAGLTVGDPVMRTGKPLSVELGPGLLETIYDGIQRPLKEIAAHSKGIYIPRGIAVNALDRKKKWDFKPGKFKVGDHITGGDIWGTVFENSLFNDHKILLPPRARGTITRIAPAGQYTVEEKLLEIEFNGQKSEHGMMHSWPVRVPRPVNEKLPSDAPFIVGQRVLDSLFPSVQGGTVCIPGAFGCGKTVISQSVSKFSNSDIIVYVGCGERGNEMAEVLMDFPEVRDSRPLLR

SEQ ID NO: 32516 - protein, 62 aa, A.fumigatus
LTGILLLLQCRVGHDQLVGEVIRLDGDKATIQVYEETGTAPHLHWDELLLATMTLTFSSFTL

SEQ ID NO: 32517 - protein, 82 aa, A.fumigatus
LSIDVEGRKEPIMKRTCLIANTSNMPVAAREASIYTGITIAEYFRDQGKNVAMMADSSSRWAEALRELSGRLGKDCCHTRVS

SEQ ID NO: 32518 - protein, 280 aa, A.fumigatus
IICRIRNLHRTGRMFPQARSQVELFHHVLETATVKHVRSIHHPLIATPNDIYAESPNSFYVTNDHYYREGYGRLIEDLIPAAKWSSIVHVLIQDLKSKDADKGIDATVALTGLHNNNGLGHGRSKDEMLVVSCMSGTLYRARSNSDNRTISVFDEIHPGGQIDNPTYYADPYRTAADDASGYILAGMARPIDLSKHYNDPNAKDGAIVWYVRPKTGTSESGDQFTEWESSVLFEDDGTLIRTASTGLLVPSETKPGERKKAWLFVTGFVSESVIAVEVDL

SEQ ID NO: 32519 - protein, 112 aa, A.fumigatus
LIFQSYGGHYGPEFASYIQEQNAAIKAGTVSGENINLVALGVNNGWTDSAIQEKAYIEYSYNNTYKQLINSSDRTRLLSVYNSQCLPAIQKCAKTGTNADCRNADSVCYSNN

SEQ ID NO: 32520 - protein, 103 aa, A.fumigatus
SRIWSPRLTMWCQKWLFAFLVAGASAAPASTAKDSISSVVKNGVKYTVFEHAATGARMEFVKNSGICETTPGVNQYSGYLSVGDNMNMWFWYVLHNSMTTCRA

SEQ ID NO: 32521 - protein, 336 aa, A.fumigatus
  UNSURE (149): Identity of amino acid sequences at the above locations are unknown.
YGQGKMGLHRQGKWPKGKMPKADAGVPESLYSRREGTSQTLGRRTWWSHWGILVGKNGLAAAVGNPNVYGQGLKDWLQCRTIYIMRQFSFRGGAGDAEWFPGVGGGNNGACMEAAQKELGNDALLSSTVVSMERPADRLHRILVRTPTXYQLIRAKKTIITTPPKVENLVNFDLDDTERGVFGQFENAFYYTTVVRVAGLPAGLDIINRAADTPYNIPHLPGVYAMLPSRVPDIYTIFYGGGEAKTEDEVKKSIRDGVMMLREAQFTPSEPEILAISNHSPFALFVSADQIAKGFYRDLYALQGQRNTYYTGAAFHTHDSAAVWSFTDNLLTTMFA

SEQ ID NO: 32522 - protein, 242 aa, A.fumigatus
LHAEPNLCRFFEARNNPKQAPLAAWFNGGPGCSSMIGLFQENGPCHFVNGEDTPSLNKYSWNNYANMLYIDQPIGVGFSYGTNDVTSTETAAPYVWKLLQAFYAQFPEYESRDFGIFTEVGPVSDLAIAEIADLPVLRWTLWPRIRVVYSGAKRRHQSRNGIWRKYQPGRTGSQQRLDRLGHPRKGVYRVQLQQHLQTAYQLVRSHASAERLQQPMSASDPEMRQDRHQRRLQKCRQRLLLQ

SEQ ID NO: 32523 - protein, 87 aa, A.fumigatus
AISCIIGWISVSALHQVANVGCLRSRLQRTKQDIRPMWFTNFFCIVAARRFLFLILLTISYYYFRSRIINNTLILDKLCATSNYRPL

SEQ ID NO: 32524 - protein, 333 aa, A.fumigatus
  UNSURE (77): Identity of amino acid sequences at the above locations are unknown.
VTHPGSCTAHQKLIDARNLIDGVSVTSLHHSIAHPFPPAVGGVLIQPGPLPDCSLSQLTAEVLQSRLHPVLKELQLXDELHETQPLDFWVLIGSISGTLGHADQALTAAMSERMATLVRQRRSRGRPASLVHLGEISGIDIPADGARPWWGPTAVTQRDIDEVLSEAVLCGGPNSFARSAEFIVGLRHQSLQTGRMAGPVPKLWPFYSYTATASQGQKPPSLPERRQSAKDLVAAATSREEKAEAIAACLMEKIRARLKLNADAPLSSDTLISELGVDSLVAVELRRWFAKQLAVDMSIVLILSGASVGELANAAASKLCNGNSELCTSSNLV

SEQ ID NO: 32525 - protein, 122 aa, A.fumigatus
RFLCRSPSPPPQYDNFGRRVNTREYRYRKRLEDERHKLVEKAMKTIPNYHPPSDYRRPTKTQEKVYVPVNDYPEINFSMITNPLTPNRSCIVSFLALCSSRARETSPYDDVSKARFLLTLAT

SEQ ID NO: 32526 - protein, 194 aa, A.fumigatus
NSKSMCPHLDGSSDTNEDNQAASIPEGQNELKRNQLRELAALNGTLRDDENQACQNCKFFHKALLVELLILTRAGGQIGHRKYDCPEQRNFTANIICRVCGNAGHMARDCPDRQRGSDWRNGGGYGGGRRAIGQGDAVDREMEVSSMWFLKYRPTNADWYSNLCKNCPVVLQAQTASLLAGSRLVPITVTMIVT

SEQ ID NO: 32527 - protein, 174 aa, A.fumigatus
PLLLDYLASIALLSLNNHHELTLSSLLPFKVGLLIGPRGNTLKKMEAESGAKIAIRGKGSVKEGKGRSDAAHASNQEEDLHCLIMADTEEKVNKAKKLVHNVIETVSLCALTWTDLQTLTRITRLPRFPKARTNSRETSCESWLLSTVPSVMMRIRLVRTVSFSIKLSSLNCLY

SEQ ID NO: 32528 - protein, 167 aa, A.fumigatus
  UNSURE (11): Identity of amino acid sequences at the above locations are unknown.
AVGGLEVKMAXKKRVARRRLHLSAEIMGSSVAETQFEVRLCLCCIIFNRFINFSSFTADPPADGVKRRKKRNRWGDAQENKAAGLMGLPTMIMANFTNEQLEAYTLHLRIEEISQKLRINDVVPADGDRFVFVPLSSFFFFFFFFFFLFRRELTFSVQIPIAASAVR

SEQ ID NO: 32529 - protein, 196 aa, A.fumigatus
LVQQLMQELSGGAPGPDGQPPRRIEAGPDHGYDDRDVKPWQRGPPPSDVAPWQQRGRDNRSRDDYGSRDQGSAPPWAAQSRGGDYGYGSHAGGYGAPGAGAATSGAAPWHQQAPPPPPGGASAYGYGAYPGYGAAVPGMGAPGAPPGLSVPPPPPGMPSMYYGSGSPPPPPPGEGPPPPVCSPFGPTDQLEIRQDC

SEQ ID NO: 32530 - protein, 65 aa, A.fumigatus
RCRWVDTPMIHRSIESGTLDSQFAMIPLGRPAVADEIAHAILFLASPMSSYMCGEAMVVDGGLSA

SEQ ID NO: 32531 - protein, 228 aa, A.fumigatus
  UNSURE (7): Identity of amino acid sequences at the above locations are unknown.
PQSNGMXGVPGLWTPEQAAGWKRVVDAVHEQGGYIYCQLWHAGRATIPQMTGSPAVSASATVWDSPTECYSHPPVGSTEPVRYADHPPIELTIPHLKQTIRDYCNAAKTAMEIGFDGVELHAGNGYLPEQFLSSNVNKRTDEYGGSPEKRCRFVLELMDELAATVGEDNLAIRLSPFGLFNQARGEQRVETWTFLCESLKKAHPNLSYVSFIEPVSFPYNYNPWLPQL

SEQ ID NO: 32532 - protein, 114 aa, A.fumigatus
PVQRYEQIFSYEEKDNFLRSWGLSDVDLSSFRKIFGTTPFFSAGGWDQSNSWGVLEEGRYDALLYGRYFTSNPDLVERLRKGIPFTPYDRSRFYGPFEDNAKCYVDYPPATASS

SEQ ID NO: 32533 - protein, 103 aa, A.fumigatus
RFRWPDQSSSTAKMTIRKLDGEESMLFQPLEIANGRIRLSHRVVHAPMTRNRGVPLNPTSTPEQPNRIWYPGDLMVQYYRQRATPGGLIISEGVPPSLEVGTF

SEQ ID NO: 32534 - protein, 69 aa, A.fumigatus
PQCLLPVRRSVSLAARLPADLSKFSFLFIVIILLRRLVLVVTQNNCIPVLFGNGQESQLELTRLSESSH

SEQ ID NO: 32535 - protein, 221 aa, A.fumigatus
TFWRALHCAKSAAMSSGSEDWLGAGGGAATDDDIHTQRPRYASGNNENLNEDADYSMIMSYPAEEEDYYALLGLRRTPTPSDAEIRSAYRNLTLSFHPDKQPAELREAAERHFARIQEAYETLLDPKKRVVYDLLGAEGVRREWGAGGAMGRGGEAESQIGVRAQTPEEFRGWFLETMKKRERKVLNSLVQSRVGSFPLAALLRLLRDIVLTVPWNGNRAR

SEQ ID NO: 32536 - protein, 132 aa, A.fumigatus
QGSLTLGVDASNMIEVDENAGEVYIHIPSPSLSSYAIRYSFKAPLPTPKVLFGKEADEEDDEDEAPDGRSTQQKVNSYQEAQGPEITFNAGISGNLRRSFRKMQFQFEDGETMTRAVCSEMYCHPQPCRTVP

SEQ ID NO: 32537 - protein, 64 aa, A.fumigatus
PDPGDDRLTTNMRISISGPDGVCWKIAITFRPLSHGAKLTPLFSSPGRLSDHFPKAAERESAVP

SEQ ID NO: 32538 - protein, 62 aa, A.fumigatus
SLWRHRRSRSNAIKRCSSPRKSVANSMQATILQACITGFLALAVGLCFSKLPNLNQVQYSVR

SEQ ID NO: 32539 - protein, 218 aa, A.fumigatus
HRKKRLINPEGDGWPHRTGSHGMMESRSISRVAVDSKSIQPASSHAAESPAVPDSSFATPIELSSTPPQPLPERPDNMRRTSWSQGANGYVEYIRPRWQPDSEVTNCPICGTTFSFWYRKHHCRKCGRVVCAACSPHRITIPRQFIVRPPESNRSPAVNLIPPRAAQVINVDGDDTSQSPGGDQSSSRRWRGGTTLQPVCARPEPGTASGLPCGSRRW

SEQ ID NO: 32540 - protein, 330 aa, A.fumigatus
MGTIHRNRPVAINPALGGGEEVRLCNPCVPDPNPEPLRGYPAVRGGGEQGTNWGRGSPSQGRHRSYHSMSTSTRQFPYDAFVSFVNLRDRLSNTDTISSFQTESSSSRLNRRSISSNGYTGLGGALGGVFSSSLQERPMRYGSLPGSQYSGRHVSSSARPYLGYFRAHRHLPPPAPEGTSVSTGGSFSTTSDDHDSHRRVSYPARHHVDESDICPICSDELPPLGENGNEDAREAHIRECIESHGRGTRSTSRGGSPVAASPVPVRMLAFTATEKDCLGQDGAVQECTICMEDYEVGQPLVRLECLCKFHKRCIVEWFERKKECPVHKVA

SEQ ID NO: 32541 - protein, 62 aa, A.fumigatus
LSLDLQQLASYMAYRCRNLLFTPEWIFHLATLPSTCLPNPTKLQLVDGVLQDQNLPFLVHCL

SEQ ID NO: 32542 - protein, 62 aa, A.fumigatus
LPLDHAVSASTVYLIRSLGTVWGVAITSAIIQNTLRSGLSKALSGIPDKWKVTSLKWSISVR

SEQ ID NO: 32543 - protein, 63 aa, A.fumigatus
IIEQIRHSVSAIQDLPPDIQMAARLVYYRGIRLSFAAAAGFAFLATIAALFSRGKGLHRGSSA

SEQ ID NO: 32544 - protein, 312 aa, A.fumigatus
WNSRSLSAIMSNVFLSGFDGTITASTYAVISSEFNAANTASWLTTSYLITSTAFQPLYGRFSDIFGRRVSFFTATITFIIGCLGCGIADDIVLLNMMRALTGIGGGGLMTMGKLPSPPAGGPPHSHGPATIVNSDLIPFKRRGMYQALQNGMHGFGSICGASFGGSIVDTVGWRWCFLVQVPIGLFALITGHLVLHLPRHHQTFGQGRGFRAILRYVDLSGALLLILGLSSQLIGLSLGGNELPWSSIWVILSLMASLFLLGLFMLVEEKTPAVPLIPSRMLRGVMPVSTQIANVCVGMAAYAVSGPPLGYI

SEQ ID NO: 32545 - protein, 131 aa, A.fumigatus
ATAYQRQFLFTLPLLFQVVLLDTPTKAGARLAIPSLAAPIGSLIAGVVMSRWGRLAYLVRAGCLLMCIGNLLVMSIKFHDAGWKYLTYVIPASLGQGIVYPGILFTFLAAFDHTGKLGSLSYRNVRAHDFH

SEQ ID NO: 32546 - protein, 354 aa, A.fumigatus
NRCVRSVDPCHRQKGPLPPVRCAHSTNEFLIAFGQSTTFLLRSLGQALKPLLNSDCEIIVSILCHEGSAAAWVALAKDLGIAIKWWAPPPGDDPVLSLDTLRPLLTPKTRLVACNHVSNVVGTIHPIRQVADLVHRIPGAVLVVDGVAWAPHRPIDVKALDVDFYCFSWYKVFGPHVAQLYGRRSAQKRALAGISHFFLSEMPGLDWRLRLGANSFELEEALVPITRYLKRVGWDNIIAQETVLQDVFLAYLRRRPRVFRIFGEQSSDPAKRVPVITFEVIGHSSTVVANKVNQRGRFRVVSGNCWAPRPTHDVLGLGAEGLIRVSFVHYNTVAEVQEFCTELDSVLETLNAGI

SEQ ID NO: 32547 - protein, 437 aa, A.fumigatus
IRAKTHVYALVRGSSENQARERLVQKAISAGWWQDAYRTRLHVWHGDLTQPQLGLSQLQWQMLQGKASPSIDAIIHNGAKVHYSQDYETLKKTNVSPTVELLKAVHDREEPLHSFVFVSGGQQLSFDDREDEKNAAKSLKGSGYARSKAVSEQIVRRFANQKGSKARHVRIVKPGFIIGDAERGLANQSDFIWRLIAACVELGFYNGDEADSWLFISDITRVAQVILHSVFEDDSQPVTKVLDGLRFKTLWALLQDKFGFELQPLSRREWLARLKHSVATKKEKHVLFPLLYLLEADEEPIGVFQGPLDPTTGVEAALHANITHLVHSRFLVGADPVLTPVTSVASPAPVTDAIDVQSLREQFPALHHGVVPFNNAAGTVVHREAAESTHRYMTSFPYELGRDDPASAAKTQRLQDRFAELAAFMNADPDEIGASVP

SEQ ID NO: 32548 - protein, 401 aa, A.fumigatus
LNGHIELGAKDLFVGDMDLRNGRTYFIRVGIHECCELGESILKSLRLRGTRRIITTQLIREGGHVSVCALRSLPMHHRSGSIVERYDAVVQRGKLLSQALHINGIRHGRRTRDRCDRSQHRVGPDEKPRVDQMGDVCVQGRFNPSRRVQGSLEHPNRLLIGLQQVEQRKQDMFFLLGGHGVFEACQPFSPREGLELKSELVLEKGPQSFESQAIQHLRDGLRVVLEHAVQNHLRDAGDVRDKEPAVCFVPVVETQFHTRSDQSPDKVGLIRKASLSVADDEPRFDDAYMPSLGALLIGESTDNLFGHGLGSCIAGSFQRLGRILLVLAVVEAKLLPARDKNKAVQGLFAVMDCFQQLDRGRDIRFLQCLVVLTVVHLGAVVDDRVDTRRCFALQHLPLKLT

SEQ ID NO: 32549 - protein, 63 aa, A.fumigatus
PAPWPLTCGRVSALSLQISLHANETAAITGDELRTGPCEPITFIFARGSTEPGLLVCILYASP

SEQ ID NO: 32550 - protein, 116 aa, A.fumigatus
TDGRKGITTGPGVCNALKLSRPGQVACQGVGPAYIADLASNFLPQGTSQVAIDEAAGLFKLAASKCPDTKIVAGGYRYFPLLFITAIETAKKKNCVVREQLSCTVPSEISPATSRI

SEQ ID NO: 32551 - protein, 92 aa, A.fumigatus
KKKLCSQGAAVMHGAIRNLPSNVQNMIKGVVLFGDTRNKQDGGRIPNFPTDRTKIYCAFGDLVCDGTLIITPAHLSYGDDVPSATSFLLSKV

SEQ ID NO: 32552 - protein, 230 aa, A.fumigatus
GGAMLLTRVGSMAVWREIRCRVTSTLRHGDTGTITTHLIWSTRVHFLPLFLGIRIQLTRAAFNFSHMITELSFGPHYPTLLNPLDKTIATTEDHYYKYQYFLSIVPTIYSKGNLALDTYANAPPSNRRGKNLVFTNQYAVTSQSSVIPESPYFIPGLFFKYNIEPILLLISEERTSFLSLLVRLVNTVSGVMVTGGWLYQMSGWLGELLGRRRRRGKSEGVLTGRHEADD

SEQ ID NO: 32553 - protein, 379 aa, A.fumigatus
GHSTRFVSSQHEPLTCSSAELARRDVSAIVLESGRSQVMVQMLTIVVVILAKTKPFYTAPSPRGGQWTVLVLLVCTFLSISEFRTWLKGTEKQHFSVEKGISHDLQLNLDIVVHMSCDMLDVNIQDASGDRILAGQLLKREPTSWQLWMDKRNYETYGGAHEYQTLSQEHADRLSEQEADAHVHHVLGEVRRNPRKKFAKGPKLRRGDAVDSCRIYGSLEGNKVQGDFHITARGHGYHNNAPHLEHKSTFSPFVPGYSNSTDARSLQLLAHDHRALLRPSLSDPPQPPRQNHRHNRRPLLQVPVFPLHCANHLLQGQPRTRHLRQRSALKPPWQKPRLHQPVRGHQPVQRDSRKPLLHPRPLLQVQHRAHPAADQRGAH

SEQ ID NO: 32554 - protein, 161 aa, A.fumigatus
  UNSURE (1),(3),(7),(12): Identity of amino acid sequences at the above locations are unknown.
XPXMNAXCDDPXLVVKTTAPDTSNPAANAFDDVDLVGGSFADHARRRSIAQQHSSFSTVLSSGLAAFTGSYGNRSRESSTQQHPPAARGSLELLSEENFDDEFDEAEFARAQAEEEARKRVEWVREIKGKLKDWKGWRLDLVDSRAGAEGAGVGMGEIFEI

SEQ ID NO: 32555 - protein, 124 aa, A.fumigatus
VLLWFDITDRFSSCTAINRSPLMLAQGTDVTTAEAAVIAKYNNLIATYLAQFKSKNSGVTATVVDTQAPFNQALDNPTAYGAPDATCYNSDGTSCLWFNDYHPGIAIQDLTAQAVASALKELFF

SEQ ID NO: 32556 - protein, 254 aa, A.fumigatus
STALRSMRPWNKHCTRHCAKYDNNDNNHNNEHRYTHRAKVLHHFVSYPKLPTERSWAHPASGDSYSQTGFDISSTKPSASNPLGNPTLPGWTTSGGLNWVGFLVSKYNTSLTLSYNFAYGGATTNASLVAPYTSTVLSFIDQVTEFTNSIASKPSYAPWTSGNTLVGVWMGVNDVGNSYWLSNIDELLLKIMDSYFGQLQILYDAGVRNYVLLGVPRKSCFGSISLTDSHHVQQSTAPHLCLPKAPMSLPRKRQ

SEQ ID NO: 32557 - protein, 220 aa, A.fumigatus
KEFAGGSEEMGERQRTNAMPQAWPRPRNMVASGNSISVIHANKQPSLSLWRYFGYDQDNPDESHPLNKHMKTVSWMQLLDPHADTIYANEPEVIPDETLATFKFNRRSAYYKKRSRWERVRRVVDEARAGNFDGLIVATLMEPASVLKHTVPLLAGSAPVVVYSPTVEPLTELADLYSTPRRTAYITRKREIIAQHSLQQSLQGAEPLITNNNPHEPDFS

SEQ ID NO: 32558 - protein, 94 aa, A.fumigatus
LDKDFALDPSLLLAPTIETSRVRAWQVLPGRTHPLMSGRGGAEGYIFHAIRVFPSHQNIQAAGNPSRKKRKVAAQQESATPAESGSGVDVEMQS

SEQ ID NO: 32559 - protein, 156 aa, A.fumigatus
GPGCSRNRYERLYFFTNLSVKQLMNLAPHCSGLVANISSRRLPSGNFPVLPLRTRTRGPAYTLPPLPAGVSDIDVPPDSESYDCVDEILSLFRANVLFRNFEINGPADRMLIYGTLFISECLGKVKPGMTSREAEKVLLGQECVRGSANGHTSGFD

SEQ ID NO: 32560 - protein, 98 aa, A.fumigatus
DRNASGDLLMGIRQALINVSLDHFAIPGDVAFPLNQAFEPPRDRQDAETLRQYVPISFKSLRALSLMRFDSDTSPKYGRRSLFDYMLGYTLAVKGLPR

SEQ ID NO: 32561 - protein, 132 aa, A.fumigatus
LGVFEPSQAHVQLGTIVLDRDRHSFTDLPPELSFIFLFRYVTATMLLDISAFALSTTGVLCMLLCLVVKLFETSPVPKNIPWVLSKKGFFGRAAERFLGVNPIGFIQEGYQQVGLCHAVLWHSMYTQVGMIG

SEQ ID NO: 32562 - protein, 300 aa, A.fumigatus
MAPPMAKKRKVLDSLKNKAGRPKKKFRKQLEYHSSSDEAEDEQPTDFQAVNLADSDAEEERKPVERKPQKPASSETRSLGAQKKRKAEDSDDSSAASENESDADDNNGSDSPDSSDMEDDEYGDSDTSLPTSTNGRRRPVAKRNDPTAFSTSISKILSTKLPSSARADPVLSRSKSAAQTTSELADEKLDKQARAKLRAEKKEELDRGRVRDVMGIERGLTGVVAEEEKRLRKIAQRGVVKLFNAVRAAQVRGEEAAREERKKGTIGIGEREKAVNEVSKQGFLELISGKKGKPLNIEEA

SEQ ID NO: 32563 - protein, 85 aa, A.fumigatus
FFLIGACGGSCACSTCHVIVEDPEVFDKMEEPSDDENDMLDLAFGLTETSRLGCQVVMNKDLDGLVVRLPSMTRNVQASDFAQKK

SEQ ID NO: 32564 - protein, 100 aa, A.fumigatus
ERVLLSLLDVQRFSLLSADQLKKTLFADFVDGFLSFTNANGTLLPLFPCSLFSTDLGCANSIEQLHNTALRNLPKTLFLLCNNTSKAALDAHDIAHATTV

SEQ ID NO: 32565 - protein, 63 aa, A.fumigatus
FMSCRLHVSFIDKDGQKHDFEVAEGDNLLDIAQANDLEMEGSDLLLAVYATVRLLFAHLNSSS

SEQ ID NO: 32566 - protein, 553 aa, A.fumigatus
DFDISPLELQFPLLHQLRLLEDETGASLHLTSLKEFVDHNFSVPIDHFHNESRYEPHTRDHFNLRYWFDASHYKEGGPVFLIAAGETNGRDRFPFLSHGIVTQLAKTYNGLGVILEHRYYGESYPFADLTTKNIRFLSTEQAMADYAYFASNVVFPGLEHLNLTADAVPWIGYGGSYAGAFVAFLRKVYPEVFFGVVSSSGVTEAIVDYWQYYEPIRQFAPSDCIWSIETFMDIVDTILIEHAKNETLKSHLKAVFGATSSDVDDEFFAAALSSTLGAFQGRNWDPAVGDGTFQRYCKNLTSPSLLYQQNNTMKAWTEEVISATKYDATNSSLVTGMLNYAGYMNATMFSHLDEVRGTSSHKSPQSLQKSSGVSWGYQVCTEWGYFMPGSSVPKDRLPLISRLITLAGESRFCKEDFNITTPPDTDRINKHGGFNFSYPRAAIIDGLADPWRDATPHADGTRPRQSTDEEPFILVDVPAEDVWDGIRGAVHHWDQNGLSEQDVQQGKTAPKAIVALQQEIIRFVGVWLKQWRKHEDVSDPTANTAVRNRQLVL

SEQ ID NO: 32567 - protein, 68 aa, A.fumigatus
ATIRAPIHTVRFSPNGKYLASGADDKIVCIYTLDANPPSHASTFGRCWLYLTVGRELGNRCFLRKCLG

SEQ ID NO: 32568 - protein, 171 aa, A.fumigatus
SLTMEVASRQSSRLLRSSIRGSNRVALQNPCLSSPRIISSNTLSAIQRRNVSSTSRRTAPESSLLGFGPGSVPGGAPATYFSSRSALPMNTVIRFVPQQTAWIVERMGKFHRILEPGLAILIPFIDRIAYVKSLKESAIEIPSQNAITADNVTLELDGVLYTRVFDAYKAR

SEQ ID NO: 32569 - protein, 283 aa, A.fumigatus
DKQADSFQLSISYGVEDAAYAISQLAQTTMRSEIGQLRLDHVWKERATLNTNITQAINEAAQDWGVVCLRYEIRDIHAPEGVVAAMHRQVTAERSKRAEILESEGQRQSAINIAEGRKQSVILASEALRSERINRASGEAEAIMLKAQATARGIEVVAKAIAEGSENAHSAVSLSVAEKYVEAFSNLAREGTAVVVPGNVGDLGGMIANAMAVYGKVNESQARSIAAKALGVQEPTQIEHSQQQKAEKNTSEPEGQAASETDKAGSVADSVLEGFDQASQQRR

SEQ ID NO: 32570 - protein, 62 aa, A.fumigatus
AILLWVQMDTFEYGQRKRSITRGNPEYANKPKQLASMSNHSGTDSYGSILAQWQIPGVGCGR

SEQ ID NO: 32571 - protein, 209 aa, A.fumigatus
RHNTGAFLFLLILAAYIGLLPHSTSSSIPSNLQPNDKFLHVVTFFFLSLVFYWIPDTTRRRSLQLTLLICTLALGIGSEIVQAILPNDRPFDPFDILANLVGSLGAVGLCSWYHRRMLERRRKARFGALSDERGDDIELGGAGGSESGLGPQESGVMSLEQEVDNWDENAVDTWDTEEGADEYSASAAPGRGPESKVSPVNSEGAKRID

SEQ ID NO: 32572 - protein, 392 aa, A.fumigatus
TWRNEPPRPPQNRGFGASMSLGHHHTWQPPGHLRHADDPNDLRSVNGYSKSFPGLKTLQMRSSAGADGGHAGTLISESDTAADEDPRIATFRDLYKRSEAKINALFAKKHPAEENLGAADAETEEPESQINRACEPVSLPVAPKKPARKLDDDDYDEYDDDEEEETEAPTPPKSKTSALSHEPSGVQSPKHRPSIAASVAADSMKEVKKETLEDIRKKLEEDKKATEEAARRSFHTMFHTLENDRDAMLDQQRLEESERQVEAEMSSQANAGSTNANASTDGYGSLSNANLGASSLTLKNLIARIDMKRNMVQASDAELRSLMSEVRKNRSKWASEDKIGQEELYEAAEKVLSELKAMTEHSSAFLTRVNKRDAPDYYTSKEPPSPLHAFLQ

SEQ ID NO: 32573 - protein, 243 aa, A.fumigatus
LEKVFKKHTMARTIGKYQLLILNSHASHESAEFDLFYKNHQIIPLYIPSHSSDKLQPLNISCFAPLKEAYGIEVIRSIQNSIHHINKENFLTLYREAQKALSSKNIHSGFKASGLVPLNCQQVLDKLTIKHITPPSTAHRPSDQEWTAKTPYTTAKVQKQMHLIKQLINHNSESPLNKAIRQLAKSAKYTIHKVLLLDQEIKGLHAANKKQKRRRTTPRSFMATGGVLTGTKGPSTKPKKLYR

SEQ ID NO: 32574 - protein, 66 aa, A.fumigatus
ENPLFMSDEFAYLLHFGDGRKISEIKGFFDTLNVHNHLGREKSYSGGAYWIDLLAWTLEVSLSIFI

SEQ ID NO: 32575 - protein, 88 aa, A.fumigatus
  UNSURE (83),(84),(85): Identity of amino acid sequences at the above locations are unknown.
LFILMIVLIQTPRVRQLDVPAVLSDEGLPAMSSPEKHQGPNLLALEDDSDEDIVPYSRNHATKFWKSPNGVFSKPLEGSICSXXXTNR

SEQ ID NO: 32576 - protein, 71 aa, A.fumigatus
EIFVFLLFYEAGKCRCNLYDKAFNIAFGHKYLLKISVRHNDVKGHGDQHRLSGNIRANQVEGLCSWFCCVS

SEQ ID NO: 32577 - protein, 452 aa, A.fumigatus
  UNSURE (291): Identity of amino acid sequences at the above locations are unknown.
DRRVSRRRGHLLFLKLFLFLLLLFFFLLFFFLLLFFLLLFFLLFARRSFTSIIITRRILHHLILIGLLLRRASFLLLAPSLFQNSSLLLPQLPLRLDKRTQRCRLPIHIFQERLDLGAIARRIRDIQPLLLDPARVGLDLLHKQQDSLVDLCILVAGRAGADLLQPALQGDDDGDGELGEGDMFGPEDEELGEQLGDLFADAILVDARAEVGFRGADGGAEVELLEGAGFRGLAHLGCVEDLEEGRGYGHVRACGTGEAEEGASELEAEWEVRCGGDEAHRAEGDLDHGVXEGPQGGLLSGFSFDETVAVLGEDARPEVQRVRVLPVVHGLVRFLGGVGDAAAEVHGKLPDEPEACRVRDVLVDAPELGGRVLHQVNSRERVDGCVPGALDHSFIQGLEDGLLEAGVANDHEFAKQQEACDPGCLRRRDISPDADNRLDENFQEFSELKQIG

SEQ ID NO: 32578 - protein, 263 aa, A.fumigatus
KISLLHSPYAYMCLSKTVIVPLMCTCTVFLNFATFIDIISGIVPSYRTRWNKRNKQNFKTGGYLEEEGIYSSSNSSSSSSSSSSSSSSSSSSSSSSSSSSSSSPDEASLPSSSLGASSIISSSSAFFSAARRFSSSRRPCSRIAAFSSLNFRCVLTNAPKGVDSQSTSFRNDSTSARLRGVYVTFSLFSSIQRALASTFCTSSKIAWLTFAFLLPVVREPTCFSQRFRATTMGTESSGKAICLVQRTKNSESSSATCSPTPSW

SEQ ID NO: 32579 - protein, 496 aa, A.fumigatus
  UNSURE (217): Identity of amino acid sequences at the above locations are unknown.
RRRPPGKVRVSLDSKKFKTLTPLIKSHTSSVHQLLVNLSDASTLKLTLSSIEPMLPYLLQFRKLLKVLIKTIVGIWADVSTTEATRITGFLLLRKLMVIGDSGLKETVLKALYEGVVKGTRNTTVHTLSGVHLMKNSAAELWGIDQDISYTTGFRFIRQLAMHLRSSITNASKESYKTMYNWQYTHSLDFWSRVLSQHCDGLVEAKAGKQSALRPLXYPVVQITLGAMRLIPTATYFPLRFQLTRALLRLSRATGTYVPVAPALLEVLNAAEMRKPPKSSTLKQLDFSTAIRAPKSYLRTRIYQDGVGEQVAELLSEFFVLWTKHIAFPELSVPIVVALKRWLKQVGSRTTGNKNAKVNQAILLLVQKVEANARWIEEKRLNVTYTPRNRAEVESFLKDVDWESTPLGAFVKTQRKLREEKAAILEQGRREEEKRRAAEKKADEDEMMEDAPSDDDGSEASSGEEEEEEEEEEEEEEEEEEEEEEEEEEEEEFEEE

SEQ ID NO: 32580 - protein, 281 aa, A.fumigatus
KQNAFAEMNVDDFFAGGFEIADADTDKGKSRRKDVTPKIGKRKRSEEQKEEDEEASSVASSEEEEDGGVSDDDAASQASSAPDDFEAHKNQLQALKDKDPEFYKYLKENDSELLDFGEHGDLTEVLELSEDEAEEGPAKKKKKAAKDEGEEAADNTLTIAMVKKWQKLMEEQNSIRAMRQAVLAFRCAAYINEAETQEQKYSISDPDVYHQVLVTALGTVPKVLAHHLPVKETASRKSQGVSGFEEIQDPHTPHQVAYILSSSVARQSLRCIDTQVDSFVH

SEQ ID NO: 32581 - protein, 60 aa, A.fumigatus
IPQSAQCLIDPSTAAPYSIEIDFYPLVTVGGAELAIMGWGYPKCVSRWSLKRAKEGAYGY

SEQ ID NO: 32582 - protein, 292 aa, A.fumigatus
AVSYEEWRSCACELDELEDNNTWKQTFECSEYSPHLVQERLKQLEEARISCDVSRMLFLIRTSLSRDLGNMSNAALYRHSHVGTKDLIDRYITTAVDTISMLVDLAGKKCDVLESRYMLDQLLAARQAFGRSALLFSGGATFGMNHIGVLKALWEAKLLPRIISGASAGSIVCAVFCTRTDDELPALLESYAYGDFAVFDEEGKEENILQKTARFLKYGSFLDISNLARVMRNWLGDITFQEAYNRTRRILNICVSSAGVYELPRLLNYITPTQGGDLFCCLSFIIVMLNLP

SEQ ID NO: 32583 - protein, 425 aa, A.fumigatus
IAWPFCDLTCNSVFSCSVPLFFTPFVLMAKNPLTGEAVPWTDFHKQYIAASVDGDLPMTRLSEMFNVNHFIVSQVNPHVVPIFPKDDGPSHGPMQTSSSPTWLHTVTHLAKDEILHRMAVLSDLGIFPTSLTKAASIMNQKYYGDINIYPEILYANFPRILKNPTTEFMLQACLSGERATWPKLGRIRNHCAIELALDSAIQQMRVRVAFSPSLVDLRYQGFNGHSIDSLDSSGGRGRMLNRRSSYDHGVERMERMRPNSGRRSTAQVRRSRSEYLAEQSHSLSVVRSAEAGQEIQDRSDDRPKDLTVDGTYCIDFDYDETDLSSPERPVLLRASSWGSSAGAQPGSRHSQQSTVRTRPLLTTAASVMGPSVSTSRWPSSAHSADNASPRMSLYSKTISPPHNLLQMTPAVHGISAGTSTRHSYN

SEQ ID NO: 32584 - protein, 391 aa, A.fumigatus
LKQSATFKQTSGGGGGEYDYTRSGNPTRTHLERHLAKIMSAQRALVVSSGMAALDVISRLLRPGDEVVTGDDLYGGTHRLLKYLSTNGGIIVHHVDTTQPEKVREVLTPKTAMVLLETPTNPLIKIVDIPQIATAAHEVNPSCLVAVDNTMMSPLLLNPLELGADIVYESGTKYLSGHHDLMAGVIAVNDLALGERLYFPINASGCGLSPFDSWLLMRGVKTLKVRMDQQQSNAQRIAEFLEAHGFKVRYPGLRSHPQYELHHSMARGAGAVLSFETGDVAVSERIVESAKLWAISVSFGCVNSLISMPCRMSHASIDAKTRQERAMPEDLIRLCVGIEDVDDLIDDLRRAVSLFHSPAFFCILSMLITCSIARSSRCSQHYSRRIRGERL

SEQ ID NO: 32585 - protein, 145 aa, A.fumigatus
LHRADPSSPVVKTPDGTTIFPELASPQNHTVDPQLQMQSQLQSQGMQQRHMMVNQTPQMPGRHLSSPELMSGLPPGMGLHGGQPQQVFGLENQHGWPMQGLEAALNATGMENTSQDDNWSSSSRSGPTAPTTLNVEDWYVCIRDA

SEQ ID NO: 32586 - protein, 249 aa, A.fumigatus
KNAEECRRVKETYRPPQIVNEIIYILNTNTQPDQIFRHRSLLSRFRVNTGMAHPTGHADQTVDTAEADTDGPQLGAFDDALADGDIASLKRQHRSSAPRHGVVQLVLRVRPQPRIANLEPMGFEKLGNALRVGLLLVHPHLERLDTAHQEPGVKRRQAASRSVDGEVQPLPKSKVVHSNHTGHEIVMARQVLGSTFINNIRTELKRVQKERRHHSVVHRHQAARVDLVRSCGNLGDIDNLDERVGRRLE

SEQ ID NO: 32587 - protein, 64 aa, A.fumigatus
CLQGIESYKTRQEPSLLIGLHRVDCYVDALEACRGRHSSDGLAAKAKFLFANQNSDIHLATTKN

SEQ ID NO: 32588 - protein, 83 aa, A.fumigatus
  UNSURE (48),(56),(67),(72),(76): Identity of amino acid sequences at the above locations are unknown.
DRQSRYRVSGGNDPQVPRLVASMETWQTPGHPQNKYIFRSTFEGKVNXGWNYSRIXLIRGLWEPHSXALGVXAREXAATRPAV

SEQ ID NO: 32589 - protein, 690 aa, A.fumigatus
  UNSURE (655),(664),(675),(680),(683): Identity of amino acid sequences at the above locations are unknown.
KVLRSVLVDVDFAEAIRSLKSKSPDDQQTLLIASWAGSRRLEAKYGQYVQGDAATTATLRAPGVAVKVQFEDNGKDVSALNAELKIDASTNVLYPSLVPVIKQMTAAIKEVMEGHDKPRKPSSAAMLQPQKLMQEAPFDTKDAASIFGRCKVNVGILIRKQEFSLSCQPIARVAATAGFESVYITVNTVQSDEQGRFLAGLVAFNSLQASVKHVYSNESTASFDVKSIVMSLMNSKHLSSSKGISAVLRVSPVQVMLNAKQVQDLLLFREIWVPSNEESNGGRAFQPESNEPQAYIVQRYQQVAAAPAFPWNSAVAIEKLEIQLDLGSTLGKAQFAVNDLWLSSRKTSDREQSLSIGFKSSEVESKGRMSGSVELQILKIRTSIQWPEEKPNAHSVPLIQASISFQQLQAKVSFDYQPFLVANISMFDFLMYNVRGTIGAPKQRLFSILEGDKVQVFCTSLTASQCLALIQGWQRLAQDKQAAYEASLREVERYLRRRASVATEKMEPQAKELAKKAKDTNDEKAPISLNTGVVVSITEVNLGVFPSSFFDNQIFKLEAHDAQARFYVSLKEGKIHSALGLTLGQLRVALSAVNRPTCTDIEDFLVSEIVSRATGSRGGTILKCLGSWLVWRLGKPRAIRRISISFAVLSKAKSXSDGTIPASXSSGDCGNPIPXRWASXLGXPLQPVRR

SEQ ID NO: 32590 - protein, 91 aa, A.fumigatus
CFESSLFRQSSEFLVLDWKAIKLFADTSDEGGLFCCSVSRVFIAPNHINILGTVRRTYGSHFFLRSFFLASRFMASYNADRASPKTTMRFS

SEQ ID NO: 32591 - protein, 135 aa, A.fumigatus
CGMQQATKPVKAKAQENKTTRMPQNELLDLIYQCFREYKYWPFKTLKARLRQPEAYLKQTLEMVAHLVKSGDFAMTWELKPEAMESNYANALSYGNAKEELPPGTDYNFDDGSEEEANASGMVTDNDEMKFEDVV

SEQ ID NO: 32592 - protein, 405 aa, A.fumigatus
  UNSURE (30): Identity of amino acid sequences at the above locations are unknown.
CSSLSLRTNVFNHTKVIMSDPLGLISSKCXHRRVILDTAYGPLTILFGDIGGTTGPALLFLPGMFASRYLSIPMHVIAERAGVRLLVVDRPGMGASTNVPLAQRIAIWVDMLPRLLAHLGIPRVNLVSHSAGTIYLLNTWAQCRELVGPVVAFLGNFHPYPSLFFCLFLGWKTRQRNKTQKRRRITQYSVIAPWVDLAHSRVTVMQMAQYVPTKAFAMWHLIPHFVVTQASPVLASSGAVVRRLSSQSSRGRRIARSSMPIGGESNVITACRTLNRRNSRVSPSGLCMKRTPLGRIARPCSVFGKATVATGGACSDYAHCVQALAAGERSTGGRVSVRTYFAAKDALVGSGGQKYFEECWRAPGLEGIDYISTTIDGTDHDTLVQSVEVWEEIFSSVPQMTLYDR

SEQ ID NO: 32593 - protein, 61 aa, A.fumigatus
LRDVSFPLCLSLPADRMSSVWNLVECSHLFFAKKDFVLNDEQHLAEMVSLMGPPGLPLRTS

SEQ ID NO: 32594 - protein, 86 aa, A.fumigatus
  UNSURE (55),(57): Identity of amino acid sequences at the above locations are unknown.
LCMFRLFTYTGICTCNMAVGLIKLSTNNGRPRFGSSPMDTSFLRVMVLYSENFCXSXGRLPCSFHSFDYENQHDEIENQHKKIEQK

SEQ ID NO: 32595 - protein, 69 aa, A.fumigatus
HFSLQERIICLNGEVDETMSASIVAQLLFLEADNPQKPIHLYINSPGGSVTAGNSNASDIAVVCTKGLI

SEQ ID NO: 32596 - protein, 162 aa, A.fumigatus
FQCIRYRCRLYKRTNLTHLYLGLAIYDTMTYIASPVSTICVGQAASMGSLLLCGGDPGKRYCLPHSSIMIHQPSGGYFGQASDIAIHAKEILRVRNQLNKIYQRHLTGKKVLSLEEIEKLMERDYFMGAQEALEMGIVDEILDRRVKPQNEGGEGEGKPPVP

SEQ ID NO: 32597 - protein, 126 aa, A.fumigatus
HYRYWVIWRIPSVRFLDYQKVKDAERAKAKELFGTAEEPTALASKIMGIKSRTFDVPSGGAERAPADKAVRVKLTEKERKRVEKMIREARSLQEITRLEKELNEGRIPGGALDAGEDSEDENQMQT

SEQ ID NO: 32598 - protein, 102 aa, A.fumigatus
DQDAIDFTDNDISSLGNFPFFPRLHTLLLARNRVKHIQPTIASTIPNLTTLVLTANNMAELADLDPLRNLTRLTHLVLLENPVTRKEVSCPVFRRVFRFRIQ

SEQ ID NO: 32599 - protein, 105 aa, A.fumigatus
FKPCSNWLPFVISERDCLRSTPAKYLALRLEQPNDQLLWVIYGEESYANNFRPLLDQVMTDQDGCFHPSIILNPKNISEVTSYGVDSKFTSYVMLVYLYFTPSAV

SEQ ID NO: 32600 - protein, 79 aa, A.fumigatus
FACMRRMTIDNVAERNDDCINGPQRGVILGISIFYSDREVAASSKPSGKGFLVLSRLIGFYVALRNQRRASDASFKYIF

SEQ ID NO: 32601 - protein, 62 aa, A.fumigatus
SRCRSTRVRILALMKSVVMANYSLWLSVEWYYFPSTEYHREDKTKHLIQSNLGTRHRHDSPV

SEQ ID NO: 32602 - protein, 61 aa, A.fumigatus
ILSRPSRLPDSGLILTVSIQVVHAIEWIAEIAGLSKLGTSACDVSNLEFFMNHEWPSLIRT

SEQ ID NO: 32603 - protein, 112 aa, A.fumigatus
SRETAASNFPDHRGTATAFPLAAFGLSAFFWSTVSAVIFKTTTEKFLLLLALRNFLLKPVVIQFFPGLATRGQYQPLSLLGETYWESGPGGTTRSPELTNFLIEEVCEPSPQ

SEQ ID NO: 32604 - protein, 188 aa, A.fumigatus
VSHQTNQKSTMNSAHMTSQINLIVFLIISVVSVQPVVQEHNPRAGLAQAAMVTVYCTYLTMSAVSMEPDDRQCNPLIRARGTRTATVVMGAIVTMATIAYTTTRAATQSLMLGSQAAHGQYAQLRTDDNEHGLVTQQPSRREMRAEALRAAVESGSLPASALDESDDESDEYNTQDDERGSTQHHYSA

SEQ ID NO: 32605 - protein, 248 aa, A.fumigatus
VADALFAGSNSMMTRIAYAFILLINSIVSWIMLTPWALKKLEHMTLDYMEIRCDGKESHGWVAVHRINFGLGLFHLILALMLLGVKSSRNGRAVLQNGFWGPKVILWIALVVTSFFIPESFFLVYGHYIAFFCAMLFLLLGLILLVDLAHSWAELCLQKIEDNDSRLWRGLLIGSTLGMYIASIAMTVLMYVFFAKKHCSMNQAAITVSIPPDEPEEYHELSSYDFADQPHRLSHHLGCIRSTCGAGT

SEQ ID NO: 32606 - protein, 259 aa, A.fumigatus
LAHPHRFPLWVSYTVITNFRYFDLSKLFPPPNMPKSIKFNESDLLKACEAAQAQNKPNISKIAREYGVPYSTLRDRIKKGRQARTARKPVNKALDGYQEEALIQWIVWMRDHNMPVTPKLLEEFANQSLQRAGEARQVSRVWAYRFEKRLPEHLNLGPVKQKMKESKRIKAEDAGLLANWYNQLANVVKDTPPRLVYNFDECGFRPGEGKARNVIGLKGSCLDLAESEKGENITTIECIAADGWQMDPWFIFKGKLLLF

SEQ ID NO: 32607 - protein, 214 aa, A.fumigatus
PFLLPKGNGIFMECWLNESEALPLNITIATQANGWISDELAHQWLQSFIKATNERTKRGEKRILIFDGHGSHLTVDFLQTCEDNGVIPFGFLPHTTHLCQPLDGKPFLSYKQHFRRINNELSYWAGEPVGKSEFLRVIGPVREKAFNQRIICEAFKDRGIWPVDGSKIVDNLAIQAWEQIPDVYAPDLDACLRGTPSPPPISSSSVDITPPRTI

SEQ ID NO: 32608 - protein, 267 aa, A.fumigatus
SSFIQPPILSERFAATAAFQYYSRLPSLQNLVAFIQHKFCDRSDEKCVHHAESILSADSVDVNYDSISHALTVSGYWSTSPGQGWTEQIRKHAADTHQVEVGLLGVESATEPEELKMGGLLGVVGQDEKLSTLGKMKGQTELAPIADHVPEPTLFSFPSRHHPLPADATYTVSFPAPTGLHPTLTISMPRASLRRPPAPPGRHVRPPHIPDPPVVDLRRQIPALNHRPPLPQLPQPSRSPRCNRRNRSRSPRRVLLSMGLKLAARAP

SEQ ID NO: 32609 - protein, 159 aa, A.fumigatus
GGPPHPRDATCALHTYLTLPSWIFGDKYQLSTTDRLFLSSHNLAALRAVTGETDLEAPDGFFSRWGSNWLLELPNPLPPGYQPEEWNPSNPFAPAKPGPPEFGYRSAAVPRPIVFWPSRKKKAQNGFNPLNWVISAEGLFWGPNYFFFSPGPGEGRNPS

SEQ ID NO: 32610 - protein, 225 aa, A.fumigatus
  UNSURE (18): Identity of amino acid sequences at the above locations are unknown.
HDEEHGFSKWSEQEGLDXGHRHHHRYNPPWGMFRGLGRGRGRGRGRGRGFGPHFYHFHHAMHPGFHFFHHSHDPTRFTPPVDVFVTPTHTIIHVSLPGAQRSDLSVAYDASRAVLRMAGVVLRPGVDEEMRRALLIGERGRHLGVFEREMPISHSVAVEGIRARLVDGVLRVALPRVEGDVPQPDEEMDEVDRESASREFNSDGKEEEREVEDEVEREYVKVDIQ

SEQ ID NO: 32611 - protein, 64 aa, A.fumigatus
YMAHGQESVGGGRLAWVADSLWNYVKAYSTAIQGSINSRQVFILSNLFMLRLIGVTIRSFDGEG

SEQ ID NO: 32612 - protein, 106 aa, A.fumigatus
LIFFQLLQTHLKEMFSIIYTPTEGDAIQNYSRLFRRPEGCFLNINDQDAIEECLSNFGRGEDIDYIVVSDGEEVPGPFHSHCYLMHDSDRVNYRFSELATKVLVRF

SEQ ID NO: 32613 - protein, 127 aa, A.fumigatus
GRANFHYARWPMDGILMEAVQGMSVIHNPTFNKGSAFTEEERKNFKLHGLVPPNTQTLEEQVHRAYEQYSSRADDLAKNTFMASMKMQNEVLYFRVSTIIFKGEADICETFFTHVTFDIEFENLLRD

SEQ ID NO: 32614 - protein, 153 aa, A.fumigatus
CFAPLQLTQPFSRCLDKPGLLVKSLGDQLMPAQKPFARSDYEWSDGERDLLSVVKKVKPHALIGTSTKPNAFTEEIIREMAKHVHSPIVFPLSNPTRLHEAQPKDINQWTNGRALIATGSPFPPVDRNGAKYEIGKYRLSKVCRHDMTHWKTL

SEQ ID NO: 32615 - protein, 60 aa, A.fumigatus
QGQLQILGIGDQGVGAILISVAKLVITTICAGIHPSRQLPVVLDCGTDVGLADINRSLVC

SEQ ID NO: 32616 - protein, 94 aa, A.fumigatus
RPFAVKTLAFIDAKRLLDGFRPHMACFNDDIQGTGCVTLAALMAALHVSDVKLQDVRIVIFGSGSAGTGIAQQIAGTIATETHKSKDEAAKQIW

SEQ ID NO: 32617 - protein, 166 aa, A.fumigatus
CRQSDTPGSLDIIIEAGHVWSKSIEKSFGIYEGQSLHCEGTSVAWLAVQIAAKDETQFHSQMDVCFGEKLSSSGDESIHKLIILLSSSSGLSKAEVKLIVKQFLILSPVLAHKAPVDVCEPYICTTVQNYWKLPAWVDSSANSCDYQLGDGYQNRTNTLVANSENL

SEQ ID NO: 32618 - protein, 66 aa, A.fumigatus
LSGGVTNWNNYGMTYGWMMSRQKSCHRTYRSKYKVCLQYLNGPAIYLDSDFIKCKQFDNTYQSIEL

SEQ ID NO: 32619 - protein, 154 aa, A.fumigatus
TPGKRLSKLQRGKASISRKAYQICFAASSFDLWVSVAIVPAICCAIPVPAEPEPKMTMRTSCNLTSLTCKAAINAARVTHPVPWISSLKQAMCGRNPSRSLLASMKAKVFTAKGRQSHGLRFKLRPKTRLNFTHKWMYALGKSFLAVVTNLFTN

SEQ ID NO: 32620 - protein, 472 aa, A.fumigatus
KPFQLYRLIRIDAETIRILVSTDNHVGYNERDPIRGDDSWKSFHEVMCLAKERDVDMVLLAGDLFHENKPSRKSMYQVMRSIRMNCLGDKPCELEMLSDASENFQGAFNHVNYEDLDINVAIPIFSIHGNHDDPSGEGHLAALDLLQVSGLLNYYGRTPESDNIHIKPVLLQKGRTKLALYGMSNVRDERLFRTFRDGKVKFYQPSIQKNDWFNLMCVHQNHHAYTETGYLPENFLPDFLDLVIWGHEHECLINPRLNPETKFHVMQPGSSVATSLVPGEAVPKHVAILSITGREFKCEPIRLKTVRPFAMREIVLSEEKGAQKLARKENNRTEVTRFLISIVEELIEEAQAEWLEMQDEADDDEEREVPLPLVRLRVEISTPEGGSYDCENPQRFSNRFVGKVANVNDVVQFYRKKKNTTTRKKDDEIDEAAMSQLSTLDTVKVEQLVREFLAAHSLIFLRLNRPDWKLRP

SEQ ID NO: 32621 - protein, 741 aa, A.fumigatus
  UNSURE (5): Identity of amino acid sequences at the above locations are unknown.
YTHCXGPFRAPVVETSLYPLECTHNFTADYVWKSTSFDRMQLAMKTFAVDEMSVSGYIFHRLLGHEVAAAPMKTQLPKKFSVPGLPELNGSQINAVKSVLQRPMSLIQGPPGTGKTVTSATIIYHLAKINGGQVLVCAPSNVAVDQLCERIHRTGLKTVRVTAKSREDVESPVGFLSLHEQVRLNDSNIELIKLNQLKAELGELSSQDEKRLKQLTRSAEREILNNADVICCTCVGAGDPRLAKLKFRTVLIDESTQSAEPECMIPLVLGCKQVVLVGDHQQLGPVIMNKKAAKAGLNQSLFERLVILGCSPIRLNVQYRMHPCLSEFPSNMFYEGSLQNGVSAFDRLRRDVDFPWPVVDSPMMFWSNLGNEEISASGTSYLNRTEATNVEKIVTRFFKAGVQPADIGIITPYEGQRSYIVSSMQANGTFKKEHYKEIEVASVDAFQGREKDFIILSCVRSNDHQGIGFLSDPRRLNVALTRAKYGLVILGNPKVLSKHPLWNCLLQHFKERHCLVEGPLSNLQESLIQFSRPKQSYRGPQRFQMAYNHASNVTSGMMNGRNGHRNEFHDTGSVIGYIPDDVSSVHSSALGGVSIPSGYPPMFQNFADAWPALPGARRANGARGKGAPSVAGESVAATESDITGSIIDGRSVDQGGVSLAGLSINDMSKQPSLSQSDRLKRYVESGGREPYRAGVPDNGSIFGGSSASIRVTRGVPGHVHDDDDTRSVSTAFASQVGGNYD

SEQ ID NO: 32622 - protein, 811 aa, A.fumigatus
  UNSURE (3): Identity of amino acid sequences at the above locations are unknown.
LNXFMAACAQADILVSLLLIVVIRSQVRHLQARLLYMQHFIYIDDVDSGEMGYALSTFEAVLTYLVTDSAGLRRASSRNKRLWNATRAGRVGEMKAILEPKGDHSSMDDGPDEPEGKSVFFKTGEDGEVDEPLQGHSIHRRLSRSNNEPHEFDERPSDVPPLAHVFPFQTWENTSPPKEVQRPVKKVSMDVRSISESSATSLLSRTTTIESMTSAIEGDSSIETLTKTQDPAGDSIPMMAVDSRQPEALKYLLSLEEYYSLEDILEDTNTDGTTLLSAAVQLGHPEMVEILLDFLFSATDERTIAGYLKKADMHGRTVAHYLFSTPSVMYRLERLVPWRQRDRNGQTPLYALCRSYDHPDYKSMVNEALTAAQRSQGDGLPLRLDDHVDSKGNTLLHIVGDPEITIRILQESDCDPNATNEKKFTPLMMASKYGRVDQVRILFLDPRVDVHLKEARGLTAVELAKDDEVRNRIDDLILVSNSPSAYDDPSGRVTTVVRSYFVEDATVRFVLKSGAPSSQTQSNESRAGSTTYTVTTCRRTLSDFENLARCLAMEHPASYIPSFSDFRNPFQIHSKPSRSVLHNMQERLDRFLKILLTHPTFATHEMLWEFFLVPELQPEMMTDRSRRKALVLSESIADDYEPVTAEGMRETEQFVAQAQDMVRALHANTRSLIRRGHSLQNAASDMADALSLCSSVVSTLQEPTNALPRSHVDAFARYASYLSTSSSDSSPLLQFLSVFSSIDNTTVAILRSLSRPIFAHIELTIHNPQSVRQSHVSHLIVLAPEIQHQLPWPGGIPTKVSSRSGTEDSRG

SEQ ID NO: 32623 - protein, 105 aa, A.fumigatus
SRRQCHPTQSSSKLSASLTASDSASDSSAAGAVEHLSSPSSTLAILGVSSAEPCSPSSLLAIVSGMLRASSSARLTLNEGTPVVTCGSRDSLADERSVWFEISWT

SEQ ID NO: 32624 - protein, 187 aa, A.fumigatus
PLLLQSMFIQQKNRMPHKTNSRQANLQNLTTSSSVTSAVNSALESAGVDISSTDLAKALDEAQKQLKIKDFYDIGLWGYCDGDVTNGNYKTQNCSKPKAEFYFNPITIWQLNDTGVEDVLPKDLSKALDVYKNVSKWMFIAYIVAFIVTIVELVVGLFAICSRWGSCVTSLVSAVRSSFFVSVYSRH

SEQ ID NO: 32625 - protein, 134 aa, A.fumigatus
VSFLFITAASVTSTALFTVLKGTFNSALKDYGIKGYMGKNIYIATWLAVAFSLAGSLFWIISSCCCSGRSPYHGSSKTRGVTAEKAPYTYEPLGPQANQTPAAFGNTSYPPPAHGTHVPMQNMRNNAYEPFRHV

SEQ ID NO: 32626 - protein, 636 aa, A.fumigatus
  UNSURE (294): Identity of amino acid sequences at the above locations are unknown.
SKHRGCKAGVATVRTVIVPRAANSSSQSRICNTYRSNDEAKDHTFQEMSNSTQAHGTAESSEVNIMETQLSGGEWSFPGTTSPNSAQLSNSCGPRDREPSVFITASPGHVEDSSNPFSSYREAHSFMQTDDGNATSTGYPSLTQVTPTDYRVPQLKRRVSEIDMEQTSPAKRPKVACSEDGDSVQELAFSVISRRETYINRSAEHAEAQKVYEKFRSDYLDYDGDFNHFAMLCSKLQALRAKGQFRRSFLWDDFVIMHLKEYKRYINEIAAADLKTMEYENFFASYILKPSYKXRSLTAKGIEISAAQHEPSRAAGVPVIPQRETNTSFTGSLVDRLSNFHTRSLGPESPASQSATTVDQLSWSTSPASLRDPIRDSFANSRRMAKETLEMELAPTKVTRSHDPVPNSPSEAVAYRLERPTSRHRDTIQKGNRMVDEEEAHDTEVTPKVTRSDHVHDISNQTDLSSARESLEPQVTTGVPSFSVNRADDDARSIPETIASNDEGEQGSADETPKIASVELGEDRCSTAPAADESDAESDAVSEADSFDEDWVGWHCRRLQSTGPFWSDDPNTPFKVLARADANVRSELLRRGMARFPVDERGVIQPLVDYPPMVSLRDLLDRHPPSPARPSDEPEG

SEQ ID NO: 32627 - protein, 84 aa, A.fumigatus
YSKHASEYYDPCQDFADRSLKCMKRNAFDKDMCGDYFQYVCSILSCQSVLVFSFVSLNELIYFLKEPTVTVKRNGYVELVKVIH

SEQ ID NO: 32628 - protein, 117 aa, A.fumigatus
KHPKTLAIVSRIAGVDLVPVMDYEIGHINISVQSEEDKAEFLAAVAEKNSQEAGKNVSDSAWEGKDPIVDWHTDGYHYVCVVIFSDCEDMIERETELRRGNDEKIKVRSPQMVSRLS

SEQ ID NO: 32629 - protein, 474 aa, A.fumigatus
RRGCASLSLPAMVPHRRSSSSDHHHPSLHDSYQPSSSSDEPWDLRPENGTKGGEMRELDGNGNADLPRPETPTSETTDRDITTNGNESQTLRLQRPKSIRQETDDIGETMDDTATANGASDNQESHHGYAELKAGQFPPQQALGLVFEHTNNGDDAHRTSLVDVLQGAEAGAALNGWPEKMSPSKGQDMERDREKVLKLSPAKIQELTSSPQSIPYRPVASETEQGRRVLSDGIHTTGAESDEGESRAHAGHLARDYQSGDGLGLGISAASKNSVSNGRTRPHASRTVSTPTSSRRPTLPGTNERLAQTWASRSKPDRPGIGLGNSRLEQESKRQLSPSPVITEPALPSPMPPSIPLPPLSVPTYLQLELSSGRPSPLYIHRSVTNDFPYESSRVKLERLSSFLRLPPALEQVLWFGILACLDAWLYSFTILPLRFCKALYILLESWLVNLGMEFRFVSDFVIKGIGRVWQRQK

SEQ ID NO: 32630 - protein, 378 aa, A.fumigatus
SAPVAEAERRPRGTSAERGPRTKSGESRRRHRADTHKYQHRRQKSIPSALLPDDKADILKGLLMIATCCVLMYFDASRMYHWIRGQAAIKLYVIYNVLEVSDRLLAAIGQDVLECLFSREALERRPDGRSKVFRPFGLFLLALTYTVLHATSLFYQVMTLNVAVNSYSNALITLLLSNQFVEIKSTVFKKFEKENLFQLTCADVVERFQLWLMLTIIASRNIVETGAFNFVGTLSSSLSSRSTSTNSTPLSTPPRSSSSILPQSFTFFPSSLISSFSHVNSFLPTLAQVLGPFLVVLGSGRIAFGGGTLGAFSKRAPFWAQFNPHFSKKPKKGFFSKKPQKTPTPGPGGPPRGGPPIFPLNPGGAPRGLFFFFLGGEF

SEQ ID NO: 32631 - protein, 63 aa, A.fumigatus
ERLICSGRYELIDMQQGRINKGDNTNERYALALLNRTQAENSTLSTFAENGILEHRVLQFVSV

SEQ ID NO: 32632 - protein, 241 aa, A.fumigatus
  UNSURE (75),(77): Identity of amino acid sequences at the above locations are unknown.
WEGPFLPEISARVLLRAVPPDWQSNMQNSPSGETDQCRTPEITNADIPRVSQAVAIGAAHGELAERQSFIFNAGXIXQQSPAWFQHGQPRHPRLIPCEFQTLQNKRPRRNRKRTSSEMGGDSDSDSADGGAKRTPIRVGQTDVLRQFYQKAFENLQQLNCRVIAKAFVKLVEPRKQVNHPYNGRRTVMGGPCQKLDPELTKPKWWPTGVQHKEPDHLLKHGMSIAFFPRLLFCKFGSARSR

SEQ ID NO: 32633 - protein, 137 aa, A.fumigatus
AERSVCLDSNKSFGGIRLIVNDPTGGDTVIYVSSIHLPEGIEPAVVNINEKQITEADYLPLSPVSISRKSSVESGLSSLSKGMISSISSSEQTQALHAHAEVPSTGSNSLPGFYAPHSMIWSHGTSGINVPFNMSSN

SEQ ID NO: 32634 - protein, 157 aa, A.fumigatus
ARYKEPCIQIFSLSQSDRQRRQDEMAEPDHKLSLQKPSEDAPEDIGQGIDIDINIDIDLANVVLDPQKERKLLLKLDLAFVPIIMVTYLSCFLDRTNIGMYPRASPVKPAILTLARKCQSGRHARSHRGVAQRILHRRLHLLRDLRAPRSPLGRAHE

SEQ ID NO: 32635 - protein, 222 aa, A.fumigatus
  UNSURE (58),(69): Identity of amino acid sequences at the above locations are unknown.
QRVPPGVAPIRLGHLLYLFHIGQQIRPHRNHHAGVGEHARRHERNCRPVHGDQAAGQXVFGRQASLTQXIFETERAAEQEAYVVGGVHLLEILSGCDVAAGLVDAVLREVGAEVEIRVGDAGCWGHGVRVALGDDAEQRAGDGVAQAEGVEVWGVAGGEDQEVGLEEARGEARGVCDEVLAGEEAGGVRIALVVAGVAGVAGVAAGHMATAAAAGHAVYLAS

SEQ ID NO: 32636 - protein, 321 aa, A.fumigatus
HWLGNVKVAGMPEAIGASPSEFSTAVSIFYVTYVLLEAPWAVLMNKLTPRNILTGLCIVWSVTTVFTGFVTNVPALYATRLILGACEAGLFPCLNLYLTMVYRREEQAKRVSYLMSCAAISGAFGGLLAYGLLHMDGIGGKAGWRYLTSFTTLGVVWSTANVRIRWVYIIEGLFSLICAVLIWFGLPNDPSNAYFLTADEKHMMRVRNAQRAAYMGSSQFSWAEMRIAITDPKLAFSAITQFCQDILLYGFSTFLPTILKGIGYDSLMSNILTVPVYFWAAIVFVSVPGPRIAIIAFALFLAGSQMFSGLVGVHSAPGRLE

SEQ ID NO: 32637 - protein, 149 aa, A.fumigatus
SLLRCFLLVPKCFRGWWGYILLLAVSNDAVKYFATYLIGIATYTGVGLNIAWLNVNVAPHYRRALEIGVQQTIGNLAGIVSGQIYRTSPYVLGNSFSLGALVVAQGVVLGHAVYLRRENHLKVKIGAGEKEDTRRVRTGDKALDFVYHY

SEQ ID NO: 32638 - protein, 305 aa, A.fumigatus
ANTLTKRADWPSSRGTFPTISIKTPNPTPPTTSRRENSTTDSRNGKRSSPAFSTQPANPWPISSHSGKSAFPLQPFRRQPTDRSEDRMRYHAIMISLARDGFGVHTFFSAEDGKSQTTVPPSSQLPAHLREKATEQSLASARAIAALVRVHREEYGIGRTHPFTTYAIMVALFTILDHAAFDILDTDFLSLTSAFSVIACRSQVGRNLFHIFRQSVRAQDQEGRVLQSDQVPEEIKELFGRYPRSSKPDKWDDYEDGLDKLGTAEGRDVAAADGMRMRNHAASGVRDMLSKYESLSLGQQSQDRK

SEQ ID NO: 32639 - protein, 142 aa, A.fumigatus
  UNSURE (141): Identity of amino acid sequences at the above locations are unknown.
PYDQQQHQQHQQHQQQPKQCVHHPPPRPPKPHHKHLGPLPGLPPSQPPDPPLPLRPRLPRPLPAQPRPLPSARHHPPGQPSHRVPSSLHHQPGFRPPHRLPAVPRLPVRPPHRIQKGSQGGVHPRPRRLPARLLVQFRRCXV

SEQ ID NO: 32640 - protein, 219 aa, A.fumigatus
  UNSURE (151),(162): Identity of amino acid sequences at the above locations are unknown.
IDSMASSSSSSHMTSSNTSNTSNTSNNQSNAYTTRLLARQNLITNTSGLSPGFLQANLLILPSRYAPDFHALCLRNPVPCPLLGIIPQGNPHTVSPAACITNPDFDLRTDFPQYRVYQSGRHIASRKDLKEVYTPDHVGFLLGCSFSFEDXLCEAGLPPKHXLTGRLVAMYRTTVPLMPAGVFTDACMVVSMRPYLLADVEQVQQVTKPYGGDPWGNPL

SEQ ID NO: 32641 - protein, 78 aa, A.fumigatus
SRSTARSALTLPTPLVSWTSSVSRRPARTSVSSTTPRVASPSTVSRLRRPSTSSARSREFSLARAGSHSWLRTMRERE

SEQ ID NO: 32642 - protein, 155 aa, A.fumigatus
IEEPETDHELDFYSKKHQKRLSAPSHWLLDKMSGTYAPKASPGPHKLRDCLPLIVFIRNRLKYALNGRETKAIMMQRLIKVDGKVRTDPTYPAGFMDVISIEKTGENFRLIYDTKGRFTVHRIQAEEAEYKLCKVKRVQLGKGGIPFLVTHDART

SEQ ID NO: 32643 - protein, 121 aa, A.fumigatus
TFGAVCADRNVSSIRYPDPAIKVNDTVKVDIATGKITDFVRFDTGVVCMVTGGRNMGRVGIITHRERHDGGFNIVHIKDAIDNSFATRESNVFVIGQEKPWISLPKGKGVKVRNHTPKIII

SEQ ID NO: 32644 - protein, 155 aa, A.fumigatus
PFRISFIPLDRLISHSHTSRRSMMTPMDVMEAENSRDEEHDIHEDVIDVEEDEEENLSELDPSQKEYLEYQRRLDDFLSPLVLDEAVLYRLARRFSSTYRHLALHSDQQFLPTPVTRLPTGLETGRYLAIDVGGSNLRVAFIVFTTGMPGSAVKV

SEQ ID NO: 32645 - protein, 620 aa, A.fumigatus
  UNSURE (608): Identity of amino acid sequences at the above locations are unknown.
MALDEELLHLHLGDGQQRPYKLSTVATPPDEEQLNLQRSDKDTAEPSQTPRCDTPREAHTEIVQNDTSSLNRIFRFTPVPTLILDSSLRVIEVSESHLAFCGKSRDFVLGASIYELPLATIPAPDIATLNGALHVAITTRAVQVVETIHLPRISSYFSLKITPIFQGSTLLNLVLEAHNVTRTHTESLHNAYINETYKILVDTIRDYAIFMLDARGNIVTWNSGAAIIKGYKADEIIGRHFSVFYGPEDRLADKPGKELELCLRDGKVEDEGWRYRQDGLRFWANVMITPIFSFGRHVGFVKITRDLTERKAAEARMVAAFEESSKMKNDFLANMSHEIRTPMNGMHLALTMLGSTELDTQQREYTSIIEDSMSILLQVINDVLDYSKLSSGTFSLNTDVLNVENIVGAVVRNCKALNPAVEISCSMPPGFPNLLRGDPLRYRQVIQNLVGNAMKFTEKGHVKVTHRFAVEEHDANRYIITTEVTDTGIGVPEDAINTLFTPFTRFADSATKRYQGTGLGLSICKSLAELMDGSVGYKPNPEGKGSCFWLNVRMQAVDIPAPSKDTPAATAENTYEPIEEVKEIAPHMHILLVEDNMVNQIVMLKLLXSLGFERVDTAWD

SEQ ID NO: 32646 - protein, 301 aa, A.fumigatus
IGFVTNRRMLLSSSDAFGRLMFSYKEISELAGHTARVSSLLEVMEDLQAGLFEKKLVSSASTEENAAVLSGRGEVEEADSIEFTDVPIVSPNGDVLVRKLSFTVHPGDHLLIVGPNGCGKSSLFRILGGLWPVYGGKVKKPRFDEIFYIPQRPYLSRGTLRQQVIYPDGVREMRAKGVTDADLYEILSIVEIASVVDRPGGWDAEEEWRDVLSGGLQQRIAMARLFYHRPKFAILDECTSSVTLEIERVMYENAKKLGTTLMTVSHRRSLWKYHQKILQFDGQGGYFFTGLDWERRLQLEE

SEQ ID NO: 32647 - protein, 138 aa, A.fumigatus
VRDLPPRGEDFVIKYFWGALGLILCSMPVFFRIPGQITQTMADRTESEFWPTNILPPSKLTGINRLCHKPQNATVLIGRLWPSHVLLQRDLRTCRSHSTSLISSRGHGGPASRTFREEARLLGIHRGKRRRSVRPRRG

SEQ ID NO: 32648 - protein, 62 aa, A.fumigatus
  UNSURE (37): Identity of amino acid sequences at the above locations are unknown.
WPGRLFLYRAGLGAQTAVGRVSLCDNLFLSYVMLTRXVVTARKKNWTFIFVQFRSYSVVWRS

SEQ ID NO: 32649 - protein, 170 aa, A.fumigatus
LIRSAYLGEETSDGANVSLTRSTLFDMLLTGALQIEITREIGEQNIFLFGTLAEDVEELRHRHFYGDFQLDPQLSKVFEAIRSDMFGDASNFSALMSAIAEHGDYYLVSDDFNSYITTQEIVDEAFKNQDEWIAKSITSVARMGFFSTDRVISEYADSIWNIEPLEIRDD

SEQ ID NO: 32650 - protein, 226 aa, A.fumigatus
FADGNSLHSVFAKMSVSPTATSSPCPSPWTCPRPLSMKASSSPAPASPCETSETIAIWPSSPLTISTALTSEFSCSFGFWRSCPVFQRERSLIALRCLSGTTDATLQLTTPIAPINQTSVRTVGLADWFSLRRAKEAKLVFGGDEEHPAIKYLYNKVQEFYVGGKIEAINKLNHYDYVALRCTSDNRSPELQTRNDANRPRLYRHSRGAACSLRQARLEPSCCFPD

SEQ ID NO: 32651 - protein, 379 aa, A.fumigatus
LVSRNPMHRAHRELTVRAARARQANVLIHPVVGLTKPGDIDHFTRVRAYQALLPRYPNGMAVLGLLGLAMRMGGPREAIWHAIIRKNHGATHFIVGRDHAGPGKNSKGQEFYGPYDAQHAVEKYREELGIEVVEFQQVTYLPDTDEYKPKDEVPPGVKTLDISGTELRNRLRTGAPIPEWFSYPEVVKILRESSPPRHTQGFTIFLTGYMNSGKDAIARALQVTLNQQGGRSVSLLLGDTVRHELSSELGFSREDRHTNIQRIAFVAGELTRAGAAVIASPIAPYEESRNAARDAVTQAGGNFFLVHVATPLEYCEKTDKRGIYAKARRGEIKGFTGVDDPYETPSKADLTVDVSKQTVRSIVHEIILMLETEGFFDRS

SEQ ID NO: 32652 - protein, 68 aa, A.fumigatus
IHKMANPPHGGVLKDLLARDAPRHDELEMEAEKLPAIVLTERQLCDLELIMNGGFSPLEGKFTPQISF

SEQ ID NO: 32653 - protein, 129 aa, A.fumigatus
RHQSLQSTRHPCVQWAWLTGFHYVGPRKPSWSLAVMRSTLPSSISTTRFRNSTSEERLRPSTSSTTTTMSLSAVRPIIVRPNCKREMMLIDPGYIDTPAELRVHFDKLGWNRVVAFQTRYITFPQSTSK

SEQ ID NO: 32654 - protein, 182 aa, A.fumigatus
FTPLSVSPSLETSTTSPVSAPTRLSSPATPTEWPSWAFWASPCVWVVPVRPSGTPSSVRTTVPLTSSSDVTMLVPARTPRARNSTALTMLSTLSRSTGRSSASRSSSSSRSPTCPTPMSTSPRTRYPLASRPWISPVPSCATACAPVLPSPNGSLTPKSSRSSANLALLATLRVSPSSLPGT

SEQ ID NO: 32655 - protein, 68 aa, A.fumigatus
RQFTPLSVCENVRLADGNLFSMPITLDVSQAVIDEGKLKPGSRVTLRDFRDDRNLAILTIDDIYRPDK

SEQ ID NO: 32656 - protein, 202 aa, A.fumigatus
SMLPPRVSAGRIPAVSRPLLPPSSHGLRHQFRPFTHRSRLLLLSPPLGRPQVPFLSPLASTRPLPPLSIHLRQHFARLISTERRDYYKRRLSRGLRIGLTFYAILVLFQVIKLGVYQEEIEHQWPTPSEWSWKSRWCLRSAQALQNPEQIGKLMTNWPMVAGYLRELLERLENLEGEGKGIKEQEEGGIYVECVGRTGFDIT

SEQ ID NO: 32657 - protein, 1102 aa, A.fumigatus
WQHPFDKNKAYALGANRRHWVTKDQAKTWESFEVDGYAAAQHEPLIFHGWDSAKVIFQSDECMGRLCIVKSYYTTDDFKTVSPLRVSAGGCLWAVGHPQFADGLNLEDELRDRVLCIVPGLKVPSAHANRLVYSDDFFRSDAEGTELNIQHGRPVSGILSAAAVKKFFVTAAKSQGTNELALYVTLDTKAWHRADFGGHRVEQDGYTLLESTNYSMQVDVLTSPSSNTGVLFTSNSNGTYFTRNVEHTNRDRFGHVDFEKIADIQGIVLVNTVKNWDKVESENEKKVVSSISFDDGRTFQSLKVGDKQLHLHSVTTFANTGRVFSSPAPGLVMGVGNTGDHLKKYSEGSLYVSDDAGVTWRHALDGPFKYEFGDQGSVIMAVSDKGTTDEIQFSIDHGKEWHSTKLQHKINPKLLTTTPDSTSLTFLLVGSEESREQKHVVYSIDFHGLHERKCEKDDFEKWRQRLNENGEPDCLMGHQQFFNRRKTNADCFVDEEFKDPQPIFEPCKCSFEDFECDFNFVRSEDGKSCVPTAPLVPPVGRCQKQTDTFMGPSGWRLIPGNTCTREGGENLDKVVERPCKDVVSAPSHDKPMAQKQVFNDARQFSEQYYYLERQASSSGDDETVIMLTSEGEFWVSHDHGKNWEQPLKGVKIAAIVPHPYYSDGAFLLTRDKQAFWTVDRAYTFKSFEAPIPPNQEGLPVLSFHPHYKDWLIWTGAVDCSHGDCHSDAYFSKNRGENWDLLLRYVGKCEFESRENRPGSEKLIFCQQYENENKKNHLQLLSSENLFSDSHVHFNDAIRYATMSEYIIVASRDPDNPDSLIASVSVDGKTFARAEFPSNVDVPVKTAFTVLDSSTHAVFLHVTVSDVKGAEYGSIIKSNSNGTSYVLSLNAASRNEWGYVDFEKMQGLEGVAVVNIISNVDAVQKKRPAAKKLKTMITHNDGGQWMLLPPPAKDADGKNFGCSVKDGKGSDQCSLHLHGYTERRDPRDTFSSGSAIGLMMGIGNVGAYLSGKDEADTFMTRDGGITWKSVKKGRYMWEYGDAGSVIVIVPELRPTKVLYYSLDEGDNWEPYEFSEVEMHIYRLSYRSLRHFQEFSSLGQRNGV

SEQ ID NO: 32658 - protein, 246 aa, A.fumigatus
CRSGPSSRVVRIRHRGPFRKVNSHLRGRYIKCPSPWSFIVVYQSRKMTPLVKVGSLLAALLWVTFGIATVSASIPSSKRFDLSAPSADLYRHKALRDDTVQQGFAFDNVNRRLFVAQRRDGSSETAGDLTITQLDFDGNYVGHMYLKSFGHGVSFGAQAVGSATYLWTEVDANANGYGKQLARFKFASGTTLTSSSAQLAKFKPVADATEHTCAIDPVYNRLIVRYHLSGSKHIASSPRGWKEPLY

SEQ ID NO: 32659 - protein, 249 aa, A.fumigatus
  UNSURE (2),(7): Identity of amino acid sequences at the above locations are unknown.
VXDMNPXASHRFFTRPDTEADRAAHKYPVEASAGEEYNFPDKWISFILNLPSAFPHHRTQCIIEKVDALWDCILRRLTLGGAQSFSAWWMTKVFFHEMMLWQAEKNGFMRFTPSSLQNMSYGSNQPGSPSFLLKQSSGQSAGKNDSFSASDAQQANDRSRSTARPSSADVNPQTRTSLSRPPSDADPNQALVETEKPPSISDNIANFHAPNNDDSAIDLDDDSMLMSVGKYGDMMASDPADAEGDVVVI

SEQ ID NO: 32660 - protein, 96 aa, A.fumigatus
GSALDDLCTRDETSIDSTDIGLDHCGYSVDIHTHINSVLDFASSFSLFSFAFRLGNTRPLLMYIGLRSTLSAGIIHSFLTVLAFVYSIHFFLYRSF

SEQ ID NO: 32661 - protein, 168 aa, A.fumigatus
INVRPQELMADFSQWMDAHETWATHNLAETCCASISLDDLLAFAGNKDRATLVDFSQKQTYGPIRGSDALRSNIAHLYRSDRCEPLSKDNILVTNGAIHANFLALYANVARGDHVICHYPTYQQLYSVPESFGAEVSLWRADGQNGWQVSLNDLRSLIRPNTKVIIIK

SEQ ID NO: 32662 - protein, 144 aa, A.fumigatus
QSHSNPQNPTGAVLSREVLQEIVDIARQHGIIIHSDEVYRPLFHSLENGQDEPPSILSFNYEKTVATSSVTKAFSLAGIRVGWIASRSREIIEQCATARDYTLISVSQVDDRIATCALSEPTVSNILKRNLDLARGNLDLLDGF

SEQ ID NO: 32663 - protein, 131 aa, A.fumigatus
RAKYKRDERYRKIFNHVIYCVPNFSNPTGVTMSLRRREALVRLARRLNGLVICDDVYDFLHWPAPHSSNNESAWSSMLPRVLDLDRTLDGGPRDSFGNVVSNGTFSKIVAPGCRVGWAEGEPQLVYGLSQV

SEQ ID NO: 32664 - protein, 65 aa, A.fumigatus
RRLVLPVFQGMEKRPVHLITMDDDTMLARNIYNLLQHFTAQDSPSWILRIAMTLSGPHSLSVGVT

SEQ ID NO: 32665 - protein, 91 aa, A.fumigatus
KTVLSVPVQRLNCSLALELSRAFVHAKAPGHTISDEDICHGVESFSLTGRFEIINEGQVQWFVDGAHNVLSLGEAAEWFARNASNEQKYVD

SEQ ID NO: 32666 - protein, 144 aa, A.fumigatus
PAVGSSDSKPAPETNAQFSFFGQDDIESEEEEEEYREPQTPFTKKDLLSRGLRSAAPTPDTALINRKIDWNNDDSDAMEVTEEYADTPITRAESKAESKEDSEFTKWFWENRGDNNRAWKKRRRDAAKEQRQRENRRTGMKGKS

SEQ ID NO: 32667 - protein, 71 aa, A.fumigatus
AQNVVCPIHKPLYLPFIYDFEPASQRETFNTMTDVFVTNCMARRLSMNECSTELKCQGTIQSLHRDAEDCL

SEQ ID NO: 32668 - protein, 62 aa, A.fumigatus
NATAKVDAIIAENPGKSLDELVAEKKINVDQKAQGPEEACAPGHRRSNRGANRSIQELRQPL

SEQ ID NO: 32669 - protein, 176 aa, A.fumigatus
LRRRRSTWTRKRRALKKPALQATVAQIEEQIAQFKSFASHYEERLNSQKAALEKAHKEELDAVREKVRAEATEFHQKDLRQRLLSLTKFLCAAAAMRRSGDETSPESRAFEGVLYQVYGGTQDAVSSMLKLIEGVDEKVVSVEGETLEVSCKEAHHNFLIESDLVQLINHCALSRR

SEQ ID NO: 32670 - protein, 85 aa, A.fumigatus
PAVEPPISTMAAISVNSHSQAQSEASPRPDYAVSASKADAAQGTANGVDTLDNPHLKDLQRYVNFKIEASASVAMLYFDCSDHEI

SEQ ID NO: 32671 - protein, 190 aa, A.fumigatus
LTIVPCLDGKVKQTSEEYVPGEATEEVTAEASATSDPTLANAAYTELQDGPLDAGATAANEIDSSAPKAEVSPPAQTLVSDAANPVAEASWEQNGAGSLESSANADGWVEVPRDPAETETGLQATPAFVDTGLKDNQTVAAALGPNDEHVSVPKAQGSDRFEPVVHHQKPGLRAAFGGPGWTCPGKRDSR

SEQ ID NO: 32672 - protein, 79 aa, A.fumigatus
DQIDLDFNFIIIFILLDAARFFSLLLFPDLVSPSSDSSHVNKYSKHLQIQLRRSFSYWLPTVRYTINGPPHSGSILLIP

SEQ ID NO: 32673 - protein, 208 aa, A.fumigatus
FLDDHPPCFRTAATIPNAGLGIAGMEPACPPPVHKSPSTSTAPPRKRRKRTVVSGAADDCFTCAREGSVCDRRRPYCSQCLNRGRDCAGYKTTLTWGVGVASRGKLRGLSLPITGAQPAAAGDSRRSGGKENPSGQPVASPTTYTFASDASPAAASDSAERATFQSQESPTPDTNENARWMRTAANPGSLADSHEPIPWLETSPGCKH

SEQ ID NO: 32674 - protein, 64 aa, A.fumigatus
FPPMAEKIADTSAVPSAETAAASGGDFSSPTATDGTEIARNNDVTVADQENAARLIQVRSTSSI

SEQ ID NO: 32675 - protein, 389 aa, A.fumigatus
GKCPFEDHTLTRLLTSSVQTLKEARWRELYRPSVSPESAGTDASKQVHQKWERVVSVAMQAGSDDGKFRNLNETDSSKLPTASPVGTGRPSENAPANASSTARSRFPHSFPRLHHGVPSEKRAKMMDQRYFLEMVDLKHRHGSNLRKYHNYWMNCPSTQNFFYWLDHGEGKDLDLPECPRAKLEHQQVRYFSRDERLNYLVTVDQAGLFLWAKHNELVCTDSTRFKDSLKGVVPVAEDAPQFRGHSEAGYPVAYASSSSSVSTQSLTDEDSADDSPSEQINQGYEEAKGIHKLAQITPSVVRDHFARKPAKRKDMWLFVRPLLPIIEHLERPMTDKDTGRGHFISPVHRYQGKGGLPTFLIPTGGARCGGRFDQDLEWSTAQSNTFEVN

SEQ ID NO: 32676 - protein, 152 aa, A.fumigatus
LIQAASLATPVQTAPMPSTTSSSSPRETVSTTPSPRTTPVQGISQKGNTILPQFSHVLLTNPGLPRPRNSSPGSRKPALSRLARFLPPDFNLTPFDITSMMNFCPTKPPPSAPSPPSVPSSPSKNGTTTPTTSTFNSTATTASVPPAAAPRG

SEQ ID NO: 32677 - protein, 209 aa, A.fumigatus
LGPMPQILVFPVSTVAFLAVLGGVSAAPTASCSAHVSAPTGATFASGFDITTSWGNLSPYKDAPGFNVSNGVPRGCELSQVHVLHRHAQRYPVSSLLDGGGMEAFAQKVKNYSKLHDGRVGKGPLDFLNQWEYMLGEDTLQVTGAATEATSGASIWAKYGRLLYRAGPGVAAWDSSLNVYPNGTARPKPIFRTTSQARILESARWWLSE

SEQ ID NO: 32678 - protein, 185 aa, A.fumigatus
PITRSTYKMEFQSRIAQYSLDEMMIDDASASLDSCMGKHPCDLDAAFHELDFPSPPSTEEISDTETEAATEIAEETEGKKALPSRLEVSFTTPLDGFDPLQRRLSRLTHRLRHSVLYFLALYGISIQYALYPIEESGIGGVHNALPVVLLVATDDVPVSMWRKGVKRAYEYLSSRTGKRRAILLC

SEQ ID NO: 32679 - protein, 63 aa, A.fumigatus
VSSPLPNGACLLRLILTDTGGFFGNTGANSSYAEYDLVIIPEGDGLNNTLASDHACPGDKSEG

SEQ ID NO: 32680 - protein, 294 aa, A.fumigatus
HHPTPVLTCLINQPRTTSPEKFIPRFTKTRPIPSSPLPSPRLQPHPVRHHFHDELLPYETAALGTISPFCTLFTEQEWHDYAYNVDLQFYGNYGLGAPSGRAQGIGYVLELASRLAGRLIPTSDTSINSTYDNNAAQFPLHQPLYMDMSHDDVIVAVLAALGLEYFKYGEDGLPDEIEHALERTFRLNEIVPFGARLVSEVWTCPAGPKMRFKELDATLYTNPSVRGTDFIRFVLNGAPLPTQGLVGCERAENGFCALTDFLGGVAKLKEKAMYQVACFGNYTTGHQVGDGRPE

SEQ ID NO: 32681 - protein, 124 aa, A.fumigatus
RLEYLPRYLFSYCIDSYRKQCVIDDEVALLDVLDTAGQEEYSAMREQYMRTGEGFLLVYSITSRQSFEEIMTFQQQILRVKDKDYFPIIVVGNKCDLEKERAVSQQGRRTSRRFSLSQPWQYSY

SEQ ID NO: 32682 - protein, 84 aa, A.fumigatus
AICYAEGEALARQFGCKFIETSAKSRINVENAFYDLVREIRRYNKEMSSYPSGSGAAGTRAPEGKMDVSEPGDNAGCCGKCVIM

SEQ ID NO: 32683 - protein, 67 aa, A.fumigatus
TICSEQALLQEDYDFNLSFCFLACDSTWMLFLLFFLEGVFSILNSCIYPCRLLFLFSRPEKKAYIVL

SEQ ID NO: 32684 - protein, 318 aa, A.fumigatus
VSWSGLPAAGGLIWIVVFLSAYLAILVTFPCGRLMEAVLPERKWKILRWTFTLNPGRFNQKEHCIVAIMASLVTAFDNGSLATDVYVAFEKFLHVPISLGYRFMFLLTTQALSFGIAGLFHKFFVEPEACVWPGVLPTCSMLYTMHQRNKQNEETNGWKISRMKLFAVVILCGTLYQFLPGFLFTGLTTFAWITWIFPNNVTINQVFGAISGMDLLPMTLDWNQVTGYLGSPLLVPTWALTNVFCGSIFFLWVVSPALHWSNVWEGMYMPFSSSKTFDNTGRVILDTSLRSYLTHSRQAIQHQSSDELRLFTKSDCLS

SEQ ID NO: 32685 - protein, 78 aa, A.fumigatus
RLFTPYKLFQSINIDLRSVSPEVRASVPADDEDIPVNTFRAWFLGIVGTVVLTALNQFFQFHSPPRECLGQGYQQQEG

SEQ ID NO: 32686 - protein, 95 aa, A.fumigatus
HIQGKPYNTSRVMNSDYSLNQTAYHDYSPVFLSTTSVLSYGLGFAAVASIIVHTALYHHREIWYGLLASIGKSSGEEKPDIHARVSTTTPVGNTH

SEQ ID NO: 32687 - protein, 129 aa, A.fumigatus
PKQLMKKYKQVPTWWYGCTFLGIFSISIAFLYAYDTGLPWHGLILAITLHVILLLPTGIMMAYCNIKLSTAVISALVAGYIWPGKMMNNVVFKIFTLVSSAQGLGYISVMKLAHYMVSLPFKPEEQGFL

SEQ ID NO: 32688 - protein, 79 aa, A.fumigatus
QFLCPLAAGYATNATFWGLIGPKRLFSEGSMYRPMLWFFFIGAASPLVLYLLDRRFPRAMLRKVPTDRTTYNVYVTECN

SEQ ID NO: 32689 - protein, 110 aa, A.fumigatus
IHLPAIFASTASIPPATAANYMAWGIVGLYFNGHLKHRYRPWWMKYNYILSAGLDAALAVGNFLIFFCLAYPGIELKWFGNDIAARTADGLGVPLRTVERGQTFGPRNWN

SEQ ID NO: 32690 - protein, 146 aa, A.fumigatus
HVSRYSVPSADSFMMGIMDDELDIDTAHTKEDKDTAIRAKASKTWRILRLSAKGKLAAFDKIDDGKNLKALFEAPQPLESTTPAHEPASQASEPAAKASGDAGPEANASGQEEQPVDRNTTAVSEQTPGDLNDNNQEAVTGAPQAT

SEQ ID NO: 32691 - protein, 376 aa, A.fumigatus
VKYGVQITNNLFSLLVDPDLIFLAFLNIPLVLQKDAVRLHVTLRPGSVLISSTRFSDKNLEEFQTLRYNCRQVIPVFSQPFPDTRTVKMDNAHDLQASTQNSTVDLKYDCDEENIQQADVNSSLSAAVTDSLEHVLPRDREMKTPTYDYAYEKSMSHTEAKLFYQHHQLVSRGADSESDQGSGLSGRRSASGILSTKAQTEGKPQTGILGSSNSTQLGPPTSGYAENISTSAGQRPLRDDAMHHENLNEQGSSYMQFTTEVPGAVKSAMNMTGSGTVASELNVIYRKIRGLLERRAEYIRLSSQGPGDNPKDRPDWRIYPPPPEPAWDADGENGNQGSSAGAGTKKRKMGQDIGEDFDMAELIPLPGRVKLDIQIG

SEQ ID NO: 32692 - protein, 210 aa, A.fumigatus
  UNSURE (165): Identity of amino acid sequences at the above locations are unknown.
YAGYACMYHSHKSLSITLLLINLQAHTDSFHRFDKFNLKYNPVGESRLREIFLKTDNYIKGRYLAEITKEVISDLESSKYQMVEWRISIYGRSIQEWDKLAAWVVDNKLFSPNVRWLIQVPRLYDVYKASGMMENFEQVITNVFQPLFEVTKNPSSHPKLHIFLXRVVGFDSVDDESKAERRLYKKYPIPREWNTRQNPPYSYWDLLHVR

SEQ ID NO: 32693 - protein, 176 aa, A.fumigatus
SRSRGESSWTFKLDENSVYQVYENLEAANANKPTIRIPSLRDFYMDLDAVIDVSTDGPAKSFAFKRLSYLEGKFQLYTLLNEYQEIADSKKVPHRDFYNVRKVDTHVHHSACMNQKHLLRFIKSKMKKSPDEVVLFRDGKHLTLREVFESINLTAYDLSIDTLDMHVCIIPTSLFL

SEQ ID NO: 32694 - protein, 378 aa, A.fumigatus
  UNSURE (4): Identity of amino acid sequences at the above locations are unknown.
YGPXRSVLKTRRLEADGFAIPSLPIDPALTTADSGRRRASVTSVLNKVVSEVGEEAAIAKSARPAAPKRPKLPPPTPEQIASEEALENEMTALLSKGSNMIESVASGREQENKVSDRAEIDASEFEDDPEVANCLLSPAEVEIKERIWVHENKDYLRTQQAKALKRALAEADSQPGMRKPRKRRRGRLGDVTYLEGDGEDADGRSTRASTPAEATRRMLERRGFSKKINYRLLESLFGDEGADEAAKAKAESMSRSRSRSQSVASRRSASVEPRAISLATAKPAASPAPPRRSTQFPGEKPLQPGVQVGKIDSAHTNEEVLGPAPESGKIPEEEMDDYDDDEEEEEEDDYEEDPDGVEAAFAGQYGDYYDDESDYGSD

SEQ ID NO: 32695 - protein, 72 aa, A.fumigatus
RNLIHSLQLFWNVSTMADTQKVDQPVFYRVVGTVPYSDYSGKAPRQVYRSLDIQCVGRWSPVGKYLPKVGSR

SEQ ID NO: 32696 - protein, 101 aa, A.fumigatus
HVRQIGGRCGRVSQDLLNVSIPPVALWDGSHMEFHSPLEIYSFVLSSCGAAMIGEDSQTESGPPHLSFNLVSHSTVKVKKVGKISTSTDIDTRAIEYSSRS

SEQ ID NO: 32697 - protein, 65 aa, A.fumigatus
RSPVLKGFSIPLHLDLVGFSSPFFFIKRAQSVGTKCFQCFRFTSVWVFSMLLTLDGGLAYIFLGF

SEQ ID NO: 32698 - protein, 90 aa, A.fumigatus
REKFSIHAEIYATSTANLQPPLDENALLQELVAQFLTHEGYVDTARAFSEEVAAESAALENGRKESLTKYEAGEGLDAINRQSKITPAFH

SEQ ID NO: 32699 - protein, 244 aa, A.fumigatus
ASLTSLRVEIRAAILEGDIDKALKYTNAYYGNVLESYPHIQFKLRCRKFLEMMRRCNELSSAASKKGKASNGLSDGSAVFDQEMELDEQLQEGDGWDTEGMDTEESENSGKFHELLTEAVQYGQQLRMDYPNDERGGDKKVLDDIFSLVAYQDPKRSVHGHYLDPAGRVAIAEELNSAILGQLCFSRVLQCSQLLTLILLLVSLGKPSSAALERLYQQTEVLVNEISEEGGAGAFINVRNDFLL

SEQ ID NO: 32700 - protein, 110 aa, A.fumigatus
MELVRESCPILPKMAFKNGLSERLDELRFPSPRSPPSESAFPGYNSLSPGHTSFVSAFPRSSGDVRANLQRRFTTDSSKLSSWSYLNQVGGPSQVADPLDLLSSVSFPYQ

SEQ ID NO: 32701 - protein, 151 aa, A.fumigatus
PNPPACLLAAASCEIHSPNHHLSYRFPTYNQKANMSHKPGGYFYYRYTYMCPWTDTAGQSGTDNTYHSAVYTPVRKQDHTAQTSWYNNTAMPAVKADIEKNFYGDADRNKQGRTYERYNQQYVRQEQFMWCSKLPTHTSEGWETVPFGKQI

SEQ ID NO: 32702 - protein, 293 aa, A.fumigatus
RVKQTRDGITKSDEISTRLHTLSDLAQATIRRFADIYSQQRRFGGGTGAASILQTYPGKVGVPSSIFARMNSHEEAQEVAEKNFLPEDAEDLLDRLVRAVMKAKNGSTSSAQVKKRKPEAAEMNGNNGSAKKARKEKEKTSRPRRSSAGTTSKTPKKKKKGEDGWSSDEEGAPAEVTTSARRRSSRGTSKRVSYVDKDSDEDDMEVDEWGQENDEQEDNADDAESENGSDAAEEKVDDDSDSEEQLSEAEELEDPEDSSEPAVAKSEKEKPEAKNKRSEKTATLPTRRSSRRG

SEQ ID NO: 32703 - protein, 62 aa, A.fumigatus
KDNPGVDACYLINHEIFQSTESTHIIQRSRLIFFFLNLLFWAEKTIYIAKQYCKLYIVPQHQ

SEQ ID NO: 32704 - protein, 127 aa, A.fumigatus
LVNLLIMLLTALQIKEKLQKFQDMHPSDAAFMPILKSMMADLEKHIEEEETIDFVKLEDAITPKESESLPKSFGRTKMFVPTRSHPNTPNKPPFETVVGLLAAPIDHLADIFRKWPDDVINPNPSSE

SEQ ID NO: 32705 - protein, 76 aa, A.fumigatus
PRLVPITGLDQACRQSFRGRDGGVSGSVYMCTLYVFRPVSPLSLNKVNGVEYNTEALCDSGSPRTVHILLSFWGYK

SEQ ID NO: 32706 - protein, 92 aa, A.fumigatus
FLTNNMARLMDTIKKDHRELEEYYKIIVSSRDTDEQIRFQNKFTWELARHAIGEELVVYPALEKYLPGGAETADKDREEHQTARHCSDLSIF

SEQ ID NO: 32707 - protein, 629 aa, A.fumigatus
FPKRGPCQPRGEDLALYKDFQTLIDASKDLKTKIKRHKRKLQYWGAQLNKEEFTLVLDGRAVKFKQVPENTRDDMTHTPSENSPLCPTDLPVKVGGASVQIHSTPTSDLTASRDNTQGNGGLPPAASMEPLSTQSESSIDSDETASTPRPLESSTELQAGALKRKRDTVTDHASTKRGYHGTRADDQLAQPVLIKSESMSSPIRIHLDHHVAGTHDLDDVGSAIETPTKRKSYRLDGLPHELPSDTTKSPLPRNPTALQLNRHQMEPTRLAPKRPTVLQSVDTNLPSANCRRIWLEQKQSNKPERRSGCALDSVAEDGDESLKLVPRRGQVKQASRGQMTRTSTSIDDVLIRQRLDDLLERPLRIRHPLHVQNKNGNIAEIGPDQQDISRDASTQVSGRVKEASESSEPTESAIGRPSISAGNREKSKASPQEGPRSHSFKVTDTVTAHSEDAPFRARPLHQLGLRHFKINTNANQGLDFAYDTVVRRKDERKCISGCTRPGCCREKFHAMARLGCPPTTTDGSNDGEEEQKMLEDYLGEEKYLLDQLSAEERQSLLHEARARRMANLYSKHRHDHQRPSTPPGFWRTDMPDTQELEHDREVANNLEREKVKERYREAMRGGIWKFADE

SEQ ID NO: 32708 - protein, 559 aa, A.fumigatus
SMDILFAQQALNHRVRLSPFHFSREEHLHQYMRPSLRSKCAMTLRNRKKQQKIEPETAKVGWCLHIISQQTNVKTASLLLDAIEDALGLATSEKSPDIKEFRTSFMECFSCPSNSRPPNLDATFLCTFDAVSEFCTSTPPSKWLVISIGTTMLLSILAIQFTALWLQGWRSAGWIVMFSGYVGIALGIICAGLLIHGSCVFLQMGSRNALRKELWRDGLLIAVKNVDSMDTRGSNLMLGQYHTQNFEAAFLRDLDMKQHIAAWVVAVELSFAFIAHYLGLRSCKWWVSVGELGVCLTAAFARSLTKDRQQRYRVVEKRLDKRCTSTGVIKCQQGGKINPSNQSNNALDIRVYSPSLFTGQPMSAENISWYAAKLCHQDYHTTATQILKITGMLIKSTKMAGQLGHRAMIVSFLGGILVTEGLAYPNVRMCAGFRATVSQLAAHTCLLVRLILRQPQWMTMHPEFGNGRVPLGSVYIPPINSIVDWWAMSEYRNDALDLQKNLLWSFTLVNLAFYLSLLRNHGDDIQLMDAINAAHQGIDMEAEMIAKHLVTFVDESLEG

SEQ ID NO: 32709 - protein, 74 aa, A.fumigatus
SGSNYGSVWGLWSLIRVFRLCIILSINHRWSHFNILRLAIPIQSAGNVAYTTWVDQLSDGVLLFKSTSLNDGPA

SEQ ID NO: 32710 - protein, 865 aa, A.fumigatus
IRISRSFHACGEELQSERDKFEAIIQKLQAKYQPQQLEIGELRKKLKDTEAKLEEVERLQAEHESILEMAALDREMAEETADAFKHECAVLRARVEELELELEVLKEENEELGQVMTPEEKSSHGWLQMEKTNERLREALIRLRDMTQQQESELRDQIKELQQDLEDYAVIKSQYEATKETLLVSENNVEDLKQQLETALGAEEMIEELADKNMRYQEEINELKAAIEDLEALKEINDELEYNHIETEKQLQEELDYRESLFNEQCRKISQQDEVIEDLEYSLVRFRELVSTLQGDLEDMRASQQISEAEANDLTARSRAMMDLNMKLQASMAKTQTKTIDIELGRMNAEEALQHLSILKLYLPDYFEGERNSILALLRFKRVSFKASLMNNTIRENISEQASIATGLDDIFVAYDVLEKLMYISSLSDRFVNYISSCSTENFESVKGALFEMEPVERTLNFWMEGLKKNELNLRKCAVELQRSIALLSHLAETLLPSSLEAFADELCMRSSLTQSYIDHAATCMARLKALLQSKITVPEEGDGECSLLFTKAEGFVSQARGLKVALGKVYRTLEDLKSRSLSLSQDVAGPFKSAEEAAKELSAWTRQLGENLVILVSDEARTEPLTMEEASKTMSETSTAYCLPSEGSENKDTMSLLHDRLRTLSGLLEELDAVSSDLSITTEFERRPAPWIARAAELKSNKTKSPDADEEIRRLKNEIHEASTALGVKDKTIEEQALRVELVESRMREATKKASMAKDLESKIEKMQAKQADLEGVIETQRKDLQAMEAEREELKNRLERVKRLSGTTGVGTTTDGVAIDNSLSLAAMRENEALRAEVASLQAAVRFLREENRRSNMLDPYSV

SEQ ID NO: 32711 - protein, 66 aa, A.fumigatus
PTYRLIILLFYIKVSSSLIGMAFSGFYYPLAFFIKYLAFYYLSRSYYYSSFTSFIVLLDLVIKYLR

SEQ ID NO: 32712 - protein, 524 aa, A.fumigatus
SMPKMSKAWFTIRLWRTSTLIARVRRTSRKQVKAIRRGPSIAAIAGTPSMSCTLSCGCCSPGELSSLSTAPHLLAVLFDQNPNSSVVVPLRWWIAGLILHRYDLGWLIPFLLYLCITLRLLTLYVPVSIVTRPAYWVWDHTARPFVRLIPEKLRIPGAALLTIAVILVGSFASEETADNTRANRAVSLFGLIVFVFALWLSSRNRKKIVWHTVIVGMLVQFIVALFVLRTKAGYDIFNFVSTLARELLGFADDGVDFLTETGFASKHSWFLVTVIPAIIFFVSLVQLLYYSGVLQWAIGKFAVFFFWSMRVSGAEAVVAAASPFIGQGESAMLIKPFVAHLTMAEIHQVMCSGFATIAGSVLVAYIGMGVNPQALVSSCVMSIPASLAASKLRWPEEEETLTAGRVVVPEDEEHKAENALHAFANGAWLGIKIAGTIGATLLCIISFVALINGLLTWWGRYLNINDPPLTLDLILGYICNPIAFLLGVSRDGDLLRVGKLIGVKLVMVRFYPFTLRSPSGRTRH

SEQ ID NO: 32713 - protein, 97 aa, A.fumigatus
SNYFQNEFVAYSDLQTKPEYQELSVRSRIIVTYALCGFANIGSLGNQIGVLNQLAPQRAGDVSRVAVSAMITGALATFTSAAIAGLLITEEGKYLSQ

SEQ ID NO: 32714 - protein, 60 aa, A.fumigatus
APRQGLVQKRKGTYTVEVLILRAAIMYLPFVEQLYPAWNLDHTFEDVGFILFHLGLRILS

SEQ ID NO: 32715 - protein, 537 aa, A.fumigatus
RQPPPKSFSPPVLQSQSVPNVLSAHRVQASQQAHYGDATVSAALTEPFSNLELNVDNNAKAPKVAPQTEKPHDTLDDNEGLAPLQAASQFTTKRSRRSGRTGHPQNVAGNEHDGANNTNPKTKGWRQTAFVQPADTSEFKTPQNYKENFPDPAGRRRKKKGRGYAEDPNGWATEDATDIQEMGDFDFESNLSKFDKRRVFEEIRNDDTTADEDRLVSFNRRPRPGTNGGKNLHWTENVLDSPQDSDNADSDLGRSDAKLGSGSYSGREHSRTSGRARESRKGSAALGQPPVAPQINSIGRSQLSSSRTTSPRPNKTPMSASPMTGAVGPGASLRLTTTNRSCPTVSPLQTLEVEQIAVAELGLTEDMITENAGRDIAEAAVGLLSNDAAAPTILVLTGNHRTGARAVSASRHLRNRGHRVTLCVLGLEHENELLESCRKQLDVFKKIGGRVFRWEDLSAQLSSSDFAPDLVVDALFGIHISFEDLRTDDQAIAFEMIAWVNRSNLDILSVDVPSGLSASSGEFESFFLCMPAKSLTL

SEQ ID NO: 32716 - protein, 395 aa, A.fumigatus
LCLQYALLTEILKKAGVPSSRLVQLIKDFHIIPSWTDIPLPTGIDMPALCLSPVFSSFGCVRLMSYLHCVEVFVKVRVNGSAWLLLIYFVPGRSLNSCQFAFHTMCQEQQQQQQQQQLQQPQMSVPVNPGLVPFPPPRHELSAPTAVRPEASHMRKRPLFLLDKQPLAPRAIQPRPAASTASYSSESSASALLSPSLESTTTKGEPPRKRGRPSKAEAERRKAAAEARGEAYPPPRRSGPHRLKAPSTPANPPDVMSSGTSFTPQAGLRPLEVQNPELRYAPPPGRPVTLMAPIDDGRARGAPTRDTGPIIRELPRPTDPRQTLPSPQPLQMSHAESVARMDPGERPFEPRPSERFSFGDGSRRILTDPASRRPEAPALPTPELPATTLAERKPE

SEQ ID NO: 32717 - protein, 95 aa, A.fumigatus
CVVAENKVLIVALGRLTPLIRQMMSPNVEVQCNAVGCITNLATHEDNKAKIARSGALGPLIRLAKSKDMRVQRNATGSLLNMTHSGNLGCVIKRF

SEQ ID NO: 32718 - protein, 66 aa, A.fumigatus
SSTGVLKTCGNDTPINDHCLYDNQSKSCTVIMISLTGFPNYKVEALRLIDSMISVVANGVGQITLS

SEQ ID NO: 32719 - protein, 77 aa, A.fumigatus
LSEVRHIVAMKPEVGTDVIIIVADVREVDRDTLEPILFLLQSSDIEVQRAASAALGNLAVNGLSLNLISSSSTADVL

SEQ ID NO: 32720 - protein, 84 aa, A.fumigatus
AVLIHRHIEMFSDEKKDLPLSEDDGFTTFAKSNSSSKNKKNQESNLKISIWLDLVVEVDIKIKAHLYSDIVISLLQVAGMTIHG

SEQ ID NO: 32721 - protein, 140 aa, A.fumigatus
SATVPHTYLRFETVASEAFWPPITEGMTAIANACLSCLSAVDRWCHITACLGPIGGRSRDGIYETTLADNEREAVSDLLGYLENVRLALSSMPLRFASNIIINVLGPLSAVEADFTCVLASRNRLLLRRTSSRPEHLGLF

SEQ ID NO: 32722 - protein, 63 aa, A.fumigatus
FVNVNFFLPLFICRIRPSHAFLSAMNHTSFFYSPDKATSEHFANSLQGQLSADPNVFIVRSIR

SEQ ID NO: 32723 - protein, 546 aa, A.fumigatus
  UNSURE (444),(467),(499): Identity of amino acid sequences at the above locations are unknown.
RLYLSDPDPRTVPRDSRSGQVTPIEERDPDAYVERPTHYRGGILSSLLKLYDQSSGSSHYSRGRYGHSRQSSLGEVSSRGLSPDPGWKQPQRQRKWYEKSPSQSSTSLSGSTDKNSSSSPIAMLKRSRSSGPIPGSGGKRWTKPRLEDEIRITVHIAELLSRQRYLIRLCRALMKYGAPTHRLEEYMTMTARVLEIDGQFLYIPGCMIISFDDASTHTTEVKVVRSAQGVDLGKLSDVHIVYKEVIHDVIGVEEAIQRLEEIMKKKNKYSVWMLILVHGFASASVGPFAFNARPIDLPIAFLLGCLLGVLQLVLSPRSNLYSNVFEISAAVMTSFLARAFGSIRYEGERLFCFSALAQSSIALILPGYLVLCASLELQSRSIVAGSVRMVYAIIYSMFLGFGITIGTAVYGLLDSNASTEYTCPPSPIRDEYLQHFPFVILFTXCLALVNQAKWRQIPVMLFIAFAXYVTNYFGAKRFASSTQVSSALGAFVVGVLGNXYSRLRHGLAAAAMLPAIFVLVPSGLAASGSLISSPRGRKEPRNAWVS

SEQ ID NO: 32724 - protein, 433 aa, A.fumigatus
RKALIMAGGYFDLPISSSRRSSLADEFHNASRPAPPPRTSPLVTPNEGSSQEKPLGFINTPGRHRNAGILKSANRVKFTVSEAGLLEAPAAGSTSETRFDSRGSSLPQRPLRAASIPVAERAPQSISSVYPGSNAPAGVTGLADHSQAASSEISRDYEISGEKGRAFQFAQERAQRLASLLGRTSKSPRPSPRSSVPSSVASTPTEVVPPSEDGSDIPMINLSEKHFDDDFPDEDEDGLVDGRTLTRTSEAHQLVRQMTRKDFTFLTRIRARSPGTPALGRSPQSKREIRTPMSSGRPIIAGASSHPSSSYTTSLPAAATIPAAGMATPVRAVWERSVAGASRRTPVGNNPSDNGSGTKNPRANLAPPSPARRTRTRPARPLRCSSARGAVVPSLVRAANAGPNPGWRMRSALLSISPSCSRASDISSDCVGH

SEQ ID NO: 32725 - protein, 166 aa, A.fumigatus
  UNSURE (81),(104),(136): Identity of amino acid sequences at the above locations are unknown.
FCPGTWCCAPVWNCSRAALSPAPCAWFTPLSTQCSLDSASQSEPQCTACWTRTPRPSTHAPRAQSATSTCSTSLSSSFSLXASRSLIRPNGARSLSCFSSPSPXTSPTTSALSASPPARRFPPPSAPLSLASWATXTAASVTASQPQPCSPPFSFSSPPDSLPAAP

SEQ ID NO: 32726 - protein, 204 aa, A.fumigatus
RFIYPAQFCLLSIPNVESSVFPLTQFPVSWTLFHPLPLGTAHRPIFCPSAALNGRWRQLDAPVRAMATRLPPLNDVAPSSALESSSSVSTTPAPAAASATVLVSATASIPLTSNPSSTVLSTPNQDPDCVKQEASPTPSGFTSADGDTPVADNGGSTAAAGRKRKLNSTSSRGVANLTPEQLAKKRANDRQAPAGDPGADQIAH

SEQ ID NO: 32727 - protein, 467 aa, A.fumigatus
LPSSWPRSERMIGRPQRAIRERTKSHIESLEQRVHELSSQKPFLDLQAALKRNEAIQAENRDLKHGLKAVMDIIQPLVAKQDPSECSLVLFMNCSCGLSLTQWTIDQPAPPPAPSQPLDPSFSPLRYTETHHFTSTGQRYESSYTTTTSGADTPTSTHSAPTMSAHRRDSSSNGLASFRIAFDYQRHNLAHGLDFGTDERLGFNFLLDASQQVPRVEGFRRSTESFRPCQADLPPVYTPSPCGPAPEQPLPAYKTPIRNIAPTCTLDAILLDFLQSRRRKAAEGVPTQKLVGPPYPSVSSLLNPEKSVYSHPLSKVFVDILRAFPDISSLPEQVAVLYSMFLLMRWQIYPTPENYERLPDWLTPRPSQLLTPHPAWIDYIPWPRMRDRLVASYQDYPFEHWFIPFTRTLSVNWPYEATDCLLSTSDHEDLIINPVFERHFRNLDNWSLGPSFAEAYPHMAETARIKS

SEQ ID NO: 32728 - protein, 66 aa, A.fumigatus
FGVERTVEDGFEVSGIDAVADTNTVADAAAGAGVVLTDDDDSRADEGATSFKGGRRVAMALTGASS

SEQ ID NO: 32729 - protein, 343 aa, A.fumigatus
  UNSURE (3): Identity of amino acid sequences at the above locations are unknown.
AFXCSCQCLSLPQFFLDVLLIKKLQLLWLSVPDRPFPARTPHRRRKGRSLQISSVSVELPSKEPQLAKQEERLDEEKPVQQTVQEQSEPQTPSPSAAPSVADSTTQPTTPSSAVASTTARPQSHSKGPKPAVPVVPVLPVIPSPVAHQRQPPKDDVSRAPETPKSTTASATSVNETPKEDAVKETAKAASPPRAAPKSWADLVRAKGASRVSGPAGALSIESNGLVMRKSESLADVLTSLGEDVSQYSDKIAFLEPRGLINTGNMCYMNSVSWHAIRFADLHLLNAREQVLQILVSCIPFYQFLDHVGRRISHSVQSAFPMVDAMSVCPTLLPATHDNTDIIS

SEQ ID NO: 32730 - protein, 363 aa, A.fumigatus
RGHQQDAQEFLGFLLEEMHEECVRAAKNASTTKPAASITAESIDKEEQSGDGWLEVGHKQKAAITRSSGHITQESPITRIFGGKIRSEFKVPGNKTSVTLEPYQPLQLDIGSPDIHNIVDALKGLTKPESIQGDFNSSRGPNVTATKQIFIENLPPVLILHLKRFQYDSVTRGTQKIWKKIGYPLDLEIPREVFAPNKRNVMMAHGGLPKYRLIGVIYHHGRNASGGHYTVDVRRQDGREWIRLDDTVIRRIKSEDVAEAGGEEDPKVLAAALEQHKRDNTSNANIFGHIDQDDQDQSDNERGWSQVNGTSTGGHSSKKSTSTVLNGASATASGSSSGVRTPIGRYGSRDNKVAYLLFYQRVA

SEQ ID NO: 32731 - protein, 78 aa, A.fumigatus
RCFARHGETSVSRAEICLEARLSPCKGQQSAYSSLRVSSGLAFSYAISNSAASSQRATLQSLLAMALANHPPAMNSAG

SEQ ID NO: 32732 - protein, 445 aa, A.fumigatus
HSYRSYIRNQPTGDTSSPTISTRPTPHSTTMAGSGKKSKGKPGAKQKNKKGKNQETSENPSETPFAEKQDQQTHPEIDSETPLDQEGQPLQAEVEAEPQPAESQGFESNVPLQSLPEPGPNHGQAPEQVPELEHPQPVAATASAVTENWEDPQPSTNLDQEGISSQPQTLNDVQNILEATHESILEELAASDPPTETAAVETNPEPNHGLSGQSDAAEPPEPIPVTAPQTPMFQEAAAACPLPSPSLTETEYIAASSHSNAASPAPNPSPEAEAEVNLPNPQQEPTPPADQAVSPAPDPASSSRPLSPAPVAASSEPPASSSVLQTASPALEADAFHSASPVNHPASPAFHTASPASKPSSPIPQSASSHYKGASPAMAKPASPVQRYASKPASPLAKANNPLTRPYVSPAVSPSATPFRTPPPAPSVPPFNRSWLWHWLIIPLR

SEQ ID NO: 32733 - protein, 65 aa, A.fumigatus
SYHPGRCSLILMPNPLHFTKIVQPCRSGTDGFGPILTITALAPKTGALRSPNYQYSGVTRTTHGY

SEQ ID NO: 32734 - protein, 74 aa, A.fumigatus
TDTIAATVGVGPAVDVTYNSIELQPCFDTAQSTWTMTTLMPLTQARKEYNLIKKQQSCTTLKMCLSQSSDWDLD

SEQ ID NO: 32735 - protein, 113 aa, A.fumigatus
LTLPQAINELNILPLRARGSVSFIRSAAQAFSSFPPIIARNVGHVIMWSITCIGHERARLSSGVYENETRQGLADELLVMAKDLMIFSGMVKYKLPPRVYETLARAGADIGAY

SEQ ID NO: 32736 - protein, 226 aa, A.fumigatus
RPLVDPGTTNTPKQLALDQSARKVYFSDREGLRVFRCNYDGSDLEIIVQTGDYHRPGDMQDATKWCVGIAVSPRFGKFYWTQKGFSKSSTGRIFCADIDMPPGQTAAKRNDIRCLLEGLPEPIDLEVDEESGRLYWTDRGELPFGNSLNRVSLKETGSEVERTGHLGYEVLTRNLNEAIGLKLDLGRGHIYLTDLGGSVYRTDGDGKQKVKLYSDESRAFTGIALL

SEQ ID NO: 32737 - protein, 349 aa, A.fumigatus
APEPDQQLFIPPALRTISPQRKPEAPLQLSRTCRRLRDVCQPLLFQCYYHSSKSLTSLLSFLRTLEARPDLAKCVTSLDFNGQGQADALSDGDQQLLESCIAKFGLPLLLDDWQDCLGVERRLLAAELVVASCPNIEALRLPMNPEWLVSVLDSLPKDFVFAKLRKLDVWLYYISGDHYGIGYRKISGLLHASPNLEHLSLPSIEAFYPGEAGVPILEKVRHLDLGDSAPSPYFLKRVLEACPNLERFELHWIVSDGYDEDSEEWSPLDRRRALQRVQSSVREIIFEATIEFRDDDNLEDSVPTLRDFSRLEILKVNDIALQALYKVWTHPNRHGTVEQFVYQGVSVYD

SEQ ID NO: 32738 - protein, 106 aa, A.fumigatus
QISVFSHQLQPTSIAIRQQQEYISLVRPDSNPGKRNTLITMVVTSLETLPVELLSQISSYLSPLRCGQYPHSVSQKHLSSSVAHVGGSVMSANRFYSSAITILPSP

SEQ ID NO: 32739 - protein, 227 aa, A.fumigatus
YAGCYGCQYRCCRQEEGADKCRRTEILCGAREQRGRRSALGTPNLFTPSPSFPLGCDAFVAFWFQRLTVRQSKRRRTSVKHEDPETDEDVPLALNGRKLPKASETALGAEESDSDVPIERKLVAQKKKIQQKAEKDAKASRKSDASQAAKATAASKKKQVNGVKSEPVDEKKPAVKKTTKQANAEPAASARNGKTKATPVKKEESTEAEEGEEEEEEYRWWEDPTKG

SEQ ID NO: 32740 - protein, 69 aa, A.fumigatus
DEVRRCSRAFFTRKPKKWRALFGSMLNATQHVENPTFQKNFFMDFKEVLEKTGGAKDPKGHPNRDQGVL

SEQ ID NO: 32741 - protein, 139 aa, A.fumigatus
VVFTVASHGVESSQPFAPPYLLSFLTFVLIPQISHSYAYIQLNLTFHGMSATSTDVKMEDTPETNGHVEPGVSLRFGPVKSAGDIDMQDATDANTGVAGKRKARTSVGERKSYAEPESSEDEDQPLVRRTSLRRLPRFP

SEQ ID NO: 32742 - protein, 117 aa, A.fumigatus
RVNLSMRRNRQSRRQPNKPMQSRQLLLGTGKRRRHLSRRKKALKLRKVKKKRKSTDGGRIRPKGDGTIKWTTLEHNGVVFLLPYELLPSDVKMKYDGVPGHSSPESRKSGGLFSVAC

SEQ ID NO: 32743 - protein, 338 aa, A.fumigatus
  UNSURE (338): Identity of amino acid sequences at the above locations are unknown.
MRLNMWKTQPSRRTSLWISKRSWKRQVERRIQRGTQIEIKEFSKCDFRPIFDYYDAKRIEKKNLPPAEKKRLKAEKDAAEAPYMYCLWDGRKQKVGNFRVEPPALFRGRGEHPKTGRVKARVQPEQITINIGKDAPVPPPPEGHRWKEVKHDQEGTWLAMWQENINGNYKYVMLAANSDVKGLSDYKKFEKARELKKHIDRIRKDYQKALKHELMVERQKATAVYLIDQFALRAGNEKGEDEAETVGCCSLKYENVTLKPPNKVIFDFLGKDSIRFYDEVEVDPQVFKNLKIFKKPPKKEGDEIFDRLTVCAQLGLFVIDDDNFCLTRPGMEGVASPX

SEQ ID NO: 32744 - protein, 110 aa, A.fumigatus
EDTIEKFLQVGVSTNYQYTKTSTLTGTVTMTIPKNKWGAIVSNPLTHRKRGYIFTGSPGRGQFEYYQADSFTDETYRYKDGSLNWVKGVVTTCLRDTYPVKRCVGQGELK

SEQ ID NO: 32745 - protein, 252 aa, A.fumigatus
  UNSURE (52),(57),(81): Identity of amino acid sequences at the above locations are unknown.
ESGVPTSCQISIQDHKGRTRHFLIAWTGEKEMIDSFERSSAMVTVSLQLAPXETSIXSLEKSGSCDLTKLTKTASSSTIRXYGIANLTRWDLSIEDFHAPHSRFQVQTAITSHNFSNIAIRPWSAISPELAKVGGIGRYSTSFTVPSVSRIRGKLSLGPIIHTARVYIGGQRLPPIDPVNPVIDISSYIRPGQTYKLIVEVTTPLFNRIKTDANHTKIAGSTAVELQPLYASTPYQEYGLMGPVVVTWSIST

SEQ ID NO: 32746 - protein, 67 aa, A.fumigatus
NRPCVQAETQAYPQAVSTPSLAFISTLLICKLTTEINFQISRQLGPQQQTLRPVGNSRDSIFYLTLP

SEQ ID NO: 32747 - protein, 232 aa, A.fumigatus
FPQRVGHELTSVSSAALLTRPTCSQFNTLIDQKVRLHFASASLDRTAINIVYSHVLNPMVVTRSYMCIEPIELWLDLRSLRQGLVCPVDADTDPTALLVQDSGMVPVNTQVAIVNPETCTLSHVGEYGEIWIQSDACAKAFYGSRNDFDAERFNGRIVDGDPNVAYVRTGDLGFLHTVTRPIGPSGQPVEMQVLFVLGGIGETFEVNGLNHFPMDIENSVEKCHRNVVPGGW

SEQ ID NO: 32748 - protein, 313 aa, A.fumigatus
PLQFSCVFQAGGLIVVVVEVTRKAYLASLVPVIVDAILGEHQVIADIVAFVSHGDFPRSRLGEKQRGKVLASWVTRRLRTIAQFSIRDMEGSMNLFAEAPHHRSSKGSKPGSVMGNSLRRSTLVPEADSATVPRSPAPVLVEQPQESMVPQYHDVHERAGGEMLAPPLPDVQLSLPQIEDPVPPMRSSNNESHSAGIAQPDLGFNFGDFANATGSTPMDEHTGAGAVGETLPYRDVRGQGSIPTHQPPRTSSLPIGTAPASGRPDSSDRLSEDKMGDWPQEALMYQSALGGDDPYGHNAVDWTPGDATRNYRD

SEQ ID NO: 32749 - protein, 86 aa, A.fumigatus
LGAPTYLVSPVDFAQNPMTLFVALSRYKIKDTYATSQMLDYAMSVMPAKGFQLQEMKNLMISAEGRPRTDICKFRGSSHPSNLFSI

SEQ ID NO: 32750 - protein, 240 aa, A.fumigatus
LPPWCVQPNQILHMLVLPQLRSTLINNINNHRNYSHGPCRRWRHHRHHRHHRHHRHHRQSLSRDPHLNPILRNKYNLPLIPSLGRTLRPKYNCKHSPRRSRNQSPDPRFKFVQRHSRLLKQSRHRAHQPIWSGEDLGDRQRALRLRLQYQSLPRFRIRSTRVAGRSAKRSCTILKCSRSTFLKFTCLTRSRVNGKTAHFARTYRRCNCTSMSFQNMWCLSHGRWAMDHQCLQLVREYRDD

SEQ ID NO: 32751 - protein, 545 aa, A.fumigatus
TVPSIAPQRHCLPNMANDYFERLQNHRETGPSQFPQQNQYASFRSPFQRYPDAVLDLPPTYQTPLSDIHQPYHYQTHYAPLEQYVRPQDTTYSSLTTYPLIPYQGGQQYRANPPATTHQPPPAPPLSTLSQPLPWNHAQTQPQNTLSYLNYPPSTRAAEVVDVDVSGHDGKRRRLESSATVTLSKPTMPPQGRLSKYSFTPQDTTDRSYLKTRADIAKPLDVTDAAEKLQYDPKTIARDVLIASGRHPTEAPLNHHLFRLRDVFTGLDTASDLETFRWDLVDPDDKQANNTTTARDVQLLSAPAHVTSAMVRPAQPNPPYAGVTATPQHPHQQYQQPSQLQPRPLQTLETSQTSQTSQTSQTSQTVPEQRSSSQPNSQKQVQPPSDPQPRSHPSPQVQLQAQPPSQPQPKPGPSIQIRTKTQPPPKAKSSPRSSTNMVGRRPGRPPASSKIEVTIPITSQIPYKVYTCGWEKCQAELHNLEMLKKHIFKIHVPYTLTCQWKDCTFRENLPAVQLYKHVLSEHVVSIAWTLGDGPSVPATGERISR

SEQ ID NO: 32752 - protein, 129 aa, A.fumigatus
LNLCFFFSFLFFCFVAQWVRWLTTFIFTCHLEDRVAGESPLPKTIPESTQPGGEDSLVFPASYSSIRAFNRVHGNHTQIEKAREIFKAVQRLKEHIGYGLDPGGCQLATPTRIGRVSNDEDVYAVRHES

SEQ ID NO: 32753 - protein, 80 aa, A.fumigatus
YHDSSMWRVSEAMLLGPSNRLPGYLSWKLEEDSLSSVSQVQESGMIIIGSVSSSLDDYDLVRRTEPNSLGGCQDRAISPS

SEQ ID NO: 32754 - protein, 136 aa, A.fumigatus
PPLQRLPGGFGVHLAPRRLPHAHRLLGRQVHARPADPQRAGPESLLHLLQRPQHRHQQPDHRRLPGLSRPGSAGRPRHRGYHPLRPLAGRRPRPRPDHRVAVQAGRQPWLRGRRAPGPPGRWLRLSEPPVCDVPRV

SEQ ID NO: 32755 - protein, 390 aa, A.fumigatus
QSRNNFTITPTWATPGYNPGAIEPGIWNVVLGPYESVPDGIDWQLDIEMSFDPVDSWFAPDYATTDLDPLCNGCQEDSAFTWLRGDFHMHTVYSDGKYTPDQQIHNALAQNLSFIFFSDHNTDTSNQIIGAYQASLAPDLLVGRAIEVTTRSGHWQAVGLDRGQIIEWRYKPDDNPGFAAAAHQVHRVGGFVSANHPFATCPACNWSLGWEETDAVEVWNAQWDEQDQQAVQKWQELLVDGKFLTAIGGSDSHSPPSLNGWPTTIVKARGRSQAAIVEGVKAGRAYLVQGPGMDLTFEVRVPSLDAPAQIGDKVRRTAAGAKAVLVTDGMSKLKACFVSDKGYFYNTTIEDGVRVKTGVLSGARFVRVEVRNGTTDEVLALTNPVWFLGP

SEQ ID NO: 32756 - protein, 356 aa, A.fumigatus
  UNSURE (55),(113): Identity of amino acid sequences at the above locations are unknown.
KQFPKMKHICSIAWLVPLLELAIAARAPIKKTLTGHIDPSQVFSFVYVPFEVEVXTTSIYVVQNYSNKGRGNALDLGVFDQRGYQMMDAQSGTTGFRGWSGGFRYVCPRLSLXWFLLDKVETTSPSRPPGPRPATIPAPSSQASGTSCSAHTNPSPTVSTGSWISKCPSTPSTRGSPQTTPPPTLTPSATAARRIRRSPGSAATSTCTPSTRTASTRPTSRSTTRWPRISPSSSSATTTPTPATRSSAPTRPLSPRICWSAAPSRLPPAPATGRPSASTAARSSSGGTSRTTTLASRPPRTRSTGSVASSQRTTRLRRAPRVTGVSGGKRPTPWRCGTRSGTSRINRPSRSGRSCL

SEQ ID NO: 32757 - protein, 69 aa, A.fumigatus
HTIHRLVKICHIRKESKGNNTIIFTKLQEFNSEMRAMAIKYKYLFLPLLYTLIYYINKGLHHGLDIRIT

SEQ ID NO: 32758 - protein, 63 aa, A.fumigatus
RNADVEAVVKTFINVINECIKKGEKQILIFDGHGSHLTVEFLQLCEDYSVIPFRFLPYMTYLY

SEQ ID NO: 32759 - protein, 62 aa, A.fumigatus
EAEYPYLNPYPPSEPCINQLILACYTSYTSAITQASILSQEAPKTTISKPFDAFKISYPAAY

SEQ ID NO: 32760 - protein, 83 aa, A.fumigatus
ILSRDLRGVPPRPSHVQEMANILLQTDNPSGFKPIGKNWVSTFIKRRDEIKTQYARRYNYSRAQCEDPKVIKGWFNCLQQIQM

SEQ ID NO: 32761 - protein, 290 aa, A.fumigatus
KVFIPATASRTVGRYRLLILDGHGSHLTPGFDKACRDNDIIAICMPAHSSHLLQPLDVGCFGPLKRAYGGLVEQKMRLGYNHINKFDFLKAYPAAHLEVFTPLNIQNGFAAAGIHPLKPERVLEKLNIHISTPTPPPSRASTNSSWLATPHTLRQLHKQASSVKKLLKQRSQSPLTPSKLAIQQLIKGCEMAMHNAALLAKENHDLRAANEKEKQKRKQSRRQMTPNEGLSIQEARDLIQARNEQGNEVEGSSIDSAPLPLEPPKRAPPRCSNCFIIGHTRVRCPTRNTS

SEQ ID NO: 32762 - protein, 752 aa, A.fumigatus
KKDTERPSDLVKSATARHRKGNHATPIVQIESNEPSKSANPTTKASAKQSPGLKHEHFPSKDEPPVPEPVDKMLCRFQGQRGKEYHSAQNKRRKLDVSQKKQGLDQDVSHLLQDSSSRIAPRDKRDLSAVTDMSYTDEKRFVDQSDLKLQIGGQNLQQAKSYGSSGRNKVSTAMPYLQSTHMEQTKSKNKTLSIAADFATSRSQFQSNSKAETSTQVTARRRLVDSLGPLEPTVEDAVRASRTNDDTEVDPLPRHSPRRDSSSNSQPQTSSRPVKLVTDSANKGTAETSGPVSSRVGGCKVTYARQRSFLDDTSIVDSRRPSETLASTADSFVQGHRKYGPQILSNHASHLGDGETSDSGPVRGIHELRQAGDNSRFRSAIELIFEDIEDAYNTTSGRCSSFVQICEKLLDRQFVRRFLEHGFHERLVGCIDDRLDVVSASFALCACGLINLCDKLSHISLISHWSNVLVLSPVLLPVKRDLLSLSQSPATGLSRSVQMSIKQVLPRLSSSISGDEPAFELSPQFVALSSIQSCLVSLNNKGGSIEPIPATLSDHIVKLLLPERGKTIKLPVSRERFKTLALIFSILESYAIVFSAADHDQNYLSLRTLSRLHEILNLSQCNQGRQLRMYYIRAILNLTNNDPNLCNEYATPELVMGLVNIVMSDIRDASDNSSTGDDSSLNTLILVLGVLINMTEKSESARDLFLRLTLDSTPLIQSLLERFYEMVNSVSEVWKRSKQHVAFKFVLLITMS

SEQ ID NO: 32763 - protein, 123 aa, A.fumigatus
TMASSQRQYNTLPSSGSIAAPPLSENGSNVYEDDIRRPLLGSSSSTDLDGNGKKGSQSWLRAVYGEGKEIWLQGKGMILVTLAQFFGASMNVMTQILELDSGLHPFQVGSISATSAGCSATHC

SEQ ID NO: 32764 - protein, 320 aa, A.fumigatus
ILFARMSVTVVASYLYMWYTKVPHPFGTRPVLGLLIFRAMGGFFGVYSIYYAVQYLPLSEATVLTFLAPILCCYACSLFIPNETFTRRQQLAALVSMVGVVLIARPFSSSAMPPNPEKLEGRKPGTTDEFQHIVAILAMMVGVLGSTCAYTSIRIIGQRCHPLVSVTYFSLFTTVMSFLAMLLVPSVPFKLPETGLEWTLIVGLGVCGFLLQFLLTAGLSYVPPPPRRSQRVSGGAGSECKPARSSSGSRATSMIYTQMLFALFYDKVVWGNTLSPLSWAGSALIVGSALYVALVRDGKKNAAAAVAVDETAEEEREPVA

SEQ ID NO: 32765 - protein, 73 aa, A.fumigatus
LPHACRSSPVVKISIQEGQEIIQRRDQAAEAIPTIPPEQVVDTEQRPQRAPPRCSDCHILGHRRLQCPQRKNN

SEQ ID NO: 32766 - protein, 61 aa, A.fumigatus
NLAAAEIGGYFEPLKHDFITKSSYSCAADIAIAYGLEYGSHCSVGVPVEGVVLYLLPALEG

SEQ ID NO: 32767 - protein, 388 aa, A.fumigatus
VTYYFRPVLLEDPSGNRPFYRCVLTDRLFLVRFPASSDTPDSPPLSDHPISPLLLYPSGFSKFDQNSENNQSTEMVRNIVVIGGTSHPQLTQTICNVLGIPPADVLLSKFAVGETRVEIKESVREKDVYIIQSGGLKVNDSLMELLITISACKTASAKRVTAVLPLFPYSRQSDIPYNKAGAPLVKSSNAAKPGNGYTFESTPPTPHPGKPESGGLLNNVDSLQKGLANAQLDDYNNGSPVKKRIPNGPPRSDTTESLKSDVGLRSTVVNGQANDENIQSKISSFRPRPGYKQWVAQAGTLVADLLTCAGADHIITMDLHDPQYQGFFDIPVDNLYGRPLLKSYIQQNIPNYKHAVIVSPDAGGAKRATAIADSMGMEFALIHKVPFT

SEQ ID NO: 32768 - protein, 121 aa, A.fumigatus
ERRPTKITDRQNATMMLVGDVKDRTTILIDDLADTSNTITRAAKLLKKEGASQVYALVTHGILSGDAIDRINASALDKVVVTNSVDQSDHLRRCPKLEVLEVGHVFAEVSRFSFLTNTNMS

SEQ ID NO: 32769 - protein, 156 aa, A.fumigatus
NQADHEEEEEEEEHHILSPLAATIALVVVTILVAICADYLVGSIDSIVEKTSMSRTFIGLILIPIVGNAAEHVTAVVVAWKGKMDLAIGVAVGSSLQIALFVTPFLVIMGWILNVEMTLNFHIFETVAFFISSLVVTFLIQDGKSNYLEGGLCLGM

SEQ ID NO: 32770 - protein, 138 aa, A.fumigatus
DGGTLTDGIELAYVIRRVEPNNSPTDKGVCPWSIRQTGVYHKMLYPNQHSQNSLRSTSVFILIAPSHAVEKSIPYRLSENVSQDDTFRQDFLIHEYIVGDSLKGWMDYQAWLEAESKQIVCCWLLLRIIRSQYYKERH

SEQ ID NO: 32771 - protein, 90 aa, A.fumigatus
QVFNYLVGSLSRIFTTLQEVDDKLILYGFIAGFVLNVILAAQMVYYWKSPAQPKKRPARASRPLEKIPAAESTGVSTKPSAKSPTTRRRG

SEQ ID NO: 32772 - protein, 94 aa, A.fumigatus
SSHPSSSSSPPGSPRQAPNPTAPPAHSHSTHPGPQARTPPPADRAIPSPQPLDQVSCAGVAPVSGPACGRGTRGPGRRRARRGGLCYRRDARRC

SEQ ID NO: 32773 - protein, 212 aa, A.fumigatus
SRSSLQSQAGIISNNLVSISEHLADNKDLLSALVAYPGPSYPGRTQAPTLEQLLRTKLDPRVEDWVSRGRRAGASALEDRGALSESALAELWDWAPVEANQEARRRNWGGNFTLEEREMGIQNVVTGLRRQLEDEDEEASESEEEGEGEGEEEEMEVVGVRRRSGAGAGLEFDIAAPAPGSRQQQQQKAAGPAVPLEDILRYMTTGIPPTQR

SEQ ID NO: 32774 - protein, 104 aa, A.fumigatus
LWGCRIANLPAIRPTYSLSAGTSPSPSQPLYLNSIAAQSELLIQSKMASLNQDQIKILEQSRQRLVQLTRSLASLIGSLNQSEPLPSWFNPTPAQTTASKGKIC

SEQ ID NO: 32775 - protein, 401 aa, A.fumigatus
  UNSURE (401): Identity of amino acid sequences at the above locations are unknown.
PPRIPHQKKFPRLICASSEFCWNLERGTQNQLVFYMGPFGPIPVARIGIYCNDASGIRTRDSTDRRRGVERIRWRHSVHQAWLRGSTSGPARPVPAAPPDDCPGWHNWHRALPQLRASTCNGGPPGCISGLYNCWPWGFERRPDCRRDGCVGSPERRARPICGILLRPGHGLCQRMESSLLIHSHYPCGNRGSLSAGSILDHRQQRHLDYRLQLAGADYGAGVRPNLWGAGICIRHLENPAHHWGEHHGAGDYLRRRTGWTIDWFQILERPRAFCSVPWDQRLPWPVPWFLDMSQQCRLLVLGNPEYHDPRGRDQVRPTVHPRSNPARLGTYLPLPCSNDLYDWPGSSLRTIPLFCQLMGRALTPHLLMVASPGRDQDGTLDHQRYYPDFRVVPRGIQISX

SEQ ID NO: 32776 - protein, 344 aa, A.fumigatus
SAQARNFVGTWSGEHKINLSSIWVLLVRYPWLVSASIATMPLESELGIQLTEGEGSSASDGDIAFIRRGFGEVQAVRQGLYQRHLQMIALAGTIGTGLFLSSGQALVMGGPLGAFLAYTIVGLGVSSVVLTVGEMGALVPLSGGLVRYAEYFFDPAMAFANGWNQVYLYTVTIPAEIVAASVLVQFWITVNNAIWITVFSLLVLITALVFVRIYGELEFAFAILKILLIIGVNIMALVITCGGGPDGQSIGFRYWRDPGPFVQYLGIKGSLGQFLGFWTCLNNAVFSYSGIQNITIPAAETRSARRSIPEATRRVLVRIFLCHVLTIFMIGLGRPSERFPSSAN

SEQ ID NO: 32777 - protein, 68 aa, A.fumigatus
LYRPSRSPPQLIVSQLDEAVRYSGMSKSNIMEIGAYRYIRVYLEKFSLRYPDIIIIDGGTESPTDSNL

SEQ ID NO: 32778 - protein, 209 aa, A.fumigatus
  UNSURE (12),(13),(25): Identity of amino acid sequences at the above locations are unknown.
LPRGSAGNSNIXXASRILYGMAVHXHAHAVFERLNRFSVPYVAISCIGFFMSLGYMSLTESSTIVFRWLRDVVSVATLVDWIIVCIVYLRFYYGCKKQGVDRHKELPWAAPFQPYFTWASLILFALLLITGGYSTFIHGHWDTETFVSSYINIPIVLGLYYGYKFWKKTHIVTLENMPLVGLLQFYLSQDEDEPEPRPRKGLAKLNILW

SEQ ID NO: 32779 - protein, 62 aa, A.fumigatus
KVLPRFHVDRFSLVRVFRETGPLLSCPWEISYNSPETVIKQSCIFTYMRYNFTVRQDLLLSL

SEQ ID NO: 32780 - protein, 129 aa, A.fumigatus
  UNSURE (64): Identity of amino acid sequences at the above locations are unknown.
CDEVKPNCGNCLRHSIECDYTLNTEGTSTPSTEEENRTPTSLNDNYTFISSSQSNFTPPRRRRXSRPLPTQEDIEPKPQLHLPVGKKLFQFTTNDMGLFHHFITSAELGRIFKTLAEPTVSTKDSPPIM

SEQ ID NO: 32781 - protein, 70 aa, A.fumigatus
SSIHVLTVLTVINFLQGSSLAADTVGHIITYEVVTLGTYLLYTHNKIVLARVGSRRSCHLCTEVLNSIIH

SEQ ID NO: 32782 - protein, 68 aa, A.fumigatus
LHAVRPCLDHFLFYHCIDCSFSVSGQTKPSLFPVNFPLYSRRQDFALVRLNAVKLSPPSFGLETTYVF

SEQ ID NO: 32783 - protein, 170 aa, A.fumigatus
MTALQTARITLAGEQLGFMNVSNAGSTVFNWFLNISGVAGWITWASLNACHIAFMRALKARNISRDLLPYKALWQPWYAYYGLFFNVLIILTQGFTAWIPTFSVTDFFVAYLSVILFVVLYLGHKIIFRPAFVRPIEADIDTGRVALENEMWETVTPTKWYKKLGSAILG

SEQ ID NO: 32784 - protein, 111 aa, A.fumigatus
LRRFAWPFSCSAISKPQSGVLPNSGNYPIPRGDLADFPWPGVAGNPSGFFFSPDIYFSIRRTGKRKERTRLARRRRFVLIRSLASFPLSPFTYPDSMLSVLVSITFSFIIV

SEQ ID NO: 32785 - protein, 148 aa, A.fumigatus
SRGRLLRGGVRVVTREEERPTFARCAGNHKGPVYSPFNPRGSVKPPQYSPHQPGPHQPHRSPAPSCPLGSQTPRPPSPPPAPRSTPLASRAPCTPGRRPSRQWSAGTRDSSARGGIPAAGGGRCGARGRPSRSRRRGRRAARPGGSRR

SEQ ID NO: 32786 - protein, 65 aa, A.fumigatus
TTPILAASAGSAPTASFASTVVPTWFPNAATPVPTTGATVHTPCVACAVHTRKTTIPAMVSRNPR

SEQ ID NO: 32787 - protein, 136 aa, A.fumigatus
  UNSURE (9): Identity of amino acid sequences at the above locations are unknown.
HEIHNGRGXFVFRGLDVDRYSRADDILIYPGVSSHIGSIRGRQQDQRQADGTSVVLAHIKDLTRTDQAGNIGGPGSTADKQVFHTDAGDIVSLFCLETAAEGGESQISSSWLVYNILAKERPDLIWTLATDWPVDG

SEQ ID NO: 32788 - protein, 209 aa, A.fumigatus
RKQRIANLVLVAFHAFMGTFIAAGIIAAYEDIAVDLDVSIQKVSYLTSLQIAILGGGPLVWKPLSQRFGRRPIFLVSLVLSCVCNIGCATSPGYASMAACRALAAFFICPAMAIGSAVVAETFFKRERARYMGVWTVMVTLGVPTGPFIFGFVAQRVGYRWIYWILAIVHTFSTNPTYEPPLTEAYRPTPSSSSSTSSSALRPATSAPT

SEQ ID NO: 32789 - protein, 176 aa, A.fumigatus
PTSSWWHSTPSWAPSLQPASSPRTKTSRSTWMCPSKKSATSPPCRSLYWAAARWSGNRSRSASDGGRSSLSRWCSAACVISGAPRVRVMRRWRRVGRSLRSSSALRWRLGVRSLRKRSSSAREQGIWVSGRSWSRWGCRLGRSFLGLLRSAWDIGGYTGFWQLYIHSLLTLRMSHH

SEQ ID NO: 32790 - protein, 189 aa, A.fumigatus
DPLHRHRHDLPNHLGLPTGIPVSPAHRSHPLYAPRILPPAHALHQHPRPHRRVRLRHGLPLRQRPQLRRSAPAAPIQVLPQRAAARPAVPRAHRRLPPGRAARRPRLRLLDGLPRAPHLPPPAAGIPPLAELSRVPADHCRDGRLPGVHGARDARGVDRGAGGGDGGRGVWEPSGHDGAGERCGWCGPG

SEQ ID NO: 32791 - protein, 94 aa, A.fumigatus
NQDSKMGEIQTLRQPDIQYHPDYEKYLARVQRRKATEDLPTSLPPGFPEKLSSPLVWEGKEIEKQNDWIYKLDDAQREEIHAALSHFKGKLPNR

SEQ ID NO: 32792 - protein, 143 aa, A.fumigatus
  UNSURE (44): Identity of amino acid sequences at the above locations are unknown.
QGMTNVHSPEPRTRLHQSRDIPPPNSPSYTAGTIARDSQRARLXRLPRPRRRSVLPRRRHPHLPGRILAYWKHPRPAAGPTTSRRDVSRARTYQGPDSHRSSRQHRRARQHSRQASLPHRRRRHRLAVLSRDSGRGRRKPDLQ

SEQ ID NO: 32793 - protein, 145 aa, A.fumigatus
  UNSURE (116): Identity of amino acid sequences at the above locations are unknown.
LAGVQHPRQGTTGFDLDVGNGLAGGWVSVRLLPQLLSCLPRSFNNPERPYTLRPLLYHQDATASTPERVLIQYARRYFTGFLAQPRSANIPPITEAQAEALERGEFSWPEEHSAAXDFQKGDVQYIINLSIFHARKGFRDGPGKE

SEQ ID NO: 32794 - protein, 212 aa, A.fumigatus
TNAVQFILYLFLGPETRYIGTDMTSQTTSAFQREYLSLRRIDPTPFTLHEFYHPLTLFTNIPVLTAACAYAMVFLFGSVLNSVEVPQLLQSKFSLNAQQLGLQFLGLIVGSLLGEQLGGHASDSWMAFRARRISRRPPPEFRLWLSYLGFLLTIAGMVVFLVCTAHATQGVWTVAPVVGTGVAAFGNQVGTTVLANDAVGADPADAASIGVV

SEQ ID NO: 32795 - protein, 90 aa, A.fumigatus
RCLGESSTIRDGPATTGIVFKGDMAENEAFRLRDMASSCATNNDTEVNVIKVSALPIGRFRKWRICRTMEKQYDEEIHGSASSFAEERRR

SEQ ID NO: 32796 - protein, 138 aa, A.fumigatus
QGTFSRNHRSSLSSLTTLAPRRTPSPTPSVAGIERYPLKVTRRMGKKMVEKRSRIKPFIKIVNYNHLMPTRYTLELEGLKGAISQETFKEVSTREDAKKTVKKALEDRYTSGKNRWFFTPLRTCNLCLFLPCCERVLC

SEQ ID NO: 32797 - protein, 137 aa, A.fumigatus
EGTTKPFLFLRVLAKIWMRVEGLVRHFSMVDVERKNERDVLDELGKREIGLGRDHLDIEKDVLTRDLFAKSQVVIVQPNDTGSKAHPFPYAIRRRYRALPPQGHPPHGQEDGREAQPHQAFHQDCQLQPLDAHPLHS

SEQ ID NO: 32798 - protein, 348 aa, A.fumigatus
EPRRTSLFNERLILSSEKSRIPAWCDRILWKGSNIHQLHYDSACLQCSDHRPVWAVFSCDINFVDDHLRENIRSMIYAMEVGDSPETPAKSKTQAKVRKRESAELDFHTLDLPSASSDDRRWWLDNGMTSQILNRLLENIFVSGYSNHSYVAGMPVKSIIQPPSNGWSLNMNRESNPFSSSNAPDWVPARRLTDSQKAVVDNIDPITYKPPLPPRGGNGAADSSDLIYETDMQSSRANGAKKAPPIPRKPVALRNDHKALSGQAGWQSGMKALGSVPSQPSNRLDVPRFDLGDQIKPPPAVHRVPGSQDSLSVGSRHLGGFERHTDITKDLLDGEVDSEIKWEPLLPK

SEQ ID NO: 32799 - protein, 184 aa, A.fumigatus
ALLQSADPSTPVVKTRIARGFFQPGKVKPDIVVPGVLLELFLVLHPALGQNHILNALSVTKLLLKCRVGLVKRHRLGTGQPVQGVFVDCSRPLILLELCLEFRVRDEELLVHKILTQGLDCHPVHFPHQVTRPVLLLKPGPFDPVPWLRVDDRKPLEDCARALKLIVPLLKLDIRTPRALVRLP

SEQ ID NO: 32800 - protein, 146 aa, A.fumigatus
HPPLKHLPRSLDIPQRLLHVHVLVPELVHAGQDGDRPVQQVPRMVDVAIPHFRLDIPDPEYHRGRVDVQRPFEDRSRPAKFLLLQLPRCIPHPVVHVQPIAAHIVFKLLSLAALVLVQFFEVRESLCRRLQRRLLPINSLAKQLLR

SEQ ID NO: 32801 - protein, 536 aa, A.fumigatus
  UNSURE (521),(532),(536): Identity of amino acid sequences at the above locations are unknown.
PAASLASAVACGYIAVIMSNAEEFLRDFEEEDDEVFQAGEEVEEDVGEEVQRPTPEVTNEFDVAVSTTDELTRLHKSLRDHYSIRFPELETLVTNPIDYAKTVAILKNGPLNDIKALSSSADNMVGAPLKSILDGPSLMVVAVEGTTTRGREMTEAELKVVLDTCERILKLDRERTALTQSIQSRMNQIAPNLAALIGPETAAQFLNQTGGLRELAKIPACNLAAQGSKRSEGLGFATNIGIRSQGFLYHSPIIQDIPNDLKKQAIRIVAAKMVLATRADVAKYSPDGSLGEELKQQCYQRLEKLTEPPPNAGVKALPAPDDKPSRKRGGRRARKAKEAIAMTELRKAQNRVAFGKEEAEVGYGTGETTVGLGMLGQQNDGRIRATQIDQRTRAKLSKSNKGWGAATPISGTATSLRGFGSGAGGTASVLQAKGLRTSGVGPSFAGIAGTASTIAFTPVQGLELVDPKAQAELQRKRKAEEDRWFKSGTFTQVGGQSSSTNNSGANGGFKVPRTACMEKGXTPLRADAPPPXPVQX

SEQ ID NO: 32802 - protein, 99 aa, A.fumigatus
ITFALQKLNLPPPIVDTQPIVPPTHHPLSPWSHPAGPLGSRTRLPRRSRSQRSSCFARLLIGRSRRCRRRHSDSRTSKNCTSTRAARERSLKTMCAAIG

SEQ ID NO: 32803 - protein, 364 aa, A.fumigatus
YPTHRTSNTPSIVTMESSRGPPRVKNKAPAPIQISAEQLLREAVDRQEPALQAPTQRFADLEELHEYQGRKRKEFEDYVRRNRLNMNNWMRYASWELEQKEFRRARSIFERALDVNPTSVVLWIRYIESEMRNRNINHARNLLDRAVTILPRVDKFWYKYVYMEETLGNIQGTRQVFERWMSWEPDEGAWSAYIKLEKRYNEFERARAIFQRFTIVHPEPRNWIKWARFEEEYGTSDLVREVYGMAIETLGEDFMDEKLFIAYAKFEAKLKEYERARAIYKYALDRLPRSKAMALHKAYTTFEKQFGDREGVEDVILSKRRVQYEEQLKENPRNYDVWFDFARLEETSGDPGLHHGGGRVSRLQ

SEQ ID NO: 32804 - protein, 67 aa, A.fumigatus
TTHLVRVRYINVFDGGVMASYLMFQSASGVSGHNITWARLALGHVITSQLCPTIINTSRCIAMIFGG

SEQ ID NO: 32805 - protein, 163 aa, A.fumigatus
RVPDEYSNLPKELYQPRIMTDTFPAALVGPSSKERKYDRQLRLWAASGQQALEESRVLLVNSDGSWGDQGTGVSGVAGVETLKNLVLPGIGGFTIVDPAVVTEPDLGVNFFLESESLGKSRAEETCRLLRELNPDVEGSFRPKVYMTATSSLALRIGGANLNY

SEQ ID NO: 32806 - protein, 206 aa, A.fumigatus
YWTPPHRGLFSGDCAPAGGPRKPSQRMHALSALNLTCLSMLCRTRPLFRFSSFISYPRSHPIYPTLSPIYHPPTRFQSNMASVIEAAKRAAGKAAVANHYPKDAKFVGIGSGSTIVYVVEAIKESGIDTSMTRYVPTGFQSKQLILSAGLTAVDFDSLPEGTVLDVAFDGADEVDDELNLIKGGGACLFQEKIVALQAKEFICVAG

SEQ ID NO: 32807 - protein, 130 aa, A.fumigatus
  UNSURE (112): Identity of amino acid sequences at the above locations are unknown.
YLRPDSRKLQSRLLTNWKYIPIEVAPIAAPRVLTKLRELGSIQPAIRPSGTSKGPLKTDQDFYIIDAPFPPLLTKADVAAGKDGSGKGGIWEVDALAQAIKMIAGVLEVGIXSGVTGPQAQALGGVGGQK

SEQ ID NO: 32808 - protein, 109 aa, A.fumigatus
LPQSTMLYRNSVARSVLRAISSSNASVARSTLSNNVFKAHLTSSARFPARASSLALTTRKPVTTALVRYASSVPGSTNVPKVSITHVVSSGRSLIFVCRKPRLPRRTMT

SEQ ID NO: 32809 - protein, 114 aa, A.fumigatus
TLAFGDLQKVIKDTFSLEGTPKEALYLGMAGVIPYLATSLETVYLSYEINRATATGDGLIFSGQTAELMLHMLEPIQVGYGAVVSLNLSCCQAPCLTRSDPPDPLLPWSYSLGS

SEQ ID NO: 32810 - protein, 148 aa, A.fumigatus
REATLQILSFLGAIHWGLEWAGYGGKHGYKRYAAGVIAPAVAWPTLLLPVEYALISQFLAFTFLYYNDARAAAHGRAPHWYGMYRFVLTFVVGASIVASLIGREQIANTISTEHTITDKINALLFLQKKEKEEADARRRAELGEEESE

SEQ ID NO: 32811 - protein, 109 aa, A.fumigatus
  UNSURE (33),(41),(97): Identity of amino acid sequences at the above locations are unknown.
CFQLLAYAINNMDGVAGYSGWRWIFILEGLATXVVAVIAKXIVVDWPETARFLNEDERALLLRRLAQDQGEARMDRLDKKSLRRAFSDPKIYLGYVXCPPSFDLRVIQN

SEQ ID NO: 32812 - protein, 146 aa, A.fumigatus
VVMVRSVLDPANILISDKPSWGATVWIWTSEVFSMNVRAQAVGMASQTQNVANAIVQQFFPIFLKNCGFYAFYMFAGVNFLLALFVWFFIPETKQVPLEEIDALFGGANHVTHGERMMIGEKEKHFEDQANEKGDAVTIENLEARR

SEQ ID NO: 32813 - protein, 205 aa, A.fumigatus
  UNSURE (105): Identity of amino acid sequences at the above locations are unknown.
GYSLAAACLTPVGTSTGTGTMDEKDDCTHATIEDIKSASLLPDELDRAAERRLLWKCDLHVVPILTVLFMFAFLDRINIGNARLMGLERDLRMTGHQYNIALFVXFVPYILFEVPSNMLLKKMRPSWWLSGIMFAWGVFSSSCAVAEVVSDADSATGILTVCQGVTKSFQGLVVCRVLIGVFEAGFMPGTCFFLSAFQSSHADFS

SEQ ID NO: 32814 - protein, 244 aa, A.fumigatus
  UNSURE (18),(49),(63): Identity of amino acid sequences at the above locations are unknown.
EVTATCLFRSQDLLGVCXMSTVFRSQSDTELMVNFLRRPLMYFGIVNTXYAVSFFTPTILNQXGWTAVRAQVMSIPIYCVATVIAFSAAYTSDRLRHRYLFTLAGCLIATMGYVILLCQASVPVGARYFAVFAITGGGYLTQPILMGWLSNNMAGHYKQSIASAMQIGFGNCGGLVASNIFFKEEAPRYTTGYGVSLGMTWICGAACALFLTYLVRENRIRDAGRRNWRLELPQDEVEILGADH

SEQ ID NO: 32815 - protein, 86 aa, A.fumigatus
  UNSURE (17),(41): Identity of amino acid sequences at the above locations are unknown.
LEVDQAIDLGSEPSEGXATEDGIHADVDSAPPASQIEEHLXGQDTVSSQIEERIVWPNHASGDVGNTVSPDLGQSLLGLGQSLQDG

SEQ ID NO: 32816 - protein, 196 aa, A.fumigatus
  UNSURE (185),(187),(191),(193): Identity of amino acid sequences at the above locations are unknown.
VLPSVIAKGPESSEHANHSFGRIIILEALACEPGGPLVHIWHEVADQSRLLELVPSHQSDVLPDKRMSRKVRIDLTEFDAEPSDLDLIVSTSRTLNVARRSVSAQISTAVQAISGSDVELSPGLVAALTFSLVLLDPLLRINKPVGKEFLCCSIPHCSGNPLPGHPHARRFHQLRLWRRCSLIDXVXSYAXHXTIW

SEQ ID NO: 32817 - protein, 336 aa, A.fumigatus
  UNSURE (174),(198): Identity of amino acid sequences at the above locations are unknown.
GYTQWTRAPLWITASTRSVRSFHNASDKPNRGFPRSPQTHCSLLVHDSSQKPYALHVDRMRSRACSSLLPRTSATTLAIGDLRVRRSRRMCAPRNPVAPVRNTVGSPTSMSSIRSGKDLGRVSTSFLASLEYSSSASLEVARVSAVASASLALLANDSKLTKRSISAANPLRVXLRKMAFMLMSIPRHLRLRSKNICXARILCPPRSKNESSGPIMRAVTLEIRLAQIWAKACSVSDRVCKTDDLRRGAAALSSAVSGNGNAGLSILPLGFRGIRFRGMKTVGTAYAGSLLRKCSRASSRRGRNRLSMPTIPSAESSSLRPLLASQAGHLFISGTK

SEQ ID NO: 32818 - protein, 128 aa, A.fumigatus
SRVTARTVSYPIEIITTGAEHVLTCHLSMPLYHFVTADLPSNTKAPELDDVHAAASLRADAAWSGIDASAGAGVTEELVGLYASYLVTIGFLPPPSVSTIGVRPLPKVQLSEDQKKALANVGGRGGTS

SEQ ID NO: 32819 - protein, 127 aa, A.fumigatus
PDQWLHSRLKRLTNIPSLATNTDDFLIRMMKGCIQLSARPNIHNTVNMVPVDHVARVVIAGAFQPPCTPIGVAQVTGHPRLRFNQFLGALQTYGYDVPQVDYVPWKMSLEHYVNDGKHDDPESQHAL

SEQ ID NO: 32820 - protein, 567 aa, A.fumigatus
  UNSURE (248),(272): Identity of amino acid sequences at the above locations are unknown.
TTKKFLTNWFVDPQKWVEKDKAESQGGNEPWRQFYVGPRDRLYRSGYLGRYTPSGDVECSGRADDQVKIRGFRIELGEIDTHLSRHPLVRENVTLVRRDKFEEPTLVSYFVPDMNKWPAWLASKGLKDDDSAEGMVGMLRRFRPLRDDAREHLRSKLPAYAVPTVFIPLKRMPLNPNGKIDKPALPFPDTAELSAAAPRRRSSVLQTLSETEQALAQIWANRISNVTARMIGPDDSFFDLGGHSILAXQMFFDLRRRWRGIDISMNAIFRSXTLRGFAAEIDRLVNFESFASNANEADATADTLATSNEADDEYSKDARKLVETLPRSFPERIEDMLVGEPTVFLTGATGFLGAHILRDLLTRKSPMARVVALVRGKSDEQALDRIRSTCRAYGFWDESWTSRLQCVCGDLGNPRFGLSEALWNDLTERVDAVIHNGALVHWVYPYSTLKPANVLGTIDALKLCASGKPKQFSFVSSTSVLDNDHYVLESERIIAAGGAGISEDDDLEGSSVGLGTGYGQSKWAGEYLVREAGRRGLKGTIVRPGYVLGDSKTGSKHHNLTSGCTRD

SEQ ID NO: 32821 - protein, 611 aa, A.fumigatus
PHALSFRPVVKTSRSGTSSVDSGTTRKRQSSVRGWQDYIFGSGTASRKTSRASSIMDDVGEVEEGAHNPRASNNNRRKALDEQLFQPPSERSGGGIAAKHAVSGLVSGDDASTHSRKSSKSITSWTVRLFAGGSHNSRDENDAGSVRSRTSSIHQDKTRGSSSTSTNPKTALSAVAALKRINSNTSIHSAPGRSTNGSTGPGRTAAPSGRRHAASSVSQVASSEAGDKSSTNLGPVEMDAILPMESRPPTLSHMYNNYQPGELLTDRFGFIYDQRRKKRQREAAMSKNNSKRLSIAETLSSFRTETSDGDEDAVQGIAEPQRSPFSVSPEDPEAGAVAIRKWQDYLKFPTRPTELLSHTPSAGPIVSLTTTSEPPPRSTAVAVDRHGSLSVNPNAPPSASTSTVVADRPEFAGTSADEPTTAATQSASTENEPVKLLLEQLTELHDALQRDRTVRWNEFMRKVRAERRKEGEAAAAAAAAAISTRAAQSVDTPEASLAVGEVVGIANLGNKGKVGRAKWREFRSLVLGGIPVALRAKIWSECSGASSMRVPGYYDDLVAGIGGSEPDPSVVAQIDMDINRTLTDNVFFRKGPGVSKLREVLLAYSRRNPEV

SEQ ID NO: 32822 - protein, 62 aa, A.fumigatus
KHPPPALLTITDYLLHNPIGSCYESFISEVPPKLTAHLESVGRPTPNPELPWVPPRLSRMAC

SEQ ID NO: 32823 - protein, 194 aa, A.fumigatus
PGTRMEDAPLHSDQIFARRATGIPPRTSDRNSRHLARPTLPLFPRLAIPTTSPTARDASGVSTDCAALVDIAAAAAAAAASPSFLRSARTLRMNSFHLTVLSRWRASWSSVNCSRSNLTGSFSVDALCVAAVVGSSADVPANSGRSATTVDVDADGGAFGLTESEPCRSTATAVLRGGGSLVVVSDTIGPADGV

SEQ ID NO: 32824 - protein, 286 aa, A.fumigatus
QDQLIHNPPYADWQCCLNAGSTYGWDTVLRMLCTRGDYILMEEYTFSSAKETALPLGVKVASVKMDAEGLLPESLDEVLSNWDEASRGSRKPFVLYTIPTGQNPTGATQQLERRKAVYKVAQKHDLIIVEDEPYYFLQMQPYTGPDREPVPPPASHDEFIKSLIPSYLSLDVDGRVLRLESFSEVLSPGSRTGWIVGPEQLVERFMRNCETGAQHPSGISQIVLFKLLDEHWGHSGYLDWLINLRMQYTGRRDAIVNACEKYLPKEIAKWNPPAAGMFVSISPPTI

SEQ ID NO: 32825 - protein, 205 aa, A.fumigatus
FLPYGSNPEIFPQKKPCGPMEAVPLPPIEPTQINPTYPNSWINCGGGGMGWSGGGAWESSWLRTISTGEKNKGKFVCQVVGDGTILFSVPGSVYWIARRYNIPVLTIVLDDRGWNAPRRSMLVVHPNGDGSRATNEDLNISFAPTPDYSGIAKAAAGGELWAGRVATVAELGKLLPEAIQSVLNGTAAVLEAQLDGTTGKYVEKK

SEQ ID NO: 32826 - protein, 97 aa, A.fumigatus
QSTLKGAARYLKTPGIPSRQSLHNRDIGPHEMLILTTVGLISLGGGLPSPEYFPFEEISVKVPTPPGFSPPETQESGAVLTAKKGDVQAARSLYGTY

SEQ ID NO: 32827 - protein, 370 aa, A.fumigatus
  UNSURE (370): Identity of amino acid sequences at the above locations are unknown.
LIYFNLAARYPKITNDKLTFVAQMSRTLTNVIRLDSFPTFCALLVAGSTVLPVLLLRLCALVSSRIGKISGPVKSRVFLRFVRFVAAFVSAWFSFQLLNKKPIRQQGSDVISSHKTGSGANAGHSPEKKITPQYSPDLAGRTMDLTLFTFTRAMDALVCLGWSRWRASRRGQNRWSLVETVAPVLADTGLFAASSAVVMWAWFYLPERLPRSYGKWIGEVAKVDIRLIEALRRARRGIFVYGKETGQARLLESMCEDYNWPREWGDPSKTIPIPCEMVHMGCGPNCEKHAVWRFAKTFKFACATYIPLQVVFRVRSMKTMSSLWRALADALRSSTFLASFVSIFYYSVCLARTRIGPKIFSRETVTPQMX

SEQ ID NO: 32828 - protein, 83 aa, A.fumigatus
  UNSURE (9): Identity of amino acid sequences at the above locations are unknown.
SNLKSRNVXHLHAPVNGWLGTYSPGSQPPLTGRKKSAPQFSEWKINQFGTIKFNFPEQAFRKPPNFPPAVLLCSGPKNPPLRG

SEQ ID NO: 32829 - protein, 398 aa, A.fumigatus
  UNSURE (381): Identity of amino acid sequences at the above locations are unknown.
RVSPTAAGINAIVGPYIGPSDALLTYLPQAHILEFMFENLCLFWGGTMGYGNPRTLSDTSMRNSKGDIREFKPTILVGVPAVWESVKKGVLNNLNKASFLLRGLFWGAMTAKNFLLTNGFSGASTSASILDAVVFRQLMEATGGRLRIVLNGGGPVSKETHKFLSMAIAPMISGYGLTETSAMGALNDPMAWNPDALGEIPGCIEIKLVDFPDAGYFTKNDPPQGEILIRGGSVTSYYWDNEEETKAAFTEDGWFRTGDIGEFDKNGHLKIIDRKKNLVKTLNGEYIALEKLESVYRSSPVVGNICVYAAEDQDKPVAIIVPVEVALKKIASENGIEGDSVESLVHNEKLKSIVLKQLQSAGKAGGLRGIEVINGVVLSDXDGHSECSLTTLLFQTTS

SEQ ID NO: 32830 - protein, 207 aa, A.fumigatus
DYSSNISCEVAVIVVIVIAVDRFGRSNRSYQYLFLFHTAPRIFVIAVQDVEARHPPPTHGCPRSLPFTVEASGYEPVPGETIPRRLPQAKDNLILRPAEDVATTYDVFRRSARVFGNAKAVGTCRLIKTHVENKKVKKIVDGVEQEVEKKWTYFEMSGYTYKSFVEYERLALELGCGLRKLGLEKDNKIHLYGATRWALPAVFITEE

SEQ ID NO: 32831 - protein, 187 aa, A.fumigatus
IQTGAASQSMTIVTAYDTLGEEGLKHSLVQTSSLAIFLDPGLIHSLANVLSDVKSIKHVIYNTDQEVKQEDLDKLKADFDYLNIMSIEDLRKLGEENPVEPVPPSPEDLCCIMYTSGSTGPPKGVPLMHKNVIAASKLADLMIYCGSAKLTCLSYSCWYQCDCWPLHWTLRCSAYLPSSSAHPGVHV

SEQ ID NO: 32832 - protein, 282 aa, A.fumigatus
LAVLSECRYCDWHDVHDFAAVDRRDVSAGTSRVLPLLLQYEYCLWTVRHVSAFCRPVYTRANSRTVPPWLEEAATWMANGESLHDTRKVTVHIVTATTGNGGSPLLGCISFQVKPHPTPTVRNTAHITAILTFGWLFFPESPYWLVRQGKTTQAQNALRRVYGFKNDAFYNVEVRRMATENNQALALQRSLTQSTRRTFLGLDLSAEAECFNRMNRKRTLTAIFAASGQQMIGATFVIGYATYFLDLIGVKDYFDASIVLYVVMLLASMAAFPLTEIMGRRT

SEQ ID NO: 32833 - protein, 127 aa, A.fumigatus
REGLLIGLWVSSGVIMQGFDIVAGGQLAALPEFQKQFGRLQPDGSHIIPAHYLSAWNSIAPACEIASTFIYAPLLEKYGRKPGILVASAISVAGVLLQQLATDWRVHLAGRGVNGWFVSVFLTCSTE

SEQ ID NO: 32834 - protein, 86 aa, A.fumigatus
CRMYIFARTFLFLSRACLRLVVQHPLNAEASALYLIAKGKWTRNETTLRVALPCSTFSALSGASNAHQPWSPSLPSSVPRAPANPR

SEQ ID NO: 32835 - protein, 109 aa, A.fumigatus
LAVDLATRFNGEIINGDAMQMYRGLPIITNQIPFEERNGIPHHLISCVDFEEQPWRIRHFKMGMPATYKRDIHSRRESLPFQFGGTHYVHTRRVLFKGLTGLKESPFLG

SEQ ID NO: 32836 - protein, 71 aa, A.fumigatus
NNTALTVAVVPPRPDMADSDNHTGPSINVNGLNYKFPDGSSGLTNVSLSLPAGSRTLLIGGDFVPSSLDES

SEQ ID NO: 32837 - protein, 211 aa, A.fumigatus
PIVNAIPANGAGKTTLLRLLAGKRLAPTDTVSVSGRDPFKHGLEGVTYLGVEWVLNSIVRTDIDVPTLLASVGGDAYPERRDELVEILDIDLRWRMHAVSDGERRRVQLAMGLLRPWQVLLLDEITVDLDLLSRSNFLSFLKRETETRPCTIVYATHILDNLSQWPTHLVHMHLGNVSQWGPMENFKSEVTETSENSQLGELVLKWLKDLH

SEQ ID NO: 32838 - protein, 293 aa, A.fumigatus
LMSLLIYIYRKVLAVLIRAVVTRGKRISANPDDVLQITSRDAGRHLRAHLYRPATSLSPSPVLINFHGSGFLLPLHGSDDEFCRRVSRETEYTVLDVQYRLAPEYPFPAALNDVEDAVKWVLQQPDKFDLTRVAISGFSAGGNLAIVAASVLYPRETFRSVLAFYPPLDLYTDPGAKRPPDPAGNPIPAPLCRLFDKSYVPSAYDARDPRISPCYAQPERFPDRVLVVTAAGDSLAGEAEALAAKIAKLPGRQVVCQRMQGCNHAWDKSARPGTIQGDAKEKAYAMAVAMLMR

SEQ ID NO: 32839 - protein, 76 aa, A.fumigatus
YYSVGHKPRLALPAPMTFEARPKPLPQRTLIAQEWQHCRHLFCSIAIYLRYSVVFQGILDIQHYLIAFNHSLEKNR

SEQ ID NO: 32840 - protein, 329 aa, A.fumigatus
LYDEGIIITVAALVAAGIAVYESPQFQEWVNNSRRKIALALHNLGDEIQPRDSTSSPREDISMMEEVGPAAEERRRIAREEIQKRAAALEERRKRGQGGSFGTFDALVDENGNLLRPDSREPTDRTLANSTAVDLPSSQLVHRGPKEPDVSASVSEIRPAGIVTDSDKLHLEIPSTGNHSASLVDLTPTSDDTDIDFFASTGDKSEEAERSVHSSATDQEQMSASSHTEEGSQTIFEHPESSLIDSNRELRSPFSDLSELNSTGFEQQERSSTPSTADSFSHVYESAEDATSDGTLSDLGRSMDGAATPASWSEVGSVVSNEDLGHHRF

SEQ ID NO: 32841 - protein, 223 aa, A.fumigatus
  UNSURE (98),(179),(193): Identity of amino acid sequences at the above locations are unknown.
PTASTQKNPDDVVITLALRTPLTKAAKGGFKDTDLDYMIYALLKEVVQKSKLDPALIEDVCLGNVCFLLLFQFYAGKKNPINRYQVNDGKAAYLVRAXALAAGIPHTAGASSVNRFCSSGLKAVQDIANQIQLGAIDVGIAVGAELMSAGGDRLPRPFNEEVLKNQEAADCMQPMGQTXENVGADFNITREMXDTYPAESFPAGQAGQKAGCFDNKTSPSRLR

SEQ ID NO: 32842 - protein, 498 aa, A.fumigatus
  UNSURE (285),(451),(455): Identity of amino acid sequences at the above locations are unknown.
RQFACQESQLSDEAKKLMESVREDVAKIKAQMVLEKDKQDAADRGAEGLKGKDRRIAQPKGKSGRFSSAHMAEFKKMDSIANHPSAFRAAPGRFQPVGATLKRTNSKAGFNEADSRRQSPLKSTAKPSPASVAPSAKRVKQDKTDDVSTRHPTTDADKKTPKTTLPRPRSAVRSSLMTPTRASAARTSSVSLKPPRTSMIPSLPRSPVSKPAGIPHTPQTDFNPRIKSNLPTLGGLKSIFRRHQPLFSHDPTKIAAGTHVAAPDFTSKFLLGASREPSVYEEPVXILSPKKRVEFTPTTKSPVAKVDSELDQPSPSPSKITVSVSKATSDIVYPTLPVLTPEKTSAAAIRSSQDGTPTIRHVRPSNVNTQSIALPDVAGMPHGMGNKKPTTLPDIAGVPHGIGNKKRHRATEDEADTENVPPADSTSDPRSAKRLKFSAPSRAKALLSFSXTKAXTHTPVRNSSISSRTGTPASARAKSRGVLSISRLNMLAQPKHRR

SEQ ID NO: 32843 - protein, 237 aa, A.fumigatus
DQPFMVARKESRLYSSWYCRSSQSSPRSSSQPFLPFSLTLPSMSTMSTSLPAASLGFSAVSAVSPRLKRSRSWSVSIVPRPAFCWLTTVEATSILNRCRLEEMVSYEFLLRQSDGDLDLLQDLLLQGAASDQPVDVDDLLLADTMGAIHGLDVLLWVPVVLHEYDCIGAGQIQTETTDAGRQKQHIVAGIRVKPVDNVLTPGSFHAAVEPEELNGRKQLVKHFALHDIQHLLHLTED

SEQ ID NO: 32844 - protein, 201 aa, A.fumigatus
  UNSURE (32),(75): Identity of amino acid sequences at the above locations are unknown.
SRKFLQPSRHGLFGTPRGCRQEGPKQSTRFSXTCCQAFNIRDVAHAPKLSALRDLLIDCGIGVDSPSEGDLSGAXYVSPHRALIFCQMKEMLDIVQSEVFNKLLPSVQFLRLDGSVEATRRQDIVNRFNTDPSYDVLLLTTSVGGLGLNLTGADTVIFVEHDWNPQKDIQAMDRAHRIGQKKVVNVYRLITRGTLEEKILK

SEQ ID NO: 32845 - protein, 103 aa, A.fumigatus
LTISSSLQRFKIDVASTVVNQQNAGLGTMDTDQLLDLFNLGETAETAEKPSDAAGNEVDMVDIDGNVKEKGKKGWLDDLGELWDDRQYQEEYNLDSFLATMKG

SEQ ID NO: 32846 - protein, 84 aa, A.fumigatus
DCAPDACFDPISLHSPPSFQCQTYLCYMIHLERRLTLNIKVSVPFYLVEFTDDDLSPVTLSKYGLLKVARNDDPPPDSLRVASR

SEQ ID NO: 32847 - protein, 61 aa, A.fumigatus
TTSSTTDIKALTSDGSDIIPSLAPAFERYNEKQLTTVKLPGASQEVGRRCVQPSRGRILTR

SEQ ID NO: 32848 - protein, 121 aa, A.fumigatus
RGTRCRNGRFRSIYRVPVSESTTVSGKILVDVHYYEDGNVALNTNKPINIAIPSISAESIISRIAAAERDYQEELNRAFVQMAEGAFKNLRRQLPITRQKVEWEKVGGYRLGQDISGGKGR

SEQ ID NO: 32849 - protein, 473 aa, A.fumigatus
QCTTDQIISNLALDIPPNGYTPRNVDLVSCLLTSRTLHAATLGVLYRNMTFPHSIIFSKALNHMSQYPALGTLVRRLDFSHFTSVGLGRTKQMNAEIQNLTSTTLLKCLDLLPNLKECLLQEHVEGDISVDIVRKIFTGLPNLHGVDFCGCATQSFSAVFHQALTTEPGLPLTLPNLKRVSLHECSSLPPSTFEVLLPRLINLTHLDVTHTQISEAALFSIPETAQITHLSLSRCTRLKGPRVVEFLTTHPAVCNTLVYLNLLADPTRYRILEEDDVSALLPRLPKTLRSLNLGGAKITSAHAPALVPLTKHLEELGLSSADLSCKDLNMFFAPPLVSDHTGSAEGPEPWVPSSLCYLDLNKVPQLSIGTIFNTNTCLLLSQQSYPLQVIEFSDKIIAPLRERVKNNRASSGWTVRELGRRGWYVRDPASMPNQVPDDGSRPWKMGARWWGMRKIPVAVGDVGGIYGHYMFKK

SEQ ID NO: 32850 - protein, 105 aa, A.fumigatus
LWQGTRYINQLSRALNIPESAMKAAGQVFKLAVGLNFIQGRRTKTVAAVCLYIACRRQDGNTVMLIDFADVLMVSNLRQLDPGSVHSLTLFRSMYLNSVEPTRPS

SEQ ID NO: 32851 - protein, 328 aa, A.fumigatus
RVQSRPPAISCILLILSSSSSPAIEASVPIFICYRGLLLVALRWSQYIPYTIIIRSGRPRSAHSSPPQCLDIFPSPSPLFFPFLEVQTRSPFRDWSNQHRHIRGLDHNCCTLLQGLIYTRAVCFFVNPCPLCSAPSLSEVQPPVEGYLAEFQLSLSSDITTLCMMSAFRPNMRPSMPPRSGPRAPPVGRLASLKAPTPTPIKRPQPVARPQAARPTTHPKTTTCPNPGCPAPHIVEDDGQKVCSGCGTVISEANIVSEVTFGETSSGAAVVQGTFVGEDQTHVRSYGPGFQRGGAMESREITEQNGRYPFSPLSVLLARADFGKELVI

SEQ ID NO: 32852 - protein, 127 aa, A.fumigatus
FTAIRPWVRTLANSVQVNVFKLGRTYKALLDELRLGGNVFLMNPIDPESLIYRFAKQLEFGTATMQVASEAVRIVQRMNRDWMTTGRRPAGICGAALILAARMNNFRQTVREVVYGGESHRDHHQPA

SEQ ID NO: 32853 - protein, 94 aa, A.fumigatus
PSGGSWVPPHIRYLSATILMGRLHGDNIYSFSRTGYTLHGFYDQVVRYGFTYTPLDYTHLGTIISTFLQTSTQTTWSTLQPLKLLPYQLLTLRP

SEQ ID NO: 32854 - protein, 162 aa, A.fumigatus
KVLLTGVSGTGLSAATAEALASGDAAAIILMGKSQAEAQAMIDDINHKHPKAKLIFISVDFGRLASVREAAEAIRKLEVPIDGFVGFPTVVAGPWMKTEDGIESHFQCNYLSNFLLINLVVHLMPAGSRVVIVCSSIRPEAPPPAWDDPNFAVSGLLWFELG

SEQ ID NO: 32855 - protein, 61 aa, A.fumigatus
AKCYPALYLVHIKSSRALRVLSAGKSVLMQAAMGEPTLCMSLRYQKIIYSLRQGKIWVSPA

SEQ ID NO: 32856 - protein, 63 aa, A.fumigatus
NILHASSCNFLSPVMRYMMKTDSMASGLEQYQLYYTRCKTEINSQQITYRSKYLGSVISVRPG

SEQ ID NO: 32857 - protein, 90 aa, A.fumigatus
  UNSURE (12): Identity of amino acid sequences at the above locations are unknown.
RPHAIFHSCVSXSIDALHAIDSIDFTTPDATQINIFETTIRYVGGLLGAYDLTDGKHPILLKKAVELADMIYDAFDTTNMMPQSRWQWSR

SEQ ID NO: 32858 - protein, 297 aa, A.fumigatus
YYQYDASVSLAMEQVSRPLLLEPLKAAANYGHRSARGLSIQPSRQTILAELGSLNLEFTTLSQLTHDPKYFDAVQRITNVLDDAQNKTKIPGLWPMMVNAEDLEFTDPRFTVGGMADSTYEYLPKEHMLLGARTDQYRKMYAAAMEAIKKRLLFRPMTKNGEDLLFAGNTHTGLASNAPPEPQWEHLKCFFGGTVGIGAKIFNRPEELSIARKLTDGCIWAYDVMPTGIMPESMHLSPCQSMDHCEWDEQKWYQDVRRRLAKGSKEKDTVQEAKTIIRDSGLQPGLTEITDPRYLLR

SEQ ID NO: 32859 - protein, 142 aa, A.fumigatus
YCSRPEAIESVFIMYRITGDKKLQDDAWRMFQSIEKATRTKYAHAAIDDVRDVKATQLDYMESFWLAETLKYFYLIFSEPGLVSLDDYVLYVLLSYEVFAKANDQAGTRKHIHSSVPLLVHRLLSQTLPLHLNMSRLMLSHG

SEQ ID NO: 32860 - protein, 393 aa, A.fumigatus
PLNVHCSFGPAVCENRSLSGSTPSARENITAKLIPYGARLISLMVPDRDGKEQDVVIGYDDPNAYLNDTETVHTFFGAVVGRYANRIKNGTFTIGSNEYHVPKNENNGIDTLHGGKVGYDQRNWTVTAHSKSSVTFTLYDQGWEDFPGDVITHAVYSVDTAVTPQNPKGLPQLTTKLISLALTEATPIMLSNHIYWNLNAFKAPNVLNDTFLQLPYSNRLIATDGILIPNGTILTVDAFNGAPDFTEGKLIGADLKDTYGMCGTDCTGYDTCWLVDRPPQYAAPDSLVPIVRMNSSATGISLEVSSNMPALQIYTCDNAKMDYLPIKPSQEKRNKEEGKEGAKNVMQYGCVVIEPEGWIDGINHPEWGQLPLQIFSPNDGPAVNWATYQFGTV

SEQ ID NO: 32861 - protein, 563 aa, A.fumigatus
  UNSURE (415),(444): Identity of amino acid sequences at the above locations are unknown.
EAMATPSTASLDDEKRSVSANTSFPLNLRHNQTGRPSSPHTPQQQLRSSNSSFASTGSGGSSFRGEEDAIIFELGSRWFRAGFEGESTPICVVGYGPNDWRRAGDYRGWVKGIDNTSSSRAVNADPWTGAYELWRMDLRDVDLGLIEDKIGRVFRETYNKYLLTDAGTSRLVLVIPSIMPHPLLSSILSTLFSRWRFPSITLLPSPAMAAVAAGLRSALVVDLGWAETTVTGLYEYREISAKRSTRAMKSLLQETGRMLTRLASDASRESEVADDITVSFEYCEEVVSRFAWCKPRVGDKVASLSESRNMQSPTGNVPESIGNRMVSIPSPSNPHSTYIDIPFSALAEPVEKILFAKESAERDLDDEEKSIPLLVYNTLLGLPPDVRGTCMSRIIFVGGGANIPGIRRRVIDEVXAMVNAYGWSPVRGEAFQKVEEKFLASRLXTPAPVTGSQSSAVPDNQDQEAAEEEVDFVEQKLRRSKDKDTKHQVHGILREVESLGAWAGASLVASLKIRGQVEIEREKYLQHGLAGASRDLEHGHVPDRRSGLRAGGDRSSWTLAAWG

SEQ ID NO: 32862 - protein, 71 aa, A.fumigatus
HEHFALLDETVPSSSFSDIQQRGVAISIRWFCIGITSLAISSISEASQSPQDNQMAINLWEKRFEKRHFSS

SEQ ID NO: 32863 - protein, 70 aa, A.fumigatus
  UNSURE (19): Identity of amino acid sequences at the above locations are unknown.
CCIFSPLLFPSFSLLSSLXYFLSDSTYIVTIYLSVPSLSDLSAQQLRKRGLNHLLGGSFRCNKVHNMRLP

SEQ ID NO: 32864 - protein, 560 aa, A.fumigatus
RSIRVIVVNTISLGCAIMSNFVLLWGMARRIAFSIAQPIIIIGWYISSLLLTCLLCIFAASKVQNDSDSGRHRWLTGSYYYGAFAAGLYFVLSSLLLITVYGACRGHYSREFRLTTSQRSLMLQTILFLIYLLGGAAVYARIEGWRYLDAVYWADLTLLTIGIGDFVPETHKGRGLLFPYAVGGILILGLIVGSIRAQMLEKGRQKMAETVAERTRRFLVREAVSDHRHLRDVVPRLQPERDESDRDRQLREFQLMRRVRQIATLERKWISLATALTVWTMLWVLGAIAFWLPGQNEKLTYFEALYFAYTTLFTIGYGDFHATSEWERPFFVFWTLLAVPTVTLLIANVGDTLVRTIRDFTIYLGELTILPGDKPIRELIKDLFRLSWAERFLTEAVADKKPDEEDVEESAATATATAVRNANQGDQGEEQERNAIEADGHRKEESARARGDVTVETIHHHHYMLFREVRRMMDYATRNLHKEFDYQEWEYFLNLIASDGGETDGEEGNSKWDWTGYKSPLLGQKTEVQWLLEALTEALERELRKASRGYHLSEQSEFEQ

SEQ ID NO: 32865 - protein, 69 aa, A.fumigatus
  UNSURE (60): Identity of amino acid sequences at the above locations are unknown.
YLVIEIVLVNSTDLFILYLLVEELNIIYLEGVSIKYNLISLFIIILIILIRIASRTSSNXRPDTPGNGK

SEQ ID NO: 32866 - protein, 76 aa, A.fumigatus
YILVYNFFLFISFKYIYTNYSVFIKYSITILLYIDNILILLNSNNLINNFLKQLGKLFKYINNSKVSVYLGIDILY

SEQ ID NO: 32867 - protein, 61 aa, A.fumigatus
LILGTYLDITFTISKLTYFTRNPSPNYFIIVKYIFCYLIETLLLLLFYLSILSNNSFINTN

SEQ ID NO: 32868 - protein, 295 aa, A.fumigatus
GAGMPLRANYGPDRGDIVGPRTPKKKRVKTKAKKDVHMDALDPATPIRESLPLTPPPSMPGPSDNLGSSFGQSAASPESMTAIFSSPSPIPSSPFPFSPVFSSPLLSPVLSPVSSPVPGSPVPTFTVPEEDDLDSPLEDTLYNGDMCPCNFDFLIKGESRQGLDWLHPCEEELLDLRRDVPKALKTSRRPQMKRQHTAFKKSLPFCNTDSLYAKFANKFDLDDMINVVPKSRTTAPPLPDPLIPSLVCEPMTLRPIFHPRPNNESVLKSVSDVALNEYYAGQKFLFEMPYVKGVM

SEQ ID NO: 32869 - protein, 65 aa, A.fumigatus
SKGVNEHTQACENCRVTCLEPTKNMHAKSGSIIVGDQSKKLGNGKKVFKAILDGSTGHGPASLSV

SEQ ID NO: 32870 - protein, 873 aa, A.fumigatus
AEERTMASHAAMLLDPKAYRKQLQKNGNDPEISYASPDSHISAQNEAPDEPLFFFPSSSRCSSPPEDPEYLDPNDLLVDGTGQQSTSASPRSAPTTAAPAGTVSAAHQLLNPQRRPRSSKVSPKSNSGSQTESVRSQEEGSASSSPRRPARNGPAPEIEFMSAQSEDDNDWKRNSDHLDSDVEARHASLIEDMYGVEKRVHQPYKKIKRENDKEASKTGRNGPITITGDTQLGKYMKEDKGKSEYSSPATPSVVDLTIGEKISDGSEKRDDCMLTGSCTDKTGATNDDDDLQVTGSNNLSVQRVCYERLDNAMIQAQIVPKPAAQNIFGDSAHDWPSIKLGVHRHPDRNSYRIDVSDPHGKIFGAVDAKTAAVIVPLLDSQALKVDMTARLDVRRRLPGEMPWAPCSALYRASINLYGLRKDAELVGKHLGQHNVWLGTPFSVEQGVPVFNPHAERRRAQAASFLPSIAARGRTGVSYEVRTAEEVNDAVMKMFDQLQSAQNLPEMEPPDSVLTPLLRHQKQALWFMTEKEKPRKFGPKEEDNNSLWRIEYRANGVKRYREIISGIVLDEEPPQSLGGLLADMMGLGKTLSILSLVVSSLHQAHEWATKIPEPDIVRSLPGIRNCKTTLLVVPLSTVNNWVSQIKEHLKENAISYYVFHGSSRTNDVDELSSYDVVITTYSIVLSELSQRGSKRGVSPLTKMNLFRIVLDEAHNIREQSAAQTQAIFKLNAQRRWSVTGTPIQNRLEDLLSVTKFLGLVPYDDRARFGMHILSRFKTGDATVLASLRVLVDSFTLRRVKDKIDIPPRHDKIITLDFSEKEKQLHEFFRKESNVMMRVIAGEDKTKMKGRMYHHILKTMMILRQISAQRKRASR

SEQ ID NO: 32871 - protein, 68 aa, A.fumigatus
LNPATFVCNDRVAAVGYESNPKVSGTKDVHLDPVICFVCLTVLASHVTDFGPRLELFPTEGDQPSQCS

SEQ ID NO: 32872 - protein, 262 aa, A.fumigatus
SKEAKVSYHDPLQSSDPLSHADGLLSSHEGLYSDKENAPAAGDSLDVLKNPKRRANAAGPSRVVSQEVRGADYRILSPKSLNSRTYPQSPFRASPEKPHNSSYLSRPMSPLKPSSPLKSTSASAAGNADNARSRTTKANTTSTRDTRPPSQTKRPASRAATTTKTVRSPLSRPATQLDRRGSISSTASSGTTVMKPGRPGAGTRKATTVSSASAPVKRTTIARNQAPSVASKRSTASATRKATAPAGNEASATGRRVLRKRA

SEQ ID NO: 32873 - protein, 83 aa, A.fumigatus
SCGRGGCELAPDAGTSGQAFRDEVVRFSWSIFSNYKYTNFMPKSLVSTELIVVYNTEINILSHFSTSIDATDVYNLVTVARSF

SEQ ID NO: 32874 - protein, 75 aa, A.fumigatus
CVWIAQTAKIGSLVDVTESADPEGLRVFYYLVQDLKALIFSLISLHFKVLFRDFFDLQTIYLLLHYFCRLSLSKS

SEQ ID NO: 32875 - protein, 138 aa, A.fumigatus
RPLAPVGLTEDHPTLTTFFEGEIIGTKHTFKTRNEAWGATEKTDMHHWARFPAWRPLAKQAKKPDFTYWNFAEREHIFMRWKEYFLVPDHRVRTISGASFEGFYYICFNQIKRSVTGIYFHAKSEKYVSVKQLTVLGS

SEQ ID NO: 32876 - protein, 151 aa, A.fumigatus
LASMPTPSDNTSPLNVASITEDISTHTTCPPEVERLSSWRDSPEPSATESDVPDNASSPSIRSAHTLLTAQPDGTINQSNTDVSGVASGHTAPEKGTMRSDDEVALGRLSPTRGTASSAKPTSTVASPSTASLVSYEFSHVRVSEPALLRR

SEQ ID NO: 32877 - protein, 582 aa, A.fumigatus
RLLSRTRVKPAVQRRFFAPSRSGPARNRFQRKQANLKDVVRVNQVAIRLPGFVKFARECHGRAIPDSLETEYTSKVRSHSDSVAKLEEMVETTVDLAALENHEFIIKPEFDDSLRIIRKKLDKLRHDMDVEHRRVAKDLDQEVDKKLFLENHRVHGWCFRLTRNEAGCIRNKREYQECSTQKNGVYFTTSTMQALRREHDQLSSNYNRTQSGLVNEVVNVAASYCPVLEQLAGVLAHLDVIVSFAHAAVHAPTAYVRPKMHPRGTGNTILKEARHPCMEMQDDISFITNDVSLIRDESSFLIITGPNMGGKSTYIRQIGVIALMAQTGCFVPCSEAELTIFDCILARVGASDSQLKGVSTFMAEMLETSNILKSATSESLIIIDELGRGTSTYDGFGLAWAISEHIVTEIRCFGLFATHFHELTALADRYPKSVKNLHVVAFIGDGTNDNAGEERPKKQQVTLLYRVEPGICDQSFGIHVAELVRFPEKVVNMARQKAEELEDFTSAEAQGQQAGASIDGYSQEEVEEGSALLKGMLLKWKAEIESHDRKLTVEEKRQIMRDLVNADEKLRANKVFQSIKAL

SEQ ID NO: 32878 - protein, 267 aa, A.fumigatus
HLKQLTYTLRGLATTPNGIEFQGKVIACGAFPIGIDPEKFQEGLKKEKVQKRIAQLEQKFQGVKLMVGVDRLDYIKGVPQKLHALEVFLSDHPEWVGKVVLVQVAVPSRQDVEEYQNLRAVVNELVGRINGKFGGCSAAVVLSWASISDLGAIGTVEFMPIHFLHKSVNFDELIALYAVSDACIVSSTRDGMNLVAYEYIASQQKRHGVLVLSEFAGAAQSLNGSIIINPWNTEELAGAYQEAVTMSDEQRALNFSKLDKYVNKYTR

SEQ ID NO: 32879 - protein, 135 aa, A.fumigatus
  UNSURE (111): Identity of amino acid sequences at the above locations are unknown.
DLGEEIISYTKMPPSNIIRAMQPLRACIPRSTITNSSIQASSLQSTRSSNFVRRTASTTAPVAKQPQQTAPELTPSSTIAPPSLRKYPYTLKIGTVVSVGRMERTVRVSHXHTTWDPYLRKSYPKITHYLVADPR

SEQ ID NO: 32880 - protein, 67 aa, A.fumigatus
LFPGFLQFWLSAKHLILSSTSYLLSTPLQRRCDIVDRLDYRSGSDRACRFLQIPNYGNLFALANRST

SEQ ID NO: 32881 - protein, 295 aa, A.fumigatus
  UNSURE (60): Identity of amino acid sequences at the above locations are unknown.
SQGFSAGEDHQDSGAKERRCSWLQKPTSHAKIGSRSRKSGKPNGHAADAGNSQGHLLTTXISSNAKRKAQALPSKLNFRASHKDPQMKRKSLATEAELANAFRDKSGSKSSTMAPATTQIDRKARKSMPAKLNGVTDKKETVHPKSSAKLSASRPSTPLRIDRKTKSTSQASVKATKSANKVAQVTSAKAATPVAPKTEKAETADSTTPAAQAKTNSRDSTARSRRRDLKSKTGTDRSLGDHIQESSTKHNPKPPVQIYETPSQPPSAPDTTLEAAQLLSQQHKHVFTTGLEDTH

SEQ ID NO: 32882 - protein, 280 aa, A.fumigatus
RYLLGGQLPIRPDPQWRRRQQFHRQHGYLDHQPIQRRHQQGVRHRVQLRSYDDGEHHARIKADHIHTNPNDRTSWPPHTPNFSPPRQSTPASPPAVSTPPPTKSTPGTAAAPRATSSAPQRSGAVSPKQCTRGIPAHVPACRSTTAAWIPLSTRRITTKPASSGRVSSGTTITRRSRPRATPRRRNTRIPSGARICRAYLQRASDIRFLFMGSRTWSGLGLPGVRRRRRRRLLLQRLRRRARRHRRGGRRPALVLQSTGVNVAAMGGRGRRRVRAGIPAP

SEQ ID NO: 32883 - protein, 220 aa, A.fumigatus
VQHESCNQVRKSLTLSGTGTAQAYYTGSPYAQLAEKYGFIVIYPQSPYSGTCWEVSSQSALTHNGGGDSNSIANMVTWTISQYNADTSKVFVTGSSSGAMMTVSITRESKQTTYILTRTTERHGRHIPRTFRRRDSLLRRPRRLFLLLLQPSQRLEQQLRPGQRHQHPRGLGRYRQSNVPGVYRPTSPHADLPRQRGYHSLPAELLRNLQAVGGCLRVQL

SEQ ID NO: 32884 - protein, 121 aa, A.fumigatus
FENPGNQVGEDKTQPIGLNVLCFFPTTRTELPAPLNDAMRALSVFVALFSFLALSSASPGQDVAKRVTSGSLQQVTNFGSNPSGTLMYIYVPNNLATKPGIVVAIHYCRCSTSHATRCESR

SEQ ID NO: 32885 - protein, 158 aa, A.fumigatus
PERQNVMAATYPELFAAATVYSGVPAGCFYSSSNQVNAWNSSCAQGNVISTPEVWGGIAKAMYPGYTGPRPRMQIYHGSVDTTLYPQNYYETCKQWAGVFGYNYNSPQSTQSNTPQAKYQNTIWGPNLQGIFATGVGHTVPIHGEQDMEWFGFTGGSS

SEQ ID NO: 32886 - protein, 63 aa, A.fumigatus
TSTTITTTTPPTTSTTTSSGGSSTSTGVAEHWGQCGGNGWTGPTACASGYTCTVINEWYSQCL

SEQ ID NO: 32887 - protein, 108 aa, A.fumigatus
LDLLHSLDFYTWTRDAALTFKGLVDIFIGGDTFIVVNLDGLETHIQDYISSQAVLQNVSNPSGRLSDGSGLGEPKFEVNFNPYSGGWGRPQRDGPALRAITMLTYIRH

SEQ ID NO: 32888 - protein, 62 aa, A.fumigatus
  UNSURE (11),(21): Identity of amino acid sequences at the above locations are unknown.
LWLRDGLESEXVALKESNSFXEFFLNMYLNIKSQNYASLNHFLMHLDFRGLICMSLDMYSLS

SEQ ID NO: 32889 - protein, 348 aa, A.fumigatus
RPTSPSSCLTQYVTEYILSVQQAEDHFAAFISVAYMAIDVTTLGPGFTHGPGLGFPSRTGLRPEDFGLPSAPTLPIRPGNDFINVLNKLRSQVGVGVSPAKLYLAIKSLSASDTATLTSQFLSLKPLAEHEQGEFTTKVSQALSSEEGRTTLEDAALAAARACKDIKHQFIELRLALKAIGDAQPGNQSAIQGLQERLQKCEKVRTHFQNTPSTTKYNQKYDGVIEKCKELSMQISVYCEQFQGSLMPYVQAPIETNEKEDFINKYIKVGVRCDIGLPELIFYKKMEEFGDLSKKIEEELNSLHSNFGYLMTEFLNFTNNQQPDLAGSIQQIESKIQELNKRLCGLKS

SEQ ID NO: 32890 - protein, 61 aa, A.fumigatus
SLHAYRPSSTFASSTFHCYGAEIQFTMEKVQWLDFKTTGNLDQMISVVLGHIGKEILWFRG

SEQ ID NO: 32891 - protein, 190 aa, A.fumigatus
KHLSSGSDPTAGDAIPDECIIVASSIKWDVGEVQSVRLIELGVEVPQLFRSNRVDRVCGVVDLVGEVGRGQHVIVHKQPDLQVLGLGQHRDIVVRSEQSFFLPRPPGQSHTVVDPVMRQQRSDLQQGQGTRSIVVDARSFHHAVAVCTGHHAIVGISFFGLRNDIGGGDGLHRGIHVGDRINLSAAPELF

SEQ ID NO: 32892 - protein, 464 aa, A.fumigatus
QLHSTPLLMSRMVASTIHLLCTAFALTAEGAALQLPLFGASEPQIPVAGKELISSSALQSQIDVGKLLNRAKHLYSIAELGSDEYNHPTRVIGSKGSFGAVWRHVSQGRLTHVTSGHLGTLDYIYATLTEFDDYYTISNQTFPAVTGNVMESRLVLGHTVPESALPMGLTPPTKNHEPVYGPLVLVSRLGCEAADYPPELQGAIAFISRGSCPFGTKSALAGKAGAVAAVIFNNEKGGLGGTLGTPSPDHVATFGLSDSDAAPFLEQLRRGRKVDAIAYMDATVETITTTNIIAQTKEGDADNCVMAGAHSDSVMEGPGINDDGSGSLTLLEIASLLPHYRVNNCVRLAWWAGEEEGLLGSDYYVSVLSEAENLKIRLFMDYDMLASPNFAYQVYNATNAVNPVGSEQLRDLYTEFYEAHGLNFTYIPFDGRSDYDAFIRNGIPGGGIATGAEVFSPGGRDQRT

SEQ ID NO: 32893 - protein, 191 aa, A.fumigatus
NEHVAATMAYVFHIDNVEVPSLEFRQISESASLAEVEHDPDDTIWLKQVYGLEDGEPIVQTVGRIRTPVGRVIIVPATIQHRVNHCELIDKTRPGSVKVLSLFLVDPNIRIISTANVPPQRLDWSFDDIDPQELEGLDRMLQQLTVRFSERKDSLPISLNEARKLHDEVFWERFQFTKYEQVAFESNVVIL

SEQ ID NO: 32894 - protein, 302 aa, A.fumigatus
RGSWLPVENTMPDHVPSGLKFYNPGSDYVQRDLAPIALFPLVYGRTRILKDRIIGLDDALDSMGQGEVIPVPPETITREDIAWRVAAHADIEAKPFSRRFQILPFDLELKDDGRWHIISYINNLHPVRHRNIYKLIEDVFNMTIPQWNASLTPLKDMLHSRARLEYKKAQYHPIAKEVEEQSPQPKPSEAEVDYQDRLNSWRMEHWEAVQPDAGRFIPWAVPPWMMCFLPADLPTPVRIEQGVELNRDYGKRGLQMICRITCYDLTPEHPYTETGYHCEGQMVRFFRNCTSSASLLLIVTVE

SEQ ID NO: 32895 - protein, 88 aa, A.fumigatus
VIFIYTSQIAEVRNYFQTCKKQYEEQAEKFNTSKLPSDVPGSTLLLGAMKPASRAEIMSSFPSRYTSDMLIARYFNSYDPATREYRQN

SEQ ID NO: 32896 - protein, 274 aa, A.fumigatus
PSPQYNKHWEDPSQSCIVWVGMLFAMMRLAMLSYNHEGDEPPEFRGKSLDMAGSFRNLVAQCPTLADYTKPYPYLIETFIFHLHGDFRQTKEADISVWVLVGVVARLAMRMGYHRDSKVFPNITPFQGEMRRRVWTFVRQSDLLFSFQVGLPSMIRTVDSDTELPRNLYDDDFDENCKELPPSRPANEPTPISYLIAKARLAYVFGRVTELTSSVQSESYDKVMELDAELRRARDLIPEHLVIRPFEECQLDPSNLIMSRFGVRQSLASHKREL

SEQ ID NO: 32897 - protein, 133 aa, A.fumigatus
YAAELGLGTLAPFFIPLTPLGITNTGEQDSWDTYIQSSNLDIPNQWWPTFDGQQQQPSPQPSLHPSLQAQGSLSSTQLSSMQQGNTVDNMRSLPRFSNVFSSDPVKYEGLGINGPYDNNSPQKSNNASGEGTL

SEQ ID NO: 32898 - protein, 124 aa, A.fumigatus
  UNSURE (49): Identity of amino acid sequences at the above locations are unknown.
ASSSPDDMQNRIDRLESLVLSLMTNGSQSAGPAAAMAAISGTSSSGGSXNQTHDIDLDEETSNAPEESDTEQVTKSFGIMKVDNNKSYYISDAHWASLLNDVSQHLTMRLMSYLYLHFTDRRSP

SEQ ID NO: 32899 - protein, 328 aa, A.fumigatus
SVVAPQFPTNFSILRLRAITEPRSILGSANPLRMAKQLRVSLTTTLTLLEQLQAALSAPAEDPKPAELSGKDALPLLSTSATALKSQVTKLSLLTITSPFTHSAVGTVLSALNSSVLPSLVTGALLVTPADHTKAFHAEVHALTKTTLRELTSLVTEVQAVAEKADKAKEGQRKGGKLLQAEKDPVTVATGRVWDSCDALIDVAAKGVVGFVIRRVEEWRDLVRDAVEEIEEWDPEEDGDEFFDDLLSDDGEKDTQDEEDEDTEESSATLHAQKKSTLRILKPIAQIYPAIVANRLKGAGDVPCSSPSGIGRLRTLDDELTTHPGAYR

SEQ ID NO: 32900 - protein, 107 aa, A.fumigatus
RALAMCRAHLLLGLVDCERLMTNLQHIPEHIDEVAGALYEEDLGKCAQYLDKAKHCAMNAVDSVKPTWDTVDATDGQQKEDKFAIWSKTWMNVLDEVSKSVEADNQE

SEQ ID NO: 32901 - protein, 167 aa, A.fumigatus
ARPQLPIISNMVATFSPHRDAGGTLHLPSHSGIHHVDAGSAIRQLRRSLSRSPSKSSNFTILASRSHSPSKSTPFISSPLSPSRRSTQNNFVLFPSSSHPSPFALPYQTSAKITRPVVRRARTSPRSPVKRALNISTDQGNAKPAQPAPIMALSPVGAENTPAAPSA

SEQ ID NO: 32902 - protein, 60 aa, A.fumigatus
TVFPELIDHAGKSSLTVRFVEHHFVESYYPTIENTFSRIIKYNGQDFATEIVDTAGQVSI

SEQ ID NO: 32903 - protein, 83 aa, A.fumigatus
ISSFIIFSTGLFLVIPLIIDLKMLDLADFVSDRGGNPNKIKESQRKRFAPENVVDEVIALYEEARRGIHISVFDHGLERSRAP

SEQ ID NO: 32904 - protein, 97 aa, A.fumigatus
AFGRLPVWLYFSMLIEEQGADHVPLVVVGNKSDLKSEQRQVSLDEGRQLGEEFQCAFTEASARLDYNVTKAFDLMIGEIEKSQNPSQPAGGSKCILM

SEQ ID NO: 32905 - protein, 78 aa, A.fumigatus
SVLFVLKLMGDSMPTDSGSLWSLSIDGANSTNKPKSRDLGSRVRCIDVSSPASQPMCQGLHVTLDYTYIQPGVVLEPS

SEQ ID NO: 32906 - protein, 70 aa, A.fumigatus
SHPSALLAQVARKLARVHPLQFNVQKVYNKTGKKLKVNPDRDTETPIAMLIYQINVCKSARHLDTRAQGT

SEQ ID NO: 32907 - protein, 206 aa, A.fumigatus
ERFLGHGQPCVIQGNWSRAGAKVSRSIGLNLKLEEERRKDHVRRTSGESKKDKESGLFSSIFGGGRKKNSGDGHHKKNSSRTLSPDPPVRELRPDVDYPWTRFSILEERAIYRMAHIKLANPRRALYSQVLLSNFMYSYLAKVQQMHPHMLMASSASQKQQTSRDQNDEYSQYQKYQEVSRLSVLQVVLGAVILTQNTVSAGAVQR

SEQ ID NO: 32908 - protein, 60 aa, A.fumigatus
LGKVAVCYLLACPQGFHCPSSDFLFMAHFVFDTLAAWHLKCLIVMFLVLWYLSAWHSCTH

SEQ ID NO: 32909 - protein, 72 aa, A.fumigatus
PRIQSQQEQYSDSSYDDPQMYEYGDDQRDNYRPHSRGSKYENGNVYGPGHRQYGHSTFGDDVQLDDDDDDMW

SEQ ID NO: 32910 - protein, 64 aa, A.fumigatus
SLYLFPMFWSPSVNLSLPIYLVCCAKSAGSLYLTRESGSMLPAGLSSGIPLPVLGFSFYGAFRL

SEQ ID NO: 32911 - protein, 69 aa, A.fumigatus
KRLGLSNSPRTLLKSLINSYRTLLKSWMNSPRALSKSLMNNAITTLNAKVNTVLFQRTYLDEIIAFFSL

SEQ ID NO: 32912 - protein, 113 aa, A.fumigatus
LILALAHGTFIFAHAPVYGWYLASSAIGLIISWSLHNVVAWMKNRPFMGRKLSLFYIGTIILVQPYWVAEIYANFAYFNDINRTVYEKIRPWEALFRYDAALMVHLVFIAEGC

SEQ ID NO: 32913 - protein, 60 aa, A.fumigatus
TDIVCSYQPLSTRSSGMTSVCDECRLRRRRCDRIRPKCTSCVNQGVACVYRQATESPPSQ

SEQ ID NO: 32914 - protein, 65 aa, A.fumigatus
KIIPMPLCPCPNFLKPTRSWNTCPSIPSMTILYLVCVFLSLGDKPSISDATIMFKRASSRQKIDR

SEQ ID NO: 32915 - protein, 63 aa, A.fumigatus
SDYSYEATVVFKIYRTTRQSIDNEAQYPTWDIYIKLRTAGSYDLYKYPADICSSTEFDTLKLS

SEQ ID NO: 32916 - protein, 316 aa, A.fumigatus
RSCSLPMILLASSRRACSLACSSLQPVARDRSLSFATSTATWSRHLPDSLFSLSSQRLSSSYLPRFSRRTFHATSLFSLDAPRISYRVAASSSPKNRRFHPPTNFHNFQPELHDAIGVVTEEIDAATRRKRRPDSGEDAFFVSRVGSQDSGAIAFAVADGVGGWVESKVDPANFSHALCLYMALEALSWDSSTDKLRAKNLLQSGYDQLVADKSIRAGGSTASVGVGLEDGQVELANLGDSGSMLLRLAAVHHYSVPQTHGFNTPYQLSIIPPRMRAQASIFGGSFLEESPRDAVVPNLHMQHRRRAHATDRWRLR

SEQ ID NO: 32917 - protein, 111 aa, A.fumigatus
RLERHIKAQSVREVCWVDLGLHPASNSVRDCEGDGAGVLTSNSAHKEGIFPTIWPPLASGGGVNFFCDHADSIVKLGLEIVEIGGRVETAILGRRRGGHTVGDAWSIETEQ

SEQ ID NO: 32918 - protein, 73 aa, A.fumigatus
NREWIRFNPIQAPPSSFNPHSALFFASTTQQVTGDRDGLTKRRLPPGRSSDFLFDSFLFLPSLGRVFLLLLFF

SEQ ID NO: 32919 - protein, 287 aa, A.fumigatus
HEGPPHFLPEHSAKGNFLDWASLSPTGLALPPGDSTTHEPVLLSDEDLHVLDPAFLSKHTDTSIDNNNRPPYDQRPQLNPASTNQGASNLHSARPSRSSITSISSTTSTSTSATTGSDITSPKKASKSSKRNSKPKVYDKNDPRRERYLERNRRAASKCRRQKKERNQQLENLYRKQSAEQERLLSERDRMRSELLSLKDELLKHAQCEDPPLKFYIAQMVEEAGAAVAPGRPINTYSPGYSEQQAQPLMFNDDDVLQQRSPTMKMSMVADAPWSTSGGDFVDFVQL

SEQ ID NO: 32920 - protein, 76 aa, A.fumigatus
FCGFCSIVINFITPPRKLFSWSWILACIEYVYLKLNSRVETTLYKQKFMAVQREAASVCYSRPPSQQSTYVSRRSE

SEQ ID NO: 32921 - protein, 291 aa, A.fumigatus
YRAERLDRADFCHLCFAEYVDDTLRIALTLAGSDATAHMSEEVKDAGRYVPIAIAWGYFSNGVMAIVVVISFLFAIPSVEDALDDATGFPFIYVFKNATSVAGVNGLTAIILIPVIFSNILFNASTSRQTFAFARDKGLPFARWIAKVDPRRKIPVNAIALSCIISCLLSLINIGSLTAFNAIISLNVAALMYTYIISISCIIYRKIWHPDTLPPRRWDLGRWGLTVNIVGLLYCMFALFWALWPSETPVTVDNFNWSVVIFGVVFVLSLVMYAVKGRREYHGPVVIVRRD

SEQ ID NO: 32922 - protein, 166 aa, A.fumigatus
PERAPTSGGQYHWVSEFASPRYQKFLSYLTGWMSVLAWQAGSASGSFLTGTIIQGLISVRYPDYQPERWQGTLFVFAMIVVIYVFNVYAADMMPLFNNLLMILHILSWTVVVIVLWAMAPHQSAKAVFTEWTNGGGWSSIGLSALIGQISAIYASLSMLMTRCELR

SEQ ID NO: 32923 - protein, 68 aa, A.fumigatus
CLILYLQTRCRRAPKYGLQSRILTYHPYVSMHQDQDAGSYRPVIIYNRGQMERVMRQYREFVLLYTDN

SEQ ID NO: 32924 - protein, 167 aa, A.fumigatus
IMPLSQITPCLWFDGQAEEAARFYVSIFPNSKITAIQRYTEAGKVYHGREAGSVMVVEFELNGQTFTGLNGGPQFKFTGAISFQVDCEDQDEVDHYWNHLKDGGDETKQQCGWVTDKFGLTWQIIPRRLKEMLSDSDLERKSRVTNEMIKMKKLDVGLLEKAYEGAL

SEQ ID NO: 32925 - protein, 137 aa, A.fumigatus
  UNSURE (82): Identity of amino acid sequences at the above locations are unknown.
CPNVGPGPNTTTDRLQTGYPDQSINKTSSYLDLSTLYGDNQDEQNMIRTFEDGKIKPDCFAEPRLHILPAASGVILIMLNRXHNYVAEQLAIINENGRFTKPKAEIIEPVEAGLAVLNMNTNSSKLHAPSLAACIST

SEQ ID NO: 32926 - protein, 199 aa, A.fumigatus
PILHSERRVAFELSSKLTGNQKEFNARNLTNWGFSEAKYNLEINQGCSFYRLALRAFPKWFKYDSIYAHYPMTIPSENRVIMKALGREEDFSWDRPSYIPQRISVFDYANVRHILQDASNFRVMWGEATAYVFGSKGWDFMLSGDAPTHANQRNIMSRALYRGQWHDAVKQFYLDITQQLLTEKSCRIGNVNQVDISRE

SEQ ID NO: 32927 - protein, 287 aa, A.fumigatus
TSRSRAGCAKYEHELFQTARPITGGMYINITWFDYVRTIINLNRDNSTWNLDPRTHDDQDEIPTAQGNQCSVEFNLAYRWHSTIGRQDEAWTEKTYREIVGKPGQEATLQDLMDGMRKFNARMDKDPSKRTFAGLQRQGDGTFRDVDLVDILTRAIEEVSGSFGPNNVPKVLRSVEILGIQQARKWNIGSLNEFRKFFDLKPYESFEEINPDPYVADQLRHLYEHPDYVELYPGIVAEEPKEPMVPGVGIAPGYTVSRAVLSDAVTLVRGDRFYTVRDESHSSSVAS

SEQ ID NO: 32928 - protein, 64 aa, A.fumigatus
RHGTCASFSHGFIHKVLGSLSVSDQISNMYDQFTGLHPAQVSDAFGGNVQTQYHELKTPYSIYN

SEQ ID NO: 32929 - protein, 115 aa, A.fumigatus
EFTLQVPMALTDELLEQKQFDKALEICHFIFSPMDSRDPSKCWKFRLFQEIMAKDYLDNFFQSLIPNQGNSQITGRRNNPFAPHVVARSRTVAYMKATVMKYIQILIDYGHQYFR

SEQ ID NO: 32930 - protein, 118 aa, A.fumigatus
LANFLSLNGNLQIAVSMPSIEVGTIGGGTILEAQSAMLDMLGVRGSHPTNPGDNARQLARIVAAAVLAGELSLCSALAAGHLVRAHMAHNRSAATTRTSTPVSAAVSAARGLTMSSSE

SEQ ID NO: 32931 - protein, 275 aa, A.fumigatus
ALLLLAQPLRPVGVAGPLTIDGQSYFIPMATTEGVLVASTSRGAKAINAGGGAVTVLTGDGMTRGPCVGFPTLARAAAAKVWIDSEEGRSILTAAFNSTSRFARLQHLKTALAGTYLYIRFKTTTGDAMGMNMISKGVEKALHVMATECGFDDMATISVSGNFCTDKKAAAINWIDGRGKSVVAEAIIPGDVVRSVLKSDVNALVELNTSKNLIGSAMAGSVGGFNAHASNIVTAVFLATGQDPAAKCREQQLYPDHEKVSCHTFSICFRCSSTN

SEQ ID NO: 32932 - protein, 61 aa, A.fumigatus
DGGRSPCRSSTAVVRHVCSDKVAGGKCRAQAQLSRKNSGSDNSSKLPSVVTWIGRVGTTDT

SEQ ID NO: 32933 - protein, 161 aa, A.fumigatus
LTVCPRYVRKPRPGFFRITKTNHNILQGFSNPGERCTEEDWAKVTDWIQENARRYWLIPGGPLRPPSEGGADVIIMDDPQMPALIPIAKEMAPDRPVIFRSHIQIRSDLIAKPDTPQAEAWGRMWELIKQADLFISHPVSSFVPRNVPKEMVGYMGASTDW

SEQ ID NO: 32934 - protein, 241 aa, A.fumigatus
QITDEYIIQIARFDPSKGIFDVVESYEKFYNRLTAALPDEKPPKLLICGHGSIDDPDGSLIYDAVVSHIEHNIPYLIEQICVMRLGPSDQILNALMSKAKVALQLSTREGFEVKVSEAVHKGTPIIATRAGGIPLQVENNRSGFLVDVGDTDAVAEYLFKLFTDEEFYGEMSRYEIKNVCDEVSTVGNALNWLYLASKMSKHEPVRPNGRFINDMAREEAGFPYEPDESRLTRAVEVENMG

SEQ ID NO: 32935 - protein, 251 aa, A.fumigatus
NPEWRSKVKKDPGIPNLFPFKDKILHEIEEKKRLKAEEQQRLKEEARARRMAEKQQSQDGGSVPNAMIDDDEIDEDMDEDDLDSSNPMAALLASARARAAEYEDEHGDESDEDDEMDEDDDEDDDDDVDGMDEDEKEGSATLGENIPELVSQPISKENSRRAFDKVFKQVVDAADVILYVLDARDPEGTRSKEVEREVMAADGGSKRLILILNKIDLVPPPVLKGWLLHLRRSLPTLPLNAANGLGQRTHL

SEQ ID NO: 32936 - protein, 300 aa, A.fumigatus
TRSIWSPLLCSKAGYCTCDDLCPRYLSMRPMGSVNAHTCDHKQLTVKGTLETLFRALKSLCRNKQLNWSISVCIIGYPNVGKSSVINALTARLNKGSSNACPTGAEAGVTTSLRQVKLDSKLKLIDSPGIVFPNSSDKKKSKSKKDEHARLVLLNAIPPKQIEDPIPAVSLLLRRLSSSEHLMSKMLQLYNIPPLFPSGNDQTTDFLIQVARKRGRLGKGGIPNLESAAMAVINDWRDGRIQGWATPPVLPSVVMTAQGGSTSPVESGVDTKQIVTEWAAEFKIEGLWGNGEGDDEEMAE

SEQ ID NO: 32937 - protein, 70 aa, A.fumigatus
VRPIYDHLRTVSKTRSRIGAELGVDPKTILATSHGRRSIDTIKLYDPSKANWECKYSPYAIYQPSTRHPI

SEQ ID NO: 32938 - protein, 220 aa, A.fumigatus
PSPLAALRGSVGKDRRKCSSQPLSTGGGTRSILFRIKISLLEPPSAAITSRSTSFDRVPSGSRASSTYKITSAASTTCLNTLSNARREFSFEMGCETSSGMFSPSVALPSFSSSSMPSTSSSSSSSSSSSISSSSSLSSPCSSSYSAARARAEASRAAIGFDESRSSSSISSSISSSSIIALGTDPPSCDCCFSAIRRARASSLRRCCSSAFNLFFSSIS

SEQ ID NO: 32939 - protein, 97 aa, A.fumigatus
  UNSURE (49),(57): Identity of amino acid sequences at the above locations are unknown.
GSRGLEHIESYRYSIGRCYYLYRIFWLLYSRSLYFGQLLRLTHCERLCXSITFSRLXINFQLNMAHSEGSFSAPPQAHTFDGLLSDFDGTIVDSTDG

SEQ ID NO: 32940 - protein, 126 aa, A.fumigatus
AWTPRPSSPHPTAEGVSIPSSCMTPPRPTGNVSTRPTLSTNHRPGTQSDNVVQTDVSYIEGRIPKEYGSDAVEIPGARTLLNALDESGARWGVVTSGTRALVDGWLGVLNLKHPKVLVVAEDVELG

SEQ ID NO: 32941 - protein, 253 aa, A.fumigatus
GNENPRRRLLSISSIDSRNYILGLADPQRPGASPNDSKRVQKNPATFQCNLCPKRFTRAYNLRSHLRTHTDERPFVCTVCGKAFARQHDRKRHEGLHSGEKKFVCQGELSRGGQWGCGRRFARADALGRHFRSEAGRICIKPLLDEESQERERSLMDQQQHHLQPLPQQVMVPVDNPHAGNFVLPAALLAQYPALQTLQWDQIAASADDPSDIGGRSSFDASSGNEFGFEDDDSGLSSVSGINAGYSAAGNFY

SEQ ID NO: 32942 - protein, 220 aa, A.fumigatus
IRPIPCRIRTSKGNPGTPSSFYIAPIRAGEKPTRGPGFGSTVSFSEREEEPHLGGPPPSQNWSLMGSVIHSSPVETHIYNLRLLAHELRIRDHTTFVCDASWPTILSHLRSASVGVNAMWNEHFGICVVEYQAAGLISVVHDSGGPREDIVIDLGDGATGFRASSEDEFAAAFEAALALPAEEKVAMRQRARKSALRFTEEEFSQKWIEEVGKLVEICRR

SEQ ID NO: 32943 - protein, 241 aa, A.fumigatus
ATPENYRRGRKESTKLSTSDITFSGSFNPSGNAYLSVYGWTTNPLVEYYILENYGSYNPGSGMTHKGTVTSDGSTYDIYEHQQVNQPSIVGTATFNQYWSIRQNKRSSGTVTTANHFKAWASLGMNLGTHNYQIVSTEGYESSGTSTITVSSGGSSSGGSGGSSSTTSSGSSPTGGSGSVSLLPYGCGFMCILTVIVLCFVGPVRWNWLVWSYLLLFGHLPGFELVLLPVLVVPSCRVISK

SEQ ID NO: 32944 - protein, 87 aa, A.fumigatus
QGGFYPLIAEGIFPWRIASVWLALLWAFSLGALIYSLLQNGLTSSWVFGQLLPVFMAVLPIVSLVTSIIGDRSAESHSDGVHLHFCV

SEQ ID NO: 32945 - protein, 109 aa, A.fumigatus
QAIVALLLLGTYRIDRATYLIIYELEFPDQADCANTEHSAISATQLQFNLSSHSALCAPSRQTDWIQLWALFGTSTQMPDAVHDPVPNAMECSTLISICSTEKAASRQI

SEQ ID NO: 32946 - protein, 138 aa, A.fumigatus
RLLPLPGFDVVYPANEMTSFYKRFMGSEQGGGLDPFDMRRKWKDISLSGGYRKVLSRMGADYSVHVKLYSQDDEQFVQTDLDRLNGKEAAIESNADSADKIAVILKFQLGSSQYATMALRELMKGRVVAYKPDFGGGR

SEQ ID NO: 32947 - protein, 225 aa, A.fumigatus
IIRGSACLIISRKRETATDRYNRMIDRERPNFLDSANEHNIQPLSPGEEQPSPWYSEPVSTSSQTPLFGSDWTATNVQTIATTNEPTSLASSSTTNVLATTTAVISSISSSTGTSPQPGDSSSGSSDTKTIAIAVPVSVVGAALLIGALFLLLRRRRRKTQQENPSDLQVDMFQPTRTNLCSQNDTPWNEHARSHEIFLRRAGIFFRPRQMITFPFGQHSLSIIK

SEQ ID NO: 32948 - protein, 168 aa, A.fumigatus
QARPAWTPVLNAPSWNPSRPGPTSTPPLSVAAVPAGTMPAIASTTTSRAVTGAPNQSPPTPPAKRSKCSGASTTTVTTAACSAIASVRTRASLTNCWTRRTCQLRRRSKPRRTASKPASCRARMSMGRSVGTVRTVSRVRPAGAMTGSPAMGSRQRRDQSVRVWIMRR

SEQ ID NO: 32949 - protein, 193 aa, A.fumigatus
QSKGASPLTSLELHDPKASIEITECFLRWPARLREISLLSLCYGPYESHYDARSIQRLLSIHKDWLQKITLGPIPPQGEDIPDLSDFHRLSDIHVTLYNSSSNERQTPDAIYKKLAAPNLRRLEIDLGNERQPHDQWVAEFLALVRRGRKGSPPQTCVQWVDVKFCRWGDLALGLARRSSINCESVRYHIESL

SEQ ID NO: 32950 - protein, 236 aa, A.fumigatus
EMRYASTPTTFSLLQLTSQAGVDSCPECAILEPVSSWPDLDSAAVSRSGPCGYNARDSIDYNQPSSNWGTKPVATYTAGQEIEVQWCVDHNGDHGGMFSYRICQDQSIVDKLLDASYLPTQAEKQAAEDCFEAGLLPCTDVNGQECGYSADCVEGQACWRNDWFTCNGFQAAERPKCQGVDNAALNSCYTSIAGGYTVTKKVKIPDYVSNHTLLSFKWNSFQTGQIYLSCADISIS

SEQ ID NO: 32951 - protein, 129 aa, A.fumigatus
KRPFILGKHITEVDLRAYTTIIRFDPIYVQHCKCNLGTIRQNYPTINNWLKHLYYNVEGFRESTNFKHIKESCKYRSRGLIILCRLTCIDPKNQADINPKGIVPMGPIPDIESGVDHNWGLVRVGSIYV

SEQ ID NO: 32952 - protein, 618 aa, A.fumigatus
LWKMKYTNSMFKQRIENVYLQKLGPKCGSAFLHVVQLCLDAPNFHLSTQPFEDFNLRVPQTYHYPVLDLSAPDSIFSFSMNFLYTMCKIVWSCCRIDIFSAPAAEELDDCLPLALVPRTETKHVHKSPQEYEPEPQRLTRRNGSYPALPVQEMRVLREKMGLEERKAKKRTFKKLTNVEIPQDHLNEWNFQMLPRLRKLLQKVLKDSSESCGVTLMMTGDSAETAKTTICVTCASAKKVRAALKKYFVLDDREDWDIIVLRGDIQRSKVPRKKRRRPAKSRSQTAGTPAFPERDLNPCYQPRPLCGASIGAFQNDEHLPPVSYGGAILVDGMPYGMTVHHMLEAPSDDEAEEEVVENRNVGGPFRSAGNWHGESAPSNNDFMYTWCDEDPSEVDLEFEISEDEDGDDISLSRSLEGTYDDHWLSDTYSSDEEGFDVDDPYEDEDAASIGDTAGVEPGDEPPLFVTQPAIDDVHEDFFPSPEDRDDEHLASHSLGFVHASSGVRRWTRKGIKHEIDWALIKINDDRLDARNIVFDKTPPSSRGLPRRGPGGQPSQTGEAIFLNDVARMEELGGLKVHCCGRTSGLQSGQISRAMTIVKLHGRQTFSTSFCVDGNFGGKL

SEQ ID NO: 32953 - protein, 66 aa, A.fumigatus
GISFLLYCIYTLPLPHVFNDYKTVHGDIYISRASLDDYETRSPFATLNKHKIYIIILPSWACPIGD

SEQ ID NO: 32954 - protein, 221 aa, A.fumigatus
WLVVHPTYGRAPFVFLRNPSPHQEPALKNSRPKMPAPEKPVPFLFTCRFAGQLLILTDRADRMVAKNSIRKALTWKNARRFFYGGVPRRLSKELILKRMASVAPAAVSGEATGAIPATGLVDGQTPSNKSPRAKHLRTLHSWTGFLDEELEHDDRKVAMWYEENRKAIQMKIEALKTDSVATEIAQLLISNKEGGLKGVQQVLSMLPVEEKEAVLKYLGSP

SEQ ID NO: 32955 - protein, 133 aa, A.fumigatus
  UNSURE (71): Identity of amino acid sequences at the above locations are unknown.
KQDPTLTRRLGLWASFALPPITPGDSPSPFSLFQSRTLTPNPTPGKTPFPSSRVFAPRKPSITVLVSCTPXPRGPNPIHPRLNIQLPPRPLRILAIVPPPPRRHVPARRSQRQPDWAAKSTPTCAAAASNSHS

SEQ ID NO: 32956 - protein, 174 aa, A.fumigatus
  UNSURE (46): Identity of amino acid sequences at the above locations are unknown.
LGGKIHAHLRRSRFKLPLMSKCPLVMVAAGTGLAPFRAFIAERRQXSLIGKEIGEMILFFGCRAPTQDFIYKEELEELQAALGDKLRVITAFSREVGSQKVYVQDRIAEHAAEVIRLIDEGASVYICGRAGMAREVEKTVGEAMRAANRWSETELYEWSTAIKMNNKWHEDVWG

SEQ ID NO: 32957 - protein, 144 aa, A.fumigatus
SCMKPLHDTHRIVFSLPASMTAVISGMVIPEKSAMIIVAALQAYLFLPPPSPLTFFLMPPGKADERLFSWSSAGHPPTHPAPPPPPPPRTMGFEENRVGPENEFSALPATPHPHPPAVPPPPPPPHPPPPPPPPPPPPPQPAPL

SEQ ID NO: 32958 - protein, 96 aa, A.fumigatus
SLLTSQVSPSRISQQSSTLARKRRCGGYHAAVSCKTMLTHFRFDERRQLSRLVEAFISRANAKQRRGRAGRVQSGICFHLFTKHRHDKLVCPNSCH

SEQ ID NO: 32959 - protein, 134 aa, A.fumigatus
KFTQRRARSGGRQRQFFTIPEDYDTNSSNDVVVNSVIAWSFYPKLLTREGKGWRNVANNQSVTLHPTSVNKHADASLKWLSYYHIMQARNRNYNAFETNAVDDFAIALLCGEAEFKVRAHCPPFYSFAKIRILI

SEQ ID NO: 32960 - protein, 76 aa, A.fumigatus
TQMYSGIISIDANRIRFAVRDWKAMLALKILSARIREILAGTVRDPQKVLSYKQQQWVGIWQQIFSQAWKRMAEKR

SEQ ID NO: 32961 - protein, 196 aa, A.fumigatus
HILGLTKDDNFQGSWRPLSRVRMQSNAEEELDGCRAVSVSTCLPSIDMINWYVQIPVISPLILTSSQLAEQQTPEMLRLSLQDLVLRVKICKLGEVEQTLLEALDPPSSKNIRRAIDSLKEVKALTNSESLTPLGMQLAKLPLDVFLGKLIIHGVFFKCLDACISIAAILSSKSPFVNTMGSQQPERSCEAIIQEG

SEQ ID NO: 32962 - protein, 83 aa, A.fumigatus
VGGWPAEDQEKSLSSAFPGGMRKNVRGDGGGRNRYACKAATIIIADFSGITIPDITAVIDAGKEKTMRWVSCSGFMQDYADTF

SEQ ID NO: 32963 - protein, 69 aa, A.fumigatus
MLRMSRLSLYLEAGGTIQNSSASDFLSFLPIFLPPKFSSFLFSFFFVPFFLFFKSGASFIRDGTSPVTI

SEQ ID NO: 32964 - protein, 335 aa, A.fumigatus
PQSLSELRSLIEDPETDDELRSLALEDLKSSDRTLPAISKTLKNALVPRHPFADLPCLLEIRPGAGGDEAGLFAFELLRMYTAFCSRRGLQSNVIKLDVQDGPSDDRLSEAVVEIDADGAYDLLRTESGVHRVQRVPATETKGRTHTSAVSVMVLPSFPEAGPSMDSALNFDDPNSDYYVDPQEVRTEKMRASGAGGQHVNKTESAIRLTHIPTGIVVSMQDSRSQHANRKKAWQVLRAKLAEARQEAREQELVELRRGVLGGVARMGRGDKIRTYNYGQSRCTDHRSGITVHNLDNVLDGGESLETIMDSVRTWLADQEIAAISAENSINAVGK

SEQ ID NO: 32965 - protein, 80 aa, A.fumigatus
  UNSURE (28),(57),(60): Identity of amino acid sequences at the above locations are unknown.
TPKGGGESQNTLKSQPLVLKQWKVCTIXKKTLEKTNINGNGIRPFTKSNESLEGIGXKKXPLSFNQFFLTVKNNSKNLLS

SEQ ID NO: 32966 - protein, 87 aa, A.fumigatus
SNCAVAKTRSQLNRRLPDAKKLPWPPFGIQWYAGCTTLIIGNSLKAGIRKFHLVVLRYHCPNFLIETHARILVRLRCLRHLQISTSG

SEQ ID NO: 32967 - protein, 82 aa, A.fumigatus
GFVAFDTFKSLLQDENGNISGPRTVIAGFGAGFTESLLAVTPFESIKTQLFVVTFIEYPTPSSNYLGHKLLPGCAVQLTHGY

SEQ ID NO: 32968 - protein, 84 aa, A.fumigatus
HTGIRIDDRKSPNPRMRGFLHGSKIIFQERGLRGFFQGFVPTTARQAANSATRFSSYTMLKQLAQGYVAPGEKLGTASTFALGG

SEQ ID NO: 32969 - protein, 88 aa, A.fumigatus
AFQNLKFSPIDWYLALSRMQSLEASKNYKNSFVCAARIFKDEGLLTFWSGAVPRLARLIMSGGIVFTMFVGIRPSRPHFRVLIHHNQV

SEQ ID NO: 32970 - protein, 83 aa, A.fumigatus
RTTLLPDGIYRIFCRYSCYLLISQPSSDTIHYSLKTFAAIKNIIQIVHCNAATVISATTLSIIVCADLITTAHPSDASKNTSS

SEQ ID NO: 32971 - protein, 247 aa, A.fumigatus
RRSTRHSMDIHKDIRTGRLTATGLQQYLETHGINDTDSKGWTLLATAVRAGHLKMVELLLKQHADPNTKSHGFAPIHLAVTAKAERLQIISLLHSAKADLNAQDPDGNTAIISAIEQTQDDKVIRLLRRLGANLDAQGRSGKTAKQLAESSNNMLVRQAVQPDRPILDRLRTVTWIVNVVVGAFRYVVRTFIQKPVYKIFDVFKGRRQAPPQPAQAGPVGTDADFADASKPPPPPPPCPSESLEIRL

SEQ ID NO: 32972 - protein, 141 aa, A.fumigatus
  UNSURE (137): Identity of amino acid sequences at the above locations are unknown.
RRFQAIKHPQTEAGFKKSLDSYIEDSCLDKFFSPGSKFLQEVSQKAAKLKDDPRNKYKPDQIKDLTRVALYQPVLYCGRYYPPRTTTHTRRPGAPANPQQTTARRCERKCGGRLSGSLSSASQTSPPNWSVPTRAFXYACL

SEQ ID NO: 32973 - protein, 148 aa, A.fumigatus
LLAKQILLLSVKDNDLLNCHRFQPHSEEERWIEHPLDTTEPIILHKQSKMTSVSLVSGAHVFFQVPSGALVDLQYQHDTNRWTAQIMRTQVTVQPGSPLCAIQGPSSVSLFFVGDNNCIYYVTRSTVQDASEWEGNFVSFLFPSFSMI

SEQ ID NO: 32974 - protein, 229 aa, A.fumigatus
PICFTLPPLKDVLTAPAAQALPYIFHRVMGSPGGALALTTLVLVITLFCSISITVAASRSTWAFARDDAIPLASLWARVDPRLGVPVWSLLLLTVIQMLLGLINLGSSSAFTAFVSVGVIALAVAYAIPIFLSLRHGRTEVSKALWNCGPVVGPIVNIVALCWIGFELVLFSMPTVLPVTRVSMNYASVVFVGFLAIAAAWYAVYARKCEFAVCFAYLWDVCSFVVRSL

SEQ ID NO: 32975 - protein, 73 aa, A.fumigatus
ILMRGCATPVVKILDAGVLEECVRANLGDLTFEEAYARSKRILNITIATSGKNGTPNLLNYLTAPNVVSTFNA

SEQ ID NO: 32976 - protein, 251 aa, A.fumigatus
LIWSAAVASNASTGSLYQPVTVYCKDETGSIVPWPHAQDATFQSWRHVHYSDGESPLSRIAELFNVNHFIVSQARPYLIPFLGPDLSMLDRHQTGQWNITRPLMRLVVAELRHRLRQLDYLGLLPQIIGRLLIEETIPGSNLTLVPDLSLSDFTKLLQNPSKDNLAYWILKGERGVWPAISALKVRCVVEIELDKGYQRVRRRRPSESVALHRRGPNEGVPRRRRGYSIDNGRDLSSLLGSADYQPDMLNS

SEQ ID NO: 32977 - protein, 187 aa, A.fumigatus
  UNSURE (182): Identity of amino acid sequences at the above locations are unknown.
RVVYRCCNQIIMAVRSRPSLRFSVRRDDNASGHDDDDHQDNHDNTLLSSPPPAKRPRLQQQQQQQQQRRQPPSSRRRKSSPDLLDATIENSSHRAPPSSKPPQVVRPTAHSPVPPPPHLSTRRPPAPSTAGDSVSFSSSSSSSNSACVPLPGTPHTAGRSHEHRHTPLSASAALYMHGGGGXNSPDL

SEQ ID NO: 32978 - protein, 71 aa, A.fumigatus
RIRGQSISDDHRQRQRHFLPAGSCKLQQYPPPPHNEGKMSDKSREGFLNLKDDSPAAFIGVLADQKDHCFS

SEQ ID NO: 32979 - protein, 160 aa, A.fumigatus
PQTEQQQEDDPSSPAYTCQPSPSSRTTRKSISPPSRNTPPTLPTPGSLASSSKAATAKPCISTVTNANSLHRRPAAPSMPPEPPPCPSSSAVAHLPPAKTSSSARTPPTPEDNTSLSCHPGNNKFSREQSRPPPLTSAKFASGSSDSRPPSKIPRGPFRP

SEQ ID NO: 32980 - protein, 64 aa, A.fumigatus
WCLNSSCVAQLIDSIAIAPGMEGESDLFFCFVALSSSSRSFFLFFSAVAINYRDVVWPNTGFAE

SEQ ID NO: 32981 - protein, 131 aa, A.fumigatus
NHLLTTTTENNWYTATDKMTTNGTTTRRRPLVPGIYVPTVAFFKDDEEVDLPTVEKHAAYLADAGVTGIVVQGSNGEAVHLDRDERKLITSATRRALDAAGATSMPLIVGCGASSTRENIQFCQDAPDAGR

SEQ ID NO: 32982 - protein, 84 aa, A.fumigatus
GPEVAKLKWQLSAKNNPLCTMLWCNTVMTKDMFVLWGHYPWSSVIKWCPGFSHWNYCHYPLTDRDYSVLTSNLEGIQYYPLTSP

SEQ ID NO: 32983 - protein, 80 aa, A.fumigatus
INVERKIRTMFMGRTWLNRIIEDFINCFDWFIRRRMQNDDNGAKQTQGAAQFPQNAKSFMQKIGPKDSTLRDAVSQARRT

SEQ ID NO: 32984 - protein, 161 aa, A.fumigatus
PKRHTMTTIVFVPGAWITPEFYHPFFDALTKAGCPVRCAGYPSLDPADPTSTDCKADSDAIASVIRPLVEGEGRDVLLVMHSYAGMPGAAAAKGLAKTERMQQGKSGGIVGLVFIAAFLVPEGLSCAGLQGGNLPPWILMDKVLPPLPPTWDESDQMSNAL

SEQ ID NO: 32985 - protein, 120 aa, A.fumigatus
  UNSURE (97),(105): Identity of amino acid sequences at the above locations are unknown.
PYDKVNIPDDPVGNFAADVDEDVAQSLEGSIRPHSTVAFHTPQPAPAWADPAYAGRLAFIVPTLDKAIPEAAQRAMIASTQTDWIVEGMVCSHCAPXVHRIDECXRLAAGFLGVFEVTKH

SEQ ID NO: 32986 - protein, 91 aa, A.fumigatus
AMATGNQVDMVIWVYRGVGTHIYPLGMTGFSNFFVNLFVCEIFYTLSICETKYSILMFYWRIFGTTNIRIPIYVIFFLVTCWGLGIVRRTI

SEQ ID NO: 32987 - protein, 527 aa, A.fumigatus
FPRARGTRSTADSGASARRYSAMTRWRSMHISASLTTPPGFRWWHASDSEPTWDSLGLTGYRPLGDSVINHSAEVAGLASWLHLAPLCKIIQNAKVLDHYTNCDVKPKPLCDALQKFLWRLRSRGQSLQYVDTDIITSILRNLHEYSGDVCEFWERLRRTIEFELSDTDAPKELAKIFDSPSPDSLAVSGVDAVNTIPKDFNSRICVPAEQAKTMREGLSWYLTQKPGRWALPPVLHVELYRHKLDKAARQWRLVYNKVDLDEELDLTPYLVDGQCGSYVLYGYIVHRGRRTSGKFFSILRPGGPGTRWLAFDDGSDNRVECLTRKTALGPHLGLDESQKVDHKTGHDVAIAVMYIRGDVVSEFLPGPQGPWDVSPSLKEYYETGIYPLSSMSAGKPAEKEIQVEVYAPPQYDKLPSLFDSYDLMSQAKAANKVMYMTVPRSENIVELRKKIALWASAGSETQASPENIRLWQIGHTRDRFGPTLAFERISDLKSTLDLPVPVARLWMQVVSDGNFFFFFFFFCPLD

SEQ ID NO: 32988 - protein, 243 aa, A.fumigatus
IDSCGTRLMHGSIDEAKYFAIRDPRDAVVAQRKTEEAVVERAGSESSDDRQYTPEVRSGGAEASSSGNVTESDLSNGDRVSVEQPLPRASDSEVSESSSQETPDSSEIQPSNASTEDDAAIAAIIAQDVQQMDIQLAEEAQQSPIRAEQSSNDTTQSEPAEQRAASPAPEAMSSTSEEPDVPLPVEHVYYFIQIFDVEAHSVAYGGLLPLPKGGENQDRSAEALEVAEEKGIFRSGSGLMAPL

SEQ ID NO: 32989 - protein, 231 aa, A.fumigatus
SRCSRLTTVCFACRTTAHRLRYSVALAYRFRIPHNRRSHGSPSSTGRLHYLTDRINMCFLDIDDRPGPGVRVVEYRPGTLRVSMPGPRRRRSSCSSGSSSDSGSSSSSPSSSSSSCHSSSNSSSSDDTTVVIAPSPLHHHHHRYQRYSWYARSKSPEPESSYTTVQRTRVRTRSESIIPFRRRFFDSPPRSPSPVYRCVRYVEPGGWGRSRLHHPGRVWEEEVRFVSGRGG

SEQ ID NO: 32990 - protein, 198 aa, A.fumigatus
KYSILYVAKRTRNRTLSIRKKEPARHRFRMSTFRGLQAAPELSRKMSRIVKQENSVISAHEAAGRERVNIAAQLSEWGEGTEDDAVSDISDKLGVLMAEIGEQEDNFAQSLEDYRSILKSIRDTETSVQPSRDHRAKIADDIQRLKLKGEQSNAKVEVLEQELVRAEANNLVAEAQLTNVVRMASRVYLIASAGLRFV

SEQ ID NO: 32991 - protein, 101 aa, A.fumigatus
ARIPGVALVSMMMVMQRTWRNDNGGIIATAAVAATMTARAAAAWAGTGAATVTATTATAAASAPTRTWHGDSKGPRAIFDDSHAGPRSVVNVEEAHVDSVS

SEQ ID NO: 32992 - protein, 529 aa, A.fumigatus
VDPTFTDSMGHFTRRFEQLLNNLDKKNSMTDCCIETYLMKSERKFYNMYNDAQLKKHHAKESISSSASPEQLDHETQYNRLSTATAGSDPSDSDEIDRWLSRLGYRRPVAIQRFMRRRIGTWPVYALFLGLGQIIATNSAQITLLVGQVGETATKLYVIAAIYCVSSISWWFMYARLPAVIVLSLPWFIYCLAFIVIGVSPFGLSEVGRGWAQNVAAGVYAVASSSGSLFFALNFGDQGAVPVKDWMFRASLIQGISQLYTVALWYWSSKVTATEIGGVSTFALSTWRLTAVVMPIAALCFAIGVILALGLPKYYRQAPSRILFFYTSLFRRRIVLWFFLMVIVQNWFLAAAFGRNWSFLWSSKHAKTWEVVILVVGFFIIIWVLILFAFRALSKEHSWILPVFGLSLGSPRWAQTWWGTSNIGYYLPWAGGLTSGAIVSRCLWLWLGVLDEIQQVGLGMILLQTLTRVHVCFVLLAAQAVGSVATICARGFAPNRLGPDGISPNIGTSVDKIANAWFWIALFFQLLAR

SEQ ID NO: 32993 - protein, 146 aa, A.fumigatus
SPSLSSEHSETTFIMSKPLSHIKIALRRSSERGYAEHGGWLKTYHTFSFADYFDHRFLNFGCLRVLNEDRVAARNGFPLHTHRDAEIFSYILSGELTHRDSMIKKGAEGAQGKQFYRMRRGDVQFTTGGTGKYQLLMHYDVAMCRL

SEQ ID NO: 32994 - protein, 177 aa, A.fumigatus
TLTRLSGIAHSEQNESSKPVHFLQIWVLPWKHGLKPQYHTMSFSEEAKRKAFVPILSPLAAGPEANPAEEEAARPKIPDTIPIHADFLMGAGIIAPNTTFKWNVGAGDVVSSRKKRNVYIHLPMTKQGKAKIKLDGREDAVLEEGDGAFVTGVNAGDMLAVESIGEAEAEVIVLDSN

SEQ ID NO: 32995 - protein, 171 aa, A.fumigatus
TTSCDTAVSARASRAGPRFEGNAPVCSIHSAQSAQFLIAWLESTHCHIIMHQELVLTSPPRRELHITPSHPVELLPLCTFRSFLDHAIAVCQLTAENIAEDLCIPVRMQWESIPSSNAVFVQYSQATEVEEAVVEVVGEAEGVVCFQPAAVLSISALTGATECDLDVAERF

SEQ ID NO: 32996 - protein, 72 aa, A.fumigatus
PLTTAALALPRAIPLYANQVTNSQSRFPNRRLLDFRDLLIPPLLNHQINIIIHTRPYIPTAFGTDLFHTPDF

SEQ ID NO: 32997 - protein, 430 aa, A.fumigatus
  UNSURE (415): Identity of amino acid sequences at the above locations are unknown.
DCHMSDSRQGSESSAATYHSQPESENTQDSVGPESPGSPPAPPGSPRSPEQQSQDGDNQEIPNIETTPKSGENGEGSQKRQRVRFRSAISVDYPQPGGPESSEDERSIQEKQKAQRDQAQRQGQPHLMSTPYVHGSLDVTETPLKERTTQEDLQQAEKTPVDKKPDGIGAAAAVGDVSRTAKDKLRWLWDTVHGKLSKWSDRLGRPERGGDDLGPGVYHNEWTSGGNAPLGDLTDNKHKTHEEKKSHQATSTSEAHRLVRELTQDQSGNRRKTRGKPYPHTDTQGGQGGQGNNAIESGLRYRAGGGGVLAQLMKLNGGMQQGGQAGQAGQGGQRSPSDTGTSGTTTPKKEKLKWYKNKQHTRSTSTLVGASGSMSGASTPVSSEVLSAASKRLGGQQFQHGGRGRLEDQIQVDVXIAEIMRARGTLCNWC

SEQ ID NO: 32998 - protein, 176 aa, A.fumigatus
GRTQLPSKSPRDTNLIDCNMKLVWIAQRLGRQGQRRKVARIASSLFFIVALTALCLYILLAYFLANDPRLVPVAFQTARSILLVTAHPDDETLFFSPSITYRRDDPHVQRALLVISSGGLDIHSYRLMLTCLGNYEGIGERRQQEIHDSCSVLGIVPDRCVVLGLHQGRKGPRHPR

SEQ ID NO: 32999 - protein, 169 aa, A.fumigatus
PRCGTAPCGPSTSRTTSRTTNSSTSTTSTSTPSTPSSSSSAQTRIPRALPRPTAPPAPSTSATPSNSTIATPPAIWPGTASASRSSPGSRAQGTDGVGKTCWRAGTRCACAAAGAGWSRSMRRISSAQTPCASGRMTRSSGMRRSAVWCMRMCRMRRRMSTRFRPRGCI

SEQ ID NO: 33000 - protein, 144 aa, A.fumigatus
RAGTANRPSRPRQRLPQPVRKQQRAKRPASAGGPRAANPKQQVHRGGCRQAHRVRRLPPRHAPRWPQTHQAHRLPSHAAEPRPAAPRRAEPPHVRQTPLPQRRLLPPRRRPPAPLLHKRASPAHCPGLPRRLRRRLQQPLQILR

SEQ ID NO: 33001 - protein, 615 aa, A.fumigatus
LCPTSNDEFMNHSTARVLPFGRSRLHTIPDITRYTITDPLGPLALHLARKTHQLLQSLMSFKLALPNVSGCANPAAQNPSAYRTLSFDFDGVAHITDCLGCPAVARPPKRIPSKLRLNRSFSVQKLRGGRVQPPTMAWLRVEFRLLVSRLLPFPSSGYSVLPQSSRSGRAVSFAQSPRAACRCLTLLVRIGLVVLLCNIILTPIFWPSYTHLPPCYENLQTIASNSDTPGRGNTHNEKVFIAAILYDRTGELAGGPWGDALVQLIDLLGPDNVFLSLYENNSGPKGQQALEALAQRIQSNKSIVVDVDKHTAFDAFPRVTLPDGHKRIKRIDYLATLRNRALRPLDEPNHLTYDKLLYLNDVYFHPVDALQLLFCTNAHPPRTAPAYRAACAVDFSNPFKFYDSYATRDLAGYGIGLPFFPWFTSAGHGRSREDVLAGRDAVRVRSCWGGMVAFDASYFQRANPVRFRADDEVFWDASECCLVHADVQDAPEDVDAIPATGVYMNPFVRVAYTTRTLAWLGTTRRFEGLYVRVHDLLNRAVGLPRENPRRTEVPGSKVKREVWVPEEGLHNGGSFRLVEVTAGNDGFCGRRGMEVVVEDRRPGQDGFEAVPLPSR

SEQ ID NO: 33002 - protein, 64 aa, A.fumigatus
THLSTLLAIMQLKLFALTLAAAVSMVNGYPITGNGVNCRAGPSTNDKVIKSYAKGTDVTLSCQT

SEQ ID NO: 33003 - protein, 122 aa, A.fumigatus
LGYLLYRKANAIGRSSKTVREFLERNHQDDMDREQTIQLTIKSLLEVVQTGAKNIEVAIMAPGKTIEMLPDDQIEAYVKSIETEKQEEAAKKKTGRTGTTTAAILTRPGGGETGESTRESAD

SEQ ID NO: 33004 - protein, 149 aa, A.fumigatus
RLPSPMDPPAGFGMGPNSMTSTPAPGPFTSAAGGFGGFNQQFAAPPNNYALPSGLGSAPGAYPPMGQMNAAYGSTSASHTTSSFSNPATQAAFSGADHTTSTSTSNGGFYATDGSNDPFAFLSTGLGGLTVSDDAHSRRNGTGASKSPA

SEQ ID NO: 33005 - protein, 140 aa, A.fumigatus
IGTCAVGVKGKDVVVLGCEKRSALKLQDTRITPSKIAQLDNHAVLAFAGLNADARILIDKARLEAQSHRLTVEDPVTIEYITKYIASVQQRYTQSGGVRPFGISTLVVGFDPNDKVPRLYMTEPSGIYSAWYVASWLGGE

SEQ ID NO: 33006 - protein, 165 aa, A.fumigatus
PGLILASVAARNRVPITTPVAPRQSAAAAPRPSAIPPAANTGICAGRQSIISGRRAITPRPSLARPCPPASAPCTTITSGSSLPCASSLASASVPIWIQMRVDGDACRIRRDQVSRSFCPWRGAKSQAAQGLYLLMVDMATSRSSLHSWKPMPTGRMGWFCSADG

SEQ ID NO: 33007 - protein, 375 aa, A.fumigatus
LVSAHEPLLLRKPPNKMSPLITTISRSYPWMKTPLIVSAPMRVTSGPTLAVAVSRAGGLGFIGPGVKTQDISSDLQTASSLIESLSASQSQPSALQNQPILPVGIGFQLWSDDLEVAMSTISKYKPCAAWLFAPRHGQKDLDTWSRRIRHASPSTRIWIQIGTLAEARELAQGSEEPDVIVVQGAEAGGHGRANDGLGVMALLPEMMDCLPAHIPVFAAGGIADGRGAAAALCLGATGVVMGTRFLAATEARISPGYQREIVRASNGAVSTTRTLLYNRLRGTVGWPEEYSPRTIINKSFIEHQAGRPFEELKALHDEALKAGDAGWGPEGRLATYAGAAIGLIHDVKDAETIVRDVQEEVLQRLSNVQKANSAQ

SEQ ID NO: 33008 - protein, 62 aa, A.fumigatus
AYLFVYWVWDTTNSQKNRFRQQERGTMFSRKTFPQLPWQTLKNPKTITAADGSKILVDGWCK

SEQ ID NO: 33009 - protein, 98 aa, A.fumigatus
  UNSURE (11),(18): Identity of amino acid sequences at the above locations are unknown.
TPVTEMQKIAXYDKDSSXGVDYLLSLPTCNGRVGATGMCLGGHLAYRCALDSRVKAAVCYFATDIHSKTLGAGKHDDSLARAGDIKGELLMVSLISSS

SEQ ID NO: 33010 - protein, 158 aa, A.fumigatus
HICLFTGFGIQPTARRIVFVSKSVVPCSLGRLSLSSHGRPSRTPRPSLPPMVPRSSLMDGVSDLSRQRSTQTNMLTFGTDGKARKIHYTCDLYFALNWGLITGFSSPFPWFYPIFFACMITHRALRDIQRCRNKYGEAWVEYERQVPYLFIPVSYSSS

SEQ ID NO: 33011 - protein, 88 aa, A.fumigatus
YAAAFRVKKSNITNSPTSAPYFTAGNFIFSMSIGGSLRFMYIIRLATTGRHLVSFLLLFSFCFDYSYLCPLIKRFMTLARLYRLNDNV

SEQ ID NO: 33012 - protein, 70 aa, A.fumigatus
  UNSURE (32),(68): Identity of amino acid sequences at the above locations are unknown.
CSARSTKVRTRLRAIDGAETDCELVTGPVSRXARQIAGQGYICAAPSSYHEFTGPEPLQYNAEDTDKXNQ

SEQ ID NO: 33013 - protein, 280 aa, A.fumigatus
  UNSURE (26): Identity of amino acid sequences at the above locations are unknown.
LNVVLHIDFSMLFSRSGRSIFPLLPXYAAHAPNPNQGHIIALPPDGLTPYFGLRARLSQVWINRWTILLLLVLVRVLLAASGLQADMSTAKREALSACTSVESMGSSMASMPHYLSQGVNELTATGVEKAVSGLKSMLMLTITGVEELVLFIIKVLYQTYLCLFTLAVRGSVHVAVGVIKEAADFLNSTVKEVGDDIGKAVSTFESAFNKFLDGVNTVASAFGASVPTLDLNSSISTLENLQLPSSIDQGLDKLNSSLPTFDEVSLHHGAGRIRRRTKVY

SEQ ID NO: 33014 - protein, 161 aa, A.fumigatus
DLLYRQRGMDAVIVQKTTRILTGSQALYDICMRTLKLSNPSYGDLNHLVSAVMSGVTTCLRFPGQLNSDLRKLAVNMVPFPRLHFFMVGFAPLTSRGAHSFRAVSVPELTQQMFDPKNMMAASDFRNGRYLTCSAILYVTTPAAIMHDLCTDHNLAVVRFQ

SEQ ID NO: 33015 - protein, 91 aa, A.fumigatus
RRSRTRCATSSPRTRATSLSGFPTTSRPLCAPFPPVASRCPRPSLVTPPPFRSCSSVSVISSLLCSVARLSCIGTLARVWTRWSSLRPRAT

SEQ ID NO: 33016 - protein, 156 aa, A.fumigatus
ANGDKYVPRAVLVDLEPGTMDAVRAGPFGELFRPDNFVFGQSGAGNNWAKGHYTEGAELVDQVIDVVRREAEGCDCLQGFQVTHSLGGGTGAGMGTLLISKIREEFPDRMMATFSVVPSPKVSDTVVEPYNATLSVHQLVEHSDETFCIDNEVWML

SEQ ID NO: 33017 - protein, 121 aa, A.fumigatus
FSRGKVSMKEVEDQMRNIQSKNQSYFVEWIPNNIQTALCSIPPRGLKMSSTFIGNSTSIQELFKRVGDQFTAMFRRKAFLHWYTGEGMDEMEFTEAESNMNDLVSEYQQYQDASISEGEEE

SEQ ID NO: 33018 - protein, 200 aa, A.fumigatus
ETEQTYGIPTISGLLTATSQFSNPETSLKRYTDTSVLIQEFMGNAPSSERACIALARTRFLHTGYRAAGKIQEDDMLYTLGLFAIQPVRFIEKFEWRTLSDMEKCALGTFWKSIGDGLDISYENLPSSKTGFRDGLHWLEEIMAWSDEYEVRSMLPDVKNRETADQTTAVLLYMIPGPLQPIGLKFVSFMMDDRLRKAML

SEQ ID NO: 33019 - protein, 627 aa, A.fumigatus
RGGRPLERSEYHISNQQHGADAEIQETKPPNHEPTPSQILRYALMGTTELSRQEPSKQDLDDHLNEVFLGEWRLSAPPLWSSFRPKAAGLDRDVFSKGLEDDVQNLHQLHIFIERHLNGQGFRGLWLVEHCGLLAQALERCQRHHSAAEILVAINALVSRLRRLQTIVPWELHLLGMYYACLSYSAAALERHLRDLRAVKLNPFGLATSLPLVDALYMSIRSFELQGDYPDTGSMLKQVTGEPCVNDASEVTLHSFLSWASRGKAKVGRYFRLLVKLKSLELLQSVWGDLVRLLEPKAPERRFHDAYSCIMALVVEGDVTRATRYLEEISKRAGNVLPYISGFKDLNVLLANQEVCELLSRLCGGDEYLKILEVYLEHMERRLGIKWLPERSLHTSISNLSYNATGQPLLTMDGDSTGYESSERLIAEMHALGCSGSLSDLIRLANCLDEHGGEHIPVVQSSAENTPLELAWVPQRCPVDVLNSSEVRSGEHTTNSPSSLGLIRLDPENAGLSPADTRSLHLMQLGYLIIKPKASNAEHEWRESGHIVALDRSSGQLFAVFVGKGQGPISAGIQSHIPRMPFDLKSIMKIELRSDLGGTHQGDNHSSPIFDITECYLDVDPCKDLVI

SEQ ID NO: 33020 - protein, 91 aa, A.fumigatus
TVGPVRYEIWDVSGKQKPTVLASREFDDIDAAIIMFDLTDRVSYNNVPNWYSMYITNHVEVALTELCREPRKQGRHAPWEVYSHLHLWEQK

SEQ ID NO: 33021 - protein, 406 aa, A.fumigatus
  UNSURE (399): Identity of amino acid sequences at the above locations are unknown.
WAYNGCLVSDWFATKSCAPSINAGLDLKMPGPTILRGQKLVAAVRDGVVDEKAVDECVSRVLALVEKTRESHSLEPERSEIIPETNALALKIASEGIVLLKNEQGVLPLDMRRAPKIAVIGVPASEPVVSGGGSASAPPQYLQKPLDYLRDAHPFPSLVKYIRGVNTNRIIPIVPLDCTTSRNGSPGFDVAYYNEDSDIPVYTEHQKTPVVAMVRNLKPGLTEPGFSCEISTTITPKTTGPHTLAARVTGSFSLFVESKAVLSVPKQHEVTMEDFLFEPARLEHRTSVFMEAGKPYLVRLLSRARIPRENDYEPTPHGATLCYEEFSDERAAIAEAVQAAFSADVSIIFAGRNQQYESEGFDLESMSISEPQVRLIRAVTAVSKKTVLVLNSGNPVFNXRPEGTDL

SEQ ID NO: 33022 - protein, 185 aa, A.fumigatus
LVDSVNGVKGSELHHGVPTAIFPSSTLYGATWNNTLMEELGRALAYQAKLKSAQVILGPTINIHRDPRGGRNFECFSEDPLLSGQLAAGVVRGIQSQGVAACPKHFACNESEFKRREYSVAQSHNSRAVREIYLAAFQEMLRRSEPHGLMVRYVSRPSSSVYILLLHVFDVYWMIFLMPAIATIN

SEQ ID NO: 33023 - protein, 133 aa, A.fumigatus
SISWGLITTGYSCPNMQVKSESSVPVMGNLKTVNATVDEVFDLSRAGTPSSQDESAREDAAPSVQPNFTSLLPQLTLEEKVGLLSGTDFVHSSGVSRLNIPPLKVYESSAMARPVRSIVQLTWLPRSSSSSTR

SEQ ID NO: 33024 - protein, 687 aa, A.fumigatus
  UNSURE (613),(635),(648),(681): Identity of amino acid sequences at the above locations are unknown.
CNGEVDISSLELIFWFWSAGFMLDEIVGFNEQGFSLYLMSFWNLFDLGILFLLFCYYCMRLYGALMPSPYNHAIADRAYDILAANAVLLFPRLFSVLDHYRYFSQLLIAFRIMASDLVAVFLLVAITCSGFFVAFTLSFGNIEEHTPASVAYALFQMLMGFTPAAWTLWDDYNILGKIILTLFLFICHFVVVTILITVLTNSFMAIVQNANQEHQFLFAVNTISMVKSDALFSYVAPTNIIAWLVTPLRYFMPLRQFIRLNRTMIKITHFPVLFTICLYEKAILSPRVNEPIDLIDHSNRPDALSRSRARHGRFKSFNPQAPRLVREPSVATYQKDRALEEVFRNPLEETIRRPPRLMQQRKSNNIVSNWMQAMGSGPVHPPDEQDSDELDRLERPPRRSRFPFRGRTTGSLRDFTDSNRSATSDPEGHLGHIVSSPATPRRERANVSPARIRQLSQHTDIEGDDELTSDDTEVRRSNPSSSDRNGGVSPGKATPKFYSSRPSTARVKSRKNSPSRRPKFHTRNYSAATMLYNPVPSVSNDEGTDVSPVPIRPRAETPSAGDDAATATSVDQWMHRRHSLDVGVSQNVALARSNPMSVPDLGSFLQTKSQHRXRRQASHLYGLGSDLGDNRAIAXGFLGCFACSFTTXMEYAAGGIPRPDSSGSNQDMLSKLVLARMNNIXEGSVRC

SEQ ID NO: 33025 - protein, 110 aa, A.fumigatus
  UNSURE (28): Identity of amino acid sequences at the above locations are unknown.
PSSFVIQPWRSHLSAAPWKSSRQSGFMXSVETIGTHDTNLTLKWTRMLYDWCLEHPDLPGNPLVLDAQDIIPHPHVKVRYCEKTVLTPNPLNFDCENKPQPKGLKLKLSK

SEQ ID NO: 33026 - protein, 81 aa, A.fumigatus
LGLLDIWIPLSGTKPLIKYYSIWPVDHQCGLTSTVGGTQPLIAWESLPTVAQTALEDTDFGDANVPFKNANFASNLAKATF

SEQ ID NO: 33027 - protein, 205 aa, A.fumigatus
  UNSURE (198): Identity of amino acid sequences at the above locations are unknown.
SFFWCYSTSLPIMADGNISPSRSRLLLISVPRTASNLMLKLLNVPCQKLVTSERGGYFFFNAFLKVSGDGHRCVPIGERNEAEKREIRDAFQEAVDALEDCSERAEREGKIAFAKEHAFWFTNPAVLGNVTEDAASFRPRIPDKYGPSHTFSSLNHTVLPDEYLRTWRLTFIIRHPALAFPSLCRAMEKFPAKRLYAXGGNHRHA

SEQ ID NO: 33028 - protein, 120 aa, A.fumigatus
EEIAAMKRRVAEMESEAAKLREMQATLDQQSESLREDKEEIDARSIFVGNVDYGASPEEIQAHFQSCGSINRVTILLDKFTGQPKGCVMPISSKKDGGCLRRCLLSWISTPKICIMAADC

SEQ ID NO: 33029 - protein, 96 aa, A.fumigatus
GVTKGSTAVLTLGVSCGRVRSITFIASGGILKHISAHDTQGCFRIRWMVSCLEKKTKNNMKLHEPSLMKIDSINGLLRIYRSSQAAARSHYFWVVP

SEQ ID NO: 33030 - protein, 481 aa, A.fumigatus
RIGLPTIGSPPEQERPPPPPPTKIDFPVYDLLDVPGDASESSLREIADLLASIRRPQDLSTEKLKAFNLRMETNITADRIVPQGSKLFPPLPWEARVCNETEDGEPILMDNGNPYPAADRFEILKKELLLDNDDAFREVTRLPPKEGRQRVRVANARKFWMGLERMSQWWDSSLDNYFERLAIPEEASNEDKMQTDGEPQPSGIQESTTTPMEVDSPPTTQTVDGTSSDPEEGQQPTVQRYTGRRIGNGQEMPEDVREETVRALAEMAAWPFGCQVTVPMLPPRLTVKKILFPIRQSFQAARSPKDRQLARNGVMEGPVFVAQCRPETSFRGPGDAPGTGVGEVCDLFQELGAMLLAAQERARQGTTEVKAGEGKWWATKPRWGGATQDTQDNSNCEDQSVRDGNDRKRSKYEHPFVASRRPGSGRKLSNAEKWKIVQPGPSLWDKRMRYIQIGKDKDSPFDDVCLITDGRCEPMLILNLI

SEQ ID NO: 33031 - protein, 65 aa, A.fumigatus
STVPFTQNGPLTRRRVAGRDSPQPLGSGNPLGISGNYDRLPFAPYFVLASVVAGSLLQSGFGDGK

SEQ ID NO: 33032 - protein, 201 aa, A.fumigatus
LSSAWTRLNHSCDQHNDHDHRNQARTHGRPFETAMHWTQLGTPQLRENNGWTTGNSSPVYQTHGSDLSRLTIETILSWSVFEGKYDAGPSLTDLLSSPTTLSQEPFLASIDPRHERLDLDLRTCTRLLHTFLEEVHIANPILDGPLVTGYLYQACIHGIGWDAPSCLVVGLSFPSEAAHSLTRTALPAAHMCLGRNLRKLS

SEQ ID NO: 33033 - protein, 141 aa, A.fumigatus
RGDSLACLKAKWITGLYMGSFATNPTRWTLIDLRPPPPLCQTRSVGFSSPLYSWTLLPFLLAVDTGMATKQPSRGPAAYPRRRAVRACQVCRARRTKCDNKTPACSFCEKIGAKCVVNDPTDMSVHATRVEDLCGCFSFQR

SEQ ID NO: 33034 - protein, 246 aa, A.fumigatus
ATTCSSINRRSGQVIFGPPSVDLVVVLLQRQCHRMVRPRNPTVVRRFLSNAVTSRGFDPQVNGAVLSIPSFGRDFGEQYDGGFVVPAPWLSAFNSISSVGQFFGGFLCSTIADRVGRRLALAVGVVITCGGIFGELFSTARAAFLISKLILGVGLGFYLTIGPLYSSEASYVQYHDSRIMSLTRSQQVSPVVLRGITTAGVNLGIVIGQLLSNAAIRGFGERGDKWAYRGPFAIQFFFVGMFSGVY

SEQ ID NO: 33035 - protein, 157 aa, A.fumigatus
SRRRRDRLRRRGHHHLLDHRQPPGPPHHLQLRHGHPQHDQSAHRHPRRRPHPRRELDTGRADRRLGLLLPGQHRRRGLCAARGNLVAVSTSQDNRRGNRNAGRLRHRHEHCASVHGEPGRGQYAGQGRICLWRARGDRHRAVLLVHSRLEGSHFRGD

SEQ ID NO: 33036 - protein, 274 aa, A.fumigatus
QGPKPLLKGLYGADRIIKPKLVAIQMTVAQDLAAKESKWSDAVRGTNRVRTLISGGVFVCQHLVGIIFVLGFSSYFFQLAGLPTERSFDLGVGVTACGVVGTIISWTIVNRLGRRIIFNSGMAILSTINLLIGILDVVPTRGASWTQAALTVVWAFFYQVSIGAVAFVLLGETSSPSLRAKTTAVATATQAVFGIVMNIVLPYMVNPDEGNMQGKVGFVFGGLGVIATVLCYLYIPDLKGRTFEEIDLMFDIRVPPRKMGGYVSSPGAGRSRAN

SEQ ID NO: 33037 - protein, 83 aa, A.fumigatus
NMAIETSADHSTVETVHADSADVAADPGAKSALVSDNVFEHQQTVRPGDFRPTQCGSGGRSSSTSVPSDGTSKKPNSRSAIPV

SEQ ID NO: 33038 - protein, 194 aa, A.fumigatus
FLALLANMSTSHNEPAEPIPDGIIATAKQSFGDLFRWKQRVVVTNESGETHAEWQAPEPIQNPISLLMQLGARDWRFFLVGFFAWTADAFDFHALSIQTVKLSKYYHRSKTDISTAITLTLLLRSVGAAFFGLAGDRFGRKWPMVINMIVLGILQIATIYSRTFQQFLAVRSLFGLFMGGVYGNAIAMALEHCP

SEQ ID NO: 33039 - protein, 65 aa, A.fumigatus
  UNSURE (50): Identity of amino acid sequences at the above locations are unknown.
SELEADELTAGASIGVGLVRICFPKSKQFLEAKNAGKKATDPGAFWRETXQMLGKEWKMCIYCVF

SEQ ID NO: 33040 - protein, 254 aa, A.fumigatus
QLPQVSIFCSCLHVPRDDHSNATHRWLFVPRSCCVLYVPERHQHLIRTTIPTSWGYIPSPDAPETTPSIMKSDDPSKTPFESLFEFVATNDDAPYFCVPAALKFRNEICGGEERIYTYLETLANEAADLLAAVLDTEVLQEPNRKSGVPSQLRRCGMSTVQLPIAIQGRPGPIKPSYLVLQADKVASTINWFQTTLAHKYGTFVPVFAHGNRLWTRLSAQVYLEISDFAWLAGVLKEMCGELRSKQGGVDQRLR

SEQ ID NO: 33041 - protein, 441 aa, A.fumigatus
RSSESPRPMTMCAGLRKGSFTLLVNFLDKHPQVEFIRYQWIDYAGIIRARVVPVSNALKLASTESPLCGGRICLTATNVIRMMENRSHVGVDSIYPDFSSLRECHYAPGHASVMCFISEGDMGFERDPRTLLGSIVASAPQVQFRIGFEVEFRCLTPEGKDLDDTLYSWWTTTGLRNRCAPIIDEVVRLLQREKIEVLHYCSESGLGMFEIATGPLSPLESIDAWVYTREAVKSLFWEHGMIATLYPSPVEVHTGIGAHFHLSMTSDLEVDESAFLAGMLGQLGGLCALAMPFEDSYKRVTDRKSEAGCWIGWGTENRDFPIRKVKKRHWEVRCCDATANLYLVVAGFINAGLGGLQTGKQLVWQDCNSNPVALDEETRRELGIRQRMPTDLSESLRELEKWDGGAMGKCLRTFCEMKKQEIRDLGEVSDERRLRDMIRHF

SEQ ID NO: 33042 - protein, 204 aa, A.fumigatus
YLRYGSGSFGTYPTAVREALRGFQDAAEARPDPFIRYTTPKALDASREAIAKMLNVPRHECVFVKNATTGVNTILQNIPFQSGDVIIYFETIYGALEKGIIALMESTPLQARKVQYQCPISHGDLVEQFLEVVRNTRAEGLNVKIALFDVVSSLPAMRFPFERLTDVCREEGILSLIDGAHGIGQIPLDLGRLQPDFFTSNCHK

SEQ ID NO: 33043 - protein, 82 aa, A.fumigatus
RQDLGCEFVEASAKNCINVEKAFYDVVRMLRQQRQQQQGGRAQDRRPTGLGPMRDRDAGPEYPKTFRPDRARHRGGIKCVIL

SEQ ID NO: 33044 - protein, 214 aa, A.fumigatus
VRLVSFCFLSSVILFLQFCYPTTPRVWLGFRILRRAFILWIRHIVEVIPSHTHFSPSRCTVSCLSDRELSFPRLNKKKGRMSTQQTVHAQSLHSPESFWSYHATKLHWHKKPSQTLVRRPKTLPSGVTHEHWSWFPDGEISTTYNCVDRHVAAGRGENVAIIWDSPVTGVKEKYTYSQLLDEVEVLAGVLREEGVRKGDVVIIYSMYLSSGPGT

SEQ ID NO: 33045 - protein, 98 aa, A.fumigatus
FICGVFTPYMLNPGAWDWGNYTGFFWGGICFLCIIYTYFRVPEPRGRSFAELDLLFERKVSARKFSSTHVDVFDETVESQVVSDYHAQQMAAAGVTQK

SEQ ID NO: 33046 - protein, 132 aa, A.fumigatus
LLMPTLDSLGRNTPLLRLLAAEVLPRQDQLHRLALADGVGETLRTARAGDHSQLDLGLPEGGASGAVDDVAHEGELAAAAEGVAGDGGDDGLADGVGEVRPRGDEVVGVSVGEGQWGHFLDVGAGWTVSAGL

SEQ ID NO: 33047 - protein, 76 aa, A.fumigatus
LRSYQYQTSLDALTPYTTYRWIGSVVLLLIFFLRIILAQGWYIGMRLSLSSVQLPNCKFTNIYPCSQSHTPSASTS

SEQ ID NO: 33048 - protein, 120 aa, A.fumigatus
SLLPNNPWNSRLSYSTPSRSESSWLLFTTSLAARTLTRLYPAIVSAVLSASASSSSCPPSTALAATPHCSASLPLKFFPVRISSIALLLPTAWVRRCEPPAPGITPSLISGCPKVALAVQ

SEQ ID NO: 33049 - protein, 97 aa, A.fumigatus
HLPMFAVAYTLGIYLLNLFLLFLQPKFDPSLTQDEGLEDGDASASLPTKQDDEFRPFIRRLPEFKFWHSATRAIAIGFVCSWFPVFDIPVFWPVLVV

SEQ ID NO: 33050 - protein, 192 aa, A.fumigatus
YRPAGADIKEMAPLTFSNAYTNNFIAPWSHFANSVRKPVIAAVSGYALGGGCELALMCDIIYCTASATFGQPEIKLGVIPGAGGSQRLTHAVGKSKAMELILTGKNFSGKEAEQWGVAAKAVEGGHEELLAEALKTAETIAGYSRVSVLAAKEVVNKSQELSLREGVEYERRLFHGLFGSKDQKIGEFLSGD

SEQ ID NO: 33051 - protein, 108 aa, A.fumigatus
GITVTLMLRSVGALISGFFSDRYGRKWPFIITLSAFIVLELVSGFCQNLPQFLGVRALYGIAMGGMIALEDRIYSCPVDKCVRSLWPGRCHRSRGPSLRCSRSVIGLF

SEQ ID NO: 33052 - protein, 92 aa, A.fumigatus
YSLRYSKNKIRNPISVLRELTTHQWLMFLVGFLGWTWDSFDFFTVSMTVTEIAKDFDTSVTSVTWVSSSSLVYPERQHADICCSSARASPSP

SEQ ID NO: 33053 - protein, 131 aa, A.fumigatus
SPWKTVSIPVLLTSVSGLFGPAAATALEDLPYDARGVLSGCFEMGYAVGYLLAAAFYRALVPTTSHGWRSLFWIGAAPPVLIIFFRWMLPETNHFQVMVAEREERIRLAHAGDDHVRANGLRSFLKDSGTR

SEQ ID NO: 33054 - protein, 76 aa, A.fumigatus
RLLRAGFLPGAVLVISKWYLPNETQTRIAILYTSAASGGAFSGLLAFAIAKMDGTAGYEGWRWVSSSWLSFVPSSN

SEQ ID NO: 33055 - protein, 294 aa, A.fumigatus
HSRQIFIIEGLVTVGMSVACYLLLLDSPYLSPGWLTPDEIRFLEVRQLASSSHSAHDGAFSKRVIFSVLTDWKIYLLILANWSNAVPNYALKFSMPEIVKSMGYKSAKAQLLTIPPYAIGAASAYGFSVFADRSSWRMPFIVVPQMSLIVAFSILFSKAADIENNIALCYFGICLACFGMYPILPGVNSWNICNIPNPQKRAVAIGYLICTGNAGGIIGSYIYKADEKPRYPTGYGTSFAFAAAGIMACLVLEFSLWTANKKKGRMSRAEVEEIYNEDQLREMGEKSPHFSYTL

SEQ ID NO: 33056 - protein, 110 aa, A.fumigatus
DSVDRSSPSQLGGSLRVIREISRREGGITAFYRGLTPNIIGNSTSWALYFLCYGKTKDLMRRLRGSRVLELTSADYFVASGLAGMILRPSVFHWTSMLTKSHLLIALYSL

SEQ ID NO: 33057 - protein, 224 aa, A.fumigatus
LLCCIRTGRYDPAPICVSLDFNAHEITFANCTIFALGLATSFLTNPIWVIKTRMLSTGSNAPGAYASFTTGVTQIYRSEGISGFYRGLLPALFGVSHGALQFMAYEKLKAYRTRMSSASRTSGDSIGLGATPARQLGNIDFFLTSSLSKIFAGCVTYPYQVLRSRLQTYDAHLVYRGVRDAMAQIWAQEGFGGFYKGLGPNLLRVLPSTWVTFLVYENTKSCLT

SEQ ID NO: 33058 - protein, 121 aa, A.fumigatus
WTGKSHQNKFHATTLRTLTLKFSQMSETQLMNPQDRQLWEYFANLYKNSNKGIKGRGKDRRISPTSKSSDSSASCTRMQSLESDEDLKASCGSREASSAYTSSSSGEEEDPEIYYTDRKGH

SEQ ID NO: 33059 - protein, 90 aa, A.fumigatus
THQRRHTGEKPFSCDICQKRFAQRGNVRAHKITHQHAKPFTCLLDDCGKQFTQLGNLKVYCLMKQVALIPETLWANGLESRTRTSSTPLR

SEQ ID NO: 33060 - protein, 65 aa, A.fumigatus
SLTCSGNPQVVIDGKGHLLGRLASTVAKQLLNGQKIVVVRCEALNISGEFFRAKRTSSDSFFHPL

SEQ ID NO: 33061 - protein, 161 aa, A.fumigatus
RRKRRVEQRHTETWRHLEMLRLFDTGSEQRADIATSDDIVKYHAYLRKMTRYNPTRGGPFHFRAPSRIFYKAVRGMIPHKTPRGAAALERLKVFEGVPPPYDKKKRVVVPQALRVLRLRPGRKYCTVGRLSHEVGWKYQDVVARCVIIALDYWSFWCYGHG

SEQ ID NO: 33062 - protein, 62 aa, A.fumigatus
IYAPGECLASLTLKIYESGLFWLATATEAFTQVIWSGFRCPVLMGPICIPPKSRDLAPNHAN

SEQ ID NO: 33063 - protein, 89 aa, A.fumigatus
SREPPLLPLVNSSPVGRFLGPEDKLFLDRPVSDCSAKKEHLVVLSLIVVYLLRTLWIVAGDVSIFTRQADSGVKFILIKFSQGMTLTAL

SEQ ID NO: 33064 - protein, 79 aa, A.fumigatus
QQSRLIYSLRRLMRLQKTRFVCVSDTHGYAPSEAGFKLPAGDVLIHAGDLTNQGSLSELRKTIEWISKADYEVKIIVCG

SEQ ID NO: 33065 - protein, 280 aa, A.fumigatus
DLCSGHEFVHDQYMRDTIANDEELQSRKRARYEDDSTQSTQQFISVDASIDGSPTVMPNAGEPEVQARRRPTTTLSSRETVPDATIDLKVKKASPQPLPIPTSTPEAAKAKRNEIRRAWHFLRAEGSHHPEIELGALPSSWPTPEEDGFHLPNRGSSETGDETRTRTQDNMQFAHDHDDDNEDDMPNSQVTATLSISSSAFASQEQTLGPLQQDGPFDVGVDIPLSSEGAPGRPRTLGRSSSSRARRAAYLAARADSYDAWACMGLVSAGDNHSMEETEL

SEQ ID NO: 33066 - protein, 147 aa, A.fumigatus
QRARWWGWNRWGRPVLDSLVKRSTRHRCGGWGGYHLRGDDHAAFQDLGGLGAKGARVPDDQVGELADLDASDQVRHALRDGRVDGILDDVAFDAEVVRAGALVLLEGPTLCIVLVRGVPGAQDHLAAAAHGLRIRLNRRRWKLMSRE

SEQ ID NO: 33067 - protein, 128 aa, A.fumigatus
FPTHELPSPSVKTDSQAMGRCGEVILRTWNTAHKNNAQRGPLKEDEGTGADNFRVKRYIIKYTINPAIAQGMSHLIGSVEVSKLADLVIWHPSTFGTKPAQVLKSGMIVASQMVPSPPPTPVSCRPLY

SEQ ID NO: 33068 - protein, 89 aa, A.fumigatus
QVQAFVPSTSIMWVSQASIDDGIVQSYGLKKRIEAVRNCRNIGKKDMKFNDVMPKMRVDPESYVVEADGVLCDAEPAEALPLTQDYFVY

SEQ ID NO: 33069 - protein, 182 aa, A.fumigatus
GNHFGISSLVLRKFKMRLTSIVLFSLVSLGFARDPSDITHSPNRSKAKGAQLESYCPGQDADEDLQREIFNQFIQTLYENKNVPEAFETYVDPDLTEHGPYEQSRDEVVESLSQIIPSSTFTVVHSSYGGDIGFVHVRIGDEGAPPAAALADIYRMDGTCIVEHWDVLQNLPENSTNPNALF

SEQ ID NO: 33070 - protein, 384 aa, A.fumigatus
YRGTETRRTLKRRNQAGRLARSLLNMMSRSQSSLGYMDTGRDEPSTSGASPGYQQPPSTAGPINLSGLVCNVRRTTGREPHPLVGATTTILGDKLYVFGGRVLSKTRPQLTSDLYELDLIRRHWTKIEATGDIPRPRYFHSVCALGDNKLVCYGGMSPAPNASKESASNGASGQEGQPEVVVMSDIHIFDVPSRTWTRVPATDSPQGRYAHCATILPSSAFFTSASAPLSAIHHNPASSNPHQGTIGVDIHGFGGAEMVLVGGQDTSNHYIEQISVFNLRTLKWTNTSSPGRNCGAYRSVVAPLNEMKVADIGSAAADRETHEPLEESDVESCSMPIFSQLPLPGCQAWSSTCVCPDGPLELKKPMAQCQRSPPGLENSPNRQG

SEQ ID NO: 33071 - protein, 82 aa, A.fumigatus
STKCLYSILRQNTYNTPPGQRARLGRIITTIMDVVAAVSGYISKMVTTGDTASATGSSSSAKMKILLLDSETVGSAFYCRVQ

SEQ ID NO: 33072 - protein, 97 aa, A.fumigatus
KLNLEADSYNAQMPIVSTAITQSALLSHEVYLIDRLENAAREKMRHLRCLCFVRPSPTSIQFLIDELRGAQVRGVSYLPEQHYSQVFLGATGGSRWA

SEQ ID NO: 33073 - protein, 104 aa, A.fumigatus
GRPRIFACGDSINLRHPYYPPPTAMAWTHSPDSHIPEQQYYSSMDIHPSPPKPINALSPSASAAREPKLQLPSTTDPPGPQNPPKQLVWLVRLPLLLFELHCAH

SEQ ID NO: 33074 - protein, 329 aa, A.fumigatus
SIAWKMPPAKRCDICAVCASCARPRLPSNFSSTSFGEPKYGEYHIYLSNIIRKSSLERLAEADGHEVVRVVQEHFADFLVVNPDLCSVNLGFPNQRLWSHSPDLWNADALQRATEGVIALLLALKKNPLIRYEKNSLLAKKLATEVRYQVTQEEQLFNFRKTDTPPILLILDRRDDPITPLLTQWTYQAMVHELLGITNGRVDLRGVPDIRPELREIVLSQDQDPFFKKNMYQNFGDLGQNIKEYVEQYQTKTQNTMNIESIADMKRFVEDYPEFRKLSGNVSKHVTLVGELSRRVGEDNLLDVSELEQSLACNDNHANDLKVCRDLNL

SEQ ID NO: 33075 - protein, 212 aa, A.fumigatus
TLQRIIQLPTVPADNKIRLVALYALRYEKQPSNALPVLLDLLVTAGDVPSYKVNIIPKLLAYHHSLQAPPVAGGFSDLFESASLFSGARDRFKGLKGVENVYTQHSPRLEVTLQNLIKGRLKELQYPFLEGSSHTREKPQDIIIFMVGGATYEEAKMVAQVNASSPGVRVVLGGTTIHNSTSFLEEVDDAVSGWPEPGPSTAAGRLRREIGR

SEQ ID NO: 33076 - protein, 322 aa, A.fumigatus
IFGSTGHMGRSLVKTALCRNDLVAAVGRTFENSPESMKKLEEEHENCLGLLCDVRARETVKKVIDRTIERFGRIDIVANCAGYGVIGACEDQDEYEIRDQFETNFTGTLNMIQLSLPHFRERRSGRYLIFSSTSGALGVPGLGPYCASKYAVEGLMESMLYEVDSFNIKGTLVEPGHMRRDDVGDLVSNTATMPSNEHNLASPLPLYGHFFVKQPSEPYNTPTAPAAHARRMLMWLGDKQPASAVKAAHLVWQLGHCSYPPLRLVLGTYAVESIRDRLKCIIEEIEDWKYLSFPVGDQPGSSTGKDKPSTEGGDKQDRETAT

SEQ ID NO: 33077 - protein, 61 aa, A.fumigatus
WNLHTQKSGVDLNDHPVYRHRMASLFPQVNKIDIYLFMRSLILFMNCEINGITRGYNKYLL

SEQ ID NO: 33078 - protein, 112 aa, A.fumigatus
  UNSURE (11),(13),(49),(58),(67),(68),(71): Identity of amino acid sequences at the above locations are unknown.
IKRASLRWTSXRXGSWGLCGLVLVSRPLFPDTGLKACVLTCGLLRVIDXLLIGMGGLXFPLSPETRXXIKXLGNPVEVLDTRNAAAQFNLLATERGVSEIAAAMIPIGWNGK

SEQ ID NO: 33079 - protein, 244 aa, A.fumigatus
NILPSMARDEPLLAPRPSSENNSIRNAEEEDALLTGERTGRGQERRGWTFWREVGLFSWALLATIAVIVLAVVYQHETSNPNGGSRPPWGPGGKPTGKRNLIFMVSDGMGPTSLTMTRSYRQFVEGLPIDDILVLDGHIIGTSRTRSSSSLVTDSAAGATAFSCGFKSYNGAISVLPDHSPCGTVLEAASLAGYKTGLVVTTRITDATPACFASHVNLRQYEDRIAQQEIGEHPLGRVVDLIFG

SEQ ID NO: 33080 - protein, 110 aa, A.fumigatus
  UNSURE (2),(38),(40): Identity of amino acid sequences at the above locations are unknown.
EXSLSHEVIHKSTRTPLNQYRGKVADSPGRGHTSPRSXHXCSSTSNWPFLFNMSDFMPALTFQGLQANAFPANEQHPISTGHLDPTIQVESGIKAGINAWWSAQECYQAH

SEQ ID NO: 33081 - protein, 133 aa, A.fumigatus
TPLPWWPFGYGKSYSTFEYGPVTVDKANVTASDTVTVSVDVTNTHKSMDGTEVVHVYIQDEISSVVVPNRQLKGFEKVVIPAKNTKTVKIKIKVQDLGLWNSAMKYVVEPGAFTALVGSSSADIRGNATFYVQ

SEQ ID NO: 33082 - protein, 70 aa, A.fumigatus
DGIPRAEAKLLAMEEVSLAGNRVLPTNLGGGGCCWCCACSGKVGDSLVVSDSPAPVCAVAADLVLTGFSC

SEQ ID NO: 33083 - protein, 536 aa, A.fumigatus
ALRTLQLLEQHHKKLAQILRFQHENPVSTKSAATAQTGAGESETTKLSPTLPEQAQHQQQPPPPRLVGNTRLPARETSSIASNLASARGIPSQPLRPSPVSPTVSSQQAGARMTGGPSKLKTGESRLRGTQAHNLRDRPSGVSASKQPWSPPVTSPTGITTQQFVPPEAVESSRQKSKTAPSEEPFQRFYSTFEGLISKISAPLAFAGLPLGTEASTQSDSARRKSSAADTKVDRHQATSDRLGQFTEPDVSRIFSRAALRAIRDSNGNGAGNTAESFYVVPTTGGTVSYAGILTRAEKEARRNSLDEADDDFVDARETPASPELRQSLTGSRGRASRAADKLTTLHNPKTMEELQMENQALKHLSDTLSKRLHMWEVNAQSSSMALQQSLKAMHHHTGPWPDHPYGAQGSSAAVTPSAAMDSDQRIKELEERMRRNEKELERVRRENEKLRDVLGRYRERWEKLKEGAKTRRAEGRAAAGPSSTAGTVESSDKPGATPNPDSNPQEQAESAKSKSDGDMENESTGPEAKGDASDS

SEQ ID NO: 33084 - protein, 63 aa, A.fumigatus
CLRLIPNSFTLWRSAYGVTSSEHVISSSSSSHLAELLLTTAYRTIITYSLYPCSHGDCTAHLG

SEQ ID NO: 33085 - protein, 391 aa, A.fumigatus
YGIRAGSGGDGGGGGGGGGGGVVSATFPRNMEALARKSLTKPIEIVVGGKSVVAPEITQIVEVRNEDTKCGRLVEILGNLYSDDANEEGRGGMLVDRQEAAGALLRELMRKGYPCMSIHGGKDQIDRDSTIEDFKAGIFPVLIATSVAARGLDVKQLKLVVNYDAPNHLEDYVHRAGRTARAGNTGTAVTFLTEEQERYSVDIAKALRQSGQKVPEPVQKMVDSFLEKVKAGKEKASASGFGGKGLERLDQERDAARMRERRTYKTGEEGEDEEDKEDKAEKADERFSKIVSSVQSAAAAATTPLPGVPKGIDLDGKITVHRTEKDPAGASKNPLDKVGSAVADIHARLSRAGVMRSGVPIDNRGPDAGAFHATLEINDFPRKLFPVMVRY

SEQ ID NO: 33086 - protein, 340 aa, A.fumigatus
RPESEKMEVDAAEEEVDPLDAFMSELAETAPPKKTTGARFTKAKDQQPEAMFGDEHDVDLTAVGEGDADDFLAIANKAKKKKDIPTVDHEKMEYEPFRKKFYTEPSNLAEMTDEEAASLRLELDGIKVRGVDVPKPVMKWSQCGLGVQTLDVIQKLGYENPTSIQSQAIPAIMSGRDVIGVAKTGSGKTIAFLIPMFRHIRDQRPLENMEGPIGLIMTPTRELATQIHKDCKPFLKALNLRAVCAYGGAPIKDQIAELKRGAEIVVCTPGRMIDLLAANAGRVTNLRRVTYVVLDEADRMFDMGFGRGVVEMVAGGGGGGEAVWCRPPSLGTWRLWLVSR

SEQ ID NO: 33087 - protein, 132 aa, A.fumigatus
  UNSURE (85),(87),(90),(95),(102),(104),(111): Identity of amino acid sequences at the above locations are unknown.
AFCAASFDPNLPFWAFAADSARFWHSPVSQRPHTRAAPLRSTVSLTCAAIAAFVRASALSAPGTSGAASPSDLPGDLNGAFDFAXSXARXAAFGXGLAAEPXTXAGREKGXASFLEVEQKITHLFGLGVIAL

SEQ ID NO: 33088 - protein, 252 aa, A.fumigatus
CFKHAETIDIVIMTLGYLSMHLSFVSLFFSMRRLGSNFWLAATVLFSGVFAFLFGLLVTTELGVPINVLLLSEGLPFLVVTIGFEKPIILTRAVLTAAADNRGRAGQASSSTTKSIQDSIQTAIKEQGFEIIRDYCIEIAILIAGAASGVQGGLRQFCFLAAWILFFDCVLLFTFYTTILCIKLEINRIKRHITLRKALEEDGITHRVAENVASSNDWPLTESESSNKTSIFGRKLRSSSVRRFKILMVGGF

SEQ ID NO: 33089 - protein, 159 aa, A.fumigatus
NSCTLTFYWPQGVNHLALTTFIFSDSLSKSSSIAPAATELPIPSNASAQPVPFTPNLFSPFSHDSSLAFTLPFDQVPQFLKAVQEIPDTSSDEDDGEQKKWIMRAARGPAYGSGGAIKLWLADAWGSFVDLIKVNVFALRYATIFADVLSTRKLLILSS

SEQ ID NO: 33090 - protein, 75 aa, A.fumigatus
TVLHLPFPRCTLTQPKIPAALKQSIDVHLTSNIPGVPDAVEQTPFKETDVRRTGEQCNNHNGVYRVLTSVTRDGL

SEQ ID NO: 33091 - protein, 115 aa, A.fumigatus
RSLTSSAPVVRCRSENSPGKNDWLLETDSDNKEWKALGQQKDIDRDAKLRCDQKTKQKCKNAREEDCGSQPEVRAETPHREEEGHEAKVHRKVSQGHDDNINSFRVLKTSANMVA

SEQ ID NO: 33092 - protein, 162 aa, A.fumigatus
ACLGAIGLTCMCCQRALNVYTTDTSLESLASRWYVCWNDIVEVLPLFNMNILTVPAYGKIANNEVVKIECLDWTGGQIKNNDSADDIKNVDLTQIHYLSGPFEIETAEPGDVLLVEIQDVQPFEDQPWGFTGIFSRHNGGGFLDEIYPEPCACLLPTLHHCT

SEQ ID NO: 33093 - protein, 110 aa, A.fumigatus
LTSLPYSAKAIWDFEGIFCSSRHIPHVRFAGLIHPGILGCAPSAEVLAEWNRREGELIATNTRGRDVAKPPEPKNVHAGSADEDLKAKIGREGARTIPVRIHLTPSIPWT

SEQ ID NO: 33094 - protein, 64 aa, A.fumigatus
  UNSURE (43): Identity of amino acid sequences at the above locations are unknown.
GRPEHGGNCDIKNLSRGSKVYLPVHVPGAKFSVGDLHFSQGDXEISFCGAIEMAGVITLKFTVI

SEQ ID NO: 33095 - protein, 122 aa, A.fumigatus
LEPYFCRIHFTPEQKRRWFMDRQGVLFGFAFAFTVVLKAPYIGVLMYGVAQASTAYLITKCTDPPPSPAESEGFAESQVTWKNKHDFLRLSLDNLDKLNLPLQSEGEVQETKVPQSPGRKFS

SEQ ID NO: 33096 - protein, 61 aa, A.fumigatus
SQSFYILIKSIMLQNQALNFCAYRVDYPLSIRGPSKIWSQDASSTHPFNASHQLFCSVLLA

SEQ ID NO: 33097 - protein, 139 aa, A.fumigatus
VFAVPPRSGVRTPAAHTLSTHPINCFAASFSPSQESISAADQNVATGLATPLPVMSKALPCTGSNKDGFFLVGSRLLEGATPIDPASAAAKSDRISMCKLVPTIVSRESGLPTMRIVMASTSILSQVTSGNSLATSAAT

SEQ ID NO: 33098 - protein, 100 aa, A.fumigatus
KQMASTVPITYRVASIPGDGIGPEVVEATIQVVRKLCQKFQTFDIDFTHIPWGTEYYKAHGRYASEDCLDTLRQFDAVLFGAVGAPGKIVLSDRLGPTSN

SEQ ID NO: 33099 - protein, 296 aa, A.fumigatus
DCPERSTRANQQLTWLDVPDHISLWGLLLAIRRPLQLYANVRPVRTFPGTKCPLNTATKGIDWVLVRENSEGEYSGQGGRSHVGQPWEAATEVAIFTRVGIERIMRFAFETARSRPRRHLTVVTKSNSMRNGMVLWDQVAAEVAREFPDVTWDKMLVDAMTIRMVGKPDSLDTIVGTNLHMDILSDLAAALAGSIGVAPSSNLDPTRKNPSLFEPVHGSAFDITGKGVANPVATFWSAAEMLSWLGEKDAAKQLMGCVERVCAAGVLTPDLGGTANTQGVVDAVCAEIERLVLQHD

SEQ ID NO: 33100 - protein, 249 aa, A.fumigatus
DIRVACMAFTKPIFPFVRYARPSGLTLIPPSKDHARTASRLIQLFEIPGVFGEPMSKAIYDLTELIWYAEWIKGDPKSSQSFDDETEDYFNTEVLYVEYALHTDRYTPTGETKGDATIEGCVRLACLLFHNSTIWEFYPAMGPVFSKPIVGLRVALETTIPAGYFNLCRELLIWVLFVGACSSRLLAREHTFFMTELTMAVRNQGFHSWQDLRELLLGYFYVDRCYLTSLRELWDEIHIDADASRLNLC

SEQ ID NO: 33101 - protein, 150 aa, A.fumigatus
AASTWVLATSLLPTLLLLLLSVMVVLFSCLLACGRCFLSSLELELHDRILLSRPLTQFREMAIGNTFGATALSSYGGFWISFAIVLTPGGFNIESALVKADNGSTSMFDNSFGLFLMVRSSARVLSSCQRPQLTTHRAGSSSPPSCCSAP

SEQ ID NO: 33102 - protein, 75 aa, A.fumigatus
SSRAHQRSTFDGLAQQRHDSKKNNTQKNKNKTGARAETGHHTLYVIYLEAFFFFVFSSSLAAGVVTRCGSAAVVR

SEQ ID NO: 33103 - protein, 138 aa, A.fumigatus
STMSTEQNAALEKDVGPDNSINGTPENTNAPQLTSQMTHEEHEVAKAAARFGYGPLAKPNPNEYNLPPFGGEFQPGLYKSVEKRKFANPAPLGLCAFALTTFVLSCINMGARDITAPNIVVALAFGYGGLVQLLAGMW

SEQ ID NO: 33104 - protein, 135 aa, A.fumigatus
QLFRPVPDGEIFCSGFVLLSATTANNPQGWFIFTTILLFCTLRSTVAFFLLFFFLDLAFLLLGIGYIQRDSAGKPNPPVIKAGGFFGLLAAFTAWYNALAGIADSSNSFFVIPVAHFPWSPTGQARRTKTERETV

SEQ ID NO: 33105 - protein, 119 aa, A.fumigatus
FVDSLILMRVLRNEAHRRISWLIAEKSFKRKFIGLLARGIGTVPVARAMDNVKPGVGTIYLPDPVNQPTLLRGVGTNFEGPEFEKEGTISLPTINGTSHSAAIAESLHHGAGRSRASRT

SEQ ID NO: 33106 - protein, 66 aa, A.fumigatus
RLLRELSCCTHQGEYRCKPFEGHIINTNLSLHLEASHLSPINTYSSALHSIKLMRCFLPSLSSKSA

SEQ ID NO: 33107 - protein, 111 aa, A.fumigatus
AIAAARRKEGRLAQGHFELLYDIMGKKQPYIPPLIGWLYDLVLWSFSVLIDLFFREVHPRGSWKIPRRGPLILVAAPHANQVGFCSSFHTYIFDFGCSACFMLLLVISSGR

SEQ ID NO: 33108 - protein, 272 aa, A.fumigatus
  UNSURE (58): Identity of amino acid sequences at the above locations are unknown.
SSSLICLSQIHFGEGKSNTHNRVIATNPPPNLAQQLAKPTRSGQRLPQNSIRQLQEHXYAVTVMVVNILYENPNLLPVKGFGYLIPQSVPFEHNPEMALGVIFGSESSVGQDTVPCTKLTVMLGGHYWDGWKTSDYPDPDTAIGMCQTLLHRHLGITEKPLQAAVKLQRQAIPQYTVGHLSRMRDLSQTVRQDFNNRLTLAGNWYNGVGVTDCVRQAYMAASYGVGALKLDAPSVNVPWIRYNWQGWELEGGIPTSPVRITETYRSERNYFF

SEQ ID NO: 33109 - protein, 247 aa, A.fumigatus
PLVDFILQLVELELLEDVLITTKSSPAAQNRYIYYPDHLVRMPGRDPGRSLFSELYSNFRTLLTEPVFDKLVRSVVTEPARLPPGPKSVDSDESVRDFISRRLAPEIADNIVSAVYHGIYAGDIDRLSAQTLLGTYRDLEHDDRRVIGGLVHAATSDITYNLMDDWLALHSLAATKQKSYWSSLKTLVRDASVITFKNGVQQLTDALAATLRKSRKVDLLTGTEVMVISTNPANSDLTVSVTFLRER

SEQ ID NO: 33110 - protein, 224 aa, A.fumigatus
MASTNSGITTDALTGERYIPSSVRPDGSKRREIKVRPGYRPPEDVELYKNRAAAAWRNRGSGGVPGAEGLSEASENKANTAASNKNAKRREAKKRAKAAQESEPTLTSTQANGQSVRDLENWRSGASAAEKKVSTAEAQPKVDPEAEKEKKARNLKKKLRQARDLRDKKNQGEALLPEQLEKVIKIQELIRQLDALGFDANGDKKDSSEEKEKEKEKEKEKEGA

SEQ ID NO: 33111 - protein, 193 aa, A.fumigatus
WRHEQLKPGDACAEHEPSHIQLPELNIPQIQADLISIPVYRPKMRETTALGAAIAAGLAVGVWRNFAELRDINRAGGAVFEPKISREESAKSFARWEKAVAMCKGWSGDAPPPPVQPAQKEAKKNAPEVITNHNAINATPPKFNGELTTPKFPLISISGDLDNADEEELYLELRKIEILQRLKKLRKLKLSFY

SEQ ID NO: 33112 - protein, 349 aa, A.fumigatus
LSGIDADQLSNRWHEHDPFELVSSVEKCIEEAVKQFESEGYSRYGIKAIGITNQRETTVVWDHDTGEPLYNAIVWTDTRPQAIVHELKQKRESSQLQAICGLPLTTYSSATKLLWMIEHVPKVKDAYERGTLAFGTVDAWLVYRLNGGASANVFVSDPTNASRTMFMNLETLQYDNFLLDFFGIRKVHLPKIVPSSDAKAYGAMASGILAGVPIMGCLGDQSSALVGQKGFSPGMAKNTYGTGCFLLYNVGEKPVISKHGLLATVAYHFDGKPVYALEGSIAVAGSGIKFLQKNLSFFQESKEVNDLAQTVEDSGGCVFVTAFSGLYAPYWIDDAKGTMCKATRSNAPF

SEQ ID NO: 33113 - protein, 76 aa, A.fumigatus
SALTSRTVGITQYTQKGHIARATLEATCFQTKAILDAMEKDSGHALSELAVDGGMSNSNLAMHVQNMSPLTFSYRN

SEQ ID NO: 33114 - protein, 82 aa, A.fumigatus
DPAATQETPETQAFFLLSVSCAHVLAFFFWDLYLYMFMLQSWRNNEIFVYGRSDAYWTIIAMRLLLFALKSQLNKCQVYLSD

SEQ ID NO: 33115 - protein, 66 aa, A.fumigatus
LSAFFATDLGLKDGSSGTVDVSQFSKISPHPYRQTSGYSRTKCRGFPHLGTVHRDRDEICLDLWDI

SEQ ID NO: 33116 - protein, 70 aa, A.fumigatus
ISMRLLCAPQICGSGFRGEIAQLRRATQDLAVLVGRSRIKLSDVNYGVLRRLTTYLDLTSLLLIDAQWSH

SEQ ID NO: 33117 - protein, 139 aa, A.fumigatus
LRAHGIAGVYRGLCATILFRSFFFFWWGSYDVLTRWMKNNTAMSAPVINFWAGGISAQIFWLTSYPSDVVKQRLMTDPMGGSLGDGERKFYRWKDAARAVYLERGWRGYWRGFVPCFLRAFPANAMALVAFEGVMRSLP

SEQ ID NO: 33118 - protein, 114 aa, A.fumigatus
SGSDPWGSMLGSLTLYRRLLLENVFSRPAIRSLTPFASYQPDPKTLPSFGHGIAGILAGTTVSFVAAPVEHIKARLQIQYAADKSKRMYSGPIDCLTKLVGHWEVSRVLEAIVG

SEQ ID NO: 33119 - protein, 83 aa, A.fumigatus
FGGSHADGMGACVKEDDKPFTVRLSDESFETYEIDPPPYDLEVTKKELKQMYYDMVVTRYGLRGEEFMLLCHSYLTFDGSCFV

SEQ ID NO: 33120 - protein, 170 aa, A.fumigatus
FIDNKYGMGTSAARSSALTDYYKRGQYIPGIKVNGMDVLATKAAVQYAREYTIAGNGPLVFEYVTYRYGGHSMSDPGTTYRSREEIQRMRSTNDPIAGLKQKILDWKVMTEEELKALDKSARSHVDEEVAIAEQMPAPENNPRILFEDIYVRGSEPRWMRGRTVDETFYY

SEQ ID NO: 33121 - protein, 169 aa, A.fumigatus
PLTALALSRRMEMAADRLYKEKKIRGFCHLSVGQEAVATGIEHAITRDDKVITAYRCHGYALMRGGTVRSIIGELLGRREGIAYGKGGSMHMFAPNFYGGNGIVGAQVPVGAGLAFAQQYNGEKATSIVLYGDGASNQGQVFEAFNMAKLWNLPAIFGCESKLIFIATY

SEQ ID NO: 33122 - protein, 576 aa, A.fumigatus
  UNSURE (12),(54),(65): Identity of amino acid sequences at the above locations are unknown.
LAFPLTRQGKFXTDPSTVFLPKDTVTGPISVILSEYSNKHIADVAHRTFGGRLXPHFTTTPPPRXQVHQLPIPIEASQRHMSQMEGNVYMAALYPGMYASALSVLVEVRKRLGTNWIRRLMAQQDGPHVLDAGAGGAGILAWRDVLRAEWEAMVPDHPETDPIPLGRSTVVTASEALRNRASVMVHNTTFFPRLPDYIHVREKPTLDDERPPPPRKQYDVIIAPHSLLGLEEEYMRKEHVENLWTLLNPHGGVLILLEKGHQKGFEAIAGAREMLLKSYISSPGYTQYDELTESPNENKHIDKEEGMIIAPCTNHAKCPMYTVAGHAKGRRDFCHFEQRYIRPAFLQRILGAKDRNHEDVKFSYLAVQRGVDLRKEMNIVQGPEAAEAAFAGYEHLHDMESEDAQVSDDAATSEPSAAQDGRDFHTLSLPRAVYAPMKRRGHVIFDFCTPAGKIERWTVPRSYSKQAYRDARKARWGDLWALGAKTRVPRSLRLGAKHGEGKKERLEKRAASKAALGESEDGGLESAPSDNWDVFTTPVRKKGQTIPSWKKHQDKKKIRQASKKQSTVKLTDHDLD

SEQ ID NO: 33123 - protein, 94 aa, A.fumigatus
KRPDIGLPGKPRCFPLLLVAPFSSSINSLNLPQPEVSFKLHNKSQCLSSERSSLPLWVCYKTPTTLVRWRSEYVTNHSITAKPMAPFFAAGMPS

SEQ ID NO: 33124 - protein, 80 aa, A.fumigatus
GTAGKKTATHLHPDNYTSNGYFNMAASLQASVDSLQSSLQTLDSSISTLDSAVSDFPRLCKVLQTTRVRDMTVRQAYHFL

SEQ ID NO: 33125 - protein, 80 aa, A.fumigatus
  UNSURE (54),(67): Identity of amino acid sequences at the above locations are unknown.
PPSPTTKEDNHPNYTYQIIMYLRAVHAETHIPLLQQFIRDNPLGILTTAIKSPXYPLLQSSHVPFVXDIPTCQRVGKSGK

SEQ ID NO: 33126 - protein, 200 aa, A.fumigatus
HTTMDTTKSLLSTLIAIMIPLSLGSVSSPNLLPTPPMGFNNWARFMCDLNETLFLETASAMISTGLLEAGYNRVNLDDCWMAYDRAADSSLQWNTTKFPHGIPWLARHLKAQGFHVGIYEDAGDLTCGGYPGSFGHQALDAQTFATWGIDYLKLDGCNVFPEHSRPLEERVQSPVRTLAQHPKADAPPVYFLESAPGDFA

SEQ ID NO: 33127 - protein, 107 aa, A.fumigatus
IYTYVHTPWTRALAKCNYLGKPAFNDEYTYQVSSRHLILASPFFRAALTKGWKETHTLGTHGSVSFTVYDWDDQALLTFLNIIHATTPRSAMESRVRAICEDHLHRE

SEQ ID NO: 33128 - protein, 72 aa, A.fumigatus
PRSVSLSESSYHTHTSMMPLSQDSHPSTKALHADGRLNLVTDVAPPIHLSTTFRYPNDPDQLIPSEDPIVSL

SEQ ID NO: 33129 - protein, 345 aa, A.fumigatus
HPKAEFDGKNYVYSREFAPNATRFEAILSTLLGSHAVSYATGLAALHAALVLLNPRRISVGEGYHGSHEVIGVLTRLTGLKKLPLDCPAEDLQEGDVILLETPVNPLGTAFSIEAYAQKAHSRGAYLIVDSTFAPPGLQDPFLWGADIVLHSGSKYFGGHSDMLCGVLGVKRAEWHRQLLEDRAALGHVMGNLESWLGVRSLRTLEVRVQRASQNSAKLISWLNDALTAASPTPGSEEEIVQKVLVKIYHASLQDEEWLKRQMPNGFGPVFAIVMKDERLAKTLPSKLSLFQHATSLGGVESLIEWRALSDSRVDRKLLRISVGLEDWQDLKMDLLSAFKSLLEV

SEQ ID NO: 33130 - protein, 209 aa, A.fumigatus
RGYTDSRLPGDTSTTDGIRGIAAELTKAESKGINILINSASVTSEPRAKSTSSDTDFTDPDAVSRWMTCDGADAWRIAYAGNVWSHHFLTAALLPLLVKGAKAAPGHSSVVLNVASVAGLTKTHSQGQFAYSSSKAALIHLTREWAHTFLPLGVRVSCIAPSVFPNEISVGRFDEDRRSTQEEELWRKIPAGESCFIAVGGCALRTGVS

SEQ ID NO: 33131 - protein, 164 aa, A.fumigatus
IRSEMDTAPRYNFKDINVHDLEAATLFEVRGYVAVVTGAGNGVGLMAAQTLAANGARVYIIGTREEILDTIGEKYSFKGQITPCVLSHSIPSSTAPTDEGILTPDSPEILPLQTEFVASQQNSPKPNQKGSTFSSTAQALPASPARKAHPPTPTSQTQTPSRDG

SEQ ID NO: 33132 - protein, 213 aa, A.fumigatus
YFTLDLSFLFPCSVTHNRLASPGDYVDRGYYSVETVTLLVCLKIRYPQRITILRGNHESRQITQVYGFYDECLRKYGNANVWKYFTDLFDYLPLTALIENQIFCLHGGLSPSIDTLDNIRSLDRIQEVPHEGPMCDLLWSDPDDRCGWGISPRGAGYTFGQDISEAFNHNNGLTLVARAHQLVMEGYNWSQDRNVVTIFSGMAPLPILICTHH

SEQ ID NO: 33133 - protein, 109 aa, A.fumigatus
PLLHEHINWLWRATIGRRIEMWSPFFRVWPLFPFLFVPTTNMSFSAPNYCYRCGNQAAIMEIDEHLKYTLYVPLKANVRPWFIRTNCFSKLTIRSLPTRGRTDGLETYT

SEQ ID NO: 33134 - protein, 159 aa, A.fumigatus
VKDLRGFVKNNFKMQLDFSTRRPQVSWNDDKRVFLCCLYKFFERDGTAFEKIFNARYKGDLEDSGFADGRTSSKTLNTQWVDMKRHGDPIWGRVHKSPLNQDDWLPIKNIIIDVAQSLGVPLAEKEIDDIDTSNYRSRAAKSGRTITSDPVVPTSSSVS

SEQ ID NO: 33135 - protein, 250 aa, A.fumigatus
ALCEAITFRRFYIDDRTPTRKASILGSGTSPAYLLTLRSANSFLTKFPWKNSMVVLNHVSIASHPSPFISTFQSILAPIHRALWGKEGAMVSIIDTRKLTGPVYFAKSLVQQNKIRIRGYNGVGEYLIWGEIQTPAIICSFKITTLIQIAHKNEDIGRILQLDKIASCKRVRGKLRTVLSNETDSMNLDHASGVSLGKLLRLINVPQAYYQMVGEGILKSWQLQKHGDWQEFLQGLEVGFFTWLRQTTLN

SEQ ID NO: 33136 - protein, 177 aa, A.fumigatus
YPDNLDARPTGTALAKEIGRNHLVQHGTVVHEEEEERFEEIEEDKDEDEDEDEDEEEKEEEDDDSDDFQSVIGTPCPVRLAHTVSSIPPPDPRPVNRIELYNPATRNWSLAEESSTPTEIEAFSREFSVIFLDDFEEEIEELGDTIMGKDISDLSTPEHPPKDQFASDRERIKRFLK

SEQ ID NO: 33137 - protein, 121 aa, A.fumigatus
  UNSURE (41): Identity of amino acid sequences at the above locations are unknown.
FETDKKCPFTGMVSIRGRILTGRVVSTKMHRTIIIRREYLXYVPKYNRYEKRHKNLAAHVSPAFRVEEGDWVTVGQCRPLSKTVCGNPPRNGSARYFRQRLMLKWKLSWSGRQSTLSINPV

SEQ ID NO: 33138 - protein, 86 aa, A.fumigatus
SNWTRRANDRLKVVTIIIFLFLFLFVFVFVFVFIFVFLYLFESLFLFFMHNGAMLNKMISSNFLSQSCSCRPCIQVVWVSVEGCLT

SEQ ID NO: 33139 - protein, 562 aa, A.fumigatus
VLFYIDKPIVRRKEVTTWAPELARHGRGSDARSIQTLGVPMHRDPRNKNTCVETTSMATPSSDVPVPHLASRQTRRDREDPDPAAPGVNDSLASENLLRNLQRSESSAVSANSSVPSNGGRWGNIFSGLWISRHESSTAEGNPTVPVAEPRKRSVSAYVGPSKRSPPTLSQMVKEVSGETPGEVSETTTSGTISIPRSSSQQGPEENTPEPSSVPEQNRESSLKLSVRGDDGIVDVELPLPGFLSLSSSGDSTIASPKKTRTSVTSVDALASTHSSNSGFHCGGPRDNDGPSVNVAGWLKNFHEDFLLQGVRPSASVEADIKRAMQAEPTPSSAFSFEPEGQGKWVDVATTLIADTRNFTVKRLRLRRKVVGNGSCRSPSTPGAASQPGTPRHLFGHPTSASQLTSFFSNAPASSGASANSVAEAFDAPEYEERFVEEPVMDLDGTLVDALERVLAQSGQSSLAHSRAQSPSRGRRGEDKNTSDTVSRDEVPSIEVPRAECRKMVLGALEEVVRSVTAEHCREDVDGEVGLADRERRRSLAGADNTLREGIRKWLLEVEEAW

SEQ ID NO: 33140 - protein, 851 aa, A.fumigatus
PSECMADKMDVDNPNTPTSRDPRLVSRNRPAPARTASLDAGIWGSPNGYKLEARSPNNPPPIDRQDEAPGDQFIRTLSELIKAAVDTAAREVEKDKLLKKKDMTEGLLRKAKAAPNFPSTTAFFQQARKDEDSELTRMDETISRTQAHYRQLENSLTTKWVPLLLRNHSDSDQKINKLQDEIRALQKRAGDSELGASREKYQLLETKMKMLQDRVVLLEKTSDNYATSINTQMRYEKENKERVDKLSSDIAQFASQETILKHFSTEVEELKRITIALDAKLSSLQKAQEEYSGSLGRVNEIIDAQRKRLDASNDNSATFEKKFKEIHERLAPIEKVHVIPPEGPATVPIDASKIELRLKNVEDNLAKIPRPDSSLRSTVQNLSEQLQQLQSLQAMKDEFHFAEMEEIKKSTVDKADIKSLKDNYSRLADETRRISQLDRAGAVGQAEIQSLKDSYSRLAGEIQKIQSDRAIAVDKAEIQSLKETCSRLAENIQKMSQWNPAAALQQIHTVDVKINTVDAALKYSNRLLESVRVGLHSLETRYNHLSTEMVVKNMVVAMQEMYPSAGQLTEQITTLKNQAEKEISSLKKTIEQLVQTQNSQKALVNCLQDDVGQRSAEITHLRDLFGKVAHQVSALTEQLEEVRALPDKKGKEVSDGQNRIELNESFRELKDQVQNLSSGLNQMKVVMSEITLNKKDLQSLDDRFRCLEESVSVNHRVLSEQINTLKDSLETHKSIVQALDCLPASGMQSLKREQSPSGSDAAPHTNFVEMTETNPALALREKKRKKKRPRPPTVSDNENERSSGSRNESPMIFSSPAHTLDNEVASPSENKRKTKKKKKRRLITEGPITID

SEQ ID NO: 33141 - protein, 99 aa, A.fumigatus
NIAWRTSWTQLRYHINTSPVLFQFVLASDLPDGPDSEVLSFFSKRPDITLRPTWYAFDSLQDLGRHPFFSPEILLLSHIVISRSSSTWLSYTNSESCLT

SEQ ID NO: 33142 - protein, 205 aa, A.fumigatus
RILPDVRRALSIMSISGPCVWLSSLSPPATSHLSAITNHLPATSWNSEQVLSRSRVSPPRLPYPGEKGGHSVQKLAVDMQPSAVLKAENALSASTVVATSNHVRSSEAEMPPPKEAESRSTEETLSRMRLDQLNHSESHPSGVSTPASPSVSKAASLEAKKRPQEETRGDEKDDGEAMGISSDEGGDQKNSSDAKTDKKKMKRFR

SEQ ID NO: 33143 - protein, 466 aa, A.fumigatus
  UNSURE (412): Identity of amino acid sequences at the above locations are unknown.
LDGRFGRVPHGGFRCACVIVGGGGGGAGGAAVEIHRGPGYFQCCGCRSGMSGSFSLGIVGLVGLTVGLFSKGLDKINPPKKRPQVASSLKSFINHFFPSVEKVLSVDSRQECSNVVRSLCTATPKGIRWRDERSWMLVEEVKWPEATTEVVDDVVLTGIVRGKGLKADRLVHIPGWGDFQIDSITAAPLPNARAKRDDAMNVDENEAPQVLDVPTADRDDLATVAPEEIEMEEDDISIAETERKGVLLDDHHYFSDDDSHLPARPKRLPKGTSEYQSAWFIDDVSDSGSDIEEEEEQDEAMAMDTAGNPEDGVFPDRQDAMTEAGPSEYPQSEMFLDPSPEDEAQQLEEYRASRRKEASEDLEFPDEIELHPNVLARERLARFRGLKNFKTSHWETAEDRPHEPKDWRRLLXIVDYKGSKNKTLREALVGGVEPGIRVDVPLRGVPSSLRNRRQPLSLFSLLRHEH

SEQ ID NO: 33144 - protein, 167 aa, A.fumigatus
SGKVERGTRKTPHQQLMSKLDRRNQARQKQQLKHQEKAQANSIFTGANGAPRHVAVVPLSVDVDVAAILRSLNESVDVSADVSADTISRVRIDRFRQSLQYIPAKYDLMGALDVCRMADFVVLALSSEVEVEEQGEQLLRSIEGQGISNVVAVVQVCRDPSALGLSG

SEQ ID NO: 33145 - protein, 263 aa, A.fumigatus
WWSSRRTPLRSVSAIEISSSSISISSGATVARSSRSAVGTSKTCGASFSSTFMASSRFARAFGSGAAVIESIWKSPHPGIWTRRSAFSPFPRTMPVKTTSSTTSVVASGHFTSSTSIQLRSSRQRIPFGVAVHSDRTTLEHSCLESTDRTFSTEGKKWLMNDLREEATCGRFLGGLILSRPLENKPTVSPTSPTIPRLKDPDIPERQPQHWKYPGPRWISTAAPPAPPPPPPTITQAQRNPPCGTRPKRPSSHISQEYTAGSV

SEQ ID NO: 33146 - protein, 480 aa, A.fumigatus
ETASLAHSDTADSLSGIPQGNSIRMMGYGGHQYHPQRQAQQNAHPQQQQHLQSPSLSGAAAHSVHSSNGIAANSSLLRGQQQSDLASNSPDLRKMTPSSSASMVGFTAGGGYGTYGHYAPQGTSDLLSRHTDSVGQLKDPYLSQIQSLQRNMNPMAKLPSAPSHEPSSRHVATCSGDEYFVSAAVIREVATASPSAAPADIPYASLCDFACGRVAHACDYSTPANSAPVPASATAAAATTVSAILTADRVSADPGASISVPTASVVSVPTSPGAGIAIPAHAADLSAASSADVSTATASSAVTVPGTATAAASVPTVSVPAVPAGSTSPTGACTASTTDPSTTNTASTACAAADSAAQLPGSDTNPAVSTTARTSSAASIAATSPGSTASPSTSETVAAAESLRSTGTATYAAAYAATYAASPSPANASAANASVPSAVAASAATAKASDAINPTGCFERSKTCYSRTQKGGNETNEEAW

SEQ ID NO: 33147 - protein, 201 aa, A.fumigatus
  UNSURE (95),(101): Identity of amino acid sequences at the above locations are unknown.
VGDSPRHNPQTQNTAQAIHHETRWHWSATRSSSQGRRGSTEASRSRSSSQGRGRGASPRARTRTGTMAWTGTGTCTWTCTWTNTCSGAGSTSGPXATTSAXASPGSTSNSDSRAASAPSSAVTSASASASSSSGVSATASKRAYQHWQHCETASAWATNKNIPQQQQQPSESHEVDPAPKNAAPPMNGKQPRKKRLTSMPH

SEQ ID NO: 33148 - protein, 756 aa, A.fumigatus
  UNSURE (665),(671): Identity of amino acid sequences at the above locations are unknown.
IPWQNFRPHPAMNPQAAMSPHAQAMSISSPQQSYERLQQHPHLQHRQTSHTHPSVTSPAAASPMLATTQPQQTQHQYQQAQQQQQQPQYPQSSQQTAYQQTQAQASPYQQHQSSPFQHHQAQASPYQHTQQTYQQQAQQTYQQQQQAQQSRYQAQQPQQHQFQQYPYQRYQQAQQAQQVHAQQAQQTQVQPTQPAQHVQQQTQQHNCPEATQTQPSQQPHEQAVQQALQQHRQAQQQAHQHQRQSQQPSPYAQQAQQHTQQHTQQHTQQAQAQQTHPQQTHQFHQQSQHQQPQQKQATPSIQPAALSGAKPATQEPRKEETKPTKKRGRQPKAAAAAAAASASPAIASGKINGTTQPTPAAYRPEAPSPIQFVPQHPHLPQTQAHAQAHTQTQAQAQPYPQAQPQPQFQPQAQVPNQLQNPTAMQGQNQGQGQNQGQGQGQNQGQGQPQTQGQTQSQQQGPANAAGSGTPGAPGASQQPAPTPRKRGRPRKNPLPDGAQPPKPKPKKPASTAASAPAAAAAGGAPAGTAVPGQGTNAAPGTATAPGAAPVPGPDGSVPAVPVKRGRGRPRKSETAPGTTPKPKTPRKPSTTKPGGTGRPRGRPRKADVEARKRAEAEAQAKAEAEAQAQEHGQGQGQWHGQAQVHAHGHAHGQTPVQVQVQPPAXPQPQAXSQAPAQPQIQIPVQPQHQVQPSPQPQPQHLHHQASPQLQANAHTSIGNIAKPHQHGQPTKTFHNNSNNPPNPMKLTPPPKTRPPQ

SEQ ID NO: 33149 - protein, 250 aa, A.fumigatus
LRLRPRRPCLRLLNPSKLSTSTSKRNSSSSNHSIRNPHSRPRISRPRRKHLRTNSISRLRSNITRRRHRHTSTRSRLISSKLSRRINSNSKLSSHGTRHSNRSSISSNSIRTSGTSRLNKPNRCMHSKHNRPKYNQHSQHSMCSSRLSSTTARKRHKPSRLNNRTNKQCSKHCSNIARLNSKPINIRDSRSSRVPTLNRHSNIRSSIRSNIRSKPKPSKRIRSKRISSISSRSISSHSKSKRRHQSNRLL

SEQ ID NO: 33150 - protein, 255 aa, A.fumigatus
AEQNLLLKNPERRKRNQRRSVVDNPRPQPQPQPLPRLLRLLQARSTERHNQRQPPIVPRPHRRSNSYLSIHTFHRLKLTLRPTLRRKRRLNPIPKPNLSPSFNHKLRCLTSCRTPQLCKARTRAKARTKAKARARTRVKANRRPKARRRVNSRVQRMQRALVLLVLQVLHSNLLLHPGSAAVHGKIPCPMEHSLQSLSLRNPLRPLQVHPPRPPLVVLRLAPPFLVKEPMLPLAQLPLQVLPRFLVLMVLSLPFL

SEQ ID NO: 33151 - protein, 244 aa, A.fumigatus
QVLLRSKQPVGLMASLAFAVAADAATADGTDAFAADAFAGLGLAAYVAAYAAAYVAVPVERRDSAAATVSDVDGLAVEPGDVAAMLAALLVRAVVETAGFVSLPGSCAAESAAAHAVLAVLVVLGSVVLAVHAPVGLVEPAGTAGTDTVGTDAAAVAVPGTVTAELAVAVDTSAELAADKSAACAGMAMPAPGDVGTETTDAVGTEMLAPGSADTRSAVRIADTVVAAAAVALAGTGAEFAGVE

SEQ ID NO: 33152 - protein, 216 aa, A.fumigatus
  UNSURE (22),(28): Identity of amino acid sequences at the above locations are unknown.
RLNLVLRLHGNLNLRLSRGLRXRLWLRXGRRLNLHLNRCLSMCMSMCMYLCLSMPLSLSLSVLLGLRLGLGLGLSFGFGSLPCFHVGLARTTAWPTSATGFRGGWLARCFGFGGCAWGCLRLTGPSAASLYRNGRDRTIRTRNRGSTWSGSCARGSIGSLTRNGGASRSTTSGGRGGCTCSGRSGFLRLRLWRLCSIGQGIFPWTAALPGCRSRLL

SEQ ID NO: 33153 - protein, 149 aa, A.fumigatus
WRRLLLLWLLMLRLLMELMRLLRMRLLGLGLLRMLLRMLLRMLLCLLSVGTRLLRLSLMLMGLLLSLAMLLQCLLHCLFVRLLRRLGLCRFRAVVLLSLLLHMLCWLCWLYLGLLCLLCMHLLGLLSLLVPLVRILLELMLLRLLCLVP

SEQ ID NO: 33154 - protein, 173 aa, A.fumigatus
WRIILSLLGGRLVKNGRRFLLPRNKRLKTADGRASVKQESGEKKYLPYPAGYQGYPTVAMITAAVNESGITPVRLGEESIIQLLEMLCYDKKLVALNNGQFYKSVKNPAAVKMEKNRKPEGDVEDVGDKLVTNGMTEVPCGPCPVFKLCVPGGAVSPETCEYFDPWLQKALGF

SEQ ID NO: 33155 - protein, 69 aa, A.fumigatus
VHIQIRMYASILKGKFTSCKNSFHFDNLALYKSQIVSVPSKILVLLYYLEGCLLCHLISVRGAGISSTD

SEQ ID NO: 33156 - protein, 145 aa, A.fumigatus
PSYDQQQHHPQYSGPPPSYGQQGYPPQHGAPHQQGGYAGDQNYGQGAPMNYPPHDCGHSPYPPQQQQYNPQGASASYYGAPHPEQHQQGAHAPVPVGQEGERGLGSTLLGGAAGGIIGKKLGGGLLGAAGGALAGAAGMNMATKM

SEQ ID NO: 33157 - protein, 109 aa, A.fumigatus
ADAEMAPQIKHKSGDSVHSQAPQLSDHRRWQSFWEWLQGQFHLRPPDDDEPQDWWLASTAVPLVAAATGPLANVMSVVALVMPWRSHISFDQKDSLGNPLQVGFSDPRW

SEQ ID NO: 33158 - protein, 548 aa, A.fumigatus
LVAATVALHVFASPIAPNELYSQAYWSAVIAAILYFILSVILIINMLGYILGHYPQYFALTDGQRTLILQTLSFVIWLLIGAVIFSRVIDISFADALYFSDVTILTVGFGDIAPTNAIGRGILFPYAVMGIIMLGLVVGSIHQFAKDLQYDNVIRKHIERKRLATIRRATTLEKKCTGPAENGAHTSGSGTAQIGYRPHYSREHPIISSISSWTQGLAGRSKLILMKEEKDRFGAMRAIQKETIIFRRTYNLLLSIAIFGIVWTCGAVVFWQLDEDLSYFNALYFGFCSLITVGYGDFTPTTNAAKPFFVVWSLIAVPTMTTLISEMSDTVVAWFKNATDKVADWTVLPQSSKYQAFLQRLPVIYSALERRAEKKRVAQGFPIGDLEPGQPQNDAADFSHRPRPLEDLARDSNPSRQDLAQQLAFAIRRTARHALARRPKHYSYEEWVEFTRLIRFTDNSPEGVVLDEDEYGVLNWDWIGETSPMLASQTEPEWILDRLCESVIRYVDGQGRRQPSDQDVKPLSVANGDEDVEEPTLRKERDIRFEDD

SEQ ID NO: 33159 - protein, 146 aa, A.fumigatus
LKKYYSLLMWLLTRTTAQRNNHHPQNLELTSHHLPQVTQHHALQLLPPPPKTQASRHNAPPHPPNRPFPLPPVSDLQTAKPPHPLPPTPLPRRPLPRPAPQPQEARGADHRRCPLAIYTADSSNAKGAQRIRDVLCDWVADGRGRA

SEQ ID NO: 33160 - protein, 263 aa, A.fumigatus
HNTMLYSCYRRRRKLKRLVIMLLPILLTALFLSPLYLIYKPPSLLIRYLQHRYPDVLFHVPRPSHKKLVALTIDDAPSQYTPQIAATLKAHSASATFFVIGSQMDGDGREAVLADLVRAGHELGNHAMRDEPSRALSDEELSAQIAEVQARISRVYARAGVEEPRLRWFRPGSGFFSERMRRLVGGMGLRIALGSVYPHDPQVPYAWMNAAHILSMVRPGSVIICHDRRSWTVPMLGRVLPELRKRGYRVVTLSELVKDAENS

SEQ ID NO: 33161 - protein, 255 aa, A.fumigatus
TCYQQITRPPPGSKPSTEPFFTNHFCTRIIDPETGMYLPKFNVCAACIRNLRILMPQHRETFTRSATMQEQVCDFVADSPRFVQYIDLLDIAANRAELERSPRPDMTAFLAYARRKVVLRDCRRDRPVLGTWYYMPQLPEFTVCEDCYDDVVWPLVKANKPIARQFLTRMRLAPGDAPTRCREASCQLYSPRIRAKFRDAVQRNDLAYLKLIALKRYDVEQHIRERREELLEEESKGYDCDAELRKTLLEWRRWE

SEQ ID NO: 33162 - protein, 137 aa, A.fumigatus
NHRAMSAARAKLAELRALRAAGKKRLSTYEIEEQDDIFEEVDDEGYKKIIRDRLDQDDFVVDDNGEGYADDGREVWNERVADYNSESDDEELPGRNKAAKRKREEDKQRKERINNGISKYFNTGPAASAPKPKVSLI

SEQ ID NO: 33163 - protein, 548 aa, A.fumigatus
  UNSURE (511): Identity of amino acid sequences at the above locations are unknown.
PVVTAEDEAFMADLLGEVDTNVVANHVPIQNVIKSETRRKVRILSPPLASKPRNERISGKDENSEPVSQVNQAPDLEFEDDDGPLPTMDDGDVAMSDPMPSSPISKVVERKSNVNVKKEESDEEDNDLMEIAPATGQSEAKMTSVNMAGSRPPPKIKKENYTTPASSSPAKAPVDVLNASWNDVRSKLNVLSSPATESRTFGKLRAQDVIEEDGSLRMFWLDYTEVNGSLCLFGKVKNKHTGSHVSAFVKIDNILRKLFFLPREYRYKHGRVTDEEVDMKDVYGEVDEIMSRLKVGMHKIKPCTRKYAFELPDIPKEAEYLKLLYPYDKPALPMETKGETFSHVFGTNTSLFEQFVLWRNVMGPCWLKIEDADFTAVSNASWCKFECQVARPACITPVPDTGNLEPPPLTLMSLAFRTQLNVKENKQEILVASARVYENVSLTDTTPPEKLPCKTFTVMRPVGSSYPLHFEAETRKQRGTFMLEKSEQFLLSKFLALFEKMDPDVLMGHQXQEVDLSIFLSRLKEKKTPGWHRIGRLVFTTGLEGTAI

SEQ ID NO: 33164 - protein, 64 aa, A.fumigatus
RWICGWKKEKNYIQCLNYYKQRKRKTHDFLPSWISFISIHEAFSLFTLFLSHHLLFSLFFYTTF

SEQ ID NO: 33165 - protein, 101 aa, A.fumigatus
FLIFNINYSLEYKITSLIHQLLYTIKYIYLIGLASISTVIILVLSLVVFNPWLGHYITVLSGYLVNRPQASIRYSLGTISPHSQSSRLAENSRDGSQGVTN

SEQ ID NO: 33166 - protein, 92 aa, A.fumigatus
LAAKSVKIRLPKPFDGTQTRLQSFLTQLDTYIQVNKEKLTNEADKVLFATTYLTGPAFNWFEPFIRDYQTNTVKKQDDNTKEIFASYAEFKK

SEQ ID NO: 33167 - protein, 64 aa, A.fumigatus
IQATKELSTTAGRDGYNTTSIITPKKVDKQLRKLYKEYMNLSDKEIKEELEKEDPTNYESTNND

SEQ ID NO: 33168 - protein, 88 aa, A.fumigatus
FLSYGIPNTTSYHPVGIILKFRCLICPNITIRTSPDSVMIERVPKFSLFRPIISSGTAFIFPRIPSFLIKTGFIKLPITPELIITSAN

SEQ ID NO: 33169 - protein, 221 aa, A.fumigatus
RVDTSSGDPGPEQDDQFILDDYDSDADERMASSKKLSDISGLSTSTLELLERFKEQFSAPVEDEIGHEDDDVKIFYCSRTHSQLSQFSSELRRVKMPSSMPAELSTSDANTDDVQERVKHLTLGSRKNLCINPKVMSLGNAAAINERCLELQQPGIAAEKRCPYLPSKEDEGQILQFRDHTLATIKDIEDMGKLGKRMGICPYYASRSVLKHSEVCFGYAF

SEQ ID NO: 33170 - protein, 198 aa, A.fumigatus
TSQNVLLKAQKIVTLPYPLLLQRSARDALDLSIKNHVVIIDEAHNLMDAICNIHSVTIRLSQLQTALLQLTTYAHKHKARLKGKNRSYIAQIIRLVSSIRDHLRSILGQNLPAEGTVDPSDLMAGKGVDQINPYKLSRYLQESKLARKVDGYVEFLKNKNQQSDDKPSSPVLFLVQSFLLSLMNPSPRRPIFLSKVPR

SEQ ID NO: 33171 - protein, 73 aa, A.fumigatus
MSDYRNHLFSYIAPSRLDTFSYGHVIPPENLIAHTLVNGVLGSEFDFTYDSRDSEKMVRDGFLARGYLNFGTF

SEQ ID NO: 33172 - protein, 78 aa, A.fumigatus
  UNSURE (19): Identity of amino acid sequences at the above locations are unknown.
YTKVNLVKRVTGGTSSIMXSQLQNFNHPYSPYDIQLQFMRALYTCLEEGKVAVFESPTGKFSFTCRLVPATNHMLQAR

SEQ ID NO: 33173 - protein, 92 aa, A.fumigatus
ILDLGRTVATLCQAIPDGVVAFFPSYDYLSRIVAIWRKPLEGEKGETILSLIEREKSILYEGRDMGPKTDDLLQEYTRTSLHHGAGRSSASQ

SEQ ID NO: 33174 - protein, 140 aa, A.fumigatus
AMPPAPPAASSYPQSPARICCPPRPAAPDPSTTKKTTDSFLSPPASSTPTRTLQPPPVPETDTSLQPSHSRTTRASSAGNAPPPPPALAPAPPFSLLSSVRVGGRSLRRLLQGCWPPPLPLSLNWDGGSRQITRRMPRSG

SEQ ID NO: 33175 - protein, 316 aa, A.fumigatus
KAVDGRSGYTTLPLLRLEAYLSSAARHPSHRPLRKEDLPRFKGMESFKGDRLCHSSDFTEANPASKGKKAVVVGSGNSGHDIAQEFYEKGYDVSMVQRSTTCVISSESIVEIGLKSLYGEGGPPTEDSDLYLWSIPTELFKAQQIKVTAAQNQRDAAILQALDKAGFKLDMGSDNAGLLMKYLSRGGGYYIDVGGSRLIADGKIKVKQGQEITEVLPHGLQFADGTQLEADEIVFATGYQNMKTQARAIFGDEVADRIDSVWGFNEEGEMRTIWRQSGHPGFWFMGGNLALCRYYSRLLALQIKALVEGITTHGAK

SEQ ID NO: 33176 - protein, 221 aa, A.fumigatus
TGPMTVPITDHPSKDRIAPGSVNVPVGKFPQTASSTSVDAAKLASEAIDQLNSALKQKNYKAVSDLFLEDAYWRDHLGLSWDYRTIKGRENIASFLEHSTRLVQVEIDQSSPFRAPHVGPIDAFGDVTGVEFFTTFANDVGNGRGVVRMAEKDGVWKIFTIFTTLQELKGHDEAVNASRPLGVQHGAQVGIKNWHDMMTSDFEFEEKTPVVLVVGMSPFLD

SEQ ID NO: 33177 - protein, 123 aa, A.fumigatus
QDLVLTWKGAGQSGLTVAARLKMLNVDTLVIDEEDRIGDNWRRRYHQLVLHDPVWFDHMPYLPFPSSWPVFTPNDKLAEFFEAYAKLLELNVWTRTTLKSSSWNHDKKQWTVVLDILLSHCSV

SEQ ID NO: 33178 - protein, 66 aa, A.fumigatus
TPSSGTYPLKPCQVLQMLDESKVIPPYYISSALAAAMTHMVILLKQNGPYQQDKSETIEGSIGTMK

SEQ ID NO: 33179 - protein, 182 aa, A.fumigatus
PLPLKAEPHVNEQAPQSLHDPTVYTRHQHPVRLARGPFPRRDSDPNPPAGGKVAGPREADPIQQRIDEIVSQNMPSHGAPPVPPPSGAGARIPNRRNSVDRRGPDRYRGYEDPARRRRSSFGRRSQSFEEQPPPLPGHPHHQPLPPPPPPPDIPQPPPPPPPSQTQQAAQEDEGGGSEEGEL

SEQ ID NO: 33180 - protein, 551 aa, A.fumigatus
LFERCRRCPRPGFFAEDMDAPMHDDLSVGDVFAPQADMSQPCNDALLGNNPDTRFCMSGGSPSRKQVPVTKDVNEVDPFPAHNLNIEALSGRPDRRKKKKKCQTSEAPRAISTVRGFTPLASGDEDSDFSTTSAKARPSSRAAAYAESDGNSPMVQPAGCGVSALKLQLDSLSLSGSGSAQAAQSDLCSETPSNASVCSDSDQTEVLTSYEVPLEHDFVSSDAAAEETSASLPGAQDVRTQLCRKMTTTDFEPLLWLGKGSFGTVLLVRHALTGKLYAQKQFRKASLTVHKKLVEQTKTERAILESVNRHPFVVKLFYAFQDHEKLYLILEYAQGGELFHHLAMERMFDEDAAAFYMAEMVLALEHLHQNVGVIYRDLKPENCLLDRDGHLLLTDFGLSKIAVHDDDRCNSSLGTIEYMAPEVIQGKPYGKACDWWSLGALGYDLLTGSPPFKANHNAKLQEKNRQAEAQRCPISLVRMPKTFSPACCARNLPSDSVTTCPRTCRPSRTIASSARLTGKRSSVARLLPLSSLWSRTRLWRRTSLLTLPPFR

SEQ ID NO: 33181 - protein, 198 aa, A.fumigatus
VHGSRSHSRQTVRQSLRLVVTWRTRVRSTYRLPALQGQPQRQAAGKKSSSRSSTLPYFLGPDAKDFLTRLLRKEPSKRLGYHMPKDVQTIKNHRFFRKIDWKALERREVAPPILPVVTDPALAENFSADFTTLPLSPVVTSNGFDDYYSLRQRPSQRAMSTGPDGMSCDNDPFGGFSFVASSSLLDNNGVGITTQCYR

SEQ ID NO: 33182 - protein, 300 aa, A.fumigatus
PLRTIGDDAEKSRLEELAQSYDPVPYWTNIHPYLLSTIQHGLRASKALPTPSDGDQTKGEPSLDKYLLAEIPATTLRRNARSPREPVNDFLARLPPSTTKERDVGPWIYVTNPHRKIDPDEQAIAKLVREGTELLHRFEDQKAELEAEHDRSRSKSKAALTRRLNPLRRTLEQDIFALARRTGVVSGKWMMFINADQVDKYWEAVATGTVSGKLGDAAKVATDDGTGRPRLIAIYTKDYADRQDVKRVLEGMVHLGLVKTDDRPIYYHCDACTYLRILSDNPYGLKASMASTRNVLARKE

SEQ ID NO: 33183 - protein, 77 aa, A.fumigatus
RYMGTHPLIFTEIGIPFDMDDRHAYKTGDYSGQVSAMDANHFAIEGSTANGFTLWLYTTSVSISMLPRTKSFHTFSN

SEQ ID NO: 33184 - protein, 218 aa, A.fumigatus
RIRQNNHEWGDNWNGEDLSIYSVDDLELPSGKLLAFENESQRDPQSPAYSESQRNTESYRVGPRDLKQALQAPSISSEISQSSQDKLGFRAAEAWVRPSPIITNGQILQYGFDLKSCVFSMRLLGEKKGLGQEAATEIFLPDFHFPDTHTVVAVSAGEWTIDYPEIHSVKFQRLRWWHPEGDHNIKIQGVKRKPGDPTVSGEELSYLEQCQGGGCSVM

SEQ ID NO: 33185 - protein, 326 aa, A.fumigatus
NTEMEPLPDAISADASQFSCTLSNGAIQCSELQGQREHRIAIDDVICILPHASQDGKKYNMLYLRNGRNEATSVQPGDCGSSLTSVQLVSPPSTLLSRYFCAELPQHLKPSVDHAIDIYVIISIPSGTGKAKNFFKNILQPFLAHIGLTEYEVHETQSARSILELCQSRLIPRAKLGVAQTIILLSGDGGLNDIVDSFHGAVGVPIVPPIVALIPMGTGNAMASSLGLLSRPAEGLTVLLKGSPKPIPTLVANFSPGAQYVTDEGHTLIPMLDSSKTKSSVNSIHGVVVASWGLHAALVADSDTSEYKRFGGREVPDGSQGAPFPF

SEQ ID NO: 33186 - protein, 173 aa, A.fumigatus
LLTVTLLNIKGLGAERFQMAAKELLFPSSGAETHRYKGNITLFRSNVATNENSVDTLEFGEHMYVLATLVPRLEKDFLISPESVALDGRLRIIRFGAVSAEKAMQLMSLAYDGGRHVHESSVLYTELEGFRIDFREAEQKWRRVCIDGKIVIIEEDGWMEVLKGSTGRVNILV

SEQ ID NO: 33187 - protein, 372 aa, A.fumigatus
  UNSURE (314),(329): Identity of amino acid sequences at the above locations are unknown.
TIGLNDKLGVSGFCIMDSSCLYSKELQLACLTVQRAALLTKKLLEAVDKGSFDKSDSTPVTIADFAAQALIIGAIHKAFPEDEFVGEEDSKALRADPELLERTWELASTTHLDDKDSEALLYAPKSKEEMLDLIDLGARGRCSLENRAWVLDPVDGTATFMQGQQYAVCLALVENGCQKVGVLGCPNLNLATGRLREDVVDRDGYGSQVFAVAGQGAWIRKMGRGGLLAAESIPQRPQITDPKDLDFVDCGSATSSNTSLHARVASKLGAPWPYSTDLWAAQLRYIAIAVGGCNALIKIPHKALYRSKIWDHAXGMLIAEEVGVKVTDXAGNPVDCSLGRTLAGCYGMIVAPPSIHERIVEAVKEVMQEQTK

SEQ ID NO: 33188 - protein, 283 aa, A.fumigatus
  UNSURE (258): Identity of amino acid sequences at the above locations are unknown.
YYPSLNMIGNPGALLVDMKKQGLFESFDKSYHPTYGIGTMSGNIYDTSWISMVRKPTEGGSVWAFPAAFQAILQEQSPCGSWGGSTSELDCIVSTLAALLSLQKHAGDCCEMEFEDLHSRILKAKQFLQTALKGLDRLLATCTLSVGLEVRLPEILDLLELEGHTFNFDRTYLTEIQSKKLSKINLETIFNGPQSSLLHSLEAVIRKVDIKALGHQKVLGSMLASPSATAAYLMYSPVWDDEAEEYIRHAISKGAGRXSGLVAAGYPTTVFEWAWVGLNMLWQ

SEQ ID NO: 33189 - protein, 99 aa, A.fumigatus
TVPNACADADDTAKALVPLMLQGTRYSPQALVDRFERENHFATYLYETHTSVSTNSNVLAALVLLSTDGHYQPQIEKCIRYLCEAWFNCNGMLKDKWVC

SEQ ID NO: 33190 - protein, 302 aa, A.fumigatus
TLTFSIVSPVFPPHCFIIPVLLFFYTLGAFACQVILGSRRSLGTMSLQVKDPRSRGRSKSPSGRIRDRSKSRDSRLPSTAPDAARSSERKYLATDARDDHLRSRSRGPRDSNTSVSSHRNRSRYDVSDSASERDDRKDRYLRSERRRDHYYQSDSGESKLAKRDDRKDYARSPNLRPVTYESPSDDFYSDTDDEALAYGDAPSDLERDFYGYRKPARASSPRVDGPVMSGALNGAPPAKHDSSRSRHASDEDIPGHHPSYARPGQFQYVMPSQYGQFQPSYPPTSSARLHHGAGRTDGGTTV

SEQ ID NO: 33191 - protein, 189 aa, A.fumigatus
GGCSDIVSMLLNKGADTDLGDNTGSTPLHTAVWKKHCKITQLLLERGAAVGSRDSYGRTALDIAMTHGSQRWLSLFLKHAKINAQDCQPLHPAISLNKTAVVRWLLENGADINRKDSRGQTPLLYAMLEAHDHLAELLLLYDVDPDAERYDGLTPLKLASEINREDWAQKLRAKRDKHKYLSHSLHSTS

SEQ ID NO: 33192 - protein, 176 aa, A.fumigatus
RVRIDSPHADSKAKLQFRSIGMLLGYHLLWSTTANVVGTAEQADRLQKLIITNNLFVGGAVNPRDNDLQITADGDSIVFNGFKHFNTGGVVSDLTVLEGVLDGTQDHIFAVVETNQPGIQFAYNWKNIGLRLTESGSVKIENVRASWTDALGWDATTKRPLAEILTIPFASLFLPT

SEQ ID NO: 33193 - protein, 151 aa, A.fumigatus
SNFPQMAQANVPATDPAVYDAYKEIWAALPDSADAWLARAREVAEVLAQDAAQRDQDNKSPRAEVALLKHSGLLKLLGPKKYGGGEQPWRVGYKAIREVAKGDGCVLTVHMQTVKLNCNSGPLACSLGIISSGRLQPMWSAPPNKPIVCRN

SEQ ID NO: 33194 - protein, 219 aa, A.fumigatus
RRPCTPVQRYSLSISSGSYTYDLDSVCIIMGAMIKSRRCNLPCYSDSGTRSMNNHAQPWYWTGIAINLGQIMGLHRDPDAVKFNPSITGRRRALWRRLWWSCFFRDRWLGLTLGRPLRINLLDCDLPMPSTADVMSDLSEVSPSVASLFIPEDLAQLSEYWILLLRLSKILGDALTLIYHPKRPNPTIEQFESLESDLPTLEIPHECCSDHTECARFAV

SEQ ID NO: 33195 - protein, 250 aa, A.fumigatus
NNIMQKGLFPDCHSQQTRNQPLREIRAFPHPRSSPRRNDRTSQVGSGETVGGRTVSNLARDMSQSGRAVSEPTAATGTTTPYSEQSRIEDEERSAADFATASLAPRDAEANDMPIYTGLLACMTQCIRRQLTVVGESLGFSAVLDVLATHAVPRHVFRPSSHPSLTAQDVEYLKFKGCLTLPSSDICRELLRAYFHHVHPILPVVDAAQVLKFEQQHDRPAEWNLLLLWSIFFVAVNVSISPREPHHLAH

SEQ ID NO: 33196 - protein, 135 aa, A.fumigatus
LLILFTAVSVAVVSQCSAAGHPISVPPVGAASTTASETATTTESSTQTTTGTSSTASKTSSSAASSTPSSSSASSSHHHSSSSALTTRTLTSTEPSSQSTSASAAATTTLSGNAGSEKANVAGVVAVAAAALYLL

SEQ ID NO: 33197 - protein, 410 aa, A.fumigatus
PGFGRITFGYFRTIPRKWEKWVWKGGHRWRNLKGGPRFERSQTDLGSVGAFRGATRWYHGLSFFRGIFYLIFKWSAYGLDRILDRIGISAGPQWLKVLLGSRRRGQEGNSSSRAESLDFWILTDEGELELPGDYEFDVEKEMRKRELSIAPKWEESDEKRLDEKLYGWWRAGGSWGNQDQSPDYVPSDSDDLCDTTSVVSMSTNAESEWEDESDGRRTLIQRSPYPAGVSRESTPVDEPLVDVGSLARLLDLRDQESRHEARILAAHLAAGRDGRIMTRRQFQQKMERERAQVLLSSRFSGSSGQQTGKEKRKPTPEEESEMLEKFILTRRSEANRANPEAQTWESGASGLGPDGPPCVICQANPRSIITWPCRCLCICEECRVSLAMNNFGSCVTCRQEVGGFVRLWVP

SEQ ID NO: 33198 - protein, 117 aa, A.fumigatus
WSRVRKRGPYNEKAVMLPAPRLNDQAYCQYIYNDGQTIASTDCEEEDGQPADHPHRKAAYTHHFHRHFTTVSLDDLVNHIVQEPVTTTVEISEGRQSRIGSQPSVFSPIDARVNVME

SEQ ID NO: 33199 - protein, 221 aa, A.fumigatus
LGTIIQTLTPELHPPNAPSPAGLPSTHVTIIALTSTIARLLTGSLSDFFAPPATHLFPANIESGRRSSQSGPTAKRPTLSRLAFLLPSALLLSLGYLLLSSPLPLQHPGLSHVTTALIGLGYGSAFSLVPIIISVVWGVENFGTNWGIVAMVPAAGAAMWGVIYSRGYQDATDGGNGSPDGQCHGWRCYGFWAVGCTLSVWVAVVAWILAWRGWRRRGVVV

SEQ ID NO: 33200 - protein, 468 aa, A.fumigatus
AWSFSLGAGSITAFSLYGPLFLTRLHYSQLQVNAVSIAAEISMYLPVPLFGYLCDRYTPSPLALLSGLVFGGGYLLAAFAYRSGPLPEAGGEGWPPWVMVVAFVAIGTATSCMYLAAVTTCAKNFGRGKHKGIMLAVPIAGFGLSGMWQSQVATYLLCERREDGSRGDVDVFRYFLFLALFLFCLGVIGTFGLRIVDEEEDQYIDEAVEELERSGLLEESEFFRPRSEVQAAYGTFSDAADGDAPGPELSLTLSEEEREAARLEKEREEEERRKKNWLLNFETRLFLQDQTMWWLAVGFFLVTGPGEAYINNVSLLPTIPVDDKLIFLLVRHNHSDTHAGITPSQCSISSRPALYTCDYNSAHVNYSPTADRISLGLLRAPGHSSVSGKHRKWPSLLAIRSDRKEAHPVATRLPSAFSPPPLPRLSPPLIPLTPPAPRSFTRNNRADRPRLRQRLFPRPHHHLCRMGS

SEQ ID NO: 33201 - protein, 563 aa, A.fumigatus
ITTGRLHLEPYHSKLQTASEYMLNAAVAAPRCFVYPTDRAAMRLGFALRLSSPAPLFSTAPFRRQLHASGVRSIEPVIFRNSLEKTLEAHRSSNRASLIRKVINHDCPAETPPPILPLENRAGHDQSSQKASSVSNAESESPRSSAPARRAQRKARSPSQVATPQPQTTEYPQLQWHADETKGRPAQSPWLKYLTTDWKTPDAVSRLDAEIRALELYMTPTPSERTEIDRLVADMGRLLAGIVPSPPQVTGSWRTRFALSHSGLDFVLPVPDSDRSTRDVRKPSATRPKVLQTYKKLLHEVKHALQQSPSFAERVRIIGSRFPVLSAIHRPTGRLLQFHCGEGLPASVEYIMDYQAEYPSIRPLYVTARLILEARGRYGRTQMSIESDALVMLLVAFLKMNHGRFQRPDCLGEQLIAFLRAYGSDIDLTTTGVSVDPPSWFNASTVKRASALYAPDDLPAHLRGQRSLISLKRTAAARRNLPAASRLCVQDPTNYMNDLGRSCVRTLELQHTFSLAHDRLGASLKRWDDSEPAANVSILTRALQANFSDFENLRAKSLKLNAT

SEQ ID NO: 33202 - protein, 303 aa, A.fumigatus
  UNSURE (303): Identity of amino acid sequences at the above locations are unknown.
VWRDDSAWLGLLVADNLSRRDQSLSLIMSTLHRLETKLEHISSAVRDNMQPLHQQMLHALEGLRDAATPKQSSRASDKHPSLSNSQSQHLTPEMGQPDDFVFDERPNTTDSNGHVSISFSQHGVILWPGAREILPRKLLEAHERLGRNYVIDLEMKRPHLPMYIYPYPPQAGEDWLETLPLAMIKGLSDAFFATFNPFTPIMDKTFYFAFTLGAAIESGFGYTIETCLVLNVMALGCLAVLSHQEGNYPLPGTRSSRFEPPEWMGVIHEEPPGLRFFNEARRRIGFLMCDNDIQSCQFYLLSX

SEQ ID NO: 33203 - protein, 77 aa, A.fumigatus
KAKMSSIRRVSPTDLLSLNLTNLDPLTENYDLGFYLNYLMRWPSLFSAVKDRTEGIVGYSTCKNHRSHTTSARPSHR

SEQ ID NO: 33204 - protein, 222 aa, A.fumigatus
WSFPIKSENEFHPARVPNGPPLPQPHQPRPIDRKLRPGLLPQLPHAMAFTLQRCQRSHRRHSRIQYVQKSSQPYHLCKTLASLMKSKTVMGKLEEQHPSMRHSEHYTPWHGHITVLTVAPAWRRLGHARRLTERLEHGSDINDAWFVDLYVRAGNKVAVGMYKGMGYSVFRRVVNYYSDDPTGMSDSGEDAFDMRKPCSRDKNLQHIRENGEEFLVNPEDVS

SEQ ID NO: 33205 - protein, 88 aa, A.fumigatus
AAIMNFIRLFTGQCFCSMFANANMLYKSVNCLPPKSTLRTPYLCSLEAFPLIQDTIGNDCFNHGRCQRCSEKPCCCFTRVHAEGSCAA

SEQ ID NO: 33206 - protein, 455 aa, A.fumigatus
VACTPQESASFEVFSCLDLTVYDVTKYQKDHPGGADVLAEVAGSDATEAFEDIGHSEDSREILEEFLIGTLQGAKEYVAPKKVRIIAQSPVETPASSSATRYVGAVTSLLGAVASLIYVYRRGSLYSLDTTGSLHRYLSQPLRGVRLPQGGFANGFLAATLICAAAGGVIARKAAKLTKIESGFLQYPPHIKARKVPRADPHLLKGFLDSKEFQRLPLIQKDQLSSNVYRFVFGLPDSNGVIGLPIGQHVAIRAVIDGVTVSRSYTPVSNNLDRGRLELVVKCYPDGVLSGKYLANLQVGDEVEFRGPKGAMRYKPGFCKKLGMVAGGTGITPMYQLIRAICEDERDTTEISLIYANRTEADILLRDELEQFARKYPKNFKLWYMLDTAPENWAYGSGFVNQEVLSERLFAPSPDTKVLLCGPPGMVSATKKMLAAIGFQKPGPVSKMTDQIFCF

SEQ ID NO: 33207 - protein, 68 aa, A.fumigatus
FKIPLAMTVSTMADVSGAQKSPAVALPEYTLKEVALHNRKDDNWIVIHGHGKSHAPLRRVQALKSSVA

SEQ ID NO: 33208 - protein, 65 aa, A.fumigatus
HGYLSSNSPKGVHKIGRKLYKMSTVFTVVSTSLKGRLFDATHDVLDIFLIDDYTAFRASGFGAQF

SEQ ID NO: 33209 - protein, 127 aa, A.fumigatus
  UNSURE (4),(7),(19): Identity of amino acid sequences at the above locations are unknown.
RPTXEPXQNLNPTPAHASXGSFSVSPPSGLDGSVNQSTTFGYEDSPYLDLNFDFDLDFLGNESLIGDLPPSLPSTEDYEPGDKRKDIDGQVNDKEDSGKKRRESDEKAAKKPGRKPLTSEPTSVCFL

SEQ ID NO: 33210 - protein, 71 aa, A.fumigatus
DMVCLISSLTALHSLANYLCRRDRLQSMEKFRNGEIDVDNLCSELRTKARCSEGGVVVNQKDVEDIMGRVK

SEQ ID NO: 33211 - protein, 411 aa, A.fumigatus
PVGQKRKAQNRAAQRAFRERKEKHLKDLEAKVEELQKASDNANQENGLLRAQVERLQLELKEYRKRLSWVTSTSGLSPVNAIPGAYSKGMYGLNNNEFMFDFPKFGDLPGSHLFTNTQTSKSNQNKAKDNPTATPRIEAQVPGVLNRNDLKISSPNGLSNGPSPAKSTPSGQTPNSQTSTRPGSGTLNGAVDNNGAARGYQVNSSYSASTKQATHDTPSSDSPSSSSDSHQSQLLSSNGTSPEPSLHSPAVKATESSTPHACTYTTINGEESFCAQLSMACGNINNPIPAVRQNSESASNTPSHANSSDKALGLDFFAQQNGGQFDPVLFGDWREPQDAILSQDFGTFFDDAFPLPDLGSPSHNFSEATKQPAAPKKDLIAEIDSKLDEDEEVVPGEDKSQMLTCNKIWYA

SEQ ID NO: 33212 - protein, 144 aa, A.fumigatus
TQRAGEIGRWQGHNTEEQANEEMISRSGLSTRRGGLVTGGCRCRCCRRVRGASLAEATTATSSTTSTAVGTTAASASTETTTSSASLAVTSTSALVSALGCVGASVANLPGAGITTVGKPRSSKNFRLGLPSWPRGLGFLCSAG

SEQ ID NO: 33213 - protein, 462 aa, A.fumigatus
PTPRHMYSSGGAEYQSPPVEGAHRTDVQTETTEKSVELSQATPNENMTQEVAEAGDVVMEDSEAVASAPATEPIPLRETMAEQAPSSAVKPQPADTERDSNEVDLLGSLEASLGGAVRDAQTGGSASLQTDAQVGAIAAESTSTNAAREVGETVTDGPLHQPSENVEEQHAKESPEQIVESAPVAAEQKAIEQPSEPSLEPSTMSIPEQPEQEMTEPTAETVANDTPEELNQEAPTAQPRESTYKALSAVDTEPVAQPAENEAPKSATPQVIEPATDSSIVPSTEPSAEAPSDQSTAPPTDQQPPGPSSEPHAEKPAQASPEQSTRPTEPLPPSTTEQTPTQPTQPSPEHMAPPTESLTPPSPEFEQIEESSQDQPQNQAPVTDIQKPQPAPLDKSQTPEAPSAPAPSAPEITEPPTQPSDAAPSDNDAAPQPVAEQEKAEPESKEGGEEAPAPSTSDLTAA

SEQ ID NO: 33214 - protein, 566 aa, A.fumigatus
  UNSURE (43): Identity of amino acid sequences at the above locations are unknown.
RVAPLTSTAIGNLKTTLCEEMKRADAERRLCGRSLGYSSLRLXPKTTGVRPILNLRRRNLQPGWAGKAPFLGPSINSTMTPIFNVLKYETARNPASLGSTLSFVGEIHTRLKSFKERLSQSHSSDRRQRLYFVKLDIQSCFDTIPQKELIPLVESLFSEEGYQIGKHVEVRPPDEFSSMWPVQESQQSKALRKYVGRAAPVSKAQALTDAITDGGISHRRNTVFVDTPAHKEYSGDYLLDLLDEHIRYNLVKVGRKYFRQRNGIPQGSILSSVLCNLFYAQMERESLSFLDPSEAVLLRLVDDFLLITINSKLAMRFLQVMLKGQPKYGISINPAKSLVNFSAMVDGVQIPRLEGSHLFPYCGSLIDTRTLEIYRDQDRILEGTDSAAGTISSSLTVEFTRAPGRSLHRKVLSSFKLQMHPMYLDTKHNSLTVVLWNLYANLVTSAMKMYRYMKALPHRAHPTPEVVIRVIRDLIELAHHMMRARRELKSRDSCSPYMCLVQQQQVRYLAAAAFRFVLGRKQTKYAKVLRWLEQVWKAARPQSDGKAARLAEVVRNGNSVFASWRF

SEQ ID NO: 33215 - protein, 65 aa, A.fumigatus
GINESPPTAWDHFTLLSDYSIPFRSTWKYGICLPLIDVYIAPVMFHYLQPTSGFPWYVSLERTME

SEQ ID NO: 33216 - protein, 95 aa, A.fumigatus
FFLHHATYTYLYPDSIATLLLTLPFRLLDSCCIQYLIDCNICDMSSIEKHKGHVDDDAQLAAMGHKAELDRNFSMLYEFFFFLDDDKKACLLSDY

SEQ ID NO: 33217 - protein, 269 aa, A.fumigatus
PPQLLHSASRPCFVALGSVGFWSEFDFTSPLNLKCSKMVFALDTATEADAPRIADIHMAAFHTNGMLLAQFPTPAVRKGLWTSLVDKVVKEIRDPQWEVLVAREADDRVVSFAKWCLPLSESTVYEEEPWVWPEGTNMAILNGWAKKVEQAAKEIMGKTPCYRTFCAIRLSDCDCLHPPGLSFIATDPSYALRGAGSLLVNWGIERSKEENIPIALESTLDAVPFYQRLGFQTEARISMPLEGIGKDGEAILYEEECLVYRPKARISCE

SEQ ID NO: 33218 - protein, 204 aa, A.fumigatus
GSSMSDDSHWLSLTSTHCRSRAPRSRNFPFPSDISGTVGDPQLAIARTASFKMQKIIRRTALARNQAQRKAIRAAKAAEREEFKDALRQRFAFNRIELDNVRAERIRRREDWLRGPLAPKRDAGLDAKTFGSLSPQAMNPPTIPKHLRRKYINIAAGDRVCIMKGRDKGKIGEVIKVDPNNETVMVKDLNMVRFHGCIRSMSTY

SEQ ID NO: 33219 - protein, 75 aa, A.fumigatus
  UNSURE (26),(34): Identity of amino acid sequences at the above locations are unknown.
VNINIFPLTENTPQHVPLFEDIAKYXSSPLARQXIPPTQPVEADEAPAAKKRKLQNGNPAGDTQVFTRGFYSAQR

SEQ ID NO: 33220 - protein, 123 aa, A.fumigatus
KMRNGTHSVWEVETPTWILSLHNPPFPPSVLDELRNPFSKYRTRHDPEWVESKKMEDLRKEYLQSRSLMTPKGEFLAMLRAKKAERMSARRDADGNYIMDDQTAGFIANFMQQNAAKKAGSSA

SEQ ID NO: 33221 - protein, 73 aa, A.fumigatus
FIVMSFATINRSATKTLSTSIPAIEDAFAAEPSLKKRVYDAIGTHIPTIFGFCQASAVTRCCCDYKLTLIFSL

SEQ ID NO: 33222 - protein, 293 aa, A.fumigatus
NSAYAAVVDFIRKVHRTNSTERLAKRDGLDNQMDSITQLEARANEVAAAARRLAEYCRNARVDGACLPAVVPSEAPRAIREIQRLLLSNVDHLQILLTEPADLVQRLAVQSQLLSCLQWLGEFQVLACLPLTDTVSIADLARLSGVPEAQLARIIRFTITIGFLQEPQRGHVAHSPLSSLFVSRPSLRDAVMFLADSAAPTALQMASATGRFGDTVASETDTAYNIAFDHRDPFYFACEQRPKLQRRWSAYLQYTGGDARDLTQQVLSRVDWFNLNNACVVEVNTAGMWSQWV

SEQ ID NO: 33223 - protein, 332 aa, A.fumigatus
ILSDAASHLVLERNWMRSPASSRRASALHRLCDSCRACGLSKVRCSKEKPTCSRCRRRGTVCEYVVTKRPGRKPDSRSEVEPEPGHLSHPLPSPESSTAISQGNLPDPDAFDPLFALPEPFDSTPELHSGPLSTVDSSLSSALTTWCPDFDDFFSFPVSTEDTLSGDRGAVYDGTIKHPPNLRRHSESPPAVPDDTIYLFGKPVDPAPPDQSLPATTTIGRRASPPSGRESEAGSRRLSCRCLIRALDLLKHFEVIRREAEIESSLPSIDAVVEVNKQTTEAITGMLQCPCSQKDGYLLVLLALIVCKILDRYAAAAIPFSPPRVEGSTLCV

SEQ ID NO: 33224 - protein, 163 aa, A.fumigatus
  UNSURE (26),(40),(50),(66),(83): Identity of amino acid sequences at the above locations are unknown.
LPGRGDFRHGRGIKFRQDPRIVLNGXFSAPDADARKFTPXTSAPAPALPXGSEALQPKAAPASTPXAPASADAPTTNGVKAAXEPDANSTAAKAIALVATEAGLGLSDLKDSASFSSLGIDSLMSLVISEKFRETLGVTVTGSLFLEYPTVGDLKSWLLEYYS

SEQ ID NO: 33225 - protein, 80 aa, A.fumigatus
QPLEDDFRVYVLPPSWMTWYKMGLSTYNVTAMGAAYGTAKSGIGISGVGTFRPDLIMKVCSFHPASCGEIIPSRCSNSLT

SEQ ID NO: 33226 - protein, 63 aa, A.fumigatus
HFLEGVRAYMQQSRVYVGMILILIFGEVLGLYGFVFPPIDNKDISVLTAVRLIVGLILNSKSK

SEQ ID NO: 33227 - protein, 303 aa, A.fumigatus
  UNSURE (146): Identity of amino acid sequences at the above locations are unknown.
RDRMADLGGQQGRNYRPYGHASSFQRDAAFSEIFGGAPPPGRSQTMNSQTPQFSQDRAHTMSSHVPHPQMQRPPPQPARQGPNGYTPAAPNGHYQAYPGPAAMAQQSSHNPPRPYPGRYVYPQPQRLDSRPAPGPQYPDVKGYGRXMPPPALNSDAYRSRSMARMGGPPGYQQPPLSSFNHTSASAFRQQPYSSTTPVTDQGRVVPVRHANERAMSLTSYSMDRDHSHTTQTGRVIPTRRQPSGPSQPPTRHFEEEPAIVHHVNGRPRPPSDGSTNSRVMSMASTIVPDRMLTTGVKGSALCV

SEQ ID NO: 33228 - protein, 474 aa, A.fumigatus
ITSTTLKKNHILSHITMGSITPSFSSLPRTSESYFSKRGQSALDQGRKRITWDVISDMWHPQRNHSGILSIGMAENTLLHDTLLEYIHANIRLSAEHLTYNNGSMGSNALRKAVSHFLNRQFKPFRPIEPSHVLVTNGCSSAIEHLSWTFLNPGDAVLLAMPYYSTFIADLSLRPEAVVVPVHLAGFQDPLDPKTIDKYEEAAVEFEARTGKKARAVMLCNPHNPLGRCYPRETVDRLMRLCQARGMHLISDEVYALSVWNNRLDNPNKVPFTPFKSILSRDTTNLIDSSLVHVLWGLSKDFGANGLRVGAVISQSSPDFHIAQKCLSLYSFVSSLSDQITTSILKDDTFTDNYIKMNQEKLSECHEFLALLLNKHRIEYMHGCNAGFFLWVNLGKRYLEAHPDEQKVRQREGQDEWGTKLTDVIFQKLLDNKVYVAHGTAYGSEKPGWFRLVFSHPLPWLEEAMARIIRAITQ

SEQ ID NO: 33229 - protein, 65 aa, A.fumigatus
  UNSURE (65): Identity of amino acid sequences at the above locations are unknown.
AITRASNYLPPFITTRRLTGCKTLINIEVSSKGTVGLLLWVTTNLSHFSPSNTQAIFRFQIQFEX

SEQ ID NO: 33230 - protein, 159 aa, A.fumigatus
GCREYHILSLLLKTCANSLQIDVSVNAPESGTIKELLVNEEDTVTVGQDLVKLELGGAPGPKEETATEKPKEPADVGKRPPVESNKPQPSEAPKASSPPPEQPPTAKPQPPAPKSDSPSDVKPSFEGREERRVRLQFPSTSALSLWHSLTRGCSVTPLG

SEQ ID NO: 33231 - protein, 136 aa, A.fumigatus
VKMNRMRLRIAERLKQSQNTAASLTTFNEVDMSSLMEFRKLYKDDVLKKTGVKLGFMSAFSRACVLAMKDVPAVNASIEGPNGGDTIVYRDYVDISVAVATEKGLVTPVVRNAETMDLVGIEKAIADLGKKVSGIM

SEQ ID NO: 33232 - protein, 166 aa, A.fumigatus
FAISNIQSLYCLHRGEVSTAWTFISRASLMCLGLGLHSSHAMVMEQENAGQRKMCLFWAVYALEKAVALRLGRPSTIRDQDITIPRLTLDRKMTSLAFNRLPDWINIASLYGRLYDSLYSPTALTQPGSVRVSRTSALASELERMIAARTEYYVSIKQLALCSQQS

SEQ ID NO: 33233 - protein, 275 aa, A.fumigatus
KPAMKYRGVVYDVGLNFSGTGFSVEPFNPALVKYDMKTIADELYANAVRIEGEELSRLEIAARSAHSMGLKVFLNPWKMNATIEETRAYFEEAAIIAERLHNEGIDLVFIAGCEYTIFNKGVFPGDSFNDRVMFLGRHFPSSHMIEDISQTLRDKSVELNKALRSFVEVIRSQFGGKVTYSAGSWEVVDWDIFDVVGIDYYRRGETAEKYVSCLDRYRIGKPLAVLEVGCCAYEGAAERGDGGFALLKGTNPDGTGIFENDIVRLHHGAGRGCSF

SEQ ID NO: 33234 - protein, 71 aa, A.fumigatus
IASGPSLNARLRFLGRSSSWTDFGSSGFGEDDSSAFSREYSLYLAAVDNAVSVSLLLKLKGSLHHGPQEPS

SEQ ID NO: 33235 - protein, 505 aa, A.fumigatus
RLPFNLSRRETDTALSTAAKYKEYSRLKALESSSPNPDDPKSVQLEERPKKRKRAFKDGPDAIQNSSTPRKTAKGALETPSKNRLSSSHPSQVDPYISPTALRRLFSPSTHRTPLKTAIGPTPQRDGKALGLFDLLSESGGSTATPSADRVASVRAANVRTPSKRKTMDTIMEEDEDGEEESPRLGRTPASSGKKWMLSALFATPTTLRYSAMVEDGNHITERNLGPPTDPEGTARDVAGPETPSFLRRSNSARYATSHSANPSLSPIAVRKPPQFVGKGLSALVQGLRDMEEERLEDDLDVLREIEAEQAALNVEVADSQAPAEIIGRHWKKKGQKRTTRRVRMKPVISKPASKPQSASDDENRHQAAGEEPAEPAAVPETQQPRALDAVFSEKQNEEFDDEDDQVSLHTISEPDLDSDPEYGEDIKPVTKSKSFSEKMKEAIGVAQPQPTEDPAKQSKPVIEAEETKKVRARKVNPEAHANYRSLKIRNKNSKGRGAGRFRRR

SEQ ID NO: 33236 - protein, 136 aa, A.fumigatus
FRGKIPVWPLKEPFHQSLYTDSSTAIMSPFLNCNSPGSEGWKSNKALTRETVAAEVPGGTACDVAVWVWLAGSETEVLGSALGSGAALGFSLMERASAICSSSSSFCRSASVISRFPGLDGGCRLGSEKKRSVLAS

SEQ ID NO: 33237 - protein, 235 aa, A.fumigatus
GSRDTNAGYDARTDLFFSDPNLQPPSKPGKREITEADRQKEEEELQMALALSIREKPSAAPEPKAEPSTSVSEPASQTQTATSQAVPPGTSAATVSRVRALFDFQPSEPGELQFRKGDIIAVLESVYKDWWKGSLRGQTGIFPLNYVEKLPDPTVEELQREAQMEAEVFGQIKNVEKLLTLLSTRSSELNVQDNEEITSLYHSTLSIRPKLIELIGKYSQKKGMSKKTPRCNSFG

SEQ ID NO: 33238 - protein, 262 aa, A.fumigatus
YRLDEFTQLNEKFIKARRDYESLLEASMAHPAQPQYGRPGQAPYGYPGPAAPLGYPQGPPQSDPQRYFSPRPQDQTHMYPPTSHSPDPRGRTPPAGPSFPQHQQPPPDSYQPVHHRPESTYDNPQELGTSVYDSPVEHPSSSQRLPYPPSGAQVPPGVHQQFQHQQQEYPPSGYPPEDASKPPAAGFALQPPQQTLQQPPYPTAPGAHQPTPSHQPPPVPSTASKPTPYPSLTPGTPSGGEYQAYNPSQAGAANSNPNSYYR

SEQ ID NO: 33239 - protein, 104 aa, A.fumigatus
VLLYMIHPSNIRLQVSGYPILPLAHKFHLVSTSSSSISNKSTRLQAIPPRTPPSLLLPASPYNRRNRHYNNLLTLRHRALINRLHRTSHHQSPVRRRSQPPILH

SEQ ID NO: 33240 - protein, 179 aa, A.fumigatus
  UNSURE (178): Identity of amino acid sequences at the above locations are unknown.
ILPRPRDDDLIIRTQNGTWQDIVLQVGHSPLWPVDFPHAVHKHGNEFWRLGSGQGLWKYSSVSEAFADHPENFNMVNPPYRDTFLTEFTGTMWVVLRYQVTSPGAWLLHCHFEMHLDNGMAMAILDGVDKWPKVPDEYALGSHGFRVDGKNGLQHYFFQQGHGPANQPNVCIAVGELXS

SEQ ID NO: 33241 - protein, 111 aa, A.fumigatus
QRRDAEYKLKITIATQAGTLRSVEILVFDLDSAPRSRSIWITLLLPCSKYTLLRPPWHACSQRGAESGSKGYVPFLDIHIFSLKFYLDCGPVAIMTAKWNERIFYHMKINI

SEQ ID NO: 33242 - protein, 133 aa, A.fumigatus
GNGELRAMTATLAAIRGSDAYEVADPEPSGRRNRIFSEFREELAGTIDEASGMPAYARDRWVSINWIGGWTFKSLQPTIDEHEMWIYEVDGHYIEPRRAETFLIWAGERYSALVQLDKKPMDYSIRVPDGGYL

SEQ ID NO: 33243 - protein, 112 aa, A.fumigatus
MISAFGILQYKNSNLDAHRPPDWFSVTTISQPFFDYNAWPTWDGIVFLDKLDLPPWPPKAPFTGDGDTMHVLYLGKANSTWEFTLSGKKKYPSDRSAYHPLLYNVNSPEASR

SEQ ID NO: 33244 - protein, 120 aa, A.fumigatus
PIDRGHKLAFQTPHLLSLQAPLGIRRRSCSSCPTAQGQPPHMHHCRVLRPKSPSLLSTRRSLKNDVDVHCTVDELVGSYLKEIRTRQPTGPYHLAGWSAGGILAYRAAQILLARGEQVPC

SEQ ID NO: 33245 - protein, 138 aa, A.fumigatus
VLLDAPPPMGLGTLPQHFFDHCDAMGIFGQEGKAPEWLIPHFKKTNAILSGYYATPFVAGQGPDRTGIIWASQSVFDSKGCARPAPRPEDMEDMKFLTEARTDFSAGIWGSLFPGAEVVVDKADGANHFSMMVRASVL

SEQ ID NO: 33246 - protein, 181 aa, A.fumigatus
FSPTRPSCGRLCSSPISTAWDVVVSFVVAQIFTAPPYSLDAVDIGYMSAGPVIGGTLGSIVCGLVSDPVARALARRNRGVYEPEFRLVLIIPMLIASALGWFLFGNLVVAGTSPSVVAVVWAITTISRQFGMTTIGAYILDGVSKHLVRGVYHRDGDEELCVLWAFVCVPFFLVHWILGCC

SEQ ID NO: 33247 - protein, 107 aa, A.fumigatus
EIWGEPLSEQGLVPTNATQSVPRKMAFGILSPSHGPQHVGGTSLLDTSGVDEAPSVAELERGTGKHAKTVLIPQPSKDPNDPLRWPLWQRDLMFLMHIYCTILCVGG

SEQ ID NO: 33248 - protein, 96 aa, A.fumigatus
IIYTRSAYNMLEAFEVLTTSGVVLWSKSYAPVGAHVVNSLINDVFIEEKVRAQNQAASSAAPIYKKEKYTLKWKQVKDFNLIFVVCSRRSLIQWRH

SEQ ID NO: 33249 - protein, 220 aa, A.fumigatus
FNRYVSIPALKHYFNVSNSYVLNKLALVLFPWRHKPWSRQQARLTTSSAGPNGQIAQQQYSSMFLPPRDDLNSPDMYIPVMALVTYILLSAVLAGFRGQFHPELLGSITTTAIAVIVFEILCLKLAMYILSINNESQLLDLVAYSGYKFVGIIATLVMSEILTPGRGTGGWVGWVVFMYTFLANAFFLVSDKFFVTSAFQSVDKLPAPLVEVRSTPRLNQ

SEQ ID NO: 33250 - protein, 168 aa, A.fumigatus
KTRRRDRIVASLLFITSFSLIVTREKKINMYRQSFAPPPAQSPPLHHPVPQHVSTVPMMRSPPPPASQQPPSSGYGNPYQPSPAQGGSGTYAPGFSGFINDPTAQMGFQVGKTAMAAGQEYMEQNVSWLTKKPTAPQTYELLLIFHSSIAMSPSQLSSITSTYQILTS

SEQ ID NO: 33251 - protein, 113 aa, A.fumigatus
GTFIKCSILCQYLRIFPSRRFRFACHTVMGIVALYSTWAIVSAFVNCIPVARFWDRDIPGSCLSFEAVWFFNASMNIATDLTLLIMPMPLISQLQLPRMQKIALMAVFAVGLL

SEQ ID NO: 33252 - protein, 71 aa, A.fumigatus
LRSWYVCQLYLASFFIIELARMILARIKLQQKNDQPSEAQSSHNALNHAITNSDSKVTTSVCSSNGNSQSI

SEQ ID NO: 33253 - protein, 329 aa, A.fumigatus
RSEWLRIGPPGRCHDDPTTFYKHNGHQHTHMHSGSNSLSTVPAQGESIDMPSALRTFTLNFVGDVMLGRLVDQLWPQHVDNAHERRVVSYFIERYPYLSKYTHRDPWGSALPLFHNSDLNLINLETSATTTNDPWPSKAFNYRMHPANAAALREARIDYATLANNHTLDFGTDGLVETVWTMKESKIAFAGAGETTDESRRPAVLRLPRCAEAHAQDSHEQSSKSYSVHVYAASDHPRDWAVVPTFHLIDYSARTREHLRTLLTSPPASTDTPEKPALKIFSVHWGPNYTWQPAEKIRSLAHFLIDECGVDIVHGHSSHHVHGVDRHRQ

SEQ ID NO: 33254 - protein, 121 aa, A.fumigatus
STLVCSYILTLCRLPVPSLWLDVFQKIKALGFNCVSFYVDWALLEGKPGEYRAEGNFALEPFFDVAKQAGIYLLARPGPYINAEASGGGFPGWLQRVNGTLRTSDPAYLKATDKYVAYDCL

SEQ ID NO: 33255 - protein, 91 aa, A.fumigatus
ISYIAHVAATIAKGQITNGGPVILYQPENEYSGACCDATFPDGDYMQYVIDQARNAGIVVPLINNDAWTGGHNAPGTGKGEVDIYGHDSYP

SEQ ID NO: 33256 - protein, 101 aa, A.fumigatus
GHPSVWPKGNLPTTFRTDHLKQSPTTPYSLIEVCVCLKCPRIRTPLIVVQFQAGSFDPWGGPGFAACAALVNHEFERVFYKNDLSFGAAILNLYMVWKDPA

SEQ ID NO: 33257 - protein, 412 aa, A.fumigatus
  UNSURE (340),(406): Identity of amino acid sequences at the above locations are unknown.
FRADRNSVYNYWVPQLDKDDSSTGYSSEKTTASSIIVKAGYLVRTAYTKGSGLYLTADFNATTPVEVIGAPSNVRNLYINGEKTQFKTDKNGIWSTEVKYSAPKIKLPSMKDLDWKYLDTLQEVQSTYDDSAWPAADLDTTPNTLRPLTTPKSLYSSDYGFHTGYLIYRGHFVADGSETTFDVRTQGGSAFGSSVWLNESFLGSWTGLNANADYNSTYKLPQVEQGKNYVLTILIDTMGLNENWVVGTDEMKNPRGILSYKLSGRDASAITWKLTGNLGGEDYQDKIRGPLNEGGLYAERQGFHQPQPPSQKWKSASPLDGLSKPGIGFYTAQFDLDIPXGWDVPLYFNFGNSTKSAYRVQLYVNGYQYGKFVSNIGPQTSFPVPQGILNYQGNNWVALTLWALEXDGAKFG

SEQ ID NO: 33258 - protein, 60 aa, A.fumigatus
  UNSURE (2),(3),(5): Identity of amino acid sequences at the above locations are unknown.
GXXFXMHHRRILLSPVVKTDEKSLFVNGERIMIFSGEVHPFRCDTDAVIYSGLFLHSYIV

SEQ ID NO: 33259 - protein, 224 aa, A.fumigatus
TFGGTNWGNLGHPGGYTSYDYGSPLTESRNVTREKYSELKLIGNFVKASQSYILVTPGNLTTSGYADTADLTVTPLLGNGTGSYFVVRHTDYTSQACTPYKLSLPTSAGRLTVPQLGGTLTLNGRDSKIHVVDYNVAGTNIIYSTAEVFTWKNFGDSKVLILYGGPGEHHELAVSLKSDVQVVEGSNSEFKSKKVGDVVVVAWDVSPSRRIVQIGDLKIFLLGE

SEQ ID NO: 33260 - protein, 502 aa, A.fumigatus
TSTPYSRYCTPRQRTEILILAKVMSSEKLLFPRPHFFEGSKLNFAENLLYPASSPAEDTTAVISATESDREFVSWKELRERVRKCANSLREAGLQAGDRVAGFLGNHANTVIAMLATTSIGAYWTGVSPDTGVHAVLERLRQIEPKILFADNASLYNGKVHSAHEKIRQIVSELPELQLLVVFETIKSHQFNVDEVKPTQGKACTYDTFLASVSNASAALEFASLDPDHPVYILYSSGTTGAPKPIVHGALGTLLQHKKEHVLHCDIHPGDRLFYFTTTTWMMWHWLVSGLASGATIVLYDGSPFRPLDPEGGNGEMAMPRLIDELSITHFGTSAKYLSILEQASLKPTQHPHRPVTLRTLKAIFSTGSPLAPSTFEYVYSSIHPDIMLGSITGGTDILSLFCACCPILPVYKGEIQCRCLGMAVSAYDYSGSDISGTNEPGDLVCTLPFPAQPVMFWPPGPVGAEKYRKSYFDIFGPSIWHHGDFVRINPHTGGVHMPGPN

SEQ ID NO: 33261 - protein, 96 aa, A.fumigatus
SPRLHTLLIWHHWCAETHCPWSAGNVAAAQEGARAPLRYSSRRPLVLFYDHNLDDVALVGVWSCQRCHHRPLRRFSFPTLGPGRRERGDGHAASDR

SEQ ID NO: 33262 - protein, 163 aa, A.fumigatus
EDVGTTGDGTQHNVRMNGRVHIFECRGRKRRPGAENSLQCSQSHWPVRMLRWFEGGLLQDGKVFCRCPEMCDTQLIDQTRHGHLPVPSFRVQGSERRTVVEDDGGTAGKTRHQPVPHHPSCGRKIEQAVSWMNIAMEHVLLLVLQQRSQRSMDNGFRRTSGAR

SEQ ID NO: 33263 - protein, 220 aa, A.fumigatus
QSTMSSNVGLSTPRGSGTSGYVQRNYAFMKPRNAGYGAPYPPVSGANANDSSRGFKQRQPDKQILEHDRRRAVEVKVMEERERLEEENERIEQEGKGKGEGEGKVLSEEEIEERCEALRARLLKEMEEEENRKGDAADGERDEGRERRGWKRGPRDRERDLPPRERRQFKTYQVHELAEAKIEESERFKKALGIREDTETGEISSGRKDYEPRKRDRERY

SEQ ID NO: 33264 - protein, 136 aa, A.fumigatus
YVLNCLLSLGGRSRSLSLGPRFHPLRSLPSSLSPSAASPLRFSSSSISFNNLALSASHRSSISSSDNTFPSPSPLPLPSCSIRSFSSSSLSLSSITFTSTARRRSCSKICLSGCRCLNPRLESLAFAPETGGYGAP

SEQ ID NO: 33265 - protein, 181 aa, A.fumigatus
LKCFVAEALNLLKSYDTLVKSCSHTTSEEAYFSRPHAHPHQAPLPLIPSESELSELLPPCALPCDSTTSAADVRGTSIALFSPIIIGCMPTQVPIAFPVVSIGFSGLIKRAHQAVWPVFEDDMWKPSERLMETIRHYASFPATGVSLRQMVQFGDRPSTGMCIHLVLLEYLEVFQLGRSQG

SEQ ID NO: 33266 - protein, 235 aa, A.fumigatus
VKCPRSRRCRTGMRSRSRYDSTPHPSCSRNSCSRAPQEIINLPRPTLSQEVKARLLRPGKMSGGFSKILSETTQNPSIKEGQYRSSPTNGNGNGKGHVSRRYFYPSDDQGHWPPELNDYNQRFAKTLQHIKRRHDSVVTTVAQGILEWKRKRQRLQIDSTVQSFLDRFYMSRIGIRMLIGQHIALTEQTHVRHPNYVGIICTKTNVREVALEAIDNARFVCEVFTTGVAASALRY

SEQ ID NO: 33267 - protein, 338 aa, A.fumigatus
  UNSURE (194): Identity of amino acid sequences at the above locations are unknown.
FRVPGSSDAAPSPTPQLPSEPSLQSLSQEPPVSSSQSLPERPSQTKTVDSNQDATQSDKRFRRRLSEQPPSKRQRTLSYSLFPAPIDRARFLGDLTTTPKKMSQAVQPESRPDEAEKPSAAQDQPPSTSQVTDVSEQGPLLQTAEDTTQKKRKRSPSPDVIPNPAGCSYGLDLDYFCYSSDSEEEADVQPQQAXPPTKPDALVKSAVRSAMRSEQASAKRVRFDASPEDTPSKLRTRPRATDPYTGRHFIGMGDAARVTTHGSLAAAPATPTPAPRVDLSTPQRSPGFIPNKQGTFQLDYDAFSDDSESSGAPSPKSPAAKSVTETQTTTTSTEVQER

SEQ ID NO: 33268 - protein, 86 aa, A.fumigatus
GLWATQPAAERASLGLRRATLVLLLHPRVLRFYLRPRVNDNCSARVHPPPSSRGPFIVNMAEQMVLRGTLEGHNGWVTSLATSLEK

SEQ ID NO: 33269 - protein, 77 aa, A.fumigatus
RNVCFGRLWALIEHVDKLILTWMFLSNSPNMLLSGSRDKTLIIWNLTRDEQAYGYPKRSLEGHSHIVSDCVCYPKSH

SEQ ID NO: 33270 - protein, 156 aa, A.fumigatus
RDWLTACVFCSVQVISSDGAYALSASWDKSLRLWELATGETTRTFVGHTSDVLSVSFSADNRQIVSGSRDRTIKLWNTLGDCKFTITDKGHTDWVSCVRFSPNPQNPVIVSAGWDKLVKVRLSRSFPDAMYTQFETVCPNDVLHNTYLLLQSLLWP

SEQ ID NO: 33271 - protein, 179 aa, A.fumigatus
WTLRNLGFAPLCMGPTHLFPWGIEANPRIPFRFGSSLPAASRPTTSVTPVTSTPSPSPPMDPSAPPVARTAPPCSGISTSPSTSTPSTLATRSTPSSSPPTATGSAPPPPAPSPSSISRRRARLMSSSPSSSRRAPRPVSPSVSLSPGALMARLCSLVTLTTRSVPGVSCRGHRGLTSV

SEQ ID NO: 33272 - protein, 284 aa, A.fumigatus
PRVCFVPCRSSPPTVPTLCLPLGTSPSACGSSLPARPLVPSLATPATSSPSPSPPTTARSSPVLVTAPSSCGTPSATASLPSPTRATPTGFPAFASAPTPRTPSSFPLAGTSSSRYVYPDLSLTRCIPNSKPSAQMMFCIIRICYFRAFYGHETNNHQCPDGHFAILVLHLYAWDQLIYSPGGLKLTQGYPLGLGARFLPPPDRPHRSHRLHQHRHHLPRWIPLRLRWQGRHHHALGSQRVQAPLLPPRWRRDPRPRLLPQPLLALRRHRQLHHHLRSREEEQG

SEQ ID NO: 33273 - protein, 141 aa, A.fumigatus
VWELASCRLQTDHIGHTGYINTVTISPDGSLCASGGKDGTTMLWDLNESKHLYSLHAGDEIHALVFSPNRYWLCAATASSITIFDLEKKSKVDELKPEFIEKSSKAREPECISLAWSADGQTLFAGYTDNKIRAWGVMSRA

SEQ ID NO: 33274 - protein, 318 aa, A.fumigatus
LASILSQKRWWESISQVSRMLEKAGLAKPAIQVLERTKTECLKWVEEGRKKKDAQRPEAEAVTESIQIDDPDALVMHQKMKELDEYEDRQRDKVLKKVVGIHMKLAELYASDYIQDEKKAEGYQEAAVELCLKELRRRQELGLPVGSASQDSTAWLNLSEIATALTDLGQTYLKQEKNELAMPLLLRALDLLRTDEGSTPSCKQVTLLANVSTAITGELHKKTPSRGSTAAPQQLIDSGNQWAQKALDVAANLQPPIRDEECDVSCIAAMYNLGEIAHLQGKRKEAEQYWKEAKSLARGLGLEENAAHVEEALAQLTK

SEQ ID NO: 33275 - protein, 184 aa, A.fumigatus
TPKRAILTHEQHQLGTKVSPADFKPEFRAETYPPGTAPASNSYTPNTTGESGGQALNPLVERSHGKEAVKTTAESTLRGATSKDVHRGLGHPGSGQTKTEIKHDGQHHRKHEGAGLEGVGSYREDKFERTLADQRGIEREEARPNDHGDKGVSAAEDIPPQSAEMAAHEWKYEPGTKKDNAARH

SEQ ID NO: 33276 - protein, 141 aa, A.fumigatus
YTCSIVLQKLIDGGHKVIIITHAYKGRTGVRYLTNGLKVYHIPFFVIYRESTMPTVFSFFPLFRNIVIREQVQIVHGHGSMSSLCHEAILHARTMGLRTVFTDHSLFGFADAGSILANKMLKFTLSDVDHVICVSHTWYVR

SEQ ID NO: 33277 - protein, 343 aa, A.fumigatus
VLPGDSKENTVLRASLDPLMVSVIPNAVVAENFRPLSHDAQKGERTSGEIERRPSPAPIGPDDTITIVVISRLFYNKGTDLLIAVIPRILASHPNVRFIVAGSGPQAIDLEQMLERNVLQDKVELLGSIRHEEVRDVMVRGHIYLHPSLTEAFGTVIVEAASCGLYVVCTRVGGIPEVLPQHMTTFAKPEEDDLVLATEKAIAALRSNKVRTDRFHDQVKMMYSWTDVAQRTERVYKGITGDISPEEFYGYYPGQGWEANADRVRSFALIDRLKRYYGCGVWAGKLFCLCAVIDFLLYVFLEMWFPRSNIDIARSWPKKLGPNGEKSHHLNNRARTSQERLAP

SEQ ID NO: 33278 - protein, 587 aa, A.fumigatus
LPRSEGPSSRLVKTQNRDSNFDVLDYVDPLIGTSNGGHSFAGATLPFGMAKAVADTQGENQAGFAYDTQVVTGFSHMHDSGTGGSPSLGNFPLFAHASCPGDDLNQCKWQQPDRAVAWVPNSPKARPGYFSIALENGVNAEMTVTNRSALYRFKFSGASGPLSPVILVDLIDLPQSRTNGTASVDPLTGRLTGNGTFNPSFGIGSYVLHFCADFKGAELRDTGVWLKTRAGTNQTTVSVTPDGTNTASTLSAGTFARFHAPADKTILARVGVSFISVEQACSNGEREQPDFDFDGTVSAAEKAWREKLQVIEVDAESVSADLQKVFWSGVYRTMISPQDYTGENPLWQSEEPYYDSYYCIWDSYRGVHQLLTLLDPISQSRMIRSLVDIYRHEGYLPDCRMSLCKGFTQGGSNADVLIADAYFKNVSDVDWATAYEAVVKDAEVEPANWNVEGRGGLQSWKTLGYIPTDDYDPYGIGTHTRSISRTVEYAYNDFCIAALAKRLGHDADFEKYIQRSTNWQNMFKEDQRSYINGLDTGFAGFLQPRYLNGTWGFQDPIFCSPLYNFTSCYLNPAGHETYEGSCWLYTL

SEQ ID NO: 33279 - protein, 117 aa, A.fumigatus
  UNSURE (115): Identity of amino acid sequences at the above locations are unknown.
PAALSYVPHDMASLITRLGGPETFTSRLSYLHDSGILYVGDEQAFLPVFQFHYSGRPGLSAARAHFYIPSQFNATIPGIPGNDDGGAMGAFAVLSMMGLHHGAGRIRRWRYVYQXQQ

SEQ ID NO: 33280 - protein, 316 aa, A.fumigatus
HALSTDVKLQLAPAYGDFLAALPPNPSTSALAGKMTDKLVAEFRYLLAQATGSTAKFLQYLTYGYMIDNIALLITGTLHERDTRELLERCHPLGWFETLPVLCVATNIEELYNSVLIETPLADYFKGSLSHQDLDELNIEIVRNTLYKNYLEDFHNFVNTHPDFKGTPTQEVMSELLQFEADRRAINITLNSFGTELSKQERRKLYPEFGKLYPEGSLMLSRADDLEGVSLAVSVNADYKAFFDAVGLSQGGGGGFGMGGGSDGKSLEDLFYQKEMELCKIVFTRQFTPAVVYAWMRLKEQVRRSSSMTIFPSQRR

SEQ ID NO: 33281 - protein, 245 aa, A.fumigatus
RASRNSTVLLQLWKKWLRLWKERLLLALPACWMRLRMRRRFLWPLPIPSSVRDMNILRSQITQFLILCLPKGNAIGKLPGMSIQLVADSTTTDIFRAIREHLPTLIPGLLPQDMSTMSLGLSHSLARHKLKFSPDKIDTMIVQAIGLLDDLDKELNTYAMRVKEWYGWHFPELAKILNDNIAYAKLVLKMGMRSNWETADLTEILPEELEATVKAAADRSMGTEISQEDLENIQALAEQVVGFAE

SEQ ID NO: 33282 - protein, 134 aa, A.fumigatus
THIADPSSPVVKILPPVPANFRVANKDTTLPVGGGPDQKSPVYIRKGTIVTYSVYAMHRRTDFYGPDANEFRPERWEENGKRGWEYLPFNGGPRICLGREFLLSLTRPQFLANICRTIRTHGGQLHDCQVTSAI

SEQ ID NO: 33283 - protein, 341 aa, A.fumigatus
  UNSURE (325): Identity of amino acid sequences at the above locations are unknown.
QVQIHQLRTLLSGRLIEPIIPIINPKVASRRPLPKSPRVLFEQLSQTARASVAEVQEFQAMWRSPEMKAIWDHVDARIKQNGGQLLQPTGMWEQDYDVLLEELEKEEQAQKEQQQRAKEEEERAKIQGVEGGWRTIVETFTRRNLPGIRVMAHQDQPRITVVSVKAGMAFQLQAVNGDGHDMVDWRVQELAAPGRPKTKLETAVAACLNARPRQWDLAYLLVSSNIDINNRYNGTRLTLNSGHDSLLLRRQTDAVREMRQNDRQRRATALRPQAQPPPIVPRPTIPLGSIPPHLHRSSPGLSPYLHLIMHPMHNIMPAGYSPPPXSQYPPRKLNGPLLLPP

SEQ ID NO: 33284 - protein, 60 aa, A.fumigatus
LTSAEQYALTEASFTIVKLLQRFDRIENGDPDLIEPIQQTNLTLAHDRGVYIRLYSSKAL

SEQ ID NO: 33285 - protein, 79 aa, A.fumigatus
  UNSURE (63): Identity of amino acid sequences at the above locations are unknown.
PTTPRNCPPSAGPTPSNRPKANHSSGKHTTPPASILPRSLALPSPNHAPHAQHHARRILPPPXIPISPPEIKWAPPPPS

SEQ ID NO: 33286 - protein, 530 aa, A.fumigatus
RLDLFDLEEFYQRLANWVGNPTVDEDTVSSIFYLVLAIGVQVSEVNQDLAEQYFVSGRQLAFSAFTETPSIYTIQSYVLISMYMLGACRRNGAFMNLGIALRAAYAVGIHRRDANALFCTRERRARERVWKSLRMIDLFLSASLGRPPATSDFDHDVRDPATLAGEQQLPRPEAQLSQCVVALCRIFDRILTEVYMKQVVSINVAETISNQHRAWVRYLATFFSGQTERLSSKNLESMLAAAHVFGAYYWSIILLTRPFFIFRVSQYVKSKSDPGISSNDPRASASRIAIFSDACVYSALRCLNIVDDLSRFEALPRRLPFLINSVFNSAVVLGAAFFAEYDNLLPLEEGMDKSEKFLGLFVPHDPHACRFYQIIKYLRGAVAEYVRRRNRQWMERRSKQVDQLFGQVGLRSEPSASSDDVVISRNGEPLAPSPSSPEKLATGSLSAQGAQPTASTGESENDIWNTLCGTQGATALPYDSTISTLTTTGIPIGCSPGGTLTTAQPGMDTDAGGRRPSFPRGDEGAAKSAL

SEQ ID NO: 33287 - protein, 71 aa, A.fumigatus
AIYYFSLLRNLLDINDNGDKTHHLSPFSILWSTVIVVTKYSATSSSLLVLPRGSLFAASDLQYSLFLPFPP

SEQ ID NO: 33288 - protein, 93 aa, A.fumigatus
  UNSURE (86),(87),(88),(91): Identity of amino acid sequences at the above locations are unknown.
QYPHTGYQRNSCGYCKSDNGSECVFFITCPTSSHLPSFSSLCFNAFADQYMQVLPTTLVLFQYARNITISSSIAAVFTTGWQGRAXXXSIXTP

SEQ ID NO: 33289 - protein, 1060 aa, A.fumigatus
  UNSURE (1060): Identity of amino acid sequences at the above locations are unknown.
GYLSSDKDMAIPRTPVKSGQELYQLIEILNQQFHLEIPNPRIYSPSVGRNEQTPRWRTYKGLKRLYFNREVGLGRILNDFEEWVHSRPTSHLRTHSGVGRISQSRSALSRRDQLMVEDATVISTHEKNERLEYLLKLVDDEIYLLSRGSVRVCADDNRMQISPSTVLRPPKRRIPEEEEDDEEYHTAPNSPVKNPTVQDHVAVDGDELQPLATDRDNWNTGSSLMVNESVHVFKTPMALDRGKEPSRFLEKLTAPDNVHRYDTAPSAHAGLSFTFSSVATSFGRESRRQLDTSFTSTVTDVTEPMVDSDSMYEDSVVGHLISHELDVTIDDIGPMTETPPEEAPHSIEGRIMEQLLHSGPFSLDQPFPKSIPLRYRYELERVGRAWGVPLGRMLVGSSMSFKSYGEFWKWIEGHNQRCGKPLPEKSTSKAWEAVTGSFKTDKHSEVVILSGDLDWCSESEPGILKFKLNPLKTERTCRFRRRFGSDRYLSLTMPAPARPPRHLRFSSHPTLLRESLALWLTQHVHRCLGRTWRPFYVEDVKTKRKVKTTEPRFRVEFFAIDGVDFGHSPGTVPSIAPQGQDSDNHTPMSLEALIDWHMPLEANVNQSNCKLFQRISLGLSKTYATVTLKPWQILHLRDVPNRPVMNDGCALMSRPLANAICDQLGITGNTPSAFQGRIAGAKGLWMVDRHNSGISGGGDDFWIQISDSQLKIQPHPQAWRGPVDDEKLTFEVVKWSKPLHPVELNTQLLAILEHGGQVREHIAELTRAGIRAISQDFASVLESNSAALCRSLIQKIKPMADDGLSGINQRMKRLEQWTANDAEAIIRLTEAGFAPRSFYPLRRRLGRCLRDLLDRYVDELHIEVPLSTYAFCIADPYGVLKEDEVHFGFSNNWRDARGQFEDNLLDGVDVLVGRLPAHVPSDIQRRRAVWKTELRHFKDVIVFPTTGDIPLAHMLSGGDYDGDTPWICWDQNIVQRFQNSDLPTEEYPPEHFGLTKHSVSMRDIQSTDEFLQSAFTFNLTTSNLCRCTVEHEKNAYDESIDSARAKELACLLSHLVDGRX

SEQ ID NO: 33290 - protein, 171 aa, A.fumigatus
PRKLWQGGLSNFEASVNERIDAANVTRRCEQPQQSQQQHLPPPNGPQLNNPPASNLLLPAMTNGHWKTEELGYFWPDMPEDASIKQYNTSLFYKDVNVFTDRVKDVIDYKGEPLVKANLQVSLRGAALDWFTNELTELEKQSLCALPLDQGWLPELVKRFRPRAADALVKL

SEQ ID NO: 33291 - protein, 77 aa, A.fumigatus
SLSYGYNDVRNDRTPRAFAQDVICHARAAQVNDIFNQITMVWTRLEPYLRRDIPKPTPTTTLTQFLEQLESRSGIVF

SEQ ID NO: 33292 - protein, 695 aa, A.fumigatus
LPGSLKLSEVEMEGSVVEGISTSLPTCPLFSQPHDSQSLFAPEGLPTPPSYHDMHVNDLGLTPPPGSQLLQPTNATGPKPLHDEHGSSSGDVRISMAGQPTGSNHDHQTRGSRKGTSDDPSPLKRRRSSNPEVGPFFPDGPAASPIGSIEVAANAAAQTRLPQPLSSNNTPNADNLLYDPLFGPDFMLPNFDANPSSLKRTADEALADDFQVWHRPEKRLIPDSLQCSNAPSLDATPSLSSPDTIQLDHFETVPNTPGGIADSQLPAPPFDPFGSLFEDPAFHIPSDLSKIEYSSENRQAPHSADAEPSYDASCPPSFNVQVQAADPVTFDHETESVSLSTSELTKRQFSLDTQDVLANADRETLQRVDHVPEYTSPYPMYHGPLGYLPSAPGIHVKCIQIANDQVNARFSHLKYKVQQLKYERDKYRDAWSKWTALEASTGKPRAQILEEENATLRRVSTQHQRRAEQYKQEIEVWKGRLHDLSVIYNNLLYEIQVQKKIPAVAPIPRGYRPRYQPQAATHVQSVAPGQQLASTPYIPVPHQNSPPSNFPPSGITTGSVQHPSPAEPLPETMTIDLTDEAPNVSPNPSSIAPSKPMQESGELLQSLQKKKYNWLETAKLGSAQPVVARAGPRPLPRPESAPRASQLPPPPRSSSNQQPSIPHPVTQAASSVNHDDEIDVEDDLLHEMEEELARG

SEQ ID NO: 33293 - protein, 65 aa, A.fumigatus
WDRKRDGRTRHRDGQGLGTATGCNFISVYRWWTIVRCWIQFHYLSTSEGRITRRNKTAFTLKVIY

SEQ ID NO: 33294 - protein, 486 aa, A.fumigatus
QTPRMNMAKKPATRLMLTAALLSAVILVAKLQSNHFDLQTSFLSSYHSTAGHYGQSHIKAGESKTACSGGPGSEAWSHCQDGQSADEDERRAEQLAKEMSSTHHILYSVSSADRKYFKIDFGSRSVMNPSIIPHPELLDTWIITAQLHKPPSARMASVWFAELVCNAAFSADKRVLRCLEPPLQLPIPATVGDSSKCVGDLSYFSLSVGPHDARVFYGPEIPYTIYGSNSFFTCFGQWISDFRILVDWGIDTIHEHEFRQPRELQRPVPWNAVEKNWFLFWDDDGQMFLHHDIAPVRVFAKVELDGSVGPNLALATATADQACLTRFLPLSTGPSESIHQATNSLAVTLCARSDPSCHPDTAHTFVLFVVQRKTLHGLHPVYEPYVVLTRRSTPYEIYAVSSKPIWIFGRNPAAKTTEGASSALVAADSEMLYMTSISWKSHGQKYHGHIDDTLFLAFGREDSAAGGIDVAARDLLSELGMCAGPD

SEQ ID NO: 33295 - protein, 369 aa, A.fumigatus
WFPGDLLLRHRRRCLRSDEPAMRRKACNACVQAKTKCCYTQPTCSRCAKRGLVCEYMSMAKTAATIASASSASSASASSSSLSAKDPSQPDETSVSATDLPLLLWSRRSPLDDPGADHADSWSSQNFLWALDTINLPSLPSASTSMVNEVTLGPAPAIPTRHPSLTFPLTSPSSQPSSYNPLVEETIAPPASGIPDLSTTRTGLGSQEDATTDSPPAPLSKPDGQGGRPANYASLLLQYPKRLLQDDFYCPFLHRTLFNDDMPDMTILPHTSMAICCGSALGNRDGVGYIKRAMDAQRQSLIESYVSTVAMRERLVTSSGLTTRLSSQPTTVWSSGTRCMRCSSMRSWRWAWRPSTNRRAGNESDAPEG

SEQ ID NO: 33296 - protein, 70 aa, A.fumigatus
IGQDIAHKPGVAHALLVISYRAIPFDAATSTMPGSEPPNQAHVCDSCFKSYQRRVSCLVSIVVHASGADI

SEQ ID NO: 33297 - protein, 250 aa, A.fumigatus
RADNETVQPTYHCLEQWDALHAMLLYEILEMGMAPIHESESWKRKRRTRGLKSPFLSKMTQCFSRSYLECHDVALLPDTDPNRSWVQWAVTETARRTMFLANIVNFFSNRDLESGRQLPYYEPLNDELIMKMPLPCNQALWSARTEDEWRRATQMANKQASPAGSPGTSDAFAPLGAAAAASAAGPAAGPPNAVGEPLPNHHHLHLLSLQSLFSKFAKDYLRANFTTNAGFGDSNELRSFIILCALEQFS

SEQ ID NO: 33298 - protein, 65 aa, A.fumigatus
SLGMACSAAAVGVLFFLEDDQCNLAYLSIYCGCSSSEQISVPSHPITADYSKLVNDYGPGEMISQ

SEQ ID NO: 33299 - protein, 295 aa, A.fumigatus
SYPGPRGSSGSSRSLRDPRRDRPAGSDGSTATTGGRSRSRWSRPVGKGLWPRATRKRPRQKRRKRPTQWWRLSWPWTCIRRRGPVWHSASRSAVCSSIWSWPARMHYTPCGALRVRPIADTVVDGARGGHLETISLDVSTRGMHDDRDETRHTSLVALETGVAHVRLVGRLGSGHGRSCGIEGDCPVGNDQQSVGNARFMCNILSYSLADSWQGASHRNRHDCLLDPSISAAWAGRQAGVEEGLDGTQGFRMNTGGSRRITRAIPCVGKARGLIAWYGVLCCCGWRLILPGRRPM

SEQ ID NO: 33300 - protein, 74 aa, A.fumigatus
KLQRVSRRGHFSPVSILFLFLGPWERANLHFRACRVGVFARLTNSYAIVAIGASENFYRCTTHAPVIRLVSGIF

SEQ ID NO: 33301 - protein, 88 aa, A.fumigatus
VAARWATTGPFCGPKRPSPTAPSSWFQLSTSSPAWLPIRTSSSAPVLHTPASAGPYGPASTGAPTTLLNGNAGEKEGRSSSEFRFPQD

SEQ ID NO: 33302 - protein, 106 aa, A.fumigatus
QSDDSNSNRKGLLVPTTTTDQELQHLRNTLPDDVKIQRIEERLSALGNVICCNDHVALVHPDLERETEEMYVFEALFRPYSRGNRKRENSGNKLARDANTIQKQNS

SEQ ID NO: 33303 - protein, 252 aa, A.fumigatus
LVVVQTDESETETDRGRIRPLARDMKRGYYSSFVRNPAGAALYERALNGWEDFVQRAKLGGDIEPQMNDMEEAVPFKGLSAHDVLNMIIEATGVVQTRGDTTAESNKVFAPVPESRAEALYALADAATASPLPLPRAAITPRTPAHRAILPQPPQHPQLPAIQAPIDPRAFVLPPPNPQRQQPRRLLPAGQLPDPFAARNGPPQLPPPPGSNFQRPPLPGFLSGPPPPPLYYTHPPPPGPTGPPPQGPRPPF

SEQ ID NO: 33304 - protein, 90 aa, A.fumigatus
LAFSRLQSRRFCPPDKLICDCRHRRFRELLQVHYSCSRYSPCKRDLLTDKFNITSVFEAELQDVIPICHATIAGTRIVGRLTAGYVFLFI

SEQ ID NO: 33305 - protein, 157 aa, A.fumigatus
CIRILSGKQRKCTFLRPSSVLTRGGIEREKTAGINWHATLTLSKNRIADVLGVEVFRQTIADNVLTGSYMALSNQGGIVHPKTSIRDQDELSSLLQVPLVAGSVNRGSPVVGAGMVVNDWLAVTGLDTTATELSVVESVFRLGESSPRGWKDPRWRY

SEQ ID NO: 33306 - protein, 66 aa, A.fumigatus
YENSFKDLSIKYSTSFIPENPHMSTENKISQRLRLIVAHTLSHSNGPAMDDTLWSEIKKRIKHRIC

SEQ ID NO: 33307 - protein, 69 aa, A.fumigatus
SSVVLGPSSLVTGPDIDLSTKAYTDCSGAFAICHYVVTADFVGTINGLHQREIRISCRMNLERSCSRSR

SEQ ID NO: 33308 - protein, 79 aa, A.fumigatus
RCTPMIMTNSMTKSVRLMPKSRSDLLPVPLVFPARLTLNPPFQDIIPFAVVGSEKTIVVNGQQVRGRQNRWGVINVEDE

SEQ ID NO: 33309 - protein, 95 aa, A.fumigatus
FDWEAITNESSVLKMATTANSNSTNPATVFPRSHVGFDSITSQIERKLLKRGFQFNVMCVGMWAATVQLFLERTHIDCVLYSTNRPDRSRKVDSD

SEQ ID NO: 33310 - protein, 90 aa, A.fumigatus
CVLVCGLQLSSCSLNELTLTVSFTLPIGQTGLGKSTLINTIFASHLIDSKGRLTPNEPVRSTTEIQTVSHSALVPEDKIFDRNALLTIVY

SEQ ID NO: 33311 - protein, 107 aa, A.fumigatus
FCKCSLKPIDIVVLKKLSDVVNVVPVIAKADSLTLEERQAFKERIKEEFAFHNLKMYPYDNDELDDEERAVNAQIKVRPTTRATCISCPPDSKPSLSGHYSIRRRRQ

SEQ ID NO: 33312 - protein, 95 aa, A.fumigatus
LIHKILSASGATALKIHSTRDPDFPLVQSIDGAHKVGCHHIVTNGKGSRAVSVGFGGEINVWACHEGTWSKYDAASGITIQVLVNLPDSFHYFKT

SEQ ID NO: 33313 - protein, 79 aa, A.fumigatus
PVGLVKPVRTVAFSPGGKLLAAAGDSRVIVLYDTSSGEQVANLSGHSAWILSLSWSHTGEYLLSRSVDMTNLKTFRIYS

SEQ ID NO: 33314 - protein, 193 aa, A.fumigatus
RIQLYVGKLANAYFYDTVIAGETDFLYGFGTAFIEKTTLSLRGCGGGITAWKGTNTTFENKYGVYIADSQVLAANASIGNDIKERCSLGRPWNNLHRSIFIDTYFDSSILPAGYTVWKGAPNNNFNNETLMAVYGVYGPGYNPAAEKNGNVTRILHRREVMPYARPVDVFMTPDGHQPNIAWLDPIAASSGRP

SEQ ID NO: 33315 - protein, 266 aa, A.fumigatus
TMANNPDTLEGEKPRPLAEGKKAARKEQSMTLWQAVRLYPKAVGWSVLLSSTLIMEGYDLALLGSMYASPAFNQKYGVQSASGKWTVPASWQSALSNGARVGEVIGLLINGLISERLGYRWTMVSALAAMNAVIFLFFFAVDIKMLLAAEILAGIPWGIFQTLPAAYASEVCPVVLRPYLTTFINMCWVIGQFVAVGVNRGSIQRPDQWAYRIPFAVQWAWPLPILIGILFAPESPWWHVRRGNLQGRQTGPASADFVQGSQLPPG

SEQ ID NO: 33316 - protein, 133 aa, A.fumigatus
TMRGSLAPVVKTNAGNHNAAFPDNVYTGVLTVGPTYNATITGAGPTGYPVPADTPFGCSDFRAYNIDFRNEYVPYSDGPAHAVGLGYANAGFYSCGLYSYQDTVCSERNLERPPADESSCTLANLPMLISTTP

SEQ ID NO: 33317 - protein, 227 aa, A.fumigatus
RDTELAMKFFALAALFASTVNSIAVDGLIPGARVIPANDVVALKKVGAYHQKHHHRRTVIIRSSSSDEDDVSADFLWGIKRANRGGRLLLQKGKKYVIGKKLDLTFLKDIEVQLDGELKVLWPKILDPVLAGVNTIEKFTNDVPYWQANNFYYDFQKSISFWRWGGEDIKIFGSGVLNGNGQRWYNEFAGQEILVSLPESLSRSLYRLVLRSLGSQQQVLSAHSLRD

SEQ ID NO: 33318 - protein, 148 aa, A.fumigatus
ANGGPQALPKNTDGFDTLNVDGLTVTNTRVDIGDDCLSPKPNTTNVFVKNLWCNGTHGASMGSIGQYPGVLDIIENVWIENVTLLNGEVRNTLPLSSRSTSNSIRTVLVSRHGLVPMLAMAASTTSLTRTSTSRTRTILLSWISATLT

SEQ ID NO: 33319 - protein, 92 aa, A.fumigatus
DPNNKYYRPILFVTENATRVSVEGITQLNSPCWTNFFVRTKDISFDNVFIHAYSTNASVGFHSLVEAEDKLTVAHRRSPKTRMASTRSTSMD

SEQ ID NO: 33320 - protein, 139 aa, A.fumigatus
FYQNGARLKAWAGPDVGYGRINNVTYKNIHVENTDNPIVLDQCYFNINATQCAAYPSRVNFTNIVFEDIYGTSSGKRGKVVADLTCSPNAVCSGIRLKNIHLTSPAGSPPVIVCDGIQGDIGVECQSSSNSTTKRSVDL

SEQ ID NO: 33321 - protein, 75 aa, A.fumigatus
MFHHHSIIRVILSHTLGSSVFCNSHDIYITGSFMCFFPCLPLEPEIVIYMSQSYYCHCGSDDCDHSDIGEDPAGA

SEQ ID NO: 33322 - protein, 297 aa, A.fumigatus
SQTFFFLFALISLFTSVYIQSWPQFIRASIFHALAIMYHYASPPPGWSSFDYMNSPPTSPHYAYYATQFANPYVSPRGTSKRHNRKASYAAPRESGAWHSGYGQSFYEAMPEYGTPPRKHENVSAFSGGYSSCRRPRARSVATGLWDKTGYHFHETPYSSAQCRPSIFVDVVDDVFDDRPPVTPKRDSYAQSRRQPSLSQRKARPPTDSYFSSPQVPAYDDQDSPKRSRARRQSTSTRTPSKPKPSATPKAPPKATEEDAARAGIPPGYSIKNWDPTEAPIILLGSVFECQFDRPVD

SEQ ID NO: 33323 - protein, 143 aa, A.fumigatus
AGQFYSASWWIIMPDPSQGGFRAPSAADIRTMLSDICTNSGAEVSFDNLTFTINGSDDAVKSAMMVVNQIPFVKRSQYQMRVKIELANEHKEFVSGKKNGKINKIMGQSKSYFQQTVCCNVSLTFFRQRSNHIRWLQRVQLLH

SEQ ID NO: 33324 - protein, 221 aa, A.fumigatus
DRSLLSFLFTKFLPDQLPPFPSCSLSSLSPRLAQGVRDSIYSGVMHKISNFTGQARHGWERMTPTFGMSRPHTDMTSHTLRRPHGAPPMTPPTGIDPTVNLSFNVPFSSTLAGPDIDDVIHASPGALQRWSFPEGTPEGTPVYNLPVHANNVESLRRLCRQITESSNGRVEAVVTSSEPKSVPSLQRRPQGLVTNVCITGDGETVRKMRAKILNETPILLV

SEQ ID NO: 33325 - protein, 177 aa, A.fumigatus
SWALMHRQLKRHVDAMRLELTMHTLVCGRTRKNIKLIEAATGTAIYFPPPFPRIFGYTPPGAHRRSEDEVYITGDTQEQIARAKQKLRELVMGVKIYVKDVIVNSNKIDNILLDRLDKVRKVMEMNGSYVLFPQLGSQRGLVRIQGTEVLHVERTVREIMALVRRAVPSLIPIAFTF

SEQ ID NO: 33326 - protein, 207 aa, A.fumigatus
PSSGNVQIIFDGFNEYNFYIDVCGNQYESTKNGLDLVEQEMPASISFHVPDQYHKRIIGIGGQHIQRIMKKYSVFVKFSNAMDRGGMGKEDDDIKVDNVICRTPARNAQSLDLVKQEIMDMVEKVVSGRSCRDSPSKVGLLIAIQDAEYVSERVVINRLYHRELLARMAEIDELEKKWNCKIEFPSTELAYDVVTHFGPPVSGPSGL

SEQ ID NO: 33327 - protein, 717 aa, A.fumigatus
RCNEGEHPEGVGKRKSFGGLTEFTGQGPLWGRGSIYGTRWGISEWMIGKLLLSSRFMGADDEIFRPSFPSRDANRRASNAEPGSAPLEKRTVEEPDPGRAYGSLSTFHHVGPATGASRISALRAARESVTSSPSPPSSAYRRPLSAARAAPTGRAAALAAEASPSPLRRPSISFQPFKAPPLSASPSLIDPPLGASPRSRPIVSAPSSEPKHMPPPSVAASGRKTGQAASENVIASSNSASPRPAPIARYSSAFSHRRGRPSSGGINKIEDDASSGKASATSSGAQPGSGLLAEVTGTSADSLHADDENISEFLKMLDLRKDLLSPSNLSNLDAVARRTTVTSAALTRFQRMRDSNAALSESMSSSLLLQRSSNASSKQLSGVPPMVAGASVSTASSPGKPISPHTPHTPAIPSRLSSNSIVDYNDHGHSDGRLLHGGPTSLPEDTTGEETALVHRPPTVTAIDIPTSPRLFPPTYRRSSSAAQNRRSVVADEEEIFPFNMRSVSLGAEERTNVSLSTLHRRHEYHNAATNPEQQQESQRASSSSDQGPTALPSPAKRETRSQGDATVSGQTPDLSSSANHNLYQPRLGQFRSRGSFGGAHSLSSGSSSLARGGGIPTYLTERDNDRDGNASGSNSGNSTTEERRGFGRRVSAGRNYPPHPSQVEEDEPLLFAMSDFGASRRSFEEGRQGNHGADFGGSRRGSGRRGAGVPGFHVWS

SEQ ID NO: 33328 - protein, 63 aa, A.fumigatus
ISRDLFRWSISAARFDRIFSFYKSLSSLPFTIICEDDKSSILHHLGLISCIRHCRIAYSKFWN

SEQ ID NO: 33329 - protein, 71 aa, A.fumigatus
LKRRSLRINVIVPTSATFIQRLEQATLRSATNGSWGFRFHGLFTWEAYITSYPPYPGYPFSSKFKQYCRLQ

SEQ ID NO: 33330 - protein, 706 aa, A.fumigatus
PRTRILRNSCLVGSTRQILRVVCSNWDIKDDISVMDIDEEPAKDAVESADEEDWLAETTRPAKKRKLGRDPMDVIALSHIDLPLLDDPEQATMRIAKKVTIDMNDPFILLDERGPEAVAPKPKALAHLNREEMDVNVTRRLTSRYNISNDQAYDMLKQNHQNKIRSTLGNVTLEHSMPALRLQWPYYKTELAKAEARSFHRPALSFRPGQTCWFKNPAYIKRKHQKGKDAKTLYDSTKALSMADNSNVLLVEYSEESPLMLSNFGMSNRFINYYRRKNMEDSTRPKAEIGETVVLLPQDKSPFSIFGHVDPGEITPTISNSMYRAPLFQHQPRSTDFLVVRSSTGAGGSDYYLRNIEHLYVAGQQFPSVDVPGPHSRKVTTVAKNRMKMLVYRLLKKSPDMRLSISDVTAHIPGTSDMQNRQKVKDFLQHDKDSKYWVPLEPVPESDTIRSWVQPEDVCLLEAMQVGQQHLHDTGYGIDAETGGDEDEDGEGESFEQQMAPWKATRNFLLASQGKAMLKLHGEGDPTGRGEGFSFIKTSMKGGFKAIGESVEDKLDAQRLKELGGHSYNVARQQKSYETSIRRIWDAQKASLSSTVEHSDDESDMDREMEEDFSKPTPHSEAPTPAPNRRDDETTSQFSKMSMADQKGKVLRIVRQFKDERGEIVQKETTVWDPRVIRHYIQHRHKMEALTTKYACPHYLPTLFIH

SEQ ID NO: 33331 - protein, 288 aa, A.fumigatus
SLTVARSAHKIRNRSSQNFKAVTSIKAHLRWCLTGTPIHNSLDDYGALLSFIGVPALSDKPAFDRWIASPVKQKQTGSLQRLQYLVAATAFRRTKAMVKMTVALPKKVERIESIQFTGADRELYEFFKVKASRLVGQLTGFRQSMAATADNKKESTLSLINLLRLICNHGEHLLPASAINEWRTRQNEQITSDVYFGRHPGQSSQRASVPVDRKTPESGVLTNGERITNVNTPYPSSQEFPMIPDTASSPLAPYEVRLSPSAKVKALLKNLEREQSADRGTSYQPVKR

SEQ ID NO: 33332 - protein, 70 aa, A.fumigatus
QQLIRRIDSVDLTAANYVHLLEPHWNPMVEAQAVDRVHRIGQSREVVVTRYFIENSIEDVRNLVSCSAPI

SEQ ID NO: 33333 - protein, 77 aa, A.fumigatus
RRSFNPDQTSLTRDSVIFSQWTRMLDLVAQALRKHSYKYARIDGHSSLADRRSAIQHFNGDNNCTVMLASIGSAGEG

SEQ ID NO: 33334 - protein, 131 aa, A.fumigatus
  UNSURE (48): Identity of amino acid sequences at the above locations are unknown.
LRQNLVVFQWYYVFQREDSDGRSYSRLEGTDSKVGLGTVTMRTGLIGXRHIHPGQVRYLVYHGRKRRVTQQALSRDYDIVITTYDTLLSDWRAGSGLHSEIWYRVALDEGKYDVNGESYLSMIIDSCTFST

SEQ ID NO: 33335 - protein, 141 aa, A.fumigatus
SVSGASGGFKTDTDISGNFAMRERALKRWEPAADTEVDLSLESTHDTAGWDQFETNERLFGATSSYDENIYTTRIDRSDPSYKQREAEAARIAREIESTNVDNIHVREERGLAPVDDSGLDEEDKSRGVRLLIRPPLAVSG

SEQ ID NO: 33336 - protein, 165 aa, A.fumigatus
LTLASSENLARIAVKHQPHSTIVADILNLPHPDSLFDFAISIAVVHHLSTPERRIRAIREILRTLKPASDKSSGGRVLLYVWALEQKTSRRGWDKGDKQDVMVPWVLKPKSANGSSDDEPRTFHRYYHLYEATELERDIERAGGRVLDSGYEKDNWWAIATRSEE

SEQ ID NO: 33337 - protein, 147 aa, A.fumigatus
RGSIAPRGEDAGPVTTTSAFPSRTLPPASMGQAMPVAASTPLSSAPPLTAKIPASVPAKRLQPAHTAESPAKKQSKWSPEEDALIIELRGSGMKWEDISKRLPGRSAISCRLHYQNYLERRSEWDEDKKNKLARLYERYVSEKNGPV

SEQ ID NO: 33338 - protein, 237 aa, A.fumigatus
DIHDSYELPLTQAGFDGAIHMSEEVHNPTTVVPRILIQTILINGTLAFGFILVMLFCIGDIHSILHSPTGFPIIAMFYQATGSVHATTAMQSAITLIGSVSNIAVVASVSRLTWAFARDGGLPYSKFFAHVDGKYHTPLRAICLVCFTVVLLSLVNIASTTALSAVLALTTSSLFISYIIPVVMMARKRIRKEPIAFGPFALGRWGLANNIYAIVFGVFNLYFRVISDRNSCDRYQY

SEQ ID NO: 33339 - protein, 82 aa, A.fumigatus
AAGNLSLPSGFAPGLMNGGPAALVWGMLLSITGTMALALSLGEMASICPLAGAQYHWTALLAPPRIRAFSTWMQGTSYGKAV

SEQ ID NO: 33340 - protein, 144 aa, A.fumigatus
SSLTYDAGWITVFGWQAAVTSISFLVATQIQGLIILNRPEYEPQRWHGTLLMWAVMLFSLSINVFAVRILPFLQLLGGLMHVVFFIVLIVPLVLLSPRSTPEFVFTELLNQGGWSSDGVSWCLGMLTVHYCFTGKTFMTHMNFH

SEQ ID NO: 33341 - protein, 202 aa, A.fumigatus
TSTDAGRIRRGHPHERRSPQPDHRGPSHPHPNHSYQRHSGIRVHSGHAVLHRRHSLHLTLSHRLPHHRHVLPGHRLRPRNNSNAIGHHPDRLRLQHRRRCVRLPPHMGFCPRRRPALFQVLCSRGWQIPHPPPRHLPRLLHCRPALPRQHRLHHRPQRCPGPHHQLAFHLIHHPRRHDGPEAYTEGADCVRPICAWPMGSGE

SEQ ID NO: 33342 - protein, 81 aa, A.fumigatus
TDMAGTLPPLFPISDEDHSGYVAVTVYTLLSLTVTTVFVRLFTRWYIARDVYSDDVLLTGATVSSSTCHGLFLTGLTFDLV

SEQ ID NO: 33343 - protein, 164 aa, A.fumigatus
LTDYSFAPTKIYLSLTLSRPPLEGPLITFAQFIVTAVFTLPNFVSLSCGPRSLFLSPRVIPLRSWLVYTAFFVTVNLLNNWAFAYSISVPLHIILRSGGPVASLIVGYSFNGKKYSYGQILAVAVLTLGVVTAALADAQAKGEPLGIGHGGSSPQGPTDPRNEL

SEQ ID NO: 33344 - protein, 91 aa, A.fumigatus
IVDFPAAVVKTSLDPGTESIIHHIINNEFTKQGHTVIIMAHKLSTLEKHMKAGRDAVAMMADGRLDEVINYLGPETFQYSMQMGHRLTGTS

SEQ ID NO: 33345 - protein, 74 aa, A.fumigatus
YICFSYKLAMTQSFTGTSNNFQLVIAVAITIFRADSSQAIASTVGPLDEMPVLLGFVSAVKAVPNRLSWKGSIC

SEQ ID NO: 33346 - protein, 112 aa, A.fumigatus
QSSVLKSFTMAENTYQHVRSRYGDIAKRTGTTIHDKEDDIALAFGYSAQDLHALPDKANLGLSCGNPVAHANIKEVPGTLYAVVDSQRLTLNNCIRGRQLSISEVEAASMSF

SEQ ID NO: 33347 - protein, 133 aa, A.fumigatus
LNQDMINLAKKNAEAAGLSNTRFIEATITSIPLPDASVDCIISNCVINLVPSKDKPTVFQEIARLLKPGGRVAISDILARKELPAKIVNDIWLSMLGALRGPVRSQSMKNISNARDLRVRTSIPRRYCSSLLI

SEQ ID NO: 33348 - protein, 312 aa, A.fumigatus
  UNSURE (221): Identity of amino acid sequences at the above locations are unknown.
GFGLFGRRGNEPVGFNIRYNHADSPSLSGDHRIHQLIINADAEWRSLLGKEVKTFDAATEQYRRRRDRHPPPGFKEWFEFARSKDALIIEDFFDQIYDDLNPFWGLQPKEIRRQAQSLKPRIAVRNHKATAITDHGALWLDSWLSLVGSIEQYLPDLDMPFNPMDESRIVVPSETIAEYMVKERVSRQWMRDKSPAEFITEYTAVKNESESGKFEPRFLGXDDGQFWDMARVCCPPNNPSRKNLSLNPATVLHVAMEKFLPHSQNGYVRNWTQSQDICWASGDATSPWKLLSNPLSYSTAPRFIPLFSEGSQ

SEQ ID NO: 33349 - protein, 64 aa, A.fumigatus
SWSRISSINISDDVSTEFKSLQDMLPIVLSTLYDEFDGEWGDCSRLIQPDTKGTNCEHNLNLLY

SEQ ID NO: 33350 - protein, 187 aa, A.fumigatus
  UNSURE (131),(168),(173): Identity of amino acid sequences at the above locations are unknown.
PCSIQLHSTLSFRCESKFYGYRLLLTLSAVVNNQTLFIDGGEMHTLLPNGTIITFASPFHSFGLSSSANFAVTDLETIDLSKSWQNSDPGLFNYIAKPWNASDPADYPPYLNEGASFSNGESLFFYGGYSXGWGGPPIPPLATWKYDIANNNWTRDGFWGVPLVRLTXGSAVXSSVHKKAYYLSGTL

SEQ ID NO: 33351 - protein, 1029 aa, A.fumigatus
KPARHRPSPSEELSDCQPTIFRVDTGVVEETTFINRKLHAGLAKLERHSADLHTTVPSLMQALFALLLADRVNSSDVTYGLVLSGRAVAVPDAESVLLPCITTIPARLNTSGLKTVSDVVRSVHQSTARSLEYQHTSLRHIQRWLKSEKPLFDCLFSYIRSTPAPKNTLWGQLESTMPSEYPLAVEIEANSEKDEMYVHCGFSPSFGSADRGQEFLEKLDALLSAFLFEDDIALDSFSLANSGNPGSRATEVKWDATTWSATETKIRDLTATFCGLDVVNVSKGTSFISLGIDSVTAIQFARKLRELQFEIVPSDIMRFPCVGALAEHVDERSSEGRQSARVGDKKPRVSLAAHRDNVPLLDDGDSVAAIFESTPLQAGMITRTLGSDAQVYVHPHIVRLTEGVDIDRLSKAISEVVAKNDILRTSFHPIAENGVTWVGAVHTNPPLQWKEITLPSNADVIAELTSLYSFREVADFETPPVRFVLVHRKNEKLFVVIMHHALYDGVSLPLLFEELAATYHGQTTVGRPQFSEIAHYIVEGQNDSCDFWTKKLAGYEPVEIPALSSSEATERMLLSERKIGLDVEKVVESCKAMEVTVQSVALLAYAKVLACLGGKRDVVFGQVLAGRSLPVPGADQTIGPLFNTVAQRVLFEPKFLSNREMAQRVQQLTSESQAFQHAPLKDVQRALRQEHGMNAASLFDTLFVFQKSADLTTDTPHEQQIWTPFETEGYAAQAEHKLNVEIDHGREAIIVSGSGDGRYICQQALDEFMADFCTAFQDIIEHPSRCATAAPERLGGLPLRLSNAEEPERGHSESDAPAHESIIRDVLAEVSGVSVDSITPSTSIYNIGLDSLSAIRIASICRSRGLNAGVADVLAGNTLRGISARIISPVEAPIQAREPLIKDHEAIEKAVLQRLGLNKDEVETILPCLSGQLYHLVSWLKSGRTLFEPAWSYYSIERIDSGKLEEAWNQLRQRHHILRTCFVATSPSMAVQAVLKDAPQNAEIFKVIESPACIEEAAKAQAREEGLNP

SEQ ID NO: 33352 - protein, 277 aa, A.fumigatus
EDIIAQWEGDLQPIQQEIESFGCLANGKVVRMSHAPDDHGNANALSSRLTNGLNFRRRSNGQGAGAGASHPVPPLQPAAPSICRDHDRERERGLERTSNGRVPSAPRPNYETKPLPVYETKPRLNNLTPSSLSPNLAVPNAHLSPSATPHSDSHLPVPGSDYAQTPLSGPSPNSSRSDYFSLNLRKPSSGSTVTSPGFAAAAAAKKKPPPPPPPRAGSSNGALYVTALYDFAGQSAGDLAFREGDRIRVLQKTDSTDDWWEGELRGVKGSFPANYVQ

SEQ ID NO: 33353 - protein, 91 aa, A.fumigatus
SPSTMPSYLYHSQVSGSVIANAHFPTTNLVASPVQLYSIHFILRLCILSLTFFYCDLQLIHLSKRIGSLISRIGPSRSCRFFSTAYLQAEI

SEQ ID NO: 33354 - protein, 154 aa, A.fumigatus
APYIHSHIMAARHSRKFLRPLLYTSAAAATGAGVLYISYRPRNIPGSEAPAVPPPGYHEGKLVPPSFPAIKSRLEQIEDLKRSSSGNDDEYDLLVIGGGATGSGIALDAATRGLKVAVVERDDFSAGTSSKSTKLVHGGVRYLEKAVWELDYNQ

SEQ ID NO: 33355 - protein, 395 aa, A.fumigatus
  UNSURE (389),(390),(392): Identity of amino acid sequences at the above locations are unknown.
CPADGAHNDSRMNVSLAMTAALYGSTVVNHMQVTGLTKDESGKLIGARVKDLIPGKNGQEAEEFTVRAKGIINATGPFTDSIRKMDEPDVKEIVAPSAGVHVILPGYYSPSKMGLIDPSTSDGRVIFFLPWQGNTIAGTTDQPTEITTQPEPSEKDINWILSEVRGYLAPDINVERSDVLAAWSGIRPLVRDPKVKSSEALVRNHLISVSPSGLLTCAGGKWTTYRQMAEEAVDEAIKVFGLKPRAVSQVPDISGVGGSGLVSDGAVLDGSCQTHQVRLIGAHGYSKTLFINLIQHFGLETDVAKHLTESYGDRAWQVAALSAPTDARFPLRGRRISALYPFIDGEVRYAVRHEYAQTAVDVIARRTRLAFLNAAAALVFTTPWKDTGXXHXKGG

SEQ ID NO: 33356 - protein, 137 aa, A.fumigatus
NDQQRSATWLFQPLTSWLDCRYKLVKEALRERKYFLNTAPHLSSWLPIMVPVQKWWQAPYFWAGTKAYDWLAGSEGIESSYFLTKSKAIDAFPMLRRDNLIGAMVYYGMCQPTPHLMLAFGELHANVLQMERTMILG

SEQ ID NO: 33357 - protein, 135 aa, A.fumigatus
EANWRDGALYLGSICALSMPLSQVYICNQARTLVAERAKLRISAGHFMGALRASLLIIIQLPHGLFKISNPAVYKFCTLAASASAKVISFHNSYFQTSSCGVKRYSRASSATADNEKVVFIIVTRGTPFEVFNLL

SEQ ID NO: 33358 - protein, 60 aa, A.fumigatus
NTLSMTFSSDAGQSMAKQTNKRSVSGYESGRSLSYSSCPAVSQRASSTVFPEARWVVCVI

SEQ ID NO: 33359 - protein, 202 aa, A.fumigatus
ISPFLDPPGTSWQIYSPRFMDMSGHMYEDSGYAASRRRSIATPPPSMTPRHNRTRSQSVRVSNGTVSTNTSVSSGRMSEATNITQPPAYSKKFVVVGDGGCGKTCLLISYSQGYFPEVSVLSLNVGFDETHPSLLEFPPFRNMFLPCLRIISRKPPIELPERQSNWLSGILLDRKSTTDCGHSHIPKQIFCSSALPSTVLHR

SEQ ID NO: 33360 - protein, 113 aa, A.fumigatus
ISAFQKYVPTVFENYITQTTHRASGKTVELALWDTAGQEEYDRLRPLSYPETDLLFVCFAIDCPASLENVMDKVFYSPLVFPQHLTNMNSGIPKYCISVPPSSPRGWKDEQGF

SEQ ID NO: 33361 - protein, 109 aa, A.fumigatus
SCSIMEPRQIPSVFPSSFSSFSSSLVLFILFLTLSSTVRATASSAGCIVLPSNSSADLSFTNQKRFHLQSDQYTVPSDAIVAPLTQHLVNLNGTDLQVGHVFRQRFEVR

SEQ ID NO: 33362 - protein, 151 aa, A.fumigatus
YHKRFNVTGNPVDAAAYNSLSLSTGDIAFVSCDTSLYPGNLDASATVSNLLTAQEKASAVLLYSTSASHCNYTVTNDAAAQYTNVFTLLNPAFAESLRVQLSRQNGNGSLSIVYNMSFVGTVTPSTQDGSTDSPNTGAFVSLLEARLLLTN

SEQ ID NO: 33363 - protein, 951 aa, A.fumigatus
  UNSURE (915): Identity of amino acid sequences at the above locations are unknown.
LVLDTPKQIYRCDFPDCYRTFVRQDLCVRHRERHTTQGSQLQKRDHFAQAASQNKQQSQLPHNVANNNVPQMGSTQKPPILPATTVDLTSARSATTFPEGGVETLTPQSANGSSKHISVSSSTSMSLGRPLNYQPLIAQHGVGTPDSTTSRSNSLSNHSINSPPGQANAPFSPPDLQKPAYVPLTGRHSIYPSGSPSDQTYQLTGLNPISRTRPQDATAYSMSADVNGSSVVQSLPYGSPTGLQMPVGGFSDLSMNTVPPSTQASLDRSTSITGLDSLSGMITSADPAFDPMASCVYPIFGGETYNNRSPFAMADDFTAWLFNEPLPGSSSLTYPPTASMMPNYLDPTQLQNQFLISEPAFGSFLNGVLPQHPMSVTSILDPGSPQAIMSEEKRQELLHLMATRFNEAAYSAVAKRKDALMDGDVDDDSHVLSLRMMQTYIGSYWYHFHSQLPILHQPTFVADKAPNLLLLAVMAIGAATLDNIHGQEVTETAAELANFIGWHLRWEIFMDADFRPPAKLWVFQALLLLEVFEKMYSTRALHERAHIHHDTTLTLMRRGSSLIGRSALDSPASFRDDRQTRSTTGSGSNSEFAADDSWTHWIKAEATRRVAFAAFVLDSTHATMFGHSAKMVAHELRLPLPCDEALWSATSAAEVARVQSSLHANGVKPTMFLDGLKKTLNGQRVTTNAFGRTILMAGLLSVSWHMNQRDLQVSSLGVPQALGGRDKWRSALLRAFDNWRRDFDEALAQAGPPPFPNQYRRHSLEDDGVSESRDVLHGLAHMASHVDIVDCQIFAGAGRLMGRSITPRDYSAAREKMTERWATKASARDATFHALKFLSECLLNNRSVSEETGTYSGRDDYLLNRPWVIYVAVLVVWCYGYALDGPIASPPALETVADQRRDMEAFLRRVGGVRXPHELATMKGRNQCLGLLMILRDGFANTRWELLSESI

SEQ ID NO: 33364 - protein, 115 aa, A.fumigatus
SMRFTGPSGRPGEKFSASVHDMTFAVGTVTGSDQQLDYKRKEPGDKEETMETDALRADGAPRKRKRARKVNSDRKFECTHEGCGKSYSRAEHLYRHQLNRMSDVFQPQARFGGCQ

SEQ ID NO: 33365 - protein, 403 aa, A.fumigatus
GTPGGSKMKLLTEARHLRRTVSMFTMTGSKDHSVRKRMLSNIYSKSFLQSSPHMRLISRTIVYDRLLPILYDAATSSRPVDVHDLNQGLTMDFVSAYLYGVTNGTNFLQDAPYRQRMLHLYQSRKPFEFYHQEVPNLLSWTKSLGIRLIPRYCDQANEILDSWGLGLCDKAEESLKSNRLEDEPAVYKHLKQMISKHLPENKNDVEYARILEQQRLDIACEMYDHLTAGHETSAVALTYLLWELSKHPELQDALRAELSTLEPMVIFPRPSESAELPPAKSIDSLPLLEAIVTETLRLHAPIPGIQPRVTPYPSCTLAGYNNIPPKTRVNAQAYSLHRNPEVFPDPETWEPKRWLKDVNTPSELEERRRWFWAFGSGGRMCVGSNLALQGKGAFRSHQSLKLT

SEQ ID NO: 33366 - protein, 65 aa, A.fumigatus
GNGRRRNAFRRWAHDFFAPILTKGGMAADPFSRRIIVTEIVVIINELEWHFETLRITSNDSVMPK

SEQ ID NO: 33367 - protein, 63 aa, A.fumigatus
CLGLLVETKSAWQAVIRFQGGLGVCLSDVTLNELSLPKLSDFDESNLTDAYNAALTQKKSKYC

SEQ ID NO: 33368 - protein, 60 aa, A.fumigatus
HTLAGTVTSMTAKSYRHYIVLFVRTMHLKWFSSFSSIAPLSGPADGIGTTPYEIVTIKGL

SEQ ID NO: 33369 - protein, 361 aa, A.fumigatus
PATGISRSILNFITLCMRAFGNRLALTHLPAMVATYNQGTRASELVRQYAPQIAGKIILITGVSPGSLGESFVKQVAVAQPAMFILASRSISKVQNLIDELATAYPSVKVKPLYLNLLSFDDVREAAETVNSWTDVPHIDILVNNAGIMAVPYKLTEDGYESQFQTNHLSHFLLTNLLMGKILASKTPRIVVVSSSVHRIGHIHWSDPNFNGGKHYQRWLGYSQSKTANALMGVSLAEKLGHRGLLAFPICPGVSLTNLAAHGREDLAAFSADLTDMDNIYGNKWLWGMAEIKIKDLDQGAATHVFAAFDTSIANQNGAFLSDCHAADPDMEEVHSWATSKVDAERLWRMSEKLVGQEFKY

SEQ ID NO: 33370 - protein, 259 aa, A.fumigatus
AIVVKSEPSIMSLFAFGSNGSGQLGIGHDEDVSVPTRCLFEEGQTPSEEENGTQAKTISCIVAGGNHTLILYQDGSVYAAGCNEDGRCGHHPATASLQKFRQVIVKSRDGTCYHTFKHLSATWEGTFLVVGSEDPSAEADSIFVIGSGAKGELGLGQGCTKAVEPTRIPNFPPQGTKVVSIASGMGHTVVVLSNGEVYGWGGARKGQLGESARGMKIVWCPTKVEGIPFQAKGAVCGREFTVVSGNKSAGEYAIIGSMR

SEQ ID NO: 33371 - protein, 145 aa, A.fumigatus
FRATSPQGNMPLLGQCDNKWNILSDAPASQSLTYYRGIAASWHGVYVHQNDFSVIAWGRNDRGQLPPPDLPRSQKLAVGSEHVLALLDEHTVVAFGWGEHGNCGPDIDVQGNVNGTYKPVPLEMLQGSNVVGIGAGCATSWIITS

SEQ ID NO: 33372 - protein, 150 aa, A.fumigatus
RLVLTYLFLPDTTGLDLKEQERRWAFIRSGREHEYHGPAVHPKHLSVWERLRGKGKYYDAELDYKQKVEEFRAEWEAAMARKVSENDKGEDFAIDTDDSLLEGHVHSYFHRTSPMFRGMEENPSKSDNFALPPAAQEGDSTDSFNEKTQQ

SEQ ID NO: 33373 - protein, 494 aa, A.fumigatus
  UNSURE (19): Identity of amino acid sequences at the above locations are unknown.
SSTIAFLDWSLSLYSLIIXMPSFFTAGLQGLPPTPPHVLSGGRIENEPFYIVNNSAFPPRYTQNGCEFIEQYSQSAHYSKPAPMNLHPPSAHHMHNGRDLTTAHPALNQSFGPLPTTNVLPPIRTGLQLPPMESAIPPQYRRQDRLMQPEQQQRKEEKATGGVAAHLDYEMEQMSDFVAEMAQGMYALYITKINIADIDFARSVYPGTSVPPQFRKYVYQILSSTRLPSSTILLGLYYLASRMRMLSSANVYTSGSGQVYRMLTVALLLGSKFLDDNTFQNKSWAEVSNIPVGELNSMELEWLFAFEWKLHERIHDKQDGFASWLSHWETWRAKAVARAQESLHNLAPIDTNVSRGHMVSKPLLSPEGPIPPQYQRSSHYENSWLNPAASEYSPPSAPHSGPNTPDYYAVGPWAYANPPPPYTRTWILPPQQYMPQSAPRSQPPSYHHTPSYALPFAQSVWTGHGSSCGCLYCAKHVEHYMCANAFGPMQAMVA

SEQ ID NO: 33374 - protein, 77 aa, A.fumigatus
LTVCMCKMWNREIMMEGECIRIRSVKAPSDAPVMLSFGLKFGVGVLFSIFAVVIVFLRVFVMAGSVGKGYSRKGVTY

SEQ ID NO: 33375 - protein, 269 aa, A.fumigatus
HADRKQMFSILNEISNNSHFRVTGVVLASIGSSAATYILVAITGYLSFGDNVGGNIVSMYPPGVWATVGRAAIVMLVMFSYPLQCHPCRASIDAVLRWRPKPAAGNDNLPHHHPLLGPRGHRAPEPMSDLRFSLITTTILILSYIVAMTVSSLEAVLAYVGSTGSTSISFILPGLFYYKISSPDSPTHQRLMKEDDEAVDNILSDDDNSDENGIEGGQNLPLTDSAILRLTNRHWRRGLLRKLSLALVVYGILVMIVCLIVNTFFIASQ

SEQ ID NO: 33376 - protein, 108 aa, A.fumigatus
DGPVLTTPPRVMVIPLSYLRRLDSLKYTSIAALVSMGYLVILVVYHFVKGDTMDERGPVRLIHWAGPVPALSSLPVIVFAFTCHQNVGRLHGFDCRHSMLTGSRCSLS

SEQ ID NO: 33377 - protein, 156 aa, A.fumigatus
VILIGASGFLIFPELIEPCLNSHRCRRSGDAARHLSHGNGPRYLRHSLVWNDRWARPLPLGSMAHSTLDRGSLVFFRPYEAHISQCRPLFLNGGIAIKCFGVGVSYLIILGDLMPDVEQGLDWYHSRQMTCWRTGICGLLPSCSLYSHSQVEMDLC

SEQ ID NO: 33378 - protein, 62 aa, A.fumigatus
KNNYYYISRTCFQFLIFNNNYLLKYKFTSLIYLLLSTIKYIYLINLTSISIIIILILPLDYP

SEQ ID NO: 33379 - protein, 468 aa, A.fumigatus
TFNDDDLTRTHSAFLWAFRASRNWKLVKDVVPFLRSRIESEKAAEQQFSPQGGATDGDTEMQGDFDGFFKQHFCVSAQDLADELRQPLQDMGVLYDDFLTTTTPVSRFSRAMGYSRLSANKGRMMYTVRQLSMLDAARLSASGLRFTSIENVIPVLSRRVHIPSMTLAAHLRDMRDYSISGRNFEPGVHLVSFVMRPTVHDNFEVLTAKGVSNPLPSASLPLKRLQIAHLESLSHMEGWTVSTCLNWLTSETARGYRDVDAFRQQLIQAMRDLSSVMPPDINSASRFSARPLIAPCRPSRHSDGNNCIILPFCVVGTLDTQISNPDFTFTPLRLFKAQQQVNDGFTGGDGFAKELSQELYYSNARSSSTTDPEIAPSVRALRRFWPSRKQPSDKMSATSQETLMEHSPFGENTVRKGSESGHHKFTELSTEPRPGSACLTDYHNGRRLGLSAHMWTSFTIFATPLRYG

SEQ ID NO: 33380 - protein, 218 aa, A.fumigatus
LSADPSPPVGEDVQDFNHYSSVRHVDGPHTGLPRIPKDLKSDTRSLNTSPPSYAGTKRSADESEDEDARPAVRRKKVRVGASESKLTMKLRSRSSSRALSPLVRTDRSAEEAAHEDPRPALGAKRPADEAANKDSHSILGSKRSADDSEDEDPRPAVRRKKVRLGASENKLTMKLRSRSSSRALSPSPASMKRSADGTVEEDPRPTLRRRRLRNRIST

SEQ ID NO: 33381 - protein, 67 aa, A.fumigatus
TPGFLQHADSLFKESLDSKRPSGSGYTSKVRVRDKYHIVGFISSGTYGRVYKAIGKDGRKGEYAIKK

SEQ ID NO: 33382 - protein, 422 aa, A.fumigatus
TPRDPRDLGIPAKYGSVTSITSSASSAVVLMVASTKPSEKMAGKANMRSRSESNSPLYFFPIVADQIRFKPDKEGEIIQYTGLSQSAIREMALCSELDHPNVVQLAEIILEDKCIFMVFEYTEHDLLQIIHHHTQPQRHAIPAPMIKSILFQLLNGLLYLHTNWVLHRDLKPANILVTSSGAVRIGDLGLARLFYKPLNSLYSGDKVVVTIWYRAPELLMGSRHYTPAVDLWAVGCIFAELLSLRPIFKGEEAKMDSKKTVPFQRNQMMKIIDIMGLPRKETWPGLVSMPEFSQLQSLAMSTGYINRQCNLEGWYQSCLKNNGYSPGSAAGTPRAERFDLLSRLLEYDPTKRISAREALEHPYFTTGTPVTANCFAGYEGKYPHRRVTQDDNDIRSGSLPGTKRSGLPDDSLMGRAAKRLKE

SEQ ID NO: 33383 - protein, 315 aa, A.fumigatus
VATDDVEAAKEDANDDEDTLLPPGFPAEDDFETFLCYKCVESNLWLKRYAGTPGFLPAVYKDGGLSKVSEEERTGADPLNASSNQLANTKKRKADEDDTTEAKETVELAAKRTKSEVDGEQSFTESKSETTQAEPAKPKHESLPNPPPSGTFSLFLKEDFREHFCRCPECYPNLAKYPQLREEEETYEPPLSEDGDANGGGSTGTGSIYERGEAALSNIDRVRAIEGAMVYNHLRDKVKEFLKPFAESGTAVSAEDIKAYFEKLRGDEKPIKDAAAGQASASSGNGGNEKDEGGDGRKEQSGMLRLRIYVASGLF

SEQ ID NO: 33384 - protein, 370 aa, A.fumigatus
  UNSURE (29),(41),(53),(65): Identity of amino acid sequences at the above locations are unknown.
KSQGFKHYDDLIQTFLDAGMLPMVTFLHXDSPWMLVAGGNXTAKPDIGYNNGXYHNETFVDAFVXYAKIVLTHFADRVPIWVTFNEPLLYSFNFKGADNVVRAHAQVYHFYHDVLNATGRMGIKFNDNFGVPRNPRNASDVHAANRFQEMQLGLFANPIFLGQQYPDSILNTLPGAEPLSKKDLAYIANTSDFFGIDPYTATVVSPAAEGIDACAANTSSELFPYCVVQETKNRYGWNLGYRSQSYVYITPTYLREYLNYLWNTFRSPVFVSEFGFPVFGEAEKTDLSDQLFDTPRSIYYLSFMSEILKAIHEDGVRVMGALAWSWADNWEFGDYEQQFGLQVVNRTTQERYYKKSLFDLVDFVSSRMSK

SEQ ID NO: 33385 - protein, 206 aa, A.fumigatus
  UNSURE (121),(128),(148),(183): Identity of amino acid sequences at the above locations are unknown.
MRQCGELAVGKSGSEETYANDYSFATSVPRPTSTHTYGPPYAHAVKHLSPVPATTTWGNWLPYQTVITATDTTDPYGQAAWSMLWQQAGIENYTTTGLYSTTVSPTAVPSSSLVPAAADYXGPTDCYXLHADFVFGVAGSAAQVEGAXRLEGRSPTILEKLANATQPKDYVTNENYYLYKQDXQRLATIGVNTTSFSNSGDAHSFL

SEQ ID NO: 33386 - protein, 80 aa, A.fumigatus
VAWQSTARDAWCLDPLAPQKNSIASFCGIPRRSNRSSQQRDKMVSGPRPYSHLNINNVSMNSVATKVHIDNQELEIGRSL

SEQ ID NO: 33387 - protein, 68 aa, A.fumigatus
AELNGQIPLPPDAVLNIWKAIKHTEFDDAHGAFVGWDTHGDSKKRVLESAKIYVRAMGYLDHAIHQEQ

SEQ ID NO: 33388 - protein, 209 aa, A.fumigatus
SQSWTTLRTLQSANQYHNDFAPDPDYPDSLITIHTSPKVGIGQRAFLCRTAYGNVLWDCLSYIDEDTIRQINELGGLAAIVISHPHFFGANVHWAEVFGCPVYIAAEDEEWVMRKSERQVFWEGRELRIPLPGKGDGDADLVAVKTGGHFPGSSVLWFKPLRKLLVADSIAVVPSGVYHKDRLPGTASYTFMWSYPNMVCGSCLATGIG

SEQ ID NO: 33389 - protein, 208 aa, A.fumigatus
YLDLAGLAAGVTEAVAVVNPMEVVKIRLQAQHHSLADPLDTPKYRSAPHALFTVIREEGFSALYRGVSLTALRQGTNQAANFTAYTELKAFLQRVQPEYSNSQLPSYQTTVIGLISGAVGPFSNAPIDTIKTRLQKTRAEPGQSAINRIMVIAKDMFKQEGARAFYKGITPRVMRVAPGQAVTFTVYEFLKGKLEESNWAFVGGKYEE

SEQ ID NO: 33390 - protein, 104 aa, A.fumigatus
SRFITQSFAMAAKSVEGNKGKKPASAAVNLIGMMTLLWCMDTSLAVMLTCDTAGGGAGMMEALVCHPLGKAIIQRYRVLKAELTISHIPSKSECSSRDGLRPLG

SEQ ID NO: 33391 - protein, 68 aa, A.fumigatus
VKPRGFITTGVDIVKKETALGLYKGLGAVLGGIIPKMAIRFTSYEWYKQMLADKETGTVTSKATFLGT

SEQ ID NO: 33392 - protein, 148 aa, A.fumigatus
RNTLTCLLPVSSELHDAFNNFSSDSSIFCLPVTITAESLTPLSPIRFSSPGAFYPSLSQLSSVLQPKTPLYLLFRRPESGSSSLCALTYIPSNAPVRAKTLFASTRATLVRELGSEKFATTIFATEEEEITSEEAWRERDAENKGSGS

SEQ ID NO: 33393 - protein, 107 aa, A.fumigatus
CRHRYCNSKKKTEPNVQKWGDPEEALRQASNNDLYRFLGWSLKLKRGKNGRRNKGIHKSSSLNTDWKNLRGYYQKLTKSKIDDIDGSEVRRVSSMNHYSFDLFDRLV

SEQ ID NO: 33394 - protein, 108 aa, A.fumigatus
GIKYLVVEHGLDTQPKKKTPVYIEDIGPLNETILSTQLKKFYLGLQRIQVCLFNSLALFTVHRRSALLSLQFKDLQISLQKDPRGGPPIPLVELTADGCKKFLGQTKL

SEQ ID NO: 33395 - protein, 123 aa, A.fumigatus
RRTGRESREFPTGEHIFVWSIAGECGARRPLATSESHITRLFSSPSSSYGDSPDLASTMADGTLLYTFIPSLQPRHKPWRLILVPKLPRLPSRTSFIDRITIHLPATIPKISSCATYPPFAEP

SEQ ID NO: 33396 - protein, 299 aa, A.fumigatus
  UNSURE (215),(223),(224): Identity of amino acid sequences at the above locations are unknown.
FIASSKPLLRMISDDLLDSCLQILQDKALDEEEQAEKVESFLRENTSLSGASLENAVLDVLWRHRNRTLPDSSPPPPRHTVIRRTSPAPWQMARSSTPLSPPSNLGTSPGGSSWFQSSRGFPRAPLSSTVSPFTSPRPSPRLALAQPIPHSPNLNAYEFSDQSQVSDFYSDFGNDSNVDWLVADDAQSTTSSVGTMSASGALSATAPGFVPDMSXHDILRTVXXRHRFNEEIEAALEANGYDLGATIASFSQDQSGGSFSQVDDGRVLVRQIMTIEQPRLSTSPDYNRSPVVCKYWLAT

SEQ ID NO: 33397 - protein, 72 aa, A.fumigatus
GAEGLKLLAPNKESRHFYYAMYINPAVTRELPFLSYEKKKKKNCDLFLSFFPNLYKITPQRVETLRSKFTAI

SEQ ID NO: 33398 - protein, 158 aa, A.fumigatus
KMPADYTSTARALSLPMSPAESLSPAEEDTRPLWSHLASSRRNTASPSVRESTGLRDQVVNQATKMLRRTKKTWRRLTFWQRIGAIGAALLAILLGLSFMIFTGQVFFWLGPVAEKWEQSWLAFFVLWLCVFFVSFPPLVGWSTFGTISGFIYGIWKG

SEQ ID NO: 33399 - protein, 160 aa, A.fumigatus
FIFLFYLIDCSEPRSNTYLSWILYATATVLGSTCSFIVSRTILSKFVNRMMERDKRFAALALTLKYDGLKLLCMIRLCPLPYSVCNGAVSTFPTVHPLMYGLATALITPKLLVPAFIGSRIRILSEKNEDMSSASKAVNICSIILTIGIGVFTGWYIYKR

SEQ ID NO: 33400 - protein, 141 aa, A.fumigatus
VSLVIDSALTPQDANNYGYRTLARAKELEAKERADIRRSLQADHAAHRPHGSFSEDPDVNTAATTLARDEEERIEFNDFDDDNVDLVIDDDSGSEISPNLTKKQFPGPYRDEFTDNDSDVFGDGDGPDSQMFRLHTHVRSG

SEQ ID NO: 33401 - protein, 63 aa, A.fumigatus
CTGYALRVRSLIITPSSGPIVNKSSDRQIAQTATDINLAGYDEATNNRYFWLVQSTEYHDLTY

SEQ ID NO: 33402 - protein, 74 aa, A.fumigatus
KVWSAVSNERGGDRIPYKVYHLIKAQDTLCHAVNKAGGGHTKYGARGSRCGWASLGYTLNRGEKLTYTYYLIEL

SEQ ID NO: 33403 - protein, 136 aa, A.fumigatus
WTIRWQRKCMSRSTLFYRRLTSICSLSNLIGFKGHLNNSADFRPDEYEVEWITDRRYADFKFSNEYNKTCDYPKFWNETGFPLYSGGVEELKGCYNSDFDQYGELEAFGNFPDWKRQLTKFASVQDRLREWHKPRS

SEQ ID NO: 33404 - protein, 87 aa, A.fumigatus
RHLATSLTGSASSPSSPRYKIGCVNGTSPVRDIITRHYCIQIASLDIDGFRYDKAVQATLEPLGEMSAAFRECAKKYGKHNFFPTWR

SEQ ID NO: 33405 - protein, 151 aa, A.fumigatus
STDSVHDSRELEGTSEMFTETQRSVALILSLLSVSALCWPYTESLVDYNLNENRSAESPIDYWGEWPNHKYHPSPDNWRFPVYTIFLDRIANGDPTNDDINGTTFEHVVNSNQMRHGGDLVGLIDTLDYIRGMGFKVCLKSLPCLICHLQI

SEQ ID NO: 33406 - protein, 339 aa, A.fumigatus
  UNSURE (45): Identity of amino acid sequences at the above locations are unknown.
LQGAMFQLSMFLRVFSSLSSFGQPSRFQETISAEHRICNMTSTEXQFTVAIVGGGIGGLALAAGLLRRNVPVQIYEAAPKFKEIGLGLTIGPAAHRAMPLIDPQIRHVYDSLITTHADSPGYERFKQTWFEVVWASGPKSGQVLMNLKALPSGQTTVRRADFLDALVGLVPPEIAHFGKRLIRLVESPTGVNLYFEDGTSASADVVVGCDGIHSKVKEFMLPDEYEQTMPRYSGMYGYRAVLDMETMVEAVGDHRARVATMYVGDGAYGISYPIMHAKKVNVGLYVLHDMWDDAAWVRQASKENMARDMKHMGEYVNRLVEVCGKQESHFTAPPADSGP

SEQ ID NO: 33407 - protein, 147 aa, A.fumigatus
QYMPDPSQWAIFDHPHSSTFARSRIAILGDAAHASTPHQGAGAGQAIEDAHVLAELLGDRRVIEARDVLAAFQAYDEVRRPRSQRVVTSSKENAYLLCLHLDGVEHDEEKLRTTFQERLRWLWDIDIQDQAERARRIMLKKMQNSSS

SEQ ID NO: 33408 - protein, 199 aa, A.fumigatus
IAQGNVPGKSSILTSRGHFLQYSTLTSAFPLIIRPAMASLRPSVKRLLRQPPCRLYSGAPSSSSRLNLPIDYKSTPLLHHTSSSLSSALELPGSTTSKSLNLYQAINSALRTALATDNRVMLFGEDVAFGGVFRCSMDLQTEFGSERVFNTPLTEQGIVGFAIGAAAQGMKPVAEIQFAHCLHHGAGRISVSVEISSVN

SEQ ID NO: 33409 - protein, 202 aa, A.fumigatus
SVAKLLAKSGPVRVLFTHAIDSHNAFEAVDCGTFTQLPNGDDLETGSMPRWDLPGKPVREYEEVWRELAFREGPEGPGRGVSWVLEARGDVQGVSGQDASTVTRMFIARIWGTYVALRQEQMHSGGDSEAEIKDGGEVSARREEWDSTSGWKTKYVLGPDADKLPSMTTIGTGDGDWSIGSEVLLSDQPYIVRACERIDQEY

SEQ ID NO: 33410 - protein, 85 aa, A.fumigatus
EAPRSSIKMTANQTSSSSSSSSSSSSSLSTRISLRWPPDPAFENTDTIVLSLMGWYVDLRVDKSTGKIDWAIAGQRIVESQEPRT

SEQ ID NO: 33411 - protein, 211 aa, A.fumigatus
SIRHAGIYIKVVILLVVNKDVAVAGLAIVHVDNSLVGILHGSLLDPGVNTLLSGKLEHLPDLTRAADQGTAHPDSAADQSMRRDLQSTVLGSTHLDEGTVGAEKRAVLDNGHLAMSDHGLVTQTESDEHTLEEETVETIRSRERLWVLAQSGSSSVAMYSSAPSLRASSLLLALREMATTLSAPRALANKIPKCPNPPIPTTPTFLPGPQP

SEQ ID NO: 33412 - protein, 178 aa, A.fumigatus
PLTPCTSPLASSTHETPLPGPSGPSLKANSRHTSSYSLTGLPGKSQRGIDPVSRSSPFGSWVNVPQSTASNALCESMACVKSTRTGPDLASSLATDYGSVTYAALGFLRCVGRRSPSRFYRWICRHGGRRTNPSGTGRWCRYFRRRGREANGGRFGLRGCCCCCCCCYYCCWFGWRSF

SEQ ID NO: 33413 - protein, 101 aa, A.fumigatus
HRQMPIVQYCSLLRTNGAFVQMGAPEDGALQIPAHALIGRRIRMGGSLIGSPSEIREMLQLAAEKGVHPWIQERPMKDANQAVVDMNDGKARYRYVLVNDQ

SEQ ID NO: 33414 - protein, 280 aa, A.fumigatus
  UNSURE (12): Identity of amino acid sequences at the above locations are unknown.
ILFRCGASRGEXPRFILTSETKLLQGPTMYPCCVGHEIVGIAVRVGSKAEGGIKVGDRVGVGAQNDSCLGRKGDCEECASGMEQYCKHGMVGTYNGVHYNGDKSYGGYALYHRAPSHFVIKIPDAIPSAEAAPMMCGGITLYSPLKHYGCGPGKKVGVVGIGGLGHFGILFAKALGADKVVAISRKANKREDALKLGADEYIATDDEPDWAKTHNRSLDLIVSTVSSSKVCSSLSVWVTRPWSDIARCPLSNTALFSAPTVPSSRWVLPRTVLCRSLRML

SEQ ID NO: 33415 - protein, 212 aa, A.fumigatus
  UNSURE (65): Identity of amino acid sequences at the above locations are unknown.
CDLCICSTCTIYLLSHSNASAVMYSSSNSFLGGVNNARPGQPPFMQQPPYSQLPQGQQQIPQQSXFQPQPTGYGSQSASHLQPQPTGFPTGQLQPQFTGFPGAAPPQQQQQFGGYQAPAQQPQLTGYPPQSQPPSLQVPSTTGLPTRLAPRTSSEIANSFSDGAGVAPPPPPKSSGSKIPNIRLSFITAQDQAKFEQLFKSAVGDSQTMDGR

SEQ ID NO: 33416 - protein, 561 aa, A.fumigatus
  UNSURE (556),(557),(559): Identity of amino acid sequences at the above locations are unknown.
RMIVKLITQSRVLSDTTKSGQLFFPEFALAMYLCNLRITGRELPSTLPDKIKNEVSGMVDIISFGVPDTEPQGAARTNVPSFDAPLLENKSAPPAPQHPKPQQPSNAQFLSQLAAQPTGFGPQATGLQPNQPSLLGANATLAPQTTGFPGQSQQQYLHSQPTGLMTNPQATGYNGPRPPLPPMPTGFGSNLSSMQTGGLAAQPTGIPGQWGFVNAPSSGLPNIEALKQQLMPQPGREGGFTTAGLSGNVSIPWAITKEEKKIYDDLFRAWDGLHKGFIGGDTAIEIMGQSGLDRKDLERIWTLADPNNRGRLNMDEFAVAMHLIYRKLNGYPVPNRLPPELIPPSTRNLNDSIGAVKSLLSQDAESRKASGAFLQPQKTGVSYLKEHSFRGGARSPGFGRKDATLFKNNDEAAAGYRSSARRRVGNDARPSSPPTSQASEEELSVEQLKKKIRETQIMLDAVDFKDENRAEEDEVLDRRDRLEAESLMDRTRRVQDDIDTHPNAVFRKLDNGAEKRSLRRQLQAFEEQVPQIASEVRRIERENCDAKLELFRLKDXXGXPK

SEQ ID NO: 33417 - protein, 139 aa, A.fumigatus
  UNSURE (48): Identity of amino acid sequences at the above locations are unknown.
CERCDVLVVELLLGRRQQRPPRTTTLHAATSILAITPGSATNTTTEWXPTTADRIWISISLSSATSANGIPYWTTATSVHRLPRRSASTAAATVWRLSGARTTTATHGLSSSKSTSIAAGSFDHRPAHSACSQDVFGDS

SEQ ID NO: 33418 - protein, 102 aa, A.fumigatus
GNLRNLFLEGLKLTTQGSLFGAIIQLTEHCIRMRIDIVLNTTGSIHEAFRFQTITAIQDLILLGSIFIFEIYSIKHDLSLPDLLLQLLNRQLLLRCLRGRGG

SEQ ID NO: 33419 - protein, 63 aa, A.fumigatus
VISFTIILQNDWRFTHHIFDNSLPGSLERRSNSLAFSPVCDTLQQIILSINAMSSEDYRPSIV

SEQ ID NO: 33420 - protein, 290 aa, A.fumigatus
  UNSURE (50),(90),(93),(170),(175),(225),(244),(253),(259),(261),(262),(263),(264),(266),(267),(269): Identity of amino acid sequences at the above locations are unknown.
RRGTNQEEKGKPSEKGREAQRREAGGGERNDGRRGKTRRGEKKKKEGERXEGGARRRGERGRGGRERKGGKRRGRGKGKGDKEKRRRERXGKXRRKEGKGKREGKRGREGRREGGKRKGEGREKEGGKGKGRKEERREERKRRKGRGEKKRKKRKKEKGGGEKEGEKRGXKEEGXRRKREGEEEKRGERRGKREEEKKGEKKGEERGREEKKGRKEEGGKGEKEXKERKEKRKRKEKKRKREEXEDKRRGGRXRRKVRXSXXXXGXXSXDPAISMKNIISTIKFINIQIS

SEQ ID NO: 33421 - protein, 256 aa, A.fumigatus
  UNSURE (50),(89),(93),(170),(175),(225),(243),(252),(253): Identity of amino acid sequences at the above locations are unknown.
GEGQTKRKRGSQARREEKRRGEKRGEERETTEGEGRQGEGRRRKKREKEXREEQGEEEREGEEGEKEREEKGEEGGRERGTKRREEGRXGEKXGGRKGKEKEKGKEEGKGGGREEKGKEKGGKRKEEREKEGKRREGKRGREGRGEERRKGRRGKRKREEERKKGRKEGXRKKGXEGRGRERKRKEGKGEEKGKKRKRERRKERKEGEKRRKGGKRKEERGRRKXRKEKRSGRERKKKGRERXRKTRGEAEXXGGK

SEQ ID NO: 33422 - protein, 260 aa, A.fumigatus
  UNSURE (49),(89),(93),(169),(174),(225),(243),(252),(253),(258),(260): Identity of amino acid sequences at the above locations are unknown.
ERDKPRGKGEAKREGKRSAEERSGGRREKRRKAREDKERGEEEKRGRKXGGRSKEKRRERERRERKKGRKKERKGEGKGGQREEKKGEXGKKXEEGRERKKRREKRKGREEGGRKKERRREGKGRRKGKRKERGEKGREEEKEGERREEKEEEEKGKGRRRERRGEKRXKGRRXKKEEGGRGREKRGKERKKGRREKGREERRGKRERREEREERGRRKGGEGRXGKKREAEEKGKKKEERGXGRQEERRKXXEESKXEX

SEQ ID NO: 33423 - protein, 273 aa, A.fumigatus
  UNSURE (5),(7),(8),(10),(11),(12),(13),(15),(21),(30),(49),(99),(104),(181),(184),(224): Identity of amino acid sequences at the above locations are unknown.
DGRVXAXXTXXXXAXPYFPPXSSASPLVFXFLSLPFFFLSLPLLFSFLXFLLPLSSFLFPPFLLFSPSFLSFLLSLFLFFPFSSPFPSFLFLSLPLPSXPFFLXPSFLPFFLSSSLFLFPLLPFLLSSPLPSLPLFPSLLFPSFSLSSFLFPPFSFPFSSLPPPFPSSFPFSFSFPFLPPXFSXSLPSSLLFVPLSLPPSSPFSSLSFSPSSPSLSSSPCSSLXSFSLFFLLLPSPCLPSPSVVSLSSPRFSPLRFSSLLAWLPLFLLVCPSP

SEQ ID NO: 33424 - protein, 286 aa, A.fumigatus
  UNSURE (18),(21),(24),(25),(27),(29),(34),(35),(44),(62),(113),(118),(194),(198),(238): Identity of amino acid sequences at the above locations are unknown.
MLINFIVEMIFFIEMAGXALXRPXXLXLXLTFLXXLPPLLLSSXSSLFLFFSFLFRFSFLSXSSFSPFPPSSFLPFFSSLPLSSPFFSPFFSSSLFPLLSPLFSSSPSLFLLXPSSFXPLFSPSFSPPPFSFFLFFLFFSPLPFLLFLSSLLSSFLPFPFPPSFSLPSPFLFPPSLLPSLPLFPSLFPFPSFLXFFPXLSLLLFSLSPFPFPLPLLFPPFLSLPPLPLSPLLLAPPSXLSPSFFFFSPLLVFPRLPSFLSPPPASLLCASLPFSLGFPFSSWFVPL

SEQ ID NO: 33425 - protein, 357 aa, A.fumigatus
IVTREFKKPSFSPSNTNQEYITVVEAISADGHFIPPFIIFPGKCILAGWFDVCDEPDYIIGVSDSGYINDILAFQWIQHFKHHTRRRMLGVKRLLLCDGYGSHMTYEFINFCEKNNILLYFLPPHTSHILQPLDVGVFHAYKHWHSEAIENATQTGCGKFTKVEFLSALFEIQHRTFKQRTLKHAFRLTGLNPWNPSVALERLQDSKLFTDESSSNSSFSITNTPQTARQIDQFNRHLLDLSPTEEDSFHTTLSKLVKAAKTQAILVEHLTERVRESDTAKLARQRRAQASRAHLQIGGIMRKEEVTRMKRIRQDYDELVEKNRLQPQWRKVMAELQEYCLAKGIIVRKRRKVRKVV

SEQ ID NO: 33426 - protein, 277 aa, A.fumigatus
  UNSURE (9),(11),(12),(15),(16),(18),(19),(20),(25),(26),(35),(53),(103),(108),(185),(189),(228): Identity of amino acid sequences at the above locations are unknown.
YFSLRWQGXRXXDPXXYXXXLLSSXXFRLSSCLPXPLSSFFFPFSSASLFFPXLPSPPFLLPLSSLSSLLSLFPLLSSLPFSLLPFFLSFPLFSLPLPPSSFXSLLPXSLFSPLLSLLLPFPFSSSSFSSLLSPSFSSSLPFSPLSFLFPFLLPFPSLLLSFFLPPSSLPFLFSLLFFLSLPSSXFFPXSPFFSSLCPPFPSPFLSFFLPFFLSLLSLSLLFSLLLPXLFLPLFSSSPLSLSSLAFRRFSLLPPLLSSALLFPSRLASPFPLGLSLS

SEQ ID NO: 33427 - protein, 76 aa, A.fumigatus
YFAPDYELDVRPSNMDNANTKDYLDKIRAQVVENLKRTAFAPSVQMTDVPREPLVEGMDDEADAILDDLDEDEYLD

SEQ ID NO: 33428 - protein, 191 aa, A.fumigatus
PGYELWPLQEDGDLRECSWTFKARFKQNTNGLSAQRAKPASKYEMTQFHTDEYIDFLSKVTPDNMDQFSKEQGKYNVGDDCPVFDGLFEFCGISAGGSMEGAARLNRNKCDIAVNWAGGLHHAKKSEASGFCYVNGKLIFLAAIVIIQRHLLTFYRDRSWYPRAVTFQAKSSLRRYRCPPRRRCRGSVLHN

SEQ ID NO: 33429 - protein, 105 aa, A.fumigatus
QIPVRLCTVSFTMAAPPIDLNLNGSGDRSRKVAYFYDSDVGNYAYVSGHPMKPHRIRMTHSLVMNYGLYKKMEIYVSVHGLSRLGSSRTLMGYRRSVRNRPQSMK

SEQ ID NO: 33430 - protein, 216 aa, A.fumigatus
MVSLSSWRRLSLSNDIFSLFTEIVLGILELLRFKQRVLYVDIDVHHGDGVEEAFYTTDRVMTVSFHKYGEYFPGTGELRDIGVGQGKHYAVNFPLRDGIDDISYKSIFEPVIRSVMEWYRPEAVVLQCGGDSLSGDRLGCFNLSMRGHANCVNFVKSFNLPTMILGGGGYTMRNVARTWAFETGILLGENLGPELPYNDYYEVGLDWFKCRMPADC

SEQ ID NO: 33431 - protein, 85 aa, A.fumigatus
DTPNLIDNSETVHISSLALLKMLRHGRAGVPMEVMGLMLGEFVDEYTVRVVDVFAMPQSGTGVSVEAVDPVFQTKMMEMLRQTGR

SEQ ID NO: 33432 - protein, 169 aa, A.fumigatus
  UNSURE (160): Identity of amino acid sequences at the above locations are unknown.
VSAGQSKLESCTADRSSKLRPETVVGWYHSHPGFGCWLSSVDINTQQSFEQLTPRAVAVVVDPIQSVKGKVVIDAFRLIQPQTVVMGQEPRQTTSNLGHLNKPSIQALIHGLNRHYYSIAINYRKTGLGENMLMNLHKHVLTEALQNDRLPLRKATTMWXRIEQLVYPC

SEQ ID NO: 33433 - protein, 353 aa, A.fumigatus
YYLPFTRIPASPARIFRVRHRRRIHPASFFPSTLLNCLQLLLKSHRITGFTTTTLFPSSSFLPLIPVFHHIISEKSHLFSLAMSTRRSLRSRPMRDDQSSIDSDLSPRRTRSTRGVPPAPLVTVTRSVSGSAENPIRSLFLTVRMPSSKLREVTGGSARGITSTRRSHNVFTENPIITGPRSSRPKRKLVEVSTSEGDDLADQEEDEVDEDAPGEDDVDADGDLELDDAPPRPPTSKRNAKGTATSTGKSVKSVEEKEMELEEEDDEDDDELSELDTDAEGEPDDQDESGLGNGNGGDEDLDEEDEEDEEDDDSEEVTPGGDLSRLTKRQRGTLGNDFLQLPMGEFSFCKCFQ

SEQ ID NO: 33434 - protein, 146 aa, A.fumigatus
SAAADRIPEPQVKKHLTAEERAMRRAEMARRRKNLSEKRNEEEKVRWAGEAAFLGLEISLSTGCITSLTCKHRWIRLIGCCANRLQNVVVVFQLLKRKPTPPKQRQKRQRNHSQRWSDGSVVARAVVSVCLKNGSGLLRDASLGNS

SEQ ID NO: 33435 - protein, 79 aa, A.fumigatus
PAKIASGRDLFAIIVFLVFFILFIQVLVSSISIAKPTLVLVIRLTLGIRIQLRQLVIIFVVFLFQFHLLLLHALHRFSR

SEQ ID NO: 33436 - protein, 266 aa, A.fumigatus
GSGIRSAAALHWKHLQKENSPMGSCKKSLPRVPLCRLVNRLRSPPGVTSSLSSSSSSSSSSSSRSSSPPFPLPSPLSSWSSGSPSASVSSSDSSSSSSSSSSSSSISFSSTLFTDFPVDVAVPLAFLFEVGGRGGASSSSKSPSASTSSSPGASSSTSSSSWSAKSSPSLVLTSTSFLLGRLDRGPVMMGFSVKTLWERLVEVIPRALPPVTSRSLLEGILTVRKRDLMGFSALPETDRVTVTSGAGGTPRVDLVRLGLKSESMLD

SEQ ID NO: 33437 - protein, 421 aa, A.fumigatus
LAQGTGMLMTAGCSSNAKLEADSIFLNRGTAIAKIVAENTASNDSLFERDVEMWVFEEKVEIPKNSRHYDPSSPLCQGPQNLTEIINKTHENVKYLPGIALPENIHANPSVVDAVKDSTILIFNLPHQFINKTCEQIKGKILPYARGISCIKGVDVTEEGVSLFSETIGKTLGIYCGALSGANIANEVAQEKWCESSIAYDPPHLDSKAPSPNRSPSASTVDVVHFEHKDVSGQLSQVKLQPLPSEYPPIDHTVLKTLFHRPYFHIRVVSDVAGVSLGGALKNIVALAAGWVDGMGWGDNAKAAIMRVGLLEMVKFGEKFFGATIDTRTFTEESAGVADLITSCSGGRNFRCAKLSIERKQPIDKIEETELNGQKLQGTLTAVEVNKFLKKQGLEDEFPLFTAVYRMSPSPFCAALFVRNY

SEQ ID NO: 33438 - protein, 732 aa, A.fumigatus
SSVGTLRNLGLPKEFKTVNNLLAIRTALQEKVISGIRLWEYYVIDVTANAGHILENWKASELKHSASKKYAEVDISGFKDRPLKQQADLIRQHAIPTIKQVLGRFGRALDPEFGSLVLTAMFGKYDSSNSDIASIEKALVTILDEVNVPFYEEYNADVSEIMNQLFNRIKYIRIDDHGPKLGPVTDENPLIETYFTRLPLNDITKKHSPKALALVNNGWIWNADAMRDNAGPESKAYLRREVIVWGDCVKLRYGSSPEDNPFLWDYMAKYTRLMAKHFSGFRIDNCHSTPLAVAEYLLDEARKVRPNLTVFAELFTGSEEADYIFVKRLGINALIREAMQAWSTGELSRLVHRHGGHPIGSFDVELPSAGSSHAIASAGVNQNQEKISHIRPCPVQALFMDCTHDNETPAQKRDARDTLPNAALVSMCASAVGSVMGYDEIYPKLVDLVHEKRLYFSEFSQSAEVRHDCERGGIGGVKKLLNELHAMMGVEGYDETHIHHDGEYITVHRVHPKTRRGIFLIAHTAFPGHSTNAVLAPTHLVGTQAKHIGTWNLEVDASDSMRAVILSDKDHLRGLPSRIRKFEGTKAEQQGDDTVISVLDTFAPGSIALFETSIAKAEHAAGLENNITEGVDEAFAELSLVDLNFVLYRCDAEERDLSGGQDGVYNVPNHGPLVYAGLQGWWSVIGRYHQVQRTRPSTLRPSPSRPVGPRFHRRAHGESRKEGRIHCTGEAC

SEQ ID NO: 33439 - protein, 542 aa, A.fumigatus
AVARTGFTTSPTMDRWSTLVFRDGGASLEDIIKYNALGHPLCDHLRHGQWALDFIVGRMERAAKKEGYTALEKPAKWLHEKFQAVRDLPSFLLPRYFGIIIQVAYNAAWKRGIQLLGPDVRQGQEFIHQLGMVSVQVTGLVKSASLWPTKTVPSLAAGLPHFAVDWARCWGRDIFISLRGLFLCTGRFDDAKEHILAFASVLKHGMIPNLLSSGKLPRYNSRDSVWFFLQAIQDYTKMAPNGIEILNETVARRFVPYDDTWFAYDDPRAYSKHSTISEVIQEVLQRHAHGLSFREYNAGPDLDMQMKPEGFQIDVKVDWETGIIFGGSQHNCGTWQDKMGESGKAGNKGVPGTPRDGAAIEITGLLYSALTWVARLHERGLYPHDKVDIAEGRSITFKEWAAKIKQNFERCYYVPESPEEDGQYDVDPSVVNRRGIYKDLYKSGKPYEDYQLRANFPIAMTVSPDLFTPSKALGALALADSVIVGPIGVATLDPSDLNYNPNYYNSEDSDNFATAKGMNYHQGTEWVWQRGFFPPAFLHFGS

SEQ ID NO: 33440 - protein, 84 aa, A.fumigatus
RSSGPWPFLSFCNATYLYAEKAPGKTEMKPKADSSGLSRMLLSLYSKFCPATNGLSNFLPCDSMTLISPQAPPHMGSTSNAFHS

SEQ ID NO: 33441 - protein, 363 aa, A.fumigatus
CESQGNFFLVFHILTTYLGDAELLGTTGKVLGVVFEWLYLATLVTCFVLSLGNRPGGSNKFYMTMVYFWIGIMIYLTFAAIFVTVKSIQKEVADNSFSVGQLFSNSQFFSIFVSLGSTYVMWLLASLIFFDPWHMFTSVSLLRTLAICEANLYQFIQYMLLTPTYINVLNIYAFCNTHDITWGTKGDDKAEKLPSANMKPGGKVDVDIPQDDGDLNAQYEAELAKFAQKPPKETKVISEEERQADYYKGFRSAVVLAWVFCNFALGAVVLSAAGLDRFNSDKNATDDDRATIYMAVVLWSVAGLSIFKFIGAMWFLVVRMVCSRIFDFSILLSHANASHSSEAFDVISLVFSFPCDCTHPALY

SEQ ID NO: 33442 - protein, 69 aa, A.fumigatus
TFGTGAFIAVFGGYQVGMAKQRVNGKDVAQHFYEYTTQVGFEFRGTRVHIRGRSACPVQMIFCLKEKNQ

SEQ ID NO: 33443 - protein, 294 aa, A.fumigatus
KINSHRWLFQAFGRVLDPNICVLLDAGTKPGRDSIYQLWKAFDVEPMCGGACGEIKVMLSHGKKLLNPLVAGQNFEYKLSNILDKPLESAFGFISVLPGAFSAYRYVALQNDKNGQGPLERYFLGEKMHGANAGIFTANMYLAEDRILCFEIVTKRNCRWLLQYVKSSTGETDVPDRMAEFILQRRRWLNGSFFAAVYAIAHFYQIWRSDHSFMRKFMLLVEFIYQTINMIFAWFNIVCAVFSSPEWTNANVNRRATSSWSFTFSPPTLVTPNFWGLRVKSLVWSSSGSILRPW

SEQ ID NO: 33444 - protein, 119 aa, A.fumigatus
PWGTYFLPAALFENSMLLVRIMVGKVADGNHLVKILRDTPIRQGQLGWNCVYWVKEALETLKANPKALGTSIIKWEKVRSEAMDYYQRKKDQHRFDGQGNFNMRKVPTYDLMERKEIII

SEQ ID NO: 33445 - protein, 287 aa, A.fumigatus
RGYLNDALTGSLQSNDGILGFDVGHKVQPTPTLIPSLKKIKHLACGDNHVLALDEKGAVFSWGSGQQNQLGRRIIERNRLNGLQPREFGLPKNIVHVSCGAFHSFAVDATGKVYAWGLNSFGETGIREGAGDDEAAIIHPTVVDSLSGKNIVQLCGGAHHSLAVSKDGQCLVWGRLDGFQTGLKVDTLPDDAVVKDERGRPRILIEPTPLPGIKASVVAAGSDHSIAIDVDGRAWSWGFSATYQTGQGTQDDIEVATVVENTAVRGKKLNWAGAGGQFSVFTEPATV

SEQ ID NO: 33446 - protein, 397 aa, A.fumigatus
KKSNYSRISKIAFLIFLWRPVFQQIHTLLCICINLFPSIKTASEIFIMFVSLLSPLMHSVHYPPSPFPLEKVFWYSNKQKKKRELPPKKRGPKAAAKPSTSTTKTTTTKKTTVAKTANKGQPAKTTAASQLKATSKKQSQATDASAKSRKSKATSASAAAATKKRKAEEVDKEPDVKTKKARVTQPPVKKPKPKVVINHAPTTRLNVYVCGEGSSGELGLGTAKNAVDVKRPRLNPHLPADRVGVVQVAVGGMHCVALTYDNKILTWGVNDQGALGRDTTWEGGYKDIDDNKSDADSDSDSDDDSGLNPYEATPTAISSDAFPPETVFVEVAAGDSSSFALTDDGQVYGWGTFRVSYTRRLLPTNFFFCSSSLPPVKGLPQRCANGFSPEQRRYFRL

SEQ ID NO: 33447 - protein, 114 aa, A.fumigatus
YTLSFGPSTAGVKTIGPTNGPVYGPIIGGFVFENLGWRWTNWIVLIIGGGVLVLMASIKETYAPVILRRRAARKRKETQNSRWWTRYNGEQDFKSSLRANLSRPFRMLLTEPIW

SEQ ID NO: 33448 - protein, 220 aa, A.fumigatus
RSNSIFWDVYVALVYGVLYLCFVAYPIAFQQERGWSPGIGGLSFIGIGVGVLIAIACEPIFRKIINLHRKSEDGIVEPEAMVSIVGFGATLLTVGQLWSSWTWTPSVHWIVPILAGVPFGAGNACVFIYASNYLARSYGIYAASALAGNMLLRSIVGACLPLAGPSMYGNLGLNWASTLLGLLEAACISIPVVFYFYGHKIREASPLLKKLKDHTLSPHH

SEQ ID NO: 33449 - protein, 736 aa, A.fumigatus
ERVSFQPRPCRRFILSLGSCDSCLVVDDELNVLPISGGKNVKPLPPPETLDDNTGTKKELKEIKDSLADTQPVGSLVSLARTVDQAKALLTFVDVIAEKTLRSTVTLTAARGRGKSAALGVAIAAAVAHGYSNIFITSPSPENLKTLFEFIFKGFDALGYLDHVDYTILQSTNPDFNKAIVRVNIHRQHRQTIQYIQPQDAHVLGQAELLVIDEAAAIPLPLVRKLMGPYLVFMASTINGYEGTGRSLSLKLIQQLREQSRGGLKANGQDDTDIADRATGKAAKSAEKNLGGRSLREITLSEPIRYAPGDSVEKWLNKVLCLDATLPKSKINTQGCPHPSQCQLLQVNRDTLFSFHPVSEKFLQQMMALYVASHYKNTPNDLQLMSDAPAHQLFVLVPPIDEEATKLPEPLCVIQVALEGRISRQSVLNSLSRGQRAGGDLIPWLVSQQYQDEDFASLSGARIVRIATNPEYMNMGYGSRALELLIDFYEGKFTDLSEKIPDVQEEMVRVTDEELANSSLLDDNIHVRDIRSMPPLFGKLSERRPDALDYVGVSYGLTPPLHKFWKRASFVPVYLRQTPNELTGEHSCVMLRTLASAASDASWLGEFARDFHKRFIALLSYQFREFPSVLSLSICESVTAGAKLDTSYTPSLLTKSDLDAAFSPFDLKRLDSYANNLLDYHVILDMVPTIAEYYFSGRLSGKVNLSGVQQSILLAIGLQRKHLDVFTHGGAEGSRA

SEQ ID NO: 33450 - protein, 99 aa, A.fumigatus
  UNSURE (99): Identity of amino acid sequences at the above locations are unknown.
FRLQWIEEANERCPGVPIILVGLKKDLREDPLAIEEMRKKSLRFVTSREGSETATQIGARKYLECSSLTGEGVDDVFEAATRAALLTFDKRKSSCCIVX

SEQ ID NO: 33451 - protein, 107 aa, A.fumigatus
PYHQVPTVFENYVTDCRVDGRSVQLALWDTAGQEDYERLRPLAYSKAHVILIGFAVDTPDSLENVKHKVRSCWNSLIFATGQLTSSGCSGLRKQTSDVPAYLSFLSD

SEQ ID NO: 33452 - protein, 113 aa, A.fumigatus
  UNSURE (13),(15): Identity of amino acid sequences at the above locations are unknown.
LIHARIRRARGEXHXTMQHELFRLSNVRRAARVAASKTSSTPSPVNDEHSRYFLAPICVAVSLPSLEVTKRRDFFRISSIARGSSRKSFFSPTRMIGTPGHRSFASSIHCSRN

SEQ ID NO: 33453 - protein, 101 aa, A.fumigatus
YFSRSPPCDSGATDLHPLRSIFFCRLTWTLPASPACGQRVLFHPSSALIFPILSALDLLLSLFNSPPPSSQVSHSCEGLLALDILFVQLSRSHFTPLAARR

SEQ ID NO: 33454 - protein, 217 aa, A.fumigatus
NRNGCASSTARVNFSSALIKGFGFNGIYATLLQLPTGVTQAVVVPICGLIATYVRDSRCLVLAAVCLIPFGGLLGIRFTSLDHRWTLVGCTWLQYIIGAPIIVSWNLLATNVAGHTKRSMANGMWFTMFAAGHVAGAKIFFAREAPRYHSALAGLLICYAGMIVLALASYTYMKWENLRRDRKPSPDDDVSRREEAAILDGFKDLTDMKSKNFRYAL

SEQ ID NO: 33455 - protein, 63 aa, A.fumigatus
PYLDHKFRSRVIPLGGRNDPVNEKGLQHYVKFVDDLLAAGITPLVTIFHWDLPDALDKRYGVF

SEQ ID NO: 33456 - protein, 111 aa, A.fumigatus
PPRGPDRERRLPCAIFPRVYRCHGGRLHPGRCECPRLHGVELDGVSFVFDSEVPVHLADKSSFVCSNFEWAEGYETRFGVTFVDYANNQRRIPKKSAKVLREIFDQYIEKA

SEQ ID NO: 33457 - protein, 83 aa, A.fumigatus
LIVAVISLSSYQIEGAVDEDGRGPSIWDTFCKIPGKIAGGASGEVACDSYHRTHEDIALLKECGAKAYRFSISWYIFCTASGH

SEQ ID NO: 33458 - protein, 222 aa, A.fumigatus
DWHYLEWYEFWPPCAQLDEVVTDQVPGDWAEPWDPENPADVEACDRKIEFAISWFADPIYHGKYPDSMVKQLGDRLPTWTPEDIALVHGSNDFYGMNHYCANYIKAKTGEPDPNDVAGNLEILLQNKNGEWIGPETQSPWLRPHPIGFRKLLKWLSDRYNQPKIYVTENGTSLKGESDLPVDQIVNDDFRVQYFREYIAAMADAYTLDGVNVRAYMAWSLME

SEQ ID NO: 33459 - protein, 155 aa, A.fumigatus
  UNSURE (89): Identity of amino acid sequences at the above locations are unknown.
KGSPALCQVRRRLARGGYYSSRYHLPLGSSRRPRQAVRCLLNKEEFVADFANYARVMFNAFGSKVKYWITFNEHWCSSVLGYNVGQFAXGRTSDSTKSPVGDGSRERWIVGHNIVVAHGAAVKIYREEFKPRDGGEIGITLNGTSSGLHVHSLMK

SEQ ID NO: 33460 - protein, 419 aa, A.fumigatus
  UNSURE (406): Identity of amino acid sequences at the above locations are unknown.
HRLCPCPSHYSPGLPLPPNFNYNRLHYYCFHLNSHNFLPSPSLFHPPTQSHISETILFNSAHFKIYRPHIFIFLSRLTADWNSPGANHFAPGAFLWCAHTKPFPSFNTTTIRSIYTILHSVSLIHWISKYATMLLPSALPCDMRRSSTRSRFTPNRLFSTPPPSDNDFFPSSNGLLGTCRALQSLLSGSPAPPSRRAKPERLQSPFHLASSTTSSSSTRPRKPKTQTRSQRSSAKTSSKLARAANKRTRASYEADSDADSEDHTPRSRFSTPKRRRYVPYDLPLGLSQSDFYTLNSPPTTQSPPSPVPRRQQGLCDEVRAPLPPSPSPSSQSQFDPDAALPSIEEIGPETWTSEDDQQLVEVVLEKFQLSKRDWDECARQLGKDQDSIGRRWETLIGEGNVGLRRXRRMVRGRIDESWL

SEQ ID NO: 33461 - protein, 89 aa, A.fumigatus
LIAVCGTPHSDCDTDCAHVPPTILQASLSPQILIIIASIIIVFTSIPTTFSLLHHYSIHQLSRISRKLFYSTALISKSTVHTFLFFSRV

SEQ ID NO: 33462 - protein, 87 aa, A.fumigatus
WSFQPRGEDLTSMTNHKAWSRPPLSLSFSLLMFTSSGLLVRYLKVFEKSNYSSVKWVRYMTRAGSYEIRYFTSSLVPPVYMRLSERD

SEQ ID NO: 33463 - protein, 71 aa, A.fumigatus
SRPSLARLRLGLGVLDITDTSVHLLYPAAIMRSRYSVSTKTGNPVGDIESLDTMATLSKINIDLHTRIHSC

SEQ ID NO: 33464 - protein, 268 aa, A.fumigatus
  UNSURE (12),(96): Identity of amino acid sequences at the above locations are unknown.
TISGPPWRSSAXSGISPRPTITLWGYSGGSLASGLAAELRGWYAPELNIAGAALGGTVPKIMPLFNTVNKGIYAGLLPAGMQGLFNEYPAIEKILXDHLVPAKKADFVKTKNLCIVEDLLTYSFQDFYRYITDANMLKDPEVTRVLGENAMGQHVPDIPLFVYKSTNDDVSPVGDTDALVSGYCAAGGKVEYYRDELSNHATMAVIGVPNALLWLKDRMNGVPARAGCKTQTALTGLLDPRTLAVLGIDLIKVLLALLSAPVGTFVIG

SEQ ID NO: 33465 - protein, 90 aa, A.fumigatus
RLSVRLIKPCKGSMTPGRGSTQCKDSFWGLEEVCKILLLTRDRKTIYFGDIGRNANTIKEFFGCHITPCPPKANPVEHINDVVTGMGGDG

SEQ ID NO: 33466 - protein, 126 aa, A.fumigatus
VSVIHVICTRQTASACHSARQMLTPLALQVSPIQNAVYLMSMAIIAGARTLHQVRATVKAGFMPVMKVSWITSPLALAFAQKFLPEHTWVPFFNIIGFFIGTYVNTHTKKKRLEALRKVQSTSRTK

SEQ ID NO: 33467 - protein, 67 aa, A.fumigatus
SLDAPEENPDGIGIEGAMRFLGDIQVQLDEVACLGIAELLKSPSMGEFTREGFVNGWRGVGSVSSQS

SEQ ID NO: 33468 - protein, 530 aa, A.fumigatus
ADITTPCTMSSLKLREPTSADSTTLLSPSNGLTALVGMGDLTIGPTQTKVFNLTSVPREAGDSRVASITLLIEDERFDLACAITDLTQRDSVWWQQTTSGVARKRVGKDRDTCRCKIMPKPPKIRISTPNIRETYYTNERVVLELDIYNEEDEAADVSAEVRLFGHPDSAAQILWLDEEGEAISPRSQDSSPIQGARHVAKRSIGIMDRSSRQQLMLVLTDTLEPSTHELQITCVYNLLSDFQTPIIATHRLGLSIVRPFEANYDFLPRLHPEPWPDFFIIDDDLVGDETLSKPRGLRQRWCLNSKVVSFALEPLVIERITLVLLSLGGGAVCDIGSEIVADPHALEIRPEELRESTFILEVQKLVLGDRRPTALNLALEIQWRRIGTDAAASTADSANVTTTTLPIPRFVIPAGEPRVLASALNSEAIPGLIHLDYTLENPSMHFLTFNLAMEASEQFAFSGPKTAVVQLVPLSRHTVRYNLLASKRGLWIQPQLNVVDTYFNKALRVQPTEDMRSDKKGILIWVDADD

SEQ ID NO: 33469 - protein, 209 aa, A.fumigatus
RHVNRHLRWNLNQRVCATYRARVVRSVDEDCSRLDLLNEILSSRDILRPNACCESELAVVHELDCLLVALDLHHGKHRAKSLLRHDTHIVIDACQQCGLDVITIGRKIVERLVGRGFVPSALLDRLSDMCQNRLLRALRDDRPNLCSLLRRIPNTIFAQHPLHFCDKRLVDVLVDVHPLNRAPALTTVEDCPINNLPPPSTPHSRSSRT

SEQ ID NO: 33470 - protein, 60 aa, A.fumigatus
CQELGPYWRTIEIDLGNNNITGNSHDGQEFEGWLFKISTLTRHARPLSPVTGRLRIARQR

SEQ ID NO: 33471 - protein, 137 aa, A.fumigatus
MWRGRRRKIVDGAIFNSGQSWCAIERVYVHKNIYETFVAEVKRVLSKYCVGDPSEKTTQIGPVISKRAKETILAHIAEAVEKGARDETPANETFDNLPADGNYVKPTLLTGVNHNMRVMTEETFGPVLPVMKVESDE

SEQ ID NO: 33472 - protein, 131 aa, A.fumigatus
AVKLMNDSEFGLTASIWTKDVPRAEDLIEQVEAGTVFINRSDYPSPVSSAHSLVQVPTKMTINMSLGPCMDRLEELWSWCHVEQVRVRAIRQAQELSCQGLSEVDCSYVTCYPLTTITIVMPRVRPLLANY

SEQ ID NO: 33473 - protein, 427 aa, A.fumigatus
GLLRGPFQPRVKTILKRHLVPCTRHASSRKISFNMRFSQAMSKAASIVGQYTGRYIYPAETSRHLATLLGFPSRHSISSAYYDNACTDIANLASAISAFEPVRLYSRPEDLPRAQSMVNQAIPKYTGNTSNISFIPFPTNHLWVRDTGPVYVLGTGDARSRRFAINFRFREWGKRDEMESQERAADEQDWPIMTTAQLDENATFARRVIETDVSPSPVTLVESRVCLEGGALVVDGEGTLLATESSIINDNRNAGLSRSEIEAELQRLLGVEKIIWFPGRKGLDITDVHADAEVGFIRPGVVVLSRPHASVPRAWLDVYEEIREILTRSVDAKGRPFEIHTVDEPDPALLGDLSYDEPATNYVNFYFVNGGLILPQFGDEVTDKAAVETFQKLCPGRVIQPVYVHALPLAGGVIHCATQPVIAVPQD

SEQ ID NO: 33474 - protein, 165 aa, A.fumigatus
ILPFRRPYTIRNKMLSLILTIFFVHVAIYLVNTVGATTIDTLVCSCLVPYRHSTAASLPRPQTERSTILNDMFLQLWILYLKLPTSTSRNARQQSRLKREVVQLKREMNNTSSQDEFAKWAKLRRKHDKAMDEYEAMSSYPALCTEILCFLLHIVEVQIQLIDRF

SEQ ID NO: 33475 - protein, 147 aa, A.fumigatus
WSWRRYHGFRLFISTISGESRRVGRVHRCTEPRPTESRGSRGILNQSYCYSSSHQKPSPSLPADLQTLSYSSIQHDPVLADKYAAFPVPRFLLESTTATIPVAVSESLSVYGLVPDPFDVPDFFLPVLSEYVTQCDSPAAGMGDDAH

SEQ ID NO: 33476 - protein, 323 aa, A.fumigatus
IEHRLGGTANIGLDDEMHRFGSGCILVTKSFRYLVLLLPSLFLLFSACFVDGRCVLTQSLSLRFLLAVLHDVLGMLLVLRLQNLGTGGRLFPPTINFHRHAGSSFGDGDTGFIAKRTNTSPRCTCNEDISWSQGTTSDESRRNTSIALRCSFNHPSLHRTVFVGPMVKNFRECNDSLLEFQHALTGFSAHPDSLDIASVVLHMNTMYRKVLLDLFWVDTFFVDFADSDNDRNLGFGCVLDGLNSLRFDTVVRSNHQHNNVSYIGTATTHIQEGCVARSVQEGDSLARRHSYGDCTHVLCETPGAPKRAQHDFRSRPQNGGLGP

SEQ ID NO: 33477 - protein, 85 aa, A.fumigatus
VSDFSWRYSTTSLACCSSSACRISVPAVGCSLQPSISTGMPGVASETATPASLRSARTRAHVVPATRISPGRRVPRRMRAVATRP

SEQ ID NO: 33478 - protein, 489 aa, A.fumigatus
GQLVNDPLRVHVRSWAKTTILGTAPKVVLCPLRSTGGFTQHMGAVSVAMPSGKTITFLDTPGHAAFLDMRRRGANVTDIVVLVVAADDSVKPQTIEAIKHATESKVPIIVAISKIDKEGINPEKVKQDLSVHGVHVEDYGGDVQAIGVSGKTGQGMLELEEAIVTLSEVLDHRADKDGAVEGWVIEATTKSYGRVATALIRRGTLRPGDILVAGTTWARVRALRNEAGVAVSEATPGMPVEIDGWREQPTAGTEILQAEDEQHAKDVVEYRQEKSETQRLSEDTSAINEARREQQEKRRQEENEVAEALGDQDASGPKPVHFIIKADVGGSAEAVLNSVTAIGNNEVYANVLRSEVGPISEFDIEHAATASGNIISFNMPIDPAMSRMAESRGVRIMDHNIIYKLIDDVKAALSEHLAPSVTQRVTGEAEVGQIFEITLKGREKVAIAGCRVRNGIIHRAKKVRVLRGQDTIYDGTLIHFWATPHLRHR

SEQ ID NO: 33479 - protein, 62 aa, A.fumigatus
RLAVDTVSFPLNSPVLWSFVCFSESVGDLAAITVKWLLWGLDIELLLNGGATVRSSPSSSAK

SEQ ID NO: 33480 - protein, 526 aa, A.fumigatus
FGALFCQGKSLAFLFVSISPHPTFLIRHNTIMPRPPTKRNRLTSRHVQASPKVSQKTKDPETKATANNSSPLHGTENDKGLEAQPAPSVDDIKFARQLRGQTPMNNKQEQAIASSPMGERGATGSRPPTRARGYSSTLSVGRRGADMSSKIPGTPVFESSILSNFRRRPRQASILQMMQADDGSSDFGDLDDDDFLGGLSPEDESTPLNVSRRKSLVIRHPSSSPLSDCSHPSNGGSRKRKRTGEELQVPQSPLAVVEYSPAGSISPERGDEEHGVPREILHHLADEEGLDRTVAPPLSSSSMSSPQSSHLTVIAAKSPTDSLKHTKDHNTGEFSGKLTVSTASLQDRLLPRRHKNHRRNGVPGDLILDGESEVDYSVDQDEDELSYLPTRKPAQPRRRKNKPKPLEVVRAKHRKQGATKALSGELISQTESAGMKDTRQKRVNGPRSNQTADADKENQAIEVSSPLSSPLDTDAFDLESSPVPIPAKNYLSEELRLQAKKFEEIDRWEMDFEDVVTTGSQTSPCR

SEQ ID NO: 33481 - protein, 285 aa, A.fumigatus
TSRAKQPSPHGATSSPSFSAPSSPPSPASSMGCTGLALQPTSSRKWSPAQSIPADPSPTSTSPGWSHQVILLSVNLANWLKVGQYTKVPHRIMFATQIYGTLLGAGLNYAVMTTIVTNQREILLDPAGNSVWSGSTVQSLNSQAITWALARDVYGVNGRYLIVPLGLVIGLALPVVHWGLNRVFPRMRSWPLNTAIIASYAGQTYYGITSWIWSSVAVGVFSQVWLRRRLPRIYNEYNYLIGAALDGGSQIVIFILSFAVFGASGKEHPFPTWWGNPAGNPDHCI

SEQ ID NO: 33482 - protein, 498 aa, A.fumigatus
KEHVVASLIASSGNNGLSGVEVYAVERLFYNISVSATTAVLGTFSISLCGFVLAGVLRPLIVYPAEMVYWSTLPQVVLYQTLHFDQRANRGRLIKFGCALGLAAVWEIFPAYIITWFGGFSIFCLASMGAPQHTRKIFSRVFGGSSSNEGLGLLNFGFDWQYIQSSYLSLPLKQQLNSWIGYVIFYPAMLGLYYRNTWSAKSFPFMSTSLFTSNGKQFSTTSILSDRCTVDYNKLKEVGIPYLTSSTVWGYLTQNLAIGALITHVLIFYGKDMYTAWKQARSRTQPDPHFQAMLKYKEVPMWWYLALFVLAFFAGLIVNIKGETTLPAWGYIVSLLLGAFIAPFSCILYGLYGTGVATNQLSKMVAGAVHPGRPLANLYFARLVPPGHSAFRQSRQLAQGRAVHQGPAPHYVRHPDIRHFARGWSQLRRHDYHRHQPARDPPRPSGQQRLERVHRAESQLAGDHLGPSAGRLRREWTVSHCAPRSGHWSGLAGCALGA

SEQ ID NO: 33483 - protein, 312 aa, A.fumigatus
  UNSURE (9),(47): Identity of amino acid sequences at the above locations are unknown.
IGRFFGGFXGSCPIAVVAAVSLDIYDNRHRGLAITVFTMTVFTGPLXAPFIGGFIVESYLGWRWTEYLTGIMGASAFVLDLFFLEETYPPVVLVGKAAELRRRTRNWGIHAKQEEIEVEFGELIRKNFSRPLRILFTEPIVLLLSIYMAFLYGLLYLFLTAYPIVFQRIHGFNKGVGGLPYFGIIIGEFLGGIFIMLLQPWYNRQLSAYKDIPIPEWRLPPAIIGGVAFSGGLFWFGWSGYRSDIHWIVPTLSGLLTSFGLFCIFLQCLNYIVDAYLVLYVSPSHISPSGAMLMSCHVVLLQPWLQTVFCVL

SEQ ID NO: 33484 - protein, 106 aa, A.fumigatus
CCFSPGCKQCFAFYSWCRIPTFFNLYGTFGPPCYSRLLNASFRWLTRAQFNALGVNWTGTLLGCVAAIMMPIPLLFYLYGPKIREKSKFAMEYIVAAQAHNDERAE

SEQ ID NO: 33485 - protein, 386 aa, A.fumigatus
ILTDFKTYRGLWVSPNGLPYQARCVAVIVNLVFCQPSDLGLFPPVTHLESAKIVAFQSESNSRLRAIITTRNRMSRITPRTHQTYDYEPLPSPASIRLLRVDHKDPDGLLHCTIKNVDLRDEPLYHAMSYTWGNPHSELAQVQETRDRYSDNYPPEHRECVSVKGKLLYITRNAYDALLSVPRDAWAQCCNRGDRRKLLRTSLHWASIAGKEDLIEPLLCSGVDVNVRDEWGVTPLSYAAQVGSREGVELLLSAGADAGIVDNRGNTPLDYARQGNYQGIIQSLEEVMQKGGRLEPRVDWPEGPERWCWIDQICINQDDIAERGAQVAIMDQIYNNAAFTLVWLGPEDAYTDTAIKTIEKLDTAAGDFIQSKEIHPYREQPEEIYA

SEQ ID NO: 33486 - protein, 89 aa, A.fumigatus
PRCNQHRLHPEEDLPSNVPTTAQLRHHPTIVTRSVPRLERLTTMRVLERKVKSTFLLRLLANLASPIGRTLVIIPMHAPRLELSFWTKT

SEQ ID NO: 33487 - protein, 188 aa, A.fumigatus
PLEVADRLYLASYDSPPDPKAPFPFPLEQAKSPSKRSTRGQPQTPSKKRYPVYFTADDTLFYNSFHADFGPLHIGHLYRFAVHFHEILGEPANKDRAVVFYSKSDSRSRANAACLVACYMVLIQSWPPHLALAPIAQADPPYMPFRDAGYSQADFTLTIQDVVYGVWKAKEQSLCSLSSFSLEEYVYG

SEQ ID NO: 33488 - protein, 429 aa, A.fumigatus
PFDPALTGLARYEKFERVDMGDFNWITPQFLAFASPQHEPVALIPSNTPEYAALPSTVSQVISSKLPLPFKNVLAHFATRNVGLVVRLNSELYSPSYFTALGINHIDMIFEDGTCPPLPLVRRFIKMAHEMITVKNKGIAVHCKAGLGRTGCLIGAYLIYRYGFTANEIIAFMRFMRPGMVVGPQQHWLHLNQGSFREWWFEDSMKEKLAQMQPAPITPGRGSTKQRANNGPIATPPNNSHSKRSALGEIDHNEGAGTQSEEYLPAPTPGQPRKSHRKDSRHHPYARTTSGTLLLDKDMNKTEEQTRQRSSRLSNDSSESEEEIQLRMLAKRSSRSPVASPSQRSVSYSATVTASYTLTDDIHEDRENWGEAGHAAPKTPLSSKSGSGAISVTKVRTSPRRVTDSRSASKGVRKISGRIGSTGSPTRVK

SEQ ID NO: 33489 - protein, 68 aa, A.fumigatus
RYAGYSTCYRKEAGAHGKDAWGIFRVHQFEKVTSDNPVIVRLLACSCIPRLNNSFLPSLKTHGKFLRR

SEQ ID NO: 33490 - protein, 149 aa, A.fumigatus
HFSNIKFTLEPFLSSFNCSIPLSSLNYLLFNCFLSVIVKMATSAREINIRRDLNVSQNPNLSTSPTASFQSAPSSHGGSAFAGRAIPLANAKHLKPFATEDIKVLLLENVNQTGRDILTGQGYQVEFLKSSLPEDQLIEKIRFVWPNLL

SEQ ID NO: 33491 - protein, 134 aa, A.fumigatus
VEQFVLTKPENSWQVFEEMMATSEEFYQSLGLPYQVVAIVSGALNNAASKKYDLEAWFPFQGEYKELVSCSNCTDYQARALEIRYGTKKATDVKKSYVHALNATLCATERTLCCILENYQTDDVCVETSHLIWH

SEQ ID NO: 33492 - protein, 81 aa, A.fumigatus
ISDVHVIGIRSKTKLTSRVLKEARNLIVIGCFCIGTNQVDLQYAAEHGIAVFNSPFSNSRSVAELVIAEIMSSHRGPAIRA

SEQ ID NO: 33493 - protein, 318 aa, A.fumigatus
LGSRPAWIRSYEVANDEAEASGTARLLPPQPGDALVAQHNHSPYTTTRPDYTGEQGFDEETGLGPRRESRWKSFSKAIAYPLEPGLEEKLVTPEWLNQNHTDFSQPWRGQLEPSEDTEDPLKMKRRRQIWFKRFHRTLLKSPIVPLIFRLTIWCFSLTALALGGSIQHLSDKYQHPQGPSALMAIIVDAVALVYLIYITWDEYTAKPLGLRSPAAKARLILLDIFFIVFDSANLSIAFESLSTVSGACTLAEINQQISKKNNAICDRQIALACVLLVALLAWLITFSISVLRYDTPYSNKCAVLTVFLDNRLVERVAQ

SEQ ID NO: 33494 - protein, 65 aa, A.fumigatus
GLLAMVITAYIFPDYLNNFGNSSTLTLPSRIPVLVSTVFSSHATIDLKLTIDCIEQWKIVQLAMR

SEQ ID NO: 33495 - protein, 161 aa, A.fumigatus
NLRLTALNNGKSSSLPCVDRKSHTARVVDVPCNFCPFSSDCSSSSTLTPFSTECFADRKLRPAEHEAIRSATPALSSVKVFWFTESGNQKRPKRIISIMPIRMMAALELSPQPLPATKPAASATMFFRAPHSATPATSATTCTWKYGRSKRRRSSLSSTQG

SEQ ID NO: 33496 - protein, 155 aa, A.fumigatus
MPSCSMMSSEKSVTRPFATSTPLTHETARAYGRWWPFICSSVLSMNWCGRLKTRIVASLTAARRSGLATTLLGSAVPGRYLTFSWTWLMMSVNLCVWSPRASRCGESLGIVTPFSNTHICTSSSKTSGCSRVFSARILAIVDPLSSSATAIIYKT

SEQ ID NO: 33497 - protein, 104 aa, A.fumigatus
ASTAGRCPAPTSPRRSPPRSSARPPSATARRPWTSTRRTSSPPITATSSTSSASARSHLPLLSCSACRMTTPASTRGCCAASSSARTSMCRSLPTWRAWRCAAP

SEQ ID NO: 33498 - protein, 199 aa, A.fumigatus
PRQTNLRTDAYGGSAEKRAKFVLDILSQTRKVVPATFCIGIKFNSADHSSASFEDTMTQIGLLVDAGIDFLEVSGGSYEDPKVRPTPLSPHPTTRNTTLTRNTDDGHQLPTPAGKEPAHARARSLLPRIRPRNPQAFPDPHPHAHRRIPQPRRRRARPARERMRSDRHRPARRCGTGFREPAAGRECACRRGRDAPGQG

SEQ ID NO: 33499 - protein, 71 aa, A.fumigatus
KAKWMWANVSMTSILNTAAADNLTHPVLNVTGKVISSIVTLKFYCLYIYRRVCPRCVFLGCNSSNDSSYAK

SEQ ID NO: 33500 - protein, 67 aa, A.fumigatus
TGLSAGWGSPAPREMTQQDIDTVTRQFVDTARMMADAGFSGIELHGAHGYLIGMFCSAVLPFLRHCN

SEQ ID NO: 33501 - protein, 137 aa, A.fumigatus
QETQMMGTNSQPQPEKSQRTLAREAFFLEFARETRKRFPTLILMLTGGFRSRAGAEHALRENACDLIGIGRPAAVEPAFANRLLDESVPADEAEMHLGKVKPPFLLRLLPIKAVGAGLESVSFVSLSGCSDANVGWL

SEQ ID NO: 33502 - protein, 382 aa, A.fumigatus
MIAVADDERGSTIAKILAENTREHPDVFEEEVQMWVFEKGVTIPKDSPHREALGDQTHKLTDIINHVHENVKYLPGTALPSNVVANPDLRAAVKDATILVFNLPHQFIDKTLEQMKGHHLPYARAVSCVKGVEVANGRVTLFSELIMEQLGIYCGSLSGANIAPEVAAEEFCETTIGYSPPPMDLDAKDELSPDNRHVINKQRQRKISSTSAELQRVPDDYPCVDERLLRRLFERPYFHVQVVADVAGVALCGALKNIVALAAGFVAGKGWGESSKAAIIRIGMMEMIRFGRFWFPDSVNQKTFTEESAGVADLIASCSAGRNFRSAKHSVEKGVSVDELEQSELNGQKLQGTSTTRAVCDFLSTHGKLDDFPLFNAVNRKF

SEQ ID NO: 33503 - protein, 70 aa, A.fumigatus
RPRVDFGKGDNPGYRKESNEPCETLDTDFDSITESKPMMLDDRDVVCSEGLLCCDSGPGFGRIAGIDSVC

SEQ ID NO: 33504 - protein, 62 aa, A.fumigatus
NRKKKRKKKIVMKIKKGDTPYYKENVLESALLTLYKIIQTIYPGKLSANFFSDFSFAPTVSP

SEQ ID NO: 33505 - protein, 93 aa, A.fumigatus
HVLASRQAFETQLSQLDSSLFTYILSRLSFSDPRPHSAGDARSLSAAKAPRYQRVTTPFNSSLVTSSYTRLGSNGTTARRTQLLQSYSAPCGS

SEQ ID NO: 33506 - protein, 413 aa, A.fumigatus
VKRHMPPPASSMGFSDLLNPQNPESTPSTPASKSSAPSTPSTEQSNSNMASSVSLLPPLMKGARPANEEPRQDLPRPYKCPLCDRAFHRLEHQTRHIRTHTGEKPHACQFPGCTKRFSRSDELTRHSRIHNNPNSRRNNKAQHLAAAAAAAAANQDNALASNAASMMRPPSKPITRSAPVSQVGSPDISPPHSFSNYAGHMRSNLGSYARNSDRASSGMDINLLATAASQVERDEHYGFHNGPRGHHIFGSRHHNNNRLPSLSAYAISQNMSRSHSHDEDDMYSHRVKRSRPNSPNSTAPSSPTFSHDSLSPTPDHTPLATPAHSPRLRPLGTSELQLPSIRHLSLHHTPALAPMEPQPEGPNYYSPTQPHVGPSIIDIMSKPGLEAAQTPRSPSYQMWPVQVPIEFLGFPIC

SEQ ID NO: 33507 - protein, 172 aa, A.fumigatus
YGVSPFLIFITIFFFLFFFRFYPFHFLPPRIFTPHTTQSTSSFFFLFFFSFFFLCFFFFFTLVSDSDKPPPFYTPFCFFSPPESPFLSSSPPFLIILFRLFLFIPLLSPPDQLLQTFSLIFLSTLVSLTSPTRLNTHCQSRLSFRIRVRYHNTTDLHYIQHPYRRASLVLIL

SEQ ID NO: 33508 - protein, 109 aa, A.fumigatus
ATAIKYIHTHTHTYLVDCWYFYNDDGAHAATPTAPKSCPHCAIPSIVNLKYSIEDGVYRPIYSEYIIVSYRIKLNNKLRSLKYVDYSKVYSRGTLNGESHHVIDNCRPG

SEQ ID NO: 33509 - protein, 234 aa, A.fumigatus
QACVRFHISSSALPLLLSSALSHSRGSMSNNTMVNMSIEMKYDNDDTTSPDQKLPGLEALEMVKGAASVVAEIEPSSSASSIMGSREHHERMLGPLEVCVHDLVQEQSRQHGQTIAVHSIEKDLTYAELERYADWMAKYLMVKRDIQAGHIIPFCLKKSVWTVVAMLAIMKTGAACAALDPSQPVSRIKRILDDTEAPLVIVHRDYLGLAETLDVPSIVLGPDLWEGTSSGDTD

SEQ ID NO: 33510 - protein, 175 aa, A.fumigatus
PLPVVDATQPAYIAFTSGSTGEPKGIVVPHRSIATSMREHGPATRVDTETRALQFASYTFDMSFQEMFTTLTHGGCVCVPSEAERWNDLAGAMERLGVNWAQLTPTVLGLLHPEQVPSPRDLGPSAGDPITQVNYSNVGGHGVGPDRLGRGQQKASILGRRPLNPLGPPLVLPPG

SEQ ID NO: 33511 - protein, 134 aa, A.fumigatus
YGSTHYFVRSSIDLNMGWRLVGSLLAFFAATSIAWPYDEALVDYNLNTNKQASNPAEYSTDGPGHKYTPSPDNWRFPMYTLFLDRFVNGDPTNDNINGTLFEHDLNSNQMRHGGDVVGLIDTLDYLQGMGIKLR

SEQ ID NO: 33512 - protein, 84 aa, A.fumigatus
ILLLSNFILSVLMIDQTEVAHHYQPPYSYMEYDIVSEDTVYSVAFNNLMHHVNVIRQVFNIQCKGEGGKGKQKQKIPACIRASA

SEQ ID NO: 33513 - protein, 286 aa, A.fumigatus
EPAGKGVSAAWARETATRLRCKVCVGYPEIEVTADEESSAQPQEKYYNSLLVVSEEGEVLVNYRKTFLFFTDETWASEGSADRGFHELVFNNCSAEQGYVLSSRVATSFGICMDINPYKFEAPFTAWEFANRVLDSKSQLVILSMAWTTFMSREELDALADKPDLDTFNYWIQRFWPLVRQKMRHDVDLGADGHDAEGAKEKKIVIVFGNRCGEEGSVRYAGTSAIIAITQRPGLVQEGDTSGEELPFDVKILCWDILGATTEGICFADTTADPKTVFGLVKRSQA

SEQ ID NO: 33514 - protein, 75 aa, A.fumigatus
EWQPLLLYNLGHLPVYLMRHLLLNIGEKDFHIGKTLSTLMCSICWNTSYDIKTVEFYTLIFAYLDLFDVKLSRSR

SEQ ID NO: 33515 - protein, 60 aa, A.fumigatus
TTNMRIYCSRRPIQASMRERFIYADPLSEQINATYRCKTGIHTLLGRTRMAAMMAYLMTN

SEQ ID NO: 33516 - protein, 68 aa, A.fumigatus
  UNSURE (21): Identity of amino acid sequences at the above locations are unknown.
RVGFGHLMHTIMADADWAKLXGDHTTFYIMSDPIVGASDSNITNKRKREGDDSAGPEPQRPEPLFPWK

SEQ ID NO: 33517 - protein, 457 aa, A.fumigatus
RLFTPKPSFLLNPKAYTKLTSPAEIQWMVRALVAVSSGSKFEGTEVAAKIAWAHAFIYAVTAPGLRTNLREEAAHALMGIYLRRSELMGRVVTEALWTWILALRTAEKESAASSAGPASEKLLHLVAKAICPSAANIQSDKIRSDLKRQLVQLLVLCRPELIPNVSWIALCLRTGTDPGDLVREYPDDFMKQLTQAHEVGLLVFIQSRIQQADLAQDPIQSKVPGIDGAIWNAAGDLAFVAPNTMVPRLIRQIRDDLDASRLSRFTPTDAAIARTPEGTMFVDVLNTKSKQPAFDKNTKDYDTLKWEEELRAQLAQKKGQTQKKLSADEQAKVKAQLAKESKIRDEVLQEVKRIERGAGIIQGLASGPAVDADGWINPAVSSLLSLARAGVGLFAGDVVSKAYVKCSEKVSSRLGPLRPFVGVATLRAIGRSHLPPEMEAEPLGGEFSHIISSSGIY

SEQ ID NO: 33518 - protein, 125 aa, A.fumigatus
NALRKSPRAWVLFAPSLVLRHYEQLAGPICRLRWKPSHLVVSFHISLAVQASIDHVTGLVTRILYRLRIASEQRPFDMTSLAYILPLIFMVLTRNGIEEVKGEEEGEQLLLALEFLSFHSGSCEF

SEQ ID NO: 33519 - protein, 546 aa, A.fumigatus
LGLRIANTSCTVTDNRLPRVEVLNHLLTAMQKFTQHYKLIKDTLFDFCRCISSNITNEELTVLLQGTIIPDTSVRTSVLQVIESEIDLTDLDFSEHIWLGCHDQVEENAEIAENIWEENALEVDETSYGKLIPYLSSKDSQLRGAAARALGHAVELNPSVFGDIVQQLQSMYEEEVKPKEPAKDKYGMPLKVDTTDHWECRSGIALAFGAMTNSFEGDQIVSFLRFLIERGPLIDRNSVVRSQMADGGRSVVVSRGQQRVEELMEILETTLETSDKGSKTSDLLNEAVVVLYGSLAQHLKADDPRLQTVIKRLLATLPTPSETVQSAVSGCLPPLIRLCGPKSGEYVQEMLDQLLQTKNYATQRGAAYGLAGIVRGRGIFTLREYQVMSHLKDAIENKKEAHQRLGALLAFELFATILGRTFEPYVIQIVPQLLAGFGDPSIDVRDACLDAAKACFSNLSSYGVKKILPTLLDGLDDTQWRSQKGACDLLGAMAYLDPQQLAASLPDIIPPLTVVLNNTHKEVRNAANRSLQRFGDLHHGGRRIRA

SEQ ID NO: 33520 - protein, 140 aa, A.fumigatus
IRAPPSGVPAPGSRDWRCATDPWPGCNAAGEDDGADAAACDAVQEAGDDRPRIPDTNPRTRGSDRSAANPTWAPYPAPSDPPASGSHPASRRHRSVTPRGSRGRRGRRAAPRTGTCTKDWGGEGTGGARRRRRRRRRPDV

SEQ ID NO: 33521 - protein, 78 aa, A.fumigatus
REQSSQLSDASDFFFFFFFFFPDGTVDIYLNGTVHPAATMATGRQGIVWVSSRTTRIKMTSWKKKVGPHRSSLAGGNE

SEQ ID NO: 33522 - protein, 100 aa, A.fumigatus
LIFSTRSEGCGLGILSARMEPTTQTDPMTVTPKHELENGAAVAANDEEHPSKKQRLESISITEQEVSDGAPKRIKGVAPIKAEYACPCLPSIVTPLIVTK

SEQ ID NO: 33523 - protein, 138 aa, A.fumigatus
NDMMSEIGLSDNHHDSASTCQLSMPDEDQSHSAAPLLPKPEDYETAPADGMKELEMGDIKNPSLSPSPRPGSIFTVDDDEWTPRFKRSHTRARRARRACLLFLLKAVLAVWFSAVLYNVIRYCAKVSLPASMMVNTTD

SEQ ID NO: 33524 - protein, 348 aa, A.fumigatus
LQQSPKTGDLPDTSTNTSDGGSPASTPTSNDRRMKIDSNAGNIHGVYPLYDSLTLTTTTGNITVAIAPQPAHPDHPFEPARLHIRSLSGTVTISFTAPEAAVLPDLELAMELELELHQDGNDSLPHDEIMKTCDLPARPYELDIQTDSGPIAGRMVFSRSARLVSGSGDITAMLIPVIGGVGEDCSREMWRNVSIVTGTGTGAQRVHVTEPYILRSKAGLRSKAGDDAVANYFVAGCHVGGHGSMEVAYPAAWAGNVHVRTEGGSVRLGGEGVEVVESGEGMVDATVGTRRINGDEEDDDDDDDEESDDDEDEDDDDIEEDDNDKRRLGGWMDVSFRSKEGSILFYVG

SEQ ID NO: 33525 - protein, 76 aa, A.fumigatus
QRLCNVTKVPQQRPAFISGHAQHAQCSGLCAFAQTLQAHGHLPPFSLLQNEDVTATFLVADAGPEDMQPSIFLRVR

SEQ ID NO: 33526 - protein, 71 aa, A.fumigatus
VPGKAAFLPWKACIAANMCNCQILEAIGVEYIDEFEVFTPADDVYHVKKHELQGPFVCGCRNLCDAFRRIA

SEQ ID NO: 33527 - protein, 293 aa, A.fumigatus
RHGSKRQLLNNFADWLYQRHGASPPSVVVVNGHTANLSIRSIFATIVTAVLGADIPSKMGSQPLEVLELLQSSLKSRPSQKPITVLINAIDAPLLRRATNQALLARLAATPKIHLLATADTPNFLLMWDISLRDHFNFVFHDCTTFAAFDTEFDVVEEVHNLLGRKGRRIGGKDGVGFVLKSLPENARNLYRLLLTELLCMMDEDHNSDDEMNGHAGRENGVNDEMGIEFRMLYQKAAEEFIASSEMMFRTLLKEFHDHQMITSRMDSGGMEILRVPLSREEMEGLLEDLVLG

SEQ ID NO: 33528 - protein, 109 aa, A.fumigatus
LLQQARIAEEAGAAAVMALERVPADIRAQCGVARMSDPSMIKEIMAAVNIPVMAKARIGHFVECQVRLPFSRGKPALQLTCVIVRSSKPLALNTSTSSKSLPLPMMSTT

SEQ ID NO: 33529 - protein, 74 aa, A.fumigatus
  UNSURE (63): Identity of amino acid sequences at the above locations are unknown.
SPGSGAPDTLLLNCSDDRSSLAGGSALLRPNPSHIAKLAVPAAEINPNVHNVPSGALLGADNXYTSTMEGVNPG

SEQ ID NO: 33530 - protein, 298 aa, A.fumigatus
  UNSURE (12): Identity of amino acid sequences at the above locations are unknown.
TRVYSFHRACIXIVSTEEGTTRDIVDVGVDLGGWYCKLGDMAGIRSEKSTSTGQGTAIIGAVEKEGIRRARARALESDVVVLVISLEEGTNGSPYRLSVDQEVIDAVNDCVQAGKCIVVAINKCDRLPAADRFGQSLHDLRTKIRTLFPAVPEKRIFDISCNEASEETLSEQSDPGNLQRFLRGLISTFEEIASPARMDGDENGQYDLSYWEDSLGVTHRQSSNLQRCMQHLDDFLNETTQAQTLQTPGYADDRNIETEIDVVMAAEHLRFAADTLAKITGKGESGDVEDVLGVVFEK

SEQ ID NO: 33531 - protein, 186 aa, A.fumigatus
TRPFSSHNLTSDSPYFNMDTDSPTETRSTEPSTLLKILHWDKLFESDTPPRLGIEVGKRLPFTALSAFSVGMAIGSSHGSKKAAYRFRAENAHRFPTTSTGWFQYHKTKNYIAIVGGVKEGMKMGFKLSAGALAFCIFEETVDYARHDRRDFLSTVTAGLSFSGIYSLLGIIPFGAVYPYNKITAN

SEQ ID NO: 33532 - protein, 76 aa, A.fumigatus
LTTVEYYIVTKISRSYVIAAVLNRRSDFVRREGRSSAEDNGRRTWETKKYSDKIFCTIHVELGNNKGSWLWLDSVF

SEQ ID NO: 33533 - protein, 279 aa, A.fumigatus
VPEPITSVYLLLKLSLLSTDETVVNGAQIFYKTQFGIDDETSRSRWLLGLVNAAPYLCCAVLGCWLAVPFNAWFGRRGTIFITCCFSAIACLWQGFVNTWWHMFISRFVLGFGIGPKSATVPIYAAETAPPAIRGALVMQWQMWTAFGIMLGYAADLAFFEVPDPPNIVGLNWRIMMASAMFPAILVCLFVFSCPESPRWYMSQNRYYKAYESMCSLRTHKIQAARDLYYMHTLLEAEKGMKLGQNKMIELIAVPRNRRALIASEIVMFLQQVINLPRS

SEQ ID NO: 33534 - protein, 250 aa, A.fumigatus
LCGVNVIAYYSSEIFIKVTSARNALATSFGWGVVNWLFAIPAVYTIDTFGRRNLLLTTFPLMALAWFFTGFSFYIPASEHNNAQLACVALGLYLFGVVYSVGEGPVPFTYSAEAYPLYVRSYGMALATATTWLFNFLLAITWPSLHDSFKDQGAFCWYAAWNLIGFVLVLLFMPETKGKTLEELDQVFSVPTRFHAAYGLRQIPYFFKRYILRQQVKPEILYEREDPVGYSSDFVFNTADWSRTRYVRGH

SEQ ID NO: 33535 - protein, 174 aa, A.fumigatus
ADQDRWEHGRGHHDAPVEPDNVWRVWDLEESKVRCIAQHDAKCSPHLPLHDQCTTNGGRSSFGCVDGNSCRLGADAEAQDEPGDEHMPPSVDEPLPQASDGGETACNEDGPTATKPRVERDCQPATKDGAAQIWCGVHQPQQPARPRGFIVNAELRLVEDLSAIDNRFICRKQT

SEQ ID NO: 33536 - protein, 145 aa, A.fumigatus
MVHIWYIPAQSPTENQPATGQWQPSRLNYKKNNNTNEIENSFYPTATYKEGQREQSDAISSTKPISFSDPGTGNLQWTVTTGVVSLPIRCRTDFVGWTVVFLSGNLSRYLRAISVEVQYRQSSGNSLRSSQNPVIVPVIIMLFIY

SEQ ID NO: 33537 - protein, 70 aa, A.fumigatus
LFSAIQMYSKLVQRCFDNCVNDFTTKSLISREEGCIMRCVDKYMKASSRLNERFQEQNAAMMQGGQLPGR

SEQ ID NO: 33538 - protein, 73 aa, A.fumigatus
  UNSURE (49),(55): Identity of amino acid sequences at the above locations are unknown.
PQAITVLSPERAWSTSLDYEMIRHCADFEQSEQLIYQYIDFMRSFKNRXNQGCSXFYFTSNRRKQSTHGHNPA

SEQ ID NO: 33539 - protein, 81 aa, A.fumigatus
RACSVQHHRIILSYRVHCCAVLCVRHLATRSSGPKGLGLLGGGDYFIAFPLPEDLVRTRYLSIYHLWFSATFYLVETSHTC

SEQ ID NO: 33540 - protein, 111 aa, A.fumigatus
LCIYCACYIHSACNCYVPIPKAALLDAWILSETCSLREANPPCLTTEKPQGIFGVPLNVSIKYANVAISLTNDNGESFIYGYVPIVVAKCGVFLKEKGTNKQPSSPRRSAY

SEQ ID NO: 33541 - protein, 279 aa, A.fumigatus
VHFDVLPILHLQAKVARGKIGTSRLMEAQDFWRVIWEQDVRIVVSLTAEIERGQVKCHRYWESGNYGPFRVNNFSERRIPMKASGSRQNQGQSTTSLSDSSEEPSEPCIIVRHFGLSHSAFPFQPLREVTQLQYPYWPDFGTTSQPSHLLQLVDECNAIIRATSNTCFDTRKAMPTEHRPVLVHCSAGCGRTGTFCTVDSVLDMLKRQHSARKTEPREISERPDTGWIYNDNVDLIAKAVADFRTQRPSMIQNLSQFVLCYESVLEWMVVQMDEGCENP

SEQ ID NO: 33542 - protein, 73 aa, A.fumigatus
DGSDARLMRTIILFPKRQLLAASSNFCHGLFYLNTNQALSHVAQSSTGANPARPSKFDYAFLSTSGIFLSNFV

SEQ ID NO: 33543 - protein, 278 aa, A.fumigatus
RSFDTRKLANTFTSDIDRRSFSRWKQCRYIIVYDAATLDMKDAVPMINMLNKFTAEGWNGEGSILRGGFKVFCNQFNALVQQPESSNPGISSNKPNSMQISLPPFAPIAGGCALPESSSAAIPFFGNIRQHMDLMGGVGQIPLQLPQNLTDSKRRLLPRWLRDASDVEDGGQKVSEKFLELEKKELDRMKQALSYEMTGVFTSAQAPSKKYRVAGIEKGNKNRYNNIYPFDHSRVRLQDVPSGGCDYVNANYMKAEYSNKRYIATQAPVPETFDVSSF

SEQ ID NO: 33544 - protein, 62 aa, A.fumigatus
RYRPLPSFFMKSTSTATGPDNSLIYPFLNILLRYLYRASNSSYNIVNRGLYSSNFLLSSYIL

SEQ ID NO: 33545 - protein, 167 aa, A.fumigatus
TISDSRQEEDFVTQLYNRSLLSQFDVTHFQNLLDEAVSWTEGTADALDQNLRDAITSRLSFRREFLLALAHDADILQNKSTGYFASCLSQLSSLTKSVSLGKPVPDAFSVKIQRRLASTVPPRPMVKISFENALAHLRRLCQDAIDLQELVEYGGPYNFKVFQAFPT

SEQ ID NO: 33546 - protein, 131 aa, A.fumigatus
RIQVAVWTLLSRKPQPSVYIRSLTQTFILSNMTVLGKVSLKGLLYDELSEFVLASSVLLDANMDNTEVPSDPRFQIAQRMDAFVKRFAQVTSCRFFRVVRISDHYIALCRHFSKCVPEPLSHSSDTLPYNY

SEQ ID NO: 33547 - protein, 67 aa, A.fumigatus
EPSDIKDPYIKSQPLGRFGSVRDIADATVYLFSNTGSYVSGQILVGKLSDLLMRIKINSRTLRLTQW

SEQ ID NO: 33548 - protein, 415 aa, A.fumigatus
EPEPILDRNFDSIFIFPARPTLSRFQSNLGYTSIYYCILKTPKQTTMEPLDQLADFEFLLEQVRQVKNDRNVPIQDQAEYFQKTLVHQIESFSEIEKKHLYRYLKLSRDNDELRASYDELNEALSEELRNVERKNAELQEVKTALRETQKDCEAKEEYIRDAEAANAALNEKNNEQRSLIRSYKQDWKAMKAELELRDKTIDDLQTTLRSKGALVDKYEREIEQYRKQRKEWERQVDEAAQYLNDKSEILKWLNEVSRPLKAKPKAPASQVSGSGSSSSEASSSDIRKVSDSVMRSTKDDGADDETQCTTDSQEGKAPSATGSPKDRQPDLQGSAMDCSNEAISEDEMSSIRGATLEEEMMCLSDSLSALSIERGGISSGMLYDRLSRDTISRKHVRFAFSTATAKATKAARKGS

SEQ ID NO: 33549 - protein, 87 aa, A.fumigatus
  UNSURE (76): Identity of amino acid sequences at the above locations are unknown.
PHGYRYNEGTADLCVFSHHHGTKVVATLRDDVGPFAVHSLHTLSRRSVSIVEYCQYDATRSSDKITQLCTLAMYIXNTAAAGRFIET

SEQ ID NO: 33550 - protein, 75 aa, A.fumigatus
GQRSEPGGGPSVWSSAGSSKTMLTPCSMLRLEEVYDVTVVKDGQEAYDTVKANMEEGKVFDVIFMDIQVYATVTM

SEQ ID NO: 33551 - protein, 180 aa, A.fumigatus
EPFVQGNLGMNRKYGGTGLGLSICAQFSRLMNGKITFESEPGKGALFTVEIPLKFVKEAAPSTPSSSAAGSRTPSVFSLDDLPGLARPPSNNGSVRSDPLTNFEKQDLQPRLVGLSQPFFTLTPSSPAPSTPRATPADGAKPEVKDNTSGKVRVLVAEDNVVNQEVVLRYGHPLDLPRQC

SEQ ID NO: 33552 - protein, 61 aa, A.fumigatus
HRQMPNLDGLESTRLIRGMGYSAPIVALSAFSEESNIKDCMDSGMDMFIRYVYRISAKMLY

SEQ ID NO: 33553 - protein, 207 aa, A.fumigatus
CLKCVIVWNINTTLLAEENQFTKSFYSPYLLHRLYSICHIKMSNFNHAPNYNPNSLPTINNGMDESFYTNMDHTMNNAHNLGMHYLAAAPPTNTSHTAIDHPLYTSFNYCMVFSNVPDQPWPSYNLLQQCLDKVRARDAKVYSSIDAILRYDGAKTGDLILSFTAAALTDGVIWTSAEGVILRQMRNWDRDSRMEGWTLVGEFGLAQ

SEQ ID NO: 33554 - protein, 200 aa, A.fumigatus
TGLTAYREVTGARGFQIVKYPWPYTMIEQVDPRQYAANDRNHIGNPTTTDIIGDAHTSDFKTFTKPQTYIDHETSTIIDVSILRVDDDTFVRFYVSGKVSGPVVEVSRNGLFGDWVTPSGTMQDSTHFGGPYPFWDNVQPGKAYLLCDKVGSVTGLSPWVSTDVTSGTFTPASGGNLGALRHGSVLSVTKQQYDALAALG

SEQ ID NO: 33555 - protein, 72 aa, A.fumigatus
RPLHHILLLTEACCKVLALSWKIQRMTIPKDHLLVHYVVLSYQYAHLARRVIFHFWLGSIGRSSSGSRRCGG

SEQ ID NO: 33556 - protein, 404 aa, A.fumigatus
NGGRKTHWRFAPLPRPRGQHQTWHHPGPGRARSPGRTIQDHRARTEKPSCAADGTGWHHRDGSVCRVGTGARHRWSAVAAARVRLYFRAGVCAGDGDGRDWRVSAGPWRHHELPRVSLCVAQHGFRHGLSLLVFAGDPGAVRDCRRVHGHRLLAPRRAHRRLDLHHAGHHCAAQLHARQSLRRDRVLVRRDQDHHADRPALPLLHPLLGRRPQPPAPGLPLLEGPGPHERVSGARRRRPLRRPAAVHRQERHRLHLRPGTDHHLRRRDGVPPPQRPHRRPPLHLPTGLLLHLRRPRHRRHLLLPGQADHLRQRRRLLLALGRGHPQRRHPRARQHRQRRHPHLGLVRRQFVPVHVLPLALLPRRLRQRPQRLQGLQPLGRPLHGRRRLRPLLAPSSPGAKGLRL

SEQ ID NO: 33557 - protein, 448 aa, A.fumigatus
PTSGRQKKSLLNLPSPPGLSSSLVSCRLHFLCKCNTMNQESSNKMAEEKPTGASPPYHDPEANIKHGTIQALVERDLLDERYKITERGLKNRHVQLMALGGTIGTGLFVGSGQALAIGGPLSLLLGYVFISALVYALVTGMAEIGAYLPVHGGTMSYHGFRYVSRSMGFAMGYLYWYSLGILVPYEIVAASMVIDYWHPGVHIAVWISIMLVIIVLLNFMPVKAYGETEFWFAGIKIITLIGLLFLSFILFWGGGPNRQRLGFHYWKDPGPMNEYLAHGAAGRFVGLLQCIVKSAIAFIFAPELIIISGGEMESPRRNVPTAARRYIYRLVFFYIFGALAIGVICSSQAKQIISGNGDASSSPWVVAIHNAGIPVLDSIVNAAILTSAWSAGNSFLYMSSRSLYSLAVSGNAPSVFKACNRWGVPYMAVGVSALYSLRHHPGQKVYDS

SEQ ID NO: 33558 - protein, 143 aa, A.fumigatus
SSSPAARWSPPAATSPPPPAATSTDWSSSTSSAPSPSASSAPPRPSRSSPATATPPPRPGSWPSTTPASPCSTASSTPPSSPRPGPPAIRSCTCPPARSTPSPSPATPPASSRPATAGASPTWPSASPPSTRSVITRGKRSTT

SEQ ID NO: 33559 - protein, 406 aa, A.fumigatus
GVVDLLPRVMTERVEGGDADGHVGDAPAVAGLEDAGGVAGDGEGVERAGGHVQERIAGGPGRGEDGGVDDAVEHGDAGVVDGHDPGRGGGVAVAGDDLLGLGGADDADGEGAEDVEEDQSVDVAAGGGGDVAAGGLHLAAGDDDQFRGEDEGDGALDDALQQADEAAGGAVRQILVHGARVLPVVEAQALAVGAAAPEEDEGEEEQADQRDDLDPGEPELGLAVGFDGHEVEQHNDDQHDGDPDGDVHAGVPVIDDHGRGDNLVRHQDPQRIPVEIAHGETHAARHIAKPVVTHGASMDRQIRANLGHPRHQRIHQRGNKDVPEQQRQRTTDGERLSRPDKQTRPDGATQCHQLHMTVFQSSLGDLVSFVQEIALDQGLDGAMFDVGLGVVVRGRSASGFFFRHFI

SEQ ID NO: 33560 - protein, 527 aa, A.fumigatus
HGGFSDVAEATGMTLAEQEERELQEAVAMSLNQNLGHQEMGITSSNQSNFGKATRDHYDEGAWAMTLFNSSAQEIIISPDPADRRRVADEPAFLRPSQDNLYLGGLLTILHSIPLAREALLLRNKVLPKYGHDPQWWNGQPINLPKIVTMQDAQDGDTAWDDILYETQRLVAFLDATNRAFGSVDALSSLKSMVSYDSESGISQFLEKWQEAAVRADPGNQLATVFSSNAFKCPLSVYDTPIQKEFFILDPFVEPDHGQTLYDVLDRTIWSDRPGEELDDVWLEHVAEVLMIKLDSSDSAKSVDVKIPAVFYPDRYLATCKDLARDFRARRLQVYEEINKLEALMNRFSVSKSVFHRGLGSREILEKAAVAASFTLPKSLANGRGDLALTPEAANAEAQRLAAELRDLSSKIEDKLKGKCTSLVSLYKLTMYIADLQNRRQKAVKTLRNYSKFLTEPSESPTEPPQHRYTLRGVCTEPHITYVLRPVTSHNSEQATDLQPSAGDRWQWWRNNLLYGRSQGPINQYPL

SEQ ID NO: 33561 - protein, 64 aa, A.fumigatus
DHLTGRLYKQYVRSLPCSNPLQTSGLGKISLGRRSLKKFATDFLPKTFYTLNNNNNTKQRFWHH

SEQ ID NO: 33562 - protein, 215 aa, A.fumigatus
VLVFPHCYYSSSVSVIPIQFHCHQSSCTTICRQSSRPFSILPSFCCRSLLELSWFLRRTEVIRCIISVLLSFRTILATSSQLSPICHIHHHIRPHSECLQAAITALWARRTSTQISLPSLGSSLKSKSRYRKPLVTSREFVRSTNWNSCAETNRAAMSANRLLCHALQFSFKSIAYYIRRASLINLTGLAGSSNTTGDDQKKLDVIGNDIFVFRP

SEQ ID NO: 33563 - protein, 62 aa, A.fumigatus
SEMTSLFSAHERAPAKCRILVSEEEEQAIVFDEHPNARYAVVCDPIDGSSNLDAGVLVGTIF

SEQ ID NO: 33564 - protein, 91 aa, A.fumigatus
VSTGTLLVSPSNRGYTLHYIGSALLQNYSSNIISIVSHLPYTSPHPSTFRMSSSGNNGAVGQENINPDIITLTRFLTEEQVKVPEATGDFT

SEQ ID NO: 33565 - protein, 98 aa, A.fumigatus
TRSAVHRCPRVCCGSPLPWLSCLLWSMNDGAQTLIQIYLHSQGKKKRQHGTEAVKSHIVAAKTVANIVKTSLVWSGGSKKIGTASKKYYRVLAVWTRF

SEQ ID NO: 33566 - protein, 140 aa, A.fumigatus
  UNSURE (114): Identity of amino acid sequences at the above locations are unknown.
YHRYQRWRDYPLPGPFFNRFGDHRFGVSLTCDCPQMEITNNVAKLLVELSKSQDEEIGDGTTGVVVLAAAMLEQAAELIDKGIPPIRIADGYDQACEIAVAPLDKIRDEIPFPXGRYGEPTPCCERPFLVAKCLIRLGTP

SEQ ID NO: 33567 - protein, 62 aa, A.fumigatus
VDLCAGTRQVRLTLPVAPVEDLSDDESTGGSIPYNNAEHDKDIAGDVKEEEEDDDENEEEGM

SEQ ID NO: 33568 - protein, 146 aa, A.fumigatus
PVGVLLGLIVFQLAVIGVLALRRAITRSLLLVPLLGATLWFSYFFAQHYEPLMKFIALKSIDRNRPGGGDISPSPSSTFSPPSGLERDALPIQIGGQQLGLRLKKYVNPSLILPLDDAWLPGHSATREYQGAFDAHETRNGNGSAV

SEQ ID NO: 33569 - protein, 203 aa, A.fumigatus
GVSLTAGANMLKRAAPYCTEILRLKPHSLAALLFKGQIALDEERFEDAIRTLNEAREHHPGSQEVQTLMQKAHVLLKRFKHKDYYKVLGVSRDSDERTIKRAYRQLTKQHHPDKAVSQGVSKEEAEKKMAAINEAYEVLSDPELRARYDNGDDPNDPESQRGNPFQGNPFGAAGGQQFFFQQGAPHFKFSGQGFNFPRGFPFR

SEQ ID NO: 33570 - protein, 199 aa, A.fumigatus
  UNSURE (1),(16): Identity of amino acid sequences at the above locations are unknown.
XSKVDRAHYAPSRPYXDSPQPIGHGATISAPHMHGHACEYLVEFIKPGSRVLDIGSGSGYLTHVFANLVTDRSTNDASGQVIGVDHIPELVDLALANMSKSEQGRTLLNSGKVKFITADGRLGWREGAPYDAIHVGAAADKLHPVLIDQLRAPGRLFIPVDVENDDGPLSSLGLGGGQYIWVVDKKEDGSVHKEKIFPG

SEQ ID NO: 33571 - protein, 80 aa, A.fumigatus
GYPRHSASARGSPSMAPYQQYPSDCPPEPFAPAHHPDPPDIASPPHHPQSGRTGHQPATAQRDMHPTAWQLPQSHSPHHP

SEQ ID NO: 33572 - protein, 385 aa, A.fumigatus
LHSQPGKGHHNFPLFVGRLHTTSIIQIPISMPLLFGRFKSRSPCLPRSPVESLTPEPIQHQPLPAYSINDKPELTMGHRHSRVAGSSSTSSSRKTTYRGTQSTPHKGNTYVQTGNVDVWFPPPYTPQASAPAAHTPGWTASFTSSTGDSPYAFLREFDTLFVVDDSSSMLGARWKEAEEALAAIAPICTRYDQDGIDIYFLNHRREATATSTGAYHNITTAADVQEIFNSVQPRGPTPYGKRLLQILTPYLRRVEKMAAATDEDGNLRDPARFVKPLNIIAITDGVFTDDAESVIVEVAKRLDACRAVPWQVGVQFFQIGDDEGARRYLEDLDDELGQMAQEDNLRDIVDTVPWKGSRGQTLSAEGILKCTMGAVHKKYDKRKAF

SEQ ID NO: 33573 - protein, 163 aa, A.fumigatus
QAAQAPHPQERPPTEEPSRHPTRETRTCKPATSTSGFRLHTPLKHQHQPHILPAGQPPSPVAQATRPTPSSASSTHSSSSTTAPVCSGHAGRKPRRPWRPSRPSARGTTKTESTSTSSTTAVRRLPLPRAHTTTSPPRQTCRRSSTACSRAGPRPTGNGCCRS

SEQ ID NO: 33574 - protein, 76 aa, A.fumigatus
IKSYHCPMLSPSSTSPSNFSHLFQSFSPSSRFDARFPSPPPPPANIGLQGCDVVLTAANGSYLIIKVHFKSVDCLP

SEQ ID NO: 33575 - protein, 112 aa, A.fumigatus
PNRNLTSIPKSILPQPNHQSLTINKYIPVSFVEMSTVKITSDVASYLALLRSYLASDDIASARLEDKENQGHSKSGQLPATLQQPQKPRECRPYEQVRVKGSTANKNLSQLR

SEQ ID NO: 33576 - protein, 124 aa, A.fumigatus
ATPDRKRECFLRRCVLEVFESTDSPTMETNMISSASEKENPDKPISAGLYRLEKGTPLVYEYTYDEMKIILEGQFEIADETGQKVTALPGDVFYFPKGAKITFTTQTYGLAFYVSFSFVVVLPF

SEQ ID NO: 33577 - protein, 182 aa, A.fumigatus
PEMPSEPASDLAKRVLILLATVPPGSRTIIVQMFPLIAAGCEAEPGEDRQWVLTRWRAIQSRLMIGSIDRCIEVVQEVWSRRDAIEAEKQRRQERVLSSSSRQSKGGPGLSSQGTREQFMSSPAIPSDLAVSSRPPFVGTRRSSAVSPLENIEFEKTVRGRLHWVSVMQEWGWEGESLSCSV

SEQ ID NO: 33578 - protein, 720 aa, A.fumigatus
EDGQQADGLRSQEAGQLVVPASSSQMNQQPYTAPQNMFQVGQQMGQGGQTNLNGASISPQFLAAQHLQNPQNVQQDRNQQAAQFQPQPQAQTQAQARAQAAQKAQMAISQAGQANPQMQQQLSQSPAMPMLNRPMPPGQMSPRQVAAQVRPPSRAPGMGQQPNGVQGLAGQPGMQSRPQIPPGLPPAAHEQLAQMTPEHLNAFLLNQQRRALANNQALARANAGQQPLPMQQNLSQPGQNQQMVNNQMGNNQNMRASLGLQQQLAGMNNGQMPNQMLAGQQMSAQQRQQQQRQHDLYKLQLLRQQSGSIEMTPDQVKEMDRIQFPPAILANNPNMVSPVPKHIKTWGQLKQWVAANPQALGGVDLQKLMTLQKLHLAQIVAQGKEGAVRNVDQNGQGNWGQMMTFQGQPQQFVNPQAFQAGQQQVPMNMPALRPVTATEIQMARQRLGAQVANYSDDQLREIILRNRQKQLMQMAQSRAAQALAAQNMNQNQQNQTVQQPPLSGPSTNPQAKQGPQQPTPPQNQQNQTVKAQNTAAAKGVKGSAPKQGTKRKSAADEPTEAQAAPVSKTAQPTTTQGGVSAPPSRPNMTITPEQLAAMTPQQRMQLAQMRRQQGQQRLPISRAAAEEAWNNLPEKIRQLYNDIAKNAPAAEPVALSPEQKAAMTQQLRECTDMLGRMDALAQWFSKIPGQEKNVRSLLAMVCPQSTLEPAPPGIYILTQS

SEQ ID NO: 33579 - protein, 341 aa, A.fumigatus
RIQLMRQFKPGPDWTINDQFTIAPEYLSGTINYIRKLFHAMITRVNQQQNQPPGHRPSSVPQGSSTMPQPNQNNMPALNASNLQQLQQQEEALQRARRASSQAASATSAVPQPPFGAPSPQGVPHVYGPGSIPPEKLKIPPSKKRKQSHPGGTPTQGQAPGTPVSKLQAAKQAVPEAKPAGLVLGGPFKCSVIECQYHHLGFATQDALDKHVGESHKVEEPINDPLEFAIESFHTSLVKDEEGAQPQDLTKDLLTTGIVSSSAKHEVKGEPIAPNTTGVGRAPGPLGTKPASPGSTQQTPRTTAAKVPTLSALKPSPSKDGKKETVKPVDQSSAGRLEGYE

SEQ ID NO: 33580 - protein, 95 aa, A.fumigatus
FSRNDCAPAITPSNHALYSDAYFLVHSRAISSYRLGSFLYCSAIRPSTASSGMGSLSNCRANSSTAEIRELGFHSSGRSMPRHILPLSSLVTFGW

SEQ ID NO: 33581 - protein, 105 aa, A.fumigatus
KGKFHVKLVLPTEYPFKPPTVSFATKIYHPNVTNDDKGSMCLGMLRPDEWKPSSRISAVLEFARQLLKEPMPDDAVEGRIAEQYKNDPKRYEEIAREWTRKYASE

SEQ ID NO: 33582 - protein, 73 aa, A.fumigatus
SSHNIPRNSRAVMDIEHIKAADSASVDQSVQDARDLATMGHDQALTRKFDLWSMLALAFCVLGIPLPLPLLTA

SEQ ID NO: 33583 - protein, 411 aa, A.fumigatus
  UNSURE (214): Identity of amino acid sequences at the above locations are unknown.
LRVGTYSTFAQGLSSGLTNGGPITILWGLVLVTVCNLCVAVSLGELTSSMPTALGQAYWVYRLWHTPTGRFVSYLCAWINTFGWWTLTASQIAFMTEFLLGMKVMFDEKWGGAGVGWLQFVIYLGLVLVLTGVNVVGCRREKILPWLNGFVGVWFTGLFVVLSLALLISVGTKADLSVQPGGVVFGAWMNQTGWSDGVVWFTGLVQAAYGLTGXDAVIHMVEEMPAPRINAPRVTYLAVLSGAVTGFGFMVVCLFCMQDVDRIVDSPSGLPFIELMLETVGLKGGAALIALFIFNGVGQGISILTTASRLTWGFARDGGLPWSRYLTVVDPAWKAPVRALWAQGVLIALVGVLYLFANTVLEAILSVSTIALTISYALPIAVLQRVGRDQLPPGPFRLGRWGTAVNWVSIV

SEQ ID NO: 33584 - protein, 150 aa, A.fumigatus
RRRGCTGEATHVTVHTPYSTVTLGAPTDARTTRTSTRTTTTTTEQMFTAISVTKSATATATATATATATGSRSTTTRETETATEGETGSSPHSHLVSVLSTSVAAETTSSTSHRSAATTAAFSPNNNGASAMGVEAPVLAGMVALGAVLL

SEQ ID NO: 33585 - protein, 430 aa, A.fumigatus
  UNSURE (200): Identity of amino acid sequences at the above locations are unknown.
RLYNADPVDCRSPAAETKRTRRQLVPAHTLQYRNGQRVGDGQGDGADAEDRLEDRVGKEVEHPNERNQDPLRPERADRSLPRGIHHCQVPTPGETAVAGKPPGQPGCSRQDTDALADSIEDEQRDQSSAPLEADRLQHQLDKRQSARRVHNPIHILHAKQTDDHEAKPRDSTRQHRQIRHPRRVDPRSRHLLDHMDDRVXASKPIRRLHQPRKPHDPITPTRLVHPGPKDNPPWLNRQVRLGANRNQQRKRQHHKQPGEPHSHKPIQPRQDLLPPTPHHIHPRQNQHQPEINHKLQPADPGPAPLLIKHHLHPQQKLGHKRNLRRRERPPPERVDPRTQVRHEPPRRRMPQPVHPVRLPERRRHATRQFAQRHRNTKVTDRHQDQTPEDRNGTAVGQPAAEALRESRVRSYSQLARPPLCSKKGQWQGNT

SEQ ID NO: 33586 - protein, 177 aa, A.fumigatus
PGLKNKNLDRITRSWENEEGGRFPRTKPELRKPGDFCIPRLRGLSFPERTKSTKKHLAEMCTLQKTSINNQFYPLQKVDNAHEVTEASSKSFVVVHLTYTSGNVESRVLSDLWRQLDMKYGDIKFCEIRGDMCIEGYPERNTPTILVYKDGEIRRQLVTLRELNGPKTKLEGAFTND

SEQ ID NO: 33587 - protein, 249 aa, A.fumigatus
PCGAWIRRSRRRPTSASEQQRRKGQFDSSTKQAQGTEPSCVCDSFVPVKVLGLQYMPALKAYCGIRATDISPIDAFSQRAFRERKERHVRELEEKVSALEQESTTLAADNERLKRELAKFATENEVLRATTGQLASSQGRHLDSEPTITGPMKYTPTDFYTNLVPKGEPAPTHRVTVCEKTGERLLDAGATWDLIQGHELYKQGLVDIGDVSNRLKGMAQCNGQGPAFREGQVLQAIEASAAACRDELI

SEQ ID NO: 33588 - protein, 63 aa, A.fumigatus
SCHHTHQPMLFRSAFNIYIYIYIFIIMITQNHAMLLRSWCQLLGAAKLTVALHLCYSKLFLSL

SEQ ID NO: 33589 - protein, 375 aa, A.fumigatus
LRLRGSFQPRGEDSAGEPVIPAAPPKTEAILTPLQQAMRQKLISSRFRHLNETLYTTPSTKALELFTSNPELFHEYHAGFSRQVKESWPSNPVDGYIAAIRKRGGVSSGSKKGNKPDHKKNAQALPLPRRPNGLCTIADLGCGDAQLARALTPSAQQLNLKLLNFDLHAPQGSLITKADISNLPIADGSVDVAIFCLSLMGTNWVSFVEEAWRVLRSDGKGECWVSEVKSRFGKVVRKKAQIGARKPLSKSEKKKLKKKQAGEDDAGSDVDDADIYAEDARKADDDETDISAFIEVFRTRGFILKPESVDKSNKMFVKMEFVKQGGAPTKGKYASVASAGGPGKKRFIDKATDVGAGMSPEEEARVLKPCVYKTR

SEQ ID NO: 33590 - protein, 107 aa, A.fumigatus
LVLPLNRTNLGLRFRYHAEPSGTFYRYDAKAIGSGSEGAQAELQNEYHRSLTLPEAETLVLKTLKQVMEEKLDAKNVQLASVTKEKGFHIYNDEEMGRAVAQLGGNQ

SEQ ID NO: 33591 - protein, 137 aa, A.fumigatus
VATSEGVILGVEKRVTSTLLEASSVEKIVEIDQHIGCAMSGLQADARSLIEHARVECQNHAFHYAEPLRVESTTQAICDLALRFGETGDDDESVMSRPFGVALLIAGYDEDGPQLYVVHSQHLTVMCSKPPVDWFCR

SEQ ID NO: 33592 - protein, 333 aa, A.fumigatus
SPMDAKNPYTQPTACSPAGGHEQVLPMLGKPAAWDSAIPTTSNTSGGTIFNNYNYPHHHHQQQQPQLVHHPFVAVSSAGTTTVPAVAPSSSSLSHNPDESVAAASRSADSDSKNRQDVGKGALSKLRKTRKTTNASNGRSTLFWVHTDPQSVSEGTREETLKRIRSHVMSEHNRKKRLENTKRYKSKTWKHLAFQPVETTSSNSSSATAASAPAPSSASSSPAFEQNTTTSSPTIPSTQHDQRAEQEHDQGQPQIKEEEGQFELAVTKRNDNVESYGVGAPSQTQSVDPEQSRSSPPWDGLGQGGKDPFNTLHTPLSDRMYRHLQHCKPTRLS

SEQ ID NO: 33593 - protein, 520 aa, A.fumigatus
RRDGSSSIRYEGLADERSYSRTGNRGATSTEPEKKDIQQETMDIKELMKVLPDARCIAVYPVWDFQRGRWFTVCVVWANDPGRVLFEPKDLTYLAAFSNTVMAEVSRLDLEAADRAKSDFISSISHELRSPLHGLLGTMELLQAMVNSYAQKSLIETVYSCGRTLLDTLNHLLDYAKINTLTRPRPSEKAIAQGSDMSQPQSAVPGSLQIENLSVLVQEVVEGLLAGAEYQRRGASGDSDALAKKEDLGLKNHLITIVDIEWQDSWRFSVYAGAWRRVVMNLFGNALKYTQAGYIRLRMRRDTLLVDGKRTPAIRMTFSDSGRGMSKDFLTNHLYSAFLQEDTTSPGLGVGLHLVHQIIKSLKGQIKFASEVGKGTDVDVVLPIELPEVPSPSSPRSFASLKERLSGMTVSLFTRSSKLGDLGFDPRVFDRIRSSLGRMVSGWFGLRVLTPDELDSTKPDFAIVTEHEYRNYYVKGTNEPKPDSGEIQPALPLIVLPARTSSWKTLGESVEDSVIFLTQP

SEQ ID NO: 33594 - protein, 272 aa, A.fumigatus
GLSRSLGHVMDHLLCQRAMREEYREERMVRALGLFVKGKSDLNEWFDSGDARDKKYGGQMGLLNKRLEKRQVARSTREDSQGARDNKDSKDDKDDDAGQYQDNELSEARSKHRRGMHGSPVQRFKQGGEHEADEAGNDDKPDEKPRKKRPTLSPTTSQLQDSLAPTNVRSVVNRAASMIYQALDVEGAMFIDASVYARRQTVGFTKSKLDNPEAYHGQQSPDIAGAEEPAPSISNPESRSDTDASDDDSQSRSLVLGHYTSTTSEAGVNLEQ

SEQ ID NO: 33595 - protein, 71 aa, A.fumigatus
AFFVAIIFITLEICFITLFSIFAFTFFYRGLASPFSFVQVSIAIPNLICRVTINAGRHGHLRIRIWRNTIP

SEQ ID NO: 33596 - protein, 103 aa, A.fumigatus
FALCRKLRQLLIINFAELALIVGAILNALRDIALLTHFETGLVGLISRRRGRLRCSGWLGFRRHRCLCSRRARGEFAADDSFGSLLDVPSGDALGAASRGGRF

SEQ ID NO: 33597 - protein, 155 aa, A.fumigatus
HTQIGRNDEHLDKKIELLSRGFQGKNVTHDHIASNSANIYNPVYEDPGSATDQRVEELELENDQLRSRIAALERELMGRSPTKKPKSKNALEPSHGSNHLGRESDIESALRRMDQLKLADSMFSPATSGNSSPSKKHRKMATRKWDFAPEEDIYV

SEQ ID NO: 33598 - protein, 162 aa, A.fumigatus
QLEQGMRCCWRRHCAHVSMGSGSEAFSFGGSPSMTSGSSASSSISCAFSVSSPLPSPSSRLSSSPSFSSRSRSASSPSSPSSPSPSSTVVSPPPSASFRSASPSPTSSAASPSMLAGTDISESGSGEIRSRRLGKSSLRSAASFDNFSSSISLSSLSSSALS

SEQ ID NO: 33599 - protein, 229 aa, A.fumigatus
PPFQPAEGSQTLMATPLARKVQPPEDKAGWKPYILEVLRRLKHADKSNWHHRMAVRAAHVTYDDTRDTVSAAAAKNELTQQIFTKTMTIQVWRPEFERPGRHFVYTTRYVYFFVSLLDQLNDRANLDQLLRRVRKKQGDFINHTKLWEDVCLTYAKVIRRAGSINEGHEENVFKPIGWEEFVANTARLGESSPASTGQPSSTGTASRRYRTEKAQQQPHESVFARRPHR

SEQ ID NO: 33600 - protein, 371 aa, A.fumigatus
ERSKVTSSTTPSYGRMSALPTQRSFEEQAVSTRDMKRMYSSQLDGKNSSPTQPAWENLPQLAPGSQVLLELLRDAIELKKLNNNLMKVSLLEDLIADLYSRLYEINMPQVLEQANEENKEKMKVDHLLMASDGAADTPTPPNSAPASEAPAPRGRTKGIARRDVQKRAETIVGRKLTPRAPAAKASVPAESEPPATSEPAAPSGNQPNKTSFEMGQQSDIPQSIQDSADDESELSEIDDEKLSKLAAERKLLFPNLRDRISPDPDSEMSVPASIDGDAADEVGDGDADLNEAEGGGETTVEEGEGEDGEEGDEADLERDENDGDEESLEEGEGNGEDTENAQDMEDEAEEPEVIEGDPPKENASEPEPMET

SEQ ID NO: 33601 - protein, 61 aa, A.fumigatus
RLDVVFASKSPSEAFPEIKSKAQYSTIHKTHRNTVASNIQPVYKPGRVGFLLEAPHHCQNP

SEQ ID NO: 33602 - protein, 193 aa, A.fumigatus
CPEAIWVNAHTCPCRFIQILIYSHRRLLLVTTYTIFLLISIGSLMIINSIPDYGAQRLWSAIFYGVHLICIYPILTALGVLGIFCQAREIMVAPFPNALSLQGLALQALIFTLISVTWIPSLPFPYEKLEGRYNWNTFTVWYGAVGFIIVNSFIFALGQAVLLLLALHRSSLSKATIQRGTETEPLLGHPAEM

SEQ ID NO: 33603 - protein, 73 aa, A.fumigatus
PGLTRHQGYKFILLVAADIYWDGLGKSVPVICKTAGKFMWAPVVLFSEVKPEAPLAAIDIFEYGRMKCDWLSV

SEQ ID NO: 33604 - protein, 88 aa, A.fumigatus
EDADRHSLARSVITTTYTSIICAASLYDSRSSPVDLTKLQKGIEVHLYDVQCIRPSRSCSILQFLPLSRHWKEAQRWIRPRSGSAEPR

SEQ ID NO: 33605 - protein, 127 aa, A.fumigatus
HRQVSFALLLLQVKLKTTLGSVSDRSRHGIGRVVEMALAHIGNDTPIHLSFDVDALDPQWAPSTGTPVRGGLTLREGDFICECVHETGNLIAMDLVEVNPSLDEVGASETIRAGCSLVRCALGDTLL

SEQ ID NO: 33606 - protein, 98 aa, A.fumigatus
HPTIFVSPNGVPLRINGLFLRVYRSIPPCIVTKSYLEYTTPHLPPTMAARVQRRRRYRWPELQLNIWIIIVLAGSAICLGIFAWFMAVQSQLRLGTPW

SEQ ID NO: 33607 - protein, 195 aa, A.fumigatus
  UNSURE (36): Identity of amino acid sequences at the above locations are unknown.
CKVGVEAAPLALIEAGLLNQVRDDLGYQLHYDDTVXYYESLTPLSDPDHRGMKKPRAVSVVTETLSKQVYDYAKDGKFVLTLGGDHSIAIGTISGTAKAIRERLGREMAVIWVDAHADINTPEMSPSGNIHGMPMAFLTRLAREDKKDIFGWLQDEHIINKNKLVYIGLRDVDRGEKQLLREHGIKAFSMHDIDR

SEQ ID NO: 33608 - protein, 166 aa, A.fumigatus
  UNSURE (4),(100): Identity of amino acid sequences at the above locations are unknown.
DIVXDLQQEQERPVLVGVLPGMAGNWVLHELGAFCTKPNLAWDAQRVPAETFAQIIDQLQRKRITGATAKQVLAMVFDGDRRPDPQLLEEENLLLRPLSXDEYLALAEAAIGQNPQMVEQIRAKNQLGKLGWFVGQMMRMGEKGRVEAQKADEILRELILGKSDQP

SEQ ID NO: 33609 - protein, 120 aa, A.fumigatus
IDLTLPFRESLSLSFSHLFPAINSVAACTWNRTDSRPEASHLGSNLHRAQSLSYRFSSSRTVSFFRYQALIFALDLNVVIQIKSSPLTFKMTAPSTIKQRFLSKPNELGVVAVGFNGGQV

SEQ ID NO: 33610 - protein, 443 aa, A.fumigatus
ILRGIPAALVQLSVWHRVSHKSSNEKLANVFVSVFTTAMPSIQVGLAVGNGTGPELTVIFERVIQSLAARYNVSVTFLRSPRIYNSYSSLLAINDTDAVTEETLADAAHYRQFCREAVPCGVRAIFRTSISAQALYLVREQLQAIKIEHFTLSPTSSILLVRDQAQGFYSGTNSVNTSKDAVSRTAHFSKAVFTRILSFALVRANQLWGGTNSVTMVYKFHLFDGLFHTWATEWERTFGVRIRFVQGDTMNRDLLAFGVSGHNLLISGNEYADIMQTILLDRSGLGAQESACAENVYLHPDVWGLSEYQTAHGSADDLVGKGIVNPTATIRAAAAVLEDQAGCAGATQRVDDVLGDLGAKGIRTPDQGGTATTEAFVEAFLQGLGQPLDAHNGASSWFSGEANGRGGRGFPERFCHPVQEPIGHGTGGSEHPASGGMGPTGSY

SEQ ID NO: 33611 - protein, 215 aa, A.fumigatus
  UNSURE (175),(192),(203): Identity of amino acid sequences at the above locations are unknown.
QGIRKACRPLVALVCLTMETISSGFHLADGNGYMLDKGYAARCRLNLQFYLWKNSLAFNLHPSIPIPHTHGSPPLRIADLACGTGIWLLDLACELPEPAVLDGLDIDLSKAPPAQWLPNNVTVHNWDILSPVPEHLVGRYDIVHLRLLILVVEHSDPVPIIQNAYRMLKPGGYIXWDDLKLPDTHVQQGNPXANTPAFDRLLXNLSAPMEELDGC

SEQ ID NO: 33612 - protein, 233 aa, A.fumigatus
GTNTLQRPFLHFYSPVFILYELSSPFLNIHWFLDKVNMTGSKLQWYNGMLLLIVFFCCRLIWGTWQSAAVYKDMWYALKKTWSASESAALNPVDITTDVFQIRDGSICVNEACARAQAEISKFSKYTAGGVPTWLVVTYVVSNIVLNGLNYYWFTKMIDAVIKRFRAPAPAGKAKEEELKQDVVIEAATKLEKEEGAFTTGDLASEKIASAVEVGPSEELRQRNPNVPTAARS

SEQ ID NO: 33613 - protein, 195 aa, A.fumigatus
RALTSWSESADLAKTPNWGQYVDMIDPIPPPPRWLRDLVEPWAVYLNIPAVTDHVHEIIAAFAFYQFIHSYLSPWLSPRLFPRHYPNLNNRTQLNWDVHVVSLVQSVLINAVALWVMFTDDERKSMSPAERVYGYSGACAFISALAAGYFIYDLYVSTVYVKIFGIGMLFHAVSALWVFSLGFVSGSLFLSLPAF

SEQ ID NO: 33614 - protein, 174 aa, A.fumigatus
IFGRDQMFFPQIPESIGPHTSPLDPIKLPYTIRVDEDFHKDPTPTVYDIQVAVEDPLRAKMLALTQNPQYTAGLRQIAALDDQLALIVQALTHSRAKHSFYTALSKDPATFLRRWVNSQRRDLETILGEATRGGGEDGSGPEFRRGGAESVWDTQVAREAVRYMLAKPDAAAAR

SEQ ID NO: 33615 - protein, 305 aa, A.fumigatus
AFPSHINVAILETGFSLQILNADLSLRIFLDSTSVSARTTSNPPNGDAATAEWSSAVGHATTGKSGRVIHNLQEEIARLTRECSVYRSRAEETQRMNDAFKMQVQNMTERLRNLEHANETNLQSIRRKDKKIEELRAEVQSEKERRRRAEGETDKFQQLMNEARDEFNRKCAELQEIANHSRTQYDVLAKAGQRERADQQRKLKAIRDDFLALKAEHEKRDVHLERLDTVISQKNREIEIGRERFDQLFEDYEAYKKAHDEEVRALIERNYQGAANIDSALASLKETEEKMKWAIQVKNEIKDAQ

SEQ ID NO: 33616 - protein, 69 aa, A.fumigatus
GRPMSERYILRIINPAEEAPNKQDIRLLGTQSVDKSLRGSWTQRTKIDPLDYFVLCHSVFTTGLEGAAP

SEQ ID NO: 33617 - protein, 94 aa, A.fumigatus
LQLSTLIVLVSSLLSSLSTSSSFSPPFISAPLVSLGSIASGQSNANEVLFTIYRCVVVGDGAVGKTCLLISYTTNKFPSEYVPTVFDNYAVTVM

SEQ ID NO: 33618 - protein, 148 aa, A.fumigatus
PGFACYRIGDEPYTLGLFDTAGQEDYDRLRPLSYPQTDVFLVCFSVTSPASFENVREKWFPEVHHHCPGVPCLIVGTQTDLRDDPAVREKLARQKMQPIRKEDGDRMAKELGAVKYVECSALTQYKLKDVFDEVRIGCDANQISHIGR

SEQ ID NO: 33619 - protein, 74 aa, A.fumigatus
PFLSVAIIYICNSVGCCHIIQNPSSKTDRNKKKTPFILSRHISFIVNRYHRSIISKHFIRLFEENKYHSIVAPY

SEQ ID NO: 33620 - protein, 73 aa, A.fumigatus
SSKWRIWLYCITRKWIARGFYEIDSINKASCTVETFNMDYLSFEGTAIFYISASYSPITSGRSRMGVAPANSP

SEQ ID NO: 33621 - protein, 208 aa, A.fumigatus
RSAKTTAATESLFNKTPGDRTTRMSSRLPDRTGSKRSRSRSPSSMRQPQKYHRKYDERDRHRDGGKWEDGNSRSSQPPVRNMRDQVRLNQLQEDEQVREWVAQEDMFVLKQAKKKAEIRVKEGRAKPIDWLTVTLRVIDPTRNPLDDEIADSELDLVDPDGVFEGLSQSQLLELEKDIDTFLSLEKNSKNRDFWKVSPICVSLSFARD

SEQ ID NO: 33622 - protein, 198 aa, A.fumigatus
SRCASVQTMKVICRDRQKATAPEGRALSSVAADINRLLTPKTYEQLETLEVQVRKKLDSNEPIDTDYWEELLRSLTVWKARAKVKKVHRAVIDERVRGLRKQQYEEAESIRTKLAPLAPVIQTYQERPQQLCEKEIRDLDPEPLLQIRPEDKGLEILDEGAFLNQVVSFPCSYVCGPSLLLTTLEGTRALHQPAGRSR

SEQ ID NO: 33623 - protein, 460 aa, A.fumigatus
VPRPCKARKVKWYVSVSCYFSSAPHHQNSPSDNGFSDEEKPSCLNCRRQNESCDYSIRLNWEGRTRRKSSVSSPSSQSSGHSAHLVSLAVLPSDLAQVDPLESGQGEGSPQELAPHNTIWATACGSSLVAKTSCSRELENGLEILTSSAYSDHLGNSFPYMSYRTPPATSSQMTDSINSRPDTTPQMMATPQETLSPFTSPALHGSGDVAYPDASLNIGSPATLNFPQSSILSSSLSYLRESAKETDPYVRSLVVHPRQTGSRGERNSVASGSHKYFPFDTDDNSRQAGIPFPRHRFSCTHPDTVDKDSLSAVRTETTTKTPGSAPTDTYFTEVMNGPIASEDYIYSLQRDAEGICQRNIYQPSEISSSERKWSAYLTSVTDNYGLDHGRPDLDLNQMDDHSAVDINYALDLIIPERQTRTTFESASADHGLATSVGCGYYASPVPINIPRYLSPLPLAL

SEQ ID NO: 33624 - protein, 81 aa, A.fumigatus
QIPTPEYSYDSMELWTWIDYSSRATASFRGAFSTSSSIPAICTDPCQLAHPGWLLLLLQPLVRHGSFSLADIFLFSFSILV

SEQ ID NO: 33625 - protein, 75 aa, A.fumigatus
LDAVNDLGPQTKFPVPEGILNYNGVNYVAVSLWALESQGALIGGLDLVASTPILSGYRKPAPAPQPGWKPRRGAY

SEQ ID NO: 33626 - protein, 528 aa, A.fumigatus
QTLPRMTSKGEIESLSAYGVARSTIQGTPLSQDELRKMDAYFRASMYLCLGMLYLRENPLLKEPLKVEHLKARLLGHWGSDAGQSFTWIHMNRLIKKYDLDVLFISGPGHGAPGILSQSYLEGVYTEVYPDKTQNEKGMQRFFKQFSFPGGIGSHATPETPGSIHEGGELGYSISHAFGTVFDHPNLITLTIVGDGEAETGPLATSWHSNKFLNPITDGAVLPVLHLNGYKINNPTILARISHEELEMLLRGYGWAPYFVEGSDRESMHQAMAATLEHCVLEIKKIQKQARESNKAFRPLWPMIVLRSPKGWSAPREIDGKYLEGFWRAHQIPITDVQSKPEHLKALENWMKAYKPEEVFDKNGTLIPELKELAPTGSSRMSANPVGNGGLLRRPLDLPDFRQYALTDIEPGVTIRPSMTNMSKYLRDVVARNMTTFRVVGPDETESNKLAEIYKAGKKVWRAEYFKEDEAGGNLDMHDRVMEVLSEHTCEGWLEGYVLSGRHGMLSRYEPFIHVIDSMVNQHCKWLE

SEQ ID NO: 33627 - protein, 288 aa, A.fumigatus
CLTVEWRAKVSSLNILLSATVWRQDHNGFTHQDPGFLDVVANKSPEIVRIYLPPDGNTLLSTMDHCFRSVNYVNVVVADKQEHVQFLNMEEAIEHCTKGVGIWDWASNDQGSEPDVVMVSCGDVSTHEALAATALLREHLPKLKIRFVNVVDLFRLISDTNHPHGMPDRQWGAIFTTDKPIIFNFHSYPWLVHRLTYKRPGQHNLHVRGYKEKGNIDTPFELAVRNQTDRYSLAIDAIDRIPSLGNTASGVREHLINLQLAAKNKAFDDGIDPDYIRNWTWNYPRKKC

SEQ ID NO: 33628 - protein, 241 aa, A.fumigatus
SFDPRGEDGIPLSPDGTLILRFSVWEASISSQPRHSSTGLAHRSTSPKTWPTGSSSPMHSPDRSSFSYTELRQVQVSICLSLHLDRLISGGPAGAWAPTLSYINGKYYLAAMTRWTYDPVARVWPRVMWVSSRDLRTWSDPIWGDPWGIDPSLFQDPVSQKVYLNLMAPNNNKDRIWGIYQCEVDIDSGRCIGEYRSMWNGTLPHNASARPEGPKMFKRDKWYYLLIAEGKYLPISEAADD

SEQ ID NO: 33629 - protein, 309 aa, A.fumigatus
ISTVVAVSESIAPCGMARSRITPVLVLKAQRCLSGTNGTIFSLQRASISLSPKRQTTDNRPGGTDDLHRASIARSLAPEGPWEPAPHNPILFNGAYGYDNLTVQSTGHATIFEAANGDSYVVYLARRKINGSSPLGRETFMSPVTWKDGWPMINGGNPVLLSESFGASHDQKPPPPRFIDTFDQKTLDPSWYTLRTPYAPIYDLKDGGRKKSHGIVFRPNVFGLSDRDTPAAILRKQKSLNMTFSAQLLPTTSGLGYGETVGISAYLSELQHQDIGVSGCVNSTGMCIFTQLMMNGTTEVIGLRDELTR

SEQ ID NO: 33630 - protein, 69 aa, A.fumigatus
RRNPIITGWNPDPSILRVGGEYFLATSSFEYWPSTPIYKSKDLANWELFSHAFTRPEQLQLYGTPTGAG

SEQ ID NO: 33631 - protein, 224 aa, A.fumigatus
LEAYNSYTKADNSVIVATDSIKNTIYILAKQHPVTPPELFGSILGTHFIQKYKHIHAAHAHIITHRWTRMNIDGKPHPHSFVRDSEETRNVQVDVTEGAGIDIKSSITGLTVLKSTGSQFHGFLRDEYTTLKETWDRILSTDVDASWQWKRFSDLGEVRANIPKFDAAWSAAREITLKTFAQDNSASVQATMYKISEQILAIEPFIETVEYSLPNKHYFEVGEY

SEQ ID NO: 33632 - protein, 297 aa, A.fumigatus
PPPMRGLFDHLSYKTILAYVWMLSVATTGIDDRSLGSPKPGSTTFSTTLQEEPTRLDGFRIALLKECFDHAAVDPAVRECVTMAAQRFKALGATVDEVSLPDHLQGPAIWTIQQRIAGSMNLLGHAHGRRGLYLTEMERARLPWTNESYQRAFPATKNVIINGLYLSSRFPDLYGKTMNIGRRLRDLYEAILEQYDVVIMPTTPVVAPRHGKRGLPLESLKPSMGLTINTAIFDVTGQPAMSIPVGFAPARDDANVQLPVGMQIVGGLWQESKVLRVGHAWETHFNWKENCYSECLN

SEQ ID NO: 33633 - protein, 80 aa, A.fumigatus
LTVLLCTPNVLMLSQSSQPTSGPRRSSVGAKTRVCVHCGRNFRRTEHLERHIRTRKDLSEHLQRAFAILSIGNYTVDVSC

SEQ ID NO: 33634 - protein, 162 aa, A.fumigatus
DFPGIGAAVAKAFASAGCERVAITDINESSLEKTRDAISSLHPNIRLVVRAGNMADEQFVEAFMNEVVSTFGRLDYAVNCVGILGDSGRSTETSTEDFDRITNINYRGCWLSSRAELKQMLKQDPLPSHDPSREPQRGSIVNIASQLGIVSRPGARKRSCVP

SEQ ID NO: 33635 - protein, 101 aa, A.fumigatus
NITAAYCASKSAIIGMTRADAIDYSADGIRVNCVCPGVIETPMTTGNEEVHARLQPAVDIAPMKRMGKPEEVADAVLFLCSTFASFVQGHALVVDGGYIIN

SEQ ID NO: 33636 - protein, 63 aa, A.fumigatus
  UNSURE (19),(53): Identity of amino acid sequences at the above locations are unknown.
LACVIATTRIAHRLRDIQXLPYVVVANPHPSLVYELYYKAFERFRVLPEIRIXKNTKDPVTPA

SEQ ID NO: 33637 - protein, 82 aa, A.fumigatus
ILVTEIDYHLKAVYQIPTEAEATRDNSAWTLQRLFYNLQTSESSVSTTELTASFGWELRQIFEQKDVQELFQKSLWKDWKKR

SEQ ID NO: 33638 - protein, 144 aa, A.fumigatus
HWVTGGYSSSLTVIMSIMRRSIWSMPGKKSLRKTGMHASSLLSYCGTSMTHQSTCLMVCTSVALMLPSLRPSDRIVVATHRFNADEGDWGFTRFCELRRLFNMPWEGRGVPLVQNDEAKITAYVRVVKDPTGVLWHSFQKYVLP

SEQ ID NO: 33639 - protein, 64 aa, A.fumigatus
ISQRRTRLTRSSYDSKKETGMVGLKNQGATCYLNSLLQSLYFTNAFRKVRASILRFLLQKLTII

SEQ ID NO: 33640 - protein, 63 aa, A.fumigatus
VKFLMHQQVGSGLNQFFSLRQPSVSISALVAQLVAYPVGCAWAKWVPLGWANPTGVSTSRSMR

SEQ ID NO: 33641 - protein, 64 aa, A.fumigatus
QHLLYPRLILLNTNYDPITVQMHCSSFLYILQPQTSSQKWLLTSVLELESAQVRLSALPASRGR

SEQ ID NO: 33642 - protein, 63 aa, A.fumigatus
QQPKPFATLNSGNSQLLIHSIPFPKTYIIDCIISRVQETSYLWCRQMSCNWSFTYISPSTFSD

SEQ ID NO: 33643 - protein, 77 aa, A.fumigatus
GPSATALHEHTSVLSDYDAQKILPYEADDSPFPEVRAVVQPVDDVSLPVNTVRVWIIGIIFTIVCHTSLATKCRSSF

SEQ ID NO: 33644 - protein, 150 aa, A.fumigatus
SVTNDSSLKSQQKCQQGLTHKMGDCDKNLQMPPVPFSQRPIIILGAGIIGCATARQLLLNGFRVVVVAEFLPGDQNIFYASAWAGATWHAAGGISSEYRYLQAVTHRHLLKMAQEGPESGVCLVDAREYLEEAPSENSSIWGKTVVTNVR

SEQ ID NO: 33645 - protein, 223 aa, A.fumigatus
IMSDVSEETAANEPPAQSSQTRWAFIDASNDSRSNLTRVKRHVMQEYMRQKRGGEPQPDNENGESVKEKEESQPKGRRRPRNKTAGKSTTEKEKKGAGKGWRKKSPDASTDTQRGLESMREDSLGEGSSTGIGERHASAAAGQTKTDIIVSVSSSDLPKFYASGDQSSTSESDSRSPLSSAPTTPYELTLSPKSILSAARTDPFNTLPMDLSSPTGQEGHAIA

SEQ ID NO: 33646 - protein, 157 aa, A.fumigatus
SRQCFVAEGESGHSHVSRFRLYLAQRQSARMHHPYPRTHKYDGPCHGHDPLVHRSCPANNWSRSIRRGPLSPPGLPECARRNQEAENHSSCWRRSRSVVKEARAHDWVRVASQQWLVKRSGYPLSDRRGRSCVHDREVPQDARGRLPRVCRRTMTRL

SEQ ID NO: 33647 - protein, 62 aa, A.fumigatus
ATEYNIIRNKSLLDPVTSLFQNTEISNDDTYSRRSVRRSQNHVPIPHPPLTENSFEKCAKEH

SEQ ID NO: 33648 - protein, 400 aa, A.fumigatus
KHYRRSRLNLNGRKRYTLVGDIRGHVCLHLPFGVLADSRIVIGVSSFADRPEVVGPEHLAELLDHARKIVPADQIKDTPIFLLATAGMRLLPNHERELLLQQICSYASKNYDFLLPDCGVHIQVIPGVTEALYGWIATNYLLGSFDEPKGHDHGKGHHTYGFLDMGGASAQIAFAPNITETEKHANDLTLLRLRNIDGSTQEHRVFVTSWLEFGVHEARRRYLEALQPAAGTAKELPDPCLPNGLRTTIDGKPLRTGDTSELSLLGTGRFDECLRQTYPLLDKDAPCSDEPCLLHGVHVPAIDFDVNHFIGISEYWHTTHEIFEMAHKDKTYDFNTYQQRVQQFCTQDWEAIDQGIQKQSWGKKVDWESASEVCFKASWIINMLHNVFTTGLEGSTAGQS

SEQ ID NO: 33649 - protein, 135 aa, A.fumigatus
IQGPWFGGMFGGFLRGPLPIKEFWSLKGFTFSSGAIDGNGIQVGYQLAEMCAISGYSLVISCVLVYILKFIPGMNLRVDEESEMMGLDQAQLFDEQIGDWSLVHNNSFPVTTPTIIGVSNQSSVSTDETHAGKAM

SEQ ID NO: 33650 - protein, 239 aa, A.fumigatus
  UNSURE (6),(20),(31): Identity of amino acid sequences at the above locations are unknown.
PDTNSXVSESAEPQYDFVGXENILPSQRRLXEITELIHTASLLHDDVIDNAVSRRSSNSANLQFGNKMAVLAGDFLLGRASVALARLRDPEVTELLATVIANLVEGEFMQLKNTVADEKNPVFTDETISYYLQKTYLKTASLISKSCRAAALLGGSAPEVVEAAYSYGRNLGLAFQLVDDLLDYTVSGVELGKPAGADLELGLATAPLLFAWKQNPELGPLVGRKFSQEGDVQRVSGDS

SEQ ID NO: 33651 - protein, 61 aa, A.fumigatus
DRKLTTRQAREIVYNSDGIEQTRALAQEYADKAVAAIADFPDSEAKSGLIQMCEKTMNRRK

SEQ ID NO: 33652 - protein, 470 aa, A.fumigatus
FDFPLLNCSSTIKDCAHLSLYAPPGESSPVAPATLPFNSSLRPRAAKDTVTHPSKMGNPSVPDLDAVGIKAEPELADQFRREVAALLGRNNLNFPGAQPVSFAKRHLLELQREDYYVCEKTDGIRCLMYFARGEEDSPVPEIHYLIDRKNDYRYVPGLHFPQPDDETFQSFHVDTLIDGELVNDTYEDGTQQLKFLVFDCLVLDGQKLMHRTLDKRLAYFKEKVLKPYNALYKKFPEEKKHRAFAVEDKSTQFSYGIEMMFREIIPKVKKIHGNDGLIFTCRSTPYRIGTDEHILKWKPPSENTIDFRLRLEFPVLEPDTDDEADGITEPYPDYDAIPICHLFVMLNANEYQHWGEMYVTESDWEALKALQVPLDDSIVECFKDEQGRWRFHRLRDDKADANHISTVEKVLESIEDRVTEEDLIRAAPAIKAAWKKRQAQAAAEEEDRRRRARQMPPSANGNGVKRKFEE

SEQ ID NO: 33653 - protein, 78 aa, A.fumigatus
  UNSURE (22): Identity of amino acid sequences at the above locations are unknown.
FCLGRGKRPVPGSEGASSNGLXSSSQIQSHISKQKTYMDTLGRTVLTLTVENLSDEARDSQIVVSSSPVLVPWNFLAG

SEQ ID NO: 33654 - protein, 162 aa, A.fumigatus
VRAKLRRAVSVLDPMNVIVPSCSPSNAVELITIESSRSAFTGDARLDANSDGDILPDELVASWTPLAWPEDAPADFSPNFVEVPRVAATAVILFSVSVPVLSEQMVVALPMVSQALSKRTKLLSFNIRVVANASASVTARGNPSGTATTMMVTATMKIWRKA

SEQ ID NO: 33655 - protein, 87 aa, A.fumigatus
LTLSVTATDPPTPHILDRRPEPISAPLINLTMWKMIIGQSIFQLVVTLVLNFAGKSIFKLSSEDDMERLKTTVFNTFVWMQIFNQWK

SEQ ID NO: 33656 - protein, 1000 aa, A.fumigatus
TSALLYNGSPSPTDLRSSASIRSSASSEGRDHESRPTSPHNVSSPTSKLAESMSNSNFLSVPGTRSRGNSLESEDSSQSTSTYGGDTYVGSPSQGARPEHGNKNGTNGKILSDEEALKPDPGREAEFQVEDNKFAFSPGQLNKLLNPKSLGAFHALGGLQGLERGLRTNLRSGMSVDEITLEGTVSFEEVASSGAQNTLPKSDSDPPNQGSPARSNTAPARRHDDAFSDRKRIYGLNKLPEKKPKSILELAWIAYNDKVLILLTIAAVISLALGIYQSVTATDGEARVQWVEGVAIIVAIVIVVVVGAANDWQKERQFVKLNKKKEDRQVKVIRSGKTVEISIHDVLVGDVMHLEPGDLVPVDGVFITGHNVKCDESSATGESDVLRKTPGSDVYQAIERHENLKKLDPFIVSGAKVSEGVGTFLVTAVGVNSTYGKTLMSLQDEGQTTPLQSKLNVLAEYIAKLGLAAGLLLFIVLFIKFLAQLKDMYGADAKGQAFLQIFIVAVTIIVVAVPEGLPLAVTLALAFATTRMLKDNNLVRLLRACETMGNATTICSDKTGTLTENKMTAVAATLGTSTKFGEKSAGASSGQANGVHDATNSSGSMSPSEFASSLASPVKALLLDSIVINSTAFEGEQDGTMTFIGSKTETALLSFARTYLGMGSISEARSNAEIAQMVPFDSGRKCMAVVIRLENGKYRMLVKGASEILLSKSTRIIRDPTKEVSDTSLSEKDRSALENIITHYATQSLRTIGLVYRDFDQWPPRGAPTSEEDRSLAQFDPLFKDMVLFGIFGIQDPLRPGVTESVRQCQKAGVFVRMVTGDNIMTAKAIAQECGIFTPGGIAIEGPKFRQLSNRQMRQIIPRLQVLARSSPDDKKILVTQLRKLGETVAVTGDGTNDSHALKTADVGFSMGITGTEVAKEASDIILMDDNFASIVKAMAWGRTVNDAVKKFLQVNSGSLTDCIGSRANVLSFSSKLRSTLLQSCSHSSRLWLVVTKSRF

SEQ ID NO: 33657 - protein, 600 aa, A.fumigatus
  UNSURE (446),(447),(449),(452): Identity of amino acid sequences at the above locations are unknown.
TNFILMSSYIYRERERDREWDEPRSSSVSIKRYVIPSEEDRERDIVYRREDPVTGDRELVIRRSTEREEPVMVQRYEREVDYDTRPYDYRSERDYYDGAYQCTSVGRVNLTDPIYVARGPLVVHPRESDYEVVHRSEVEREPAYYYHRRVREYDDDRRLRRELSPGDSISQTSRRRDDQDYSSDDSMVYIRKETREYDDHPHHRRHLAEGALVGIGAAELIRNRRKKEGDDVSSGLSRLGHDVGAGALGAVAVSAASRARDYYRSKSRHRSHSYDDERSSRHNHHHHYSHSHSHSRHSRHSRRSRSRSRSRSRSHSHSRAKTLTEIGLGAAAIAGAMALARKKSTSDRRSRSRHRRSSSAVRPGNDAESEKRSQSRIRKHMAEAGLAGAAVAGLVERARSRSRSRKGSRSHSRLRQALPVVAAGLGTAAVTGLYEKNKEKKKKEEXXEXGGXRRERRRSRSRSRAPSEAYSDPAHDPAGLIEYGQHPVTGSIPAAHYYGRPASQQGYYSDASDRVARDAAGFRGRGRSRSRSRGGRYSTSSSDTDRDGHRRRSSRRRKHRSRSRELAEAALAATGVGYAAHKYKQSRDRKKEERERSSEF

SEQ ID NO: 33658 - protein, 141 aa, A.fumigatus
LKKCTNNLLVRETNDRFLLEYDDDSYPSSYPSDLPYPPSPLPPTQPGEHPYYPNSNYFPPPPGSTPAPPAPAAPYNPADYPPPPGAVPPAQPYGYPPEPGPDRYAPRPRRADENVSAAWNSPPSAAQYPMHDGGSRDRFKI

SEQ ID NO: 33659 - protein, 173 aa, A.fumigatus
LVANQQPSGVEKPPSPLRTPRPRTPRDRARAASQPPQPKSVAFDLNAEERPIDPGYETDDSDTTIDSLTPHHHRDRHRSSDTSFAHRRRHSSSDPYFTPRKPQFQPSSSQAKIDRPGHSKDKGTTDLQEPDSDSTIDLPDRFDSHGRLLPERDNDPLVDGLEKLLRGINRVFV

SEQ ID NO: 33660 - protein, 177 aa, A.fumigatus
VGCENESPFESATGCELSRPDRPLRHPPSQLRPYVSESGIGCVSHSRRRFRVGRHWRTGGAGSGFVCRSSTSYEPEPWHRQWQRHQGRSPSASWHESASASGCDYGCDYGCDGCGGCGGYGYGCGCSDDGDCDGSCAHHHRSGSGDGSYCGSSREHVKQHSRQQHPRRRHPRRDRDG

SEQ ID NO: 33661 - protein, 77 aa, A.fumigatus
WRTSTRTELTTGRHPVSDSNQRRKHVVRSDTYKQPGPISVSSLRLQGPAWVSAGGGIYATLFGVYRMLRSMRQLRYI

SEQ ID NO: 33662 - protein, 307 aa, A.fumigatus
  UNSURE (292),(293),(294),(297),(300): Identity of amino acid sequences at the above locations are unknown.
IHLPILKIMPPSDRTFLAFQHNAKLHNLQTIVRGIYPFATLEESNRQLFKQGTDEDYAIITEQTIFHPQGGGQPSDEGTMTSASGGAFTVAAVRMDAVREGQVLHFGRFNQSSVVFSEGDTVEQTIDAEKRLLYSRLHTAGHVLGAAVRHLLEKEVEGFDELKASHFPDAAACEFQGAIDGKWKDSIQAKVNEFIEAKLPVEVDWWDEEEFRRRGLERLLPDRGAVAVAPGEKFRVVNIVGAEVYPCGGTHVETTDLSGSTTVKEDYQERWPVKGHLYRNRLNPSNCRLKFXXXKLXNPXKLLFFDL

SEQ ID NO: 33663 - protein, 119 aa, A.fumigatus
  UNSURE (40): Identity of amino acid sequences at the above locations are unknown.
GAPEWIKLTGVFDGNTTNTTLNDGYLTSGETGSTGYASHXAQYFVKYIQAYKNLGAHVDAITIQNEPLFSSAGYPTMYVYDYESAQLIQNYIGPALASAGLDTEIWAYDHNTGLWLSLN

SEQ ID NO: 33664 - protein, 177 aa, A.fumigatus
QITDVPSYPQTVLNQAGQYVKSVAWHCYAPNVDWTVLSQFHNTNPGVKQYMTECWTPASGAWHQAADFTMGPLQNWASGVAAWTLGTNAQDGPHLSTGGCATCQGLVTINNGGYTLNTAYYMMAQFSKFMPLGAIVLNGSGSYTYFGRRRYPVRGFLESRWEPALWLLKTLLAMMSM

SEQ ID NO: 33665 - protein, 155 aa, A.fumigatus
SSFTVVDPDRSVVSTCVPPQGYTSAPTMLTTRNFSPGATATAPRSGSNRSRPRLRNSSSSHQSTSTGNLASINSFTFAWIESFHFPSIAPWNSHAAASGKCDALSSSNPSTSFSRRCRTAAPRTWPAVCSREYSRRFSASIVCSTVSPSEKTTED

SEQ ID NO: 33666 - protein, 68 aa, A.fumigatus
VEDIDFEFVYALHNFVATVDGQANAAKGDTMVLLDDSNSYWWLVRIVKDGSIGNILRSRFPKTVPDSL

SEQ ID NO: 33667 - protein, 283 aa, A.fumigatus
  UNSURE (231),(232): Identity of amino acid sequences at the above locations are unknown.
QKQLSATMLGDNSEKSKNPLKKAMRRRNAKNVTFTAPTYIEASDIDWSTEDEIDDGDSLIDAGNIIRDGDDLQDDHNDDIVVEPLRPKSNRDKATDESENVEETPQSGSTSPDKQPSSQELFEVASEPTVSRSRNGTVRNTDSFFKDDTVETKKISLTPNLLRDEVSSGGLSSETKEGRSSFDNIDKALGANDKGRDDKKRKDKKPGMLSGLFKRKDKRTKSIEDDSHEPXXVSGRIISNVTHTPGRPLNPGPPPESRPTKGNPAPKAGRLKSPEAKIWPCSP

SEQ ID NO: 33668 - protein, 201 aa, A.fumigatus
IAPRTDARLRMPSRQSAVPNLDLSSFTLQANAKNSSPLTPGAQSSDRASPLTPRSPKSSTSSPFFKGATICPVTQESNSKSSSPTFPLSSAQSAEPTTPGFTAIPPYPPSPRDSPKHSREPSRSFFANLKAPKSAHRAQRSDGSGSSNDKPKSRGSSRDRRTQIASKSYESTPDLPGTIDRAAQEEKSKRLASYNVLRLSF

SEQ ID NO: 33669 - protein, 63 aa, A.fumigatus
SISYCQKLMSLRLSLSNNHLFHIPYRFAECSHLRYLNIRANNFREFPRGVRVIKESVYKLSKS

SEQ ID NO: 33670 - protein, 155 aa, A.fumigatus
VYKLPLLEILDLSRNKISHIPEEIKRLSSLRVLSIMQNRLDDLPFGISEMNKLQILKVAGNPLRYPLRRVLETSETEIAPSTMTDNEKEVAVTAELKRFLKTRQLNEQDRGNESRYCGFSKCAWRLLATSADSFQASVFSILQSLSDASSAAGSQ

SEQ ID NO: 33671 - protein, 105 aa, A.fumigatus
NKFPDMTKSAAYDIAVREFYRLRLQEDIERRVAAEEAEATGATFGPSLLEVGMELENQEYERWKAWAKMEAQLLDQKTAAFTGAPEIAAADDAVEELEEKVPVPV

SEQ ID NO: 33672 - protein, 199 aa, A.fumigatus
PLLPLSLVSIISLLLHHHHHHTPHTTHTMSLSLSRSLHRALLRRSYGTVQAPPSAASLAANRIPPALQEATAATAPRTNWSREEVQQIYETPLSQLTYAAVGRSLISYFSMDTDFCKATVHRRFHDPAAIQMCTLMNIKTGGCSEDCSYCAQSSRYNTGLKATKMSPVDEVLKAARIAKDNGSTRFVLHQPGWKDTSGG

SEQ ID NO: 33673 - protein, 221 aa, A.fumigatus
DAASFLNVHPDVAVNAKLLTGGLVPLCTTLASEEIFQAFSSPEKSDALLHGHSYTAHAVGCTVAVDSLRAMTKMESSGSWDAYRGDWKAVDVSGEDNSPEVWSVWSRDLLRDLSYADSVESVFALGTVLSISLRDAQGGGKFSHEDHFSPDSSRLTCDLVPTTLGYTSTAAKGLQQRLSAGGPQFNVHSRVLGNVLYLMSSITSKPETVRGLEELLRSALL

SEQ ID NO: 33674 - protein, 137 aa, A.fumigatus
GRSLNGRTRISGLTIPRRTSSTASMHSLSEPTRLPVILSPLMTMVQMGVSSTGRPGGMPTQLRVPPTRSMSHAWANAFALPAVTTTACAPSPVMSCTRCTGSTDLKSTNSIAPSPRTKSRLSPASTPITSAPWALAY

SEQ ID NO: 33675 - protein, 93 aa, A.fumigatus
  UNSURE (65),(72): Identity of amino acid sequences at the above locations are unknown.
QLKLSSTQVPDCTMRFLRLLALAPLALAASVPRAKIPTYNAVTVFQPPADYNIPRVLYARTLKLXNGDLLCXWEELLQGPPASVLPHLPVQGP

SEQ ID NO: 33676 - protein, 75 aa, A.fumigatus
RLLQRRCIYMVTMQIPQTQTVALVSELGGKVEFDDNYPVPVPGQNEVLAKVLYTGVCQSGKFTQYQYQNQLEPFS

SEQ ID NO: 33677 - protein, 221 aa, A.fumigatus
LLSPNLEARWNLTITILSLSLVKTRYWRRSSIPVFVRVVSLPSTSTRTNWSHSPEQSDLHTKNGTAAGADGNPITNIKRPHVGGHEGVGRIVAVGPGCGPGLKVGGLVGIRFASRVCRRCEFCLAGTEQYCIRSTNHLHHEDGSFQMYIALDADYLTILPDDIDPQVIGPVLCAGVTAYKVCNPPLVPWSSNRLGRSQRQHQSGELAGRGGCWRWPRTPRG

SEQ ID NO: 33678 - protein, 176 aa, A.fumigatus
DRTFGQTTGQLADIASVQYAKAHGALVIGVDAGDKRDFVLGLGAIEFVDFKSVDPVQRVHDITGLGAHAVVVTAGNAKAFAHACDMLRVGGTLSCVGIPPGRPVLETPICTIVIKGLRITGNLVGSLKECMEAVELVRRGMVKPEIRVRPFRDLPQVYEEMEKGDISGRIVLGVAE

SEQ ID NO: 33679 - protein, 65 aa, A.fumigatus
LTQRYRPLSSFFIKSTSAAGRIDNSLIHPFLSILLRYLYRASSSSYNIVNKGLYSSNFLLSSYIL

SEQ ID NO: 33680 - protein, 60 aa, A.fumigatus
GGFYSGLMRRQDFWPIMFAGFKLWPFVSILNFTVVPADKRLLVGSLFGVIWAVYLSLMSG

SEQ ID NO: 33681 - protein, 146 aa, A.fumigatus
AAAGLARLIITWVFTGGRSARSTVWVVISARPSYTRPVFPSAQETVTSWLVCSTYVAFPVPTTAGRPSSRLTIAACEVRPPWSVTIAAARFMMGTQSGSVVGVTRIDPSTNRSWSRADSMRQTRPATAASPIERPVASTRPLPRPT

SEQ ID NO: 33682 - protein, 372 aa, A.fumigatus
VVARRAPKANHRVILLWFEFRAANEPGVFIGLEVAHAKDGGTGVDGRTKSCESLRQLVHKIVATVVLIPRRQPRNLGFGLCILHPVEVDQCHWVHPDRVTDDKLHARQPDAVRRQPPPAVSSRRVGQVDHHLGLHRRQVRQIHRLGCDLRATLIYQARVPFGAGDRYLLAGVQHVRSIPCAHNRRKTQLATDDRRVRGAAAMVRDDRGRSLHDGHPVRVCGGSHQNRPIYEPVLVTSRFNETDAASHRRFSYRKARGQHPALAAANLIRVETGSRITPARMHRLWPGVHNVQPASDPIFGPFHVHCARIMALNGTGPACKLENLRIAEHESRALSLGRRHVMRWLLRIITVNHLDSLIPPLFADNGPQPGLA

SEQ ID NO: 33683 - protein, 81 aa, A.fumigatus
PGPVRRWVDSGDSHHRPGLGAHHEASGRDRHGPWRPHLARGDRQSRAGSSGGCGHRECYVRAAHQPGGNGLLRRREHGPGI

SEQ ID NO: 33684 - protein, 665 aa, A.fumigatus
LPSYLGEEQRYEGEMATNKQNNDLLVCDFEQIRRHDGAIVGGKNASLGEMINTLEAKGIAVPPGFATTAQAYCVYVDANGIRDKMGALIADWEAGKTTLAETGRAMRRLFLHGSWPEHAATRIRDAYRALATRVGVSEPSVAIRSSATAEDLPDASFAGQLESYLNVTGERAVLDACRRCYASLFTDRAISYRRTKGFDQMNIALSVGVQQMVRSDAGGSGVMFSIDTESGFDQVVLITAAWGLGENVVQGAVNPDEYQIFKPLLGKAGLRPIISKKRGDKAIKMVYSDDPQQPTHNVPTSKAERAAFVLSDSEILQLASWACTIEGHYAGAMDMEWAKDGITGRLYIVHARPETVHSRRGDATSRLHTYQVGRGKGRVLATGLSIGEAAVAGRVCLIESARDQDRFVDGSILVTPTTDPDWVPIMKRAAAIVTDHGGRTSHAAIVSRELGLPAVVGTGNATYVLHTSQEVTVSCAEGNTGLVYEGRAEITTQTVDLADLPPVKTQVMINLANPAAAYRWWRLPADGIGLARMEFVVSNAIRVHPMALVHFDRMQDAEAKAEIARLTTGYEHDRCDYFVDQLAQGFAALCASVYPRPAILRMSDFKTNEYAGLIGGAEFEPQEDNPMIGFRGASRYYSPRYREGFALECRAIKRLREDMGFTNAI

SEQ ID NO: 33685 - protein, 63 aa, A.fumigatus
TSRCPSECSRWCGRTQAGPASCSPSTQKAASIRLCSSLPRGVWAKTLFRARSTRMNTKSSSLC

SEQ ID NO: 33686 - protein, 447 aa, A.fumigatus
EDDALRLVTSDRERLRGHQRSSSRRPDKGGPRRDASLESRHSRAPSRNRQEQDTNLNTTTEQPTNRLMTSDNSQTDASLQERARETEKVQMQARNASAAALSSTALSEQRRKELAAAELEARRLSLARNPSAPNIPFPGELQYSRSPLDSPPFSRSSANQRTPARRRVSTSKASPDYPSSSDSNSSRSGGPLGLPATPKAMRHPKYPNGYEETVSPGSSVPDNVITLSDARYQGEGERIGRSMSVPVPEHHPGPMPVDLPTHPRFNPRLPRSRSTSRSRNIGHRRESSRELGGSGGYPYGSSPVTVSIEETIEDSVSLKEAENPPILPELQHLNTPPPPPPPAPLGPVSPRTSSGTIDIAIDNENLGKLLPRAMTAAPAITTETRPSIERRRTSFDHRRGKSVNESFTNKIRNLTRMRSNSRGLDNWTSSRETGVPYESVQMSDGRM

SEQ ID NO: 33687 - protein, 280 aa, A.fumigatus
YNPTLIYAKAHLIFTEAISCTAFLLLSHFAHTLRLTTRLIDLRIDLAEPYFDVIRYSFSIGSQLTSLKHSFNYPFYTSQSPEHIDSHPKANEMSSPSVRNPVQRNPGTTHKSRKGSGSSAASSRPEITTPKNKKTPRKLQTRTPQPVEEDVDDEKPPTPSPQPTKKKFQPEPVQPEVSPAPEGNRDEPEQQEEDKTALPARPKKKRSKPEAEQRGISSPLPGDVQPQASGSASRGDKATDLTGTAKALGGKVKDTAQDTREEVKEDVPSTPLDLSALKGL

SEQ ID NO: 33688 - protein, 173 aa, A.fumigatus
NIASTIPFIPPSLPSISILTQRPTKCPRQAFVIPSRETLVPPTSLARVRVPALRPQGRRSLPPRTRRLPASCRPERPNPSRKTLTTRSLQLHLLNRRRRSFSPSPCSLRYRLHRKATGTSQSSKRRTRRHSLPGRRRRGPSPRLSSGAFRPPSRVMSSRKHPALQAEAIRPRT

SEQ ID NO: 33689 - protein, 175 aa, A.fumigatus
KGSATDCLGKYQMSFCVDQSRIVLYKRQLASSTYRSFCANIYSSQRSIPFNSFKCTQATITCAYYHPTSWTIDIIMHQARPPLAVSSCSFHWALVPPFASFLSSKTITGGHICNEGNAKRQPQSIGTGRWLEPKGQSVDGQASMENWTSNQVGEEPGNRLKEINYDCISGRKGPA

SEQ ID NO: 33690 - protein, 168 aa, A.fumigatus
LIHVQIIKAQEESDLQLCWTYLALAFNMCQSMGLHRSAALKHDPVPIADAKRHAFWSLYTIDKNLSLNLGLASHFQNHDIDAEFFAPSDNPHYRPWDLMTLTTIDFATLQGRIYDRLYSTSATQATESERLKSIEELSSDLMLVRERLLGVSVSIIDDVLLPTLARSM

SEQ ID NO: 33691 - protein, 410 aa, A.fumigatus
RVVCAPRRRKKSCRSLNSAPSNLTPCGVSSSPKLHLITHICFCSEPKNIDLLVFCKYTLSAVSRPRLQVPNTPHRNLKHSLTDGSVEAQWRQPSQLRRLPRAARASRAADRHRRNQQQSRNRIARLKIRPAPILRVSLRPQRSRLPICKFYGLRCSRKTVKLTSTSSSSNDSLYPKPSYKPPSGFKAAKKQLPPSSTTSSLLSDLRGKQLFHITAPSFLPLSKVKEVSLAKILQGEPILEHEGVQYGIPSENIGHGDLGGKSLLLYDSKTQTYYSAPATTMPTYHVQQLIDLPKSLGTEDAVLAAAQDQIKPPRKQPKHLKMRFRPVGSEEGPPETIGSSSEESEGEGKPNSKFPRESKTEREERKRKHAEEVEGSQSAGLPRKKTKKQTVDTSQSSKKRDEKKRKKEKA

SEQ ID NO: 33692 - protein, 81 aa, A.fumigatus
TTCSDSKQVCTYKEEQAQRPSLASGVTCLYQLFTSSQPHQSWRSHVIEGQYSSNQKQSGITQLAYVIALLIGLYFTLPSHL

SEQ ID NO: 33693 - protein, 143 aa, A.fumigatus
NSVLAPVSAFAARKARQQQARLLEPEKTAQNEPAVEPPSKRARRSPEEGAARQAANENDRVQTRRSARTKAETLSSAELAEKQPQESAAAARAQTAERTPAPEKGDADTFDAAEEEEEEEKEEDILERENGVGVIAVEDDAEG

SEQ ID NO: 33694 - protein, 62 aa, A.fumigatus
YKINFNAHTRVLRIKVMPTRLHDVHQRWATAAMATWALNGLLNQDEVDLLCGSVGSSMYYFC

SEQ ID NO: 33695 - protein, 61 aa, A.fumigatus
LGKLLVSFDLTHMMEAIVNRAISDQKQYAEISTCSTIKSNKSETTIGRKWQAEVRTTPYYS

SEQ ID NO: 33696 - protein, 79 aa, A.fumigatus
PPLWFCRLEYVLLLLGSYGTNKYILAFTGFAGNYRGSSKEPDYSFCPNSSAFPSLVIEAGWAESFPHCLHPGLEGSASV

SEQ ID NO: 33697 - protein, 79 aa, A.fumigatus
PHMVSVPLCLEAQYGWIMVRPDIDNLRTKFFSDYVTGLEGLTSLRTLLCRLLLVKSCEQTTGGLLGVQQMDYIAWPGEE

SEQ ID NO: 33698 - protein, 350 aa, A.fumigatus
FPQGYCFDSGRLESLQSALEAESSLKRRRQSSSGDLNFLRPQKRATDDRRPSSSSTASSSTPQSQLHDESEELKRLLGLDSDDTLRALQEEQRKAEKWLEERKEQERRDEEYARMLMNGMYEPPRPASAHSTASTNYSRSSIQLPSEASLVYRGEAGPSSIPEHRSINTPLVDRLVDRSRSSYSIPSTPESGHSEVQHLPLITLRDSDDSDIAEISPQDFHSGQSRPQSHHRLYPSYNTHPGHSSNRRSVATELGRYVPVTQPSIRLGYSAPQGSVYGPNVLQNTMARLQASRQMLQQAGRSVFEGFSSYFLPSGSSGLPTGLSADDYYASLKGYRYAALRLDITTASLG

SEQ ID NO: 33699 - protein, 180 aa, A.fumigatus
DFTRPLKGPPGESRDKAMQQLQVLVKAVLLRRTKTSKIDGQPILRLPPRVLEKVYAVFSEDEQAIYDALESKTQVQFNKYLKANAVGRNYSNILVLLLRLRQACCHPHLMTDFSVEVNAATDELDLVANAKAFGDEVVVRLKENENLECPICIDAVDNPIIFFPCGLHHGAGRSRATMTA

SEQ ID NO: 33700 - protein, 285 aa, A.fumigatus
YNNCIIRLTIVFRSSDFYEPGVDPKQVQEEIKQLLETIRPDTEIAKEKREGTPEALRYTLLEHQKLGLTWMKTMEESEKKGGILADDMGLGKTIQAIALIVSRPSTDPERKPTLIVAPVSLMQQWKREIQKAVKPGRHQLSVYVLHGDKRVVSYRDMKDYDVVLTTFGTLSSELKHREKYDELQSAGANEEALSRTLLKNLPCLGPSSLWHRVIIDEAQCIKNRNTRSAQACCRLNSTYRWCMSGTPMMNTVEELHSLLKFLRIRPYSSLDRFNKVSVGDHTVFG

SEQ ID NO: 33701 - protein, 106 aa, A.fumigatus
SSISPRLTRRSIPCQLEIPVESRLLFLYKDSIIPGRSVLGAQLNTLRTILTASTAHIPSYRSQTHDLPNHLVFLIGFFFFFAIFPPLLILIETPIFAGLVLVLGSL

SEQ ID NO: 33702 - protein, 192 aa, A.fumigatus
SATAWARPTFKQNCNVDKLINILDQAVSAYDAQDLATKAIPLLHTLVTIYEVAPDGPRKYMQWLLLPEDSDRKQPIGKSDTLSSKLLRLSTTPYQNLKIAISELMFVLSGKDAENLTKNIGYGFAAGLLASRGIEIPQSASEAFATNSNSFDPEINPITGQRWDAEKQDTGPPMSREEKEREAERLFVLFER

SEQ ID NO: 33703 - protein, 135 aa, A.fumigatus
GGTRNGSKHTRMVRMLSCLIFKRRSFFSNVFCVMLRLSYPHHSQISELQIATSQPLGLIMQYTFRTIIALGLAFYTSWSLAFITLAGIPAFSAIVAFLSSRIKPRIEAQQVELNRASKVANNATSLIDTVKCLNG

SEQ ID NO: 33704 - protein, 126 aa, A.fumigatus
YSHRYLQFPGLAVEHLMTYWAILEKVRGSQLRLTKMDDDIYEHFKREFPDFDPAAPIDEDSMKSKEGKEKWRKFIKEYEKKISDYNFGTILRVSPGVEYDQDTTIFGRLLLCANSFGKVRIATNRH

SEQ ID NO: 33705 - protein, 177 aa, A.fumigatus
WSFLTLLISSEITENPGRGRFSISLYKMTFALSISLPSLRRILHWRWSWMSLFSFTTKNHLPTLSLAMALALLASSVTPIFAILLGDIFHSFTSFGGGDISGDDLLRKVKRNGIALSGLGIASWVLNGTYFSLFIVFGELQVSNARTRIFEELLRRDQEWFETHKDGSNAFLSYLQA

SEQ ID NO: 33706 - protein, 106 aa, A.fumigatus
RLNVNAASIVAIQLFYLQWEKKAPDTFQVPLETLPTGFFALIGKNRSSQKSFLLVESRVTVALHELAFLRELLSFLDSTVPSVCGRNRLQRRSWQDHEKADYHDRW

SEQ ID NO: 33707 - protein, 70 aa, A.fumigatus
RTNLPPPSSFVMPAAADTEEEQPMLPLPGAPSSSWAQFCQRFRALFSGADPRVCVAFWLFGESMQTEAFP

SEQ ID NO: 33708 - protein, 260 aa, A.fumigatus
IEAYLDADNYALCLIIIGLINNVLYVVILSAALDLVGPSVPKGVVLLADVIPSFATKLIAPYFIHMVPYPVRIIIFVFLSAAGMLLVALSPPYTDGGTIATKLAGIVLASLSSGGGELSFVGLTHFYGPFSLAAWGSGTGAAGLVGAGAYALATTSLGLSVKATLLASSCLPAVMVVSFFMVLPRSPLQPISAAYAGYRAVEEREELAEEREFMEGDRDATFDEQERLLGASVLSDQSKKAGWQRFKRDLKRVRGLFFPL

SEQ ID NO: 33709 - protein, 79 aa, A.fumigatus
  UNSURE (62),(70),(71): Identity of amino acid sequences at the above locations are unknown.
IFTVVCGFQSFQKKYPDVISEIRGGGLFLGVQLSKSHTTKASDLVTAVPERGLLIITAGEGXLRFVPPPXXTEEQIKSF

SEQ ID NO: 33710 - protein, 173 aa, A.fumigatus
HSNASMLPLLLVYVAEYTINQGVSPTLLFPLDESPFAHFRAFYPAYNAIYQVGVFISRSSTPFFRIHDLYLPSFLQILNLVLLTLQAVFNFIPSVYIIFIIIFWEGLLGGLVYVNTFAEIGDRVPKEDREFSLGATTVSDAAGICIAGFVSMVFEVWLCDWQVTHGRDYCRRI

SEQ ID NO: 33711 - protein, 283 aa, A.fumigatus
  UNSURE (65): Identity of amino acid sequences at the above locations are unknown.
LINTLISFIIILIFAFIHLFSSSPSFLIFSVSRLVNSSSNTDPAHPPPYKSDIIYFSSLITHSSXFYVNLTLLYVYILSRLSSLATMPRFDDADFGVEPAPAGARSPRDARGSASGSLPIPNEAGNTVEIPATRSSISDAAQFMHNLSLSPSMRDRRGSRNSFGTSLPIPRSPRVSRLSSVRKADAASVSRDILASQVQDMSKEKVAAAKNMAFAFDIDGVLAHGNHAIPEAKEALKMLNGDNELGIKIPYILLTNGGGKTEAARCEQLSEILEVPISTDQFI

SEQ ID NO: 33712 - protein, 213 aa, A.fumigatus
ASSCCTVTPPSQKPPNNAPPSPTYPSSHSNTPEHLVSFDQFPIVQFHRSSSTSTTSIAPLPLCKMSAGVTFTLSNGVKIPAVGFGTFASEGAKGETYNAVTCALKTGYRHLDCAWFYQNEDEVGDAIQDFLKENPSVKREDIFICTKVWNHLHRYEDVIWSLENSLKKLKVDYVDLYLVHWPIAAEKETQEKPKIGPDGKVILRPRVFCLNRY

SEQ ID NO: 33713 - protein, 189 aa, A.fumigatus
YVFLEDLTKNPEPTWRAMEKLYEEGKAKAIGVSNWTIEGLEQLLKFAKVKPHVNQIEIHPFLPNEELIQYCFKHDILPEAYSPLGSQNQVPTTGERVSENPTLNEIAKKGGNTLAQVLIAWGLRRGYVVLPKSSNPARIESNFKSIQLSDADYEAVNNVAKGRHFRFVNMKDTFGYDVWPEETAKQMSA

SEQ ID NO: 33714 - protein, 122 aa, A.fumigatus
VRWKLCFHPLLLSSAKLSTHGRFEQFKELTDGDKPVVIDFWATWCGPCKAISPLFEKMSDNPEYGNVGFYKVDVDEQEQVSQEVGIRAMPTFVLFKNGYKIGEAVGAAPPRLEGLLNTARSL

SEQ ID NO: 33715 - protein, 177 aa, A.fumigatus
STNAPDLATAVSHHIRRPASMREVGEMWKNILVGFFPNREYAPFPFRDTHYYINLDLNTHGYLGLGSVVRTQGFNAGVHFLQLNFTAAPADGSPFSWEGNEHFLKREMRGSLQSVPEDRKRAIYGLIAIGTYVRLYRYLPDGQFAPVTFVVGKQTLHVRADQAVIREFLAGVQEEWM

SEQ ID NO: 33716 - protein, 110 aa, A.fumigatus
RHVLLISLQKQLVIMRVTVFSLLTALSASLVCAQGYSKECSDIYLQEGWLVATCPKDDNNGRITSSVYLPNKIANDNAVLEVSSRLPSSPVLLPGLTEIQWAVEYVCRAW

SEQ ID NO: 33717 - protein, 169 aa, A.fumigatus
TTEIPPPALKSDHRTASLRSGHNSAGANSPRPSLSRRSSSSNFATSPTSTANMPSKRPQEQAAPTAASVAADFFQREVDLHQSTDLHSKVVVVVHDACYGHRFSRPRTSKTALSYIVERPERIQACVVGVSAAYVLMAGRHAGKRFAPHPELDLHQLPAPPFQIRKTSR

SEQ ID NO: 33718 - protein, 119 aa, A.fumigatus
PDEIQMGIFLCMRCAALHRKLGTHISKVKSLTMDTWTAEQVDVSKSVQQREEAQADCLWDTEYEITREYPHEQDLQSQEHQTSGPQRYRRGRCQHGAVHPAEIPVSFAGGWKTETTKPS

SEQ ID NO: 33719 - protein, 173 aa, A.fumigatus
VNQFNNVKRHKLIAYGTQNMKSHGNTLMNKIFNPKNIKPPVPKDIDEADASMERYIRQKYQYRSLEDGKPKPPSRHDSSYGMSPEGSPPPLPPKSGRFPGPGLRSASSTSNLQRPSNRPFATSPRSERPDSPPPRSVSTSGSQGFGLSIRDTSDASFESKLAQLREMGFTNER

SEQ ID NO: 33720 - protein, 338 aa, A.fumigatus
  UNSURE (188),(189),(191): Identity of amino acid sequences at the above locations are unknown.
CCLVDIMQVANVVQTTFDEYATPDLTPDRMAAFYRKVGGNYDILFLETKYSALSFIYQRLGCFHSIQPTNDPFKPPSIPALQPNGFVRWQTIQLLLDPDEHARYLQNAVALWDIESPNGGTFPKMIPRDAFPSEPDPEMVEWHEGVSRRFEFDYWRKNVLRSSPPNFRTYHWQFGHKDAPLEPRGGPXXCXPKSTGLHHHSTDDTQSQRIRLRGVAITGGGAASFPHPQLEESNQPIFPVQRRRLNSRLLERHRRPFDPDQPQNRGAANGRTPSSTQQAQSPTVATTPQTPRPKTQDPQSTDNRQDQDDTAVRGTYHLPAPPALDATRTKHTPAYPKK

SEQ ID NO: 33721 - protein, 250 aa, A.fumigatus
ICTTRWEWVGDEGLDTPYSNSMTLEISGYTTIHRDRSRLLLWIPHHQFRFVDMFVRLGGSPTEPVNLQAMYNHSQSRSKGPLESKSILLEHPALVRAMWILRPGRRHIEQTDIALLGMIRRDIVPVLPEDLVGRGVSGPPDAEHLRVRVGTAGSKKGAEDVVEELRVEKVGGIVVGVYVAGLAVEGAPDGEHVGGVAGGVVVGVWGTDGGDAGVGLDVAVGDFEFVEGGEGGGAAVGEEVGLWARPLAVG

SEQ ID NO: 33722 - protein, 188 aa, A.fumigatus
RPVLHPPRRQHAPQPRPNHVHHRHRRSRPLRWRIYPANRGIHRKPQPPLRHRLPPRPSQRPRGLQRLPAQPLRPRHRPQRRRPSPNLQRVDVPTSPPPRQRRRHRLPRPLRTRNHPRPHPNQRRRPRHLFPKHQLQRHLPRRRRAPRLGHPQQQVPQRRPLLRYHRPSPLAAPRRRLRRLFSNPQSQP

SEQ ID NO: 33723 - protein, 399 aa, A.fumigatus
PHGEPLADLPAGCENIFGQAPGGQSVTALLSSSAAKGLFSGAIVQSAPLDLPWFTREVYKEVVTPGVAKAVGCNQTVSEEKLLACLRSVPASAFLDNATEFQSAMTAVNKKVADEFLHVSTMLASIEPLMPMVDDSGSGVIDDQFYTLLADNTLPNRVPTMFTTVTDEAALYVGGFIPQIEASTENLNLLFGIAYPPGLANALAASNAFPLNPSDPDTVRNVGAQALTYSEWTCPQAHLLANGGATAFPALYELEITHGHIQTNAGVPAICSPNTNYNATCHAADVLPVWGTLNSKSRNVDPYYDTTDLLHSQLLDDVFGAFFRTRSPNPDPEMLRVRGPAYAATYEIFGKNGYYIPPYHPEQRNVSLLDMPPTWTQNPHGTNKCRVFEEYGFTFQRAF

SEQ ID NO: 33724 - protein, 72 aa, A.fumigatus
YWSLGGVLHICKYFRCISPRCVFFTLSPYEKFGNKSDGAASHEANQLIGTPSLVMLLNVFMSKLHLTILMQP

SEQ ID NO: 33725 - protein, 337 aa, A.fumigatus
QISWGRVLQEDISEVLLRGAFDQEFQWLRRKNGKCSTLRLGEQAIDFGVQQTMKSKMAAKDQKRLDNASSSDTKIEFEFGGAPGVTLIMIGFPLLMYYMYIGAVLYDGLLPTPEDGQSWADFLSHLVSLAYTHAYPTRKAWTIYWTFLILEGAGYLYLPGVYGKGKRLPHLGGKQLPYYCSAVSSWYLTIAAALILHFTGVFKLYTLIDEFGPLMSVAICSGIFVSIVAYISALVRGVEHRMTGSHVYDFFMGAELNPRLFGWLDFKMYFEVRIPWFILFLLTLGTALKQLEEYGLVAGEVLFLLMAHFLYANACAKGEELIITSWFVCFPREAIEC

SEQ ID NO: 33726 - protein, 140 aa, A.fumigatus
LSDRDMYYEKWGFMLIFWNLAGVPMSYCHCTLYLAYHDPSTYHWNPWVLAVWAVAYLFMYWVWDTCNSQKNYFRAQERGVTVDRKTFPQLPWKYIENPQSIPTKTGDSILCSGWCKSLSPGAGYAADEGSWHGAQGALYM

SEQ ID NO: 33727 - protein, 69 aa, A.fumigatus
QMHRTMASQVQGTAFITGAASGIGKATAHVLAKNGISAVALVDVNRALLEETKSELLSHIHHQVGRTRA

SEQ ID NO: 33728 - protein, 72 aa, A.fumigatus
RLHDFIRADVLFRIGSAGYDRHITIFSDQGRLYQVGMCIFRWHASFLQSAVPALIVGNAANAIIARLNNADY

SEQ ID NO: 33729 - protein, 159 aa, A.fumigatus
KIRICLQGYHSCKYYLNRCEGEELRRGIVSEESRCRSFHPLAGYCSNLIEPSKDKLIDPSSVSHIFRLSPSVGCVMTGSIADARASVDRARGEAAEFRYKYGYEMPCDVLAKRLANINQVYTQRVGLSVVFWVIVKSQTNRTSSGLHASARRCYDSDFR

SEQ ID NO: 33730 - protein, 72 aa, A.fumigatus
HMRKRDKLATDHRPFDIHYSVEWFSINCLVFIRSFDSPAPITLLHTKFIIFRAGANLSLTLSFRLLGFGIRQ

SEQ ID NO: 33731 - protein, 139 aa, A.fumigatus
LSSRRLTEHLQAYMRPLGVAMTLISVDDEKGPQLYKCDPAGYYVGYKATASGPKQQEALNYLEKKLKNKDYAEGSWEEVVELGITALSNVLSVDFKKHELEIGIVGGPRADGREGTDPSFRALTEDEIDERLQAISEKD

SEQ ID NO: 33732 - protein, 777 aa, A.fumigatus
IQTPKLVTSYAVPPQSSFSCRPCSVRRKLAKKSVVKRQTFVAVDRPGREIQAFVEEIGGTGSSAPVISSSSFSVSDSSSPTVFVGIVPIAPMEDDEQDSFDVLTVHQDGLVRRLTSDLKTQRWSVNHTEIAKLRSTHKVNSCFLVDFDDAKKYLFKRRQDLVAMALGDLTDSGVDEPSVLVLVSHPTGSKQIALSDVQVQIFSVPSSAPSEGRILDESQKLRHLQTVTLPNIDELKTFDSSSLQWYFHPGSAGLNLSFEKGFVNIDLSQYAPTVTTRFILEDESFSSLMRTSPQSVIAAGKSIVALFDTQYQSIQRSIAVDSVPSGGSTSRTMFVSYFAKLGVAVAIKGNALFAFDLSSSISSLNSTLKRPRDGLLIDAIGRGIGSPAFQLDASSKKNRTEIMASLGLTSAEQVSKWEEFTQKVEKSAKSNDNAAFDDAVLDYFGVGAPKALPAAQHYVNPEMVLFLLSKIFSLREARSKDKLSATSDSRLTIGIWPEMTCRWLIQLGHFCLSSVEIALRRVQKPHILPPLPTGSFTQAVIDSDRSLHHFIDVLQGSVLLNADELAYALKVLLTMARSHSMVLEEATKSVTYDDENSNHTSKEVTLHNAEASLQDIFIGFNTTLQKIHNQPFPTIVSSFRSALSRSELLSIVHHLRLCLATGGYTSRFTENPPSPFSPEQTTPSLSLDTIINLLNAAVDAIGPSGWITAAGIDDASTRDLDLIADMKSEISAALAGVEEATYLKGILREYLRFANSFTHSSATGKTGDVAKQAASQE

SEQ ID NO: 33733 - protein, 211 aa, A.fumigatus
ALFNPTLRYAYPCTILTPTSPGFLSSQWHNTSRGMFAGSCIGVICLVICLEFLRRVGREYDAFIVRRARLRNQYLSTTASSQGLTRATDADASAEDSPNSTRGVVGAASKGAGRTLCSAFEDKTPVRPTLIEQLVRALLHMLQFAVAYFVMLLAMYFNGYIIICIFIGAFLGSFIFSWEPLNLQKEYVIPLPLPYLPQMICKELGLTCVLV

SEQ ID NO: 33734 - protein, 158 aa, A.fumigatus
ASGSRNRADHQTRFDFYFKSCSAQPATMPPKARINSKNSVEQEGRVLLAVSALKNKEILNIREAARVYNVPYTTLQRRLKGHTFRAELRANGHKMTQNEEDSLIRWILSMDQRGAAPRPSHVREMANILLAQRGSTPTQTVGEKWVYNFINQHDEIKT

SEQ ID NO: 33735 - protein, 106 aa, A.fumigatus
ITIIQHGITLEDIYNFNKTSFAMGLVATTKVVTRAKILSQPFLIQLGNREWVTSIECINSTGWVLPLCIIFKGKVHIKGWYQDTALPADWWIEVSENGWTTDQIRL

SEQ ID NO: 33736 - protein, 174 aa, A.fumigatus
PSSRAAKTALLLDQTQLGPSTVQVTAAHTIDEIAGDHVATAGEAKDENNQDLEQEDKPKSRIVAEYLAHGYVISDNAIQKAIALDKKHGFSSRFTSALANFDQKYHATDRAKGIDESYKITDKAASGWRGLHSYFEKALDTPSGRKLREFYVQTDKQVRDIHNEGRRLANLKSG

SEQ ID NO: 33737 - protein, 245 aa, A.fumigatus
KQTLHRSDTMGLLQVNRLSRELSMLRQQTASVASTTSSTSTTLNDCLDGYHSTPYLISSAHPTASRRHRSSSSLSSSYVPVVQGSRTGNGPAIARSREPSLSFPSARPNDLSKPARALSTTSRQPDQVLPSLAALIQPQPQQQGENVPSNVPGPQNARQRSFSPQQVPPSGNPPRQEILVQRGELEAMKRENEALRRRIRDLELVVKKYREREVASPEEPTNDQETTLRLGKPSISLRDDAKDGP

SEQ ID NO: 33738 - protein, 63 aa, A.fumigatus
LLKHILLYSSRIIDQIKMTERTTVHVSGISSATTDKEVKDFFSFWYETAVHRDLLTSLEILIY

SEQ ID NO: 33739 - protein, 66 aa, A.fumigatus
QPLISLVCSQAYSFCCLIVYYSTPYSSQIITDPTTIQAFFVLSLFSSHLLLFHAYLHCPCLQSWIL

SEQ ID NO: 33740 - protein, 130 aa, A.fumigatus
DPSFLLYIIDKMHLTECGIPHQVNKAFCYSATHLMFQSFVIQLDWEGQAGHFPFIKIEELCCNDNAHYLQAIVIECHDHLYKDAAAQNLGEFTGSYKQFTLHFKQFPSLGCVVLILYKYYHGCHAMEAAD

SEQ ID NO: 33741 - protein, 83 aa, A.fumigatus
YIIRNTLWASGCHMLSDSLSHQTREAHHPAPGFSSNSIQSFEIQTPFLPFLWGIILFLPNVPGAFFRETRGGVPFRISFSCLP

SEQ ID NO: 33742 - protein, 62 aa, A.fumigatus
GIIAGNLISGSRIPLFFFVALIETQSDKGPLVAKPMIAPTIMAKLKNPMVWLLKLYGGAAKA

SEQ ID NO: 33743 - protein, 355 aa, A.fumigatus
YLPRRVRPIETPGNSQNVQVGTEDTLRMNVEFQKTLSNLEDKLNALITSLTTSPTASGAPAAALALLDADDSLTSAIETLRRHQENYARILKLRAEAESLEEKVKGIVRDVVGYEKEIRRICGDDEPSDSDADDVSDDDDLDSGGDRVQTKPGGLRNTKEIDYKLLLDFARRISKYNHQAAADAAANATQAAKGRGRSLQPGDQDMAMTGVNGGPGAEEGAEPVSSVTKEATSWLDESAKMTRQVYMIPYPMEDRIRMGLMGQIQLAAAEGRPGFNPDQEVERLIREAEGLGSTEPVVPASQPMGEERRHANEAAEAAAQAGAASSGTMAAPAPAPKPKATLDLDLYDPDDDEMM

SEQ ID NO: 33744 - protein, 146 aa, A.fumigatus
RPQNWNRFWKMSAICMSTAVSFSQGLGPLALAPMFPQLMKSFDADLASVVKFTGVCMLVLGFSNFFWCVLEILDSDMWLTSRRVPIQAAFGRRPVLIFSTLICLFSNIWRALATSYGSYMGACILNGFGAGPAEVGTLATTQGFVC

SEQ ID NO: 33745 - protein, 249 aa, A.fumigatus
LPQQVGPVIAGPMAEHVGWRSFFWLNTGVLGIVLVALIFLFPETKWHRAHPSEVHDGQEPVETPSSASEPEKPAEVIMQRENIASESGADQDPWLGKGYPSKQQFMLWQPSDNYLKTLWTCFWIPWKLLTFPIVELAAFTVSWSASCMLTLNLTQSQAFAAPPYNFNSQTIGFFNFAIMVGAIIGLATNGPLSDWVSMRATKKNRGIREPEMRLPAMIPYVIIMMIGNFVVAFGYENKWDWKVSFTAFC

SEQ ID NO: 33746 - protein, 104 aa, A.fumigatus
IIVIIGYTCAGIQVSALPAITSTYAVDSYKPVAGLVFVAITVNKNLWGYGFAEFITPWVIKSGFVRPIMMNMSLTTFWCLCAIPVYFYGKRFRKWTAKSSVHSM

SEQ ID NO: 33747 - protein, 658 aa, A.fumigatus
TILTVSTFTSGFGIELRPHVSETFDSWLAALLCWQPIRPKGVQNKMTKPQSVAIGVRRIADRRRNSESTVQKDAAIIKVGKMLLWDRPSTSGPRPNSGHRVSTYRQQRALSSSWQKVSCTLQENGAFKLFTETDITLVTCIQLSQLSRCAVQQLNESVLEDDFCIAIYPQYAAHSASGLTRPVYLALESRVLFEVWFVLLRAFTIPELYGPELPVEENSTNAAGSSDASSPPTRDMFRIERMLSVRVTEAKLQRDRPSEETPRSRKPSRSHSNPVPAPAVSDYYTEVLLDGEIRAKTAVKFRTSNPFWREDFTFNDLPPVLSQVSVLVKTLNPTQKDWTLIAHGSYALHQDANALHALDDVEISSHDATYGRVEIRLDDLESGVETEKWWTILDERDQSVGEMLMRARMEETVVLMSHEYTPMSEILHAFTNGLTINMAQIISSELNQLSEALLNIYQVSGQTVEWISALVEDEIDGVHKDSTANRLRYTTRIHSNDSRESGQDREVLVRDMGRTATVEANLLFRGNSLLTKALDLHMRRLGKEYLEETIGERLREIDESDPECEVDPSRVHRSDDLERNWRTLVSLTTSVWKSIAGSASRCPAELRLIFRHIRACAEDRYGDFLRTVTYSSVSGFLFLRFFCPAILSSPRGWKEPRH

SEQ ID NO: 33748 - protein, 62 aa, A.fumigatus
  UNSURE (60): Identity of amino acid sequences at the above locations are unknown.
AFWYFQGDLQQNKVLSYQSIDTYLSLSIYQTKEKKPSNKKQADESVSIFFQIENDLSNLXIT

SEQ ID NO: 33749 - protein, 227 aa, A.fumigatus
FTLDSERHLGVLSDKVTTLLNVLLEISKSSLDELLLVSVDLANFKDLLNTVGTELDTGGEEVNTLVLVKRALNEGGFDDTLLALSGLQEGLGEASAGHGHGESSGTGTVLGLDDLITTELNAVDERIAGLALNIGVVGLGEQRDDGDSGVATNNGDGLLGGVGLLNLGDEAGGTDDIEGGDTEETLRVVDTLGLEHLGDNGDGRVYLVVTLALLIRYNCLGYVRGLR

SEQ ID NO: 33750 - protein, 138 aa, A.fumigatus
QELFFTNLFLSLTNNNLTVPLIGFLPRLFYAFSGEPKQLTKCTRTEFPPASPVRSIAGKNVVTIHLNDSVDTSACHLVAPGERNHLGQKPARRVATRAGDWPISSGLEKLDYMLPFALSIRSYPISVVSTVSGFQQRG

SEQ ID NO: 33751 - protein, 178 aa, A.fumigatus
ASKVAVLGAAGGIGQPLYILLKLNPRVSELALYDIRGGPGTSPDIRNLRFQSFKAQYMLTRDLLTGVAADLSHINTNSTVTGYDPTPSGLRDALKGSEIVLIPAGVPRKPGMTRDGMCIGLFNDARTITDAAMQISSTPMPLLFVTSPRLLLRHPPRPTSWLSQTPYVSQTIISDQQR

SEQ ID NO: 33752 - protein, 201 aa, A.fumigatus
RHNKVNSTVPIVAEVFKSKGVYNPKRLFGVTTLDVVRASRFISQIKKTDPAKEAVPVVGGHSGVTIVPLLSQSNHPDIEGETRDTLVNRIQFGGDEVVKAKDGAGSATLSMAMAGARFAESLLKAAQGEKGVIEPTFVESPLYKDQGVDFFASRVELGPNGVEKILEVGKVNAYEEKLIQAALTDLKKNIQKGRDFVAQNP

SEQ ID NO: 33753 - protein, 154 aa, A.fumigatus
GDEAAAAGGGGGGVDRAGAGGGGRGAEDAGGGGGGGAAGLEGAGGGGGGAGEGGFLDVNGGGGSFAEPGKGGGARGGGASGAVLIDVEDETVEEGLEAGLGGGLRRLATSGLSGGADGDSVEDGGGGGGGRAPGGFGAEATGGGGGREASESDR

SEQ ID NO: 33754 - protein, 406 aa, A.fumigatus
PRELSHLAMKGLNLSGQKTFRSQALVCQFCQLPTRPIARQAPFARYYSFSTTTASRAQSRQLRPKKDSRNSWITNRLTPGRLASTSSNTSSSFDPETSLRQVSYESSELLKLDSVPSNESVVKLLQRCEQIAEALVSREQDKVEKSPSAREEGSAISSLLDLEEKNASKKHFRSIRDAQPRLAESLSQIVTGLLKDEKVFISPEAMACYTKIHTLLKMADHFPEMFYLYAHKPVPEENSSPVKYHKANPKSVNSAIPTELANMALDIAIEQRNLPLVLAIIDNTFCAPAFHRAKLFKKAAVPLGGLAATPAACYVIASWASSLQTTMDPSTATGIAFAATLAYVGGTSSIGLLAITSANDQMERVVWQPGVPLRHRWLREEERAALDRVAVAWGFKDIYMRGEEEG

SEQ ID NO: 33755 - protein, 85 aa, A.fumigatus
LFTLLYPTCIFIFTDGTVYVLYAADVYPRIDEDWNMCSMPAHTTEFPKKKNYVPVVDITFPIYGIYNPTSERLKTPVTKLIAQRI

SEQ ID NO: 33756 - protein, 91 aa, A.fumigatus
SYGGLNPSSLYFIPTHLNPDWIVFILSITAPRTKMRPPPPRPPPLGGMGGPPPPPPPSGSLPSRPAKGEVKDRVSWKPVFLSSQVPLLMSW

SEQ ID NO: 33757 - protein, 416 aa, A.fumigatus
SALLSDITKGTKLKKTVTNDRSAPMIAGGGVKSAAPPVASAPPVPGMPKPSGLAPPVPSANRLRSSSESGGGGDSSTSHAPQLAGLFAGGMPKLRSRGGVDTGANRDSPYLSDSEASRPPPPPVASAPKPPGARPPPPPPPSSTESPSAPPLNPLVANLRKPPPRPASRPSSTVSSSTSIKTAPDAPPPRAPPPLPGSAKLPPPPLTSRKPPSPAPPPPPPAPSSPAAPPPPPPPASSAPRPPPPAPARSTPPPPPPAAAASSPHTNGVAAASIAVQAARNALGHSNHAPSVPPPPPPAASAPSAPPPPPPPSAPPTAPAVHPSHPPPPPAQTPTPPPSQPVTRSTLDPSAYTLTNGGLSPGHQNMGSHQIIRVEDNRFKFQSEGLLPKPRPFVGGPPAIPCWVFTTRLEGPQLAI

SEQ ID NO: 33758 - protein, 64 aa, A.fumigatus
GKKLLHSGHKVRLVKYHPSHTDKLTQAVPLLSLLLAPHVDILEPPSDGNPIQCGALLLSQPTMS

SEQ ID NO: 33759 - protein, 90 aa, A.fumigatus
LGAAGKFPTPVSHSEDMANKVTEIKSTIKFQLKKVLCLGVAVGNVGMTKEELVANVMLAINYLVSLLKKGWQNVGSLVLKATMSPPKRLY

SEQ ID NO: 33760 - protein, 105 aa, A.fumigatus
NCSGCSTSTCTSSFAWFGETATSPVDVEEAALASSSTSTPCSFESSCTTTSSSAGIFSTTTASSRTGTIDPSSSTSGSGSFVTSYKWGSGSFYRGASCQERSRAQ

SEQ ID NO: 33761 - protein, 74 aa, A.fumigatus
LIQAPEEEEKFLHYLRRKSHQVPWLEEFIYSLSFVPDIVEFQALLICLAYNITTGIKRLHAIVEHVSHPRSRWI

SEQ ID NO: 33762 - protein, 252 aa, A.fumigatus
TSLCPYQALIWLDTTSNWKEGATSFLTSPLRTGSWMISSVPVIQHRAGLALRQPHKLRERAAEEADTDGPKPSERMVQSACLLHLDYGLDLDKALAAGNSFYALHEILVFAAFSENQFLNMLETKLLNELDPTFLVHQKNPTLSNLLYHQRILDRHIQRIKDNLAAFKGNGSLGWPRSALEPGKQRIVDDVAETLIGDYQYLLSRSLTLSGQCSRGMQVVMNNAMIKESRDAMSQAEGVVKLTRLAFIFVRL

SEQ ID NO: 33763 - protein, 152 aa, A.fumigatus
  UNSURE (95): Identity of amino acid sequences at the above locations are unknown.
LIYEAQLDLPTAITSLATVFQLGPTETPNSTWLQNQIQAWLHIDDIFQPEFLSGIIVVTEDNGIQPNLSAFIESLPKEWKPDWWIFFNKEVGGQXHPGPRMVSYGKIHTVYRIYDDVNGAFMVAIQPPITPGYVNGTQKEPQWRLRLQRITF

SEQ ID NO: 33764 - protein, 60 aa, A.fumigatus
LGVLDLFQVIQENAPDAIKAGDIKNHFGRKVAIVCSLFLPNLLASPETHLKVAVILTSHG

SEQ ID NO: 33765 - protein, 74 aa, A.fumigatus
LTSCRSMSIYSFLIAVRSEGQQLMSESGETTSHLMGMFYRTLRMVDNGIKPLYVFDGAPPKLKSSPRVTINLYV

SEQ ID NO: 33766 - protein, 100 aa, A.fumigatus
RSSSRDQRQSDHLLKSAISAYATFTLGDSYPAGMVTMIVIYSCHVLTHLSAYDWFIGRGSLTLFFRDISAHRSRSLQNKSARQGSDRSECAHSPDRQLVA

SEQ ID NO: 33767 - protein, 222 aa, A.fumigatus
PESIDINILPAPVEHACNIINEELCGFVLRDPFTLVLDLWIAIQLVWVTMLCAVQLVQISRNQTTYENMRGHSIDRSYPSSRAFASAITAGTTSLEAAGLSATGQGPNPALARGHSHRGRRHGCLQQWSSLLGIDTFFATARDGLRDGPRADRPKNPFSRGIITNCRDFWCDPAPYFGKREPGTAMLGGEIVNYNQMYEVPMRMYSDGRYQSVAHDDPEQHV

SEQ ID NO: 33768 - protein, 323 aa, A.fumigatus
RNMSARQRRPAESYENTSNSSQPAAIASAVLEKPPKVMKKLVHWDDLPHWQRDNHHIHTGYRPASFSFLVSFQSLTYLHNETVNIYTHLLPSLLSIPAAYLLYQELVPRYGTATRDDIIAFSCFFAGAAFCLGMSATYHTISNHSPLVARIGNTLDYIGIIGLIVGSFVPSIYYGFYCVPALQRLYWTMICAIGLGCIIVSILPKFRTPQWRPFRAAMFVGMGLSAVFPVLHGLQMFGFDQMTRQIGLGWLLLQGFLYILGATIYAARVPERLRPGKFDILGSSHQIFHVLVVCAAVAHLTGLLKAFDYRHSGVAGSCLLEVN

SEQ ID NO: 33769 - protein, 223 aa, A.fumigatus
PVILGSQCSLTRREIDTPWIQNQEKMFWRGSTTGGFSRAGGWRRQHRQIFVGNINSLDNVKVLAKTTDGQWQTKEVNRADYRDLFDVKFTFIGQCDPSDCDAQKEFFEVVDAVGQQDAWAYKYLVDIDGNAFSGRYYAFLHSHSLVCKVAIFREWHDEWIKPWVHYVPLTLAGDESVETMRYFVTEDEGKSTAAKIAGKGRDWALKALRNDDMEVWFFRLLLE

SEQ ID NO: 33770 - protein, 159 aa, A.fumigatus
SVSCTVAAAVSQYAVSTSRPPPPPPLQANGRDPRFGYPLAFLDRQKLLQILAAGPVQSGRVKLGHQVVNIESTPDGVTVRTSHGHVYQGDLVVGADGVHSRVRAEMWRLATASQGEIFRSEYNSSYPPHCGFVVCFFPPPLSFFLLWAMHLKTNAPFGS

SEQ ID NO: 33771 - protein, 95 aa, A.fumigatus
FGCEGGARLIASVVLQVLAVHPDYQGRGIGTRLLMVGVEEVRRLGLPAWLEASEAGYSVYRRCGFHDAERMELDFGKYGLSGMEQVYCMLMDDEH

SEQ ID NO: 33772 - protein, 165 aa, A.fumigatus
KHPTSSSHDPSFLRNIISMLQSKITLHPAVQADALPLAKLHNAAFANDALLEAMYGPLTQNDPPFANDLRQIIADDPHSRITKAIDTESGQIVAWSWWSIYPDAEAHASAAEVARERWTTPPPTSLCPRLYLDFQDMKARMREKWIGGRAAASKLASLLQCLIWV
